United States Patent 9,719,064 (GENOMICS OF ACTINOPLANES UTAHENSIS) - sequence listing, part 4

SEQ ID NO: 8085 - protein, 267 aa, Actinoplanes utahensis
MPHPTTCEPRSPPTAPPSTRSTRRCPLPARTPKYQVIADDLTTKIKDGELPAGSALPPQKELSARYGVTLATLRQALKQLEDEGLLSQEPGRGTFVYPRIKYQLTSLHGFAEDLRDQGQTVTTEILDQSIGTPPDWAALIGQDEALRLERVRLVGGRPAVHQLSWVRGTELVSADLSDLSLYAALIAKGRLVHRATEVVRPGLLAEPAAGLLRRPPGEPVLVSERVTYALDGSALVVDRATMLGSAMEIRTERAATGLSVQWSRPSA

SEQ ID NO: 8086 - protein, 404 aa, Actinoplanes utahensis
MSAPTQMLETAHIETARPHPAAAMEAPTATGRFGEFGGRYVPESLVPACAALAAAFREAWADPSFHERLARLRSEYAGRPTALTPAANLSAELGVTLLLKREDLAHTGSHKINNVLGQAVLAQRMGKTRLIAETGAGQHGVATATAAALFGMRATVYMGERDIDRQRLNVFRMELLGAEVIPVTSGSRTLKDATNEAMRAWVAAVDEAHFCLGSVAGPHPYPWLVRELQRVIGEEARAQTPVVPDVVVACVGGGSNAAGTFAGFVDTPARLVGVEAAGGAAMTNGTPGVVHGYRSLILQDPAGQVLEAESIAAGLDYPGVGPEHAHLGTTGRAEYRTVTDDEVLAAVRRLARSEGIICALESAHAVAWVLRAAGTPDLPAGSTVLLTLSGRGDKDMATLAGEVR

SEQ ID NO: 8087 - protein, 391 aa, Actinoplanes utahensis
MSVWKSRPALRWLLPGATAVVVIGGGAAAGTIVANAGPSLPDRSAAQLLVDLQGANPAGLSGTVVESTDLGLPGVAGLASKFGASAGGTGGLTSLIAGSNTARVWYAGEDKVRFALLGTQGETDVIRNGSDVWQWSSSDNTGKHLKLPKDAGKGSPRSLPSALPSTPQQAADAALAAIDPSTKVETTGAAKVAGRDAYELVLSPRDTESLVGQVRLAIDAEQHVPLRVEVYAKGAAKPAVRVAFDSISFSVPDAEQFTFNPPPNAKIDEAGTPSDAAKAGAAKGDAAKKGLPHPVPSVSSQKDGPKVIGKGWTSIVSAKLPGGTLSELTKAGKGTGEDAQQAQALLSVLPEVSGSWGKGRLLSGSLFSVLVTDDGRVLAGLVTPEALYKVA

SEQ ID NO: 8088 - protein, 225 aa, Actinoplanes utahensis
MRLLVVEDEERLAAALRRGLQAEGFAVDVAHDGQDGLEMARHGGYDAMILDVMLPRLSGYRVVRQLRAERHWLPVLMLSAKDGEYDQADGLDCGADDYLTKPFSYVVLLARLRALLRRGTQARPVVLTCGDVELDPAEKRVLVTGTEVTLTTREFALLEYLIRRPGEVVSKTELLDHVWDAALETAPNAVEVYIGYLRRKIGRDRLETVRGSGYRLVAASGALTE

SEQ ID NO: 8089 - protein, 467 aa, Actinoplanes utahensis
MRRRLRELSLRARLLLISVAALGFGLAAGGVVLVTVLTFAQGRAVHSQAMDTARGVASLVDQGQLPSRIEVSPETKVQVIDESGRVRSVSATADRLVPFLYEDELRDLPDGEGRSIPGERIGFEGEARVVKLTAGPATQPLRILVARSTSELTQSVHLLRVTLLVAFPLLVALLAAGLWRALGAALRPVDALRAGAEEITGGTRAGRLPVPDSHDEVGRLAITLNDMLHRLDTARARQRAFVADAAHELRSPLTNMRTELEVAQRLPDDTDWAAFTDDLLVDVQRLSRLVDDLLLLARADDGVGRAAVARRLEEVDLGQLVDEVASRYPGVEVVASDEPLPMVAEPDGLARVVANLIDNACRHKRDRVTVRTAASGTDLLVVVTDDGPGIPAEDRERVFHRFTRLDDARARDAGGSGLGLAIVRELVRRHGGSVTLGDAEPGLRVEVRLPADKQQTPVSASTPASPK

SEQ ID NO: 8090 - protein, 245 aa, Actinoplanes utahensis
MSLLKRSAVVAAAAGLLTLALAGPAAAHVTVNPNTATAGGYTKVAFRVPNESDSASTTKLEVNLPADQPIASVSVKPLPGWTATAVKTKLATPIKSHDTEITEAVSKITWTAAKGSEIQPGQFQEFDVSMGALPQSGQLVFKALQTYSDGTVVRWIDEPTADGSEPDSPAPVLKIVPAAAASASPAAAAAAAPAKADDSGDSGSGTGWGLAGLVAGLVALVLAGLAYAKASRKPETAGTGKAAAS

SEQ ID NO: 8091 - protein, 247 aa, Actinoplanes utahensis
MTVRIWQGMAGKSRLWHGLLAFIVLASLITQIVLTATDSAPHAGPAVHETVVTRFVRLFSYFTIQSNLLVLIATLALLRDPNRDGRVWRVIRLDALLGIVITGIVYSTILAGQVALHGAAYLANLGFHYIAPWAALLGWLLFGPRPRIDARTMAWAALWPTLWIGYTLAHGAATDWYPYPFADVNSLGYPRVLANLAAVVLVAAVLAALLRLLDTRLPYRVAAAPEAAAPVLPLPRSGTEPVAHRDR

SEQ ID NO: 8092 - protein, 152 aa, Actinoplanes utahensis
MSRAHLERQTRPEVDGRRHPGRMTTRLLQILLGVHLFGALPSLLCAVLRTGDYVALFAPSLARLGDPKDSIPFPSVEAAPWWCPLYAWFVTAHFLVGFLLFFPLPLVGWSVAMSARDRGPSVHARAWVWAWGAVTVLTFSPWGFALHYWMAD

SEQ ID NO: 8093 - protein, 531 aa, Actinoplanes utahensis
MGCIEAHRSGSDSAPRRIPAPDGGPPALRRCPAAGVGADKEITVANESPRRRSLPVRALLAGTVAAVGAFTALMVTPDANAAAGTLGAAAAQSGRYFGTAIAAGRLGDATYTTIAGREFTMVTPENEMKPDATEPQRGQFTFSSGDQIYNWATQRGMKVRGHTLAWHSQQPGWMQSLNGSGLRQAMIDHINGVMAHYKGKLAYWDVVNEAYNEDGSRRQSNLQGTGNDWIEVAFRTARAADPSVKLCYNDYNIENWSYAKTQGVYNMIRDFKSRGVPIDCVGLQTHFTGGSSLPGNFPTTLSSFAALGVDVALTEVDVTNASTSQYAGLTQACVNVPRCVGITVWGVRDSDSWRSSESPLLFDGGGTKKAAYTSVLNALNAAGPVTSSPTPGGGSGSPSSSPSTPPAGTGRIVGAQSGRCIDVPNASQNNGTRVQLYDCNGQTNQAWTLTSGKQLTVYGNRCLDAAGSGNGAAVQIYSCNGQANQQWNVNANGTITGVQSGRCLDVWGTGNGQQVQIYDCSGQANQRFTLS

SEQ ID NO: 8094 - protein, 223 aa, Actinoplanes utahensis
MADTAIFDVDGTLVDTNYQHALAWYRSFRRYEITLPIWRIHRAIGMGGDQLVKAVAGDDVERRHGDALREVWSEEFDRLIDEVRPFEGARELIEEVKSRGFRLVLASSGKKQHVEHFLDLVGGRPFADAWTTADDVENSKPEPDLVATALHRVDGVSGVMIGDSTWDCVAARKLEVPTIAVRTGGFSVQELHDAGAVRVFDSLVDLRESLDDTPLGSPAPADP

SEQ ID NO: 8095 - protein, 100 aa, Actinoplanes utahensis
MSTSISAWRTGLTANLTITDTGSAAVDGWALGFTLAAGQTISSGWNATYSPASGSVTARNAGYHAAIPVNGSVTIGFQAGHTGNTAAPTGFTLNGNACGE

SEQ ID NO: 8096 - protein, 452 aa, Actinoplanes utahensis
MSLLRRTRSLLLASAAAGVVVAASVAVIGTAEAATTLGASAAQTGRYFGAAIAAGRLGDTTYTGILTREFNAVTPENEMKWDATEPSQGRFTFTNGDRILNQGLTNGSRVRGHALLWHNQQPGWAQALSGSALRSAAINHVTQVATHYKGKIYAWDVVNEAFADGGSGARRDSNLQRTGNDWIEAAFRAARAADPGAKLCYNDYNTDGINAKSTGVYTMVRDFKSRGVPIDCVGFQSHLGTGIPGDYQANLQRFADLGVDVQITELDVAQGGNQANVYASVTRACMAVSRCAGITVWGIRDTDSWRSGENPLLFDGSGNKKAAYTSVLNALNAGGTTTSPSAPSPSTSVSTPPQPSGACSASVSLNSWNGGFVATIRVTAGSAPITGWNVGVALPAGSAVTSTWSATAGGSTGTVSFRNASYNGQLAAGGTTEFGFQGTGTGPTATPTCAAA

SEQ ID NO: 8097 - protein, 548 aa, Actinoplanes utahensis
MPRSSLPGRRRWFRTAILAVLCVAGVIALPGSAAQALDNGVARTPPMGWNSWNTFGCNISESLIRQMADAVVSSGMRDLGYQYVVVDDCWFNPNRDSAGNLQGDPTRFPSGMKALGDYLHAKGLKFGLYEVPLDKTCAQYFNSYPGATGSQGHEAQDARQFAAWGVDYLKYDWCSPTGTINDQVTTFAKMRDALAATGRPIVYSINPNSVHAKTGPQRNWGDVANMWRTTEDISAAWDTGQTNGYPMGVKNIVDVTVPLAGYARPGQFNDPDMMEVGRSGLTDTEQRSHFALWTMLAAPLIAGNDLRSMSTATQTILKNPRLIAIDQDSLGLQATQVSNDGTRRVLAKKLSNGDVAVALYNQGGATTTVSTTAAAIGKSGGSLTLQDAWTGGTTTSTGAISASVPAHGTVVYRVSGGGTGTPPAGATLVSASSGRCLDVPNSATANGTQPAVWDCNGGANQQWTAGGATLQSLGKCLDAPTGATAGSKVQLWDCNGGTNQQWTLNADGTIRGTASGLCLDVDHNLTANGTPVLLWTCTAAVNQRWSRG

SEQ ID NO: 8098 - protein, 454 aa, Actinoplanes utahensis
MPKRSWAAALLILASLAVPSAAHADNPIVQTVYTADPAPMVYNGRVYLYTGHDEDNSTYYTMKDWRLFSSADMVNWTDHGSPMSLATFSWAGANAWAGQVVPRNGKFYWYVPVTDRATGRMAIGVGVANSPTGPFTDALGHPLAENGEIDPTVFIDDSGQAYLYWGNPNLWYVRLNPDMISYTGGIQQIPLTTAGFGTRTGSTNRPTLYEEGPWVYKRNGTYYNVFAAKCCSEFIGYSTAPGPTGPWTYRGTVMPTQGGSFTNHPGVIDFNGNSYFFYHNGALPGGGGYTRSVAVERFSYHADGSIPTITMTTGGAPQVGTLNPYVRQEAETIAWSSGVETEATSGGRNVGYLENGDYIKVKGVAFGTGATSFSARVASATSGGRLELRLGSATGAVVGTCTVPGTGGWQTWTTVTCPVSGATGTPDLYLRFTGGSGYLFNVDWWQFAGAGSAR

SEQ ID NO: 8099 - protein, 765 aa, Actinoplanes utahensis
MTPFPISRRGLLQAAGAGAVAAGLGPISRADAAAVAPARADLGVSAFPFDLGQVRLTTGRFLDNQTRTLNYLRFVDADRLLYNFRANHGRSTGGAAANGGWDAPDFPFRTHVQGHFLTAWAQAWAALGDTTCRDRANYMVAELAKCQAANGYLSGFPESDFTALEAGTLSNGNVPYYCVHKTLAGLLDVWRLIGGTQARDVLLRLAGWVDTRTARLTTSQMQAMLGTEFGGMNEVLADIYQQTGDGRWLATAQRFDHAAVFTPLAAGADQLNGLHANTQVPKWVGAVREYKATGTTRYRDIGLNAWNITTGAHTYAIGGNSQAEHFRAPNAIAGYLTNDTCEHCNSYNMLKLTRELWLTDPDRAAYFDFYERALLNHLIGAQNPADSHGHITYFTPLRPGGRRGVGPAWGGGTWSTDYASFWCCQGTGVETNTKLMESIYFFSGTTLTVNLFTPSVLSWAERGITVTQATAYPVSDTTTLTVSGTPSGTWSIRVRIPGWTTGATLAVNGVAQGVGATPGGYATVTRAWAAGDVLTVRLPMRVIMQPAADNPAVQAITYGPVVLCGNYGGTTLSAHPSLNVSSIARTGSGSLAFTATANGATVSLGPFPDAQGFDYAVYWNTGSGGEAAYQVVNVASGLVLGVQDMSTADGGRVIVWGDTGTADHRWVQVPDGGAVRFRNVNSGKVLGVQNMATTDNAPVLQWADNGTADHRWTLVANADGSYRIRNVNSGRVLAVSGGASTWGSQVVQTSDTGGTGNNWRLVRVA

SEQ ID NO: 8100 - protein, 463 aa, Actinoplanes utahensis
MKRTRPISAYAAAAGVGLLASTAAVMTVPAHAAAAGCSVTYAVSSQWDGGFGANVSVTNLGDPLTGWTVTWTYGAGQTVTQAWNATVTQSGSAVTAKNVAYNGSVATGGTVSFGFNGSWTGSNPAPAGFAVNGVACTGSPGSPSPSSPSPSSPSPSPSTPGGTCTLPSTYRWSSTGALAQPKSGWVALKDFTNVVYNGKHLVYASDVAGSGYGSMAFTPFTDWSDMAAAGQNGMSQGTVAPTLFYFAPKNIWVLAYQWGPTAFSYKTSTDPTNANGWSAPQTLFTGSITGSGTGVIDQTLIGDGQNMYLFFAGDNGRIYRASMPIANFPGSFGSSYTTVLSDSTNNLFEAVQVYRVQGQNQYLMIVEAIGSRGRYFRSFTASSLGGSWTPQAASESNPFAGAANSGATWTNDISHGDLVRNNPDQTMTVDPCHLQLLYQGKNPGAGGTYDQLPWRPGLLTLQR

SEQ ID NO: 8101 - protein, 283 aa, Actinoplanes utahensis
MAATRTDAAGLVRAAQAGNRAARDELVGAYLPVVYTIVRQALDTDPDVDDVAQDIMLRVLRQLRSLRSPDSFRSWLVAIALRQVSTHQHRRARDAARAVPIDEAAGVPDVGAEFEGVTGLRADLSAQRRQVRRAGRWLDPDDRSLLSLWLLEASGHLTRAELADALGVTVVHAGVRVQRMRAQLEVSRAIVAALDAEPRCPRLGAELAGWPGTPGPRWRKRLARHVRGCPVCTRAAGDLVPAERLLPGLLLLPVPAALTATVLAKSVGAGAVLSVAAGKALAS

SEQ ID NO: 8102 - protein, 209 aa, Actinoplanes utahensis
MTAGTLIVGATAGAVSVTAPEVPRPATIARTPQPATIAAPAPVTARATTGATRGTTPRPAGTGTLRAGPVSLEAANATGRYITAAGSYGMLIGTGRGGPAATRQPATFRAVAGLNDQRCFSFRAADGRYLRHASWRLRLNADDGTALFRGDATFCPGAGQAAGSITLESSNYPGWFLRHRGDELWVDQFDGSAAFRADGSFLVRPGLAG

SEQ ID NO: 8103 - protein, 806 aa, Actinoplanes utahensis
MNARSRPRRLRTLLPVLLTATVAAGAALFFAGTSDAASTLGASATARNRYFGAAIAASKLGDATYAGILKREFTAVTPENEMKWDATEPSRGSFTFTAGDRIVTQAQANGQRVRGHTLAWHSQMPGWAQALSGSTLRSAMLNHVTQVATHYRGKIYAWDVVNEAFADDGRGTRRDSSLQRTGNDWIEAAFKAARTADPSARLCYNDYNTDGINAKSTAVYAMVKDFKARGVPIDCVGFQSHLTGAMPADYQANLQRFADLGVDVQITELDIAGSGQADAYAAVTRACLAVARCAGITVWGIRDSDSWRTGTNPLLFDAGGAKKAAYTAVLNALNAGGGSTGSTIAPATAIDTSAWYVLVNRNSGKALDVYNLATTDGARIAQFTRNDQTQQQWQFVDSGGGFYRLKSKLSGKVLDVSGKSTADGGAIVQWADNKGANQQFSVQSGNGFIQLINRNSGKAVEVQGAATTDGANVVQYTDGNGTNQQWQLVPVGGGSTPTTSPASGSCALPSSYRWTSTGALATPKSGRVALKDFTTVPYNGRHLVYATTHDTGSSWGSMSFSPFTDWTDMASATQNSMNFAAVAPTLFYFAPKSIWVLAYQWGGSAFSYRTSSDPSNPNGWSAAKTLFSGSITGSGTGPIDQTLIGDGTNMYLFFAGDNGKIYRASMPIGTFPGSFGTSSAVVMSDSTSNLFEAVQVYKVQGQSRYLMIVEAVGSGGRYFRSFTATSLGGSWTPQAATEANPFAGKANSGATWTNDISHGELVRATADQTMTVDPCHLQLLYQGRSPSSGGDYGLLPYRPGVLTLQR

SEQ ID NO: 8104 - protein, 243 aa, Actinoplanes utahensis
MPESPRSDRRPILALAAATLTVLVGYSAVATFLLRTERSPQAMPAPQPPPVWTMPSAQPPVSVAPAPSTRPVLDPVSRHSPAAPVPPPRPSRTTAGRRTAPPRLLAGTTLGLGFAGFPEYRIRRWDTAVIVAAVTAASSSHDRRDARFTVRAGRADPRCVSFESAGEPGRFLRHREFLLRLEPADGSSLFDQDATFCPERTGGGFALRSVNYPQRHLMLAADGIRLEPSATRQATVFEACPAL

SEQ ID NO: 8105 - protein, 63 aa, Actinoplanes utahensis
MVSDARHRHTEAVRTLAAERDAARSDIDRLLLVITAQRETLRQHINQRLDELADGRPRLAPRG

SEQ ID NO: 8106 - protein, 89 aa, Actinoplanes utahensis
MCRSIHQLHNFEPPATTDEVQAAALQYVRKIAGTTRPSQANQAVFDEAVAAITAATQALLDGLVTTAAPRDREVEAAKARARAERRYAS

SEQ ID NO: 8107 - protein, 129 aa, Actinoplanes utahensis
MGAYWYESSIDRQLREATERGEFDNLPGAGKPLAGHGEEYDEDWWVKDWLRREGATAGVVPPTLALRRAAEDLTTVVDRLHTEREVREHVADLNTRIDKARRGHLDGPPVILPPFDADAVVRAWRIRRP

SEQ ID NO: 8108 - protein, 959 aa, Actinoplanes utahensis
MRVRLAATLSLCLLLGTAVALHRSGRAAPAADPHAGHILPTAVPVAVTTALPLPHTGWKVTADSGQTSAAKAIDGAAGTAWLSGTTALPHRLAIDTGNRVAVSGLTYLPRASTATGRIGRYRVQTSDNGTTWAAPVATGTFADDATLKTVTFGTVITRYVRLVAVTEAGNRGRQVAAAEVDLLGGTDPALPRTGWTATADSQETAAANGAAANALDGDTRSIWHTAYSVAPAAPLPHTFTVDMRVTNLVSGLSYLPRQDGGRNGLIGRYRIETSMDGTTWGPAAATGAFIDSQDAQTVTFAPALARFVRITALSEAGNRGPWSSAAEINLLGRPDPTLARTGWTVTADSEETAAENGRAVNVLDGDPATIWHSAWSATPVPGLPHSVTVDLHHAVPVGGLSYLPRPASPNGRIGRYRIATSSDATTWTDRVTDGVFADNPARQTVIFPPATARYVRLTAVTEAGTRGPWSSAAELDLLGPAGSVAPKRGVWSAPVGFPLVPVAAAQLPNGRILTWSAFKADTFSGGGGLTLTATYDPATGVVTQRSVSETGHDMFCPGIATLPDGRIVVTGGNNSEKTSIYDPATDAWTAGPAMTTPRGYQASATLGDGRVFTVGGSWSGGAGGVNGGRHKAGEVFSPATGWTALPGADAAPMLTADSNPNGDYRKDNHAWLFAWSGGRVLQAGPSRAMNWYTTAGTGGVSPAGVRGDDGDAMNGNAVMYDTGKILTVGGAPNYENNDATANAYVLTIAGSTVTTRKIAPMANARAFHNSVVLPDGKVAVFGGQNYPVPFSDNTAVLQAELFDPVTETFSPLSPAAMPRTYHSVALLMPDGRVFTGGGGLCGAGCATNHFDAEIFTPPYLVGVKSRPVITSAPTTAANGSKITVTTDKSIKSFALVRMGTATHSVDTDQRRLSLPQVAVSGGYQLTIPADPGVAVPGYWMMFAVDAKGVPSIARTIRVF

SEQ ID NO: 8109 - protein, 510 aa, Actinoplanes utahensis
MATDDFWSKFRRWRRARPFWSGLLLLLSGLELLYSSNLSLGNLQIHIGPQGFLSYLLPILMLICGALVMFSPAQRMFYGIVGLLTALYSFIGLNLGGWFIGMLLGIVGGALALSWSPAPHRPATALQGPLDFAGPSQGEPVPAEGTDTRHLEVAGHDDRPHEQPVVSDPSILPGLAPEPEGEDPRGSLPGPRRGLNRKALAIITLPILVGATMLIGSRLPASADDCPAGLPSIKTSASPSKTGGKKTPATIPARPAGKTPTKTATTTTPAPATSTSAAAASNDSNPIVDGIHSVVDGVGNLLGIGGNESPAPSASPSASASKAAEPAATGTTAPGAAPAKTTAPAPARTTSKPAADSDVIPCLGARQENVVADGSVPRSAIKPGVMKVDSLTMYNSTYKGVADVPTANGTIKALQFDMDKAVNKPFSLTIDEPGDAVTTIKSAELTTTGNVHFYTPKMTGNLFGLIPVTFTPEQPPPLTLPILWFTNVTIDLAFVSCNTLTGQPLQITES

SEQ ID NO: 8110 - protein, 212 aa, Actinoplanes utahensis
MEDSQSAPATGRTNWRRFAVAVGVPTAVAAGLVVALQTGALAANFVISGTQFKLSADTLEGNGFTQYSDALVDGSGKPRAAAMSGISSATITNLCQSVSQKTPLGTITLQIKAATGVKASDDDSKKVQASNLLIGMSELSGDATFTNIEIGRDAGNLNRAGDAKGAVGGFGQQAEHVTINSLKQQAYSTSASTFKLTGMSLKLLTGDGNECY

SEQ ID NO: 8111 - protein, 642 aa, Actinoplanes utahensis
MRGVRLQRRLNLGFAALLGLFTAFLVVQFGTGGRLRDDHDRRSARIAAAREANQHALQRMTDAETGVRGYQLTGERLFLEPYENGRGAALAALGTAAEQTRDPQVRELVEAERQAAYDWLAQYAASVIDRQSRATRTDPALGKHLFDRVRALNAAADDAIAAEQHAENAAGRRRSRILGAGSAALVLAVLAAGYLLVRVSRRQLLVPLARLGDTIRRQAAGDRSARAELLGAAELRTVIEALNDLSAQTEELLAAEQARTARAWLCQAVVAELQQEGADPAQVGHRVVARIGGALGADAVHGNLFVPGTGQIAVRWPPEAPDPAPDAVTGIRDMPAGQPAIRAGGLAVTIGGDPDCPGGWVLVVREFLPQFTAPEHRLLASVAGEIERALRQLGIRVHQELLIGQLRMLDQRKDVFIQTVTHELRTPLTSILGYAEMLADEDEELNPMQRRSLNAILRNGHRLQDTINDLLLLDRPATAVDAVTEPLDLAVLATTVHAELQAAAQAKNLAVTLDAAPAWVRGDRTQLQRALRKLLENAIKFTAAGGSVTWGCDADSRHVTVTVTDTGIGIPPEDVSGLFTPFHRAGNAMDQAVQGPGLGLAIVRDIVRDHGGAIAVQSVVGRGTTFTVTLPAVPAPVALPVS

SEQ ID NO: 8112 - protein, 301 aa, Actinoplanes utahensis
MAAMADQIIAGGFRIVVDPVSDSVRLSAIFAVLPLLTLFLLLGVFRVRAWLAGVISLVVALVVAIAGYAMPVGQALLSASEGAAFGFFPILWIVINAIWVYNLTVVSGHFDVLRRSMERVSPDMRIQAIIVAFCFGALLEALAGFGTPVAVTVVMLTALGFAPIRAASVALIANTAPVAFGALATPIVTLATVTSGAGNDPRLTTDTLGAMVGRQTPVLALVVPLILVFVVDGRRGVRQAWPAAAVAGLVFAVAQFVASNHLSVPLTDIVASLAAAAAVVLLLRLWQPARAVGSSPLTGAA

SEQ ID NO: 8113 - protein, 245 aa, Actinoplanes utahensis
MARAYAPYLIIIVIFAIANLGPVKSALARSPWTVIFAWPGLHVLSATGKPLSSTNFTLGWLPAAGTLLIIAGILSAVVLRVRPGAAARAYGRTYAELRQPIVTVMAVLALAYVLNQSGQTNTLGAFLATAGGVFVFLSPILGWIGVAVTGSDTSANALFGALQVQTAAKAGLDPLLLAAANSSGGVLGKMVSPQNLAIAAGAVGMAGREGDIFRKVILWSAVLLLGMCVLVTLQSTPILGWMIPG

SEQ ID NO: 8114 - protein, 531 aa, Actinoplanes utahensis
MADLILMADRIHTLTPGIRPTAVAVAGGRITALGDRADVRDWRGPGTRIIDVGTATITPGLVDGHTHPVHGIGLTRGLDLSGVHTLAGLKDALRSASSVCAAPDGWLEGWGLDPDAFKGAPLTAAPLIEVLGPHVPVFLRFFDAHSALVSPRALDIAGPAARSHAGVVRDADGQPTGCLLELEAVETVRAVLPPDPPGTRLRRLRELLTRMAASGLTAANAMDFEEDSLALFRALEDAGDLPMRWRCAPLVTPGADLADIVAKQRLHGRRWQVEGAKFMIDGTVDGGTAWLDEPDSLGESTASIWPDPGEYAAAARHLAGHGVPTVSHAIGDAGIRYALDTVGRLPRQRVPHRIEHLETMPGDLIGRFAALDVTASMQPTHCTHHTRADHTDNWSRRLGKLRADRAFRARDLRDSGARLVLGSDWPIAPFDPRGILAAARLRRPAGAVDTSPVLPAQGLTARMALEGYTSQAAEAAGIGDSGRIAAGCRADFSVFELDPLGVDADEFAESAVVMTVVEGDVLFGGSFAADG

SEQ ID NO: 8115 - protein, 406 aa, Actinoplanes utahensis
MDDEDLGTDQDPLLVRPFVAQEGGAGDAEASGATWPAGAAPDSVTQVLPVYSGGSGPGGSSASRSGGSGAGGSGAGGSGAGSAGAGGNRFGSGGSGVGSTAGARADGLARADGPTRADGRTQAGGRARADGPTRADGPTRTDGRTQAGGRARRLFGTRRRPVLVAGVGAGAVVVLAVAGYAALRPEFDPALSADLPRPSFPAVTGPGTTEATTTAAGTAGVVVGAHGGTGTGGGPGVNRTATPTAAVSVTPSRIGGSASAAAGVSSAASAGAQAPAAVVVGSGTAGTGILVSGNGLCLDLPGAVPVDDSVIQVFDCNRSAAQVWTLGTDGTLQVMGKCALLVGDSTVHLTSCDLRTTAQWRITGDHQLINAASNRCLTDPSQGARPGTRVVVVTCTGASDQRWSLS

SEQ ID NO: 8116 - protein, 66 aa, Actinoplanes utahensis
MNARIRRAVRARGHFPNEQAALKCVYLAVMSLDPTGTGRRRWAIRWKPALNAFDFAFEGRLTAGRN

SEQ ID NO: 8117 - protein, 887 aa, Actinoplanes utahensis
MIIYVNPMGPGELERVRPAPGSGFGSLRTDRGNLPLDRLDVQAAISGLVARTEVTAEFVNTHDTALEATYVFPLPDRAAVVGMTMTADGRTVTAELQERAAAREQYDQAVAAGQRASIAEEERPDVFTMRAGNILAGERIVVRLSLVGPMPFEDGAATYRFPLVVAPRYIPGAPLPGPYAGDGQTADTDAVPDASRISPPVLLPGFPNPLRLSLGVTVDAAGLELGEVRSSLHAISEEGGTLRIAPGERADRDFVLRLAYAPGGNTAVAVPDNDGEEGTYQIVILPPAGDVPPRPKDVVLLLDRSGSMGGWKMVAARRAAARVIDTLTGADRFAVLTFDHQVERPDGVEPGLSEATDRNRFRAIEHLARADARGGTELLTPLTTGLGLLADSTGRDRVLVLVTDGQVGNEDQIVHEVTPLIGSTRLHTIGIDRAVNAGFLGRLAALGAGRAELVESEDRLDEAMEHIHRRIGAPVVTGLSLTADDVTALEGTRSPQRLPGLYPGVPLVVTGRYSGSTAGTFTVTGTTRDEQAFQATIPLRERAEPAVTKQWARARLRDLEDAFAAGDHTLEQQIVETSLRFGVLCRFTAYVAVDERVVNEGGEVRRVTQPVEMPSGWESTAPPMAAGMILASASSPFPGGPAPAAPGMFPPAPPIPGGPVPSRPRFAPASAKLRASHRQPDAFDDARLAGQPPIVGGPPPSADSPASPAASPPAPTSDASTPAGGSSAPTGSVPASASGPTSPAGGPQSPAGGPPSPAGGVPRSASGLPAGGGRVSPRGFGRSRQPADAGIPLADIRQLATVEAGRLRDAADHPDYERRDLLDDLASRLTVLLTPLSGDDFGPLQALITLLNGNAPLAEKWSTALRVLTEFGAPTSPKRATKPFWKR

SEQ ID NO: 8118 - protein, 219 aa, Actinoplanes utahensis
MWTMEELVDRVRTALAAEYSGAPNGRVRDLPDRRSIRWYSTIGLVDRPLGTRGRTALYGPRHLMQLVAIKRLQAAGRTLAEIQADLSGASDESLTDLARVPSELLEADPSPPPATPRPPFWKSPPAPQTAPTHALDWAFPQSEAPSGLAEVPSPAGDPGTAPPIGADALLTGVPLGSGLILLVPGSFHLDRIDRTQLATAARPLLDLLASRGLTDRRDS

SEQ ID NO: 8119 - protein, 244 aa, Actinoplanes utahensis
MVTVSMIRGRMSGMLDRLRLVSLSHVNDPARISVFPGDPPFELDTVATLGGEGFYLRAVRGGEHTGTHWGAPGHFTEGGLLADELEPADLFRPAVKVDVRSACAADPAYAVTIGDLQDWEGRHGRIPDESFVIIWTGWEERFGCADFERHPGFAPETVRWLVETGRLGERGGTGTDAFSPDVSSDAGFTVSRLVYQRRRVSLEVLAHLADLPATGAWVLCGGQINRAGSGSTALIYGVVPPAAG

SEQ ID NO: 8120 - protein, 780 aa, Actinoplanes utahensis
MNRTGFASLTAVVIMAPLLTSPAEAQPQRPLTPAVHGHAGVLPEIDGRGLTRTHLRLGGKFLPQARYRPQPTARRAPAATPAVGTVRSWVGLDDTDGDLYRKDYTLRAVGRHIEVWVAKDIAFPAGDCRKNSTEVTDAQVADLVTQFDTNIYPKETATFSTPPDRSGAHPGMAGDFSGDGDKTVTLVDNVRDDNYFHFPERPTYIAGFFSAQLNELFDRNVMTIDAYDWQHRLGADPKNEPTDDLCTSRPARPRMYEGTFAHEWQHLLEYYQDPAEVDWLNEGLSDYAQTLVGYVDPRIGVHHPGFDSHIACYQGFGNVKTTYNANPRECGGPQNSLNLWDEGEPNEVLADYGITYELMVYLRDRFGVKMIAELHRDAKHQSLDALQTALPKGLKVADVLHDFQVMTLVDKEVGEPGGTVTGVPRDRVTAAELQSTVNLANPATYDKSGAAPNGADFIRLPQGLIKSVAFSGAPTLPPTPLAWKIDAGLLFSGNTSDLDETAARQVEVPTADPVLRFKTTYGMEKDFDYGYVTVSADGGKTYQAIEGNNTVKGPLGPAITGQAADVKENYDLKAYAGKKILLGFRYVTDAAVNLGGWHLGEVTLGASKITSDSLDGWKSPTQWHPIPVRGWHVSLVGLGHLRAAVVPITEVAALRGFPKVVAIVAQDDPTGTVTQYAPYTLTVDGVVQPGGGQTATPPPAASTTTKGHSTAGNTPGHATPGAAPSHSTPSHPTPGHPTPSPTRSRSTAGVTQGHATPGASPAHPTAGSGHGQPAAGGTTP

SEQ ID NO: 8121 - protein, 898 aa, Actinoplanes utahensis
MHMAPTRAVDHEASALHASPVVGGRSPGSHSPCRVGPESPRTASETVVEQEGSAIIQPIASAAPAAWTRMWAVRGHDGVSLEEAVLPALLGAVAGPAALLDHQDVDGGDGRPGGEQPAGQSPAGAEQDRGQGGADHHAERGEDEPEVEWAVRLLDSAAAAGWLRTDGHRHESTRVGRDENNSPQDRVVSISSASGTDPLWTGGAVAETGLTEQNSRKLGTWSVFVIAVSAMTPLTVVAGALPLGYGEVKEKGIPVAYVLVAVVLAIFTVGLTAMARHVPNSGAFYAYAAKGLTRPAGVGTAFIALLAYNAMQIGLYGAFGVAAHNAAAIFGLKMSWIVWALLGWAVVSVLGLRQIDFNARILTVLVGAEVLIVLTLDAVMVGHPDGGSVAFDTVNPGLIASAGGVSLLVGAVAGMVGFESPLVYAAEARDPRRTVARAIFMTLGVAAILYGGSAWAMSVVAGPDKIIDVAARYLNDLFFVLPGPYLPTAVIDLARVFFATSLFAAMLAFHHTVARYALTVAREGVLPPALARTRDDVPVAASIAQSGLAFIVLVIFAALVLNPTSDLFFLGTVSGGLGVLALMTIASIAVVRFFRRDTHGETTWRRSAAPWIAAVFLVLMLLLSVAFFGELLDSDNLVKVWLPPIAFLGVYLLGVWWGRRLRRERPAVYAAIGTGLPPEADRPGLVVPPQRLNGVAAAAKPEAAARLEIADAAPATVGLGATPGPATPNPATTVTPDVTSQPEAAGKSPTAEPDVVGRSAAVGTPASGLEPDAAGRTMAAGMPVTGAKPGVTTRTEALGEAAAGAPADVVARTEALGEAAAGAPADVVARTEAVRGAAGDPVEISAGEADGGPADVVAGEAAGWRTERARPAGTDGGGVTKPTVGGSEPEEGGNPPVS

SEQ ID NO: 8122 - protein, 104 aa, Actinoplanes utahensis
MGRVVFVPSDTSRFVPMPIGPQPPGRRGTVEEPYSPLNLRLVLAAFGMVVCAALSAILFRAGWTLPGWLLAAWAAVAAVDILVIQKRRRARNRAEQGRKHSLFE

SEQ ID NO: 8123 - protein, 32 aa, Actinoplanes utahensis
MVTLGYLAARSVELAGRFRSRFVTASADPSGV

SEQ ID NO: 8124 - protein, 382 aa, Actinoplanes utahensis
MWIFDGHNDLAMRLRGWHGSSTAGLDGSRPELHTDLPRLRAGRVGAQFWSVYVPSSLPEPEAVTHTLEQIDVVYRLLAEYPDTLEAARTADDVERIVAAGRIASLIGVEGGHCLARSPGVLRSLARLGVRYVTLTHNHHTAWADSAAAPPVSGGLTAEGRALVREMQRIGVLVDLSHVAPVTMHAALDEATAPVIFSHSGARTVTDHPRNVADDVLERLPANGGVVQIPFVACFVSPAVLDWQRAADEEWQRLGLPPVQDTWPRAPRAGESDPPTATIADMTSEPAFLPWLAAHPRPDATAAEVADHVDHARAVAGIDHIGLGGDFDGTPDVPIDLPDVAAYPVLLTELESRDWSRTDLRKLAHHNVLRVLREAEQHATADL

SEQ ID NO: 8125 - protein, 347 aa, Actinoplanes utahensis
MRSTLRKTVLTLTALVAGLGAATATPAQAATHAADAGCVTGAKLVPTCGVLWGGAAGGFTSAPRDKALKDWENASGRTATIFHQYHKGNEPFPTKAEIAMTADSAHPRVLLENWKIAYGTTWAAVARGGQDKRIDAFAARAKAYGKKFFLVLNHEPENDVIPRSGSGMQAKDFAAMYRHTIERLRAQGVTNVINVVAYMGNEKWMAQSWWTDLYPGDDVVDWVGLDSYVSVEKGYYHYGDFSALLDRKAKGGTLGWYDWATTRHADKPVMVAEWGAYHRVGRATDKSFVYNSVIDQLQKRPAIKAIVHFDTKHDDEGDRDISINSSAASLKAFRKLAANPIFDVKLG

SEQ ID NO: 8126 - protein, 314 aa, Actinoplanes utahensis
MLAEISAAAYRLRLPLVLYSAVLTVATVAAGRLSPAPIGPTVATLALVAVAGVTAVLALAVMAAAQRTGSQRPALIVDGAFHTPRPGTFPLLAVAMLGLAGAAVVAPAEAGQARPVFWGAGAFGVLTLACCARAIRHGIGLTLTPHGLHADKHTGSVTIPWEAVDPRRVWSGPFEVRLRYTRPDLVRTTGWVVNPHRFRVDGIATGFVAATIQHYAANRTELVLIGQPAGQLHPATEPVSPPRSVEPWNLSSVLPLLALAAMTGAGAVAADVWAGRRWGDVSVPGLVAHLLAIQALLAAALLARGSIRLLRRRG

SEQ ID NO: 8127 - protein, 86 aa, Actinoplanes utahensis
MTVRSPGPLYTPAVIMRLDTAVDRHRRPIVLFALVWTMLAVAARRLGHADDATARESVHVLAAVAAIAIGAVLIDAIRGFRARARI

SEQ ID NO: 8128 - protein, 646 aa, Actinoplanes utahensis
MTTTAGHRARNVPERASLVALLTATAVLYLWNLSASGWGNSFYAAAAQAGAKSWKAWLFGSLDAGNAITVDKPPAAMWVMGLSARIFGVNSWAILAPQALMGVASVFLLYLAVKRWFGHGAGLLAGAALALTPVAVLMFRYDNPDALLVLLMTAAAYTTVRATEVASGKSLAWTGVLLGFGFLTKMMQAFLVLPAMALVYLVAAPAPLGRRFRHLSLAGLALVASAGWFVALVSLWPASSRPYIAGSTNNTLWELALGYNGLGRILGGAGNGGGGGGGGGNVGFGGATGIGRLFGTSMGTEISWLLPAALIALVTVLAATWTAPRTDRARAAMLLWGGWLLVTGVTFSYMSGTIHPYYTIALAPSIAAVTGIGARVLWLYRTRLWGRIVLAAMVLATAAWGFVLLGRTDWLPALRWAAVVAGVVAAAGLIVPAVALRRLAVIGIVAGLLSAGLGSAAYATATVGVAHTGSIPSSGPSGSSGMGGGPGGGGFGRTGDGAPPAGNAPAQPSPSASSSTASASPSAPFPGGGGMGRGGGADTELTALLKASTTTWSAAVSGATSAADLELASGTSVIALGGWNGSDPSPTLAEFQTYVKSGRIHYYIAGGVGGGGGMGGGSTDSSQIASWVTANYPATTVGGSTVYDLS

SEQ ID NO: 8129 - protein, 542 aa, Actinoplanes utahensis
MSEHVSDSAEWQALQGYAEKFSAVHLRDLFASDPQRGERYAAEVAGLYVDYSKNLVTDEVLSALFALAGRAKLNERIAAMFAGEHINVTEDRAVLHTALRLPRDATLVVDGQDVVADVHEVLDRMGAFADKVRSGEWVGHTGQRIRTVVNIGIGGSDLGPVMAYEALKDFSQRDIECRFVSNIDPTDLYEKTRDLDPASTLFIIVSKTFTTQETLTNAREARSWLLASLSDEAAVAKHFVAVSTNAEKVADFGIDTDNMFGFWDWVGGRYSLPSAVGLSVMISIGKERFAEMLAGYHAVDEHFRTTPVERNVPALLGLINVWYDTFLGAQSHAVLPYAQYLHRFAAYLQQLTMESNGKSVRLSGDPVSFQTGEIFWGEPGTNGQHAFYQLIHQGTKLIPADFIGFSEPNHDIGEMHDLFMSNFLAQTGALAFGRTLEQVQAEGTKPEVAPHRVMQGNHPTTTILAESLTPGTFGQLVALYEHITFTQGVIWEINSFDQWGVELGKVMANQLAPKLTAAESPADDADSSTNTLIKRYRAARGR

SEQ ID NO: 8130 - protein, 348 aa, Actinoplanes utahensis
MTSLLLGSVTRSSVLDITEWFGALQAQDLNSVLWSLGARLRGSTLPEIVAATENRDVVRTWPMRGTVHLVPSADAHWMLELTGVRALAGAAKRREILGLAEADADRAAEILGAALAGGGRLTRSACVATINAGGVPVSGQLGYHLLWYASQRGVTAIAPNEGSEQTFVLLDEWAPTRNAPSREEALGILAHRYFRSHGPTTAKDFAGWTMLPMKDARAGIATAGLRRVEVDGVEMWADPAVLDAGPVRGWRALPGFDEYMLGYKDRAMMATPEMLRSIIPGGNGIFQSTLVRDGRVMAVWKRTLGRKAVSITVSPLVEFTAGDWMQAEEALQPYGAFVGLPVTVKKLA

SEQ ID NO: 8131 - protein, 436 aa, Actinoplanes utahensis
MRVRRQVLALIAGVGVALGTTVIYSTTGEAAVACSATVWAEGVTYTAGQQVTYQSKLYQALVTHTAYAGTGWNPAATPTLWKELGGCSGGSTPTPTPSVTTTSPSPTTSPTPTPTATGGTGCATKGRPAGKVLQGYWENWDGASNGVHPGLGWIPVNDTRITQHGYNVLMAAFPVIRSDGTVLWENGMDAGVKVPTPAEICAAKAQGATVLMSIGGAAAGIDLSSSAVADRFVATIVPILKANNFDGIDIDIETGLSGSGSISTLSTSQANLIRIIDGVLAQMPANFGLTMAPETAYVTGGSVTYGSIWGSYLPIIKKYLDNGRLWWLNMQYYNGSMYGCSGDSYSAGTVQGFTVQTQCLNNGITIQGVTVKVPYDKQVPGLPAQSGAGGGYMTPALVSQAYNSVPSIKGLMTWSINWDGSKGWTFGDNVKALQGR

SEQ ID NO: 8132 - protein, 185 aa, Actinoplanes utahensis
MARLICTGITSLDGYIADERGNFDWSRPDEEVHSFVNDLERPIGTYLYGRRLYEVMRFWEDAEARPDSTPATVDYARVWRAADKVVYSTTLAEVTTARTRLERVFDPEVVRKAKEAADRDLSIGGPHLAAHAFRAGLVDEVQLFVSPIAVGGGTRFLPDGVRLDLKLAEQRRFANGVVYLRYRAS

SEQ ID NO: 8133 - protein, 689 aa, Actinoplanes utahensis
MAFRDRRLPVPASGSPLLMPDAEVSRRSGRRRIRNGHRRKKINSGKGTGMADQEALGREYLLHEEIGRGALAVVRRATRRSGGPPLAAKLLHPELASDRRIRESFLREEAALRHLDHPGIVGFHDLVVEGGTLALLMDLVDGPDLRRHLAHRGGRLGAAETAVIVGQAAEAVAAAHRRGVVHLDLKPENLLVVRDTGPAVVRVTDFGLAVLLMDAARGVAGGTPGYTAPEIWQGATPTAAADVYSLGILLVELITGHVGGDPDALPERLAGPARSCLAPDPRDRPAAEQVGGYLRALVASGVLGPPPPVVAEGEAGDVPDPVSRRTTVRGAGSVGSPGAGGGAGAAVDPEHSGIWVGQLAGGVPLGGFLAGAPPQGGFLAGTPAQGGFLAGAPPQGRFLAGTPAQGGLLAGAPPQGGFLAGTPAQGGLLAGAPPRGGGGPRVPAAGLGGTGLVAEAPPRRREGRGMLVAAGVLAVVAAGMVGLGIAKVVGDRSHPAAAVPVSSAPAVTPSAGAGGVLPPTEQVRASASAAPVRVTLAGYAADDGGTLALSIRDGTAIAYICDGNTREAWLQGTAVDGRLALSGTGGARITGTFDALGATGKVTVAGGTHAFTLRPVQKPSGLYRTSAKVRGARIQGSWIVLPDGRQVGVLTDGGRTGPAPRFDVAGGTATVDGVAVAVTAVDVDSGAGF

SEQ ID NO: 8134 - protein, 371 aa, Actinoplanes utahensis
MQFGIFSVSDITADPTTGKTPTEAQRIKDIVTIAKHAEQAGLDVFALGEHHNEPFFSSSPTTTLAYIAAQTTTLQLSTATTLITTNDPVKIAEDFAMLQHLADGRVDLMLGRGNTGPVYPWFGKDIRAGIPLAIENYALLHRLWREHTVDWEGKFRTPLQSFTSTPRPLDDVPPFVWHGSIRSPQIAEQAAYYGDGFFANHIFWPASHTQRMIALYRERFAHYGHGDPDQAIVGLGGQVFMRRNSQDAVNEFRPYFDNAPVYGHGPSLEDFTRETPLTVGSPQQVIERTLKFRDYVGDYQRQLFLVDHAGLPLKTVLEQLDLLGQEVIPVLRKEFAALKPAHVPDAPTHAALVAAKNAAEAAVTEKVEVQA

SEQ ID NO: 8135 - protein, 204 aa, Actinoplanes utahensis
MKQRSLVVISAGLSQPSSTRLLADQLSAAADRAATRIGVQLDIQVIELRDLAHEITDHLLTGFPPAALRQAQDAVAAADALITVTPVFSASYSGLFKSFFDVLEKDALADKPVLLAATAGTARHSLVLEHALRPLFAYLRAVPVPTAVFAASDDWGANSVEGPLRGRIERAATELARELDRREPVTVVDPFALTESFEDMLKTL

SEQ ID NO: 8136 - protein, 181 aa, Actinoplanes utahensis
MTYGPPQQQPNPPQPAAPKKKPSGKLILGILVGVVLLCCGGGVTAINAFTGDSGSTKAGGTSTSGAPADAVVVAAAGSPSAGVSAASSPAPVTAKPKPTAAPTTRTPAAKPATTGTRPAPPKTTRPRTTKPTTKAPTTAPPQSGVHPGAFCSPEGAYGTTSAGTLMRCTSKNGDRPRWRRA

SEQ ID NO: 8137 - protein, 203 aa, Actinoplanes utahensis
MGRRGGLSRVVGRGVDTLCASTTARFVVQAVRVGTSTPVQPLADLPDGEPPVVRRHLVVLPRGRRPAGPAPEAALRHLIAIPRERPDTPPAVDRRTVPIDGGVRTRPADLSVSSLTGSGLTGSGAAASGVAGSGVVAPRLPVGDSGVSRLAVSELTGASGPVRSKRWSVVAVVVSVGMLVLFCAGVAAVTVRLSVLLVALRSD

SEQ ID NO: 8138 - protein, 209 aa, Actinoplanes utahensis
MTMTGARGPALAERPRADLPVTPLTWQRTDTVGTELVFPRGSRPHGSAIVAGARAYSLTWQAEVTSTSEVTSLHVTSQGDGWSRELWLDRGASGWTCRAEHAGDAGDLPSAGAEQRDALDPRAVLRLADSPIFVAWAVRGLGLTVKSGPVTVPAIRVQVPSLAVLPGTVTYHLVSPQRLRITGDWPASTFELDAAGMAVYQAGHLRLAR

SEQ ID NO: 8139 - protein, 343 aa, Actinoplanes utahensis
MIRSARLTALPAVAVGGAALWAYGIAVLQPLTEPDSRWWEMAQNSSYWARDLRWGAIVASCLALIVLAGGARWPTRGVAAGGVGWIVVDLLMDRADPGRPALPLTLGVGVLVVATAAVVCTRCGRRTSLRPPVLRTVAVIGVLSAISMLGVGSPSGGEPQLPPTRLAVVLLHIVLAWIATLTAAAPVAASRAAATTGVALGWVVLTVFFAHSPPDALVWLLLAGSGLFVAGIWSVGHPSAPAGLRAAVTISGALIIPIMCMVIGYATIIIGPDMTRMAGNESLNGDEDMLLGLAGVLAGLAVAWCGRAVSRLFAMSPQGCRSAEAGPDDGGVQVTLTLPVGDT

SEQ ID NO: 8140 - protein, 197 aa, Actinoplanes utahensis
MPRVSEAHLAARRQQILDAAVRCFVRNGFHQTSMQDVIKEADLSVGAFYRYFKSKNELIMAIAGIKIGEVTGILDNLLAADPMPPLPAFLDAVIGQVEATLQADQTVRIAIQIWGEATYDDEVAEVVRDVYRRIRERMVRTAERARATGQLPPGADATAVGAAIFGLVQGYILQRILVGQVDRETYVAGVRALMTPA

SEQ ID NO: 8141 - protein, 217 aa, Actinoplanes utahensis
MEPRDPETRAGLEPRDPETRAGLESRDPETRAAAERRPQRPRDPEARRAALAAATMEIIAEAGVGRTTHRAVAARAGLPLGATTYYFPTLDDLIAAGLRYSCDAMRADLDVWSTRLAAAPDMPAELTALTAEYLQDRRQVRIEYELCMAAARDARLRALAETWMDGLPEILHPWVGEPAARDICALLDGIILRALVTETELDAPGLTAAIRRLIPPA

SEQ ID NO: 8142 - protein, 109 aa, Actinoplanes utahensis
MRYVLLAVAIGSELFATSMMKATDGFSRLWPTLVVLAGYGVSFVALSQAIKGGIQVGIAYAIWSAVGTAAIVVIGALFLDEPVTLAKVGGITLIIAGVVMLNLTGAEAH

SEQ ID NO: 8143 - protein, 127 aa, Actinoplanes utahensis
MTAVANPATVEECLRVGAGFTQGDRNWIAEQFGPLDARLAAFHADATELEITVKDREARGQKVTLECWIGGREKIVTTSSEEDLHAAIMDVRDDLRRRLNDAKTKQEPRHNRHLREVPEVVVDEDPI

SEQ ID NO: 8144 - protein, 197 aa, Actinoplanes utahensis
MRPYRPADLPALYDICVRTADLGGDARGKYSTDALMGDLFAGPYAVLEPDLAFVLDDGGRAVGYVVGTADTASFVRRYREEWIPRLAGRYPVPPPPPRTPEQDMVALHYRPERMIVPELADHPAHLHIDLLPPYQRRGYGRQLIDALSAAAARAGATGVHLGMVTENVRARPFYDRMGFTVLPVPDPGPLTYLGKRL

SEQ ID NO: 8145 - protein, 459 aa, Actinoplanes utahensis
MRRRGTPPRTSWQRRAGGCGTEVRRVRPGAVAVQLAGARVVGAARPLLAAVRRPPRPAGPGRDPGLAPESIGSVHDDARRAGRHGTAGHRRAERGGGRDLGQPGHGDRQHRHPGRQGARRGGAGDLGAALRRRPAVRQRAVGLRAGAAPGRRGAGGAQEVRRLLRGDRPGGAARRTRCRPARGGRCAVRRVHPVDHPRRLHPGLRRAAGQRRAHHRGPDRVGRARPGDRGVVHQPVLERAGRTRPGRRHRADRRGRLRRGRRVTGGNEWLRRSAEDPGHSQWYIKRFRDMAAQGADLAGEARLVDTLVPRGARILDAGCGPGRVGGFLASLGHDVTGVDLDPELIEAAIADHPGPQWLVGDLSELKLPGVPFDAIVCAGNVMTFAAPDTRVEIIRRFGEHLAPSGRVAVGFGAGRGYPFDEFLADVTTAGLAADLLLSTWDLRPFTPSAQFLVALLRHP

SEQ ID NO: 8146 - protein, 485 aa, Actinoplanes utahensis
MTHLSTGHPDLDLILGGGLRRGSVVVLAGPPGTGKTVLAQQICFAVATGEHKAIYYTTLSEPHAKLVEHLHDFTFFDAGSLGPRVEYVHLGDMLRGHQAAGLDPVIDEVVRKALDDEPALLVVDSTMMLRDFVSDRALRTSLYDLTSRVAHSGAVLLLLGEYSDADMQSGIEFTLADGIIALSHQIREPVDRRTLRVIKMRGAAPLGGAHTLHITDDGIRVYPRIESFLPTDMPGRGARISSGIPGLDDLMGGGIPDGDGTVVLGPTGVGKTIGCLSFLAEGLAQGQRCLYVTFQDTVEELKEMAGRFGWDFAAAEERDQLVIAHVPVGALDLDLDVLSSMIRHSFDDGSVRRVVIDSLAEMAHAAREAQRFPAYLRSMLAVVRSAGASLWVTSETQLFGHVDDPLTGLMYLFHNVIQVRYIEECAAAGRFLNVVKMRNSRHDNAMYRCHIADQGGLTVGERLEQATGLLGWDAPRNCLPPGRDS

SEQ ID NO: 8147 - protein, 119 aa, Actinoplanes utahensis
MGTILVVDDEPDLRFLAKRILTRAGHQVIAAGNGADALEAVRQVRPDLVVTDMMMPVMNGVELIRRLRADPVTAGIPILAASSDWHLAVEADAALAKPYGRADLVEAAERLLREGSDRR

SEQ ID NO: 8148 - protein, 89 aa, Actinoplanes utahensis
MLFRSRPPSRSGRHGRGSATSQALRHGRIRGQLLGLGAAQPARRSSAWPGTARSRFQSYAWGFVLLGMVAPAALLLDVFAVRRPATARA

SEQ ID NO: 8149 - protein, 253 aa, Actinoplanes utahensis
MTLYFDLPRTTPVAADPTPWRDYRPSPRLVHTAVGSGLLTVLVAAAGGWSLLLGEGAAAVACTIATLVLGHLSGLLLHLWVRPYNTGDRMRIAAAGDGSPGLTFRYSGRLYYWYGGFLGLLTIAQLGLAVTVWPFAAGALLSGAALVMLSRHAPGRLTLTPDGVHHHGIRHQRFLPWESISDILPGEQAHIPIIAAPTTGGQPHLTIQVPWLDTDPALVLQALRWYHANPVHRFELSYHIACDRTRQRAWHLH

SEQ ID NO: 8150 - protein, 562 aa, Actinoplanes utahensis
MLNSLSRRAAVAAAAVLALAAAGCSGDSGTRSTGGNAGTSAITIFNGSTGTIVENWNPFTPTFLQPTNGLIYEPLYWYNFAAESKPTPMLATGYSWDTAGSALTITTRDGVKWSDGQAFSARDVAYTFELIRQNKALNSTGVKLASAVAKDDRTAVLTFEKPSFTDEAAVIANTPIIAEHVWSRISDPAKTINPNPVGTGPYKLKTFSAQSYVMEKNPYYWQPGKPQIQNVRYIALATADAASAALTAGQVDWMSAFLPGLDQLLKNQKNLSYVNTPAMTTSIFTCAGAALGCKGPQTDPAVRQAIYWALNRDQLNKLAGGGFAETASPTMLLPQRDRSWIADQADATVPGAPDTAKAEQLLDAAGWAKGSDGIRAKGGQKLSLTIQTVTGWSDYISLNDAMTQELKEIGIELKPTQLSWNEWNNNQVQGKFELSLDSIGLGASPNPYATYLKYSSKTTEKVGESAPPSGNYARYSNPKVDAAVDAAAATNDEATQKAQYAIVQAEIVKDLPYIPIYVNSMLTEFNTSHATGWPSNDNKYALPASWKQWDNGIVLTNLQPAK

SEQ ID NO: 8151 - protein, 329 aa, Actinoplanes utahensis
MRHLLRKLGFYLVALGAALTVNFFVPRLMPGDPVDILLSKLGQRGPVTPEMRASVEAMLGTDSGRPLWGQYLRYLGNLAHGDLGVSVTFYPASVGSIIEQTLPWTIGLIGLATVISFLAGVGLGTVAGWRRGSWLDNLVPVTTMFQSVPYFWLALILLFVFGSIWPLFPLNGGYDVYTVTPGWNAAFAGSVVYYGALPAITIILSSVGGWMLGMRNMMVSTLSEDYMVTAEAKGLRPGRMMRRYAARNAILPSVSGFAISLGFVVAGSIVTEAVFSYPGIGNALLQAVGSNDYALMQGIFLVITLSVLGANLLVDLLYSVIDPRTRARA

SEQ ID NO: 8152 - protein, 317 aa, Actinoplanes utahensis
MTMTTELAEPTIPQDQSPIEVRRFTRNRKLIAGLTLGGAIVSFGLLGPIFCQDPSLVHDQGLTGPGAEHWLGTTQTGQDVLAQLAYGTRGSLAVGAIVGVLTLILSTFFGVVGAYAGGWVDDLFSLFTNVVLVIPGLPLVIVISSYVPDKSIWLVSLVLAITSWAGSARVLRGYTLSLRNRDYVLAARVAGEKRWRVLAVEILPNLIPLLASQVIFAVIFAILGEAGLSYLGLGASGSFTWGTMLYYAQNGLALRLGAWWWFVPPGLMLALFGAALSLINFSIDEVIDPRLRNRTRAARKSWRMSSEQLSKAKEATL

SEQ ID NO: 8153 - protein, 290 aa, Actinoplanes utahensis
MTVLSIENFSVDYLVDPVVHAVKNVSLDLQRGEVLGLAGESGCGKSTLAYGIIRLLKPPAMITSGRAVFRSRAGCETDWNALDAEELRANRWEKISMVFQGAMNSLNPVISIRDQFEDVFTTHRPGMGRRERRQRCADLLERVGVDPARLTSYPHELSGGMRQRVMIAMAMALEPQVMIMDEPTTALDVVVQREILREITRLRDELGFAVIFITHDLPLLLEISDRIAVMRGGEIVELGAAADLYTTPKHEYTRQLLASFPSLTGDRGSFVRGAMDDRLLALDAVEVEAS

SEQ ID NO: 8154 - protein, 270 aa, Actinoplanes utahensis
MTTLEVSGLGKDYRLRDGWRTSTLRAVDDVSLTLGHGKTIALVGQSGSGKSTVARLLLQLERPSRGEIRLDGEPVGRRGAGLAAYRRKVQMVFQDPFASLNPYHTIGHHLARPVRLHHRRITDTDVRAKVLELLERVRLTPADTVARRRPHELSGGQRQRVAIARALAPRPGILVADEPVSMLDVSIRLGVLNLLAALQREEDLGVLYITHDLATARHFADEILVMYQGAIVERGPADDVILNPRHEYTKMLAEAAPNPERRIGELRGTV

SEQ ID NO: 8155 - protein, 220 aa, Actinoplanes utahensis
MDVIGAGFGRTGTLSLKVALERIGLGPCAHMLPLIGDEERCRLFTRAAAGEPGALDRALDGYRSTVDWPGVYFWRELVDRHPRARVVLTVRDPDDWYASAERTIWAASRRPAAPGLTAMREMVDATNWVGTFDGRFGDRAYAIEVFNRHNAAVRETVPAERLLEYRIGDGWEPLCAFLGRPVPDEDFPRLNDTAAFQERLSGLGLSVDAGRTPTGATNGR

SEQ ID NO: 8156 - protein, 178 aa, Actinoplanes utahensis
MEGRPVPVVSSHRRDTLVIGASRDVADTTDDHEGHAMSDWNTQVIEEFRANEGRVGGPFAGAPMVLIHHTGRKTGRESVTPLMYLPDDTDRDTIYIFASKAGAPDNPAWYHNLTSAGSTTVEVGTETYAVTVKELTGPERDERYAEQARRYPGFAEYEQKTAGIRTIPVLQLTRAASA

SEQ ID NO: 8157 - protein, 71 aa, Actinoplanes utahensis
MADRNNAEPNGDNRVKDPDDWSTGDEPATGAQESYLHTLATEAHEDVPDGLTKAEASRRIDDLQEKTGRGR

SEQ ID NO: 8158 - protein, 214 aa, Actinoplanes utahensis
MRMFRIVLAAAATAACGLTGAANLPTPAHAAGPGVPTAAHPADSGISTAAHAAHAGPAGPADPRPDGLRLTGAERSMLLAATRRFRDVREAVRAGYLPTDDCVPGMGLHYSNPALAADPRIDPEHPEILLYVRGDHGRVHLAGLEYYRPDADGDLRTDGDRPALFGHRFNGPMLGHPVPVGAPPMPVHYDLHVWLYTRNPAGELTTDNPVITCH

SEQ ID NO: 8159 - protein, 476 aa, Actinoplanes utahensis
MREAVGAPAPAGRPGRGRRPGARESILDAIRACEPLSRVELAKITGLTEAAVSMTVRRLLEEGLVVETGRTPTGGKPRTLLQLDPTARLAVGVHLDEDTTTYVLTGQTGGVISRLARPALPAMSATRTGSTTGTSAGPAPAPTADQPVTAAPGSTASGSAAPGSTTSGPATAGPATTGSVTASGDGDRLGDGVDLLLRTLAADIDTLLAGSGVDPARCLGVGIVWPGPHSGGPADDPLPHLRGLGGDELGSRLSAATGWPVLVENDATAAAVGEYWVARVGPEQAFAALYMGGGIGAGIVVEGRAMRGSHASAGEFGHLCLDVFGPECWCGSRGCLEVLAGPRTVVSAARDNRVAAAEAGLDLSQPLRSVATEFAAIARAARAGAPHCRTLLETSARYVAAAAETVVNLLDIDLLVLTGPGFAAASAIYGPAIMRRLAPADARTWHRNVTVTVSLAAATASATGAAALVLQSHLRA

SEQ ID NO: 8160 - protein, 825 aa, Actinoplanes utahensis
MIRTDLHSGWTVRAVGGPVPAEIAAGTVPATVPGTVHTDLLDAELIPDPYLGENESLLVWFHRAAWLYATTLRAAPAAPDERVDLVFDGLDTVATITLGDAELGRTANMHRGHRFDVRDRLHGAPLPLSVRFDSALDYAERLQKVIGERPRPYPHPFNAVRKMACSFGWDWGPDLQTAGIWKPVRLERWRVARLASVRPLATVDADGRTGKCRISIEVERSGLAAATALTAEVAVGSQTVPVTLPATADAVTTEITVPDAPVWWPVGYGDQPLVDVRVVLRDGDGDLDVFDTRVGFRTVTLDETPDAVGTPFTLIVNGQPIFVRGLNWIPEDHLLTRLTRARYAAAIERAVEANANLLRVWGGGIYESDDFYAECDERGVLVWQDFPLACAAYSEEEPIRSEILAEARENVARLAPHPSLILWNGGNENIWGHQDWDWKPRLNGQTWGAGYYYRDFPALLADLDPSRPYHPGSPSSPGHDPEIIHPNDDRHGTRHEWEAWNRQDYTHHANFLPRFCAEFGWQAPATWSTLRESLAPEDFDQESPAFLLHQKAAGGNDKLDTGLAHHMRVPADFAEWHWATQLNQARATAYAVHHLRGHAPRTMGSILWQLNDCWPVTSWAVVDGAGRRKPAWYALRRAYAPRLLSLRFPPGSPDGALVAVNDSPTPWRGTVRVRRVSFTGEPLAEGTVELDVAPRSGSVVPLDAGLTTPGDVTREVLVADADGLRATHLFAEDFDLAYDPSPLTADITPAEGGYCITVTASRFARDVALLTDKIDPASSVDDLLVDLLAGESHTFHVRTTWADPAAFGAPGVLVAANTLAAATEA

SEQ ID NO: 8161 - protein, 283 aa, Actinoplanes utahensis
MAGGLIGLVLTGSAAQVGVEPFFMELIAGMEEALAPAGATVLLLVVPDRDAELATYRRWAQDHTVAAVVVVNLVHDDVRPDRVAALGLPAVLAGRHPGPYAKVVTDDAGAMTTAIAALTALGHRVIGRVSGPADLVHTAERTAAIRAAAAGRGVTVRIAEGDYTAEGGVRALRSLLASAPPPTAIVFDNDVMAVAAEQELLRTGTRVPAQVSLLACDDSPLCELAVPPLSALSTDVHEHGLTLGRAVLDVLDGGAGRTHPGPAVSIRHRESTGPAPAAPKVSW

SEQ ID NO: 8162 - protein, 732 aa, Actinoplanes utahensis
MNPSRGTHRGDDHHDRRAHAGGPAHHRDPGPGPGRRSGGRGPRPAEPGRRPSAAPALRLVGPRPDGPRRRPPRRDHPAQRRPGRGRPAGPGHPAPRQPDRRPHRRVGPGRAGRRHPHRRRRRVRPRRPPGDPGRPPGRLPPPPARRALGHSGSGPHVEYLIYRVRSTGFVRTRGETMRKRTIRTLLAAGVLAAGSAAFVNLATGSASAGTGPTTLTGQQRHAIDGYHADRMVVDTVHQRLLIADDVAHRILAVGYDGTVAAQVALPDGANAGDLRLTADAGRLWAILPGAHQIVSWDAATLGDAKPYPVDLLDLGHLTLAGGTPWFTFDKNYFASLDPATGAVTRYVLGKGNDTSASPSQPLIAANPADPTQLALTYAGTRTTLFRYDTAGDMTAPVTAETGVLAAHNTLAYTPDGTMIYVAGAGGVFYTWADDLAGISARTIGLDGAADVATTDGWVAAGTGDVRLYPDAETTAAREFDFPATATVTDLGWGAGAGRLFAISTDPTGAQSLWVIDQPTATPAPATPELTLNRDGSVNAYGATVTMTAHLGTTAQNRTVEIWADPYGTDRPRTLLKKGVVDAAGNLSVGYQLTRNTTFSVVFAGDAGYAARTVTSAVNTSVAVATTVANHYTVKRSYYYVHKSKNPVFGTTMTPYPGRTERLTLQQYSGGRWVAFKSGNYRLSSAGKYSYTLTGTHRTGVKYRVSAAYLTGISGDRANATTNGPWKYFIFTS

SEQ ID NO: 8163 - protein, 327 aa, Actinoplanes utahensis
MPEPRRITSADVARRAGVSRATVSYVLNNTSGQSISPATRDRVLQAAAGLGYAPSAAARTLRTGRSDVVLCLLPDWPIGNEVGNLLGNLSTALAREGLTFVAHPGSREDRPIAEIWKALTPAAVLSFTDFSDDEREAMRAAGVALVVALLGRPGRHGRELEVPQQLVGRRQAEHLAGTGHQRLGYAYPDDPRLQIFADPRLAGVRAAAPVDPVVRVVPLDAAQASAAVARWCADGVTAICAYNDEVALAVLAGARRLGLAAPTDVAVIGVDDIPAARLAVPPLTTVTTDQLTLAAHLATTVVAAVGGRAAPPLPTGDLIQLVVRDSA

SEQ ID NO: 8164 - protein, 784 aa, Actinoplanes utahensis
MTLDLAAKVALLTGATTFTLAPEPRIGLHEIRLSDGPTGVRGLKFSGGRVVALFPNATLLASAWDPDAAYEVGRLLAEEALAQRIHVVLGPTINLHRSPLGGRLFEAYSEDPLLTGRLAAAYVRGMQDQGVAACLKHLVANESETDRTTVDSVVDEATLREVYLLPFEIAVEEADAWTMMAAYNDVNGAAATEQRHVNNEIVKGEWGYRGLIMSDWFATRTTAASANGGLDLVMPGPAGPWGDALVAAVRRGEVDEAVIDDHLNRLLLLAERVGALGTPRGYPAGLPAPASALRREQLTRLAASGMTVLRNEGAVLPLARDTRIAVIGRHALQTIDMGGGSAQVNPPYQVSIAEALPGAVIADGVEVRTRPVPARGGFLTDPQTGRPGIRVRMFEAAGTELESRFCAQATTMIGMDDDFDGVVHTAELTGRITGGGTVELGALGAGTWTVTVGESRVDYHLDLTGNGFGEAVLAPPLRVDRFETTAGDILTARVRLLSGGSFANTGLFGLLAHTAPRPAVDVLDEAVRAAAGAEVAVVVVGLTEEQETESVDKTTLALPGAQDALVEAVAGAARRTVVVVNAATPVLMPWLSRVDAVLWAGLPGQEGGHAVAAALFGDIEPAGRLVTTFPAADGKSPAWSVTPVDGKLAYDEGPFIGYRGHHAGRAPEPAFWFGHGLGYGTWEYADARRVDGDPAAVAVTVTNTGSRTSREVVQVYLQPDDPAQPVRLAGWTPVTVASGESARVTVTLDSRMWRVWNTTSGVWERASGGQLLIARGLGDIRATL

SEQ ID NO: 8165 - protein, 188 aa, Actinoplanes utahensis
MAEIVLIRHGQTEWSANGRHTSYTDLALTAEGEAQARRAGERLGGRTFAAVISSPRRRALRTAELAGLTVTEVTEDLAEWNYGEYEGITTRQIRESRPDWSLWVHGCPGGESPEQVGERLDRVLARARAIDGDVALVGHGHSLRVTGARWVGLPAGAGGLLKLDTATVSVLGWEHAVDPVLASWNAPC

SEQ ID NO: 8166 - protein, 111 aa, Actinoplanes utahensis
MSAEGMIAMFLAVLIGSTIAALAVTFWPQRHGGPSGLFAGPGPATGPGPLSAVLLPVATVIPPMPESTEGILIAQLMRGELSAEQYRHAMSGIAAREEGHSPMPLPGALPD

SEQ ID NO: 8167 - protein, 126 aa, Actinoplanes utahensis
MIVVLVAMLGLVAALALVFWPWPAGRRVTGERRETRAEPGRREDRETREDRERREKRDRRASRARRVSRGRVAPPPLRLPDSLEGVLTVQLMTGEIDSQQYIRALERIAARDERRHPMSVPPDCRP

SEQ ID NO: 8168 - protein, 38 aa, Actinoplanes utahensis
MAQELHLSPRTVDHHLRNVFTRLGVRSRTEMAHLLATR

SEQ ID NO: 8169 - protein, 382 aa, Actinoplanes utahensis
MFHAPLVQEVQRLLTAAEAGHGGALLLCGAPGSGRTTLLRTAAALAGGWTVHELAGYASETARPGAALRRLTAGRSLHHHLRTTSAHRPLLQLLDDAHLLDAPSLRAIAHAAHRLTTLPVVILAAGPPGLTAGDLPTRRIPPLTPEQCRTLLGAHAPDLADDVAIALIRIAGGNPAALTDLATGLTPAQRRGYEPLPATLAPDHPQRLRLRTELDALPEPTRRLLLLAAAGPPTPLPDLLDAADAGLADLLPAEHAGLVTVDDTTVRFGSELARATTYREMSAIARRAAHLALAEVSAARGRRLDTLLHRAAAATTTGLGTPSGLATPSGLATPSGVVIPTGPATPTTEAAASGISAPPAAVFPISGASVAATPISGAGVAS

SEQ ID NO: 8170 - protein, 328 aa, Actinoplanes utahensis
MLRPDDTKPVISPMRGSSGAAQTGARRSVSPGEGVFDVHRSWKRLLATAAAALMLSAPLGATAAHAADNPYQRGPAPTLAALQAASGPYAVSQVSVSRSSVSGFGGGVIYYPTSTADGTFGGIAISPGYTAYWSSISWLGPRLASHGFVVIGIETLSTLDQPDSRGRQLLAALDYLTRSSTVRNRVDASRLAVAGHSMGGGGSLEAANDRPSLQAAVPLAPWDLTKSWTGIKVPTLIVGGQSDTIAPVASHSIPFYTTIPASSEKAYLELAGQSHFFPQTVNTTTAVEAVAWLKRFVDNDTRYDQFICPGPSSVLVSAYRSTCPLSAG

SEQ ID NO: 8171 - protein, 663 aa, Actinoplanes utahensis
MRSGARRRRRPQHLAGLDRLLGGGIRRVRIGHVGDAVLLQAVPVRGVRPAAPAVAAPAEAGPHRRARLLCPGPGRLVHVRRFLEEAAATREAAPAAGAETARGARHAGRARATGRARAVARPERRQGDRDAVLRQTCGVRRERRVVAAAVLSGRAGRRAGAAVLAAARRGEGHRDERHRRARRDPAGRLRLDYRHHRLLIDTGPPGEERGGTRRHSEPRLPMRKVGRAWESPLSRHRGSQGTPRRDRGRREDRWPDSSTMGVALAGRRRGIWLGVTVVVLAVLGYAVVRAMTAGGGAKTKAAETVAVDRGAVSTEVATTGTLAAAQTRSLSFAVAGTVETVKVRAGTTVTAGQVLATVDDDDARQAVDDAQSALDDAEDALTAAKKSAGATSSTTTSCVAAAAYRVSPSPSPSSSPSPSASARPSRTATVTPTKAPAQGGTGTGTNCSANGGGTTRQGGQNGGGDQILSAQQRVNAAEVTLQEREDALAGATITAPIPGRILSVGGKVGSRVSSGSTFISLADIYDMQITASFPEADADHLAVQQKAVITLADKPGETFAATLVVVDPVGTSDGTLTTFGVVLAFADAPKDLLVGQSAQVRVTTGSRAAVLRVPSTAVHDVAGTSGTVQKNGAEVSVRIGLRGDRYTEITSGLVEGDPVSRSW

SEQ ID NO: 8172 - protein, 240 aa, Actinoplanes utahensis
MTVGDASARATRVLVVDDEPNISALLSATLRLVAFDVRVAETGHAALVAVSEFEPDLIVLDVMLPDVDGFEVARRLRAAGSRTPVLFLTARDAVEDRIVGLSAGADDYVTKPFSLEEVVLRIRAILRRSRPEEPKPDTGVLRYADLELAEDAHEVRRAGRLIELSPTEFNLLRYLMINAGRVVSKAQILDRVWKYDFGGDGRIVESYVYYLRRKIDRTEPALIHTVRGVGYALRLPREGE

SEQ ID NO: 8173 - protein, 499 aa, Actinoplanes utahensis
MGVTLRWRHWTLQSRLALVVGVLAAIALLAANVAGVVLIRGYLLDRIDRQLTGMARPMEFATPPSGGFVARRGFRIGPEQVSYLFAADGTLDTENSSTADPGKPAVPTFEQVRTRAATRLPYTVTSADGTDWRLFALPVGTSGRYVLFGSSLDEVRQTTGKLITIDAGVLLLILGLLGLGAAFVVRVGLRPLTEMEHAAADISGGDLSLRVPGADPHTEPGRLGLALNSMLTRIETEVTARTASEQRLRQFVADASHELRTPLTSIRGFAELYRRGGAPPGPRLDETMSRIEAEAGRMGVLVEDLLMLARMDRQRTLDLRPVDLLEIAADTIRDARARVPERPVLLSGLSDDADTFEPATVLGDDHGLRQVATNLVANALNHTPAGTRVTVRVGHTVAGPADEAAACSGSITFRDGLPLAVLEVEDDGPGVPDEHAARIFERLYRADASRNRGKGGGSGLGLAIVAAIVHGHGGWVELHHTPGGGATFRVLLPSIGDAP

SEQ ID NO: 8174 - protein, 409 aa, Actinoplanes utahensis
MKVRLSRHPSLVVNAVIGVVLVAGAITVYETFSSSDAGATAAAASDRTVSVQQGTVTRTVTADGTVESASTASASFETSGTVTEIDVKVGDRVRKGQVLAKVDPAAAKRALAEAQANLDAANDAWDRAQTAGSDTTDAENSVTTAKLAVTDAAAGVAGTTLKAPMAGTVTSVAGTVGSSAAGTGSSSSSSSQGGGGSPGGGGTTSSSSSSSAGFVEIADLSRMQVSASFAEADATRLKEKQAGTVTWNALSGTSETAEVTAIDPAGTTSNSVVTYGVTLTLDRVPAGAKVGQTVSVVVTTGSRANVLMVNSAAITTVGNRHTVTVVANGVTETRPVEIGLEGDSATEITSGLAAGEQVTVKITSTSAGSGNQGGFPGGGAGFPGGGGNFGGGGNFGGGIGARAGGGAGR

SEQ ID NO: 8175 - protein, 284 aa, Actinoplanes utahensis
MSRPVLEVQNLKKIYGTGEATVHALRGVSMTVHRGDYVAIMGSSGSGKSTLMNILGALDIPTVGSYKLDGVEVGTLSDAQLALARNRLIGFIFQAFNLIPRATAVANVELPLAYAGVKSGERRRRAMAALDIVGLADRADHEPNQLSGGQQQRVAVARALVTEPALLLADEPTGNLDSRSTDDVLQVFDDLSAAGRTIVIITHEDEVGARAKRLVRLVDGAIVTDVRQSPIDLPPVGAVAAHAGVRGVAAGHPPAGQAVAARANGTATTYGRPAADRSGGRHTA

SEQ ID NO: 8176 - protein, 413 aa, Actinoplanes utahensis
MNFFEVVRFSLRGLSANKLRSSLTMLGILIGVAAVILLVAVGNGSAKAISDRIEALGTDTITVMSTGRGGSSSTALTRPMADALVNSELAPDIKSVSPVVSASSATMTYEGTDHSVSTFVGTVPTWFGASSTPVEKGAAFTADDVAQGRRVVVIGQTVAEELFPGVDPIDRQVTVSGALFTVIGVLKEKSSTGFQDANDTAVAPLTAVQQVLSGYGALTSIIVEANDPGRVNLVQSEVATILDQKLGVKSSTTARTSGGRTNGTGSGTPYRIQNASSLLETQTATADTFTTLLGAVAAISLLVGGIGITNIMLVTVTERTREIGIRKALGAPRRVILTQFLIEATLLSVLGGALGVAAALIGSHFTIVGVKPVIVPSSIGLAVGVSIAIGLFFGGLPAARAARLRPIDALRYE

SEQ ID NO: 8177 - protein, 198 aa, Actinoplanes utahensis
MNRMNDETAVLPTIPAPDADPAGPGDDDNEGLAEELAAAAPRQWWNRGTIGLGAAVLLMGGFLGGVYAQREWGPKTNATSGFPGPGGRFPGGLSASGFPGGGFGQGGTGRGGTGTGGTGTAAAAADTTGTVKLVSGTTIYVQTADGTVVTVNTDGKTTVSAAKKAKLADVKAGDAITVRGEAGTDGAVAATSVITQHK

SEQ ID NO: 8178 - protein, 130 aa, Actinoplanes utahensis
MWPAAGAKRSHTGVDGGVPRTLPGALLATPQPRSASGHGLGGGALGRDSPILFGRAGLLAEIDVRLAVGGGVALCGPPGIGRTALLDAVAEQAVARGELLLRLRPARGERTLAYAGVADLVRQVPPDLAS

SEQ ID NO: 8179 - protein, 519 aa, Actinoplanes utahensis
MAAERLDWLVTAARTALTGGAPALAGRAAEAVIAADAPAGHRVRARVVLIDLAGQALGEMGEMFAAALAEAGDDPALLAPVRLRLTWQAMITGEPDRAAAEAVATAEIAHRAGDATSEAMALSGLAQIQRMRGEPRWRESLARALALPAFPAPDWLHYGPHYMAARFALIDDRLDEARAELLRLLAVAEHDRIGEARVEVLRSLSEVATRAGRCREALRYAHRAVQAAQEAGLSPGPTWYTAAVAELAGGSLPAAAGFAQRGIRASEQEGDNLYLRRNLHALGQAGLRSGDTRAGVAALRRLRDLEAEAGNSDPMIVRWHADLAAGLAALGEHVEAAETLARARKAAEQLGSTPALAGYLDRATAIVQSESGQAESAVELSTAAAQLFEQLRQPVEQGHALLVAGGAERRRRRYAAARLLIGAALAIFMNADARPWAEETERALARTEGSLAPEQGLTSTELRIAVMVRDGASNREIASRLYLSVKTVEATLTRVYRKLGVRSRTQLSSRLQVLEGDPT

SEQ ID NO: 8180 - protein, 79 aa, Actinoplanes utahensis
MPTLRQIRVALAHRLAERRAHRRLSEELAAFRTAAERTELDLVLGRHTAEETRAIEAILSRQDAERRSLGGSPATGVVR

SEQ ID NO: 8181 - protein, 333 aa, Actinoplanes utahensis
MLEVTALGWTLTIGVIVALLALDLTLGVVRPHVVGFREAAGWSIFYIGVAVAFGLVFASVAGWGYGTEYFAGYIVEKSLSVDNLFVFVIIMSTFAVPERYQQEVLTFGIIIALVLRVAFIALGATLLNLFSFMFLIFGLILIYTAVQLYRHRDQDPSIEDNALVRAGRRLLPVTDDYVEGKMITRVGGKRMVTPLLLVLLAIGSTDILFALDSIPAVFGVTEQAYIVFVANAFALLGLRALFFLVKGLLDRLVYLSTGLAVILAFIGVKLVLHWAHKAISHAVPEVGTPVSLAVIIGILVITTVASLARSRRDPALKAHAGSLKAHPEQEPRR

SEQ ID NO: 8182 - protein, 253 aa, Actinoplanes utahensis
MPALFLSHGAPPLVDDPTWVAQLRDLAAALPRPKAVLMASAHWESAPLMLSATETVPLVYDFDGFAQRYYEVQYRAPGAPVLADRVAALMPDGETVARTRRGLDHGAYVPLTVMYPEADIPVLQMSLPTLEPDRLLELGARLAPLRDEGVLIVGSGFTTHGLPFLRDWRPDAAAPGWSREFDAWAAETLARGAVDELADFRSAAPGMPYAHPTIEHFAPMFLTLGASGAPEQAPEQPIDGFWMGLAKRSFVSA

SEQ ID NO: 8183 - protein, 219 aa, Actinoplanes utahensis
MAPPQLPPADDLYLTAHDASSGRPLLGSAALGLGLGAALLGELILWRRIDLISAGLVVTDKRPTGDTATTALLERILREADRRGLRDWLARLATGSATDLVGRRLARGGLIRRVERRGLLGTRSSFVPADAMTAAWPATRIRTKVAGSEPLNVPDLLVSGLIRATGLDRQVLAALTARDRDRLSEQSRRDLPAELQQLVAQVEAAVVVAPFRPMWRPGS

SEQ ID NO: 8184 - protein, 348 aa, Actinoplanes utahensis
MSAHEVLTMGRIGVDLYPEQLGTPLAQVRTFAKSLGGSPTNVAVAAARLGRRAAVITRVGADPFGSYLRDALRRFGVDDRFVGVVEHLPTPVTFCEIFPPDRFPLYFYRYPRAPDLEISPYDVDLAAVRAATIFWVTGTGLSAAPSREATLAALRARGRTGVTVFDLDWRPMLWASPEEARPWYLEALRYATVAIGNVDEVAIAVGGIGGVVAASDGVGGAATAGGDDDLLGRLLATGVELAVLKQGPAGVRAATRTETTYAPAIEVDVVNGLGAGDAFGGALCHGLLAGWPLAETIRFANAAGALVASRLACADAMPTAAEVHELLAAGRAPARLSESPDLPDVDHG

SEQ ID NO: 8185 - protein, 296 aa, Actinoplanes utahensis
MSIMAEARANPVVPRGSTADRPYDVVVSPENAGWAHSGLRVVQLPVGGRVTFVTGSDEMLVLPLSGGCDVACDDERLTLTGRRSVFSRVTDFAYLPRDAAVTLRAPNGGRFALPAARARRQLPFRYGAAEDVPVELRGAGSASRQVNNFCTPESFEADALIAVEVLTPGGNWSSYPPHRHDTLEEIYYYEVATSPSGRPGCGYQRVYGDQDRPIDVCAEVRTGDVVLIPYGWHGPSMAAPGYDLYYLNVMAGPGERRWLITDDPAHGWVREAWAVQAVDPRLPLTTDRELLTRRRT

SEQ ID NO: 8186 - protein, 623 aa, Actinoplanes utahensis
MKHRLTVAQAAVRFLANQFTERDGIRERAVAGFLGIFGHGNVAGIGQALVQAHRTGSPSMPYRLARNEQAMVHTAVGYARMRNRLSTMACTASIGPGSTNMLTGAALATISRIPVLLLPSDVFATRVATPVLQELEDPRAGDVSVNDAFRPLSKFFDRVWRPEQLPAALLGAMRVLTDPAETGAVTVCLPQDVQIEAYEWPDDLFAERVWHITRPVPDPLSVERAAAVIRGARRPLIVAGGGVIYSEASAQLDRFARETGIPVADTQAGKGALSWDHPNEVGGIGATGSPVANRLAGHADVVIGIGTRYSDFTTASRTAFRHPHVRFVNLNVTSFDAGKLAALPLVADARAGLQALRPALHGRRFTDEFQEDVAGWNAVVAAHLRPGGGLPTQAQVIGVVNDACGARDVVVQAAGSLPGDLQRLWRSRDPKQYQVEYGYSCMGFEIAGALGIKLADPSREVFALVGDGSYLMMAQEIVTAIAEGVKLIVILVQNHGFASIGALSEQVGSQRFGTSYRYRSPQTGDYDGALLPVDLALNAESLGAAVIRCRTTADLAEGLKRAREHDHLTLLHIETDPLAAAPSSEAWWDVPVAEVATLHSTRHARAAYLEAKRDQRPHLRPGD

SEQ ID NO: 8187 - protein, 301 aa, Actinoplanes utahensis
MSPVRRLRLGSCPDSWGVWYAADPRQIPWSRFLDELTEAGYRWLELGPHGYLPTDPAQLADELAARGLSCAAGTVGGVGGPHRDFPAVVAGTRRVAALTRAVGGRDVVFVPVPGYRDDATGGYLEPATLGAGQWRALLDNTNTLGRIVTEEYGLNLRFHPHADYQVENQSQIERFLDGTDPRFVSLCLDTGHLAYRRADILSLIAAYPSRIGYVHLKQMDPDIALRAEAEDLAFAQAVALGVSVAPPRGTPDVPTVLSALAALDADLFVVVEQDMYPVDFDVPLPIATRTRRYLEETGDFA

SEQ ID NO: 8188 - protein, 326 aa, Actinoplanes utahensis
MRKRLLAAGTATVLALAACSGGGRDKSAADTSGAGGNAPGSSGYTIAFVTHETPGDTFWDKVRAGAVQAAKDEGVTLKYSNDPDAGKQAQLIQSAVDAKVNGIATTLVTPDALAGAVKSATTAGIPVVGLNAGIDQYQKLGALMYFGSDESLAGTSLGKRIAGEGAKHPLCVIHQTGSVALEARCAGVKSAVPATENLQVNGADDSAVTTTLQAKLAQDKSIDYIVTLGAPVALDAINAKQQASSEAKLVTFDLNQEMAKRIKNGEVEFAIDQQPYVQGYMAVTSLYLYLKNGNDIGGGRPVLTGPSFVDQTNIDKILPFTEKNTR

SEQ ID NO: 8189 - protein, 463 aa, Actinoplanes utahensis
MTPPTPPGTPDPAKTADPAGTRDLTDHAHHLTDPAHHLTHPAHHLTGSADSARQPADSARQPVGSARHATALGSQPEPARGTTRSRARRAARLLARPEVGALAAAVVIFLFFLVVAPSFRSTAAFFTVLYQSSTIGIVAVGVGLLMIGGEFDLSAGVITTSAGLVNSMFCWYFGVNLWVGAALSLAFCLLVGFLNGWLVTRTGIPSFLITLGTFFVLQGANLGVTKLVTGSVSSRDITAIDGFASLQKLFASSITIDFATIWITVVWWALFVALAAWTLQRTRIGNWIYAVGGSAGSARAVGVPVTRTKIGLFMTVSFLGWFIGMHSLYRFNTLQAGNGVGNEFLYIIAAVVGGTLLTGGFGNAVGAAIGAFIFGMTSLGIVYAGWDPNWFKAFLGVMLLLAVLVNTYVKRLATSTASFSSTADTPPPRDRASTSARPPVLAGAPPSSDPASPSARVAAQEED

SEQ ID NO: 8190 - protein, 273 aa, Actinoplanes utahensis
MTDTLADHADRGLRRGELLIELTGVGKTYGAIRALLDIDLRVRAGEVTCVLGDNGAGKSTLIKIISGLHPHTSGSLKVDGAARFLGSPRDALDLGIATVYQDLAVVPLMEVWRNFFLGSEIVSGRFPLAGMRVREMRRIADRELRKMGIAVADINQPIGTLSGGQRQCVAIARAVYFGARVLILDEPTAALGVKQSGVVLKYIAAARDAGLGVILITHNPQHAYLVGDHFVILQRGVAILDAGRGSVTLEELTTQMAGGDELAELSRELERRS

SEQ ID NO: 8191 - protein, 341 aa, Actinoplanes utahensis
MTALAAVRVGVIGTGLIGRDHIRRMATGMSAISVVAVADVDLVLASRVAASVGAEVFTDGLDLIASPRVDAVVICSWGRTHERYVLAAIAAGKPVFCEKPLATSQHACLRIVEAEVAHGSRLVQVGYMRRYDPAYRAVKRVLDSGVIGAPLMMHCAHRNAGVPSFYEPENTITDTAVHEIDMVRWMFGAEVTAVRVLRPRASRNAGVLPDPSLLLLELANEVLVDVEISVNARYGYDIRGEILGEDGTVSLGDPGLIAVRRAGRLASPVPEDWRERFGPAYDIELREWADSLVGGGEAGGPGAWDGYAASVVSDAAVRALRTAERIPVSLVDRPKLYALSG

SEQ ID NO: 8192 - protein, 237 aa, Actinoplanes utahensis
MFTNHSVGNSSPRLTLLVRSDIFRSMDTAQPAPRRRGRPGHDVDAVLAAAVRLFNAHGYDATSMFDVAETLGITKSTLYHHVSSKEQLLGMAVDRAVDGLFEAAEQVRDAPASATVRLEALVRSSVLVLAERLEFVTLLLRVRGNTAVEQHALARRREFDALVTELVKQAQAEGGVRADVDPATAARLLFGMVNSLVEWYRPDRGRPGALADTVVRLAFDGLRTIDTTDDQHVQDEQ

SEQ ID NO: 8193 - protein, 561 aa, Actinoplanes utahensis
MTTPADLYATHRELLERAIEAASARDYWSAYPESPSKSVYGEDAAPAGERAFAALLGNRFPIDVPGATGTVSTERSPFGIELGVSYPKADPLALVAAARATIPSWRAVGPQGRAGIAAEILRRINARIFEMAHAVQHTSGQAFVMAFQAGGAHAQDRALEAIAYALAATTRMPSTSSWAKPQRGGDPLSMTKTGTVVGRGVALVIGCTTFPTWNSYPGLFASLVTGNPVIVKPHPGAVLPLAITVQICREVLTEAGLNPDVVTLAVEEPGDGIAATLATHPDVRIVDFTGSSEFGDWLEANARQAVVYTEKAGLNTVLLDSTDDYRGLLRNLAFSLSLYSGQMCTTPQNLLIPRDGIDTEAGRRTPQEFGADLATALGKLLGDPKRAAGTLGAIVNDGVLARLTEAAGSPGVVHPSTEVTDEQFPGATIRTPVVLSLDAADDKTYTREWFGPVSFLITTDSTEHSLRVFTETVRAHGALTALVHSTSSEVLAAAREAALDAGVHLSENLTGGVFVNQTAAFSDLHGTGANPAATASLTDDYFVSGRFFTLQSRHHVPAATS

SEQ ID NO: 8194 - protein, 286 aa, Actinoplanes utahensis
MPDGYRQTLIRQIAQHAHSEIIGMQPEGDWITRAPTLRRKAILLAKVQDEAGHGLYLYSAAETLGADRGDLTRRLIEGRQKYSSIFNYPTLSFADVGVIGWLVDGAAICNQVPLCRSSYGPYARAMIRICKEESFHQRQGYELLMTMMGGTPAQRDMVQDAVNRWWWPSLMMFGPPDGDSPNSARSMAWKIKRHSNDELRQRFVDMSVPQAEALGVTLPDSELRWNADREHYDFGEPDWAELKRVITGDGPLNRQRIARRRQADTDGAWVREAAAAHAAKQTGSGR

SEQ ID NO: 8195 - protein, 391 aa, Actinoplanes utahensis
MYATSGRCSRCSCGPSAASTTCMSARCGPPTTGWLCSTRGICTPGATRGSASGSCSPTTWWPATPMTRRRISSRAPTRCIGIRRTTPSPTRCRTSEVTMAFDDAYGALTDHDDDARWAYGTGFTDPLAGVPAAFPDGVDRGDLATYCLMLGDDALIMSHRLQQWVTRAPELEDELALANIGLDLLGQARLLLTRAGEAGGGGHDEDALAYHRDPHEFRNVRLAERADGDFAQLTARLLVFATWRLALFDRLAASRDPMLAAIAAKGVKELTYHRDYAAQWVVRLGDGTPLSHDRMTAAMTGVLSAAGELFRPHEVEARLAADGVAVDPATLRAEFDMVLAEVLAAATIDAGSVTDDDEAAGQGRDGAHTTALGEILAEMQELARAVPGGTW

SEQ ID NO: 8196 - protein, 162 aa, Actinoplanes utahensis
MNAELVVGTVTDPELPMVTLAELGIVREVRQDGDGVVVTITPTYSGCPAMEAIRADIATALRRAGFGPVEVRTVLAPAWTTDWISESGRRKLAEAGIAPPGAAPRRAGGPIPLTLTPRSGAVPCPRCGSAETEAVAAFGATACRELRRCPACREPFEHMKEI

SEQ ID NO: 8197 - protein, 348 aa, Actinoplanes utahensis
MAISGFHTLRVAAVDRLCPDAVAVTLAVPPELTERFAFRPGQSLTVQRAGERRTYSICAPAGGAPRIGVREVPGGRISGWIVHDLRVGDELEVAPPSGTFTPDLTAGGRHVLIAAGSGITPMLSIAASLLRRPDAEVVLLYGNRRTDTVMFAEELADLKDRYPARLELVHVLSREPREADLFSGRLDAARLRALLPLLIDVPAVDHWWLCGPFGMVVDATEVLSEAGVAPERIHRELFWADEAPPEPVRPEPESRGPSSEITVHLDGRATTVTVEQGVTLLDGVQRARPDLPFACKGGVCGTCRARVIEGDVAMRRNFALEDAELAAGFVLTCQSTATSPKVVVDFDE

SEQ ID NO: 8198 - protein, 200 aa, Actinoplanes utahensis
MEVFDQLAEKYQGEHSHNPYQSALIEKIGTLLPAGTSVLDLGCGTGVPTARVLTESDHRVVGVDIAEGMLRLAREQVPAAEFVHANFAELPADFGRFEAVTAFFSLLMLSKADIERTLDKIAGWLQPGGYFAIGMVNFDADSIPIEFMGVPVTVSGYLEPDLRAVLEKHGFEVATIETVFFTPTDGPQESQIFALAKLRP

SEQ ID NO: 8199 - protein, 94 aa, Actinoplanes utahensis
MTARGMLTMVGTAVGGLIGWPESTPSADPASLRTLFADFGVTVGPEPADLTQAVLAFQARVGLDTDGTAGPETVHLLARYAAEARELNEFRRAA

SEQ ID NO: 8200 - protein, 113 aa, Actinoplanes utahensis
MNSGRIACSIGFVMLVLGSTAGCSHSDAVWVQGRAHPAASAPPPADNQDRFVAAVRQELPELAVDRRDEEIADLGSTACASAHGQEHDDLAAYGVSPEQARKLTDVARAALCP

SEQ ID NO: 8201 - protein, 333 aa, Actinoplanes utahensis
MGVAGGPAAPWWRQGRWRTAKSQTAHRFGTISGNTVKNMTEPLNRSAAEHHHVPSSFYPPVTHIPPAMVRTPADPRWKRRIAGGAAVLVLVLVGGGSSAGAFLTEQYLNGRPATASSISGTTVASTTITEGDELAPIVAKVRPSVVTVLVDGARESSLGSGVVVSADGLILTNHHVISSNGTVSVRLSTGTTVPAKVVAADPTHDLALVQATGVSGLTPVTFATDDSVAVGDTVLAFGAPLGLEGTVTSGIVSAFGRSLDTGAEKLSGLLQTDAPINEGNSGGALVDTAGRVIGINVAIATSGDSTGSVGLGFAIPADTVTGVVRQLQTRAAG

SEQ ID NO: 8202 - protein, 1162 aa, Actinoplanes utahensis
MRLLRDLWVTSRSRTALAVFLIVLGAAGSSVALALAGSVLVDRSVLLFTVLAGALGAIVLSDVVVGLIAARLTADWAAEVRRGLNRVAFGQDIPTLENTPVGELLDRIDSDVYQVASELRGSGVRIAQSLAVATLSIVTAFFVWWPAGLAMIAVAVLIFITMNKPIQRISAIRIAEEEAWSDLAAVMEEAIHGQDDVRTSLAAPYVLRLYADRAREVLSRGRRVWRTSSRVTMGAGTITRTLIASLVVVGAWALATGHIDGARLTGVWLLALGFGGTLEQITRMVPELQNALGAWGRVQMLRAVPQEPSGGRAPADGDLIVRDLTFRYGEADSGRPPALRGVTLTFARGRSYTLIGRTGSGKSTLAKVLTRAVDVPPGTVFLGGVDLNDLDVEGLRRWTAIVPQRTEILAGTLAENIALFDEDLLPRAGAALDELGLSSWVAGLPDGIGTRLGEGGYKLSAGQEQLVAFARILVRDPQVVILDEATARMDPVTESWVQQATDRLLRGRIGVIVAHRLSSVQRCDEVVVLADGEVLEAGPLRESRRFAELMASSNLTVPAPARDRSGGVLVEERHDWDAAVRLELGPDALSNPLPTVEPPPLPTPPRTRTMREIVRLATNDARYGLGAVSLFVFLVVFGLDGAVLPVLWSRVVDGVGNPMLPAVGIAACLIALIPTLYFTGAWFPEWWVRQMLRISLRLVHGQIGPRRVSKHTPAEVVAQGGDTERVVMLADNLIDNGVALVVVVAMTLTSRSPVPALFFVGTMLLSGLAATLFGPRLEQAARRTVGARAAFATALVSALSAARTVKLAGATEPVLAHLAKLDARRSELQWREIAIQVWARSTPSIASGLLPIGVWSLYLTDRLSAAATLVAVATLGSARWFAWTTASLVSHFPSARVWTARTVAMTGSAEYTAEIPGVDISAGTAPAPAAAARNPLRTLQLRGFSAVHENGAQGVRDIDLTVDRGDLVLVVGPVGSGKSSLLRALAGIVHHTGDLCWNGEPVNEPELFLRPNQVGYVAQLPRVLSGTVADNIRLGHEVDAEDAVTVAQLRHDLSAAGGGLQLLIGHKGTRLSGGQLQRLALARALAPRTELLIADDVSSALDVTTELELWRALRSHGVTVVGSTSKRAALAQADRVVVLIGGKAEDQGTWAELEDRWGHLAG

SEQ ID NO: 8203 - protein, 397 aa, Actinoplanes utahensis
MLVCMSVEEAAVAARPRRRRAGARFGVILVAVLALLFGVPWATLLWSGNAWPAPVRIAGTVVFVLVAAAFPVLMFRGHGRRDDRSSRIADTTLGVVWVLFTWSVLGQLLGLVLALAGVADPIRSRLVTGLVLAISAVLLLWGHREAMRVSRVRAVDVTISRLGRGLDGLRVVLITDTHYGPIDRSRWSRGVIDVVNSLRPDIVAHTGDIADGEVPQRLAQAAPLGDVRASMARVYVTGNHEYMSGAAGWVEYMSSLGWDALHNRHLVVTRGGDSLVVAGVDDRTAAGSGVPGHHADHEAALAGADPTLPVLLLAHQPQQIDGAVAHGIDLQLSGHTHGGQMWPFHYLVRIDQPVLQGLSRHGDRTQLYTSRGTGFWGPPFRIFAPSEITVLTLRSAE

SEQ ID NO: 8204 - protein, 217 aa, Actinoplanes utahensis
MESTFPELVDRARGLVAGGRRAVLGITGPPGAGKTTLAESLLAALGPGDEVAHVPMDGFHLADVELERLGRRDRKGAPDTFDGWGYASVLRRILADQDEMVYAPGFERVLEQPIAGTIGVSRAARLVITEGNYLLLEDGRWAGLSGVFSEVWYADLEPAERLRRLVARHVRFGKSPEDALTWATGTDERNAELIATTRDRADLVVPSALLRTLGRVS

SEQ ID NO: 8205 - protein, 217 aa, Actinoplanes utahensis
MFRLIQLHTEAGVPQIGVDPDGYVSARAALARYRTAPATYFAVGRFDHEGTLTEVILDPSCGLDGACQRPASVIHAKTYQRLCEGCAAGMDVLTVPQLARRLGIACRLAPPISRLRQNTLGGLRSPAGNRIAREFADHVHDPAWRAELCGELGQTPIALNGLLIGAGALSHRQVLDLYPVLCALGDELPAGVRDDLARATARPLSPAGVAGLRLGLG

SEQ ID NO: 8206 - protein, 57 aa, Actinoplanes utahensis
MLVGVRTGQGVACVCGHPFEAHQHYRAGTECVICAPRECARFRRTRWWRRWTAGRAV

SEQ ID NO: 8207 - protein, 317 aa, Actinoplanes utahensis
MALPDFLIAGVPKAGTTALHAALVHHPDLFLSPVKEPKFFLSDGPPPRHGGPGDVQTYQEHVWRREDYEALFAPAPAGARLGEATPFYLHDLGAHDRIKAVRPDVRLILLLRDPVDRAHSNWTHLWNAGLEPEADFLAACRAEPARIEAGWAQFWHYLGLGLYGRQLEHLYQRFPREQVLLLRYKELKDAPAATLDRVCAFLGVRTGLLTAIPKENVNRHVVEDNGLNRVLRGLLRAGGGFGQHFPVPLRLAARGPLLTLLHRKKGARPVTTPAERAELLPYFAEDIALLQDITGERYDDWLSVDRHARAPETPPVQ

SEQ ID NO: 8208 - protein, 303 aa, Actinoplanes utahensis
MSVGTTALPLPRWEDSTVVVEPPGTEPGAWSGAPSAIAADGHIYLAYRVRLPIGAGRGIANVIARSADGLAFTVVAEVGKDRFAAESLERPALVRTPQGRWRLYVSAATPGTKHWRIEMVEADTPEGLAAAPARTVLAGDAEFGWKDPVLHHDGHGWHLWASVHPLESWDDADRMTTEYATSPDGVHWTRRRTALSGRAGRWDARGVRVSSVSVTGDDITVAYDGRATAGENWEERTGVARGRRLADGSFGELTAEDDEPVGSPHPPYGLRYVSLVDLPDGTRRLYYEATREDGAHDLRTERV

SEQ ID NO: 8209 - protein, 332 aa, Actinoplanes utahensis
MRTLGGRYRLEHRIGLGGMSEVWRGHDQVLDRPVAIKIMAPAVEGTLGQTGVDLIRAEARSAARLAHPNVAGVHDFGTSPAPGRRDVPYIVMELVEGQTLSQHLAGGRLDWRIGVRICAEVAAALAAAHAEQVVHRDIKPANVMLTPSGAKVLDFGIAAAVGAPEPDTGGMVMGTPAYVAPERFDGMPATPASDMFGLGSLLYHCLAGRVPWTTRSPTELIRAQRYHDPEPLPSLDGLPPEVLDLCFRCLRRDPAERPTALVAALLLAEAVDARVYVPMMEMKPVVPAWDRTAAEAATYAGPQEQAATYGGLQQQAATYAGPQEHAGRHRLD

SEQ ID NO: 8210 - protein, 469 aa, Actinoplanes utahensis
MARPGLFAIRDVGSLVQDTAEEGTELKKAVGVTQLTAMGVGAIIGTGIFVVIGKGSGIAGPAVVLSFVLAAVACVFSALSYAELASSIPVSGSAYTYTYATMGELVAWIIGWDLILEYGVSVAGIAIGWGGNLNAFLDAAFGVSLPDTIAKSPGEGGVVNLPAVFVVLAITLLLVRGVTESARANLVMVVVKLVVLIFFLVVAFANFSTRHFHPFAPHGTHGVTAAAAIIFFAYIGFDAVSTGSEEARNPSRDLPWAIIGSLAICTVFYVLTAIGALGIASPDQMKDSDAPLAAALDQGAGMSWAAGILALGAVVAITSVVLVIFFGQTRIFFAMCRDGLLPRRMATVHPRFGTPARITVTLGVLIAILAALVPLGTIVELVNIGTLFAFVLVNIGVIVLRRTRPEMPRPYRVPWSPVLPLIGVAFAVYLMSDLPGATWLRFGVWLVAGLIIYGLYGYRHSRVRLERAD

SEQ ID NO: 8211 - protein, 108 aa, Actinoplanes utahensis
MGEAVITTRRQADGALVVEVRGSLDAATVDGLRATLVDTVLRDRPAVVVVDLTYVTFMDSVGLGALVAGERTVRDIGGRFRLRNPSEFVHRQLRVTGLAELLGVSFGF

SEQ ID NO: 8212 - protein, 489 aa, Actinoplanes utahensis
MPSSRRSVVKAGVFGAVALGGGLSATRPTTSQVSATILENRFQGNKGWLPQENVNDAARQIQGFASATSVNKGDTIDFHVTLATPQHFTVQLFRLGHYRGVGGRLVHTSPNLSGSTRVVPTVDPVTGTVDCGDWPAAYSFKVPPGWVSGLYLAVFRTQDGHRSVTPFVVRDDSRRSDFVMVVPFTTYNAYNVWPADGRNGKSLYKGYRPDGLMGDATQRAYEVSFNRPFSGGGRPTWFDIDVATAQWMESQRYDVTYVSSIDLHEGRVDPSRHRALIFSGHDEYWTASMRDVVQKAITGNTHVAFLAANNLYWNIRIEADARGTSGRIVTCYKGAPDPAPDPIGETTLWRNLGTGQEHAEARLLGVQYRGILATPVPMVVQNTQHWLWAGTGLKDGDTIRDLVAVEADGFESDLPTDYESTQTLLSASPYTDRMGRGDRVQNTSVCETPNGTIMFVAGTFHWPLALVKSKVTDARIQRATKNLFDRFLR

SEQ ID NO: 8213 - protein, 421 aa, Actinoplanes utahensis
MQALRFAAALYQRQLAINYWGRVRRDPLSRLHLAEGRNDPYAVYDEVRAHGPLMPTRLGNYTTATHAVCNSVLRDRRFGPRAVEMNGPGAPGDQIDMSFLDKDPPDHTRLRRLAQPAFSPKQIAGYRPRVEQVVGDLLDAAAAKGTFDLVSEFAAPLPIAVISDLLGIPDADADAFAEHGAVVGSALDGVRSLRHAAALIAASNAMDDVFIRLFALRRREPADDAVSRILAAEGDQIQSHELLPMCRLLLVAGFETTVNLIGNAVNALLDHPDQWAALAADPAGLADAAVEETLRWDSPVQRTARCAREDVEVAGRTVRRGQFVVCLLGGANRDPAVYADADRFDIRRVPEADHLAFSSGIHYCVGAPLARLEAGVALRMLAERMPDLRRAGRLRRRDASIIRGPRSLLVAAGSRARPVSV

SEQ ID NO: 8214 - protein, 730 aa, Actinoplanes utahensis
MHLWERSPVIAAAAALLLVGASAPARADEVEQVVNGGFDGTSDPFWSTAGMPISLTDGRACVDVPGGTTNRWDAAIGQNDIDLVAGETYRFSFDASGDAGHVVRAITGLAVSPYDTYVEQSPVLGDLQHYEYTFKAAASTAQGQVAFQVGGSATPWHFCVDNVSLVGGVPPVVYKPDTGPRVRVNQVAYLPDGPKAATVVTAATTPLPWQLKNKKGKVVYEGDTTPRGVDPSSGQNVQTIDFSRWSAAGTGFTITADGETSRPFDIGRTAFRSLRADALKFYYTQRSGIEIRDDLRPGYARPAGHLGVAPNQGDGNVPCQAGVCDYRLDVTGGWYDAGDHGKYVVNGGITVWELLSEYEQSHDVRTVNLSIPESGDRTPDILDEVRWELEFLLKMQAPNGMVHHKVHDQAWTGLPLLPDQDPQPRELHPVSTAATLNLAAVAAQASRIWEKYDPAFAARTLAAARKAYTAAKTNPIALASPSDGTGGGTYDDAKVSDEFYWAAAELYLTTEEKQYRADVLASPENTADVFGAGAFDWGSTAAAGRLDLALIQNNLPGLGRIRKSVAQAADRYLAVQKAQPYGVGYAPANNVWDWGSNSIILNNLVVMSAAHQLTGKQKYRDGVLTGLDYVFGRNALNQSYVTGYGEVSSQNEHSRWYAHELDPSLPHPPNGTLAGGANSSIQDPLAQEKLTGCVAQFCYIDDIQSWSTNEEAINWNAALARVSGYVAELS

SEQ ID NO: 8215 - protein, 412 aa, Actinoplanes utahensis
MADVEHTIGMLLGTEDDWPRAFESLLRRLGTVAGPDGRSHRTRAVRVTIEPFNLRDQPKHDLVIDRLAYWYYHPREWLKKIALMDGVYLLNSPFTFQSMEKHAAYCAMMRLGLKVPETVLVPFKNPLDNSRWAYTAARYNNPFDLEATAASIGYPLYMKPYDGGAWVGVSKIRNAQELHAAYDASGERLMHLQASVEDYDVFARSLTIGPETMVMRFLPDQPMHARYQVDHHFLSDAAGDEVVTVSRLVNAFFRWEFNSCESLVRGDEVFPIDYANACPDVALTSLHYYFPWAMTALLRWSVFCVVTGRRMRLDTDTADYFAIADDPDRSYPEKLSGYRDLADRYFEIDRYREFCDTHLGAVDDIVYDWVTSEEFRSLLRETVRAMYPVHEHEKFLGHFGGLIDAWIRDQGR

SEQ ID NO: 8216 - protein, 227 aa, Actinoplanes utahensis
MGGGRWRTIRLPLPALHTSMTARVWSPAGDGDRLLIAHDGPEYESQTGLTARLPGCHVALLPPGELREDWYAASPAYARALALEIVPRLRARLGARPVVGAGASLGALAMLHAQRSFPAGFAGLFLQSGSFFQPRHDRQESGFAHWSRIVRYVRRVLTATRGPAVPVTLTCGSAEENLANNRDMADALDKQGYATTLAVVPGGHDWATWRTALDPHLTALLNQAWPE

SEQ ID NO: 8217 - protein, 266 aa, Actinoplanes utahensis
MAEIYRSAAAENERGEVLRRAGRPAEATEHFSRALAALLTSSDPDPATHAAILDNLALVAHERGDLAEAKRHLVRSLQVGPLVGDPVGRAITYDNLGVVEVELARAGHGRREAHLGEAERHFAAAERLFRSVLPDAVDDYLRSVLNRADAAELRGDLDRVDRLSRHAAEVAAHHAIAPENALEAVTMRGGFLHQRRNRPRVAVELLTARLPALLPGCPPASSMAALAVLLRAATATGDPVLIEDVTARITELGEPGTSKAKIMARR

SEQ ID NO: 8218 - protein, 144 aa, Actinoplanes utahensis
MRIRIEGRELPQTPELRLNNVHVGVQRRAEVVGRVPVTAGSAVWEMDVEVREVDGLIDVGGPWVHGSPGARFLYLSWGAVHDGEFAMFRRAKLLFGDVPGALLRGAVAGEGVLVGRLGLTDSAGDPLCARVRPPVIAWTLSPFS

SEQ ID NO: 8219 - protein, 547 aa, Actinoplanes utahensis
MRDPVLADLAVPVPVTPAGTPVGDVEAALRADPELLGVLTESGGELFLIDRAFLDLVLAGRLGYGRALLHRRPLRSLLRRPALVLPAATDWGDAARAAMERPDGSKAIPIVVALGDDTFGLAPVGPLVEHISRRYQAMALTDDLTGLGNRRSLMSRRAPAPGAAAMVIDLNRFKEINDTLGHTRGDELLRQVAVALSGACRPAEAFRLGGDEFVVFTPDLAVWPGLSPCEAGHRLLHAIQGPFPVGGVPVTVEASMGIAVVGPGDPRDLEDLVSRADSAMYAAKRDRTQVELWHGALAAGAIDLGLDTDLWAAIGNGELVLHYQPLVDAQTRATVSVEALVRWSHPRRGLLPPGVFLPQAERSDVIHMLTAAVLGDAVRQAATWHRAGRDVPVAVNLAAPVLSSDRVLTKIGELLDETGLPPRGLIVEVTESAVMTRPAESADRLRSLRAMGVGVAIDDFGTGNTSLGLLTQLPLSELKLDRSFVTRIHQPQDRVIIESVARMANGLGLTLVAEGVEDADTADTLTALGFDLLQGYHFGRPEPIMAA

SEQ ID NO: 8220 - protein, 344 aa, Actinoplanes utahensis
MRPGGHLSVAVDLRADRGHPSRITAHPRCPLPAHPPAAHPPAAHRPAAACPPVAGPAARRPLARPGLPDGRPRVGGCRVRMALSWVDGKVSEGRPRVVRVLKLLDDEPPVRVLHGFVSRDGTLSLWAETGVPIPIPAAARGVPWHPFALPPADLPAGERRDPALLTLPSTGAGPLPSPQVGLPPRRGARRARVWRVPAVEVPFLDADLAAEFDGRVAPSVRWLIELCGFAAGLVRRGRVLPGVRLDGPRPAACWRPILIGSDAARHATLLDRMPPACRAEATPGSESRPARQGDTAPTAASAADLCTAALERLVDVLVRTRLAEAGVTLTEPAIPPTGISALAS

SEQ ID NO: 8221 - protein, 779 aa, Actinoplanes utahensis
MQDGLGGVLAALSGEPWFSMPGDELDELVRALDAWFAQAARGAEVRVCFRLSDPREHEPVLPGEVPLPPDAWRLEFLLQAADEPSVLVPAADIWRDDFAPLRRWTLHPQERLLAGLGRAARLYPALGDALHQAHPVEMIVDTEGAHGFLSHAALLDEAGYGVLLPGWWRRRSGLGLALHVRSPEPITPVLRDRTTGLRDLVDYEWGLALGGRTLTEDDLADLAKAKVPLVRLRGRWVFLDPDKLAAGLAFLSRGGGTMTAGDALRVTRLLPPEGLPLPVTDARGEGWLGDLLSGELEQRLALIEPPAGLGTVLRSYQIRGFSWLVFMDSLGLGACLADDMGLGKTVQLLTLLLHRRDGPALLVCPLSVLGNWQREAARFAPGLRVRVLHGADRDDPAALADGADLVLTTYATAVRDADALAAITWDRVVLDEAQHIKNSAGAAARAVRRFPARNRIALTGTPVENRLAELWSILDFVNPGLLASAHTFRARFAVPIERYEDEEAAARLRQATRPFLLRRTKADPGIAGELPSKRHVRHLCGMTTEQVTLYRAVLDELLERLAEPGETRRKGLVLAAMTKLKQVCVHPALLLKDASPLPGRSGKIERLEEIVDRALAGGESVLCFTQFARFGGMLAPHLAARFGVPVPFLHGGTPRGARDAMVAEFQRAERPGVFVLSLKAGGTGLNLTAANHVIHVDRWWNPATETQASDRAFRLGQRRDVHVHTLVCLGTLEERIDQLLTDKGVLAERVVGSGEGWLTALSTSELRDLFALAPEAIID

SEQ ID NO: 8222 - protein, 267 aa, Actinoplanes utahensis
MSDFAPAFLGMFESLRMGPTFARGRRDERAGHVRSLTVSSSLAVALVRGPDDPSAFRSRIAVRAFGAAEWARVESALVSQARFVAGLLDGRMPPGVEAVFADAGLTLLPLSLDEVAMDCTCERWPMPCVHLAATCYALARMFEADPFEVFAWRGRHRDELLMRLRRLREAAAVNASDVADAAKTATQAENPVEPEPPLIDPDDLETFWGRSLDLGESPVQEPSGGRPDALLDQLDPPRIGYQGRPLTDILRPAFRALADTEGVGRSA

SEQ ID NO: 8223 - protein, 248 aa, Actinoplanes utahensis
MNKAQRFFALAGMGVAAGALIGMGPAQAASAAGTPVSAGGAAKHASDWGDDHVIGYYRTEWSCERAGFTGRRYGAWDDYSCDPIDYGWRGWVFRLVVDQDDWRWSDWRGDWPGGWPYRPDYRGGSFHIRAIHDHSGPHGWPDRNDHRGWPDRNDHRGWPDRGGNDDRNGDRGWPDRGGNDNRGGNDNRGGNDNRGGNDNRGGNDNRGGNDNRGGNDNRGGNDNRGGNDDRGGNDNHGGNDNQHHWPRP

SEQ ID NO: 8224 - protein, 469 aa, Actinoplanes utahensis
MTGSDPTVGVDPDRLAVCLGVLAEVEGLPPEHPDAVRVRRATAALFKTVKLQRRKDRRQAVLDNDRAVTAATATGAPGRIDDETAGIPLKSQTVGATAGVLKQARGCYVCKQRYTMVDAFYHQLCPDCAKLNHERRDARTDLTGRRALLTGGRAKIGMYIALRLLRDGADLTITTRFPHDAVRRFTAMPDSADWLHRLRVVGIDLRDPAQVVGLAESVAARGPLDILINNAAQTVRRTAGAYAAIAAAEAEALPGGRLPELEYFGSAGSSPAAVLTAGAQHLTPQQITELALTARSVAIDAGGLVPDTTATNSWSDRVHEVDPLELLEVQLCNVTAPFILVSRLRPAMTASSFPRRYVVNVSAMEGIFARGYKGAGHPHTNMAKAALNMLTRTSAVDMFADGILMTSVDTGWITDERPHPTKMRLHEEGFHAPLDLVDGAARVYDPIVRGEQGEDVYGCFLKDYAPVAW

SEQ ID NO: 8225 - protein, 1820 aa, Actinoplanes utahensis
MFAGWGSRVARLRWPVLLATLVAVLGAGIWGMGVFGQLTEGGYADPASESARAAEVVADEAGGPGGDVIAIYTPARGIGIDDAGLTGRIRERLAGLPSNTVTATSSYWDRKSAAYAAKDRSSAVAVISLAGADDAAKTEAFAGIADDFAVSGATVRLAGAVPLAHTSNQRSTDDLGKAELISMPIVLILLLFIFGSLVAATLPVIVGGCAVLGSLGVLNAISHGHDVNSFAVNVASLLGLGMAIDYGLFMVGRFREEQAAGHDPAEAVRRTVGTAGRTVVFSATLLMTALAGLLLFPQGFLKSLAYGGLAAVFLAMLLSLTLLPAILAILGPRVDKLPVRLPGAQRTGDGWGRLARFVLRRPVLVAIPILAGLIVLALPIGGVRFGENDERVLPAGDPARVAIETLKTSYPQFSGDGVQVVVRGPAAAAKPFAAQLAKIPGVASVGPAGAGKDLTVYNAALQSTDSFSAPARRVVDDIRALQPPPGTTVLVGGVTARNVDSLAAIGNRLPLMIGLLTGATLLLMFLAFGSVLLPIKAVVMSGLSLSATFGLLVWLFQQGHGAGLLGVTPAPLEAGIVVLMAAVVFGLSTDYEVFLLSRMVEARTRGASTAEAVTIGLSRTGRVITAAALLLIVVTGAFALSSITTMRFVGVGMITALILDATVVRMLLVPAVLALLGNAAWWAPGPLRRLQERAGLAEHDPLPAVAEPRTEVLDYTAVAAHLGAGRDAETAVIPRVRDNDETTTLPTISDDTAVLPAVRGDNEADAGPEADIDADADPEADETTTPPAIHDAETDPHAAPGDGTDPGAADAESTGPAANRTADTAVFPAVTDGETATLPAARDDATGSVAVTDTEASGLTADGDESLVVAPDETSILVWDPAAGETAPASDLTDSGDISDSGGMADSGDLVDADDAGTDTASHADTGAAFHADTGAASHVDAVPDTDAASNADIAFDAGAARDAGAASDAGAGSEAGAGSDVAAAFDGSAVSDLETGALADPSARDALSDAPDSRGLTATAKHEAASTPPPAAASAPDATSTSFSPSNSTDSRAGTTGFSAWTKSRPADAASRELAGSGAFDVTQVMPILSPHLLRSRSTTTPTPVAPESDSTQPADHPSGPSEGIPAPDPVSADPVSADPVSADSASTDAALSNPTSSEAASSDARAGDATFPGADLSGPASSRPGSSDAAFSESTGLAEPADPLDSSSLWAQVEATLAADARTAASGSAETPAAEASHQAPAPQGMAPEPREQGSETPEPAGKIISSDLMSDTGKVVTGPEPTAAAATSAAEVPAVAPIIAPETDADTTAPAADVAEMAPVTAIPAEVADAFTWMSDPRIAGIVSGGNESTETGSDFNWLTETREFPITPTSPEQPGALDFPVAKPARPATLGDLPNAPRRANPVSEDVAKAAEPQTESAVEAGSEPEGRTEPNTDPPDGPAEATPDAVPIGDVDANPGSADETATGDVAEASNDASPSVEADTDDAAEIGNETGSSVEDDVSAESPTSPKPEADAESRIEVRAPVDVGAAVDGGAVDGGAVDGGAGFDGDAGSADASGAGPAVETEMDPGSTVGSEVDAGSAAVTPADAGVGAGGQAAAGAGADSDGPGSGSAAEATVNAPGVGRRRPQTLDEWLHGSRPATTPVEVTPRVSPVDESQKRPAAVGDVAPVSAAPVSSVPMRRPQTLDEWLHGDPAQPRPQSLGDVTAGEVRPVSSAGPRPRSLGDLTAGQNRPVSSAGPRPQSLEDLAAGENRPIGSAGPRPGKATGQKPPAPARRPASLADHYPDRPRRPGSGPQQPAPESPAAPDRDNDPDPSAS

SEQ ID NO: 8226 - protein, 266 aa, Actinoplanes utahensis
MRRRRLQVPDVLLKPGSPRWRDHLGPAVVILIGVLLVVAVGVVAKLSHGDHPAADPVTGAVVEPTVEQVPIPLPSPSITESAPPVNAISVEEGSIPDTVDLSAEGTIDWVHWGEDGTYSLERSSSGGFAILEGTPDAPRRRHTLSPQRYVWSGGTPAPKNAGATSGVRTCGTGNGFTLSAPATPDQRTLRLYLGVAGATGTLRLKLTTGGETYTSALTRKAATLATTRYTINYRSTGPGKISVEWITGKTFDPDCGGVALEAATLH

SEQ ID NO: 8227 - protein, 188 aa, Actinoplanes utahensis
MSDRTTPSDKRRGQAIAGGVAGALVFVVLVVVFFVVRGGHDKQPAATSAAVQQDSAAAVAPPPAEASPAAGLPPELSHEPDVQPGTGGPLTELVALPLIVGTGPVVAAGQTITVNYKLIPYKGGAVMDSSWSRHEPFTTVIGAGQVIKGWDQGIPGQHVGSRIQLDVPAALAYKDQDLRFVVDILAAH

SEQ ID NO: 8228 - protein, 269 aa, Actinoplanes utahensis
MLILLPPSEGKTPATTGSPVDPDTLWLPALGAARRRVMTRLVAMCRRGSARSIADSLTVLGLSEGQRSEIARNAALPEAPAGPAAEIYTGVLYEALAPATLDDAARARLYETAVVFSGLWGVVRLGDRIPAYRCSVGVSLPAPVGGLTAYWKKQLSRALDPVAAGGPVLDLRSGAYAAMWSPPAATASRVAALRVLHERVVGGVAKRSVVSHFNKATKGRLVRALATEPVAPSSLDELITAMRDLKFTVEERPAPPGRPRQLDIVVAEL

SEQ ID NO: 8229 - protein, 156 aa, Actinoplanes utahensis
MDMADDEPLYTTREERQVWSQLACMVVSAAAYTAWVLPEVARHPVAGIHWVVPLFWATLAGLVCTVVVAVVLEIVVVVRRGAEAKSAVTVDVRDREIGRRGVRLATPVMGTGLAAVLVLAARGADDFWIGNVAFLTGLVAAVAESILKIRLYRRGF

SEQ ID NO: 8230 - protein, 73 aa, Actinoplanes utahensis
MAPKATRVTNRIRALRAAAGGMTQAGLAERLGVTRQTVIAIEQGRYSPSLELAFQIARIFEQPLDTVFQYDEG

SEQ ID NO: 8231 - protein, 327 aa, Actinoplanes utahensis
MAQPASVVTARLVRALGPARSRIRSAAANSWRRTSRRATPVGTDDPLPLSLAPQPTRSYSGHMPTQDLRQAAESFGIDAARYDRTRPPYPAELLDRILAATPGRAVLNAGCGTGIEARQLRERGCTVLGVEPDRRMADVARASGIPVEVARLEEWQPAGRSFDLVVAGTAWHWIDPVAGAAKAAQVLRPGGRLAPFWHTFRLPDELTAASAEVFARLAPDSPIRLPRQAPATPVEGYRPILTAAADGIRAAGGFTEPEQWQVDWEKAYTRDEWLDQLPTSGAFTRLPGDQLAAVCDAVGAAIDRLGGGFVMAYTSVAVTAVRTSPAR

SEQ ID NO: 8232 - protein, 539 aa, Actinoplanes utahensis
MLVLLLVLVGALLATPRAASAHAATVGSSPAPGSVVAASPAEVTVTFSETITPVSGHIQVVAPDGERISGLATARGAVLHIPVRAARHPLGTYLISYRVISADSHPVGGAITFSVGAPSARPQAAASTGIHPSVRFAVPAFRLLGYAGITLTIGPALLLALLWPRRRSRTGPIRTVRAGFALIALATLGALGTQAQQGSGAALWQVSAGELAEVAGSRFGLTLIARLALLAALYPLVQPLLRAGPAGRPRVAATLLLGAAGLATWPLTGHAVAAPLPVVTVTVGVVHLAAMAIWIGGLVTLLAFLLRGTDRRILGVLLPVWSRWAMLSVLWLAIAGAVQAVVQVGAVDALLHTGYGQVLLVKLGVLVLVLAAAAVARRLVGRSPEGRGLRRTVGIEVAATAVILALSAVLVQVNPGRTAGAEAGAVTGVGVSQTLTCPLYTLQFNIYPVELGEYNTVHAFLYTPEGKPLPPAEWQISTQLMGQGLEAVKEPLLGLEPPHHALGSVSFPLPGTYEIAFTIRVDDLNRATVKTTVTVPAKS

SEQ ID NO: 8233 - protein, 561 aa, Actinoplanes utahensis
MVRKGSRRPRLDTISRDSKEAKMSVHARAGRPAEASDLIDVPKVVSRYYTEHPDPAEVVQRVAFGTSGHRGSSLRTAFNEDHIAATSQAIVEYRRAQGVDGPLFMGRDTHALSEPAQITALSVFAANDVTVLIDSRDGYTPTPAVSHAILTYNRKNRAKADGVVVTPSHNPPDDGGFKYNPPNGGPADTDATRWIQDRANELIADGLKDVRRAHGRGDTYDFLGSYVDDLPAVIDIDAIRNAGVRIGADPLGGASVAYWGEIADRHRLDLTVVNPTVDPRFAFMTLDWDGKIRMDCSSPYAMASLIEQKDRFQIATGNDADADRHGIVTPDGGLMNPNHYLAVAIDYLFRSRDGWPGGAGIGKTLVSSSMIDRVAADLGRTLVEVPVGFKWFVPGLLDGSIGFGGEESAGASFLRRDGGAWSTDKDGILLDLLASEIIAVTQKTPSEHYRALTARFGEPAYARIDAPATREEKAVLGKLSPEQVTAKQLAGEPITAVLTSAPGNDAAIGGLKVVTGSGWFAARPSGTEDVYKIYAESFHGPEHLARIQEEARAVVSAALRG

SEQ ID NO: 8234 - protein, 766 aa, Actinoplanes utahensis
MSTRGTAAEQRRRGGLAPAAVALTASVAVVLWLALGAGNLYAGFTGGPIAMAAAAFACQRIAATVRLPPPVRSFWRQLQYAAFCLLAASVVTLFRSNNDTGLSPYVGLPMLVGILILMTAFLRLPFGTRTATGLVRALLDGATVAVASGLIFWYVVLDLAPAGTSLVARIVAAVIGVCGVLLLVVIGKAAAAPSSPVDPASLRVLTVAPVVAVTGTILLIAGSDRGRLILSVLAVPSVAVAMAVAAYLQRRARRTTTATAGRSLLSLLPFLAVTATAALVISVSAQQMSSRQRTVIIGAVLIAGFVVARQLLSLRENTIAMRGIRRQQAELERLALSDTLTGLPNRTRFAVALGDLIGEHRPASALLIDVDDFKMINDTLGPAAGDQLLFQVAERLRRHCLPGELPARLGGDEFAVLLPVDDPAEAEAAAARLLAGITEPFKVGDQQLLLHASVGIAIAATGETADEVQRNADIAMYAAKEAGKASWVRFEPRMRHDMVHHARLASELHNGIIRGELRLVYQPVFDLVTGRVAGAEALVRWQHPTRGFVSPADFIPVAERSGLIVPLGAWVLREACAQLARWRAQYGDDAIESINVNVAVRQLRETGFVDEVAAVLSEAGLTSRNLILEVTESSVVDGWQVRETLQALHEMGVMLALDDFGTGQSSLSLLRAFPVDVLKLDKSFVDGIADGADRGRLAVAAAVAQLAEYLQLKAVAEGIESAEQRDRLRDMGYRYGQGYHMAKPLPAEECGALMSAAPVPAAVRSA

SEQ ID NO: 8235 - protein, 402 aa, Actinoplanes utahensis
MSMDPADHPPTEPDHCVPLLTDRSLASPLPIGAADDPATGAAADAATSAAADAATGAAADAATGAAEDAATSAAGDPEPTGEWPLPGPDDFAEDDTDPHGFIPVSGAPYPPATDPFDDPAFTSAYPLPGWSAPPDPEPLPSALRQRRPMLLAIGAFVALAGLIGAFLLVRHDASGTRATVSEATAPTGMAAGPATEATGGTGPREVAGPRDGLAAASFEILDSATLVRVSAADLGADLFRVGTAAGSGLTPAVERSDGTVRLRLRSDGSGGSAAVTVQLSSAVRWTLRLDGGTAQTSLDLTGADLAALDLGGGASRIDLTLPAPHGLLPVRMSGGVDQFRVVLSRATPVRVRVQSGAGQITLGGATHRGIAPGRSFTTADWSGSTGVDLLAVAGLATLTVTG

SEQ ID NO: 8236 - protein, 364 aa, Actinoplanes utahensis
MSLRPRIGAPTSSRPRTGAPTSLRPRTGAPTSLRPRIGARLRRLLTPLVVLTLVAAPAGCGAEPAPDDPAGARAVVPLPENVQDPAPVPSAGPVPDCVPRASLRPDGPLPTAGRMPAGSPMAAIAARGRLIVGIDQNAYLFSFRDPKTGDLAGFEIDIARAVGRAIFGRDDAVQFQAITTADRIPVLQQKKVDLVVRTMSMTCERWQQVSFSTEYLTSHQRLLVRRGSGIREFSDLAGRKVCATRGSTSIRTIAEQPSKPIPVATDSTLDCLVMLQQGQVDAVSTIDVLLAGLAAQDPTTEVTGRFSSDEPSGIGIPKDEPDLVRFVNAVLARMRADGSWTRSYQRWLTPLGPPPAPPAAVYRD

SEQ ID NO: 8237 - protein, 416 aa, Actinoplanes utahensis
MPGLRRLATPDLYRLTAAALILLGIALGGTALATVHHRAALTRDITGVSGPLSVGAQELYRALSDADATAATAFLTGGAEPAALRQRYLDDLSRAGAALTTAARDAGDADAARIAVLTDRLPVYAGLVETARADNRMGIPLGGAYLREASALMRETLLPQAQGLFAAAQARLADAQRGAAGSSWQILVLGLLTVAGLTGAQTLVARRTNRVFNIGLLAASLAAVIALAWSAAALGVAANRVEAGRRDGSRLVSVLADARRAELQARADESLTLVARGGGAAFETDYRTVADRLTDLLTTAAAQAPEADRAMILTARSHAARWHTLHDGLRRLDDSGDYLGAVGQATAAGPDGLTAVVTDLDTAVARALATANQRVDRQAGHGGRALTGLQIAILLLTAGLVAAVMLGFRPRIGEYR

SEQ ID NO: 8238 - protein, 482 aa, Actinoplanes utahensis
MRGGEVVQVVGRAVAQALSERRVRADAVVERAVGLLAGRARCRIADAYRHLLRIAAEQGADPAVVAGRMIRLLDHVDAPLSPFTGADLVTDRLAGVEELAGLGWGEWDLVTGEVYWSPQLYRIYQRDPALGPLSRAEGRLAGVSDGLSLRDAALAATQSRDRVELVKRVTINGRIRRLRTVVDTVRDPDGRPIRLFGIVQDVTEQPVSAQRLAEVERKLDEQRRAADAEHDLALRLQEIILPIPDEPIELPGLKAAVRYLPAGQETMVGGDWFHAAALRDGSVLLAVGDVAGHGTQAASNMAQLRHALRALTVVDSDPATLLGHLNRLTCELESETPELAATAVIARFDPHRFRLTWAQAGHPPPLLCRGGRTEALHRPAGPMLGVLEDARYASTVIDFRPGDVLLLYTDGLVEHRGQSLDTGLNAVIHTVDDAVRAAPLQPLAELVGRLRRANPDDDTCILAARPSTGGTRDLRHHLLGRN

SEQ ID NO: 8239 - protein, 127 aa, Actinoplanes utahensis
MIGAAVRFQPCRTGPSRHPAGADVRRGEIWTIGDRSDLRYRVLVLSADSYNERDNASPYCAPIVRQRGVTELPPFAVALTEQDPITGVVVINRMRRLPASVGAERIGMVTGASMARLTEAMRDLFEL

SEQ ID NO: 8240 - protein, 479 aa, Actinoplanes utahensis
MSQKAQIGVTGLAVMGRNLARNFARHGHTVAVHNRSYSRTKELVEEFGQEGTFLPAETAEQFVQSLERPRRVVIMVKAGPATDAVIDEFAPLLEEGDMLIDAGNAHYADTRRREAALKAQGLHFVGMGVSGGEEGALHGPSIMPGGPRESYDALGPLLEDIAAKVDGEPCCTHVGPDGAGHFVKMVHNGIEYADMQLIAEAYDLLRQVGGLSPQEIAEVFGQWNEGRLGSYLIEITAEVLKQNDAATGRPFVDIVLDQAEQKGTGRWTVQAALDLGVPVSGIAESVFARALSGGADVRKAAADAGLPGPAAGAEHPGGDLRADVEQALFASKIVAYAQGFQQIQAASKEYDWAIDPGAMAKIWRAGCIIRAKFLDFIKQAYDKNPELATLLVDDYFLDAVSGAQDAWRRVVATAAQQGIPAPGFSSALAYYDGLRAERLPAALIQGQRDFFGAHTYRRVDKDGSFHTLWATDDRPEVDA

SEQ ID NO: 8241 - protein, 204 aa, Actinoplanes utahensis
MCRARRGPGRNAAPAGSGRHRRGTRKHRRPKASPGTSCQTGRILESWPDMDEIPIGPAGPADAGEILTLQLAAYVTEAQLYDDPHLPALTQTLDELTAELADGLALKATLGHRIVGAVRGRLDGTVLRIGRLTVAPDLRGRGLGTRLLTAIERAAAGQAEWYALFTGHLSETNIRLYERARYEETHREQVRPGLTLVHLMKENA

SEQ ID NO: 8242 - protein, 1067 aa, Actinoplanes utahensis
MELTLLSRVAARGVPISGARLADLLALLAGDLAGGCGAGRLIGELWPDEQPEHPSKALQTLVSRARARLGPDVIRGTPTGYRLTLTPEQVDASAVLLRAADAERHARAGAHAAAVAAADAGLALFGGPEADGPLGALRAARATVRETLLRARALALGRLGQGYEELARIAVDRPRDEEILVDLLRVEAATQGPAAALIRYDTYRRQLRDELGTEPGPALRAAHRELLLSDAPVVRQGLRFEPNELLGREDDIAAVGALLRTARVVSIVGAGGLGKTRLAQAVGRRAGHRMIFVVELAGVTRDADVLPEVATALGVAEAPDPVAGTAPTLVPERASRSGAAPAFVPEQALLSGVAGALTPGPALLVLDNCEQVLDGVAGLVQALIARSGAVTVLTTSRAPLGIWSESVYPLAELDLDTTVELFTQRARAARPAADLPAGPVRELCRRLDGLPLAVELAAARIRVMSPAEIGHRLDDRFALLRDGSRDAPDRHRTLHAVIDWSWHLLDDEGRAAMRALSVFPGGFTAEAARQVLARPVSGKDADTARHVLGEDAGAVRHLLGADAVARLVEHSLVKVQDSPAGTRFVMLETVREFAFAQAGPADEAAFLAWARDLGVRDEPDLAAALVVGVDGFRADHDNLVRAHRSALAAGDAATVASTTALLGTLWVTDSNVNRLIALAAEAPGALVRFRPDPAQVETVRTAAVWCTAIAFLVSGSPSLRALAVLRRLPSPDPATLAGAAQTVICAPDLAALATGGTPVEGSSCSVVSGAGRDAGSGGSVAAGGRPPAAGGSPLVAGLANYALSYVAENANDPVAAVAAARAMLVCLQGEHPWLRAVAHGRIGELCLRTAPGEEAFRHLDAALSIMEELGASASAARARWAIVLADLQRGAFDRAEQGLEVLSRGVLDEEAGRMLFERCTRAEILLGRGDVDGGLALWREAARALRRTPGLWANEMVGVAVLVHCRHGRLDLVQDLAGELPGRLAALLPDVPVVSFRVCGVLLMALAEVRAARGEPDDGHRDLAERFGFSGTFQATVAVAGGTGPDLDHEAVRAAALALLRIPAEKR

SEQ ID NO: 8243 - protein, 250 aa, Actinoplanes utahensis
MSDAMTMLRRTVKHTSRNPGAVIMTVGLPVVLLLLFVGVFGGSLNVGMSEDDYIQYVVAGVLLMTVGYGATTTALAVNRDMTAGIINRFRTMPISRASVLTGHVLGSSIRTLASATLVVAVALALGFRGDPDPARWLAAAGLLALLTVALTWLAVAVGLAARTAEGIAPFTLLVQLLPFLSSAFVRPEAMDGAVRWFAGHEPFTPIIDTLRGLLLGSAVGDAWRSAVLWCLVLAAGGYLWARLLFRRDPR

SEQ ID NO: 8244 - protein, 310 aa, Actinoplanes utahensis
MDENNGVTVRGLRKSFGGTVVLDGVDLDVAEGTTVALLGPNGAGKTTVVRILSTLIGADAGEVTVAGHDLARDPAGVRAAIGVTGQFSAVDDLLTGAENLELMADLHHLGRAGRRDRVDALLHRFELEDAAGRTAATYSGGMRRRLDLAMTLIGRPRLIFLDEPTTGLDPRSRRMLWQIVRELLAGGVTIFLTTQYLDEADQLADRIAVLDGGRIVAAGTPAELKRGVPGGHVRLRLRDAAAREAAADLFPDASREDDDALAVRIPRRIPVRELLDRLDRGGIEVDELSVHSPDLEDVFLALTGPKEAGR

SEQ ID NO: 8245 - protein, 203 aa, Actinoplanes utahensis
MSEPPPVVVARFLERTRAEGPGERTAVWVQGCSIRCPGCFNPHLFTPRGGTPVPPAELAARILATGTDGVTLLGGEPFDQAAGLAAVAATVRAAGRTVMTFTGYDHAELRSRADQGVAGLLAATDLLVAGPFRQDLIDRVRPWAGSTNQQFVHLTDRLPVDVTPDRLEVTVSGTGDIAVNGWADTETLDALLAGLQTRRLKPR

SEQ ID NO: 8246 - protein, 262 aa, Actinoplanes utahensis
MTWTPPDGTGPYQPPPPAGPGAGWRIGHSMWLFFPILGFGCLSGGGFLYVGLRAHRPAWWIPGIVYSVLSIAGFTIGGSAPTDSLRQNLSYAVLFGAWLVSIFHAALINGAWLRWLAGYQAWQAQMRAVWVGQQPTSFAPLPPYLQGVVAPPQQFYNTAPGYQPAPVPQPAVHQPSTPAQVDVNTATEQQLATLPGLTPGRIAQVLQSRQQRRGFLTVDDFAAAAGLAPHEFVAIRDRLTCSAAPPPPDDTTSGPYGRVVDV

SEQ ID NO: 8247 - protein, 71 aa, Actinoplanes utahensis
MSSPRIVVTVSGDGQVSAETLDILGEECLNYIAVLEDLIGGKVRHSAWTADYTRQAQHVQEQQVNRDVDPA

SEQ ID NO: 8248 - protein, 147 aa, Actinoplanes utahensis
MSVSLLLVPLALAGAAAVQARAERRSNGQTLVQVNTRMRDVTLLADALRDTGAVVSGGEAALTARWGDQALTFGRDADGIWSAHADGVGVERAVELITAVDAAYGRRVQQAVLDRIRAQAPAAGLRLESESRQDDASVRLVFEVETA

SEQ ID NO: 8249 - protein, 109 aa, Actinoplanes utahensis
MHLARALRHPRVAGDLLVDPDLRADLAGLTEGYSGAEIEQAVIAGLFDAFSERRPLRRDDLVRAVMSIVPLSVTQAERIAALRGWARNRAVPATATDDGDFRNETGSVR

SEQ ID NO: 8250 - protein, 415 aa, Actinoplanes utahensis
MSFSETLAQLLKARFPVLYVETFEEQRALHRIAAVAGDEVLVRTPRGLWTWTLTGGLIPPDGKPRSGTHGAAGALQAVQRVDEPGVFVFRDLHPAHVDGQYPQNMELIRLLRDTAQAFRSGSQPRTLVLLSPVLSIPAELRKTVTLVEFPLPGAPDLHGLLDAMIRANAASGRIRIDLDDAGRERFVAAAAGLTMEEAENAFARAIANDAVLDLEDVRIVHDEKQQTVQKSGFLDFVPTEIVLDDVGGLGNLKAWLVKRNGSWLPEAAEWGLPAPRGVLITGVPGCGKSLTAKAMATAWNLPLLRLDVGRVFAGLVGSSEQNMRSALRVAEAVAPCVLWIDEIEKGFAGGAVGDSGTGARVFGTFLTWMQEKRRPVFVVATANDFEGLPPELLRKGRFDEAFFVDLPSRAERAAS

SEQ ID NO: 8251 - protein, 69 aa, Actinoplanes utahensis
MKRASRAALALTAAAALLAGCSTVHMARPRSPEVKLPANGIAGLDADAILSDAEGALKAAGSFRLRLAS

SEQ ID NO: 8252 - protein, 180 aa, Actinoplanes utahensis
MPPGAGSGVTAASAGPRFALDLRISGDDVIGSVWLPQASGQLLTVGGHHYVRPGAEFWRAVDPKGVARKRLGDRWLRADATDVAGISHFFDPAVLLRTLLKPTTPLTKTAPLQIHGIPAIGLTYAPGVTLYIATAGRPYPIQLDFPGAEGLRFTEFGATFGGIKVPDTSRCADLAALQLR

SEQ ID NO: 8253 - protein, 171 aa, Actinoplanes utahensis
MPCSRGDLATRQLRAEDGLMGRSTLYQAAGGAAGMLALATDFHARCLADPVLEHPFSHLDDPEHVQHLAAYWGEVFGGPPTYSGRHGGHSGMLRIHANQCDEDPFSGRFLEVFDEAVAHTLPDDPALRGALHDYMVAATREVAAVFPASATVPDALPMPHWAWSGPTGGDS

SEQ ID NO: 8254 - protein, 422 aa, Actinoplanes utahensis
MIRYGDEVASIARELRDPGDLEILLDRAESARIVMIGEATHGTHEFYAWRSVLTQRLIEERGFSFVAVEGDWPDGERVDAAVRGGPGAPDDPRSALIRYDRWPTWMWANEESVDFTRWLRGLNAVRPPGERVGFHGLDVYSLWESMREILTWVREHDPDLVPVALDAYRCFEPFDEDPNAYGWATQFVDATCAEAVVRMLAGLRGRDFGVWQNAAVVAGAESYYRNMVRGGPEAWNGRDRHMDETLDRLLNHYGPGSKAVVWAHNTHVGDARATDQVDHGEVTLGQLARDRFGWDEVLLVGMGTYRGSVVAGPQWGAPMEMMGVPPARAGSLEEILHLTAPARGLFVFPAGSDGPDLLTTILPHRAIGVVYRPERERWANYVPTVLGDRYDAFLWFDESHGLRPLHTLRVNTHEPETYPSGV

SEQ ID NO: 8255 - protein, 367 aa, Actinoplanes utahensis
MKKIVRLLLAALLSACGVTVVAAGPAAATLASGYVLSSSTATLPAELSALATGKRVQYLSTSITGSTITATGLILTPKSGRKNRVVAWAHGTTGLAYQCAPSTNQSVFWEEARIAVAALLNRGFTVAATDYPGLGSGGQHPYLIGASEARAIIDSVKAARNLDASLSTQYAIDGHSQGGQGALFASQIAPAYDGNLVLEGTSSIAPLSNADTIAPFIPGTAEQGYLVMALYGLNAVDPSVQPLTILATPAKAKVGVLYSGCLNEILASYQSLTAAQLVNNGVVPDYVLTKLAQYDNPAQSAPTAPILVVQGTADEAVPYDITAGMLIPQLQAYSQPVQFVPIQDATHDTAVIQSADLVADWITARFS

SEQ ID NO: 8256 - protein, 341 aa, Actinoplanes utahensis
MEHRRLGTSGLFVSEVIFGNWLTHGETVDEAAATACVRAALDAGIDTFDTADVYAQGAAETLLGRALRGLPRESVTIASKVCLPVGDGANDRGLSRKHIIQSCHDSLRRLGTDHLDLYQAHRFDPGTPLDETFEAFDTLIGQGKIGYVGVSEWTAEQLRQGIAASAGLRARIVANQPQYNMLWRVIESEVVPVCAAAGIGQVVFQPLAQGVLTGKYRPGEPVPPGSRAAAGGRAPRFINRVLGDRLLERVQALRPVAAEAGLSMAQLAVAWTLHRPTVTAAIIGASRPEQVTENAAASGVPLGDDLLKRIDEALDELVDRDPAKTARMMAVRPGWSATPPD

SEQ ID NO: 8257 - protein, 137 aa, Actinoplanes utahensis
MSAAERAWRAMRALVTEQHDAKVQVSAALGLSFVRVKALLLLAGGPHTLSETARLLGCDPPYATVITGDLAARGLVTREPNPADGRSRLVTLTPAGRDAAREANRILGTPPPELLALPPEDLAALDRVLSRLGPTPG

SEQ ID NO: 8258 - protein, 454 aa, Actinoplanes utahensis
MPRRYLILAICCMSLLIISLDVTIMNIALPAIRDDLHAPVSGLQWTIDAYTLVVASLVVLAGATADRVGRRRVFQTGLALFTVASLLCSLAPHLEALIAFRVLQAIGGSMLNPVAMSIITNTFTEPRERARAIGVWGAVVGFGMALGPLVGGFLVHGLGWRSIFWINVPVGVAALILTALFVPESRAPIPRRLDAAGQVLVLVLLATVTFAIIEGPGAGWWSPEILGCFTAGLLALLGLLWWEPRRAEPLIDLGLFRSPPFSGAVLIAICAFGGLGGFLFLNTLYLQETRGLSALQAGLWTLPMAGATALVSPFAGRLVASRGTRLPLLAAGAAMTLGPIPLTWARPDTPVWQLLIGYLLFGIGFGMVNAPITTTAVAGMPRERAGVAAAIASTSRQVGSALGVAVIGAVLASGHRHAGAAILCGLGAAVLVLGRLSTGDGARTHTRTAESVPA

SEQ ID NO: 8259 - protein, 702 aa, Actinoplanes utahensis
MKIWPGNPYPLGATYDGGGTNFAIFSEAAERVELCLFDDEGNETRVDLPEREALVWHGYLPRVTPGQRYGFRVHGPYDPSRGLRCNPHKLLLDPYAKAIDGDYRWDQALFSYDFGDPASYNDADSAPFAPRSVVINPFFDWGNDRPLKIPMWQTVIYEAHVKGMTINHPKIPDDVRGTYSGLAHPEMIKYFQRLGITAVELMPVHQFVHDSGLVERGLSNYWGYNTIGFFAPHNGYASFGGAGGQVQEFKSMVKALHQAGIEVILDVVYNHTAEGNHLGPTLSFRGIDNPAFYRLVEGDKQYYYDTTGTGNSLNVRHHESLRLIMDSLRYWVTEMHVDGFRFDLAASLAREFHEVDRLAAFFDLVNQDPVVSQVKLIAEPWDVGDGGYQVGGFPPNWTEWNGKYRDSVRDFWRGEPSSLGEFASRFTGSSDLYQDDGRRPIASINFVTAHDGFTLHDLVSYNEKHNDANGEGNRDGESHNRSWNCGAEGETDDAEIVVLRERQKRNFLATLLLSQGVPMLLHGDELGRTQRGNNNVYCQDNELSWVDWENAREEDVLTHFTRLLLKLRAEHPIFRRRRFFTGAFADENKLPDIAWLRRDGEVMTEADWNTPSGMTMTVFLNGHGIPERGALGEEITDDSFLLLFNPLSEDVSFTLPSRDYGKTWEIVAHTADPLLARRRKTARAGSRVDVLRHALVVLRCRY

SEQ ID NO: 8260 - protein, 171 aa, Actinoplanes utahensis
MSVGNPLAPRPGRCWAGGVTRIERRSDPVATGRILRALPSWFGLEEAVRDYVGDASVLPSYLAVSGSATIGVALVRRHFPESAELHLIAVHPDARGSGAGTLLLNAVEEDLRCAGVRLLQVKTIGASYEHEGYAQTRGFYRARGFLPVAEMRGLVWDGPTLLLVKVIAPDP

SEQ ID NO: 8261 - protein, 126 aa, Actinoplanes utahensis
MSDTPLSDVMAEHAQTRDAEAYQRFVALFRSSTVGVVVTGTPVPDAPGGFVSDGTLAVRRTGHGDGRQRILTFADPEVFARRFGPVFNAGMSGDALLRMAADDRECAGILVNSATAETSVIISSVH

SEQ ID NO: 8262 - protein, 138 aa, Actinoplanes utahensis
MSDLERFVRAQDGVYERARDELAAGRKRTHWMWFVFPQLTGLGSSPTAQAYAIADLAEARAYLAHPVLGARLTDAARTLLGVEGRTAEQILGYPDDLKLRSSMTLFAAAAAEPGVFGEVLDRFYDGPDPRTLELLGRG

SEQ ID NO: 8263 - protein, 346 aa, Actinoplanes utahensis
MHFTPRDGRVGDLFGVLHRDGRYHLFYEHRSGGDAGWGCAVSDDLVIWREGAVAAAPGGPGCGSVVDGPSGPVLFHSGPGSGVRRATAAADLTGWLADPDQPVLGAAPEGFSDVRDPFVFAAPGGWRMLVAATAAGGGSAVLQYRSADLDDWSYDGVLTTAAGGQVDCPRLFELDGEWVLLVAGADASYAIGGYDGVAFRPRARGVFGRGRLGPAAPFVDAAGRRCVLARVGGSTWAGALSVPWILSVRGTSLLATPHPHLDRYLVTGVTGLTADAGELRDHGDLILRMPAGGETTVLADADIVEVTVEGVSGLGAARRAVPGEPGAHIARIAGSGRRHDYHRGDE

SEQ ID NO: 8264 - protein, 73 aa, Actinoplanes utahensis
MTEKTYAASFDRNGACWRRSTRSYSDNCVEVADLADGGRAVRDSKDPDGPVLFFTPDEWTAFVGGAKDGEFDD

SEQ ID NO: 8265 - protein, 270 aa, Actinoplanes utahensis
MWSLKAWQARFATGDRLRAYAGWCNAVEGNTTFYATPARATVATWAEQTAPDFRLIPKVPKRITHELRMSGAEEDLRVFLDAMEPLGPRATALWIQLPGSFGPGDLAVLSRFLRSLPMDRRYAVEVRHPDFFTDPGRLTELLAAHDAEWVPFDTTTFFASPPTSAAERDAWLKKPRMPRRDTALTDHPIVRYLGRDDTERTVAGWQPWVATTAGWLREGRSPTVFLHTPDNADAPDLARRFHAEVAALVPGLPPLPEPAPREAEGPATLF

SEQ ID NO: 8266 - protein, 222 aa, Actinoplanes utahensis
MTDSVGRIGIRAASAALLLAGVTGGVYLGEHRPPPTSGTLDSVQAEANDMQLLKDRQNDHAAARARITAAEGVAAQKAASTARTASGYAKTLDKQATAAKKAAQKPSGPVAFAGPIPGSCTEFSGSRAVGCALTLQAGFGLDQFACLNKLWNKESGWNYRAENRGSGAYGIPQSLPGSKMASFGADWQTNPATQIKWGLDYIKKRYNTPCNAWAHSVQFNNY

SEQ ID NO: 8267 - protein, 94 aa, Actinoplanes utahensis
MVANGGYEVQKLGQAALDSEDPVVIAEFYNTGYAAASKQDADAEQQITDALAARSKAVADLTDLAQAAGKPFCTPLLITRSGTPAPEAGSMPDC

SEQ ID NO: 8268 - protein, 168 aa, Actinoplanes utahensis
MRAGATLRTPRGGTVKVTAVHRFLGARTMHNLTVADLHTYYVLAGGTPVLVHNSILCDIHGNPIDDSEPLYGPFHRLQSPTQSPAVAQQILESSQLWGKEPRVGLIDIPQPQAHLGPLPEGAAGVEFYTGIPPGPPYPGQVRWLGGSPGVPIEDGYAKLPIIITKYTQ

SEQ ID NO: 8269 - protein, 30 aa, Actinoplanes utahensis
MRRPYPLRLSAAVTARTSPFAISGLLNLIG

SEQ ID NO: 8270 - protein, 235 aa, Actinoplanes utahensis
MVEAVLFDCDGVLVDSERITNAVLRGMLHELGWAVGEAECFRLFVGKALADEVGVITAHTGFVVTDEWIGEFRRRRNEGLLAGLEPIPGAVAAVHEVDRAFGGRVAVASGADRFKVELQLTKVGLDGVFAGKIFSGMEMPRSKPAPDVYLAAAAALGVDPARAAVVEDTATGVRAGVAAGATVLGYCPPDSPAHHAPEVLLAAGAAHVFTDMAQLPALLTAMPADRPAPASARHR

SEQ ID NO: 8271 - protein, 119 aa, Actinoplanes utahensis
MADADDVRRLALAMPEVTEIDSDGFDFRVANKGFIWSYPERLPGRPRVIRTDIAVLYVGDEAEKQALLLGEPELFFTTPGYDGLPLVMVRLPRVSTDRLAELITDAWRMRAPADLQASP

SEQ ID NO: 8272 - protein, 116 aa, Actinoplanes utahensis
MTEQICEVVITAGSAEWLADFTRRLVERRLAACGQITPQVRSIYRWQGAVEDEGEARVAVHTRLSLVDAIVAAAEREHPYDVPCVLALPVVGGNPRYVAWVLEQTGQEIATSTSRD

SEQ ID NO: 8273 - protein, 246 aa, Actinoplanes utahensis
MISSTLVALVALSATPPVSITVAPATLPITIGQCNGGTITVKLTNHGKTPIYADASLSADPALHLPRSLITTWLPAGYTSSVPVAVRATRAGDFRVRVTAGPSRVEVPIRVGTPAPGAALTRLASRVTASSARAGSPACAAIDGRADTMWNDTTGKRWPDWWQLDWDTAHRVSRIAVTTTADGGLRDWDVQVAVPTGWQTVDSVRGNRSALKISTFTARATTAVRIVTLAGNGVNDQSRLVDVAIS

SEQ ID NO: 8274 - protein, 511 aa, Actinoplanes utahensis
MLQLPRRRLFTLSGVALAGALPRPRLTNPFTLGVASGDPLPGGVLLWTRLAPRPLEPAGGLPPVSYPVDWQVAEDAKFSRVVRSGTGTAAPGYGHSVHVDVTGLRPGRDYFYRFRSQGFLSPTGRTRTAPAKTATPRALRFAVTSCQAYGDGYYDAWRHLAAESLDLVMFLGDYIYEGAITSSGGSRMDPKLHLPDTFELETDTLDLYRMRYALYRTDPDLQAAHAAFPWILTWDDHEVQDNYADGVSRFVTTPVRDFLVRRANAYRAYWENQPLRWPRQPSGPDMSLYRRFRFGDLAHAYVLDTRQYRSDQACGDNLRAGCTARDDPQRTLLGAPQRDWLLGRMGRSPARWNVLAQQIMMARCVYGGPANRLDMDKWDGYSADRQRVLELAARMPGTVVVSGDIHNNYACDLRLDFGRPETPPVAVELVGTSISSGGDGSDTTAQLDMQRRYNPHLKLANGQRGYVLCELGRDVMRADYRVMNQVTRRGGTISTRASFISERARAGLVPA

SEQ ID NO: 8275 - protein, 265 aa, Actinoplanes utahensis
MPDHTPTHAPSAVGPDPDAAVGLAPAAAHPSRRRLAVILGAVLAILAAVNVADKYGPHHTGLVAGPTVALALVLLARRAGLSWHDLGLSRRTLLPGLKYAIGAVAVVAVVYTIGAAIPATRVAFHDVRYHLHPGAALLTAFVIVPLGTVLLEEIAFRGVLLGLIHRHRGATWASITSSVLFGLWHILPSLRLAEVNQAVGGTLGSGLPGTILAILGAVAFTAIAGLLLCELRRRSGSLLAAAALHWATNGLGLLIAAALATTTLT

SEQ ID NO: 8276 - protein, 98 aa, Actinoplanes utahensis
MRVPTAVITAGSLIGGWQAARRTGVRPLGGLVLAAGGVLAGREWSRRTTPAVTGALAATYLGAFGLSHPLAKKIGAWPAVLTVSAVTAAASYLVADRR

SEQ ID NO: 8277 - protein, 560 aa, Actinoplanes utahensis
MSMPPARQRILTALVALTGLVATPVGAPAAQAAETLVSQNKPVTASSVEWAGTPATAGVDGDNGTRWSSAFAAGQWFQVDLGAPTAISRIAINWENAYAKAFTIQFSGDGSAYTQAYATSSGTGGQQSIPVSGTARYVRINLTARALDLYGYSFWEFQVFSGGGTTNPTPRLLSYAKPARASSEQNDANCNPCTADKAFDNDPASRWATSPTNGWVDPGWIYVDLGATAQISQVVLQWDPAYGKAYQIQVSNDATNWTSIYATTTGDGLKDVINATGTGRYVRMYGTARGGPYGYSLWEFSVYGTGGNPVDPPAPPADPAFPATRLVFDDEFNGAGGAKPDTTKWTYDPGVPQNGEVQYYTPDSANASMNGAGQLVIQARREDYQGRQYTSARMNTSNRFSLQYGRVEARIRVPKGNGLWPAFWMMGADFLTGRPWPYNGEIDIMEVLGRNTTESYSTLHAPAYNGAGGYGQKYSTVDLSQDFHVWAVEWDSKGMRFFLDNTLVFNAVKDTVENTRGPWIYDHQFYIILNLAVGGDFPGPIDSSTPFPSTMLVDYVRVYQ

SEQ ID NO: 8278 - protein, 202 aa, Actinoplanes utahensis
MHTWYLWGLSALGPASGALTLLWRRRQAAALTDALTGLANRDRFDAVSHRSLLHAARTGTWSAVLVIDMNGFAEIAETLGRAPADQVLTGFAEVLRQSVPAPGLPARLGGDRFAVLLTDLAFPGQAYEAAGRIAAAMGTVAVAGRLVPLAAGIGVAVSAPGELTHDELVHRADAAMRRAKALGPDTRWAVWQDSPTPEAVAA

SEQ ID NO: 8279 - protein, 393 aa, Actinoplanes utahensis
MPVPQTHDEAVEAAHRLAAVLTPGAIGRDRDGATVIPSEALAALDSSGLLAITVPAADGGPGLGPRTLAEVARIIAAADPSIAQVPQAHYLMIDVLAVHGTPPTRKRLYDEVLAGRRLGNALAERGGQHAQDLRTRISGGRLDGVKYYTTGALTSAWIAVSALDEQGRLVLAFVARDAEGVTVDTDWDMVGQRATISGTATFTEVIVEPGMRLDYAGAYQQPQQLGARAQLYHAAIEVGIAGAALADARAYLRTKARPATEAVRAGAGVAADDPHVKHRYGRLASRVRAAEALLDAAARTLEAITLTPADADAAARGSLAVAAAKAFGSEIAVEAGSELFQMCGTSSAAAKYDLDRHWRNARTHSVHDPLDWKYHHLAAYDLLDVLPPNHGQL

SEQ ID NO: 8280 - protein, 220 aa, Actinoplanes utahensis
MLNNPVWAALSGPQAGYAEAAGDAARYLPEISPFCAVSDPADPKAWRDLATLTDHALLTGPAISPPRGWVEEGRSAGVQMVGTAMTAVDDPEAVPLTEHDVPEMLDLVARAQPGPFRKRTVDLGRYLGIRSADGRLISMAGERIRMPGWTEVSAVCTDPEFRGQGLGARLTLAVAAGILARGELPFLHAVHDNENAIRLYGRLGFEHSADVVFAAFRYTG

SEQ ID NO: 8281 - protein, 1019 aa, Actinoplanes utahensis
MTTRTARACFAAWSLLLVALYYAFPAAHLYTWALLGYSSAAAILVGTRLNRPGRRLPWYLVSAALACFTTGDSWYNLVLALGGRPGFPGLADLFYLLVYPLLTGALLLFIRARSGRGDNRGALLDALVPTVGLGLLAWVYWIAPFTRAQDLTVLQKIVSIGYPLGDVLVLAMILRMLTQTGTRPRTLGSLGVAMLGLLVSDIFYGQSQLRDDWVLGGPVDLGWVLFYSAMGFTALRPSMRQLTEPAERCRSIIGRHRLVWMTAAALIAPILLCLEYLQGRPAEIQRDGIVDAPVIAGAAAVMFLLVLGRLADLAMAQRQAVARERALREAGALLFAAATERDVVAALHQAVARLMPPGQPYHLELPPQAPGPADVAVHWRAAADLPAGVDAGGFPTVLFATQPLPGRQWHGQLIVGAAEDVLQTLRPALQTLGAQIAVVLDRISLTAEVGRRESETYFRTLVQRTVDVILIVDGDQDTTVRYASPSADKLFGTVIPAGTPLADLIAPEAQEALRDVLCRLRRGHGDLDGVELTAQGAGGRRMTVECDLRDLRDDPTVAGLVVTLRDVTEQRRLEDDLTHQAFHDSLTGLANRVLFRNRLEQAFTVASRDGATLGVLFVDLDDFKEVNDTLGHAIGDQLLIAVARRISSIIGAGSTAARMGGDEFAILVEQSDTAHAAEDVAARLVAALDAPIEVPDGEGGLHLVSGRVSVGVATSGDADNATELLRHADLALYLAKGMGKAGWQRYQSDLAHAMVQRLEMRAQLHEAIEDEQFMLQFQPIVELADQRVTGVEALVRWQHPTRGLLGPFHFVEAAEENGAIVGIGNWVMREALCQIARWKADDPHTTLRYVSVNVSPRQFRSADFVDQVRAALAAAGARPEWLLLEITESLVLRDADKVVQDLRALRAMGVRVAIDDFGTGYSSLSYLRQMPVDVLKLDKSFIDDILTSRQQHALVDAIVTLAGNLDLAVVAEGIEEPGQHLALDAMGCHYGQGYHFAKPLWPTAIPALTAAAEAIAMTA

SEQ ID NO: 8282 - protein, 280 aa, Actinoplanes utahensis
MSLRRIGVALASLTLLGTGVTAASPQAQAATTVPAFDHIVLVMFENKASSQITSSSAAYFTALAGQGAKFTQSYAITHPSQPNYIALFSGATQGVTNDNCPKTFTTGNLGAQLIAAGRTFKGYSEAMPSDGYTGCSSGTYRRKHNSWVDFSTVPAASNVRYSTFPSDYTQLPTVSFVTPDMCNDMHDCSISTGNTWLRNNLDGYAQWAKTHNSLLIVTFDEDNSLSLNHIYTAFVGANVKVGSYSEKITHYTVLRTIESAYGLSALGGAAGVSPITDVWQ

SEQ ID NO: 8283 - protein, 410 aa, Actinoplanes utahensis
MYLASVERPAVRRTDRTQRLAGTVLALGTVSLITDVSSEMVSAILPLYLIAGLGLSPAVYGLIDGVYTGATALLRLAGGYVADRARRRKTVAAVGYGLSAVMKFGLLAAGTAVPWISAAIVADRAGKGLRTAPRDALITLATPATSLGRAFGVHRAMDTAGAFAGPLVALAVLAASGQAYDSVFVVSGCIAMVGVLVLVLFVRDHRGPRPAANTVSLPAAAALLRRKPVRMLLIGAVLLGLSTIGDGFVYLLLQRRESLATGWFPLLAVGTSLTYLLLAVPFGRLADRVGRAPVVLGGYAALVVVYTMLGSGLGGPVTIVAVLVLYGGYYAATDGVLMALAGPLLPAELRTTGLALVQTGQALAYLVSSVLFGLAWQWWDATGAIRAFTVLAVLTLSVSAGLLLRSNRER

SEQ ID NO: 8284 - protein, 331 aa, Actinoplanes utahensis
MSAEPSLRRRVLLAALVSVVLLGGAVVYVVIAGRRGSAPAAAAVVDAGPGDRVLFRSTAASGYGRVATVARGAETGQRTVSGLDCDRVYAAAGRGICLRPDGPLATYQLAVLDAGLRVSDTYPLVGVPNRARVSPSGNVLAWTVFVTGDSYNGGRFSTRAGMLNLATGDTVDSVELFSVVRDGRPYRAADVNVWGVTFADDQHFYATLSTAGKRYLVAGDVTAQTVRTLAENVECPSLSPDRTRIAFKEAIKGDPSKGWRLTVLDLATMRRTPLAETRSVDDQTAWYDNTTVMYAVRRGSRNSDVWAAPADGGGTARLLIPDAESPAALWN

SEQ ID NO: 8285 - protein, 285 aa, Actinoplanes utahensis
MITQEHIHTLSGRDVHDRDGDKIGTAGQVWTDAAGLPTWVSVRTGLFGLNESLVPLQDADLRDDRLVVPFDKATVKDAPNVDASHDEPLTQAEVDQLYSYYGVNQHDSYRSYQAGATATNENYTGDSYTDENYTGQSRPGGTDYELGAGQGDGHLRGDDAMTRSEERLTVGTERERTGKARLRKYVTTEQQQVSVPVTREEVRLEREPVTDANRDAAFSGPDLTESEHEVTLHEERPVVQTETVPVERVRLGKETVTDERTVSGEVRKEQIEAELPGDERRRRLG

SEQ ID NO: 8286 - protein, 289 aa, Actinoplanes utahensis
MAGEILPRIGSPRRVAIVTGGGAGLGRELTVGLAGAGFTVVVADVDGAAAEASAARAEQVAGAAAGAGPPAGADAAAGLSVGADAAAGADSPAVAGGVAVAVCADVTDAEQARGVVRVAAELGGPHVLVNNAGGWTRGGRQYPDAEPADWAATLALNLTAPMLLTQLVREPMRRLGGGVVVNVASSAARGDGAYGSPEYAAAKAGLVRLTTSLAGLDGVRVTCIVPDWIGLDRAHAEFAALSPAERAVTPPLIPPAQVVDAVLDLIAGGASGTVVELRGGREPIPRRPA

SEQ ID NO: 8287 - protein, 302 aa, Actinoplanes utahensis
MTRPLLAVDAPSLYFRAFHGIPEKAAQTDAGEPVNAIRGFLDMIAQLVRTRRPDRLICALDADWRPAWRVELVPSYKAHRVAHDTVEEVPAALERQVPVLLEVLEAVGIPAFGVPGYEADDVLGTIAATQAAPVEVVSGDRDLFQLVDDARGTRLLYCGRGVAKLEDADEALVQGKYGVPARYYADFAAMRGDPSDGLPGVAGVGEKTAARLIERYGGIAEILAALDDPEAGFAPGVRTKLAAGRDYLAKALPVCRVALDVKLPDVDPALPREPRDPQALLALAERWNLAGSARRLVDALAG

SEQ ID NO: 8288 - protein, 377 aa, Actinoplanes utahensis
MDRLLPTPEAHDLLDLTRELATRELAGKVDDYEARGEFPREILRTLGRSGLLGLPYAESDGGAGQPYEVYLQVLEILAGTWLGIAEAVSVHTLSCFPVAAFGSERQRKALPEMLGGELLGAYCLSEPQGGSDAGNLATRAVPDGEDWLVNGTKAWITHGGRADFYNLFVRTGGPGPKGISCLLADAATPGLLPQAPERLMGLRSSAPAQIVLDDARIPHDRLVGEQGQGFAIAMQALDAGRLGIAACAVGLAQAATDYAVAYAREREQFGQPIGRFQGVGFMLADMATQVSAARSLLLAAARLKDAGRPFSVEAAKAKLFATDAAMRVTTDAVQILGGYGYVADHPAERWFREAKVLQIVEGTNQIQRMVIARSLTG

SEQ ID NO: 8289 - protein, 149 aa, Actinoplanes utahensis
MEEIDRAIVSALTVDGRLTYTDLAERVGLSVSAVHQRVRRLEERGAIAGYTAKVSFEALDLPLTAFVAIRPFDPSQPDDAPERLAHLSEIDSCYSVAGEDFYMLLVRVKSPADLERLLQDIRTAANVTTRTTVVLSTPYENRPPRIAPE

SEQ ID NO: 8290 - protein, 192 aa, Actinoplanes utahensis
MCRMNADDVDAAVQELQDTLAPYAYGPAWSTRAGDLDWTCRQTAVHIAHDLVAYAAQLAGRADNGYLPLDLRVDPGATPGEVLRVIAAAAGLLSAQLRAASPDDRAWHWGPADPSGFAALGVNEILIHTYDVAGGLGVAWRPPAALCAAVLSRLFPGHPDGDPVAALLWCTGRIALPGRPRRTSWVLRAAVD

SEQ ID NO: 8291 - protein, 224 aa, Actinoplanes utahensis
MRRRTLLAAGGAGVATAVAGGLWARGSAPATVPAVPVPSVPPGPERCELRYSKARGTTVDFYTAVPAGHGDGTGLPVCLVLHGGSKRPADFEALGLGHFLTDAVAHGAPPFVLAGATGDRLAWQPDGRDDPQRMVHEEVPAWCAARGFDTSRLVAWGWSMGGYGSLLLAETFPGFVRAVAAFSPAVVPGDVVFQNADRLGATPVGLWCGSRDPLYGSVRALLAS

SEQ ID NO: 8292 - protein, 255 aa, Actinoplanes utahensis
MAATSLLTVAGNAMGLSNRGAKQADTVYAADLPLRKANKPTHTADLSALRVQVCQDASVAARNADQVTAQAGVAATAAATLEKTGLTHGIAWSEVTQAQGDAGAAAKLAAETACHAAEATEAAGKALDADHSATVDANNAVKYRQAAEREQAAAEKLADKAEKLAAAALAAAADAKAQRLRAEKDAASARQHAANAAGYYADAKRQRGIAREATAAAIQHSLNAYSAAQRAIAQQNVVVAKGAEAKQKQDEALAS

SEQ ID NO: 8293 - protein, 187 aa, Actinoplanes utahensis
MWAVAQNMGRMAKTLQDIAWQAYNAEQAAAEKKLNDWIDDKAKWLNDHIGGSDVTKGFIDGAAGMVKGIIQTSNCVTGTFLGTDAATDEYTVPEVSYLPNSDKSCNMLVKGFKDLLSDPKQLLHWDDWKKNWKYALGETLFDGAFFLVTDGTGLITKIAESGVAQTAKQAIRDIAKLSAKDMAALAS

SEQ ID NO: 8294 - protein, 331 aa, Actinoplanes utahensis
MGGKLAVTFSADELKALSKAIGLKGIDAVENALRGLKDLPVLKGLTDLLESCFKRNSFAPDTRVLLGDGTSRAIADIRVGDRVLATDPITGVTRPEPVTALHRNDDTALADVTVEDRAGRQSTLHTTREHPFWNAGTRQWTYAGDLRPGTALATVGAGRWAGVARVRTFTGERTMHNLTVADLHTFYVLAGRTPVLVHNCNVALGQKMAGTYKWAKDNNFEHFGDLGPDEWMGPVKDAIRNSNVTLHVNMEEMGSFVESVRVGMEGVGGATDLEMSWIATAIIRGERTWSSVNFYKLVNGKMTKIVVEEPDWSKITPQRWFTDPPTSCKCL

SEQ ID NO: 8295 - protein, 220 aa, Actinoplanes utahensis
MSDRMAELYPEVVRAGGLAEALRRAAAARDVDLGPALEQSSARWSASIDAPHGGCEVSVGAEQRFFHVEIRRSDYRATWVSGAAPELDPVAGVILAWLAGESAAAVSARFPFVTAGEFADVAGDDEMVAAQWRSLLAAPEYRDERPLLAAVHRSPRARRLFPVLTHGMLRLSADMGRVGGREIRIVPLRHGGHRIEDGAGTVLATLESLLSLDPLLDLDS

SEQ ID NO: 8296 - protein, 241 aa, Actinoplanes utahensis
MIALVDHEATSFGSAAGTYERGRPPYPEPALDYLLPGGRARVLDLGAGTGKLTRQILARGLDVVAVDPSEGMLAELRRTVPDVPAHPGTAERIPLPDASVDVVLVAQAWHWIDPARAVPEIARVLTPGGRLGLIWNLRDERTDWVHRLGTIIGHEAPRGTTMGPPFGPVTTATFGWTHPVRAGELLDLVASRSRQILLPADERAAVLAQVRQLTATHPALLGRDSYAFPYVTQCAYADLPA

SEQ ID NO: 8297 - protein, 63 aa, Actinoplanes utahensis
MSFTDKVKNKTEELTGKAKQGLGEATDNQRLYAEGEAQEAAAHAKQAGEHVKDAGRDVRDALS

SEQ ID NO: 8298 - protein, 454 aa, Actinoplanes utahensis
MVAELDSGQPYEYQRRELVEPDWTRFPGWRDVTAAQWQSAQWQRVNCVKNVKQLRTVLGDLVDESFYADLEKDQAELATMSMLLPPQMVNTMVPHQVPDTASFYADPVRLYMLPVASDRRRDWPSHPNASRDSLHEHDMWVAEGLTHRYPTKVLAELLSTCPQYCGHCTRMDLVGNSTPAVAKLKLVQKPVDRYAAHLDYLKAHPGVRDVVVSGGDVANVPWKQLEAYLMGLLAVPTVRDIRLATKALMGLPQHWLQDDVVEGMHRVAVTAERRGVNLAVHTHVNHVNSLTPTVARAVRTLLEVGVRDVRNQGVLMRGVNATAGDLLDLCFALQGEAGILPYYFYMCDMIPNAEHWRVPVWHAQQLQHDLMGYLPGYATPRIVCDVPFVGKRWVHMVAEYDREHGISYWTKNYRTSIEKDDSEALSKLYAYYDPIDTLPESGQDWWRKQSLAGA

SEQ ID NO: 8299 - protein, 336 aa, Actinoplanes utahensis
MAGSVGLGRVLEPSGVLPQAAWRLDASPEIGPDEARIRVQRLNLDAASYRQLGEKHAGDGAAIRAEVLEIVGTRGKMHNPVTGSGGMLIGVVEEVGPESPLPIKPGDRVATLVSLTLTPLRITDGLAGWDGLSEQVPADGTAILFGRSIVGVLPDDLPPELALAVYDVCGAPALTDRIVRKYQDPTVLVLGGAGKSGSLSLAAAKRAGARTTAIVVSEAERAALSEAGVADEIAIADARNPVQVAEKATADITVVCVDVPGCEHGAILATKPGGTVIFFSMATSFAAAALGAEGLAADVTMLVGNGYVPGHADFAVDLLRTTHAVRGLFEKRIAGD

SEQ ID NO: 8300 - protein, 511 aa, Actinoplanes utahensis
MTLPSVRYTNGRFYSAAEPRATAMLVRGGTIAWLGDTADAPAADRTVDLDGALVTPAFVDAHLHVTDTGLAADGLELSGVRSAGELLAAVERFARTRPAGAVVHGQGWDESTWTEQRLPTAAELDRAAAGRRVYLTQASVHSALVSAALLPAAEGVDGYDPSGWVREHAHHAVRAVALGSLSPEQRTDAQRTALRTAAAAGIAAVHECGGPGTSSEADFQSVLRLSGQNLPEVYGFWGELGGADKARELGAHGAAGDLYADGALGSRTASLRTPYRDGDHGCGEAFLTAEQVAEHLLDCIRVGFQGGFHAIGDAAIATVLEGFALAAKQVGVDRIREGNHRIEHVELIDKAMIARMVEFGVTASVQPVFDALWGGADRMYAQRLGADRALASNPIGAMHATGVALAFGSDSPVTALDPWSTVVAAIAPRNPVYRMKVRAAFAAASRGGWRAAGISGAGVLAPGASATFAAWDTPGGLHEGLPALLPDVDGAVPARPVCRRTVLHGDTIHEI

SEQ ID NO: 8301 - protein, 514 aa, Actinoplanes utahensis
MAGKLDLDPRIVARARALAAKAGQPVVDLARSHTTVSVERAVLRLAGVHGADSDGIPWVNRLVDAVRADVGLGHGVAVPVCHAALTTGVDDLTVLAQKAAAGAVRFGVPEKKPEIAAARRLAKKAAANGLKIVDRRRAERDRLIKRYGDPQQRPWIYLIVATGDIYEDIPQAQAAARAGADIIAVIRSTGQSLLDYVPEGATREGFAGTYATQENFRLMRAALDETSRELGRYIRLTNYASGLCMPEIAALAGMERLDMMLNDSMYGILFRDINPIRTFVDQRFSRQVHARAGIIINTGEDNYLTTADAVEAAHTVTVSQLLNEFFAHEAGLADWQLGLGHAFEINPDLPDSFRLELAHALLARELFPEAPLKWMPPTKHMTGDVFRGNLLDGFFNLAGALTGQGILLVGMMTEAVVTPWLSDRDIALQNVKYVLNGAGNLHEDFTPGPFIRGRANQVLGEAIDLLERIVDDTLMDAIADGTFGLMKRPADRGKGLDGVAKQEADYYNPVEEML

SEQ ID NO: 8302 - protein, 243 aa, Actinoplanes utahensis
MIIRPYGDTTGDGMVQLSFTLPIPHDKRAEGAALQLAGKMGMDPAMLVHAKQMGGGFTFFVVYGKVTHLVDTEQVQVVERDFPLLSAKEVNAVIKRRLRRRLNVVGACIGTDAHTVGIDAILNLKGIAGEKGLEYYSELSVTNMGAQVSVPDLVETARAQKADAVLVSQVVTQRDAHLQNTKAMSAAFREALPAGKRPLLIVGGPRFDELMTEELGVDRIFGRGTTPREVASYLVHALIESRN

SEQ ID NO: 8303 - protein, 121 aa, Actinoplanes utahensis
MITVTHRRYVPYSHAHYAGNLVDGAYSLGLFGDVATEVCIQLDGDEGLFASYDDVQFTAPVQAGDVLEITATVVHMGTRSRRIEFRSVVVCRGTGGSGAQVLAEPIVAVTATGTVVVPPKA

SEQ ID NO: 8304 - protein, 413 aa, Actinoplanes utahensis
MNSAVCVDVGSTYTKSAKIDLSGAELISRAEVPTTSGTDVLEGLTAAVAAVDGAGAPLYVCSSAGGGLRLAVVGYESLVTAEAGHRVGLSAGAQVVHVAAGPLTGAAVAALRAARPDVVLLVGGTDGGDGEVLLHNARRLAANRLRIPVVLAGNVEVRAEAARLLRERGVPVTETGNVLPRIGVLDPLPARAAIRAVFLRHVIGGKRLSRGNRFASMVRYATPDAVLAGVELLADRAAGGVLVVDVGGATTDVYSALVPDAELETGPRRDVAGTLWRARTVEGDLGVAVGAAGTREAAVAEKLPEPAGDRELAATAARIALRRHARGHSAGPGQPRTGGRDLRDVRLVVGSGGVLRHGGGDHVLDAVLHDTAGGWALPDRARTVIDKEYVLAAAGLLATDHPAVSGALLQTLL

SEQ ID NO: 8305 - protein, 300 aa, Actinoplanes utahensis
MQGNVPRLGLDFNAQRRAVLDNHVTATRQLAAGVAAGRQPQPDLVVWPENASDIDPLRNTDASAEISAAATAIKAPILVGAVLRTDKPADIKNAGLLWLPDTGPDLAQTYVKQHPVPFAEYMPLRSVARLVTDRVDMVKNMLAGDHSGVVRTGSLTLGDVICFEVAYDGIVRDTVTGGAQILAVQTNNATFDVGEARQQLAMVRLRAVEHGMDSLMVSTVGVSAFVDTRGDVHGATGFNTAKVVVHKMSLGATRTLATRSGIWPEAIAVGLAVIALAGAAPLRRRRPVPSTDDDMSVEER

SEQ ID NO: 8306 - protein, 262 aa, Actinoplanes utahensis
MTEVEGYPGVGRVLVIIPTYNEADNVRLITGRVRAAVPEVDILVADDNSPDGTGAIADELALADDHIFVLHRQGKEGLGAAYKAGFAWAKDKGYDAVVEMDADGSHAPEELSRLLDALSGADAVLGTRYIPGGSVHNWPMRRLLLSRGGNIYIRMALGMPFRDATGGYRAYRMTVLDAIDVPSVASTGYSFQVELAWRAYRGGFKLVEVPITFTEREHGVSKMSGNIFKEQLLRVTVWGAQARKESLLTLLGRKPRQEQTWP

SEQ ID NO: 8307 - protein, 170 aa, Actinoplanes utahensis
MRRGLSLALPLLSLAEVAVFLTVAHLIGAGWAFLLLAAFTLAGFALLRREGIRGWRAFQQSAAAGRPPGAEVTGSLVGLGGALLLALPGFVTGIAGVLLLLPPLRGMARRGVERFAERRLGAGMTGDLFGPRKVRVRVDDPTVVNSSVVDAGFPPSPRHPAAAIEGEIVR

SEQ ID NO: 8308 - protein, 112 aa, Actinoplanes utahensis
MGERMLRGSRLGAVSYESDRNTELAPRQTREYLCVKGHQFEVPFAVDAEVPTTWECKFDGSVARLVDGSEPEQKKAKPPRTHWDMLLERRSIAELEDILNERLQEVRTRRGR

SEQ ID NO: 8309 - protein, 109 aa, Actinoplanes utahensis
MAEAGARADRAAAEAGAVREELAGVVAERDGLRRTAAEVDRAREDLRRAGEERADLERRLVAARADADAAHQRVAQLTGQVSDLASALAALGTSRPAAAAPAQAASPEA

SEQ ID NO: 8310 - protein, 129 aa, Actinoplanes utahensis
MTTQDQAAEAIETRPCSHCGRPVPQRASAGRPFRYCRDNDGECQRASRNVRMRHRSSPGLAGSVARTWEVVDRLDQMVGTLTEALHSEMSPAGVERQVAEVRAETSRAVAAAHAERDDARRDAEQAATA

SEQ ID NO: 8311 - protein, 613 aa, Actinoplanes utahensis
MASAAWSCVVIAPPTLGRSAILPMSPRWTGFRGPGAGGQRVYRGVRTAARVEGAVRVPRCPDCGPGGGYSACLPRRPDCGPTGRTRRHCRIRREKCAAKVAVELSGSGLRHTVGMPVAGRHRTVAAMALPFDLWGQRGWAAAEVAGESHHHEAIRGLFGGRLSAGGAEMAVSAQLLPDPANPHDRDAVTVWVGPVQVGHLPPDAAKRYAPALASLVARGWTPQVGARMFATQRGPHDFSASIRLDLAEPHLIAPANHPPREAYRLLPTGAPIEVAGDDEHRDVLIEFLRPEGECWVHTTLHEAGDRTATIEVRLEGLRVGRLSPRLSGELLPAVRHLHDRGLTTCARAIISGDTVTTRLMVYAVKAHELPESWLDAPPEGASPAGPTVPEPMAAPGRPAVVPALESSPAAETAVLPAPLLSAPVTPDPAAGAPVPSASPSPVPAAPPSAPPPGTPAPSGLPTALPSPVVPAGVVAPPVAPVRHPAPRPRPTPESNSAADTAVLSTAPAGSPVTMPAVPGHPAEVGRRTVPIVPAGSGPVPVVPGTVGAGPGGAPGTPMPGPTADGGFWGAPSIEQGDAAGAPEFPGTPDGRHGGSSGVPGSPVVGQGGSSGSP

SEQ ID NO: 8312 - protein, 343 aa, Actinoplanes utahensis
MSPGSPAGGHGAFGLPGAAGGGRGSEAHDVRETGFAETRGAQAPRSPQAAHRPAGLRFNPPPAWPAPPAGWTPPPGWTPDPAWGPPPAGWQLWVEDRGFSPTDPAAGHRHPGAIDVDWLRAGSDATTTEFDRIRPDGEAWVPDVASPGDGGDGWPAEGDRSRVGGDGWPAEVDQSRGSGDAWPAEIDQSRGSGDAWPAEGDQSWGTRDVRAPEFADAHGGASAVGFGDPLSGGDGWAAEFDQGRADSDALHAELGRVRADRDLAVAELERLRADRDALAGEVDRAHADRDVMAAEVSRLRADREAMRSEIERLRDELGRVGHPEVPDPGRDRRREDFGGYRLR

SEQ ID NO: 8313 - protein, 442 aa, Actinoplanes utahensis
MCSSKIGDTANRVCSRSSAPTSNRITTPTLRLLANQSPAACAGPEGGRVTYRDVFAEPRFRVLFLGRTAAIAAESLRIFALSVFVFERTGSALLSALAFAAGFLPQLAGGLLLGVLTDRIRPRPLIVTGYLAGGVAALLIAVVPLPVAAQLTIIGVVACGTPIFMGAAGRLVAEVLTGDAYVLGRSVLNAASSGAQLLGLALGGVAVAAAGPRQALLIAAGGQALAALIIRLGLPDLAGESADRGSAVRASLAGVRDLLGDPIIRAFLLAQWLPSACVAGAEALLVSYGHGRGFPAGAAGALMAAVPVGMLAGDLIVGRWVRPATRERLVRPLILLAGAPLLLLLTGPTLPATLGCLVLAGAGYAYQLGLQRPLLDATPEGRRGQMFTLLSTGLMTLQGLSPVVLGVLAQWGSPAAAIATAGAGTLLCMILPPRTRELVKRT

SEQ ID NO: 8314 - protein, 323 aa, Actinoplanes utahensis
MRFEVGAEDLLHTRFAVSPIFELHNLLRALHAPAPGLPESWLARFRPAFDQLRPDPWLTAVLALKSARSGANFFAPPPRGMTQTIDQDLAAIRAVPLRAARTEIDFYLARRRVPAPVRILLYADDVLDRMAAFLSDAWSALMAPEWPTIRAVCERDVVHRSAELGRAGWSAALAGLAPKVRWHRGGIELTAHRGPAGTLDGTGLLLIPSVLIWPRTAVFGDDPWPKAIVYPARGVGTLFELSPPAVPDTLAALLGRSRAQLLTALADPASTTHLATAFNLAPGAVGDHLSVLYRSGLLSRARSGRSVLYSRTPLGDQLVHTAR

SEQ ID NO: 8315 - protein, 129 aa, Actinoplanes utahensis
MASRTVSAAVALVGAAGLSLAAAVPAQAATPCVQKVSVINNGGFVIDFQVTTRTGELSASTDDYPINQYRVVDLNSTPFAEGSDVRPLVHAQAGNTVPGNVFVSFCNNGQTATYTASGTTLNYTVTLLT

SEQ ID NO: 8316 - protein, 199 aa, Actinoplanes utahensis
MTGRSTRSACEEPPSGVRHFPMCNLRLLKSRWWATVTCNQRLQEDVMEQGIIEREIFIEATPEVVFEVVSSPEHLKGWWPDDADYEARPGSEGTITFGDCSAGGKVVQFAVVDARPPRTFSFRWTHPAGEPPTAGNSLLVTFELTPSGGGTLLRMTETGFRERGWSQAIAEQEYREHVHGWGIFLPRLAPYVATLQVQP

SEQ ID NO: 8317 - protein, 112 aa, Actinoplanes utahensis
MSTAVDDDLWSAVGDPTRRRMLDLLLAHGEGTATTLSQQMPVTRQAVAKHLTVLDRVGLVRGTPAGRGKRYRVDDAQLARAIGQLASVGAAWDARLRRIRTIAEAIQQTTTD

SEQ ID NO: 8318 - protein, 155 aa, Actinoplanes utahensis
MCGRLDRMSLEIARELQITFDAADPAALSAFWAEAIGYRLQPPPAGFSSWEQALEAWGVPPERRNDASALIDPKGAGPRLFFQKVPEGKTAKNRVHLDVRAAPGLTGDERMAALEAEAARLVGLGATRVQRHEPVPPNAGHIVMADPGGNEFCLD

SEQ ID NO: 8319 - protein, 247 aa, Actinoplanes utahensis
MGGIGCERLWSGSGCRPADHASRRLLVLPMAQNRWVTFRGWPVEALEFYEGLGADNSKTYWTRHLAFYEEQVRGPMLELLAALEPEFGPGKVFRPYRDVRFSKDKTPYKTHLGAWLESGGYLQLSADGLAAGSGYYRMDPGQLDRFRRAIANDVTGIQLTTLITDIERTGISVVGRDTLKTAPRGYPKDHPRIDLLRHKGLITWREWEPAAWLGTAAAQKRVVEFLRAGLPLRHWLDDHVGPPLAGA

SEQ ID NO: 8320 - protein, 280 aa, Actinoplanes utahensis
MDAADFSSFRETPVSELLAARYGTAAAPLDTLTDTIRLQLRRRSVRRFLPGEVTDDQLTALTAAAQSAATSSNLQVWSVIAVRDPGRRQRLATLAGNQSFIAQAPLFLVWIADLSRARRLADRAGSSLTGADYLESTLITFVDAALAAQNTVIAAESLGLGSVFVGAVRNRPEEIAAELKLPPHAVAAFGLAVGTPDPAEAAAVKPRLPQAAVLHHEQYDADAADAHIPVYDERLAAYNRRFGLSGGWSERVLSRLGGAEALGGRHRLRETLERLGLPSR

SEQ ID NO: 8321 - protein, 354 aa, Actinoplanes utahensis
MIGKASEFLWYIPNEDRPGHRGDDVVDGHNSLAALTAQALACERHGWSGALIGTGWGRPDTFTVATALAARTTTFRPLIAVRPGYWRPAQFASAAATLQHLSGGRVLINIVSGKDRLAAYGDEEQDQASRYGRTREFLHLVRRLWAEEHVTHRGGHFAVDDSTVVPRLATPPRLYFGGASAAAERVAAAAADVQLFWGEPLDGVRERIERLTALSREVGRDLPPLEFGLRITTVVRETGAQAWADAEARVAAMAGGPAIDPLWAAATGQRRLLDLAARGDVLDDNLYTAPARVGGGGAGTTWLVGSAAEVARSLRKYQNLGISHFVLSDTPYLPEIARQGGQLLPLLAETALRA

SEQ ID NO: 8322 - protein, 583 aa, Actinoplanes utahensis
MGNTVRTHWTGDSGADSPVPPGTTPPSTILRGGYPQTDRIRADHRCMRIRDIGVGTRLGASYLVLTTLIVTSAGVGWSGLRQQAAAEKELAALERVRDDIQTAKYNAADVTGWQGLVIADIGAFGYAFATGPKGYNRQGEMKSKAAIYAQLASADTADMSPAERAEFAKLKTAWDEFFTWDTTVMRWLSADTQASRAKAMDSINGGDAAAAYGKVLDITAGLDKSVTDRTAALRAHVQRVRTDAMRGLAIALALAVILAVLMGTWVTRSVIRPLATVVAALKRLAAHDLTVRVSLDRRDELGTLGDAVNSTAESLSHTVAAIAGHAGTVSAASQDLSDVSTQIAAASSEMDTQATAVATSADHVSGNVQTLQAGSTEMTLAIDEIARNAGEAAQVAGEAVGVVARTNQTVGKLGESSAEIGKVIAMITAIAEQTNLLALNATIEAARAGELGKGFAVVAGEVKELSQETAKATEEISRLVDAIQADSTEAVGAIGKIGDVVARISDFQTLIAAAVEEQTATTSEMGRNVAEVADSSTAIATSIAGVATAVGTTTEVVNQAQSNAANLARTSSELRELVAGFTL

SEQ ID NO: 8323 - protein, 241 aa, Actinoplanes utahensis
MTDAVRLEALVKTYDNAVTALDGVTAAFADGTFTAVMGPSGSGKSTLLHCAAGLDRPSSGRVFLGGAELTATTDTELTRFRRARVGFVFQDYNLLPALTVEQNVQLPLRLAGRRADRRRGRAILDQLGLGDRLTQLPAELSGGQCQRVAVARALLTEPAVIFADEPTGALDLRGAREVLTLLRQVVRDHGRTVVMVTHDPMAAAYADSVLFLADGRLAGSLAAPAPDAVADRLAHLTGVPA

SEQ ID NO: 8324 - protein, 391 aa, Actinoplanes utahensis
MRRTGTNLPKVGQYNRAVVLDQIQLADGISRVEIAELTGLTPQTVSGIVRRLIGEGIVREDGATVSNGGKPRTLLRVNAAAGLAVGVHFDPSQLSCVVADLLGRPLVQRQQPIRPGAGPTEVVAAVAGLVTDVLAAAGVPRDRVLGLGLATPGPIDQSLGALVGPPQLLGWTRVPLKDMLAAATGLPVTLDNDATAAAIGECWAGAGRGVADFAYFFFGAGVGGGLILGQQVYRGGSMNAAEFGHQTVLPGGPPCYCGNRGCLESLISPGALVARSGLTDYDTLRQAALDGDRAAVDVVEAAAEHLATAVVNVANILDVDLFVLGGHGLRHLESRFRDAAAKALETRPLARSIRTVRVEVSPLGADAAVVGAAALVLHTTYAPQVSELLSL

SEQ ID NO: 8325 - protein, 515 aa, Actinoplanes utahensis
MSAAAPLLEMRSITKTFPGVTALSDVNLTVRDGEIHAICGENGAGKSTLMKVLSGVHPFGSYNGSIVYRGAEARFADIRASEHAGIVIIHQELALVPGMSITENIFLGNEPTRFGRIDWKAANRRVLELLAMVGLNEDPDTLVKDIGVGKQQLVEIAKAFAKDVQLLILDEPTAALNETDSRHLLDLLRGFRKRGITSIMISHKLNEIEAIADSITILRDGRTIETIDVAAEGADEDRIVRGMVGRDLGSRFPEHEPHIGEVFFEVRDWTVRHPISAERLVCKNSGFTVRRGEIVGFAGLMGAGRTELAMSLFGRSYGIYLSGQVFKDGQEIQLRSVAEAIGHGLAYVSEDRKAIGLNLLDDIKTSVVAAKLSKITKNGVLDEAAEYHEAEAYRRSLRIKTPSVDEGVTKLSGGNQQKVVLAKWMFTDPDLLILDEPTRGIDVGAKYEIYGIIQRLAAEGRGVIVISSELPELIGLCDRIYTVFEGTITGEIARRDADPEVLMKQMTSTKKLATP

SEQ ID NO: 8326 - protein, 524 aa, Actinoplanes utahensis
MDVHRPGSADPRRAHPGHRRRCEIRDLRDHPAPGRRGPRRHRDLLRAARADRALRPDLHGLRGHDHRRDRPPRRRPGSPDEADDLDEEAGHPMSRIKDLQKNLFGGTTSNARQFGMIFTLVAIIVFFQIRTGGLTLQPGNLIALTQQYAYISVLSIGMLMVIVAGHIDLSVGSVAAFVGIVVAKAISVHHVPWPLAIVLGLVVGAAIGAWQGFWVAYVGIPAFIVTLAGMLLFRGGNQYIGNADTVPVPPGFRQIGAGYLPEVGPDTGYNNLTLLLGLLACVAVVWRELRSRQVRKQMEGAEPAPMWVSVIRMAVMIAVIIFATLRFAGGRVGTSFPISGIILAVLVIAYSFYTRNTAGGRHIYAVGGNARAAELSGVQLRRVNFLVIMNMSVLAALAGMIFVARSTASGPQDGLGWELDAIAAVFIGGAAVSGGLGTVGGSIVGGLVMAVLKNGLLLTGTGSDMDQIIRGLFLLGAVALDVYNKKQGRFSIIGSLTRQFRPRHEVAAAETLAEDREKTPATRI

SEQ ID NO: 8327 - protein, 367 aa, Actinoplanes utahensis
MRSFMIKSLAVGTAVVLALSACSNDRTKSGGDTGNTKGFAKDGLIGVALPSKTSENWVLAGDLFTNGLKDAGFQSDVQYAGASTTVADQQAQITAMVNKGAKVIVIGATDAGQLTNQVAAAHQAGAKVVAYDRLITNTPDVDYYIAFDNFKVGQLQGQALLDGMKAKKPKGPYTIELFSGSPDDNNSGVFFNGAMDVLKPEIASGTVIVGSKQTDVKQTATQGWKAENAQSRMDALLNSTYTGGKTLDGVLSPNDTLARAIITSIKGAGKPVPVVTGQDSEVESVKSIMKGEQYSTINKDTRKLVAETITMVKALQAGNEPQVNDTKSYNNGVKVVPSFLLPPVIVTKANAAEAYANDPKLEPLTKS

SEQ ID NO: 8328 - protein, 237 aa, Actinoplanes utahensis
MDLSDARELALRLMAEHRLSRWRLTFDDAKTRAGVCRPGRREIGLSRPLISLYSPEQVTETVLHEIAHALAGARHGHDEVWRAIAVRIGCSGRRCVPEEAPRVDGAWEGFCRQGHRTTAHRRPVRVRSCRNCSPGFNRSALFAWTYRGHPVPLHPDYVAELVRLHGAAPVALAVGDRVRLRGGGKYGGVLGTIVKQGRSRYQIQTPRGLLNASFSMVERIPPNSTRTSPDRERPGRC

SEQ ID NO: 8329 - protein, 555 aa, Actinoplanes utahensis
MSGAARFAADHPWDGLAYGWIVASPVARGRLNAVFTDPAEDDDVLVVLWHGNVPHLPGAGSPEATAGAGAPSPSTPASVPGPPGFDGPEPPPLQSDRIAHRGQPVALVVADTLEGARRAARLVRWDITEERHDVVLRAIDPGPPTDIGLTPDTTHPGPPAAGTDIGLTPDTTHPGPTTPGTGIDAMSGAANPGVDVVYTTPAAPDGPLEPPATIARWDGQRLELSASGQDPDTVAELFGLPTGHVRVIPGPGGGSGPVRPDAVLAALGAWVTGRPVQVTSPHPAGFRAPTVQRLRISATPDGRLTAIDHTVRTATSRFRDPGVVPHGGYDVPDLTLRHRAVPLDVPPSRSARTPGTVALECALDELALSIGMDPLTFRERNLRGDCLRRLRAGAARFGWPDRPHGRAGEWLIGTGLAGGAHFAEVRVSTVTGEVGVTRLFGVYTARDAADARATRSRFLGDMVAGVSMALHEAPAPDPEGGTWTDSAPGGSRIPAYPDIAWIDAAWVDGLEPSRSDIGSPAAAILNAVADATGTRIRTLPARLPDLLAGGTAAPA

SEQ ID NO: 8330 - protein, 341 aa, Actinoplanes utahensis
MRGVPGDGPGHPAGGGPMKTFDYRTASGLADGLEPGAVFLAGGTNLVDLMKLGVAAPDVLVDVTRLPLHDITTLADGTIRIGSGVRNSDLAADRRVRTGFPLVSQALLAGAPGQLRNMATTGGNLLQRTRCRYFLAAGLPCNKHLPGSGCPARTGDHRDLAILGGSAGCIATHPSDLAVALAAVGAVIRVDGPAGAREIPVTDLYRLPGDEPERDTVLEHGELITAVDLPPLSAAARSAYRKARDRASSAFAAGSVAAALRTGDGLVREVRLAFGAVAPKPWRALAAEEALRGGPATRERFLAAADAELAAARPLRDNAYKIPLIRNLTAAVLESLTEDAR

SEQ ID NO: 8331 - protein, 186 aa, Actinoplanes utahensis
MRISVNGVQHHLVGLDPRTTLLDLLRERLRLTGAKRGCDHGQCGACTVLLDGRRVASCLILAISQQDAEVTTVEGLGHAADPHPVQRAFLAHDGFGCGFCTPGQICSAVGMLDEVARGWSSAVTGAAGPPSDPQAARHGDAEAGPHSDPQGDPLSDAEIRERMSGNLCRCGAYPAMVPAIRQAAGR

SEQ ID NO: 8332 - protein, 57 aa, Actinoplanes utahensis
MGMRMATCNLCHRDVPDEQIEEHRRDVHPDVAADGTRETDDSRIVPDSTVPPAPREE

SEQ ID NO: 8333 - protein, 623 aa, Actinoplanes utahensis
MIFEGRSRRISREYAVFVRLSAVLFSVVTVTALAVWSALMPTRMLLFGTVAIGPALAAAAALPSVVLLVGGYAFAAALAVSTAEGLFGTADQWLRLAFIAWATAVSWGLAVFQRRAQRSASGAARERQVLAAVAEQSGDAIISTSLDGTIVAWNGGATRMYGWPAAEVIGRSLAEILPDDRGDELQRALGELAAGRRLHLDESRRVRRDGTPLLICADVWPIRDENGVVVAAAATERDITEEKLARERSARADRLESLGQLAGGIAHDFNNLLAIILNYADFLDGEVSGEAAEDLRRIRNAADRAKELTGQLLVFAKREPTQVEVIDLNQVVTEAGELLSRTIGENVRLVNRPSAAPMPVRANRARLDQILLNLVINARDAMPDGGVVVVETDLVEVGEGPAAPLPPGRYARLTVSDTGCGMTAEVRDRLFEPFFTTKPPDRGTGLGLATVYGIVGDAGGTIGVESAPGVGTTFRILLPSAAVPAGASPGPSQAELAHGHGELVLVVEDDEFVRDLVIRILRDNGYRATALGDGPLAALDLHDVALVITDVVQPGRSGPALAARLRARRPDLRVLFISGYSDADVRREHRIEPEARIVQKPFTAVELLAGVGEALAAAHANGA

SEQ ID NO: 8334 - protein, 198 aa, Actinoplanes utahensis
MAITPAEINGIAFRRPRPGASGYHEEQVDAFLEDVAGEMRRLEAENRALSSRLGHDDLAERVRRAELECLEAQERARALREALTAAREASFTPVNADKSGMLEVAQRTADACVDQARAEAELLVEQATTKAAQLLSDAQLRASTIVADARHAHSEAIAGIEAQRAATLDEISELIALAGRQRAATADDISGRLQEFTS

SEQ ID NO: 8335 - protein, 740 aa, Actinoplanes utahensis
MPRTVLASTALALSAIVVFAAILAGWHVPPVLLWLPAAPSCMIPMVIAARITRISGFPRPTRMFWGHLAACTVLSAVGSVCNAVDALGHGAPTQEMSPWTVAAYGGCVVALMAGMFRLPMGSTGSGDRLRIGLDAGTVLLAASIFMWQFQRTGSPVVIGFTMVLQLVTIFAIAKVALAGHHYIARNALRLFALGLFGGVLIGASQRFIADRPELNMGPLGVPLIMVLATAAAEVQRNSCPSRAGLRVGGRRPFSVLPYLAVVAIDGLLVATCWPHPRERLVVLGAVALTAVVMWRQITAMRENTGLVARLDHNSTHDALTGLPNRALFNARLAGGEAGQPVSVALIDLDDFKTVNDTLGHGAGDALLTTTARRLRASVREVDTVARLGGDEFVVLMPGLTAAEAEPVARRMIGSLAEPVLAEGHDLLVRASIGIADGPGDEPGELLRRADIAMYAAKHEGGGTVRVYTAGMAGAVADTAALGAQLRQAIAGGQLRLEYQPIVALDGSHLTGVEALVRWQHPQRGMIPPGEFIPVAERTGLIVPLGEWVLRTACEQHAAWRTELGPDAPARMNVNVSARQLSEGDFLERVVHILAVTGMPAELLTLEITESTAVALGEESTGKLEALRRTGIRIALDDFGTGQSSLTLLHELPVDQLKLDRSFVEATQGRRLNMPAAVFALAGAAGLDIVAEGVETPEQADRLAALGYRAAQGFHFARPMPADQLVNSCRRPEMSSAVAAR

SEQ ID NO: 8336 - protein, 384 aa, Actinoplanes utahensis
MVPARFGADRAWGERAARPLRILAGNGARPSNAELAALRAGLTRRDEPAAALVRAVRESPVLTIGDLHRIVAAGPAEDLPEPFAGFFATVARRPDWVDDGLLERGAQACRAFGMDAGLVLAYGSLLGGYRTGAALEPLVRTGRLTGGETLRRIKETSLWWRSVTAPGGLAPDGAGLKATLHVRVLHALVNARLENDPTWDHAGRGLPINQYDQASTLGVFSTSFLLHLRLLGVRVTRADARAVMHLWCYVGWLLGVDEQWLPHTERQGRRQLYHFLSHDPPPDANSVALARALIAMTDDVTHGWRRTFERERALSVSSWLLGRHALRDLGLPYRPPWYALTRVAANLLITHVLARLPGGRTRLLTRAERQAQAQFARWGAELPA

SEQ ID NO: 8337 - protein, 244 aa, Actinoplanes utahensis
MSQQRVAIVTGASRGIGRAVAQRLAADGAAVVVGYSGNAAAAAAVADEITAAGGRAIAAGADVADETAVAAMFDLAEQAFGGIDVVVNSAGIMHLSPIAELDLDDLDRMHRTNIRGAFVIARESARRLRAGGALVMISTSVLGLQFPTYGGYAASKGAVEAMTMILARELRGRDITVNAVAPGPTATDLFLEGKDQATIDRLAQQPPLERLGTPADIAAAVAFLAGPAGHWINGQTLRANGGII

SEQ ID NO: 8338 - protein, 208 aa, Actinoplanes utahensis
MTGLRDRCPGRHYGGMTGRDNDVRRPSGLVTGSLIGLSFGTVFVMVNSGDLPDPWPTVIRAAAVVTAAALLFWMFRVVRSAGSAAGSDDVQGFAHRAYWYAVVGEVIALFGGLYVINQVLDKPDVAVAWVALVVGVHFAPLAWAWRMPFYYWLAALMAALGLGGLLAYAAGASAGTVALIAGVGSGFALYGAVAAGLRYAQRRAASIV

SEQ ID NO: 8339 - protein, 327 aa, Actinoplanes utahensis
MVDIGWVRRMDAITGGAIVLTVDAVIFLMTALVGAPLLLFFMADDEGAGPLWPYATVWGVSAVLGAGSAAVAYLIGDRGTRGIRQIGASIALTTAVATGALVVGAIESSPVLAMVSALFAAANVGAVKMLLGPEPVEAGPPALPNTFLLAAPLAEAEFRTRETVEIQVRPAPAIASGDTEAPAIVSGDTEAPAIVSGDTEAPAIVSGDTEAPAIVSADTEASATASADTESAAGERRDEKTGAGETTRTESQTGLAAFSGTIDAGLADVDAAGGESDSEVAEAESVDVTSPARRIVGRDPRIRPRGSAAMHTMGGVRLPPRATRRRS

SEQ ID NO: 8340 - protein, 258 aa, Actinoplanes utahensis
MVDGADVLEVAGRLGPYFRWEPVNDAADWRPFRDLLDHNVAAERVAIARSTLVRMSGLTPDAIGERETASITFLGLASRLLSPLLGAASIAGALPLPEPDRLWWRPVPGGPVPVAYRAVDAVPCTTEPATVIAARFTETALARLTGPLLETFRTRFSLSPQVLWGNVASALGGAAGMIADQSPPHASRAAEILEALLLRAPLRATADLVRPDPARDRRFLVRRNCCLYYRIPGGGTCGDCILTPPTDRENHWRAVLHR

SEQ ID NO: 8341 - protein, 567 aa, Actinoplanes utahensis
MKLEVRRLWPIFAALTACVLGFLLLRQVATSAFDGLEARQVAQDADRIRIGLDNQAQLLTAFGVTNSIWDEAYFTIARGDEAAFDVDYPPASQHDDNGLDGVLGVSAAGKLLVGGLTDGGDRFTALPADLNDPALLKRLYDPNARAGTPTCGVLAAGGGYLFCGLGAFRSSGEGAPSGGFIMLKRLDAARLAGLGKELSLSIGLVGGVRPGAVAQPALSSRMGAVQVHTAVLGTDQMAVDASVATVDGGSLTMEAVQPRPIYQAATRTAWRLFALMVVATLLLVLFMRWSTRRALRVRVRPLRETTEQIIASGDHTLRINASGSDDLAALGRTVDGMLDRISANEELLRTEQEQRQQELQRAHDEQTAAQSAAQRAARELVSGTSTVVSAQLADVSERAGSVSAAAARIEGQVADVREVAGRLLTGNAEATGAIGTLHASLAQVDEVARFIGGIAKQTNLLALNATIEAARAGAAGKGFGVVADEVKSLALTTAESTRTISTTLDELNEHVAAVVEIMSGMSAAITDIDATTARAQSMTAEQATTLTALTGQVSAAIRKLDDLAVAD

SEQ ID NO: 8342 - protein, 180 aa, Actinoplanes utahensis
MAIDIHGKRIAFLATDGVEEVEYTEPRKAVENAGGTAELISIKDGAIQAVNHLDKAGTYAVDRLAKDAAVTDYDALVLPGGVANPDFLRADPDAVRFVRDFAATGKPVAAICHGPWTLVEAGVVEGRTLTSWPSLRTDVTNAGATWVDAEVHVDGALVTSRKPDDLPAFCEQLLRSVSNR

SEQ ID NO: 8343 - protein, 164 aa, Actinoplanes utahensis
MTVPTWVKTAAGVVAAAGAGVLATDPDSRWYRRLRKPSWQPPPAAFPAVWTPLYALIAVAGARAIDRAEGSEQADLVRAYAVNLGLNAAWSGLFFGAKRPKAALAEILALNVSNVVLLRRAARADRLAGAALAPYVVWTMFATALNTAIVRLNGNGSGVRTRSG

SEQ ID NO: 8344 - protein, 501 aa, Actinoplanes utahensis
MSSDRIRALALSCLLTVGALVPAAPALADAGQDGNPGASVTDPDMPTLGSRLDAVRTAKTMNYYPSAAGWTAMWTRFDPIQVDSDLERIAALGGTTVRLVVFPKVFGFPQPDPDYLAELSDIINLAGLHRLTVKLTLFDWWSRYSSVNGSVTWANAVLAPYVDDPRVIAVEVKNEMSPDDAEAIGWARRVIPAIREFAPSMPLTVSVDGHAGPSGLARLKDVLGDDMLNYWDFHYYGPSEQALTEIRRAQEMVAPDPMVIGETGLSTAGSSQGAQAVYLARVFRAAAEAGVGSVAPWTLTDFAPGAIPAGSQVSAQPAQYRFGLFRADGTAKPAAAVVRDAWSGTTPGDDLLDMSFERDSDDSPWQDNLPGAGVATQTDETAHDGIYSVRFSGTGRDPRGLPSLRISPLTPVHGGQTWSASAWAKGLDLTGTTEIALSWFDAQGRWISQDRSLRLPPGTTDWTRLSVGAIAPPDAAALQLHLKSGDNAGAAWFDDVNLTVS

SEQ ID NO: 8345 - protein, 41 aa, Actinoplanes utahensis
MNKHFERTRGIDDTMTRESAQLLASFKGAKHRPAPRPSPSD

SEQ ID NO: 8346 - protein, 349 aa, Actinoplanes utahensis
MPADPPTPYVAVDAEILDRNLRAMAGRGLPLRPHAKTHKCVEIARRQLELGADGLTVATVSEAEIFADGGADDLFIAYPIWPSGQRADRLRALAARVALRIGVDSAESAAALGRAVPGLEVLVEVDSGHHRSGVAPGSAGEIAAAADRAGLTVRGVFTFPGHAYGPGRMAAAVWDEADALTEAAAAVAAAGLDAGVRSGGSTPTAALTGAGPLTEMRPGVYVFGDAQQVELGTCGWDEVALTVESTVVSRSGRRIILDAGSKVLGADQQAWATGGGRLLGHPQARITALSEHHATVLFPGDSPLPGLGDRLWVVPNHVCATVNLADELVVTSGGELIDRWRVAARGANT

SEQ ID NO: 8347 - protein, 140 aa, Actinoplanes utahensis
MLTFDPFREFDRMMGAGAAGLAMPIDLYRSGDHFILHCDLAGIDPGSVQVDVDRRVLTIRAERSARTDDDVQWVRRERPTGTFERRITLGDGLALDQISATWQDGVLTLTIPVAEAAKPRRIPISTGDRHESPAPALTES

SEQ ID NO: 8348 - protein, 536 aa, Actinoplanes utahensis
MSLTCTNLSFSWPDDTPVFDDLTLAVPPGRTGLVAANGSGKSTLLRLISGELRPTGGSVVVDGVLGYLPQHLPFAAERSVAEVLGVDRILAALHAIEAGDAAEEHFTTVGTDWDIEERTRAELDRLGLGGIGLGRRLATLSGGQVVSLGLAAQLLKRPDVLLLDEPTNNLDGPARDRLTAVLRGWSGTLLVVSHDRALLDGMDRIAALDHGEIRWYGGDFTAYSAAVRSEREVAERQVRTAEQDLKRQKREMQQARERAARRASTAARTLGDAGLARIVAGGLKRDAQVSAAKANETHANRVGDARARLDQASRAAKQDDRIVVELPDTTVPAGRTVFHGENLQVAYDGVPVFAAPGVDLDIRGPERIALIGPNGAGKSTLMRVLTGDQRPDAGELTRADGRVAYLSQRLDLLDQDRTVAENLAAWAPALPDADRMNLLARFLFRGARAHLPVRALSGGERLRATLACVLFAEPAPQLLLLDEPTNNLDLDSVGQLEAALSAYRGAFVVVSHDERFLDEIGITRRLRLDGGRLAEL

SEQ ID NO: 8349 - protein, 87 aa, Actinoplanes utahensis
MDAEQELTDRVVASFADTPDPRLREVMRSLTRHLHAFVRDVRLTEDEWRAAIAFRTAATSVIARGAGSASTSCWLRPPTLRFDDREA

SEQ ID NO: 8350 - protein, 315 aa, Actinoplanes utahensis
MELRHLRSFAALAEERHFGRAAERLHIAQPALSQQVKQLEREFGVELVSRTTRRVELTEAGLRFAEHARTVLGSVDRAATDMAMVASGQAGRVSVGFIGTATYELLPLAAREVRRLLPEVRLELHGELLSPALLDGLLDGTYDLIVLRPDSLTTPRTETRPDNPTTPRTESPGADIRVLRTERLVAVLPDWHDLADQPRIHLSDLAPDPFVMHFSGHRSSMHEHVLTACAAAGFRPSSIMEVGETATLVVFVAAGLGVALVPEAVRSLALEGVVYLPLDQAPTIDLALATRSGETSPAVRQVAEIVTRCTGIGWR

SEQ ID NO: 8351 - protein, 391 aa, Actinoplanes utahensis
MNSAYLYAAARTPFGRFGGALADARPDDLAAAALSGVLAKAPGLDPAGIGDVVWGCANQAGEDNRNVGRMAVLLAGLPVSVPATTVNRLCGSSLDAAIIASRTIESGDADVVVAGGAESMTRAPWVLPKPSRAFPAGNVTAVSTTLGWRLINERMPQEWTISLGECNEQLGDKFGISRERQDEFAARSHRLADAAWAAGFYDDLVVPHPALTRDEGIRPGSSAATLAGLKPSFRPDGTITAGNASPLNDGASAVLLGSRSAADRIGVAPIARIAGRGVSAIEPTLFGFAPVEAADRALARAGITWADVTAVELNEAFAVQSLACVDAWGVDPEIVNAKGGAIAIGHPLGASGGRILGTLAARLRESGGRYGVAAICIGVGQALAVVLENVA

SEQ ID NO: 8352 - protein, 219 aa, Actinoplanes utahensis
MTARIVATAAEAVAGIADGSTVLIGGFGMAGMPVHLIDALIEQGATDLTVVSNNAGNGDTGLAALLAKGRVRKMICSFPRQSDSWVFDGLYRAGRIELEVVPQGNLAERMRAAGAGIGAFYCPTGVGTPLAEGKETREIDGRTHVLEFPIKGDVALIGAYRSDRMGNLVYRKTARNFGPVMATAATLVIAQVREVVDTGRLDPEVIVTPSIYVDRVVAV

SEQ ID NO: 8353 - protein, 214 aa, Actinoplanes utahensis
MSLDKHEMAALVARDIEPGSFVNLGIGQPTLVADHLPPEAGVVLHTENGMLNMGPAATGDRIDPELTNAGKVPVTELPGSAYFHHADSFAMMRGGHLDVCVLGAFQVSARGDLANWHTGEADAIPAVGGAMDLAVGAKSVYVMMTLFAKDASPKLVPDCTYPLTGLACVDRVYTDLATFAITPAGVVVRETFGITFDELAGRLTIPLLRMSSSE

SEQ ID NO: 8354 - protein, 309 aa, Actinoplanes utahensis
MRLGVNLPQTDRYDLARDVTVFARAAEEIGYDSLWAYERILAPVDTSGPHGLYGVPDLPWPPSYSHTTDALVTLSLAAAVTSRVELGTSVLVPGLHLPFRLARSIAALDTASGGRVIAGLGSGWSIDEFAATAPRPIEERGAALDEFLDIAAAVWGPDPVSYATDRYRLAPSRVNPKPARRVPIYLAGGNRTALSRIARRGDGWLPTGVPPQQVGRILGELRAEAAAGGRDPESLTCIFQLGVRGLAEAPDEGRQPYTGSLRQIVTDIAALEEAGVDHVLVTLASVAGDLKELIALAETLHREARAAGL

SEQ ID NO: 8355 - protein, 339 aa, Actinoplanes utahensis
MKRYVPLVLLLLAAALPYSAISLPGLFEGPLNSPGTLQLLAVCLVFGGLALGYDLLFGRAGLLSFGHALFIAAGAYGVDILIGHYGWSLWGAAAVTVAAAAVLAGLLGSVALRTSGIAFSMVTLAFAEVGHILVNRDPGGLTGGEEGLPMRTAGLPDRLVGVSNTVNLYWLALASLIVVVLVVHAIDRAPLGRTLTGLRDDERRIAVVGLDPYRVKLVAFVVAGALAGLGGVVYALVTAGASPHVASCDLTLTLIVMAVLGGAGTRWGALAGGILYAYLDQRLARLGGRLPGPLGEPLFVLGILFILAVYFVPGGLAGLRARLEPLRRAVRRREALPTP

SEQ ID NO: 8356 - protein, 288 aa, Actinoplanes utahensis
MSTVVLLTLTGLGLAALYFLIASGLSLVFGLAGVLNFAHGLFLSAGAYATWWAAPHWGLPAAVVFGIAVAAATGALVELLMIRPLYTRHTEQVLVTAGLSLAGVALLQSVWGADARVFPRPAWAAHVTGVLGATVPNDRFLLIGAAVLVVIALTMFLRYTRYGLIIRAGVENRAMVRALGIDVRIAFTLVFAIGGALAGLAGILGGMYFTAVSPGQGASLLIFAFIVVVIGGLGSINGSAVAAVGVGLLQQFVNYYGAAGAGDVSVVALLAIVLLIRPAGIAGTAVAA

SEQ ID NO: 8357 - protein, 237 aa, Actinoplanes utahensis
MSTPILRVADLSVRLGGSHILQGVTFDVAPTGVTALLGRNGVGKTTTLRAILGEVPAEGAVAVDGKPILGRATHRLVRDGLGYIPEDRCVFAGLTVAENLRLAERTPEPDYPLVHDLFPELEQRAAQRAGTLSGGQQQMVAIARVLLNPNRLLLVDEPTKGLAPAVVTAVATVLARVAERVPVLLVEQNLAVVRRLAGDAVVLEAGRVAWRGPATDLLGDAAATKSLLGVGTTAGSR

SEQ ID NO: 8358 - protein, 248 aa, Actinoplanes utahensis
MTALTVEDVSWRIGAVPIVDDVSLHLAPDEFVALIGPNGAGKTSLFNLISGLRRPSSGRILLGSRDLTALAAHGRARLGLGRTFQTSAVFGTLSVTENVALAVQARRGGAMRAWRHRADRDIAVRAAEIMAEVRLEHRADRIAGSLAHGEKRKLEIALLLAGDPAVLLLDEPMAGVSTEDVPTLVEVIRGLTAGTGRSVLMVEHHMDVVLDLADRVAVLHHGALLACDTPAAVMADPFVQRAYLGEGR

SEQ ID NO: 8359 - protein, 396 aa, Actinoplanes utahensis
MRSLSTSRRAVLGAAVLSAVVVTTSACGSPKDAAGNGSSINVGVVYSQSGPLASYGAQYVEGFKAGLAYATDNTGKVGDKTITVTYTDDAGDPVKAVSAAKDLIGKGYRVLAGSTSSGVALQVAPIAAENRVLFVSGPAASDGVTGANRYTFRSGRQSYQDVLTARAYLGDGRKVLVFAPDTAFGKSNVDAVTRVLGGAGATVSTIAVPAGATDFTPFASQIKAAEPDLVFVAWAGTTAGAMWQALDQQGVLASTKVVTGLDLRAGWAGFGAGASKLNLLAHYFDGATDNPAYQALKAAVPGGRTDLFHPDGFAAAQMIVHALQASPDDTAKMIGALEGYSFDSVKGRLTVRAADHALLQPMFQARLTGAGDAATATLTGTVSAADTAPPAAAMKG

SEQ ID NO: 8360 - protein, 273 aa, Actinoplanes utahensis
MCGSSTYSRSSLIRTVTGMTTARVVDLDLTGRTALVTGAGSGIGRACAERLAAAGAEVLAVDIDERAAKETATSTGGRALAADLSDPDAVDTLPGAVDVLVNNAGLQVVAPLPEFPPDKFTLIQRVMVEAPFRLIRLVLPHMYDRGWGRIVNISSVHGLVASPYKAAYVTAKHGLEGLSKVTALEGAAHGVTSNCVNPAFVRTPLVDRQIADQALANGIPEADVVEKIMLDRAAIKKLIEPDQVAEVLAYLCSPPAAFITGSSIIIDGGWTAH

SEQ ID NO: 8361 - protein, 266 aa, Actinoplanes utahensis
MDEVDIPVAGGALRAVSWPGDGPLVIAAHGITANALSWAAVARALGGKVHLVAPDLRGRGFSAQLPGPYGMDTHADDLVAIADYFGISRVPLVGHSMGGFVVAATAGKHPERVGPVLLVDGGIALGVPAAIDVDVALEAVIGPAMRRLSMNFDSEDSYVAYFRANPALGRYWSADLEAYILRDFTGTGSTCNLAAVRGDAADMLRNPRPAPFPLLWAPRGLADEDTGLYRADQLTGVDAEPVPDVNHYTILTAGAGHVASRLLALL

SEQ ID NO: 8362 - protein, 460 aa, Actinoplanes utahensis
MVAEHRGGGGHREQLQHRPHQGNDTMRHGVNVLNVGGPGPCAAPPPPTRILIMDLCVTSAPPALWTRDFRLYFTARAVSLLGDAMMPVAAALAVGALYGVAGVGYVLAVFTAPFVLFIVVGGVFADRIGARTMMIGADAVRAVSQGVVAVAFLTGTPPLWLLLAASAVSGVSAAMFQPGVNGMVPLIARDPQRANATLKVADAATQLGGPVLAGILTAVAGAAPVYAVDAATFVISGLCLALIRISPVAARGSATLLRDLRHGWTEFRSRIWMWSVILIWMLFGLLVFGPYIPLAAQLVGGRLGDAAYGTTMAALGAGTVLGGLAAIRLRPRRPLAAGAVALIGFAAIPFSVALTPPLPVLAAGHLIGGAAWAFWSVMWSTSVQTRVPGEVLNRVTAYEMAGSVSGVAVGQALAGPLTTVVPPRDLMLLATLVTLVVVALLLAIRPIRGLRRGSEQGEQA

SEQ ID NO: 8363 - protein, 315 aa, Actinoplanes utahensis
MPHRVVALVGPVLELFPVTAAAAVFGDHGPDLPRHYSFRMCAERPGPIPTTLGTEIVVPDGLAALDDAGTVLIAGWTPGPHFSAELGDAVLAAHARGARIVAVSCAVYIPARLGLLDGRRASVHWECTDDLARRYPQLFADGSILYTDHGDVATAGATAATVDLCLAQVGREHGAGLAIRIARQLSAGPPRTGCQRQGPAPASPGPAPDSLAPLLDWVVANLDRPLTVRDMAARSGMSERTVTRHFLEQLGVPPGRWLLDQRIASTRALLEETDLPVETIATRVGLSSAVNLRRRFRNALATTPAAYRRMFRTRV

SEQ ID NO: 8364 - protein, 357 aa, Actinoplanes utahensis
MFPRHGIRPGADAAPARPAEDRGHAPPAHHPAVAGRDHLRSRARVAVPEPGPGPQPDPGPRRPAVRGPGGAHPHRHGRARDRPAAVRPADPGAPDARPDLSARRGAAGRGHRDPGRALVRPPAHPGQPGHRGDPDPPHPDAQDGKSPMTTVLLIHGGLGEDMNADRFWHRPGVVTALRRHGVDVVAPDRLRRPTDWTAEADHLTTLLPGHPVTVVAGSNGCSAAVRLALAAPGRVARLLLAWPATAGDPRVDHHDRRGLTDRGTDPAVIDSMLTGQTLRGVTDDELAAVTAPVGVLASIPANPFHQRRTVDALMVILPTAVELPGCPEPPHPAFPAHAGRFVHTVVEFGNLSGAARS

SEQ ID NO: 8365 - protein, 206 aa, Actinoplanes utahensis
MATSPHALNHPTVVFYGDSIVTGWRGTTHPRARWSSLVSDELGWREVNLSIDGMGYFRRRGPRGGDDRYLPSATDTTLLDAAIRLDPDAVIVCLAANDIRMLPEHADEVRAAIDRDLTRLRDELPGRPILVVVYYTGLDLSERAILINSWIADTAKRLGLPYFDTFPQAIDYNYDLLCDDRSHPNDDGHRALADAILPTCRSLLPG

SEQ ID NO: 8366 - protein, 609 aa, Actinoplanes utahensis
MRRKRSLGLLVAAAVSLVAGLLAAPGPAIAAASLPCDLYAAAGTPCVAAHSVTRALFGAYSGRLYQVTRASDGATHDIGTLAAGGYADAADQDAFCNGTTCRVTHIWDQTSRHNDLQIAPDGGAGSGDRGADASEIAVTAGGHKVYGIWVSPGVGYRYNGVASGVAVNGQPEGVYMVASGTHVGSDCCFDYGNAESTPYDTGNGHMDAVSIATTCYFAPCQGSGPWIEADMENGMFQGGNGANPNPGNNSAFVTAVLKNNGQTTYALKGGNSQSGGLTTWFNGGLPTDKQGYRPMHQEGGIILGIGGDNSNRNRGTWFEGAMVAGYPTDAAENAVQANVVGVGYAGQTTIPNGPAGTVTGPGGKCTDVSADDTGANGAAVQIWDCQSFSEDQRWTHFADNSLRTLNRCLDATGNGTANGTPLQLWDCNGGGAQKFVQQADGSLRNPQSGRCVDSPNGTTANGTRLQLWDCNGAAAQKFAVNAGGVVGTPGGKCTDVGGDDTGGNGTAVQIWDCQSYAVDQHWFHQSNGALRTLGRCLDINGNGTANGTPVELWDCNGVGGQVWQQQADGSLRNPQSGRCLDAPNGTTANGTRLQIWDCNGSAAQKFTLS

SEQ ID NO: 8367 - protein, 235 aa, Actinoplanes utahensis
MFYDRGVTDEWGVRLAGDRALLDRGSTAERVADILRQRITEGVFLPGTRLSEESLREALGISRNTLREAFRLLAHEGLLEHQLNRGVFVRLLSTGDIRDLYAIRRILECGALRNLGAVPPEAVAAARDAIEAAEAAAERGEWGAVGTANMRFHQAIADLAGSRRVAEAVRGLLAELRLVFLVVADPRQLHEPYLVGNRALYELLAAGDARAAEEALQRYFDEAEGQLLAAYEAAN

SEQ ID NO: 8368 - protein, 285 aa, Actinoplanes utahensis
MTGALEVVRAGMRTTIQDLGRPGYAHLGVPRSGAVDGGALRLANRLVGNPAGAAGLEILLGGVRLRATRATTVAVTGAPCAVRAGERAADPGLPIAVPAGAVISIGQPWAGLRVYLAVGGGIAVPPVLGSRSTDTLSGLGPEQIRDGDVLPLGETRGMPPGVDVAPYPPPPVELRLRVWPGPRDDWFTPAAVRTLGSAEYRVAADSDRVGVRLAGPGLARAVRGELPSEGLVLGAIQVPANGQPLVFLADHPTTGGYPVIGVVDPADVDLLGQARPGTAVRFRPA

SEQ ID NO: 8369 - protein, 204 aa, Actinoplanes utahensis
MRIFRAGPSAVLIEWADGSGVAAAYRLLDAARKQGRLRATEIVPAARTVLVDGVAGTDQIRTLLTEATTAPPPATGPSRVIEIPTVYDGADLDDVAQWWGTDRAGVVAVHTGTAFRVAFCGFAPGFAYLTGLGPEHHVPRRATPRTRVPAGTVALAGAYSGVYPGASPGGWQCIGRTAAVLFDLENEPPALLTPGATVRFVVAA

SEQ ID NO: 8370 - protein, 431 aa, Actinoplanes utahensis
MIASRRVILASLIGTSLEWYDFFLYASAAALVFGRLFFPGFEPLTGTLLAFATYAVGFVARPLGGILFGHFGDRTGRKGVLVATLLLMGGATFLIGALPTHATIGAAAPILLVTLRFLQGLGLGGEWAGAVVMSLEHGDPRRRGLSASWPQVGVPAGNLLAAGVLWVLSATLSEAAFLSWGWRVPFLLSGVLVLVGLWIRGTVTESPAFAELAAEGGRARLPLIEVLRRHPRGLLVAMAARIGTDVAFYTFSLYVLTYVTGTVGRPRTVALTGVLVASGLQLGLIPFFGGLSDRLGRRPVYAAGAVAAGIWAFAFFPLLDTGNTVVIVLAVVVALAAHAAMYGPQAAFVAELFATRLRYSGASMGYQIAGILGGALAPIIAIKLVASTGGALAVSAYVAGALLLTLVALAFAPETSRDTGTSAPLSIATHT

SEQ ID NO: 8371 - protein, 292 aa, Actinoplanes utahensis
MPALPSGWTPYAVTGDADGTVWTTLLKPAGLVRVAGDPELEPLDGRPMLLAADRNTLWYTRSDDRIGRRDPSGTHTTFATPAGSSPYGIAVAPDGTVWFTAAGSDRIGRLRGGTITMIDLPLSGARPAMITTDRGGTPWAALNGAEALAVVRPGDTVELVRLPEGSAPVGITAAPDGVWFADIARGLAGRVAPSGAIDEFRFPDPACRPHAIAPDPAGGCWVTLWGSTELARVTASGEITRHRLPGAEPHGLWVCSDQVWVAMESGALVPVSRDVSGANASATSVSSNAPAT

SEQ ID NO: 8372 - protein, 189 aa, Actinoplanes utahensis
MADATQIPGAARPGGRTARTRRQVLDAVAAILLEHGFDGLTMDAVAERSGVHRATVYRRWRDPGGLLADTVDAARELPWEPPDTGSLLGDLTAINREVVAALTARPSIAQALIAASFRSPAAARALRDFWADRYARATVVVTRAGVPGDPRDVLVAACAPVFHELALMREPEPGDLAERYAAIAVRGSR

SEQ ID NO: 8373 - protein, 1294 aa, Actinoplanes utahensis
MRLVAAAAHDERPGLRVPGGRRPPGRLHEQIGLGGVHLEHRVERGGAPPGGEQRMQPGRAQFVVHPASVSQPASAGAAAVGRLVWRVRSVIGSMNVSMKRFIYPGVRMKGSFAVLAAALLLMPVSAPTAAAEPAVTLDGAHWIWYPEGDPATSAPAATRYLRRAFTVAASDIATAQLVVTGDDTIDVWVNGVRLAGSPRAADSWKRAVRVDLAGSLHPGSNTVALAARNTGGPAGVLGRLHAGSVDLVTDGSWRAATGVPENWADPAFSDVAWTTAKDLGAYGGGPWGAGVALPDPAAASPVSVTDLTVNRQADPVGVDTPRFGWRLAAGTGGQMQGRYQLTVGSTAGAADVWDSGIVASTASRDIGYSGPALGANRTYFWRVRVWDAQGRPSAWSAGARFDTGIALTAAFVGAPPAGDLSGADWIWYPEGDPATSAPAATRYFRRTVTLATSTTLVVAGDDTADVWVDGTQISASPRVTDSWKTAATVTVPAGTRTIAIAASNTTVGPAGVIAKLGGIVTDGSWRSATAAPGGWQQPGFDDSGWLAAKVLAAYGSGPWGGQVLVPAAAPYLRKGFAVTRPVARARLFATALGLHDTYLNGARVGTERLAPGWTDYTKRVQYRGYDVTAALRLGDNALAAQIGHGWYSGNIGFAGSRRYGTQPWYAAQLIIEYTDGTSATVQTDGSWRTAPGNILGDDLYAGETQDARLIRSGWNTAGFDDSDWVPVTVQNGARPTLVPQVDPGVTVQQELRPVAVTQPKPGVFIADLGQNFTGWDRLRVSGPAGTTVTLRHGEILNADGTLYTANLRAAQATDRFTLAGTGTETFEPRFTVHGYRYVEITGFPGTPDADSLTGLAAWTGGAATGMFTSSDSTLNQVQRAILWGARSNLLSIPTDCPQRDERLGWTGDIAAFVATSTFNFDTYGLLAKFATDLTDAQHSDGAFTDVAPDVLGGAGKAGWGDAGVIVPYTVWQRFGDLAPADRNFAAMARWVDYLRSTAGADLIRNQDTYGDWLNVDDGTGNDLTSTAFFGWSARLVSRMAAATGRTAQAATYGTLADQIAAAFTGRFVHADNTVGTGSETGYVLALAFGLVPGDRVQAVADRLAAKVASRNGHLSVGFMGVENLLPVLADHGHADVAYRILQQPDYPGWGYMIARGATTIWERWDGIRPDGSLQDPGMNSFNHYGLGSVGDWLYREVGGVAPAAPGYAQVLLAPKPGGSLTSASAELTTTFGRVRSAWSRSGSAVTLQVVVATGTTATVRVPGTAVTSAPAEAVPVGGTSYVVGAGSYTFTSTL

SEQ ID NO: 8374 - protein, 328 aa, Actinoplanes utahensis
MTRRDVVVIGGSAGAHKPLTQLLSRLPADLPAAVLVVLHLAPGARSTLAEMLGSACALPVRTAADGEPIRTGQVYVGAADRHLVVDGDVLRLSDGPRQNRVRPAVDALFRAVARWCGPRAIGVVLSGSLDDGAAGLAAIVAGGGLALVQDPAEARFPGMPRAALRVVPQAVTASALDLGDLVAGSAGQPTGAGEGPQEALRWETDMIADGSSDARDRGEPVALGCPECHGGMYVVRTGRAAHYVCHVGHSYSPQTLLAARDNGLEEALWTAVSVLQEKVMILRELIDQAEKAGEAEVARGYRAEADRTSAAAALLQEQAAGSRRTAAR

SEQ ID NO: 8375 - protein, 137 aa, Actinoplanes utahensis
MNLPDHSLRTEVHLPDEPGDARLVIVGELDGEETVGLHDAVSRTLRHPATRAVHVDAGDLIFLDSSGIRSLLAARRRAAEAGVELSIVAVSPIVYQILQITGLLPILGVGAGTVVRQPAARGSDRAAQTTLPPSVGR

SEQ ID NO: 8376 - protein, 330 aa, Actinoplanes utahensis
MTNRDLIAVGASAGGVEALRALVAGLPADLPAAVLVVLHLPRSAPSALPQILTRSGPLPAAIATDGEEPAPGRIYVAPADRHLLVLDGRIRLSHGPAENGHRPAVDPLFRSAARALADRVIAVVLSGSGDDGAVGAAAVAAAGGAVVVQAPEDALHPTMPRAVLTRVPRARVAVAAELGVLLAELSREKVPGLPGPDDPLLAGEVAIDAFGEPTTDLLPGEPSGFGCPSCGGALFTFSDSPVPRFRCRVGHAWSPESLLDEQAVATEGALWQALRALEEKAELGRRMAGAAGGRSYQLRFEQMAVDATEAGALIRGLLDRLAGSSATQQE

SEQ ID NO: 8377 - protein, 616 aa, Actinoplanes utahensis
MDELDSEFEALLTYLKESRGFDFTGYKRSSLSRRVHRRMSTIPVTGYGDYLDYLQVHPDEFTALFNTILINVTAFFRDAEAWDFLRSDVLLPMLAAKPEGSPIRIWSAGCASGQEACTLAMLLGEILGPEQFHERVKIYATDVDEEQLNEARHASYSARDVESVPPGLLERYFEVIGNRYVFRKDMRRSVIFGRNDLVQDAPISRVDLLTCRNTLMYFNAETQARILNRFHFALAEGGALFLGKAEMLLSHSSLFLPIDLKRRIFRKVPTRPMMTTGIARADQLAAPAPTPLVGLDQLRNAALMAAPAAQIVVTVDGLVALTNHQAESLFGVSPRDVGRPFRDLDVSYRPVELRRYLEQVQVERRALHVPDVEWTRGPGETRYLDIQVTPLVDGDAGLLGVSLIFHDVSAAKQLRVDLERANRELEAAYEELQSTNEELETTNEELQSTVEELETTNEELQSTNEELETMNEELQSTNDELQSINEQLHNSSADLDGANAFLDAILSGLRAGIAVVDRDLRVLVWNRQAEELWGLRSGEAIDKHLLNLDIGLPVDQIRPLIRASLSGETTDNEIRLEAVNRRGRSITVRVACSPLLDVASVPTGSIIVMDAVAPSA

SEQ ID NO: 8378 - protein, 335 aa, Actinoplanes utahensis
MTASTTSTQTTSPPKGTDQGGGIGSLEVLALLLVLLVPARGRIAGLLSGAGLQTWATVFVSVLMQAVPFLVFGVVLSAVIAVFVPRGFWARALPSHPALAVPAAGVAGVILPGCECGSVPIAGSLIRRGVTPAAALAFLLAAPAINPIVLTATVIAFPGQPMMAVARGIASLVVAVAMGWLWLRVGKPEWIRLPHRPDLDDESKARAFWAACRHDIMHAGGFLVLGAAAAATINVVVPDRWLQSLAAYPLLSILALATLAVLLSICSEADAFVAASLTQFSLTSRLVFLVVGPMVDLKLISMQTGVFGRRFAMRFAPATFVAAILLGSVFGLVLL

SEQ ID NO: 8379 - protein, 353 aa, Actinoplanes utahensis
MLIRNLLGLGVALAAGGALLFGAPVQTGAPQPVALAAAWPAAQRGSVPSKLADGSEYTPGLFLDAKTSAGTVQSADTRQLRLVIRDGDGALTELRRVPAQHRTPFTALTAAGDTLVWVEGPQDKPQLWSADRRHPASARMLTADLGAIQFFDSQNDLIVEDGRVHWAASAAGNRTEFRSVPLAGGPVTVQRENGAWGLTGWPWAVDGHVAARGATTLRNLTTGQSIAVPTAARTVTACSPAWCRMVSINQDGWARIDLSHPDGSARRKVLDGNVATAITDVAVLDRFEVLAQVTAQSELSGNQQLLIYDLSNRHLVMVSPDAGNISYRAGVLWWSTGDQSSFVRNSLDLRTVG

SEQ ID NO: 8380 - protein, 386 aa, Actinoplanes utahensis
MPQIVNERLLNWASLIEPETLQQAEKASRLPFIHPHIALMPDAHLGKGATVGSVIPTRGALIPAAVGVDIGCGMAAVRTQYRVEDLRPDRAALRTAIEAAVPLSAGSYNSRVTASAQHRIDRLTAEASFDPARYAKNWQLQLGSLGSGNHFIEVCRDESGRVWLFLHSGSRGVGNKIASHHIQVARDLMDRRGIDLPDRDLAYLEEGTDEFDAYLTELRWAQNFALANRDEMMDRVIECFADFAGGPVEQRDRVQCHHNYTEQESHYGETVWLSRKGAINAAKGVPGLIPGSMGDASYVVTGRGNAEALNSSPHGAGRAYSRSKARRTFTREQLRTAMKGIEYRDTDAFLDEIPQAYKPIDTVMRDAADLVTIRHTLRQLVNVKGD

SEQ ID NO: 8381 - protein, 103 aa, Actinoplanes utahensis
MDFGCTIERHGDRVVIVPEGDIDAESAAALRQVLRQAVETDGFAHVEVDLHRVSFLDSIGLGVFVAARKAAHARGLTFRLRDFGPMVKMLLQVTNLEETLATA

SEQ ID NO: 8382 - protein, 251 aa, Actinoplanes utahensis
MRFAVADAAETDHAVALVETPRDDPSWPVVRQDAITAWLPMARRLARRYASRGADLDDLNQVATVGLIKAIDGFEPDRGADFTGYAIPTILGELRRHFRDRMWNLRVPRRLQELNMAINRARGELIQTLGRVPTVTDIAGHLGVGEEEVLEGLEGAYAYRPASLSAPIAADGETELGDTLGARDPGFEQTELHLTLGPAMACLTEREQRIVTLRFYGNLTQSQIGEQVGVSQMHVSRLLAQALDKLRTHLS

SEQ ID NO: 8383 - protein, 439 aa, Actinoplanes utahensis
MLDIHAVLDQRAVTPVFQPLADLTSGLIIGYEALSRGPAGTPWEAPMALFAAARAAGREPELDWICRAAAYRAALRAGFGAELNLFVNMEPTAWRVDCPADLVPVVEQARDRLRVVTEMTERVIADDPAALLAATGNCRENGWGVALDDVGADPMSLALMPFVHPDVVKLDMGLLRAPDHPATARVVAAVAAYAEASGAIVLAEGVETAEQMEVARTMGATLGQGWHLGRPGPLPGVLPIGAALPTLGRARPETRTPFEVVARQRRLTRTTKAQLMPMSRHLEALAGDGPEPPVLLACFQDARNFTAATVRRFTRIAAHSPLVAALGAGLPATPAPGVRGAHLGPGDPLRGEWSVLVIGPHRAAALVARDLGDLAPEPERRFDFALTHDRDLVVAAARTLLGRLTPITGPASTRNNPTSPGHLSGHASVDLAGHRQGVR

SEQ ID NO: 8384 - protein, 448 aa, Actinoplanes utahensis
MTWPRSRNGGSTSRSPTTVIWSSRRPARCWAGSPRSPGPHRPGIIRRRRGTSPVMRALTWQGTGKVSVETVPDPTIHEPTDAIVRMTSTAICGSDLHLYDVLGMYLDRGDILGHEPMGIVEAVGSEVTHIKPGDRVVIPFNISCGHCWMCSRGYFAQCETTQVKDQGKGAALFGYTKLYGQVPGAQAEYLRVPQAQFGPIKVPAEGPDERFLFLSDVLTTSWQAARYADVRPGDTVLVTGLGPIGQMCARIARHLGAERVIAVDEVPERLAMAARNGIEVLNSGSVDDVPAAVHELTGGRGADGVIEAVGMEAHGSPLQSAAMKAAGMLPDALARKATETVGIDRMAALRTAFGSVRRAGTISIIGVYGGNADPMPMMDLFDKGVTLRMGQAHVKRWVDDIMPLLTGDGDPLGVGDLVTHRMPLEEAPHAYDIFKNKQDGCIKVVLQP

SEQ ID NO: 8385 - protein, 324 aa, Actinoplanes utahensis
MGERLRRSVLTGPGISRRRAGKGFRYLGPDGAAITDPQTLDRIRSLVIPPAWRDVWICPEPRGHIQATGTDAAGRKQYRYHDAWRTARDEKKFERVREVAGRLPRIRDRLCADLTTGRGLTRERVLAAVVRLLDLGMFRVGGDQYAAREQDPSYGLSTLRPEHVRSRGGETRLEFAGKSGVEHRRTVEDGEVAAVLTALKRRRRDMPRLFGYWDPSARRWQDVKADMINDYLREISGAEMTAKDFRTWHGTVTAAAELAAAGPQPTEAKRRKVVARAMREVADQLGNTPAVARASYVDPRLLEKYENGEGPKRGDEPEVRRLLR

SEQ ID NO: 8386 - protein, 274 aa, Actinoplanes utahensis
MSYALDDATMHALCAVALRQHPSANRFVALALSHDDPLADVARTVERVVFEESFQLGETAMVAEYTAYEEQSYFFLVLDRETGMPAGAARAIEGGGKTLDDAPDLIGKPLSEIVDVHGMHDGGKIWDYATLAVLPRYRSDRSGLTVSVMLYRAFINAGHRWQVRHVVCMLDQAAFRNLDMLGCRFIPMAGSEPFEYLGSAANRALYIPFDEIARSMGDKAELLLSELNAPDENGRRRPGARRITARLAGQVSSGEDLDPHIELPGFERRRQPRR

SEQ ID NO: 8387 - protein, 117 aa, Actinoplanes utahensis
MRALSFGPAAAAYERYRPGYPGELSDVIAACADGPIRTALEIDAGTGKATRLVAGRGGGELRQPPPAGRPGRAGGGASGAGAVRGDARDPVADGTGVEVARPSLLHPASGWLRIYAV

SEQ ID NO: 8388 - protein, 302 aa, Actinoplanes utahensis
MGELIEVRPGIHAWLQADGSWWLNNAGAVSTADGQLVVDTCATETRARRFLETLRAATGQAPKLAVNTHQHGDHTYGNCLLPAATVLIGQENMREGLRVDPIIDGCPPFWSPVPDWGDVTRRLPDLTVTGAMTVHLGDRRIELRHPGGPAHTTGDLIAWVPDARVLFTGDLVFAGLTPLVFMGSVTGALAAVDWLAGLAPEVIVPGHGPILEGADIARVLDEHRRYYHLVLDAGAAGIADGRPPLDAARAVDLGEFAGWADAERLVLNLHRYYADHHGTDLDLIAAFSDAVAYHGGPLPTRV

SEQ ID NO: 8389 - protein, 391 aa, Actinoplanes utahensis
MRRISQRVSAIAESATLAVDARAKALRAAGRPVIGFGAGEPDFPTSEHIVEAAARACRRPESHRYSPTAGQPALREAIAQASPLPLTADRVLVTNGGKQAVYQAFATILDPGDEVLVPAPYWTTYPEAIRLAGGVPVDVPADESTGYLVTVDKLAAARTPRTRVLLVCSPSNPTGAVHSRQQLAEIGQWAVQNNLFVVTDEIYQHLVYGDAQFHSLPALVPALADRTLVLSGVSKTFAMTGWRVGWMTGPRDLIDAAANLQSHLTSHVGNVAQAAALAALTGGLDAAERMRSAFDRRRRTIVGMLNDIPGVVCPEPQGAFYVFPSVRGLLGRELRGRRPQTSAELATLILEEAEVAVVPGEAFGMPGYFRFSYALGDDDLVEGVTRIAKLL

SEQ ID NO: 8390 - protein, 414 aa, Actinoplanes utahensis
MRAGPAGQRSPVKILTAMLGAALALSPAAPAHDEKIAYTRWTALPAWPRPAGRTTYAGRAWESASWTGPVHRIGFGASQLVASWDARTPAGTWLQVDMRGTYTNGQKTPWYVMGRWASGEEAIRRTSVRGQHDPYSSIDTDTFTITDPARGVLLADYQLRLTAFTAPGSAVLPEVREVGAMVSDVPPRFEVRRSDGHLAWGRELAVPRRSQKIHAGQYPQYNGGGEAWCSPTSTAMVVEYWHRGPSRADLAWVDPSYADPQVDNAARHTYDVAYDGTGNWPFNTAYAAGFDLEAIVTRLHSLDDAEHFIAAGIPVITSQSFLPAELDGAGYGTAGHLMVIIGFTTTGDVIVNDPASASDERVRHVYRREQFERIWQRTRRHRADGTVTNGSGGIAYLIKPWTTPWPRVPGATNW

SEQ ID NO: 8391 - protein, 589 aa, Actinoplanes utahensis
MTTVAARPTPTRPHPIRRQVRGSALARIVRTTDAKQIGIMYMITSIIFYVIGGIMALLMRAELARPGMQILSPEQYNQLFTMHGTAMLLFFATPIVFAFGNFVVPIQIGAPDVAFPRLNAFAYWLYLFGTLIAISGFITPGGAADFGWFAYTPLSDSLHSPGIGGNCWVVGLAISGLGTILGSVNLITTILTLRAPGMTMFRMPIMTWNMLVTALLAIMVFPFLAAALFALAADRVLGAHVFDVATGGPMLWQHLFWFFGHPEVYIIALPFFGIITEVIPVFSRKPLFGYKGLVAATIAIAALSMSVWAHHMYATGQVLLPFFSFLTFMIGVPTGMKFFTWIGTMWRGQISFETPMLFAVGFLVTFLFGGLSGIILASPPMDFHVSDSYFVVAHFHYVLFGTIVFAVFSGIYFWFPKMFGRMLDERLGKVHFWLTMIGFHTTFLVQHWLGTRGMPRRYADFLPTDGFTGLNTISSIGSFILGAATLPFLYNVWRSYKVGKVVTEDDPWGHGNSLEWATSSPPPLRNFDRMPRIRSERPAFDLKYPHLAAGEQSLAGPPEGGARPLTRESDGGATYAEDIAADRDRKRKR

SEQ ID NO: 8392 - protein, 150 aa, Actinoplanes utahensis
MATIVYYAPMTAAAVNGVPALSRRRTGVWVLSGAQYALAALTALCACSALARAADFAGHWYVPSPDDRYTANADVLTGWTGGYFVTFFLPVAPLLAGLGLAVSVALFLQGHTAGRRGLTATLAGSAVAMLLVLVAAVSPAGMSLITWLID

SEQ ID NO: 8393 - protein, 44 aa, Actinoplanes utahensis
MLGVLGAHLPAWSLVAGLLLLALWQIGYRRLTTPVTPVATEAAP

SEQ ID NO: 8394 - protein, 306 aa, Actinoplanes utahensis
MSHATTEERHATWLELFFDLVIVAAVAQLAHLLHTGPDGRQLLIFAVLYYAMWSVWTGFTLYANVAATGTHLLTMLSAMFGIAVMAASVPQLAEHDRPQPFIIAYVACRMLAVASWKRSNEVMTEWPGVHQAIGLVPWVASLGFEEPARYWLWVLGIVVDLGFTLRASGSPDRVLAEQISDYERDQRRWTTRLVRRIAPWHEADPVPSAAAADRPHLGERLGLFVIIVLGEAVAQLVNEAAGTEQWSYEMWILVLVGFGLLVALWWLTLQYGSAAAPVAGAWSRALRLTMPVHYLTTAAIVAILAS

SEQ ID NO: 8395 - protein, 178 aa, Actinoplanes utahensis
MRFYGPRVDLDTEPRLDVADRMRGAFRRYPTGVAVITAAGPDGPAGLTASSVASVAVDPPALSFSVLGTRSARALLDSPSLVVHLLGARHAGLAREFAHTAGDRFTPAQGWRTLPTGEPILPDAVAALRCAPMHRLPVGGSTLVVATVLEVFHGPDDDPLIHHAREFTTLARDTRGVR

SEQ ID NO: 8396 - protein, 190 aa, Actinoplanes utahensis
MAASCDALFAHRVKETLLKHRRTALVPVVLLASAGCGVINNADAAPAPTVAPTPAVSAASVSPTSIKDNGDIPDPCTLLSRAEVTSLTGRRITQVDRDGAAPGDVSRFCQWQQDSGQLALFLSRTTADDFKVTVAEAHDVDGVGQAAFTANGHLYVLYGTVQVDVYSRGGSDEQNLGDAKKVAKVVIPRI

SEQ ID NO: 8397 - protein, 123 aa, Actinoplanes utahensis
MNKAKGLLMAAAGVVSGFAVGAAPAQAAGNPPPGFNVDVAGYFGQLGDCQWTGQAGKLVGRWLNYTCDRGDGVYRGLWQLVVRRGGSGPSTAGRPAYPGATGHPGGPDLPGWPHHAGGPGPRG

SEQ ID NO: 8398 - protein, 215 aa, Actinoplanes utahensis
MTLWTFPAGYRPRSSRFDGDGCQCRGPPGEYGSPVTVVDIRKVGDPVLRRVAEPVTDFDAELDRLVRDLTETLLRSHGAGLAAPQIGVSLRVFAINPDLPGNDLRLDHLVNPVLEFPDDEEQDGPEGCLSIPGIYLDTRRRMNVSARGFTKQGDPVQVVGDGILARCMQHETDHLDGILFLDRQDEAGRQRLLATLREAAWFEGLAAPEVRVSPH

SEQ ID NO: 8399 - protein, 317 aa, Actinoplanes utahensis
MCPASGGGIASDVDDERKGPEKGDSTWTVIVAVAANLAIAIAKIVAALLTGSASLWAEALHSVADTGNEVLLLIGLRKSQKGPDARHPFGYGQERYFWTFLAALGIFLIGGVLSIGEGVRSLLAPEPVDSFWVGVGVLVVAAGFESYSWYTAHKQLRREADERDRSMRHHLRHASDPSATTVFLEDTAALIGLAVALTALVLHETTGWAGWDAVGSITIGLLLIVVAFLLARRSKALLLDESAPADVLDPIRERVDRQDWVARVGDLHAVWVGPSQLLVNVRVTPTDSDELVERVTRLRRDLQDDDVIALVTVTLEA

SEQ ID NO: 8400 - protein, 502 aa, Actinoplanes utahensis
MKRNRIIAAAGTAVTAGVIAVALPLPQANAATAGATGYAGQNGGTTGGAGGAVVHATTGTQIHQALCSRATSSTPIVIQVEGTINHGNTTKVSGAGCNTAADKIELKQVSNVTIVGVGAGAVFDQLGIHIRDSSNIIIQNVQIQNVKKSGSPTSNGGDAIGMESTVRNVWVDHVNLLASGGEAQGYDSLIDMKDNTQYVTLSYSTLRNSGRGGLVGSSESDLGNGYITYHHNLYENIDSRTPLLRGGIAHIYNNYYVRLNKSGINSRAGAKARVDNNYFQDSQNVLGTFYTDAAGYWQVSGNIFDNVTWTAPDGETNPAGPDPVSNTSVSIPYAYTLDAASCVPAIVRQTAGANTGLKVSDGRCSTTSPSATGSPTPSATTPPSGTNLSLGAGADGSSKAGGTSYGNVKDGDAGTYWSPSGSTGDISIKWGSATTVSRVNVREIGSAVTTYRILNGATGAVLASGSGSGVITFPAVSLTRITFKIITASGTPRIAEFETYAS

SEQ ID NO: 8401 - protein, 287 aa, Actinoplanes utahensis
MTTTKEDRQAEERQQQPPGHTGLMNRKPDHGEDSYRGSGRLIGKKAVITGGDSGIGRAVAIAFAREGADVLISYLPQEQDDARETAAQVEAAGRRVALAPGDLTDPAQGAKIVEQAVRDLGGIDVLVNNAAFQMTHESVEEVTDEEWQHTFDTNITAMFRLVKAALPHLGKGASIINTSSVNYDMPKPTLLPYATTKGAIANFTAGLAQMLGSRGIRVNAVAPGPIWTPLIPSTMPPEQVAEFGKNTPLGRAGEPAEVAPVYVLLASDEASFISGAIIPVTGGKPIL

SEQ ID NO: 8402 - protein, 191 aa, Actinoplanes utahensis
MPPRKRTVSNTSPSYTVPGLKPDVAGEIIAVLQDRLNALNDLALTLKHVHWNVVGPHFIAVHQMLDPQVDAVRVMVDDVAERIATLGGSPVGTPGALVAQRTWDDYSIGRADTNSHLAALDIVYSGVLEAHREAIEKTDEPDPVTQDLLIAQAGQLEQFHWFVRAHLESADGTLVTSGVRDEKTAAKRAKR

SEQ ID NO: 8403 - protein, 71 aa, Actinoplanes utahensis
MAGKEHDVNRSARSGRFVKQSTAEREPRTTTTERVGKNSGEREVHRSTSTGRFVRKTTAELHPSTTETQHV

SEQ ID NO: 8404 - protein, 280 aa, Actinoplanes utahensis
MGSLPEVDDLRLVTAIARLGSVGAAARELLVSQPSASQRLAALERRVGERLFDRDPTGARPTGAGREMAERAAHILQHLATLVEQTRAAARERPLSVGTFSSLAPLLFPALDPPVTQVADHGDRLIAWVAEGSLDAAVVAIAEQVVLPPGVVATPIGRDGHAMLFPAGVAGPGRGRRPYRDRQVVVYTFDMSAEVLRARLTTLGAAPRAAATAETAVRLARTYRLPVLLPGCLARIHARPEETVTAAPVRHLLRLTLVTPGPPPAALDVASLAGRLGIGT

SEQ ID NO: 8405 - protein, 424 aa, Actinoplanes utahensis
MRDYRDLAALLLTTFVSWFGQRLTAVALPLVALAATGSAGSTGLVAGAAGLPLVTAGWWAGPLRRRVTTGRSLSVTLAAQAAGLLIVPVAALLGRVTVVPLIAGGLFAGVAAAVAGPARQALTADLADRIGPGTAARALAWQDLAHRASMVIAPPLAAAAVAAGHTNALLWSESAGIAVASALLSAVRGDPAPARAATPARVRVPAAASVPAPVPAPEPAASLRAVWRRHPDLRRVLVMSAAAGLVWFAFTLGLTVLGAGSGRPGVLIAAGMTGYGAGSIAGALLAPLLTTRLPALPTAAAGWIILGLAFIAIAAAAGSVPLIAGCAAIGGAVVPFGIAAANTLISTRTAGAERRAAFAAESILHDGSATLGMLLGGPLIALAGPRPTLLAAGLLQIAVALPVLLTARREVTGRGCPPPVTGPA

SEQ ID NO: 8406 - protein, 168 aa, Actinoplanes utahensis
MGYRFHPVVRRPKMKAVDVIVQRVRTTWSKQSRGNPGAALRSAVPEAFPLPAAGAPLFHDITVAEDEDFVPREAILPQPPAAAFGLRLVGNALRVQLPNGHGAPARAPRPVLTLRRGDWLRWHLNNRHAEQTGWYYSQTTVSIAFGPTAPDTFLGAPPHTIDERARLR

SEQ ID NO: 8407 - protein, 587 aa, Actinoplanes utahensis
MAEITSEVLIERLAAWGVDTVYGIPGDGINGIMEGLRRHADKVRFVLVHHEEAAAFMAVAHAKATGRIGVCLATSGPGGIHLANGLYDAKLDHVPVLAITGLQESSVLGTGYQQEVALDRLYEDVAEYNQVVMNPAQLPTVVDVAIRTAYARRGVAHLTVPNDVQIAPAHQDPYQSVAPVRPPSTSPIYLAPAVRPADEDLRRAAEILNAGEKVAILAGIGARGAGALVEEAAAALDAPIVKSLMGKMVVPDDSPYTIGGLGLLGTRPAEELMEEADTLLMLGTNFPYTKFLPEPGRARVVQVDIEPARAGTRIPTEVPLVGDVGATLRALLPLLTRKTGTHLSGYRERYADWQHAMAALEAPDRDPIAPQYLAHLLDRHAADDAVLTCDSGTVATWAARHWQIRGNREFYLSGTLATMAPGLPYAIGIQHAFPGRQVIAYVGDGGFAMLMAEFHTAVRYRLPVKVVINNNNALGQILWEQMVLGYPEHGVRFGEPLPDFAGWASGSGGHGVRVTKPGDLPGALREALAYPGPALLDVAVNPDEPPLPGKVTYDQAKKFATAWLKGQPHKSSIATTLFKDKIQQLKG

SEQ ID NO: 8408 - protein, 586 aa, Actinoplanes utahensis
MTHGPEQAMSAPARRPAAFTPQELGFTPAKPVAWLSPVQLAGTGLRVALAGIQGGYLDKRELQASFPNDVHREAGPDGEAWIDFVADLGDGFHATYSIAYLLAQPSLKVGEHDLPRGRALILGGDEVYPTPSAQGYEDRLVGPYHAAMPGTPPGDGAGPAMYALPGNHDWYDGLTAFLRLFTGTRRTGIGGWRLPQHRSYFAVQLPGDWWLLALDDQDSTYIDDPQLAYFSRVAANFGPQTRVIVATASPTWVQGDDVPEVYASLDYFVRAVIEPTGAKIRLMVSGDWHHYARYSGAERELITCGGGGAYLYPTHQLPETIEVPPADLPSPSPRVKYSLRSRFPGKLRSQAYAASIFGRLPKDNPSFIGMIGAVHTMMLLAASGVLKSGFGSPLQKFALAPLVVLMALVVAGSYAFAHLSRSVRGGFRRRVLGLLHGAAHLALAALGTWAWWELPLHDWPWPWSLIAEIVIYGVVSGLAGTELVAVYLLIAARFDVNVNELFSAQGIVDSKSFLRFHVAADGTLTIYPIGVRKVSRRWRAVPDGAPHESWLAPDDRLRPHLIEAPIVLTPDPQASSTAPAAFPAAE

SEQ ID NO: 8409 - protein, 671 aa, Actinoplanes utahensis
MPASATRSPVPANCTGDSQATGFAGVKPSSCGVKAAGRRAGADIACSGPWVISVLPWGAGKGVPERESRSRGRPYTLGGAPRKGPAELGIEDDLFLLRAYEPVVRFTEGEWFFPVSVDRYVSRAGLWRAEPGASPVQVARPGELTLDRLATAGGAEQGLRYSLSGIGGDTTHHAHIPLRERPPHLARASRLAQVGLTARLVDAMNRFSLLFRGSVPGGSAAHSFLLQRDHLEPHRPTYYGRVFREEPWIVLQYWFFYSFNNWRSAFGGVNEHEGDWEQVTVYLDGTGVIDQDGLPPARWVVFSAHDEVGDDLRRRWDDPDLAVAEDRHPVVFSGAGSHSGAYLPGDYLITVRPPKLRGLVRALRWSARLLAPWSGEDRQTLGIPYVDYARGDGRAIGPGHDEGWHPVLIGDDTPWVRDFRGLWGRDTRDRLGGERGPAGPRYSRDGTVRQAWADPVGWAGLSKVVPNQAAERQLAEIRARRNDERLDTLDREIDALRHDLAVSAAGLPAGAPEVRALAADEQRLLALRMERTRLADEQSRMATVWPVVEDPHAHLLHRRLPMETATGLLGRARSWWAVLSTPLILWALGAVVSPLPIAGKQTALILLLTLLTVEGLVRQKFWAVLLRLLLAFVALLLLALLWLDGRYLVNFAFFAAALLVLLVNIREAWRR

SEQ ID NO: 8410 - protein, 579 aa, Actinoplanes utahensis
MLAGGLSETLRVTLPLPERYAVVPTVLAAAAAAAGATLARRRTGGLEALIPALAVAGCGIVAAGISTRQTVPLAIGIVAVLVLLLRPAAARTLPAAAVVLLIAAAALVRLPATPDAGTADPRRYFVAPQRANRSADLLDQVAGWLSTPTLPLFTATGDPVSRWRLAVLDTYDGVSWSSGAAFVPAGLGVPPYPAGGPEPGVRQHVVLGALTGPYLPAADRPARVTEPVTAVDPVDGVLLTDRRPATGAAYDIGSVPHTAPAEPIVAPAAAGDAAETAVPAEIRTALRTFLRSVPLQPGMTAAARARTVEWYLSTHRRNVTGAAATAGTGSVVRLLGPRGIGTTVQFATAFALLMRELGIPSRLVVGFQPHTPGAVYGADALVWAQLRYAGPGWVDYQPTPPAVRPGDTVPPPAGAPPDEVTRDVPTQTPPPVAEPAPAPARRTVTLLLAAAVTVGGYLAVTLVLPVLRRAWRRRGGPPADRIARAWHDVLDEAAHGALAPARIRTMTPFDVSAALAAAGGRDNRALATLAALADKALYGTQPCTAAEAAQAWRCARPARFRLRRWRTLVYPSRLRTRAR

SEQ ID NO: 8411 - protein, 331 aa, Actinoplanes utahensis
MTPNGVLVAVGGAAGTAGWLLLGYPAALVVALLAAVLLAAGVLLRLTAGGGARVELGCAVTRAERGDRIIVSVAADRRALVRLRIDPPGERVDLPIGRSPRQWTSPPLPRGRLLIVAEAVTVHDPFALWRRQLPFTSEAVHVTVMPRLLPLEAAPPFVDRQEDGRAASLWGPGVAFAGLREYEPGDDVRHIDWAASARAGDDRLYSRQFAPTLTDSLVVVLDHHAPAGQAGGFEDAVDLAFSFCRAGASLALSTSGRVWPAGAEADAQLLAVQPTTDARVLRPAARAGTTVVVTPDPGRRAALQPLFAQDDLILVAADGRAPLQWRRWLRR

SEQ ID NO: 8412 - protein, 343 aa, Actinoplanes utahensis
MHLDGQTPAIADDFSPRFAALTAEVRRTVYGKAEVVEKAVICLLAGGHLLLDDRPGVGKTTLAKALAGLLAGGTVNRIQGTPDLLPSDIIGTSVYERGRDDFTFRAGPVIANIVLFDEINRCSPRTQSALLEAMQERRVTAFRHEQDLPEFFMVIGTQNPLESLGTYPLPEAQLDRFLMRLSLGYPDRQAARALLKTHGRPDAAPPDRPEDAASAWPVSVFREMARQAAALPVSDAVYDYLLAVVEATRTHPAVVLGASPRASVDLLRAARVSALVRRPAGTPEQPAHLRPEDVRDVAADVLAHRLMLTGPGGAPEQRAIVESILGTVPTGQVPVTRPRNARR

SEQ ID NO: 8413 - protein, 550 aa, Actinoplanes utahensis
MTHQDRRPFRRAQVTPAALIAALPVVLGAAVFVHGPAARPVPVTESATMWLASARGALVRANGLVSRPAEQIIDTVPYAPAAHGVHLSAEVPGAVFATTAGQVSRVDVRAGRAERVAGDPVIAAGPDVYQVGADTVTRLDPATLRPTGSWTLGRTVAVAAGPDAAYVATSAGLSRVDATGVSPVADEHAGGPVLMDGVADGVAVYHPERGGITVVRGRSAATAGTLTPGPATTFAAAPDGRAFAVVAGREVRVWAAGRPWSAPLAFTPGTGALADGRLYLADPAAGRVHVLGLSAGLPEQDVLDFHAPGRMELDVHRRDGFLWLDDVRGPEAYVIREGHARQIVKYVTPSAPPTSRSAAATTAPPPTTTPPTKPPRSPDPPRPSRSRHDPKPSASTHPSRRPATPSRPSTSPATHPSTQTPDPRAKCGGHDASITVDDADRTGPDPRVTVRVCVKAGGDQYWIVTRSEGKWYAKRPVSGAVGRQSYVVHLLHGSGTPGQHRQFSVVAARSPEARQALAANRDADIQNADYPRDELPSGVDKISAPCESTS

SEQ ID NO: 8414 - protein, 179 aa, Actinoplanes utahensis
MTHRRILAIVTGAALLVAVTACDDKTEGDDRQARPPAGPATTELPTGTAKLLSPADGAQVNQCAIFTGQANLPGDKTLVLGVRNTDNGNAERYFEAVKNWEYPGDLKAWTGAQYFGSKDSSVGQHFRVELLIVDLGLATKALRNAKTEGWHAPDNPAGSTIAAHITLARVAGPGPAECS

SEQ ID NO: 8415 - protein, 836 aa, Actinoplanes utahensis
MPSPTRPASSAPDSIIEIAERQVLGDGSFRATVRFSGYDGVSSITVTDRRGAALEEALDWYFESYQTMPVDSGGRRERTERALVDYGVDLFEQTLSSRVNDGEIFRRYAEHRDNRFAGCRLRISGTEAFHRLRWEALRESPDDEPLSVQMPVERYAQEMKPPFRLPSPGPILNVLLVAARPDGAADLSYQRMSRRLLEFSWTAGIPVRVGLARSGTWRGLVRHLDDPAVLDRQRGYQVMQLDMHGRMLSDEQLREGMATGRLRPHEPIAPFTGRGAFLLFETGTTGVADPVPASKVAQLLERHRVAVAVINACQSAQGSDNEAGLAQRLAQAGVPAAVGMAYSISAEAAEQAVTTIYRGLAAGMRPDQAVQAARKQMYNDNARTALHQSFALQDWLLPVLFQQREVNLELEEMTDEQAQSWFASLTHAGEEPDVLGRDVDVVTVERLLLDAGAPNSLLLHGAAGVGKTAFAGLLAWWWVRTDLARRAFTYSFRKRRWSARDIVHDIGRKLYPEADFERFSAAPWDTWLGRVSNRLRAERFVLILDAGDDPIDADADLSGLLALLKQGATLVVIVSRFEEPELTARLRSARYELRPIQPAGIIVAARRPSAPPDSPPADPPSPGVPKPAPPAVERPARPGTPVSRMRPLLASVAAVAVVAGVVAAISLWPHDDSGAQPPPGTTTTAATAGTTSPAVAATGDPDWVTGPLTGAATVAAPKPGTPIGQCVTLTGTSSLPADRTVLVAVRRADRYAGELFTYFRIADWDQPHAADRWSALVPLGNSGGQLYTLVVLTADLESVRKVWAAAKRDPTSATPVAGLQRAAQIQIRQTRADQLC

SEQ ID NO: 8416 - protein, 130 aa, Actinoplanes utahensis
MSHPTVGTMDGTAHQGGSVPQATIVFTPGFPIDPAVVAEAWSADAEARELLAEGEKPYAADVRPTGYHLDPLQAVVIPLTVNVAADLLVLLITRLLDRLLPEGGAHRPKVDVLPAEGEDRIIAVTDKAGE

SEQ ID NO: 8417 - protein, 754 aa, Actinoplanes utahensis
MEPQDGKGPAERNGVRRSVVWRWWLVAGVSVTGGCALLPSSGLAANLGYNAIGLLAALAVLAGVRLHRPERARAWYWLSAGQAATVTGDLLWEYFQYIAHQDPFPSVADVFYLSAYPMLAAGLWLLFRGRSRAGGVVNALIAGLGLGLVYWILVVHPIAADNAGSGLAGVIATAYPAGDLLLLVMVAGLVTSRAGGTAAVRLLAAAASLLLVTDGADAVATMHGYPEGALFSSGWAIAYLFWGAAALHPSMAAAPQPAAARPPRAGSVQYVLPTVCALLPPAMLFLPWVGGNRLDRVVLGGGSAALTVLAAAQVAMLMRRVRGQAAELRQQALHDDLTGLPNRRRFEQALHHAARTGTLRVIFLGLTGFKSVNDEFGRPVGDRVLTVVAGRIAAASPAGALLSRLGGDEFALLAPADVPVEEIARRIVAALAAPVPAGGHELLAGANLGLAEAGEPVEALRRAEAAMHAAKSTGEPFRHWSPALDERAGEAARLGAELRAALQGDQFRVFYQPIVRVPEGRVTALEALVRWEHPVQGMVRPDRFIPVAEQTGLIVELGAWVLRTACERLVRWRAELGPDAPDRISVNVSARQLARPEFPDTVAGILALTGLPAGCLTVEVTETAVFGGGQAVTALHRLREIGVRIALDDFGTGHSSLGLLQTVPVDVIKVDKSFVDRVTEPGRHSVIARALIQVSDGLGLTAVAEGVETAEQAEALRELGYHLLQGYFYGRPEAEPDLLSRPVTAVPLSATPAP

SEQ ID NO: 8418 - protein, 67 aa, Actinoplanes utahensis
MQFSDNGTADHHWQPIPDGNVKLRVTHSQQAPAINDMSTANGAQSPRGRWPDPGLAHPRWRIIPAAL

SEQ ID NO: 8419 - protein, 112 aa, Actinoplanes utahensis
MAEADVQSSLTQISKAAELYGVTDQDVDRWRADIEDRPAWAQRAHVSGMLAQRLVMTAMEHRQQCTVEACRTCAGLREMVVIALAGVRTVVDDRLAELYRRPARWPWRRRRL

SEQ ID NO: 8420 - protein, 468 aa, Actinoplanes utahensis
MSIDKFGYQQQLRRELRIRDLIAYGLVFMVVIAPFGIFGGVFQASGGMIALAYVVGAAAMILTASSYGVMVEKYPVAGSVYGYAGRAIAPAVGFLTGWAILLDYVCIPLLLSLVAGAAMNSIVTSVPVWAWVIIFVLVNTVTNVLGIKTTKLLNWLFLAAELVILVIFLIFGLKALADGKGHGFSFDPFYNGTSFTWSLVLGGVSIGMLSYLGFDALGLLAEDAADGARTVRRAMYLSLVVVAALFVAQTWVAALLVPDPAGLIANGDPAGSAFYDAAEVAGGHWLGKLTALATALAWGIANNMVAQVATSRLLMAMSRDGQLPRFLSRVSPTRSVPTNAIVTTAIISLGIGLWMANRDDGITLMSALVNFGALIAFVVLHVCVIWEWAKNGRRGSVLRNVLVPLLGAAVLIAVIWNGNILAQKVGLAWLGVGVVVLIVLLATGRKPSLPEVPGDDEPLVAPKAVENV

SEQ ID NO: 8421 - protein, 329 aa, Actinoplanes utahensis
MSDALHIPADPGQYGYTFGGREAIASIKPGDTVTLRTLDCFGGKVRSVTDLPSQVCEFPYLNPVTGPLHVEGAQPGDTLAVHVVSLTPASPVGISSTFPHFGALTSTGYTRTLQAPLEERVWLYDIDLAAQTVRYRASRSDFTVDLELAPMLGTVGVAPAAHEVRQTIVPDVHGGNLDTPLLGPGATLYLGVNVPGALLALGDGHARQGDGEVCGVAVEVAMDVTIRVDVISGVPTGTPRLETDAQLVSLGAARPLEDAFRISQDDLVRHVAALTGLDLLDAYQLVSQTTSARAGNVVDPQYVMSAGIDKKYLPGVTAYSGIHERLRNG

SEQ ID NO: 8422 - protein, 226 aa, Actinoplanes utahensis
MRRPGLDPTLVREQLFILAHDETRHMRPRLHVPALSAGLAGATVMDLLIAQRVMIESGTVQPDWYQRETTFDPVTDDVLALIMQKAPGPALPGLIRAIAPSMYERTAAALIHKGVLLESPARRWRKKEYEIAEEGISVRVRAKVGYRLDGRDGPSPDADCLCTLVSALGLHAALLRGTRAELEPLMQRISRDLPDRARPTRHPIGGAPAVAAAVLALVQDLATSAM

SEQ ID NO: 8423 - protein, 219 aa, Actinoplanes utahensis
MPRSPGPGCPSGTTCTARTSSRCPAGPSTGPWSVCRSASRCSAWESPRCWRGRSPRITTTTDYRVSMAEILTLTLTLEKRGPAGAFLLSDEQVAAVGDGRKAFPVRLTVNGVTLPLRLARMGGENMIGLAKAARAQAGVEIGTAYEVTVAADAGERTVEVPAELAAALAADGAAQTAYDRLAFSHRKEFARWIGEAKREATRAQRVAETVEMLKAGRHR

SEQ ID NO: 8424 - protein, 153 aa, Actinoplanes utahensis
MNARLDHRGSHVSGQVAKHLFAASRAIAESPLPETVRHLVEIRASQINGCAFCIDMHTKDATKAGESPVRLHLVAGWREATVFTDAERAALELAEEGTRIADAAGGVGDEVWAAAAEHFDAEQLAALTAQIAVINAWNRLNVITRQPGGDYQA

SEQ ID NO: 8425 - protein, 320 aa, Actinoplanes utahensis
MSRFRTLMLSALLATTVGVPPATAASYPDPGVVTGSTAAHDPSMVKTPNGGYLLATTGDGITLKTSSDRTRFVAAGRAFPTGTPWANDYTGGSATLWAPDISYHSGRYLMYYAASTFGSSRSAIFLAASPTGAAGTWTDHGKVIESTAGGNWNAIDPDLTVTPSGEWWLTLGSFWSGIKRVRLDPATGKRADSTMDAVAERFVNSKSVEAPFVFRHGGYYYLFLAFDFCCRGASSTYRIMVARSTSITGPYRDRAGTLTTAGGGTEILASHGAIHGPGHPAVLTDSDSDVLLYHYYTSAGDARLGINLLGWDSSAWPYVH

SEQ ID NO: 8426 - protein, 34 aa, Actinoplanes utahensis
MRRRVTAVWWSPDPALLLGLMLTEPRQLVSTTSR

SEQ ID NO: 8427 - protein, 688 aa, Actinoplanes utahensis
MHVFDLRRHPAKDDPDLIGADEKHFAAIAGSLGASIADLQQRLDAERKAPAGKGRQAVDRDDAVRRMASRLRALRRFSLDLCLGRMVHESGEVVYIGRLGLTDGEGGRLLVDWRSPAAEPFFGATHGNPMGLVSRRRYRWREGRIIDFWDEIYRADALDGAVALDDQSAFIASLGTSRSPRMRDVLGTIQADQDAIIRAGSRGALVVDGGPGTGKTVVALHRTAYLLYTDPRMSARRGGVLFVGPHEPYLAYVSDVLPSLGEDDVQTCTVRDLVPEGAAAAEESDPEVARLKAGLVGAMEAAVAFYEEPPARPTVGSRADWAAAFDAPDPGTPHNEAREPIWAELLAVLDEPDTETRRELRTALNRAWPLLDAADLVADLWSVPAYLRRCAPWLGAEDVRRLQRADPRGWTVADLPLLDAARQRLGDASADERARRQKAALAAGRRDMDRVVEDLIASNEYDDGEGLMTMLRQQDLREVLDEGGTLPPADPDLLAGPFAHIVVDEAQELTDAEWQMLLLRCPSRSFTVVGDRAQARHGFTESWEERLRRVGFDRIGLASLTINYRTPAEVMAEAEPVIRAALPDANVPTSIRESGVPVVHGHTAELDGILTQWLAANDEGVACVIGPSGFPGQRRDRVRSLTPALAKGLEFDLVILIDPDDFGSGVEGAVDRYVAMTRATQRLVVLTS

SEQ ID NO: 8428 - protein, 121 aa, Actinoplanes utahensis
MIIVGNVLTGLVALIHMYIVVLETVLWTKPQGRKAFGLTPEFAEQTRVLGLNQGLYNGFLAAGLIAGLIAGGHTGFAAKIFFLVCVAVAGIVGATTASRRILYVQTVPAALALLFVLLGGY

SEQ ID NO: 8429 - protein, 521 aa, Actinoplanes utahensis
MRRDRRGYFRKVDVKPADRKPADRIVPLGHRFADELPEMAVAWRAAEAPEPRLLVLDEELAGELGLDPDWLRGEAGLGLLTGTVPPAGAKPVAQAYAGHQFGGYSPRLGDGRALLLGELGDRDLHLKGSGRTPFARGGDGFAAVGPMLREFIVSRAMHALGIPTTRSLAVVATGRTILREQPQPGAVLARVAASHLRVGSFQFARASGDPGLLRRLADHAIARHHPAAAGDYPAFFDAVVAAQASLVAQWMLVGFVHGVMNTDNMTISGETIDYGPCAFMEAVDPAAVFSSIDTAGRYAYGNQPGIAQWNLARFAESLLPLLHDDEEQAIEMAVAALRGFGPAFDAAWSAGMHAKLGLSGGADALVADVAALLRAGRVDYTGFFRTLAGAARGETDPVLAGAARGGTNPVLAGTARGGTNPVLGGAAHGEAEPAPAGFESWLERWRAAGPDPDLMDRVNPLYIPRNHLVEEALAAAADGDLTPVHRLVEAVSDPFRSRPGLERYAEPAPDDFGPYRTFCGT

SEQ ID NO: 8430 - protein, 344 aa, Actinoplanes utahensis
MTEIQVSGAVPRQARARATFLGYAMKALRSLPRPVQRAVLNGAAAGELPPVADFVRMLEIAGDLPETGPTHAELLARFPALAAVEVTDPAVDGVPARLYRLPGHPAEAALIWVHGGAFVRGDLAMPEAHWTGLTLAARGIPVLSLDYRKALHGVRFPAPSDDVLTGWSWAVNHPSLIGVPAAKMHLGGASAGASLAAGVAKRLRDGEGRPPATVVLAYPAVHPELTGWDEPGLAAIRDNHSAVYFSPGWIRDLSAHYAGPDRLTDPYAFPGLGDLTGTPPTLIVNCGADTLRRSGELYTEQLRAAGVAVTSHLLPDAPHGTLNDPFSDAGVRTADLIAGWLVPK

SEQ ID NO: 8431 - protein, 266 aa, Actinoplanes utahensis
MSHPSPADPSGAPATPAAAPASAAPAAAPASAAPAYPGGFAAPGALFATDPTTGAPVGFPAPGQPAPGAYAAPGAYPAAQPVQTIPAPYAGQPGAYPGAQPAAYPAPQPGQHIPAPYSGQHPGYPAAQPGLAPQGMLACRFCGSVPAAQVKFRGHQGLLVIMRFLHTTGPFCRDCGLGVFRQMTSRTLVQGWYSYGSFVITPITVLVNLFRRNTVANLPAPQPNPHGPSRPPMDPGPRLLERPMTWLGLLIPFALIALLIFAASQN

SEQ ID NO: 8432 - protein, 45 aa, Actinoplanes utahensis
MYKQRHAVECGINRLKRNRAVATRYDKLAVRYETTVTIAAINEWL

SEQ ID NO: 8433 - protein, 75 aa, Actinoplanes utahensis
MGRSRGGLTTKLHLGCEQGQKPLSIVLTAGQRGDSPQFIAVLEGVRVPRPVGRPRSRPDRVLADKAYTSRANLAS

SEQ ID NO: 8434 - protein, 147 aa, Actinoplanes utahensis
MDTLAVTRRHDLTEAQWAVLEPLLPAGRRPGRPSQWTKRQLIDGIRWRIRVGAPWRDIPSVYGSWSAAYALFRRWQRERTWARLLTALQSLADEAGRIVWDVSVDSTVARAHQHAAGARKRGICRVNRRVGSAPSRPIMRWGGLGVG

SEQ ID NO: 8435 - protein, 267 aa, Actinoplanes utahensis
MPVGAKAPCRSGLKCRAVDVARTFLAEVDARQPGALAGLFLHGSLCWGEFFAGSDVDFVGVWARPPDHDALAAAHHATRARHPDATFDGFHCSPEDLAVSALTVGRRPAFFDGAFDPLGKGDINPVTWHELAERAVVIRGELPPVHTDPAVLHDFTRDNLDTYWRAAIPQIEQAGFEAVGGHEPSVAWVVLGVARLHHLLAKGSLTSKSGAGRYVVGELDARWHRLGLDALRIRERPQAPALYDDPAERGRATYDFLRWAIEDGMGR

SEQ ID NO: 8436 - protein, 177 aa, Actinoplanes utahensis
MIGRTVVRMDDITALIMEDHHRFRLGFARLDDASGEAELRAVWEPLALHLDIHAEAEEEILYPHLLTDSGGDDAEEETDDAIRDHNKIRDGIAEAARHPVGSDEWWGGVWQARTENSEHLAEEEDEVLPDFRRHASRELRLELGARWLRFFAEHPQGKGLDFHNKDPEKYIAAVEES

SEQ ID NO: 8437 - protein, 56 aa, Actinoplanes utahensis
MNAQATDTVRTSPFGPETPEFNPMRVLRNRVVAEFPQVIADITGQATELIKRYAGA

SEQ ID NO: 8438 - protein, 312 aa, Actinoplanes utahensis
MRIGYFLSSEEYTPAQLIEQAELAQDAGFQGLWISDHYHPWNDAQGQSSFVWSVIGALSQVATVPITTAVTCPIQRIHPAIIAQAAATSAVMHEGRFILGVGTGEALNEHVTGMRWPMTSERLEMLEEAVAVMRELWTGEFVTHRGRHYEVDQARIYTRPAQPPKVYVSAFGPKAIDVAARIGDGYISVMPDGDLVTRFREAGGGDKPVQGGFKGCWAPTEEQGVEIAHRLWANAGVPGELSQVLPSPRHFEQASELVTPEMTRKSIVCGPDPAGHAAQLKAYEEAGFDEVYVANIGPNYRELIDMYRSEFL

SEQ ID NO: 8439 - protein, 256 aa, Actinoplanes utahensis
MVAIRSRTEGQHRPGVPEVVVVHGLGVCDYLEPATRALAGWTRAHLIDLPGCGGSDDPPHELDVPEYADLVAAWLDEHRTGPVLLAGQSSGAQVAAEAALRSPSVVAVALVCPFPDPAARSLPRLLRRCWSDLWRESPSLARVHLRDVRRTGPRRYRHLLRVHLRHVLGRPVRRLTVPVLVLGASLDPISPPAWGRHLAALAPRGSYAEVPGPHTFCWSDPRAWSEPLRALARAADDSAGGAGVSGRHAYRIFPVQ

SEQ ID NO: 8440 - protein, 114 aa, Actinoplanes utahensis
MTATFAVSKHDEGGGVIRLAVRGEIDHDVSDALAAIVANAAAQPGVSSLVVDLERVPFLAAAGIRALVEGRAAALQQHCGYQVVNARGVVHGVLATTGLLGLFDTRVRRSPAHR

SEQ ID NO: 8441 - protein, 282 aa, Actinoplanes utahensis
MPILNRLEEARRLDGVSDKLQSAVSAAVRPQRLRDLLHGTWLGHPLHPVMVQVPVGAFVSTAILDLLPGVRRAQQTLLAVGVATAVPAAVAGWTDWSQMTRDRRRVGLVHAGSNAVAIGLYAASLVARLRGRTARGKALSLAGLSAAGFGAYLGGHLAYAQSAGTNQAAPDLARLPEEWTEVCSLASVPERRTVVRLAGDVPVLLYRIGDRVSALVERCGHETGPLGEGDVTGAGWDACVVCPWHGSTFRLADGAVVHGPAANNQPVIPVRVQDGRVEIRRP

SEQ ID NO: 8442 - protein, 131 aa, Actinoplanes utahensis
MPTRDEMPSTLRRSPKKAQDTYVAAHDSAVDQYGEGERAHRTAFSAVKHSFEKVGDHWEPKAKKGPSDAKAAGGRDTRAETAGGVDANASKEHLLDLAKRLDVTGRSRMTKAELVDAIQKANDRSTRKARS

SEQ ID NO: 8443 - protein, 369 aa, Actinoplanes utahensis
MRDLDRLEPLEDLDLMADRYAHACERADCREQRRLRERFVREALPFAGRLARRYRGRGEPTDDLVQVARLGLIKTVDRFDPQRGSFTAYAILTITGEIKRHFRDHTWGVHVPRGQQDRVLEFVHARAELTSELARTPTLAELAERLGLDETQVRGAQTSAAAHNTESLNVPLGDTGSEAGDLIGDVDGDLSLVDDRTTVESLLCELPARERRLLALRFWGNLSQVEIADELGISQMHVSRLLSRTLSWLREAMLTDVTPPWAGAGAPEHLVLATAVPDGVRADVRGEIDRDNANQVRRDLMTAAGTCGRGRRLTVDLSGVPLLSAAGIGMLTAVYEVARQREVRMLITGVQPYVARVLAISGLGELLVP

SEQ ID NO: 8444 - protein, 430 aa, Actinoplanes utahensis
MPEESDGAEVRRRHLSGGIAALAPMFAPLRERNYRLWATADLVSTAGTWMQVLGLNWLILSDTGSAATMGLVVMLQALPVLILGTWGGALADRLPARPLLIASQAVRALLALALVAHGGHPLIYAVALASGVISSFEGPALGRFGSALVPPSALGSALALGSVLSSAGRIGGMALGGILVGVTGPAALFVINAVSYLAVIGALSAMRTGELRDLPTAAPGERGIRSGLRYIAGQPIVLIVLALSFVLGSLGRNYQVSMAAMTAGPLHAGSGAYGLLSTVFAVGAVLGGLLLAGSGRSTLRVLLGTGLTISLLQLGAGLAPNLTSFAALILPIAAGAVVFDTVVSTRIQLDTREDMRGRVLAAVGIVSSLSGMFGAPAVGWLCDTAGPRGALLLGGAITTAAALAGAAAVARATGRGLHLPEPFTPAEQMA

SEQ ID NO: 8445 - protein, 276 aa, Actinoplanes utahensis
MSVINAQDVETDEVTVVVATRNRADRLRDTVPHHRAPTIIVDNASDQPLDFPGVVRLPENLGAAARNIGVELATTPYVAFADDDSYWQPDSLAQAAKIFRAHPRTALLTARVLIGPEARVDPISDEMARAPLGTAPDAPGPAVLGFLSCATIVRRDAFLGVNGFHPRLFVYGEEALLAMDLAAAGHHLAYVQALTVRHFPEPAGRDPRARLRREARNRALTALLRRPPRVVATTLAEVARTEPAALLDVTRDLPWALTHRRPLPGEVEAALRRLES

SEQ ID NO: 8446 - protein, 378 aa, Actinoplanes utahensis
MGKPVADARDSVLAGVGTLRQYAELGPVHRGRTLAGNDDAIDLMAYGPRGVVAVITPWNDPVAVACGLLGAALVTGNTVVHKPSERTPGTGHRLIELFALHFPAGVLNMVAGDGAVGAVLAAARVDVVAHVGSTATGRSIAAACARTGAKALLENGGKDPLLVDAGVDPGWAAGQAALGAFANSGQICVAVERIYVHRAVAGEFLAALESEAEAWGSRIGPLVDRRLRAAVDDQVQRAVKDGAVALRGGAVPAGPGAFYPPTVLSDCTDDMAVMRDETFGPVAPVMVVDSFADGLRRSGASDYGLAATVLTPSMSNAQAAWRALPAGTVKINAVFGGAPGGAAQPRGFSGSGFGYGPELLDEMTCTKVVHLAAPAGGW

SEQ ID NO: 8447 - protein, 45 aa, Actinoplanes utahensis
MREVTQLIGGAWRPGGSGRELTVSNPADDSLVTRTVASDEGDVVA

SEQ ID NO: 8448 - protein, 542 aa, Actinoplanes utahensis
MRVLGINAIFHDPAAALIVDGQVVAAAEEERFSRRKHGKRPVPFAAWELPELSAAWCLQEAGLTPGDLDAVAYSFDPGITRDAADLGLDDPWDHLRVDYARRAPQFLAAALPGLDPEQVRFVPHHVAHAASAGLSVPDDNAVLVLDGRGEVAGHLAGAYRDGELSVLRTQELPHSLGLLYEDLTRHLGFLHSSDEYKVMALASYGKPKFLDLLRELVRSTGDGGFTVERIDWGALAKPCAPGAELSDVHADLAASVQKRLEEVILDLARWTYEASGGLPTLTMAGGTALNCVANGRLAAEGPFDRVWVQPAAGDSGTALGAALAVHGQSIPFTTAALGRGWSDEELEADLKRAALPYTRPASIAAEAAEVLARNGIVAWYQGRSEYGPRALGHRSLLAHPGDKDTQRRMNDVKGREQFRPIAPMVRAERFHDIFEGVYPSEHMLFVHRVKPDWRDRIPAVVHVDGTARVQTVHADTEPVVAEMLAEFEKRTGLPVVVNTSLNTAGRPMVDTPREAMELFGSAPVDLLAIGPFAVHRAGAFRA

SEQ ID NO: 8449 - protein, 248 aa, Actinoplanes utahensis
MITVVVPTLGRPSLGALLAALPRDLDILVVDDRPFPPDPLTVPDHVTVIPGPACGPAAARNAGWRATRAEWVVFLDDDVLPGPDWAGRLADDLADAKPDVGGVQGRLRVPLPGHRRPTDWERVTAGLADGSWLTADMAYRRAALEAVDGFDERLPRAFREDADLAYRVRAAGWRLTTGERTTLHPVRPESPWVSLRTQRGNADDALLRRIHGPDWRRRLEIPPGRRSRHAGITGLLAAALIAGAAAAS

SEQ ID NO: 8450 - protein, 654 aa, Actinoplanes utahensis
MALAISGTQSSGGIDSSGPRSSGGIDSSGPRSSGGVDSSGIQRSGGTRGGRAARNGPGGSGGGTETGGRVMSRLYDAVLFDRDGTLIADVPYNGDPDRVRPMPGARAALDRLRAAGLRLGVVTNQSGLARGNFTPGQLASVHHRVEELLGPFDTWQICPHDDTAGCDCRKPRPGMIVEAARALGTTPQRCVVVGDIGRDMAAALAAGAAGILVPTPVTLPDEVDAAPAVVPDLTAAAELILHREALVTPAPRPHPAGTVLVVRSDSAGDVLVTGPAIRAVAHGSERVVLLCGPRGRAAAELLPGVDELISWKLPWIDPEPDPVAAADLGGLTERIRAAGVDEAVVFTSYHQSALPLALLLRTAGVQRITAISEDYPGSLLDVRHRVPPGVPEPERARSVAAAAGFGLPPGDDGGLRVRGDDGFPARAGGGPRVRDGKGPRLRDGEDPRVRDGEDPRVRDGEDPRLRDGEDPRVRESGGPRAGVPRQVAGGGHVVVHPGASVEARSCPPDNLRRIVRELTAAGHRVTVTAGPGEENLAAYVADAVADLVAPPTLTDLAHLVAAASCLVVGNTGPAHLAAAVGTPVISLYAPTVPYAQWGPYRVPAVRLGRAGAACRDTRATRCPVPGHPCLSTVEPAQVLDAVERLGAASLEDVA

SEQ ID NO: 8451 - protein, 308 aa, Actinoplanes utahensis
MNILLWHVHGSWTTSFVQGKHRYLIPVNDARDAWGRGRARTFDWPDSVEELPLDQIRDADVAIVQRPEEIDLVPPSLPVIYVEHNTPKGDVPNTRHPMADRDDLIIAHVTHFNDLFWDCGGTRTTVIEHGIVEPKARWTGELDRLAIVTNEPVRRGRVTGTDLFERFTAAAPIDVFGMGVADLPGDRITPHEDPPQHAMHDLLAQRRAYLHLCRWTSLGLSLIEAMQIGMPVIALATTEAIAAVPDGAGVLSTRVDTLVEAAHWLIEEPDEARRMGERARRAALARYGLDRFLADWDHLLEGHTCGSR

SEQ ID NO: 8452 - protein, 399 aa, Actinoplanes utahensis
MRIAMISEHASPLAALGGVDAGGQNTHVADLASALVADGHEVRVYTRRDSPDLPATVPVEAGFEVVHVPAGPERTLPKDDLLPFMGDFATWMARDWLAWPPDVAHAHFWMSGLAAVTAARRCDVPVVQTFHALGSVKRRHQGTDDTSPAHRVAYERQLGRVVDRVIVQCQDELDELLLLGVPRARTTLVPSGVNVERFRKDGPVAPRDSRPRILSVGRLVPRKGFEDLIRALPEVPGAELVIAGGPPAAALGQDPYAQRLLHLAKECHVEDRVELLGAVPAARMPAWYRSADVVAATPWYEPFGLTPLEAMACGVPVVATAVGGLTDTVVDGVTGDLVPAHDPHGLGLALRRLVTDQSRRLSYAAAAVDRAVHAYAWPHIAARMSAVYARVASLSAAVA

SEQ ID NO: 8453 - protein, 437 aa, Actinoplanes utahensis
MDPLDKHLAALAASLAPFRTVGARLADWGADLAAHLGGGGRLLVAGNGGSAAEAQHLAAELVGKLREDRMPLSAIALTPDSSAVTAIGNDYGFDEVFARQVRAHGRPGDVLLVLSTSGRSPNLVAAVRAARDCGMRTWAMVGAGSSPVGDACDEVLHCPSPDSQVVQELHLVAVHIMCEHIDLNLSQPTAGGTRVKKPLLVVVGDTLLDRDVEGTVRRIAPDAPAPVLDETEVSERPGGAGLAALLAAGREDYDVALVTALAGDAAGARLSELLTAAGIAVYALPLPGSTPQKIRMRAAGQVLLRLDRGGDARMPGEAPDGLLDVLNEASAILVSDYGRGVAGHPAVRAALAAASAPIVWDPHPNGATPVPGVALATPNLAEAKGFSGDAGKGTMLTTAQRTGHHLLDHWRARAVAVTCGAGGAVLSQAGPTPLVIP

SEQ ID NO: 8454 - protein, 189 aa, Actinoplanes utahensis
MAAATTYVLNGGVTAALSPAAATPAVPAPERIGADAAGRLAAEVRDRGGVVVATGGCFDLLHTGHLATLRAARGLGDCLIVCLNSDESVRGLKGPDRPINAQADRARLLAALDCVDAVVIFDEPTPEAVLSWLRPDVWVKGGDYASLPEADLVKRWDGQTVIVPYLDGRSTTRTIDAARSLTAAADSRR

SEQ ID NO: 8455 - protein, 227 aa, Actinoplanes utahensis
MDAVIVTGGSSGLGAAVVDAVIKAGGQPVVIDRQAPAREGVPWIECDLADTRAAERATREAIAAVDATVSGVVTAAGFDVPGTLLDVPGETWDRIVAVDLLATAAVVRAALPALKESHGTVVTVASTLGIKAVSDATAYCAAKFGVVGFTRALAAELAGEVGVTLVIPGGMRTRFFDERDDRYKPGPDALLNDPCNVADAILFALQQPAGCAVRELVIAAETETSYP

SEQ ID NO: 8456 - protein, 309 aa, Actinoplanes utahensis
MILVLRALGVGDLATGVPALRALRSAFPGRELVLAAPRWLTPLVDLIGGVDRVLPVDGLDGVGAPGLPEAVSGAELAVNLHGSGPESHRMLRGAGRLWGFRCAAAEHLDGPEWVRDEHEVHRWCRMLRYYGVAADESDLSLMKPLVGSASVTVVHPGAKSASRRWPPERYAAVARELAGRGHRVVITGSGAERDLTAKVAADAGLGPEALPDTDIGSLAALIAGARLLISGDTGVSHLATGFGTPSVTLFGPMSPAYWGPPPGRARHRVIWHGTSSERGDRPGPDVHPALLAVTVDEALAAADHALAAP

SEQ ID NO: 8457 - protein, 600 aa, Actinoplanes utahensis
MPPDGCARWRGHIIVCGLDDVGLRTVEQLYHAGVRVVVVEDIADPRLVRVVRGWGVPVVVGSPRLQETLDEAGLPGAVAVICVLADDLHTLEAALLMRELRPDVRVVVQLRNPAVGRALSAMQVSVLDVAGLSAPSMVEACLRSGTHELDLDGQPFVAAQVVAEQSGTLRTRYGSLAPLAVMPAAAASDDDVVICPGRDHPVRPGDLVTLLGTPEELAAARLLDKARGPAHAGPGRWARSLHLAGSVLRALDRRIAYASIALMLLLNLSIVVLQLGYREPDGTRMTLLDAVYFSVESIATVGYGDYNFRHQQPWLRCFAIGLMILGACFAATFIALLTNVLVSIKIQEALGNRLLDRLTDHVVVIGIGSVGTRVVEGLRASGTRVVVIESDEDNRYIDQVRDSGVPVLIGDATLPRTLDRVQLGSARAVAVLTSDDLVNLETGLAVRDRLGERWGSVPVVLRLFDRTLAATVEHTFGLGLARSTAALAAPWFVGAALGLDVLATFYVGSQLMLVGRLTVAAGGGLDGLAMQDLSARTRVVAIRRASGHGELEHPPRRDTRFAAGDQAHLIGPYEELLQVLRRDALSTSELTPSENVVPGR

SEQ ID NO: 8458 - protein, 105 aa, Actinoplanes utahensis
MYRQGDVLIVPVPPAGVPACAPVPRDPRGRMVLARGEATGHAHVVGGPGVRLVADLDDPERMFVEVPAHGRVSHEEHGPIALPSGVYRVIRQREYVPGAFRPVAD

SEQ ID NO: 8459 - protein, 44 aa, Actinoplanes utahensis
MFRARSVRSRTETGERIVRLTHEQEALAAAVEDRWLAAAVALAS

SEQ ID NO: 8460 - protein, 234 aa, Actinoplanes utahensis
MVAGRLRQRLGEDVAALGREFQRPVLDAIYGQHDGAWLSTFDAGDRLLPGAGLMGGLAGLAQVAGNAGWWWAHERVAVLTERPVALTRDNVGRLHRGDGPALEFADGYGLWAWRGMPIPAGLAAELPRLSVDRIRGESNAEIRRVMLEHFGYERYLREAGARKRDADETGVLWWLDLPGDEPLAMVEVVNATPEPDGSSRVYWLRVPPQTRTAREGVAWTFGLTADEYQPLIQT

SEQ ID NO: 8461 - protein, 437 aa, Actinoplanes utahensis
MSRLAVVGNPENRRVGRFVTAADRAGLPTPEIFPWREVLLTGRVPGPDTLTRIDSPGENAEVDALLRALGTTAPPPLDPGHRPRHHSGRDGGHRPDPPLEHDGAATFAGPTAEHGEATVSAGPTAEHGEAAVSAGPTAEHDQAAVSAGPTAEHGEIVGGAAAFAGLAVALHRIEAGGGILLNRPADILTMTAKPRCHAVLSAAGVPVPPALEIAVTGYAALRSALDTAGWSRVFVKAAYGSSASGVLALALGGRRPGGHRPIMAVTSVELADGKIFNNLRVRRYDDEASIAAIIDRLAPDGLHVERWFPKAALAGRVLDLRVVVIAGRARHVVARTSRSPMTNLHLGNARGDVAAVRAAAGGAAWAAAMRTCERAAACFPGTLHAGVDLMFHANWRSHAVAEVNAFGDLLPGILSDDGLDTYEAQIAALQNGWLPTP

SEQ ID NO: 8462 - protein, 141 aa, Actinoplanes utahensis
MITILLVRHADIDLPPVSADPPLNEAGRRRAEALAHLLGAAGVSTVFTSAFRRTRETVEPLKMASREMPSAATVAHEARAGRYGAVVLIAGHSNTVPEVIAALGAPPPAIGETDFDNLFVVTTADDAEPGLLRLKYGISLS

SEQ ID NO: 8463 - protein, 357 aa, Actinoplanes utahensis
MTYAHRISCITPPFILTRLLDSDNVDIRQAALSTLVSTAHLRGERSVRGLIAGALASPSDGRRSVYDCRHSTFLPFATLVRSEDDAAVSDASANRAFDGFGATRSFYAEVFQRNSIDDRGMRLEGYVHRGRRYNNAFWDGQEMVFGDGDGQVFTDFTGSLDVIAHELTHGVTEHTAGLEYHGQSGALNESISDAFGSMVKQWSLGQTADQADWLIGPEVFTPHIDADALRSMKAPGTAFDNKLFGKDPQPDHMSRYVDAPDTDEGDWGGVHTNSGIPNKAFYLVAIGIGGKSWEAPGHIWYESLKASTSKAQFQDFADTTYRKAEQLYGTDSREQQAVKAAWDGVGIQVTTTPTLAR

SEQ ID NO: 8464 - protein, 99 aa, Actinoplanes utahensis
MRVSLASHGGMAAAITSRLPPRVLDADRLPRDAAQELRRLVAAATADPGGAAPSPRARDAMTYTVTIDDGPRSTTLTASDTTMSAAFGELVAWLDQRIG

SEQ ID NO: 8465 - protein, 407 aa, Actinoplanes utahensis
MEETGYGVLARRTLVVLGVTLSTLAVLYLAHEVRRVLTWILIAAFFAVALHPAVNWMTRRVTFCRRWLATLLVFVAALALLAGLVTVFVAPLAREGSQVMANLPGLLDDARHGRGPAGPLLERFHVVEYARANAGRFREYASGLGAPTLAFLRSVATGIAGTVTIFVLSYLMVLEAPKIVDGFLALFAPRRAERIRRVGHDCAKTITGYITGNLLISAICGALTFAVLTVLHVPYAGLIALFVGIADLVPLVGATLGAVAATIAAFVQSTTAGIVVIVFFVLYQQLENHLLQPLIFARTVQLNPLTVLVAILIAVELAGILGALLAIPVAGIVQIILRDVWDSRHGRPKAEPTVGENRVPVSAVHDEARGRDAGTADVHGAYAGQLTDRAASTDPLVEPRDQLAEGR

SEQ ID NO: 8466 - protein, 217 aa, Actinoplanes utahensis
MPDRRSGEKAGLSRAKVLDAALDYIDAHGLPALSMRKLGARLGVEAMSLYRHVPNKDALLDGLVDRVLETAFGSLGEPTSGDWPDWLREFAHALRKTLIAHPGVLPLAATRPVNSPDALRWSESWLAAMRAAGVPLGRAMDMVNVLATFTIGHTLAEVGQTPGHEGAGPDLDQRSDELDPAEFPNLVEVIRTRAGLDFDSRFTEAVDILIAGYAAAQ

SEQ ID NO: 8467 - protein, 158 aa, Actinoplanes utahensis
MTALALTLILLAVGYHAVMTLVDLFPFNNVRDAKRAERVREVATNAPVMALPAVLLALGSASGLPILGCLGGVVELLAVLGGLLLWWSPYLAGVTMPWATAGTGVSWADLHARTYARTIMVLPRIGGRPRPNLEHILLHSLMLSAAITTLAAASGRHG

SEQ ID NO: 8468 - protein, 426 aa, Actinoplanes utahensis
MRWRGLTGVLSSQACTLSANRLLTVAVPWLVLERTGSAAQTGLVVACQVLPYAFTQWLAGPLLDRIDPRRISAAGDVVSAGVLIVPALSGAPPIWLLTVMLLLVGCADGPASAAKRLLVPFAAADAGQSTVRGVGLATAVERTATAVGTALAGWLVATIGGDRALFAAAAMLGVATLIVTLTVTDPVRDRGRDDETYLDRLRTGTAFLRGSAPLRAVTAMFVVTNLLDQALMAVLLPVWARAGGHDATVVGLALSTVGLASIASALASAGFGARLPRRATYLIGVLTSGPTRIVVLALGLPPEAVIAVYALAGIGSGLFNPLLETLQVELIPAALRGRVQTLINAWAWAGIPVGGLFGAVLLSTGGLRTALWICGTGYLAAVLWPVWRVDWSLTVSTSERHRNPLTVRIPVPRRRVAAPVPVREHS

SEQ ID NO: 8469 - protein, 75 aa, Actinoplanes utahensis
MTGPERGRDPMPIHHQQSDPDRYPPLDPGAPIPDDPGELDPTNPDLPPAPAEPMPPISPVPARPEPATQPEPEPA

SEQ ID NO: 8470 - protein, 222 aa, Actinoplanes utahensis
MDNARVLVVGGHGKVARLLLPLLVGAGHEVTAAFRDPGHEGDVAATGARPVVADVETLDADGFAELIAGHDAVVWSAGAGGGDPGRTYAVDRDAAIRSMDAALHIGVRRYLMVSYFGARIDHGVPSDSGFFPYAEAKAAADAHLASSDLDWTILAPSRLTDDAATGRIETASQGATAGSVSRADVAAVVAHALGEPATIHRIVRFNAGATPIADALSEDDLV

SEQ ID NO: 8471 - protein, 312 aa, Actinoplanes utahensis
MSIRLGYQIPNFTYPGVPDENLFDTVVAQAREAEAVGFDTVLVMDHFYQLPGIGAPEANMLEAYTTLGALATATSTVQLSTLVTGNTYRNPTLLAKTVTTLDVVSKGRAILGIGAGWFEREHHDLGFEFGTFTQRFERLEEALTIIAPMLKGEPATFEGKWYVARGAMNNPRVRPHIPIMLGGSGEQKTFRLAARFADHMNIICDVDDVGRKVSVLRERCEEIGRDPATLATSYLAMGLVGENEQEVKEFSALVPEDRRNRAFLGTAEQVAEQLHEKVLGAGIGGITINLIKNGHRPGVVTAVGEALKPLVK

SEQ ID NO: 8472 - protein, 196 aa, Actinoplanes utahensis
MSRERAYHHGDLRAALITASFEQLAEAGLRRFSVAAVARRLGVSSAAPYRHFPDRDHLLSAVSAAAAHDLRSAILTAADEAGADPSARLAAVAGAYFRYVVRTGAGFHVIYAPELYAIPDTPRRDHTRALMDTLIDLAAATDVPTYQQAVSLVEAVIAVAHGYTSLYADGFFTRGARSVDTTATRATDAARALIHA

SEQ ID NO: 8473 - protein, 86 aa, Actinoplanes utahensis
MDRELWAAAYRPPVDVASFARRAIDVFAARDVALGRTGERQKDLELLTALLAEGRLNPEAEIANDHDRRWADRRATDSPNPRAPSA

SEQ ID NO: 8474 - protein, 215 aa, Actinoplanes utahensis
MRVGYTGVIVVGRSARLLVHEEGMDDFGYQHRYVRPLGDGWQLVETGGHLETLELREPCRRLAMSTGRPVLAAQVFDSDRALLCTAVGHTTGLVTCRYDVLAACGDEDGARTPPGATGRPVGDVVSGLLAWSAAAGLPADPAAVRTVVTGDQLADDAVFALVGALGVAGIGRTLPRAFPVESWPFSPLSTLAYLARMSALGRARAGEAEPMASWE

SEQ ID NO: 8475 - protein, 473 aa, Actinoplanes utahensis
MASPLSDSSQIQGNILRPFRGDHQAFVFLSFRSDRPGARAWLTGAAGRTTGNDEVPQSRPAPDGTPARALLNVGLTGTGLTLLHPETAGDLAGHTAFWQGPLGTRLDDAGLLTTAPALLGDLGPGDPSQWVVGGPGRPVDALLTVAADEYDDLAVAVERELLEAERHALAILSVQWGGVLRNEHGKRIEHFGFADGISQPGVRGFADTQKSGAPVIAAGEFLLGHPGERRPPSWTPRPTPAAWMRNGSFQVFRRLRQDVAGWWEHMNALSAADGGSPEDAAARALGRHLDGRPLAAPDRVNDFTYHGDDDGARTPRYAHIRKVNPREDAVFRDRGHKMLRRGIPFGPRLHRHQPDNGEERGMLFNAYMASIDDQFEYVQRRWATDPGFPSSTLARYGRAGATDGPAVDGLDPVLGGNARQAGETLAPEVVRGIPAAAFGGFVTTSGAVYAFTPSLRALRQLAGDAPLDALATA

SEQ ID NO: 8476 - protein, 1349 aa, Actinoplanes utahensis
MTMQRTDKIRKADTPGVTDDSSPTSQIAAELAATWRSYLPDHAIGLLRTGESVGNLPLSERTDAVILFADVAGFTAMAESLAGSGSYGTERLTSVINRWFAVTAEAIVTAGGSVVDFAGDALIGLFRYTPDTALTVARRAVRCAEIIRMATASVDPVPTPEGQRSLAIRVGMASGPVLVMVLGDPGIRLQHLVAGPALDQAVSALHRAERGEIVVDPGLLDTAGPELDVPVPPATAVSPIADLEGLLTPFLHPAIRDRLRSGRHELVNEHRKVTTAFVRLPDLSVDDPQTVRTLQRFLRAGVAIIDQYGGHLRHLMADDKGTVLVAVFGTPVSYEDDEERALRCCLELLALPGGPYRGGVTTGRVYCGEVGSDIRREYAVVGDAVNLAARLMQAAPAGHLLIDQVTHDRVGDIALNARQAAVSAKGKAEPVPVWIVREAQEAGPPAARSKAAPGSLVGRASELGLLDAFAKQVEKGHGHLVWLHGEAGIGKTRVADEALRAARALGFAEYAGGSRSHGKRTSYLVWRSIFRKLLDIDPALSISMQQTVLTERVSRYDTSGLRAPLLATVINLPMEDTDLTTQLEPAGRDELLRATLLACIRDRAEEGPIVLLLEDCHWIDPASLALLEYLVPHIADLPVLMIATSREAIPERLIGPAHVADLHLGQMTRGDAEQLATLRLRERHGVVADIAPEVLRQISEQAGGNAFYIEEMVSYLHGRGVDTGNPRALAGVPVPENLQRLVMARIDQLSDDEKATIKVASVIGRRFQPPWIASIYPAAGSAPEVADHLNRLHALDLTPRIAPGPEPEYEFKHPVTQEAAYQSITYDTRAALHERIGRFIEEEYADRLSQYVDVLAHHYARTERVDKQRAWFRKAGDRAREIFANETATYYYGLLLPLLADPDRAQLHVEIGSVHQHTGQWAEAEDHYLQAMRLARVTGRRDVLAAAQRQLGDLLTYTRTDDEPVTWLSRALAEFEHLGDATGQCRTLDRITFALYRVGAYNEALSMAQRHLELATEIGDLAAVSAALEHTGLVYLHTGRPEAAFDHLQRSLTTAEQSGDRQRMLNAACNLGFASVLGSNHVQAIASFMNALQVAQDIGAGQTANIVVGNIGEIYRDEGEYRHARICAMRSLRVALELGDSLAVAVQVANLGAVAAAEGDTDVAQDLLERAIELIRPHSAPFYLCDWLHRLARLHLAAERLAEAEQLNAEALRIAEEHDERDARVSAYILSIRLRVRAGRLESGDATDMLRKATDEWNEPHEVAALLDAVRQLDPHDEQARTTAADIYRTLYERAPSVEYRRAYRRLTGVLLPPGPPLPELPGWIAAEDGADLDELLQRIDRSAREPRP

SEQ ID NO: 8477 - protein, 199 aa, Actinoplanes utahensis
MPIAVSDAAFELVGACAHALRFALAAPLDYPYAAAGISTTTPPPALFRRVQVASPPPDRGAEPWHTGLTLDDKPFQADLPTDRLGEVRLEDGIPSLDLPDPSSIVLDRWFSVPRRSSTIAFPGRDFGQYLLSVQYWNPVPPGEPAVTRDVAYHGTYRFEFERPPAGDWIAVSFEGFWPPERDSADLLIPLGECDDNCPT

SEQ ID NO: 8478 - protein, 91 aa, Actinoplanes utahensis
MTLRPEEVAMIIVVMLWLAALATGVWAVWPAKEKKVAAVAPPRPEPGSLEGVLVAQLVRAEISAAQYRRAVEGIAARDEQRHPMSVPGEEA

SEQ ID NO: 8479 - protein, 148 aa, Actinoplanes utahensis
MKQFLVSLALVVASVVLGLMVPTVARHSQADFDDAQRVGTGTVYLCTEYGPLTFAGFGYTSKCRVDVVWRDGSKEMVNPNRYGFADASELGRTITIGDLGNGKYARPDRPFRPLIVVTAWLIALVAVAALLLGLAGLRRALRERVSFR

SEQ ID NO: 8480 - protein, 52 aa, Actinoplanes utahensis
MSTWRITIAEGTLRTLDEASFCHAAGIAAGRMIEDQAMRILQLKAQVYGEPK

SEQ ID NO: 8481 - protein, 252 aa, Actinoplanes utahensis
MESGIQTILVGAQFAGLLVVAIAEVVSPAGEAEVESEWPVGAGRTVVGAPVEMVFVGRLPGGVPGRETGRVRLGVGRQHGLTIGNGHAHGGYRGGDQGGQGGRHPGLQRGTGRSVWSARRTRQSVVVVVSDRCAKRHFRYFASMIVVRSLLLFLLAALTEIGGAWLIWQGRREHRGPWWVVAGVLALGAYGFVATLQPDAGFGRILAAYGGVFVAGSLAWGVLVDGFRPDRWDLAGAVICLIGVTVIMYAPR

SEQ ID NO: 8482 - protein, 416 aa, Actinoplanes utahensis
MFPRSTPAPSLLRGATGRRLGRRDALRLGGLSALGAALAACGVPGRGTPAAVVDADALATFWQGKAKNGRLDFANWPLYMDPKHPELTRFTAETGIKVNYQEVIQEMGPWFAKVQPQLSAKQSIGYDLMVITNGIQFGQFRAAGFLAPLDHSRLPNFTANAGPKYATETFDPGNVFSVPWASGITGIAYDPKKTGREITSLADLWDPKFKGKVGMMSDSTELANFGLLAAGVKPGESNEADWRKAAAKLKQQRDAGIVRKYYEQDYVDALGKGEVWLTQAWSGDVFQKNLSDGTNLKFVIPQEGGTIWTDNFAIPVTAANPVDALMMINFFYRVENAASLAEYINYACPVPAAQAQILKDAAKLSGTDRSDMELVAKSDLVFPSETDYAKLHYYVNFGTAEEQQRFSSIFEPIVLG

SEQ ID NO: 8483 - protein, 170 aa, Actinoplanes utahensis
MLAFVSMRVDDARGKADPMHPDVRVAQAGPVDLDTVTTLFLGYLDFYEAPADRAEARQFLSDRMTRGESTVLLARIGAQAAGFTQLYPSFSSVRRAPIWVLNDLFVDPAFRGRGVGRTLLRTAADLAEQNGVVRIELSTDESNSTAQALYESEGYRTGFPVRHYLRRIGA

SEQ ID NO: 8484 - protein, 492 aa, Actinoplanes utahensis
MTTRQRTLRKSAAAAIIALTAAGSAIGMPAPAQAAVPKVAASWSSLMYRSLTHDTQLAAMRTSLAGQQAAVRTWNAEAAAANRADRTALATVATATTADTRARADLSAARTALTGAQQNLVTARQTLTTAKQTLAAAGITVTAAKRGLTTADRNLTAARQRLVAAKRNLTTAKQNLASAKQNLTLAKRNLAAADRRNPRNAVAVKRATTAVTRAATALNHATATVPRATTAVTSATTAVAQAGTAVTQAGAGVTQATAGADRAITRVTRATTGVIRATTAVTAATKTVGVRKAQTQTTAADLAAAAKAERAARARIAEATAGAATGATAVTRTQQAITALPTAASLAGQAAALSRDVVTQVRANFKIEDTTQVYGVTVHRSVAFAFQHMIDAAKADGVQLSGGGFRTTQRQIELRTINGCPDVWTAPSSSCRVPTAIPGRSLHELGLAVDITSGGRTISSKTAAFKWLTAHAKTYGFVNFPVEAWHWSISGN

SEQ ID NO: 8485 - protein, 68 aa, Actinoplanes utahensis
MQSGPRRARARPGLRRPVRLALAAGLRSGAVCRLVFYEARRAAEWAVQAEWAVQAEWAVQAEWAVRAV

SEQ ID NO: 8486 - protein, 125 aa, Actinoplanes utahensis
MAFLLDLCNILGGLLLAIPLLRRLPNVGDNLERFTDRVARWAWLIGIVALIAAGYFLIVHLFEGHIWHFEVVGIAVGLLLTWEKFTGRRILEAPGPAEPAGRALVIAIFGVIAIIVGIEGLFTPN

SEQ ID NO: 8487 - protein, 293 aa, Actinoplanes utahensis
MSTLTPRVVIVSRRSELDELLARHGTRGAAAYFLKQRGRDLDEVSTRHEALREALTQVGAAIPADWRRGHVERADLPRFLFAPEDVVIAVGQDGLVANVAKYLDGQPVIGVDPEPGRNPGVLVRHPATAVGRLLRGSLPRQQRTMVVARLDDGQELAGLNEIYIGHAGHQSARYVITTPDGTRERQSSSGLIVGTGTGATGWCASIARDRATAPPLPAPADPALCWFVREAWPSPVTGVSCVSGLLTTGQELELTSESERLVVFADGLESDALELSWGQRVRVSLAPRHLSLV

SEQ ID NO: 8488 - protein, 36 aa, Actinoplanes utahensis
MLQALALRELAQHLPAIGELTVTPDMLTRLLGRIGS

SEQ ID NO: 8489 - protein, 35 aa, Actinoplanes utahensis
MLGQLAQGQRLQHLGRQVPVGREAGRLGLRLGLAS

SEQ ID NO: 8490 - protein, 261 aa, Actinoplanes utahensis
MADIKRRLHLRHLRSAPTSWVSYTVRGRAKRAGTGLAFWYRPLTAVLSEVPVDDRELPLLFHARTEDFADVTVQATVTYRFSDPAAAASRLDFSIDPYRGQWHGQPLDQVATLLAELAQQPALDLIARLPLAETLTTGIAPVRQGVADALATDPRLAETGVTVVSARVVAIRPEPDLERALQTPTREKVQQDADRATYARRAHAVQQERSIAENELQSKIELARQEQHLVEQHGANARRGAELDAESQLVAAQGEAERARL

SEQ ID NO: 8491 - protein, 230 aa, Actinoplanes utahensis
MTLNAMAVTVDLVLLTIRQQRLQVLLVRRGIEPFRGGWALPGGFVLDDEDLDDAARRELREETGVDAVAGHLEQLGTYGRPGRDPRGRVVTVAYLAMLPDLPAPVAGSDAAGAAWRPVDEAGDLAFDHDRILADGVERARAKLEYTPLATAFCPPEFTVADLRVVYESVWQVQFDPRNFHRKVTTAEDFIEPTGHSVTRERGRPAQLFRRGHAPLLHPPLLRPGSLGQKS

SEQ ID NO: 8492 - protein, 734 aa, Actinoplanes utahensis
MTMVMERTAEVRPLPQRWVRPPSSRRVVARVVQFVGAVSAVSSVLPPRHHQVALLAGMIPTTGLLTARVASGVVGVLLVYLGSGLRRGKRRAWQVALTLSLIAIGLHLVKGGLIPMAVAGGIVALLLSRRHEFTAEGDPRNRWRAARACATFLSAGFALGFAEIAVRVDHLTGRPGVLSWAAHALLGLVGITGPVHFVSPLADLTVTVTTGAFGLLAFASAALLLLRPSTGAAASPGDDPARLRAVLDRHGDGDSLGYFALRSDKQLVWAPSGRAAVAYRVVNGVSLASGDPLGLPSEWPQAIGQWLADCARHGWTPAVLACGTAGGRAYQKTGLDVIELGDEAIVDVAGFSLDGRPMRGVRQAVARIRRAGYTCAVLRQRDLPAETLAEAVACANALRDGKVERGFSMALSRLGDPGDGDCVLVLCRDEEGTLRGLLQLVPWGRRGLSLDLMRGDRTAPNGLTELMIVSAIEAAPGFGVARISLNFAVLRSVFARAEELGAGPVIRLWSRVLRAASRLWQIESLYRANAKYQPDWQPRFLCFPSARDLPRIAIAALRAESFLPTGGPSSIAACPATPPAQVAEGSATQKAQVAEGSATQKVQVAEGSATQKVQVAEGSVDGSATPPADPAGGAATPPGPAPGPVPRRPRRGRLVRLTGLPLLLLTALLLIVVAAATARWWRSAAVRITGLILAEVLVVAGAGLIANRSQNFYPTWQALAGHVPPVAVAASTGA

SEQ ID NO: 8493 - protein, 111 aa, Actinoplanes utahensis
MASPEYTRAPDRLFPVVVVLCGAAGVPRVQQWASRADRVLTVILVPTRATSGSALASLPSSLRRDARAGTDVITLHDPDPADLDAAVRDLPEPLAAPLYLPPPRLAHEVRP

SEQ ID NO: 8494 - protein, 328 aa, Actinoplanes utahensis
MRIDAPATVLVTVAFTLLATVSLGLLWRRARLLTRIGLAALVLVLVTGSAGLQLNRMTETYPTWGTLAGLPSPEMHIGERLVSYPVRGPASGLDMTMTVYFPAAYRADPRRRFPVIEALHGFPGTPSTWVRRLDIVRHLDQEIASGRMAPAVVLLPYLTPRRLLDTECTNLVGGPQTETYLTRDVPEWTMAHLRVRADRAAWGLTGYSAGGFCAMNLLLRHPDRYAAAASLSGFADPGIKVGDHSEATTNNVAWRLEHLPRPRVAMWIGWAADDHLARSGSREVVQAAKAPVTVVTAVVPHGGHSHAAWQQMEGPAFDWLSAHLARAE

SEQ ID NO: 8495 - protein, 637 aa, Actinoplanes utahensis
MMRRGVAALVPAILLIPGPAVAAVGRPGGGEPRARVWVTTVDRSELLHERSPVGFRRGSSALTTITVNPERTFQRMDGFGAALTDAAASVLYRLSAADRADAVQQLFDPEKGIGVSFLRQPIGSSDFTAAAAHYTYDDVPAGQTDFGLRHFSVEHDRAQILPLLRAARRLNPRLTVLATPWSPPAWMKTGGSLIGGRLRDDPRIYDAYARYLVRFVQAYAAAGVPVDYLTVQNEPQNRLPGGYPGTDMPVRQEAAVIERLGPLLRQVSPRTRILGYDHNWQTHPGDVGSTPPGEDPETDYPYRLLDSPAGKWLAGTAYHCYSGDPGAQTALHEAHPDKGIWFTECSGSHGAGDTDEQIFRGTLTWHARTLAIGVPRNWAKSVVNWNIALDSGGGPHLGGCGTCTGLLTLLPDGTVRRDAEFFTIGHLSKFVRPGAVRIASTSFGTTGWNGQIMDVAFRNPDGSTALVVHNENDEPRSFAVAVGARTFEYTLPGGALATFVWPRSVGARPGEIPLTGATAVAVPPGEGAPLAVDGDASTRWSSGAAQAPGQYLQVDLGADRVFRRVAVDSGDNLGDYARGWQLSVSRDGATWTTVAAGAGTGQLTEVALRPTRARYLRITSTGGSGSWWSVADLRLYR

SEQ ID NO: 8496 - protein, 143 aa, Actinoplanes utahensis
MTRLLAPVLLLTLVAACAAAPAGGSTPQVSGAPDRVFPLDFSRSGGFAGRSDRLHIDADGRMTVTRQGAGSSGPVAVDRTVLDALRQVLATADPIPSASSGICADGYRYRISTPSWSVSTDDCAEHHESLDRALELLVPLLRP

SEQ ID NO: 8497 - protein, 168 aa, Actinoplanes utahensis
MPTAVRSLFAAAVTATAVVAVATPAAAAPADKLSVLSGFTQTSAGSYTSWLAARNNQGAWSDYGFDWSTDYCTTSPDNPLGFDFKLSCARHDFGYRNYKAVGTFDANKDRLDSMLYADLKRKCATYSTLSQAACNSVAWTYYQAVHNFGSLAAVDQADIRSAAALEKS

SEQ ID NO: 8498 - protein, 280 aa, Actinoplanes utahensis
MGIQAPQSVGLPLREPKCSCDHLYLPEVGLIIVSASINDRQRRQHATSFGAAAREYRRGRPPYPREAVDWLLPTGAATVVDLGAGTGKFTELLVAPGREVIAVEPSAGMREQLADAVPAATVHGGTAERIPLPDASADAVLMAQAWHWVDPELAVPEIARVLRPGGTLGLVWNIRDSREPWVAELDDLLHHHSRQDLDTAPELPAPFAAAERAEFSWRHTLTRDAVLDMIASRSYVIVLPEPERAELLGNVTELLASHPDLADHDDIVLPYVTRCTRATR

SEQ ID NO: 8499 - protein, 256 aa, Actinoplanes utahensis
MIELKSTGEIARMAVTGQFVGELLAELSGTAAVGVNLMDLEHHARRRIEQRGAESCYWDYAPSFGRGPFRNVLCLSVNDAVLHGLPHDYVLRDGDLLSIDMAVGIDGWVADSAVSVIVGEPDPDDLALIESTEVALEAGIAAAQPGGRLGDISAAIGEVAHAYGLAVNLEFGGHGLGRTMHEAPHIPNNGRARRGMRLDPGLTIAIEPWFCRGTDKIKFDADGWTIRSADGSRTAHSEHTVAITESGPQVLTRRPA

SEQ ID NO: 8500 - protein, 88 aa, Actinoplanes utahensis
MVRQPLTPEQIAAGRRLGAALRAARAGRGLVEVALAAGISPETLRKIEAGRLPAPAFGTVVCLSRALDVPLGDLADVWLADTAVSRAS

SEQ ID NO: 8501 - protein, 463 aa, Actinoplanes utahensis
MTTWSMLQISEYFTAVTRAGDEASVARVAVQRATEATDAELGAVVCGDTLTASVGLGRSPDPALFLGLRSETAAFPGVGEAYVSMHALAGDNTERLVVARTDEPFTAEERQMLQGMAKVLGLALRSLRTLAAEQQLRREREREAEDRLVLVRALERRERLLETLLRIQRAAGQGTPLHEQLDTITGEARRLLPDAAVVLVLSDADDPASAAGPYDRSSVLLLAERTMAAGEPVVDGDLTGAPVYRGDRLAGALVFAGHGGDVRESERRDVLAAFSEQASLALTGAHTAAAVHEAHHDPLTRLPNRALFLRRLEKSLAENASAALLYLDLDLFKQVNDTLGHAAGDELLRGVADRLVGAVRDTDMAARFGGDEFAVLLEPITGEAQAWEIAQRVVDAIARPFDIAGRAVLTRASVGIAYTGPGRSAAHVLEDADLAMYRAKKTMPGTCRAFDPRMRSEELRPAC

SEQ ID NO: 8502 - protein, 388 aa, Actinoplanes utahensis
MDAERWFGVGRSLLADPAEAGSQACREALGGRRASLVIVFASLTHATPEMAAAVHAAAGGDVLMIGCSTSGEYTSDGGGAGVVVNALGGYTAAVRAVPHDSVDLYTAGETVASALDDVDAEHRVLLMLGDGRSGDQQEVVRGAYAVSGAQVPLIGGCAGDNVTQTGTFAFFSDGGPVQVLPNAVLGAALGAPSPFGIGMAHGWHRLDEPMVVTRSEGGKIYELDGEPALDVYLRRTGAPEGLSADPSAFLQFATIRPLGLARRTGEDIRIIFACDAAERSISGLADTPEGAMVWFMAGETDEVVGAAAAAGRAAMESLSGAAPLGVLVFDCCVRPIALGEDSTELATERLRDALKPVPFGGFYSNGEIIRQAGAKGMHHLTVAALALS

SEQ ID NO: 8503 - protein, 400 aa, Actinoplanes utahensis
MMGRMDYETAVGSLFQAEGREDPYPAYDVIRAHAPIFPVGDDQWFVTSHALVSRLLRDPGLRVADRSDYDRHWPDWRDNRGVASVVLSMLQTNPPDHSRVRRAAAATFTARRVAGLRDVITRQVGDLIDEMPAEADFIGAFAYPLPIAVICALLGIPDGERRWFRQRAADLTVVLEPISTPEEMARADKAGREIEAYFTGLIADRRHTPREDLTSALVAAAETDLTGEELLANLILLLVAGFETTTNLLGTGLKILLEHPDQADRLRSDAGLAPAFVEEILRYDSPVQLTSRFPTEPLDLDGVRVPAGPMLTMLLGSANRDPQRYPDPHRFDPDRPNIQPVSFGGGAHYCLGAPLARLEAQVAFPLLLSRLPGLAAAGAPVRRDRLVLRGYAALPVTTGR

SEQ ID NO: 8504 - protein, 315 aa, Actinoplanes utahensis
MRIGYKLMAEGFGPQELIRQAIRAEQAGFDFVEMSDHYHPWLEEQGHSPFAWNVLSAIAARTDRLGLATGVTCPTVRYHPAIIAQAAATLALISDGRFTLGIGSGERLNEHVVGRGFPGVAVRQEMLAEALDIINLLWQGGYRSYQGRHLQLEDARVFDLPDELPVIAVAAGGKQAAELAATHGSGLFATEPRADLVTTFQEKGGTGPRYAEIATAWAPTVDAAVAEAHRTSRWSVTGWKVMSELPNPVNFDAASQTVRPEDVQRQFVCGPDPQAYRDAVKTYSEAGFDHLVLMNAGPDPDGFLDFFESELSGRW

SEQ ID NO: 8505 - protein, 139 aa, Actinoplanes utahensis
MTSAMELHGDPHVARYLETDGEDGFHWRNGTEILILFTKGRKSGEQRSHALIFREHRGAYLVVASKGGAAAPPAWFVNLEAEPRVEVQIRGDRFPARARVATAQEKPEMWAKMAEVWPDYDEYQKKTDREIPVVVLERV

SEQ ID NO: 8506 - protein, 89 aa, Actinoplanes utahensis
MTDTMVVELGLQAMTIAAKLSAPILLTALAIGFAISLFQSVTQIQEATLSFVPKAVAIGAVLLFTGNWMLHQMMTYTTQLFDKVPELLR

SEQ ID NO: 8507 - protein, 179 aa, Actinoplanes utahensis
MRKIPTVFQRDPEDRRRVLPEAHPDCAWVLAGEGVATRKYDGTCVLLDEDGTWWARREVRPARTRPPGYRPVMTDENTGRTVGWEPIAQSSYAACHLEAVARGTSWRPGTYELIGPKINGNPERVPGHELVAHADAERFDVPRDLAGLREWILAHPRYEGLVWHHPDGRRAKLKYRDFA

SEQ ID NO: 8508 - protein, 354 aa, Actinoplanes utahensis
MVRIHKAPLHRRFRGCPLVYRIAAADAHRVSTSRVGDLLLLAVAVVWGSSYLTAKTLVAAGGVLVLLALRFLISAVALLPALAVRRSRGRFDRRELLVGVGLGVTQTSVLILETFGLSMTSATNAGVLISLTILMTPILEGFTRRRWLPPAFFGGAAAATLGVVFLVAGPGLRTPSAGDALMLAAAVVRAAHVTLSAHLTRGRSHDTATLAALQTLTGAVVCSTVAARALPAAVAAYGPAQWAAVTYLALGCSVFAFVVQLWAIRRTSASRASLLLGTEPVWAVLFGVALAGDRLTPAALLGIALVLAGTYYGQRLEGRSRAERSPTYARGNDIVRRTPRPRVGARSVRRSRGI

SEQ ID NO: 8509 - protein, 295 aa, Actinoplanes utahensis
MDPHHLRLLRELRDRGSVAAVARALHITPSAVSQQLNTLQRSARVPLTERAGRRLVLTAAGRALAAAAVDVLTALDRADRAVGAHLDDPLSPVTVAAFHSAALTWFPELIRRAPQVRCADEDVARADFPGLAGDYDLVIAHRVAHSPPWPADRVTVLPLIYEPIHVAMPVGSPLADRQRLTAADVAGQPWISVHEGFPVGGVLTAIAAAAGRPLDIVHRVNEFTVTAAMVAAGAGLAIMPALTTVPDPRVVLRPLADLPAGRHIDVLTRPETLHRASVRAVLGALREISRSGGAS

SEQ ID NO: 8510 - protein, 291 aa, Actinoplanes utahensis
MRTVTRRVTLWRADLEGLVCPVAEEIAEALIGRDPVMVVLEHRVKGITAVREVFETAVEREPTWRFSGIGWPADVQTGTVVTVTWQAGRDAVVVRTRVLDDPMRIDGVNYYHEYDPLVVTRDFDPRPSNRGQVLKVIRGLGRVFEDGSAVFPEDSLAGQAGLGRGQKGTFLLKNAVDQLIREGYVTRVTGSTDADGLACYPAVDGQDPVDLLFYAPLVEPAPHPHEDDDEDDEHHDRREHWVKGFIRKLPPGAQPSERQMAAYQWAVENELIDEDAMGPGYTYVKKHHRNG

SEQ ID NO: 8511 - protein, 89 aa, Actinoplanes utahensis
MRLLRAEAEYASVRKNPLIAYVLWCVCGIFGGHRFYLGDTARSIVMLFTLGGVGVWTLLDVFFIARRVRTVNQERRAAILARYGILDAP

SEQ ID NO: 8512 - protein, 264 aa, Actinoplanes utahensis
MTIDKLDTGVPHPARRYNYWLGGKDNFAADRESGDLLARSYPAARIAARANRAFLRRAVGHLAGEAGIRQFLDIGTGLPTADNTHQVAQRVAPDSRIVYVDNDPMVMVHARALLTSTPEGRTRYLEQDLRRPEEILAALDILDLTRPVALILVAVIHFLPDHARATEIVHTLVDALPAGSYLTMTSATTDFLTPELKANWDESLRTGRSDVHPRTRAAFEDYFAGLDPIAPGITAIGDWRPDPADPEHPTPVDASLFGAVARKP

SEQ ID NO: 8513 - protein, 307 aa, Actinoplanes utahensis
MQRYRVGILAVATVVVLGGGGLIYAGLDGGSGGGVVSSALSLDGSDTSTKGASPSPTGPSPEELARAARAQQAKALTAALTKLSAASPEFSVAVLDKTTGESFAFRGDEHYDTASIVKAQILACMLLKDQDAGRDPSSAEMALAKPMIQFSDNNATTSLFGRIGGKAAVGRCNKRLGLTATEVASSWGFTRTTANDQVKLLAKFVDVKGPLDADSRKTAFKLMNTVSKGQTWGVPSIARSGETTTVKNGWDTRSADGGLWAINTIGRVTGGRVDVSVAVLSHNNRSQPAGQALVEKVAKLTRQYLKY

SEQ ID NO: 8514 - protein, 138 aa, Actinoplanes utahensis
MPRRCRWPAGRVESGNRWPGAHRACQAAGVTEREPIVMQVYCRVKVVVDDPAAMTEVAVRRLREADIDWSAEADTLAEAEAEMRTDLPQALSSLVDPAALLAGVPGVEISGGRWWAEPGEPAPGFQPGFPGPAPRRTV

SEQ ID NO: 8515 - protein, 375 aa, Actinoplanes utahensis
MQSAPRLAIDYGSACTRAVLAWPDRPWQPLLVEGTAEPSSAVHVGADGALTAGAAAWRLAADDPAGFVESPLAAGVGTVRVRGRNVEIAGLVAATLRLIAAEAVRMAGVLPADVRMSVPAGWDPARRTWLRQAAHQAGLNRPQLVEAPVAALVATRCTARPIPVLDPPSAAGPPSSRPSGGGTTYAATTAPSRFVLVCDVGATAEVSVLRADLSGAEVMSTVTGVDAGGRAIDDRLVSMLLHREATAAPTRPSPATTPVGSTTTRRVPDLDTTRRVPDLDTTRRVPDLDTTRRVPDPDTTGRAAVGHRRHGVPGRRVEHVEPVPRGRGHPCAADEQFGFHNSSSCQGPVTPPAFPASGRAATLPGLAPSGAGRGG

SEQ ID NO: 8516 - protein, 333 aa, Actinoplanes utahensis
MNSSVSTTAPLAKVRLRPQHSPHPVVPPRFRDWPPPERAGAVSVSSVTVGFLGLGVMGRPMALNLVRAGTDLVVWNRSAAARDELRAAGAAVASGVTDLFARADVVLMMLADDRVADEVLGRDGPGFAGMLAGRTLVHMGTTAPAWSRGLAEQVADAGGHYVEAPVSGSRVPAENAELVAMLAGAGADLDRVTPVLGPMVRETVRCGPVPNGLLMKLSVNTFLISMVTGLAEAFHFAERHRLDRATLLAALDAGPMASPVSRLKGRKLLDGDFAVQASIRDVLYNNHLIVEAAETAGIPSPLLDTCLELYAETASAGHGAEDMAAVIQALRAR

SEQ ID NO: 8517 - protein, 334 aa, Actinoplanes utahensis
MSQQVGLLIGEQAGAGDRRGGVRIEGGEELFRADEAAAFPHRVAVDVDVLRQDPVRVEAGLLGELATGRLQGCLAGVDAATGGLPEAYPGKGILPVHQQDPAVGVEAEHPDGRAVGDLHDHKPKLSRVAKYFDVHPDNPQARSIQQIVELIGADGLIAYPTDSCFALGCRMGNKDGLDRIRAIRHLDDKHHFTLMCHDFAQLGQFVQINNALFRAIKASTPGPYTFILPATKEVPRRLLHPKKKTVGVRITGHTTAQAILAALGEPLVSSTLLLPGEPEPMTQGWEIKEALDHAVDAVIDSGECGTEPTTVIDLSEGVPEVLRVGAGDPGRFSG

SEQ ID NO: 8518 - protein, 413 aa, Actinoplanes utahensis
MLIAVPGNAGPKYAARVAAPWTGTWSTGPTEATPDTAPLPADCTVRQVVHLSLGGAAPRVHLTNRYGPERIRFGEVWIGVRAGDPDSTAMWPGTIRPVTFDGRTEGRLPAWGDLVSDPVPDLPLAPGADLVISFHLPERTRTGTLSPHSFQHGRVLTGNVAAAPAPPAGAVITRYVLLGGVSVRTAGPSSAVVAFGDSITCGTQTTLDADRRWPDLLAARVRAAGLPLGVLNAGIGGNRLLTGAEVRGAAPVGALAQATPPTVRRQYGPAGLRRFDPDVLDQPGVSHVITLIGVNDIGSGGATAEALIAGHRALLRRSRAAGLSVVGGTLLPFGGSMYDEPAHRSARLTLNRWIREGGEFDAVADFDAAVRDGADPERLAAAYDSGDHLHPNDAGMLALAGAVPLTALSPVTR

SEQ ID NO: 8519 - protein, 357 aa, Actinoplanes utahensis
MKLARLVAAAVLAAAAGALFVPATAEAHGAIQVPGSRTWFCYQDGRNPTTGAIEPKNPACAAAVAKSGVTSLYNWFAVLRSDGAGRVSGFIPDGQLCSGGTGGPYDFTGYNLARDDWPTTHLTAGATMEFHYNDWAKHPGTFSLYITKDGYDPTRPLAWSDLEPTPFDTVTNPPADGGPGTDAGHYYWTGKLPSGKSGKHLIYSVWSRSDSTETFYGCSDVVFDGGNGQVTGIGTPPSSPPPSSPSASPSTPGGGTGSGCSAMYNVTSSWTGGFQAQVMVHAGTTAVNGWHVSWTWPGGQTLASLWSGRATSTGSLVSVTNETWNGTIAAGDHTTFGFLGSGSAPATVPNLTCTSGS

SEQ ID NO: 8520 - protein, 973 aa, Actinoplanes utahensis
MRQSAHRLRRRLAVLGVAVLGAGAAFAAGGPPAYAAAGCAVVYKVPSQWPGGFTGDIAITNSGDPLTSWKLEYDFPDAAQKVTQGWNGTYAQSGRHVTITSASWNGTLGTGATTGTGFNGTFGSTNPVPTSFTLNGQPCNGSAAAPTVAISSPAANTRYTGPAAIPIAATATAAGGQTIAKVEFYHDGLLLGSDDTAPYTYTWSGVPAQAAAYHLQAVAYDGAGTRSSTADVPVFVDASTTPSIVADATSATLEPGRSGTFNLALSAAPTADVTVTVARSAGTTAVTATPATLTFTPQNWRTGQPVTVAASTSATAGSTATISATATGYTAATVAVSVVAAGSTDVRFTQMYNDIKNPSNGYFSPEGVPYHSIETLIDEAPDQGHETTSEAFSYWLWLEAEHGQVTGDWAPFNSAWSTMEKYIIPSHADQPTNANYNASKPATYAAEHPLPSQYPSQLDSSVSVGSDPLAAELKSTYNTDDIYGTHWLMDVDNVYGFGHCGDGTTRVAYINTFQRGPQESTFETVPQPSCDTFKFGGPNGYLDLFTKDTSYARQWKYTNAPDADARSIQVAYWANRWATAQGKQSQISGTVANAAKMGDYLRYAFYDKYFKQPGCTSTACPAGTGKNSSSNLLSWYYAWGGAYDTSAGWAWRIGSSTSHFGYQNPMAAYALSSVAALNPKSPTGKADWQASLSRQLEFYRWLQSSEGAIAGGATNSWDGSYSAPPAGTPTFYGMSYVEAPVYGDPPSNQWFGMQTWSLERLAEYYYTTGDATAKTILDKWVTWALANSDITAGSFAIPSDLGWSGAPATWNAASPAANTNLHVTVKSRGTDLGVAGSFAKLLAYYAAKSGNTAAKTAAKNLLDAIWTHKDTKGVSVTETREDYKRMDDTYDATTGQGIYIPNGWTGRMPNGDVIKPGVSFLDIRSFYKKDPDFPKVQAYLNGGAAPTFNYHRFWAQVDVATGYADYARLFPEG

SEQ ID NO: 8521 - protein, 872 aa, Actinoplanes utahensis
MRWSPGGALVAALVVAATSVVVVAQPPSATAAAADPYTWKNVRIDGGGFIPGIVFNPGEKNLIYARTDIGGAYRWNQTGQSWTPLLDGVGQTDWGHNGVLSIAADPVDTGRVYAAVGMYTNSWDPNNGAILRSTDRGATWQQTDLPFKVGGNMPGRGMGERLAVDPHDNRNVYFAAEGGNGLWRSTDHGVTWARVTAFPNAGNYVQDPADTSGYLAQNQGLTWVTFGAAGQVFVGVADRANPVYMSADSGVTWSRIAGQPTGYLAHKGVVQGDYLYIATSDTGGPYDGGAGAVWKYRISTATWTDISPTAVADRYYGYSGLTVDTQHPGTLMVATQISWWPDAIFFRSTDNGATWTRAWDWTGYPSRSRRYALDISADPWLDFNNAPAAPEESPKLGWMNESLQIDPFDSNRLLYGTGATLYGTTDLTKWDSGGTITIKPVAKGIEETAVLDLASPPSGAPLVSALGDVGGFYHADLDTVPASFHDTPSLGSNTSLDFAELSPSFFVRVGNADAAPHIGVSNDGGKTWYQGQEPAGVSGGGTVAVGADANAVVWSPAGTGVHYSTTRGSSWTASTGVPAGAIVESDRVNPETFYAYAGGSFYTSVDGGASFTASTVALPSAGRLHVKAVPGVAGEVWVAGSTGLLRSTDSGKTFTQVSAEVTAGVNVAFGKAAPGASHPAVFLVGTVDGVDGVYRSDDTGASWVRINDDGHRYGNAGDALAGDPRIYGRVYLGTNGRGILYADRTGATPSAPASPSPSASPSTSPRRPTAGCSASYKTIGSWSGGFQGEVTVANTGASATTGWTVKWAYTAGQAVTQSWGGTAAQSGSAVTVTNASYNGALASGASTTFGFLGSTTGTTDPVPSPVSCSRVP

SEQ ID NO: 8522 - protein, 454 aa, Actinoplanes utahensis
MKVCVVGTGYVGLTTGVSLAFLGHEVTCVDLDQNKVDMLRAGKCPIYEPGMEELLAEAAPNLSFTTSYDEGVPGADVVFVAVQTPSAADGSPDLRYLRSAAESVARSLNHDFTVVVNKSTVPIGSGNWVDAILRESFAQRDDRPAGVEFAVASNPEFLREGNAIADTLFPDRIVIGSDNPRSLEVLNRLYRPIINQTFTAPAFQPRPEDASAVPLVSTDLASAELIKYAANAFLALKISYVNEIGQLAAKVGADITEVARGMGLDQRIGSRFLQPGVGWGGSCFGKDTKALVATASEYNLEMPIVTAARDVNQRQRAIAVERLQNELRILKGRKIGLLGCAFKPNTDDLRDSPALDIANLLLARGARVRLHDPIAGERFRREQPELAPYLSETLDGVFDDCDAVVLVTEWAQYLELDWGKFVGLMRNPLVLDGRHALDAERMRRLGFKYVAVAG

SEQ ID NO: 8523 - protein, 457 aa, Actinoplanes utahensis
MFGHSGSSRSRVALAGALSAGLIFSLAACGNDKKSDSTGSNDAASAGIDCSVFSQFGDIKGKTVSVYTGIVTPEDTPHKKSYEPFEKCTGATVKYEGDKSFETQILVRAKAGTPPDIAYVPQPGLLQQLVATGKAVEAPAEVSANVDKFWTKDWKAYGTVDGKFYAAPLGANVKSLVWYSPKQFKEKGYTVPTTLDELKALSDKIAATGSKPWCAGIGSGDATGWPLTDWVEDFMLRINGVDTYDKWVKHEIPFNSPEDIAAWDAVGAYLKNDKYVNGGLGDVKSIASTTFQDAGLQILEGTCSLHRQASFYAANFAKGTDISENGDIYAFYLPGKDAATKPVLGGGEFVVAFNNRPEVKAFQYFLSTDTWANLKAKVSSGWVSANNGLKIESLTNPIDQLSAKILQDPKAQFRFDGSDMMPAAVGSNAFWKQATAWIIGQDTQTTVNNIEAAWPKK

SEQ ID NO: 8524 - protein, 331 aa, Actinoplanes utahensis
MFHTANDTPEKLLQMLSALLLFAAVLGVILFLASRVRGKRSDNWVGYLYLLPVVLLLAVGLVYPGLRTVYESFFDASGGSYIGLDNYKTIFTDDDLLQVLFNTILWTVLVPLVATAIGLIYAILVDKSRFESFAKALIFLPMAISMVAAGVIWKFMYEYRVDQPNVKQIGLINQLIVWLGGHPLQLLISDNLPGPLGMNTLLLIVVFIWIQAGFAMTILSAAIKAIPDEIIEAARLDGVTPWSMFVKITLPSVRTTIVVVLTTLAIGALKVFDVVRTMTGGNFKTSVIANEFYSQLVRASNQGLAAALAVVLFLLVTPIIIYNIRQVRQEA

SEQ ID NO: 8525 - protein, 303 aa, Actinoplanes utahensis
MTVTPLTTTPDITPVQLSAAAVAKKKLSSPWASLAAIVIAVLWTIPTFGLLVSSFRPELAIKRTGWWTFFSDPQVTLDNYRAVFDSDSGISLGTYFINSLMICIPSVLIPLSLAALAAYAFAWINFRGKNILFVAVFALQIVPLQVTLIPLLTIFGKVGIAGTFWPLWLAHTTFALPLAIYLLHNFIKEIPATLIEAARVDGAGHVSIFFKVMLPLLTPALAAFGIFQFLWVWNDLLVALVFAGGGDTVAPITLQLANITGTRGTAWHLLASGTFVSIIVPVTVFLLLQRFFVRGLLAGSVKG

SEQ ID NO: 8526 - protein, 226 aa, Actinoplanes utahensis
MSVVEVTGVGRDFGSGDRVVHALAGVSFTAEKGELVAVRGRSGAGKTTLLNLIGGLDQPTAGRIVVAGREVTGAGERELLELRRDRIGFVFQSFGLVPILSAAENVSVPMRLARRDPRDRDERVSVLLELVGLGGQANQRPGELSGGQQQRVALARALANDPDLLIADEPTGQLDSDTGRAIMDLLRAVVDARGMTALVATHDPSLMDRADRVLTLRDGRLEAGAA

SEQ ID NO: 8527 - protein, 317 aa, Actinoplanes utahensis
MTTDLADLERRAAAAAVARAGGQDRLRGHIVCDGLVRIFRTEGVEVMALQGLDLVIDRGELLAVVGASGSGKSTMLNILSGLDEPTAGIATVAGFDLLGMTAKRRLEYRRKIVGFVWQQTARNLLPYLTARENVELPMRLAGRRRRKRAEELLEMVGVADQAGRRPAEMSGGEQQRCAVAVALANDPEVLFADEPTGELDEATADEVFGALRTVNAELGVTVVVVTHDRNVAGQVRRAVAIRDGKTASEVRRSARLAADGSEHHVSEEYAVLDRAGRLQLPAAFVEALELRDRVRLNLEPDHVEVRPGTAAEQGEPA

SEQ ID NO: 8528 - protein, 881 aa, Actinoplanes utahensis
MSVLRRVRAFAGQLLLLAVLAGLTAFLVAGPVRLANGRTDDGLRGDIGRLAYTSRDLTLSAIQRDYEPSRAAGAGELAALRQKLPAPLTGMIGGSWYIAESGRASVVPAGTTAGSCPNAATIRYEPAAAAAITMVAGRQPDTTRIPEVMLGEHEAQALRIRLGDRLDLTSRWGTGRVQVVGLYRANDPADPIWDDLKLVPNVACPDPRDGTRSLAVLLGDQTAAAEAGNLVGDFGDRWRFRLDERRITADRVDALASAVARLRHNPPPETTLQSSLDSTLAAFDRQVRAVRALLAVVQAGILATAAGLILLAARLMAGRRRAEFALIRARGGAVHTVAGRTVLETLVVVPAAVALGWLGGALVSGRPDPAEPYLVVAVLLVGLLAAPAYAAFDARRPSFSGHRGDVAALRPPTRRLTAEGFLVLLAVGGILLLRRRGLDAGAGVDPYLIGTPVLLALAASVVALRLVPFPLRWAGRIAARARGAIAFLGLSGAGRAPMHSGPLAVLVVAIATGLFTGTVTSTVGGARDRAADLSVPADALVTGFAFTPDTAARLAALPHVTRVTPVLLAPGTTIHGDTSPMILQGQAMVVDAAAAGLDLPAALVAAKPGTAAIPVAVSPHLAERIGTAGSVDVQGRRYRYAVAAIVATVPGLGTDTQDFMVLPEQAMPIPDFAPIVPNRLLVDGAGLDVARLRDTADAGQVDQLRKVTGRAVQAWELAVPATVTTRTAYRRSLEQRGVDGALSFTFTAGMVAAAALSLTAVALAVLTGAPARGRTLSRLRTMGLSRRQGRRLLVFELVPLVAVAVLAGGLAGFTLPALIGPALGLDGFTAGVTAGISLDPWFAGGVLALAVVAVIAALAVENVANRRLRVGSVLRLGEEQS

SEQ ID NO: 8529 - protein, 796 aa, Actinoplanes utahensis
MRDRRTGRPVARTVSGVWRPRDPADPYWLLLPDVTAGRLPQTSTYGPIVSTDPAFFDNASAGWLVQPDLSAPTLGSIRRTAQSMTATGADLPAKSGLGASATVTTGLPDLAGRLGRADLVRRSTLVTPMLLVVVLGGYALSLVALLLAESRKSETALLRARGASRRQLTALAATEALALVLPAALLGPPLAVALVSLHTRVRLDAGVWLIGVLVAVGGILALTAPATRRGGTYLAETAGRKRLPVLRRAGLDLVVVALAALAWLQLRQYSAPTGAGGLGIDPLLAAAPTLGVLTGAVLAIRLLPPVARSVAARLGRGRSQASLLGAWQAGRRSHAGPMVMLALAVAAATVSWCLAATAQQSRADQAEQLVGADLRLVETGGVAPAGRDRQLAALPGVRAVVPAWRDSVQVAAGREPADLVAMDTATAGGVVRARADATGGAPADLLAELAAAARTGTAATATLKAGRITTSGPARVTAIFAGGRRVELGTSDADRPLRIRDGGPGLLGFRVESSGQVPITWDITGQDDVWSPLTPQAVGGYAVVRSSGPWTPVPIAITRPAASALGDVSHLQIGGVSVPVTVVATVNRVPGTTVPAAILIDRGVVDSRLFQGYGIVRDTGEWWISGRPAGLTGLTGLRVLDRQELASGEDPFDTAGRVALFGAALGAMVLAVAGIAADARATARHRSVELAVLHTLGAGPRLLARSLIVEQALLAGLGAVAGLAVGLLVAAGMVPQMVLTPAAARPVPDALLRVLWGRTAGSAALLVVIALAVSAITATSATRRLPAARLRLGEDR

SEQ ID NO: 8530 - protein, 179 aa, Actinoplanes utahensis
MNTMVNGGERRGGRNPADGPGAPGVDPIWQDAPHARTGAPMALIVRRAAAARGLLAAAAAVMLSAVLLMTGLTAYATASAGAGVRAAVALADPDERSVLVRGAAGTDPQARDKTIRQAYAPARISGARYGSGWAVEGARGSAVPDSSGVVYASLVRIDDLPAHADLLAGAWPAGTGQVA

SEQ ID NO: 8531 - protein, 72 aa, Actinoplanes utahensis
MDDALVAYNAGRVDGAAGHRDPQIAEDPEVGADYRIGLLDGRIAAYHMINEVRGILGVTDSLFDQPDDPRPA

SEQ ID NO: 8532 - protein, 195 aa, Actinoplanes utahensis
MNRIIRGVAMSGLAVAAGLAVAAGPAAASTGTSSAPAAPQKPAAPQAPAAPQKPAAPQAPAAPQAKAHLQDRIVGFYRSPMACHAVGRRGEFRHQWASHDCIPVRHGFRRGSWALKAYYGWAGPGDFHHGPDFHHGPDFHHGPDFHDGPGFHDGPGFHDGPGFHDGPGFHDGPGFHDGPDFHDGPHGGPGPWKKN

SEQ ID NO: 8533 - protein, 441 aa, Actinoplanes utahensis
MTLVAERPTLRAKWIDRWDPEDPTFWSNGGSRIAKRNLIFSIFSEHIGFSVWSLWSVMVLFLGPKYGFDPAQKFLLTAVPTLVGAGLRIPYTFAVARFGGRNWTVISASLLLIPSILAAFLIRPGISFTTLVLLAATAGVGGGNFASSMANINAFFPNRYKGWALGINAGGGNIGVAAVQLVGLAVLATAGAGHPGIVAGIYIPLIVLATLGSALWMDNLSQARNDKRGMRDAIRDGHTWVMSLLYIGTFGSFIGFGFAFGQVLQVQFAGQFNTPIKAAYLTFLGPLLGSLIRPLGGALADRLGGARVTFVNFIAMGLGASVVLVAAQQRSLPLYIAGFITLFILSGLGNGSTYKMIPAIFKAKYPDDAPQALRLSGAVIGIAGAIGAVGGVLVNLAFRQSFLIYKDADAAYLAFIGFYALCVVVTWVVYLRPGARRAIAV

SEQ ID NO: 8534 - protein, 101 aa, Actinoplanes utahensis
MKTLTTLGPVSDIPLGEGRTYAVGDDMIAIFRLRDGSLRAVSAVCPHKGGPLADGQIDNAVVVCPLHLFTWDLATGCSPSGQPPIDVYPVRVDDGQIVLGE

SEQ ID NO: 8535 - protein, 820 aa, Actinoplanes utahensis
MTQKLVVIGNGMAGARTVEEILARDGDFSVTMFGDEPYGNYNRIMLSNLLAGVETEEGIFLNDLAWYRDNGITLNAGVKVERIDATTKTVVDSRGVVTPYDKLIIATGSYSWTPPMKNVHNPKRGYHQGVFAFRTLDDTRGMIRYARDHERAVVIGGGLLGLEAARGLQNHVSQVTLLHAMGHLMERQLDPKAGRMLQASVEGRLGIQVITNAMTTEILGKDRVTGVKLADGTVIECDVVVIAAGIRPNTEMVAGSGLPVERGIVVDDQMRVRGQADIYSVGECAQHRGNLYGLVAPLWEQAKVLADHITGRDAGAAYEGSKLYTKLKVAGIDVASMGLIAPESEDDEVIVYNEPRKGVHKQLIIRDDVLVGATLVGDNGKAQSLIQAFESGVRLPEERAELIFDIGGPAGEVPPAEMADDAQVCNCNGVSKGAICGVVAGGCATVSGVMDRTRAGKGCGTCKPLVQRIVEWANGGAAEEDPAASWYVPGVPMPKPELMAAIRGFGLKSVSSVFATLVPGGAEDAKSKMGLASLLKMMWGAEYVDERDARFINDRVHGNIQKDGTFSVVPQMKGGVTTPAELKRIAEVAEKYQVPMVKLTGGQRIDLLGIPKEQLPAIWADLDMPSGYAYAKSFRTVKTCVGSDFCRFGVGDSTALGIAIEERFQGLEGPGKMKLAVSGCPRNCAEAYVKDLGVVAIDGGRWEIYVGGAAGAHIRKGDLLTTVDSAAEVIRLTGRFLQYYRENANWLERTYAFVPRVGIDRIREIVVDDADGIAAALDAAVEEAVQSYKDPWKERAEPATPGQFRTSLPLIVLPQVPVRA

SEQ ID NO: 8536 - protein, 218 aa, Actinoplanes utahensis
MPTLIAVAHGTRSANGRRQLQDLAGAVARRRPGLDVRLCYVDVQEPKVADIVPITPNAVVVPLLLSAGYHVRVDIAEAVAGTSIPVTAPLGPDPLLLDAMMRHLPPAGAVVLAAAGSSDPAWRADVAQVATRLPGPARVGYVSGSGPRVPDVVAGLRAEGAERIAIAAYLLADGLFYRSLSGAGADAVTPPLCRDAAVADLVLGRFDSAVLTTAGRRL

SEQ ID NO: 8537 - protein, 366 aa, Actinoplanes utahensis
MTEGALAGFTVAVTAERRRGEMTALLERRGARVVSAPAITIVPLIDDDALRAATEACIGLEPHLVVATTGFGFRGWLEAAEGWGLAETLREALRAAKIIARGPKPCGAIRAAGLSEDWAAKTEASEEVLERLLHDGVAGRKIVVQEHGEPQTEFVNALRAAGAAVVEVPVYRWALPADTTPVRRLAEQVAAGQIDAVTFTSAPAVKAFLQIAGETGVDVPAAFRDGTLAACVGPVTAAPLVERDVPVVMPERFRLGALIKTVTDELPRRAVRLRVAGTTLEVRGHAVLIDGAVHALAPAAMAILASLARRPGAVVSKEQLAAALPRGNDGHAVDVAVARLRAALGSGRHIETVIKRGYRLRVDEAA

SEQ ID NO: 8538 - protein, 297 aa, Actinoplanes utahensis
MTVTDRDRTASRLLRSSAEHSYDPEIEIDWDAPFVEGKYFVPVHRSSLYGTALWDRLTEQQRIELTKHEVASIAGLGVWFETILMQLLVRGYYRQDPTSPHAQYALTEIGDECRHSIMFGKMIARLDTPVYRPDGINQFLGTWIAHTATGPRMFAAILIAEEILDTLQREAMADETVQPLVRMVSRIHVVEEARHVRFAREELARQIRLAGKSRLAFDRLVIARAAYLTGTRLIDPRVYRAVGIDPEEGRRVARANPYHRETMRWAGERIVGYLSDLDLIGGGPAKALWKASGLLPR

SEQ ID NO: 8539 - protein, 227 aa, Actinoplanes utahensis
MNSVTPPVNTDGRRGRWDSHREQRRAELTAAAIEAIRQHGPEVGMEAIAAHAGVSKPVLYRYFSDKSELWLAVGQQAGTMVLEAMIPAVASVREERAAIAAAIDVYLTHIEADLNLYRFVVHQPDIARHRDVVADVVDTVASGLARIFGDRLRARGLDSGASLPWAYGVVGYVQSVGDWWLRQQQPISREALGEYLTTFLWGGVAGISRAADMPGGLAAQAEGWLQA

SEQ ID NO: 8540 - protein, 485 aa, Actinoplanes utahensis
MNHFDMLIIGAGLSGIGAAWRLQDQRPGDTYAILEARDAIGGTWDLFRYPGVRSDSDMFTLSYPFRPWREPESLASGDKIRRYIEETAAEAGITRHIRFGRKVVSAKWSSAEARWTVRTAGGEVYTADFVYACAGYYSYAEGYQPDFAGLGDFRGRVVHPQFWPDDLDFHDRRVVVIGSGATAVTLVPAMAADAAHVTMLQRSPTYVIPQPNRDVVANAARRLLPPHAANRVARAKNVLVTQLFYQLAQRRPKLVRRVLRGVAGRYLRTPGYVDTHFNPRYDPWDQRLCVIPDGDLFRVIADGRASVVTDHVDAFVPEGIRLRSGTVLAADVVVSATGLSLLPVGGVQVSIDGTPVDIGQHAAYRGMMLSGVPNFAYCIGYVNASWTLRADLSHRYVLKLLDHMARHNLAVATPAEPGAAGRPLLDLSSGYVQRALDKFPRQGDRDPWLVRQNYLRDVVATPRADVTQDMRFTPRSAPVPASKVV

SEQ ID NO: 8541 - protein, 288 aa, Actinoplanes utahensis
MPRLDPYRFAGRTAVLTGAASGIGEQLAYGLAQRGSHLILADVDAARLDPVAARIRSAHPALSVETVVADLSDRSAVDAVAARVPAAIGLLINNAGVALGGRFDQVSVDQFEHVMNVNFRAPMLLTHALLPALTATPGGHLVNVSSLFGLIAPPGQSAYCASKFALRGLSESLRGELFENGVGVTTVHPGGIRTRIAESALIGEGVPESDIAPTRKLFAALLSFPAEKAAEQILRATEKRKARLLIAANAKGPDLLQRMLPVGSGTIIRALTAATVKTAGRAKAGATR

SEQ ID NO: 8542 - protein, 279 aa, Actinoplanes utahensis
MNYLDVRGSRIRFHETGDPAAPPVVLLHGIGRSLEDWSLQHPRFDSDYRVISIDMPGFGLSRRVPATTTLPVLADAVWATLDELGETRPVHLMGNSLGGAVSMTMLAGTPDRVTTLTLVNSAGFGKEVTWALRVMALPGLGRTMLRNIDKRTAPRVERTLFRDRALVTPERVEMAIRIAQQPDFAPVYLEVAKALGGLRGVAAPWRTALLASMAGLTTPTMIVWGDRDMILPSHHMAAARAAFPHAQSHMFPETGHMPQIERPDEFAALVRPMLAAVPA

SEQ ID NO: 8543 - protein, 266 aa, Actinoplanes utahensis
MRPHRSPLPLRRPDPLPPLAAAPLATSPSAARIPFLRLRPHRSPPPLPPPGSAPSACGRTARRFPFRLPSASAPDAPPTFHAGPPPAAVHLPVAITRRWSCGTRFTRLDGTMRRAILLFVALIGGLLAGCGSASPKAPAPALPAVTGTHPVGSVQDLQTADSSVRVKVAAAGAAADRYVVRVTVQVLRGTYEFNPVLLHLRDTTGADTGPVPGRSRPATAFTLHPGVTLSWRVPFPHPAAPDAQVVLTSRSGTALAAWNTRPAGTP

SEQ ID NO: 8544 - protein, 212 aa, Actinoplanes utahensis
MTTPQPQDLRLLEALHSTPARRYLSTEPIADDVIRDILDAAIRGPSGGNSQPWVWIVVRDADTKKQIADWYREGWERHYGSRREEILNAPDGGPMSKRSFLAADHLAAHLEEAPVWIIPAILGAAKSSNPRLGSSIYGAVQQLMLAARAHGLGSTLTTLHIGHEADVRDILGLPENALTMALIPLGYPSKGRWAQPKRRPLEEVVFFDRYQQ

SEQ ID NO: 8545 - protein, 417 aa, Actinoplanes utahensis
MSEQLLTTDQVAQRLGVKPATVYAYVSRGLLPSRRNAAGKGSLFAKADVDALLAGRKRATPNIQTGITLIRDGALFYRGRDATELARTSTYEAVATLLWTGPHDPEPGLDGGGALEPAPFAVSRASLALAERVGALLPATARLTDRLRVTVAAIAAADPFRFDTSPAAVVTTGRTLIATMVAALPLRSAREPVDILRSDPSAPTGAGGPGSIAELLWPRLTGEPMTEVGRRVLEAALILLADHDIAASTLAARVAASTRAHPYAVVSAGLAALDGPLHGAASEYVHPLLVEALAGADPVAIISERLRVSGGIPGFGHLLYQNGDPRAITILRLLGDHPARRAATALADAVQARSGIHPNIDLALATLTLHFGMPSDAGEAIFAIARTAGWLAHALEEYANHPVRFRPTGQYSGRPPA

SEQ ID NO: 8546 - protein, 394 aa, Actinoplanes utahensis
MLTASTLTAHPSSRHVESMLTVNPGLAGVVAFDTEIAEPDRDGGSLRYRGVDIRSLAGNVSYGDVWGLLADGDFTRALPPAEPSAVPVRSGDVRVDAQAAVSMLAPHLRLRQLIDIDDVQARDDLARTSSMILSYVAQAARGAHLPVIPQRLVDAGRSTTERFMIQWQGEPDPRQVAALDRYWICAAEHGMNASTFTARVVASTGADVPACLSAAISALSGPLHGGAPARVLGMIEQVERAGDARAYVRGVLDSGQRLMGFGHAVYRAEDPRARILRDAAFELGAPRFEVARDLELAALTELRERKPDRVLETNVEFWAAVILDFAGVPAELFTSLFACARTAGWSAHILEQKRLGKIIRPSADYVGPAHRPAEALAGWSDALHRNRLPGNVTA

SEQ ID NO: 8547 - protein, 282 aa, Actinoplanes utahensis
MSADTADLGQPVADFGNAKDFGQAAAGFGETVDFGRTAADYARHRAGFPPALMDRIDDVAGRTVLDLGTGTGSLARLFAARGAVVTGLDPAEPLLDQARRLDREAGLSIRYVVGAAECIHLPDATFDLVTAGQCWHWFRAGEAAAEVSRLLRPGGRIVIAHFDWLPLPGNVVAATEELIVAHNPAWALAGGTGIHPRWLTDLRSAGFTGLETFSFDVDVPYSPVDWTGRIRASAGVAASLPPPAVERFSAELTALLERDFPADPLLVPHRVWAVVARKPDDR

SEQ ID NO: 8548 - protein, 644 aa, Actinoplanes utahensis
MLLAERPGRGAARTVTPAERAQARSVSLRRIGALFIGHRRQLAVVVAIIVVSSVLGMATPFLLRQIIDVALPHGDLHLLSWLVLGMIVVAAITSVLGVLQTWISTTVGQRVMHRLRVDVFAHLQQQSIAFFTRTRTGEVQSRITNDIGGMQTVVTSTATSIAANLTTVVATTVAMVALTWQLTLISLLVLPPAIYLTRRVARMRRQITAERQRELAELNVIIEEGLSISGIQLSKTMGAGAAQVERFTGSSGRLIDLELRSELAGRWRMAAMSVIFAIIPATIYLAAGLPFAAGGMSIGTLVAFTALQGNLFRPLMSLLDVSVTMTSSLALFARIFEYLDLPVEIASPASPIRLPEVRGHLRFENVSFAYDTDASTATDVNRDAPVGVSGGTGVDRDVPVGIKPDGPAGRSARSEVKQDALGGRAALADVNLDVPAGTSLALVGETGSGKSTAAALIARLHDPTAGRVTIDGVDLRDLDLADLSTIVGVVSQETYLLHTTIRANLRYAKPTATDAEIEAACRAAQIHALIESLPEGYDTLVGSRGHRFSGGEKQRIAIARTLLRDPKILVLDEATSALDNETERAVQRAFDELSRGRTTVTIAHRLSTVRDADQIVLIDHGRIVESGTHDSLLSEGGRYAALAS

SEQ ID NO: 8549 - protein, 134 aa, Actinoplanes utahensis
MEEESLNDAFWAVSRRLREQARSEMEPWGVAPSQFRALSVLLAHGDMRLSALAERLRIAPRSATEVVDDLQERGLAERRPDPDDRRATLVTLTDLGRTTGAEIKAARSAAGQRVFAALTPDDQAQLARILRQLT

SEQ ID NO: 8550 - protein, 281 aa, Actinoplanes utahensis
MRTEPLLSQADDLLDRGRAENAAHLLAPIVGRQPENVDAWHRMARAHLEMGDLDGGLRAAKAAWHFDPHGPETLYWLSRAATELGRHREAIEAAAAACREDPGNPRLHNRLADAQLAAGHVGDALDNLKIAVELADYDADLHVTFGRALFAAGRPLSARESVGRALALEPGHAAAHRTLALFEIAMEPVVDAASLAQAADGFAESLRVGPTGRVDERAVLAKDAIGYVARVALTWCLVALLVLGVLAATSLVTLPAGLYLTILCLGAVAGCGAIAFRRSLL

SEQ ID NO: 8551 - protein, 167 aa, Actinoplanes utahensis
MEDTRAPDEADKAERQRLRSRLVDLLNSYSSEANHIGHAFAGRHRLHGPDLHALLAVMHAERAGEPLTPGRLGETMGLSSGATTAMIDRLERGGHLRRSRESSDRRVVHLRYAEAGMALAAAFFQPLAPRTDAVMARFDTEELQVVERFVRGMVEALLAYRDELRAE

SEQ ID NO: 8552 - protein, 651 aa, Actinoplanes utahensis
MRRAWVSLLLALLLGGLVIGLAGETRVDNDPTASLPSSAESTRVARAQAGRPTAALVVVARGGQPLADGDLVTVTPLGQPIVSQDRRAAIVSVPLPSGVSSDETIKQVRDLRTRVRAGLPAGVTAQVTGGAGFSADLADSFTGANTRLLLVTVVVVALLLLVTYRSPLLWLVPLIVVGLADRVTTGLISLISQHTSLPINGSTTGIVTVLVFGAGTDYALLLISRYREELHAVDDRFEAMRRALRGAGPAIAASAGTVILSLLTLLLASLESNVSLGVTAAAGIAVAALFALLVLPAALVVCGRGLFWPFVPRVGQDGVEAEKGVWARVGRAVSRKPVAVTIVSIIVLGVLSAGGLGTRLGLSQTEQFRVKSESVAGLETLSTHFPAGAASPTVVLTGPDQAQAVLATVSGTPGVAQARVVEQGSIQVILNAAPDTKEAFDAIRTLRTSLAGRALVGGSVATSLDTRDATRHDLRVIVPVILLVVLLVLVVLLRALVAPLLLIVTVIISFGAALGAGSFLFGHALDNQVPLFSFLFLVALGVDYNIFLVTRAREEAGKRGTRDGMVHAVAVTGAVITSAGILLAAVFAVLGVLPVITLTQIGVIVMIGVLLDTLLVRTVLVPALATILGDRFWWPGRPHSAAPNAPELISA

SEQ ID NO: 8553 - protein, 390 aa, Actinoplanes utahensis
MGFLDKLPGMDFHWFLPTNGDSRDIVGGGHGTPVGSAGGVRPLTIGYLGQIARSAEQLGFVGALTPTGAWCEDAWLTTAMLTEVTERLKFLVAFRPGLISPTLAAQMSSTFQRLSGGRLLLNVVTGGESAEQRQFGDFLDKDARYARTAEFLTVVRGLLRGETISYDGTHVKVENARLARVPDIAPTVYFGGSSKAAGPVAAEHADVYLTWGEPPAQVAEKLAWIRTLKPDMRFGIRLHVITRDTAEAAWAEADRLLQNVSEADIAGVQAGLRTSESEGQRRMLELHGGNRDGLLVAPNLWAGVGLVRGGAGTALVGSHTEVADRIEEYAALGISEFILSGYPHLEEAYWFGEGVLPELRRRGLWRHPAGEKDTAPAAIPFAGVPSLAKR

SEQ ID NO: 8554 - protein, 78 aa, Actinoplanes utahensis
MERAASGYQTVRHDFTTWRYEMAFDDKVDNKAEELGGKVKEGVGKATDDEQLEAEGHADQASANIKQAGEKIKDVFKS

SEQ ID NO: 8555 - protein, 361 aa, Actinoplanes utahensis
MPSRKAPARTFINKAGSVPEKIAKGGKPTSSDVAAAAGVSRSAVSFAFNNPQRISTATRERILAVAEELGYTPSTLGRMLQAGTTNSIGVLLPQRLAQVMENPYFARFLMGAGQVCDREGYTLLLTPPLQDSVLKAIPYAAVDGFIVCGLEIDRGEVAELDRRGIPFVLIDSDRHEGAPHVEVDDRGGAREVARHLLELGHRRIAVLSLGPRSADGHRGPLARRLAGITDALAEVGLTLADVQLAEVPVTRGDGYRATKALMSDAKPTAILALSDVLAYGAVDALQELGVDVPGQVSVTGFDDLAESAWFRPRLTTVRQPIVTKGRMAAEFLVSAMRGEDQHPQQTLGTSLIVRNSTAKPA

SEQ ID NO: 8556 - protein, 582 aa, Actinoplanes utahensis
MQELAERKQPSGYVTRVSCLLPFLAMTDQLIAPPTVEAPPASWWRNAVIYQIYPRSFADSNGDGIGDLPGISSRLPYLKDLGVDAVWLSPFYASPQADAGYDVSDYRTVDPIFGTVADASELIAGAHALGLRVIVDLVPNHSSDQHEWFQKAIAEGPGSLFRERYHFRPGKGENGELPPNDWPSIFGGPAWTRVADGEWYLHLFAPEQPDFNWEHPAVRDEFKTILRFWLDLGVDGFRIDVAHGLVKEAGLPDVGSHAEWHLLGVGESPCFDRDGVHEIYRSWRRILDEYPGDRVAVAEAWAPTLARVADYVRDDELHQAFNFSYLGTAWNVHEQQQMIEDSLAAMRAVGAPTTWTLSNHDVVRHTTRLMQTADGEVAGRKAVAVDEAAGLRRARAASALMLALPGSAYLYQGEELGLPEVLDLPPEVRQDPAFHRATGQDGYRDGCRVPIPWSGDTAPYGFGPDGGGSWLPQPASWAGLSVSAQAGTPGSTLELYRAALAERRVNPALQPIDNLRWLSAPAGVLAFERSVEGAPVFRCTVNMGDQPVTVARPGTPLLASGPIELGPDEVELPPDTTVWWSV

SEQ ID NO: 8557 - protein, 797 aa, Actinoplanes utahensis
MPDMRPVGRPARTAGRILLLACVWAGLSIVLGIAGMLSDHPPAWLLWPTGIAAAATAAWAAHTAAAGTEGDAHRFWRRLTISACVLTLGTVSHAIRTTLAGHPMPMNTLSAVCYLGSVAGTAYAMIRLPHPPRTWRANLAICLDIAIVGVASAVVITHFLWSMPVPGGPPTGGPMPAGDMPPGPMPQLGLAAGLMLIVLVTAITAVVAVIRVGITGAGGVHGPALWYLAPLGLLAPISWLIYPAVRDWPHLSVTAIVMPPLGLMFALATRAQLRHVDHPPVRRVGPPWVQRWRRVSVVPVAAVVVTVGMLVFVTLHLGFLPPGLAGGSVALTTLVVIRQLTALSDNTVLVDRLEEQANHDDLTGLPNRRMFSATLQDRTDPVTVAVCDLDGFGTLNDRLGDARGDALLRAAAARITATFGPDAVVARLLGDEFGILLPTGAVLPATGLPGSGPPAPLASTTGLPGSGSLGERLVRAFRLPLQVDGHDLLVTVTVGVAAGRDDEVPDLLRRAELALKAAKRAGANRHTEHTDEMDSTAQHDADLAAALRRGLDRGEFRLVYQPIVELPGGRITGVEALVRWHPADGPPVSPAEFIPVAEQTGLILDLGLWVIETACADAARWQLRHGVDAPRVNINVSARQLLDPDLPDQVAATMARYHLDPDKITLEITETAVFGGGAALNTVRDLRDLGVGVALDDFGTGQSSLTLLRTCPVTTLKVDKSFIDELNGTAEQEAIATSLSTIAATLGLRAVAEGVETREQAIRLEALGYRYAQGYYFAKPGPAALIDAALDHTPATI

SEQ ID NO: 8558 - protein, 269 aa, Actinoplanes utahensis
MPSADIGLAAGSTAAVSGAGAAAVRLDAVTHAYGDVTAVGPVDLTVPAGEFLVLVGASGCGKSTLLRLIAGFEQPTSGTVRTAGSPPVPGRGAGLVFQQPRLFPWKTVGGNIALALRYAGQPATGGRIDELLERVGLHDVANRRTWQISGGQQQRVAIARALAVDNPLLLLDEPFAALDALTRERLQADLRKVSAESGRTCVFVTHSVDEAVFLGSRVVVLTPRPGQIALDLPIALPRTGVAADELRGSPEFAALRAEVGHAIRDRATV

SEQ ID NO: 8559 - protein, 343 aa, Actinoplanes utahensis
MKRLLAAASALSLLLVAACGSGGAASGGGDASKKAIRIAYQAFPSGDLIVKNQGLLEKALPDYKITWTKFDSGASINTAFVAKSVDIAAIGSSPVARGLSAPLNIPYQVAFVLDVAGDNEALVARNGTGITDVAGLRGRKVATPFASTSHYSLLAALDQAGVKESEVTIVDLEPQDIQAAWTRGDLDAAYTWLPSLDEIKKTGKVLISSRQLATAGKPTLDLGVVSTPFAGAHPEAVDAWRKVEAQALNTIATDPAAAAKAVGAELNLSADDAAHQLQQGVFLKPADISSPDWLGTDGKVGKIADNLVSAAEFLKSQQKIDAVPSLDAAQKAIYVKGLPSALG

SEQ ID NO: 8560 - protein, 282 aa, Actinoplanes utahensis
MTTLLAPAGATAPVATTALAPGGGLRRRLVLRLVALVALGLLWEIAARVLNNPAFIPSPGAVWHQLILTSTVHDGVRGYSGHLLIEHLGVSLRRIVIGSAIGIAGGLLIGVLLGTVGWLRVIAEPVVTFVRALPPLAYFSLFIIWFGIDETPKLWLLSIAALPPVAVATAAAVHGAPAGLIEAARALGAGRWQSIRDVVLPSALPEIFTGIRLAVGVAYSSVVAAETINGVPGIGGMIRDAQRYSQTDVVVLGLFAIGLSGLLIDALLRVAEQRLIPWRGIS

SEQ ID NO: 8561 - protein, 303 aa, Actinoplanes utahensis
MSVLSPPRPTAQAGDDTRVVPARHPWRWAGAALVLVLLAQFVHGLATNPGWEWHTFTGYIFEKSVLHALLVTLELTIAGAALGFLGGIPLAAMRLSPSPILRTVSWTYTWVFRSVPLIVQLLFWANLGYLYEKLQFGLPFGPGWSFATKDLIGSFGAALLGLALHEAAFAGEIIRSGLLSVDQGQHEAAAALGLPRHRQFFRIVLPQAMRAILPNAANLLVDLLKSTSIVYVLAIGELFYQVQVVYGRNGRVVPLLMVATVWYVVLTALLSILQFYVERYFARGAVRTLPPTPFQRLKAAIKR

SEQ ID NO: 8562 - protein, 255 aa, Actinoplanes utahensis
MSTPVVELTGVHKSFGTLEVLRGIDLTAQAGTVTVILGPSGSGKSTLLRSINHLEKVDRGRVRVDGELIGYREAGEKLHELGERQILKQRARIGFVFQNFNLFPHLTALENVAEAPISALKKNRASTYAQARALLDRVGLADKADVYPRQLSGGQQQRVAIARALALEPRLILFDEPTSALDPELVGEVLDVLRDLAAAGTTMIVVTHEIGFAREAADTVIFIDEGRIVEQGPPAEVLDNPRHERTKAFLSAVLV

SEQ ID NO: 8563 - protein, 325 aa, Actinoplanes utahensis
MRTRVAIVFAAVAALGLTACAAPDESPAAAAAAPGASAGPGINISPDQNRIVPAKDDAIAALVPADIRATGKLTIGVGAAGSGSPPLAFTATDNKTLIGNEPDIAYAVAGVLGLQPEIENTSWENLFIGLDSAKYNVGISNITVTEERKEKYDFATYRLDNLAFAAKKGSGWKIAGPADVAGKTIAVSSGTNQEKILVEWSKEAEKQGLKPVNIKYYQTNQATYLALGSGQIDAYLGPNPSVAYQVAVDGKLEIVGTYSGAGATLQGKIALTTKKDDGLVKALGAAVNKLIETGDYTRILQRWNLTNEAVDKSEINPQGLPKANK

SEQ ID NO: 8564 - protein, 232 aa, Actinoplanes utahensis
MTSAVTDDRVLDNPAWLALHGDHARFAQVHGLAARYHSDVAPFHALGAPEDPRAWSDLNAFVPPGEPVMLAGLGARPGPGWEIDRSIDGVQLVDVSLRAEPDPNLVVLTPDDVPEILDLIARTQPGPYLRRTIELGTYLGFRDEGRLVAMAGERLRPPGWTEISAVCTDAAYRGRGLATRLVRAVAAGIRARGATPFLHTGAANTTAIRLYEAIGFQLRRTVDFTAYRRAGS

SEQ ID NO: 8565 - protein, 281 aa, Actinoplanes utahensis
MSTPRPADDALLQRFRDARTAEELLTALNWYRTERNRSQRQVAEKAVGTPGLSKTRVNDLLTGRYSSIDGQLLRPLAQACGVDREELLEALDEAWRRIVQNAARERSHRANQRPAPPPRPSPDAHLRTLSVMAEIAGRMTDPDTLPLAQEIYERVLEQRRLLLGEDDPLTLTTQHNLGVVHFARDNLRAAYNALKIAYEARLATLGESAMATLTSQESLAVVCSEMGETFRAEQLLAECLAHRQEWLAQAPTEAERARLRVAAQKTADNLRAVRSQLGGTR

SEQ ID NO: 8566 - protein, 73 aa, Actinoplanes utahensis
MGDTSPRHTVWRRSARCGTGNCVEVATVGDTVLIRDSKDPSAGSITCTAGQWAGFLSAIRSGVFGPAGDRPLS

SEQ ID NO: 8567 - protein, 94 aa, Actinoplanes utahensis
MRPAPSLGQAPVRPSEPPADPASPIRLAVYAICTGAIALGSGRAFGSTFFTSTSARAAALAVIALPVSVAAGLACDPVLRRWQQFIDGRRGPEA

SEQ ID NO: 8568 - protein, 101 aa, Actinoplanes utahensis
MTEIDRELHIDPRAPRGRRRGGGLVGVLHAALDLATGIVTKPENFVRALLLVWSLVLIGALLLRDVQMLSVAVAAMVVLSTWAAARLMRARVRPRDRDDHR

SEQ ID NO: 8569 - protein, 296 aa, Actinoplanes utahensis
MGVGERRAAALERKRLTRRLYRIRLERGLTQAQVAERMRWSQSKVHRIETGENSISYADLKVLLGVYEVDDQLAEELTAMADAARQRSLPEMSDIHSKDFRDFLESELIADREYEFENSFVPGLLQTREYAETVVRKLLYADSCAESEREAVLEQVRRIVSLREMRQQVFAEGGISQARFVLDEAVLRRVVGGGAVMRQQLEHLRKMSRHPRVDLRVLPFSTGAHVAMAGPFVILEFPDAEDRPLLYLENAAGEFLTKHDERLLARFAANFEELRAAAHGADRLDALLDGALAALG

SEQ ID NO: 8570 - protein, 464 aa, Actinoplanes utahensis
MEAGEGGRQVVVAEHRGGADGDPAGDHRGDLAHLEAGAVQLGEDAAGPGDEHLAGRSERDPPGGTGEQGHAELGLQGPDLCGDRRLGDVQTFRRPGEPAVPGHRLHVAELSKLHPFIVAHDECHRERVLDISIVGYQSGVMPTAKLGTLTCSAIGLGCMGFSQAYGPADDDSSILTIRAALEHGVTLLDTAMSYGAGHNERLVGRAVAGRRDRVLLATKFGIVRGDDGVRLDAHPDRVAGYCEASLRRLGTDVIDLYYLHRADPRVPIADTVGAMAELVAAGKVRHLGLSEVGPERFAAARAVHPIAAVQTEWSLAWREPEDDIVPAARAGGAGLVAYSPLGRGLLTGALPAGPFAPGDFRAGDPRFAGPELKGNRTLVEALREVARSYDVTVGQLALAWLHAQGDDVVPIPGTRDPARVAENAAAARLTLTPADLATLESVAPRTAWRGDRRSFAAHGTTRTR

SEQ ID NO: 8571 - protein, 324 aa, Actinoplanes utahensis
MVTTYPYTASEEGAVWYGIWPGVVAADLVDLTPLATPPEDVARTSVALDRLQGGAASFYIRCYRHYRGAAASEPGGDPAPADPGRYTGRGRLIDLVACYRATAPDPAGYAEFVRRAVRDVAGWGGGKVQVGEELNVPAPLDGGFPGCFEAVAAGVAAGLDERDRLGAAVAIGVNGAGVADPAFWARMTGALGPVSTARLDFVGLDMFPDVFRPIPEDDIGAGVRFLVRTLRRVTRDAGISGRTPLHVTETGWPTGRARDEAKQARVLRAVAEAVLATGEVSVYELFSLRDGISDGGWQNGFGLLRDDYRPKPAYDVVRRLIATS

SEQ ID NO: 8572 - protein, 187 aa, Actinoplanes utahensis
MDRVPTNALANPLVLPILGLLAERPRHAYALFSELRSRYTYLGVRNSTVYTLLNTLVDAGWLRPTPVGTDRQEFRLTPAGRQALAERVEREIRDGALGDRTAFLTALAYLGILTPDAAAATLEIRAGRVHHEQERLAHALDAATGVPELHMIEIHFYRDQLQREHAWLDATARRTRSGALAWPGQES

SEQ ID NO: 8573 - protein, 290 aa, Actinoplanes utahensis
MSVSETRWWQSGRRAGWWAHLVRAGKRYDEADGGRLAAAVTYYSFFATFSLGLLGFAIFGFVLDDQAVLHAAQRYAAQNLPHVDVQSFRDARNTVGVIAFIGLPVSGWFWVDVLRSSIRRMWRLPEYPGRLVVRILVDMLVLAGLGVLLSGSLAIAYETSVIVNRVIVAAGAGTTPSRVVVSAVGLLSGLTVNALLATALLTGLPRIRMPWRRVLGPAVLVAAGFEFLTTLGRVYVERTQTNPTYHLVAGSVGLLVFLNAVNQLVLFAAALTATSETGHAGDLAAEPQLS

SEQ ID NO: 8574 - protein, 138 aa, Actinoplanes utahensis
MVVTRKGDYYPLVTKEARLMTAVCPTGEHDKHDVFAELCPCRGLLDLIANKWTTLAVGALEGGPLRFGVLQRHLEGISPKVLTQTLRRMEDAGLLTRTVYPAVPLHVEYELTAVGRSLVTPLRGLRDWAERYLHELQL

SEQ ID NO: 8575 - protein, 313 aa, Actinoplanes utahensis
MRVVTQHEFGDPSVLHLAEAPKPRPLPTEVLVRVVAAGVNPVDHKTREGAGMAGVLGAPPFILGWDVSGVVEETGFGVHTLRPGDEVYGMPWFPRQAGAYAEYVTAPSRQFARKPANLSHVEAAGVPLAALTAWQALTDATTVTAGQRVLIHAAAGGVGHFAVQFARHLGAHVIGTARAARHDWLRELGADEVIDYTTTRFEDAVKEADLVLDLVGDEDTGLRSVTALAPGGLLIAVPGGVAPAVARAAAEQGKRAVPFLVEPDGAALGAIAGLIEAGHVRVEVAGVLPLAEAGEAHRRLATGRTRGKLVLEV

SEQ ID NO: 8576 - protein, 371 aa, Actinoplanes utahensis
MPVPLSILDLAPLVSGGDVGDALRRTLDLARSAEQFGYHRYWVAEHHFTPGVASAQPALLLGQIAAVTSRIRLGSGAVQTGHQTALSIVEQFGLLDALYPGRFDLGLGRSGQAKKEALAGSAEETAEEVTVVDGLLIPKPFSWAPIFASERSALIGRLLQQPGAEPLGLGEILDQITGLLAGPYGDGKGAEVTAVPGAGADVQLWLLGSSGGESARTAGARGLPFVANYHVAPAKVLEAAAAYRAAFRPSAALAEPYLVVSADVVVAEDDETARRLAAPYPLWVRSIRTGAGAIPFPSPAEAAAFEWTDHDRKLVEDRVATQFVGSPATVAGRLDTLRRVTGADELLVTTITHDHADRVRSFELLAKEWAG

SEQ ID NO: 8577 - protein, 337 aa, Actinoplanes utahensis
MKFLLLSLITHFDREKSPAQRLREVVDAAVLGEQLGYDGFAVGERHERPFLSSSPPVVLSHIAAKTSTIELWTGVTTLSLLDPVRAFEDYSTLDNLSGGRLQLIVGKGNGAAQAQLFHVTVDDQWERQRESYELFRRLWREPKVTWEGRFRPSLTDAETWPRPLQQPITVWHGSATSRASVELAARYGDPLFSANVTNPVDPYAQLIDFYRERWAFHGHDPAKIRIGAGSAGFYVTRTSQEALDVYRPIWQARIDQFRKVGVEPVFPTIEDAIERSSALIGSPQQIIDKVHRYHERFGHEVTHLAADTEGLTEKQQRASLELFASEVAPVLRQLKGW

SEQ ID NO: 8578 - protein, 422 aa, Actinoplanes utahensis
MPKQIILAAHFPGVNNTTVWSDPRSGSQIDFASFEHLARTAERGRFDFFFLAEGLRLREQRGLIHDLDVVGRPDTLTVLTALAAVTEHLGLAGTLNATFHEPYELARQLATLDHLSGGRAAWNVVTSHGAFYGENFRRGGFLDHADRYVRAGEFIEAARTLWDSDGGDFAIHSSQFGIEGRFGVPRSPQGHPVILQAGDSDEGRELAARHADAIFSRHHKLDDARQFYRDVKDRLGRYGRERDSLKIIPGVSYVLGDTDADAQEKAHHIRRQQVSPQTAILLLEQLWNRDLSAYDPEGPLPTADPVLDEDDSIVKGRAGMFPDRIKTANEWRALAEAKKLSIRDLVIEVTGRQNFIGTADRIATELNEYVQTEACDGFILVSHLTPGGLDDFVDQVVPLLQERGVFRTEYETTTLRGHLGLA

SEQ ID NO: 8579 - protein, 309 aa, Actinoplanes utahensis
MTLHVAVGLDGDSFAASDWVAAARQADEARLDFATFEDRFGRRGPDAVLVAARVAPVTRHLGLVPVATTTHTEPFHLSTALATLDHVSRGRAGWQVRVSSDPAEAALLGRRAPLGFDDLFAEAADAITVVRRLWDSWEDDAIIKDVATGRFIDREKLHYLDFTGAYFSVKGPSIVPRPPQGQPVIAALTHTAQVAERLDVDVYFVTPQTLDEAAGIVTRLPGKLVFADLEVTADAGPAELAGRIAAWEPAGIAGVRLLPATPDALTRITRDLVPELRDRGIFTPSTATTLRERLGLPQAVNHFQEAARA

SEQ ID NO: 8580 - protein, 510 aa, Actinoplanes utahensis
MINVEDLTVTFHLPRRTVEAVRGVSFDIEAGECVAIVGESGSGKSVTARSLLGLAGPGARVQAARLEVDGRDARRFAPRDWRRLRGGFAGLVLQDALVSLDPLRTVGAEIAEVLRVHGQGSRAGRTSQAHRLLRDVHVPEPERRATQYPHQLSGGLRQRALIATALAGGPKLLIADEPTTALDATVQAQILTLLAERRAAGETLLLISHDLAVVSRLADRVLVMKDGRIVESGPTRRLLTGADHAYTRQLIAAASGRKRTADTAPGPVVAEARALRKVYGDRAVVRDVDVTIARGEIVGLVGESGSGKTTVAQLLFGLVEPTSGQVRFEGSRFSGVPERARRPLRRRLQFIAQDPLSAFDPRWTVRRIVAEALPRGADVVPVLERVGLGADVLDRYPRQLSGGQRQRVAIARAIAPRPSLIICDEPVSALDVSVQAQVLDLLADIRETDGTALLFISHDLGVIRDLADRVLVMRDGRVVEQGPVKTVFDQPTDDYTRQLLAAVPTLEVLP

SEQ ID NO: 8581 - protein, 284 aa, Actinoplanes utahensis
MTVALTRPRAVRPAGLRAPRPGVALAVVFLLLALTAAVAPALFAGDPLAADPLHTLQAPSGRHWFGTDQLGRDVFARVVHGARHSLSIGVTATLIAVGAGILLGLLAGLSHRVADEALSRSFDALSAFPLVLLALLFITIAGTGTASLIVAIGVSLIPHFARVVRAQTFVVRRAAYVTHAVAFGASRPRLVIRHVLPNVLGPIPVLAVIGLGETVLLAAGLSFLGMGPQPPSPEWGAMISDGRGYLHIAWWASILPGLVVTATIVSLTVVGRFLQRRFEGRETA

SEQ ID NO: 8582 - protein, 304 aa, Actinoplanes utahensis
MIIGILRRVAAGALVLWAAATAAYLALLLAPGSAVDAIIGDGADTPAIRAQIIQEWHLDSPAVVQYLDFLGRLLHGDLGRSYLLQRPVADVIGSELGPTLQLAAAAAGFGITLALVLALVARRPWVRRLSSTTELVLVSTPPFLIGIVLLSVFSFRLGWFPVSGARDAAALVLPAITMGLPIAGTLAQVLRDGLDRALDEPFAVTARARGLRESAVLVRHALKHALLPAITMLSWSFGVLIAGTVIIETVFGRPGIGQITVNAVNSSDLPVVLAVVILSAAVFVAINTLTDLAYLLIDPRLRRS

SEQ ID NO: 8583 - protein, 541 aa, Actinoplanes utahensis
MRRMTIATVTTLLLLAGCSSGTSGSTADAGKPVSGGALTWAVETEPITFNPHQYAQAKARLLVWNSFEALLTHDDKGGYLPWLATGYEVSPDGRTYTFKLRTDASFSDGTKFDAAAVKANIDQLLTPGYAPGVAAVQLRNLDKVEVKDPATVVFQLKRPDVLILDFVSSPQGAQISPQSLKAAKNLKAGGPELAGTGPFVLDRYTPGQEVHFTKNPNYNWAPANAGHTGPAYLNEITYRFLKESSVRVGALTSGQAQVIEGVPATDESLIKANPDLRLQRGLNSGSAYAYYFNTAHAPFDDVRVRQAFREALDVPAVLGGVYRNTATRAWSVIGPTSPFYDRSLEGAYGGDAAKANQLLDQAGWSARDAEGYRVKDGKRLTVRIVQSAPFVRDRRDVLAQAVQAAVKQSAGIDLQVQLVDQGTATKALADGAYEVFDNSRADTDAGAALNLLLYSTGAINRTGFKSPELDRLLDDGIATTDPAKRAQAYRALQKLVITDQALVLPLYAPQDQIATAGTVGGAHFEPTAGVPGSAYNLWLRK

SEQ ID NO: 8584 - protein, 587 aa, Actinoplanes utahensis
MNHPRRQAVSSDVQSNDLADEQPPAAPEASRLRRLLRRSAGLRQFLRRPAISHGVTVLACLIVFVELLFPNILNRLNPGSFLRIPIEAAIGIAVLVVLPGRPRRIAAVLAGAGLGWVVIEKCLDIGFFQVLNRPFDPVLDWVLFDDAYDFVVSTYGTGGAIGAVAALIALIAVILGGTTWAVLRITRLLGQDRRKSAFTAGFIAVAWGLAVAFGIPTLLPGVPVAARTTVMYAWDRAGQARAGIRNEAAFSREVQVDAFKNVPSDQLLTGLAGKDVMLTFVESYGRNAVEVPPLSDGVDPVLDTATAKLKAAGFTSRSGWLTSPTFGGGSWLAHSTTMSGLWIDNQRRYRNLTASNRITLPNLFRQAGWDTVSVMPGATRAWPEGNFYGFNRIWDSRNLGYNGPRFSWAPMPDQYTLKKFNEVEYAKPGRQPLFVEMPLVSSHTPWAPIPSFVDWDQVGDGSIYNAIVANQPSKAEIWKASDTVRQEYGKSIQYTVTTLTDWVAKYGKDNLVMIYLGDHQPSPVVTGDNASHDVPITIIAKDPAVIDRIAGWGWTDGVKPAANAPVWPMNAFRDKFLTAMGPGGASH

SEQ ID NO: 8585 - protein, 632 aa, Actinoplanes utahensis
MRPDAEQRQIMADYRQTYERSITDPEAFWRAAAAGITWSVAPTRILDDSEAPIFRWFPDAELNTCHNALDRHVEAGHGDRTALIYDSPVTGTVRTYSYAGLRAEVALFAGALRRLGVERGDRVVIYMATVPETVIAMLACARLGAVHSVVFGGFGAGELAARIDDARPKVIVATSCGIEAGRVVPYQPMLDAALRAASHQPGRCVWLQRPEQPAPLLEERDLTWAEAVADAVPAECVPVRATDPLYILYTSGTTGRPKGVVRDNGGHAVALHWSMEHIFDVRPGEVFWAASDVGWVVGHSYIVYAPLLAGAATVLYEGKPVGTPDAGAFWRVAAEHRVVCLFTAPTAVRAIRKEDPDGKHLSGYDLGALRLLFLAGERLDPQTYRWAGDLLGVPVVDNWWQTETGWPIAASPRGIEALPTRPGSPSLPMPGYRVRVVDASGNDLPPGAEGAIVIGLPLPPGCLPTLWQDDERYVRSYLSAFQGNFSTGDGGRFDEDGYLYVLGRTDDVINVAGHRLSTGAMEEVLAGHPAVAECAVIGVHDPVRGQVPRAFVVLKSGASADGVAAELIALVRGRIGPVAALRRVDVVAALPKTRSGKILRGTMRGIADGAEPAVPSTIEDPAVLDALRPLLR

SEQ ID NO: 8586 - protein, 361 aa, Actinoplanes utahensis
MDGYQATLSPRWRRALLLVAAGLLAPALWLPAAGGPVGRATAIALAAAQIVALRRLDRAPRLATAGILVAGTALSFVIPGLGPGLAFVVLSTYAWARPAPESLWALTGTIVAVGTPAAAQGRWPLVAGWIGASLLAWSWGALGRARSARHEAERRRAVLEERGRIARELHDVLSHTVSVMVVQAAAADDVFDLNPAQARAAIRRTEAAGREALAELRTFLRTVRDGDAEPHDAPPQPSLAGVERLVSTMGTGGLTVALRREGDGEPPAGVQLCAYRIVQEALTNTVRHAGATEAGVLIRIGPAEVEVEVSDNGSATGPVTAGNGIRGMRERAVLTGGTLTAAPRPGGGFLVTARLPWQATA

SEQ ID NO: 8587 - protein, 220 aa, Actinoplanes utahensis
MTVRVLIVDDQALVRVGFRMIIEARDDLQVVGEAGDGEQALRLAAQTRPDVVLMDVRMPGMDGLAATARLTALPDAPRVIMLTTYDLDESLYAALRAGASGFLLKDVRPGDLAEAIRVVARGEALLAPTATRRLLDRFVAADMTPPGADVRLDRLTAREREVLELLGRGASNAEIATRLTVTEATVKTHVSAVLRKLDVRDRVQAVVLAYDLGVVRPRSS

SEQ ID NO: 8588 - protein, 357 aa, Actinoplanes utahensis
MTKKTVAALLLTGLAISLLGAVLTLLLHAPILGYQRAHQPHADPAALSRTLWTRPLTVFVVAILYARFVRQLLRGDPRALRRVRIVSAAGLAGVCWLLVSAAYPAWLRAIQIGQLVVLAALVITVNLRTVRSAFDAPVPPDPRPRNGRAAWTLILLTPVVAELTMGNVALRDLIYFPIFIPIYGAGALLIRETTRRLGGGTAGLLLLGLAYGILEEGLALQGLTSPHLYHAADWAPRLLGLNTAYAELNLIYHPVFSVLIPITLTEHLFRTHGDRPYLRRGGLISTAVVAALGAGLLRIAVPPTMDPGYQVPLLPAVLFLTVAALLAAAAYGVRRKPARRGPAPAAAAAPAPVPAAA

SEQ ID NO: 8589 - protein, 122 aa, Actinoplanes utahensis
MIAGWTGAAALGFLALIFPFAGARQPFFTHGTWVLLPMAGAAVIVLLIARALRRWRAAPTWTAAHRLAACFGALTGHTVFGLIANADTLQDRLFLGALAALTVTLGARAIRPAPGIPAGAAG

SEQ ID NO: 8590 - protein, 44 aa, Actinoplanes utahensis
MGKTEDRDKMYELGARLFTIHTGGPTPDLTELREFLTWRDQRNA

SEQ ID NO: 8591 - protein, 145 aa, Actinoplanes utahensis
MGVVGADCLGDLLPGELLANERRGADDDSHRRSAGVDTVLVENGVALLVQATKVVHGLDDSLVDWFTDDGSAPMSNDKFRDARAFDLDTMKGAVAADKWDVELIAQRQRSPSGDTHEFASEHPGVLLKDALNGWLSGAGIEDKTS

SEQ ID NO: 8592 - protein, 1282 aa, Actinoplanes utahensis
MRDALIADLVTRVRHFHTTGSPEPLLSDGGLDAAAELLRLATHEITGREDVDADALHAVAAYQWTRGLVWQSTTATHDRPGEDPEGRAEVEFAGALATYELLFMVDHRRVPRDLWPYLIRETGHDPWQDPLDRAKDLLVDAKEASDPAAVATVIEQLQNLDEPSDAGFRDSLLGDAHLVRFDIVRDSIDLTNAVSAYRAALDRFDAGSASYTHACQGLGAALGRQGQLALHFGEQASVLLTEAVGWLRRAADGDTSVLPYLQRVMALRIEEKVRAGSVPVEEHPLAADGEERRQAVALLQLADHVRTRVLSHQEATRHAADPSFPLSATAIDLAVHTSVANVEVARLAMDAAEHRWGATRDSPWWTAADAYVEAVRHSLLDDPDADRLAAAHAVATRQLTMLVDEPAERAGTLFAAGLLYLTPYLGTMSGLTFDGAHQLWLARHQRRLTAHPEGDPTPLPPPDVAADRAVEYLRQAADLAVGHDRGRILKALVEAYSFRAGMRQESADDEALAGCRTAFDLLDPTRDQLSFLYVLRVLYRFGEIALPPDLNSLLAMPLATVRDRYGIPEASSVFAEALTLAGEAMRPDLEAELLAAADDHLPVLASDAQRRVRWRSEVHLLADGVLPCSPDLRVDADLVDQVRAVAAGPELAATFIHLAAHTAFGATPELIANALDLLSEAHQEAPELWRWHGDAIDYLEAGLTYDLATRSADDGTHPESARRFGAAALRYALCRQHDLALASLDAGRLQMTLCDNDQTSSAAIVLLWAAAGLSGTPGEPVAWALFEFYQRILFHLADRQVDVNAVIMLHQAAKGRWLASALHSPGPFTASPRLLRELREMPVEQSLPDIDLPGGAETVMTLYAGSGEAETETGPDAVARNRQRAADRRISAELSSARSSWQPPPIPLDELQSMLPPETVFVSLMLGEARKPSGDPSGALHAMAVTRDAVEYRTLLIPDAGGSLIRLYRGSHHLALSPFGIRVAQLRNSVTADPLHRAVSRDAQQHLSERPDSYLAGFADRMPQWHAEGRRHLCVWADGPLHYVPFHLLTSGTGPAADDWTVTQIASPEMLREQPPSVRRGFVAFASGSGGTAHGLPVEDALESHAAQVATAMGGEAVLGSTATPERFLSGLTQARYVHVAAHGSHNEWAPWFQCLYLSGGRVFAHDILRTDLRGVELVTLSACESALGRFDLNDNLRGLPAALLSAGATAVIGCLWPVHPTVATEFFHHLYERLAVDPDRRSAFRAAQQRTRDRHPAYRDWGTFTFVGNWRTTIPEEPPND

SEQ ID NO: 8593 - protein, 228 aa, Actinoplanes utahensis
MTDLDTSIHEVDLLLEPRLQSPGAAPRISGRVTLGTPVVRPLEAGTISADPGWREFLEAQAADNDYLMLSVFCSFRAVPNGDPIVDAAVGVNLQAPGEPADRQPIAWSISPKHRVRTVPRTGRIALTANLTVAEAAIEYAPQGNREDLFLVGMGERDSDPEWRFRAVSGQPLIGDEELTIVVKKPAGVPAHADISLAATIRHRRLGLIPYRADLPSVLRSVKLGSLDG

SEQ ID NO: 8594 - protein, 553 aa, Actinoplanes utahensis
MIRPEHWRPADGLTLEPNALKAATAADLNAVVAAGPGAGKTELLAQRADFLLRTGQCPYPRRILAVSFKVDAARNLAERVRRRCGPTLADRFDSFTFHAFAKRLVDNFRPTLTGANALDSDYRIDRQDRIASKQITFEDLVPLGLEIVQANIYARRGLDQTYSHVFLDEFQDCTADQYELIKAVFGPSTAIVTAVGDTKQRIMLWAGALDGVLETFADDFSAVRLPLYQNFRSAPRLRRMQNRMIAQMDPSAVSPAEDLVGDDGVIDVLGFSDEYQESRTVGDLLSGWLGQGVPPAEIAVLVRNQPHLVASVLGDELRARGIAFRNEQESQDLTAEPIAALVLNFLRVVADDRQPHAYADLMRIVARTNASDDEVARFDSQVKRIITTARIAVRASTFTPDDSAGWRNLVIGFLRLVSRPVLTALSASYQQGNRLDDLIVQTMAAFERELAVDGNAVLALRRLSEADAVRVLTIHKCKGLEFEKVVVLGVETQLFWSKDLTTIMSEFFVAISRAKLHLVLTHVEHRGRPSAATRRWDERRSSHQTLLGFAAED

SEQ ID NO: 8595 - protein, 647 aa, Actinoplanes utahensis
MKIVALRLSNFQSFGPEPTTIDLDDLTYILGPNGSGKTAALEALSRLFSPLAAQRQIQPEDFHVPVDRSASEVQDAQPTLWLEVDVLCPEAGAGGTHASVPPFFAHMRIDTADGIPQIRVRLTAQLAADGVIDEKIEYVLQADAAGVPTSCTQMSRFDRAQIEVYYLPARRDPVDHIAYTAASLIGRSLRAADWTSEREVLGDLSAQITDTLVANAAVAGIGVHLTKQWQNLHSGGYFRDPSIAFGRGDLEGVLRQLTVTFSPSHGGASLPFDRLSDGQKSLLYISLVLSWQSLVRRVLRGEETSLDPDRLRPPVHVVIEIEEPENSLAPQYLGRIIRQVRGACSAGDVQALIATHAPALLRRVDPDTIRFLRLDAARRTTVERIVVPADDVLAAKYVREAVQAYPELYFSRLVVLGEGDSEQVVLPRVLAAAGIAEDDASVSVVPLGGRHVNHFWRLLNQLHIPHVTLLDLDSGRYHGGWGRVRNAMRQLNAVQPDTFAEAQIDQLPKWDDDCDFPQPGCGPDIGGGLGPIDVLEQHGVFFSQPVDLDLMMLAAYPTAYAVDPPAKPDPQTVVAVLGKSHKNEIRLRSEVLDLFDEYHRKFDLGSKPATHLSALASLDDQHLLKESPMVLTRMVEHVRAVLGGLPE

SEQ ID NO: 8596 - protein, 256 aa, Actinoplanes utahensis
MIDRPVRIGLQLQPQHMDYATIRRTAAEAEDLGVDVLFNWDHFYPLYGEPDGLHFECWTMLAAWAESTSRVEIGALVSCNSYRNPELLADMARTVDHISAGRLILGIGSGWFERDYTEYGYEFGTAGGRLDDLAGALPRIESRWGKLNPPPTRKIPVLIGGGGEKKTLRLVAKHADIWHSFADAETLEHKLGVLRGHCSDVGRDPSEIEVSVASKPDSRDRMHELGARLFTVGVGGPKPDLSELREALAWRDKING

SEQ ID NO: 8597 - protein, 262 aa, Actinoplanes utahensis
MAVSEAGPARPPIIRRRRLEPDARREQILSVAIRLFGDRPYADVSTTDVARGAGVARGLVNHYFGTKKELYLEVIRVMLTVPEVALSRLPDGGPAERADAIVTWFLDVVSRHSTSWLAAITAGGMAGDPDVDEVIAEAVDIAADSILSAVGPAPTASSATAAATGPAGPSTVVVPPAVPAAGPAGPSSGITAGAPPAASASGSPPAAEPGEALRGMARAYVGLATYTAREWLQRDALTRDQVHTLLTTTLLTMVEKVFPRAT

SEQ ID NO: 8598 - protein, 390 aa, Actinoplanes utahensis
MPTPGLDGYAEPWRMPEHDDLAEMARTFFLKEVVPHAARLEQQGHPDREHYRRAGELGLLGLSVPQEYGGGGGDFTHEAVVLHEQQLTGEGSLGLAVHCGIVTGYLAAYGTEEQKRRWLPGLCSGELIGAIAMTEPDGGSDVQAIRTRAVRTGEDLLVSGSKTFITNGYLADLLVLAVKTDQSAKAHGISLLVCELDDDAPGFRRGRNLEKIGLHANDTAELFFDEFRVPAADILGGPDAENTGFYQLMQQLPQERLVIGVGAVAAMQRAVELATAYAKERTAFGKPLVGHQNTRMVLAECATRTRVSRVFLDDCIARHTRGELDVASAAMAKLFLTEGQCEVVDRCLQIFGGYGYTTEYPIARMYADARVQKIYGGTNEIMKELIARVL

SEQ ID NO: 8599 - protein, 410 aa, Actinoplanes utahensis
MSSEQAYLYDAVRTPRGRGKDNGALHGTKPITLVTGLIDAVRERSPGLDPRRIDDVVLGIVTPIGEQGGDLARSAALVAGLPDTVGGVQLNRFCASGLEAVNQAASRIRSGWEHLILAGGVESMSRNPMGSDGGAWFLDPETALATSFVPQGISADLIATLEGFTRDDVDAYAIQSQERAAKAIAGGAFQRSIVAVRDPSGLEILAVDEHPRPDTTRAGLGKLRPSFAGIGEQAGFDAVALQKYHWLESIEHVHHAGNSSGIVDGASLVVVGSERAGRELGLTPRARIVGAAVSGADPTLMLTGPTPATIKALKAADLEISDIDLFEINEAFAAVVLKYIRDLQLDPDKVNVNGGAIALGHPLGATGAMLVGTVVDELERRDLKRAVVTLCIGGGMGVATVIERVTEFDK

SEQ ID NO: 8600 - protein, 676 aa, Actinoplanes utahensis
MISYDKDEAGIVTLTMNDPDQSANTMNATYVAAMSAALDRLEAERDQVTGVIVSSAKSTFFAGGDLPTMSRARPEDAGALFDLLGTIKKDLRRLETYGRPVVAAINGAALGGGFEIALACHHRIALDAPGTRVGFPEVTLGLLPGAGGVTRTVRMLGLAPALTVWLLTGKRVKPAAAREAGMIDEVVSSQDEMMARAREWIAANPDAAQPWDRPGYRMPGGTPATPKLAVQLPAFPATLRKQLKGNRMPAPEAILATAVEGAQVDIETAFTIETRRLITLLTGRIAKNMIGAFFFDMRAVNGGAARPRVDVAPATRIAVLGAGMMGAGIAYACAQAGLEVVVKDVSREAAARAVAEGDPAVLARITPTADVEDLRGCDVVIEAVFEDPKLKHQVFAEVEPVLAAGALLASNTSTLPITGLAEGVTRPGDFIGMHFFSPVGKMPLLEIMVGEQTSDAAIARAFDLGRRIGKTPIVVNDGRGFFTSRVIGQFMNEAVAMLAEGVPAASIEQAALQAGYPTGPLALADEVTLTLMHKIHKAYAAAGTTAGPAKAHALIQEMLERHDRPGRSSGRGFYTYENGRRGRLWDGLAGLATDEGRAIPFADVQERLLFSEALDALRCRAEGVLRTDADGNIGSILGIGFPAWTGGVLRYVEQHPDFKGRAAELAARYGDRFAPA

SEQ ID NO: 8601 - protein, 355 aa, Actinoplanes utahensis
MTALRGVRVVELAGLAPGPFGCMVLADLGADVVLVDRPGGTGLDGPLQRNRRTLTLDLKSPDGLAGLLDLVAKADVLVEGYRPGVAERLGFGPDRCAGLNPRLVYARMTGWGQDGPLAAAAGHDIDYLAIAGALEPLGRSGQPPHAPVNLLADFAGGGMLLAVGVLAALLERERSGRGQVVDAAMVDGSALLTTFLRGLIDAGQWPGGRGENLLDGGAPFYDTYRTADGGYLAVGAIEPQFYGALLGGLGLDDAELPGQFDRDGWPELRRILADRIGSRTRDEWAAVFARLDACVSPVLTPAEAPDHPHNRARSAFVEVGGQVQPSPAPRFGRTPNQAPRPPATATVGEVLAGWR

SEQ ID NO: 8602 - protein, 342 aa, Actinoplanes utahensis
MRIGTDRLDDSLIARRRMVEIAALVCRCIGIAVVLCTALGVRGFAAESVPGPVLYLCAALMALSSVMSGFSARHPASPRYAMLSALQIALDTAVTIGCVVFTERHTGANTWPVLSLPIAIAAIRHQLPGALAVWAVTSASLLLMPLDPGAAALGVSLNLMIAGISGSQASAFQRQLSTLQEVRRELQHQATHDALTGLPNRAHLAASAEHDPGRPLAVLLLDLNGFKQINDTHGHAAGDVLLHEVGNRLGTVLGPGDLAARLGGDEFVVLLRDADAATAGRTAQRIRSVIAQPVGIGPDRAVRVGVSVGVAIRPAGDGAGLDALIADADAAMYREKHAGRAA

SEQ ID NO: 8603 - protein, 519 aa, Actinoplanes utahensis
MLGLENIGLAKRLGIIVATGAVALGGIGTIALIGQESVASKANEVSRLQCGLAALNHLNNRQSELKVDAYRAAGGADVSQDVKDDVQSSSEALDAVSGCDLPSSIAGQVNGYRGDFDDFNTFISDFVTAGVADPRSVRARIGEIGDKNDKTDGELDTLTDAVTKQVDDGHQKTGSAIKRTRWTVIIVALIALALLIGMALPLVRSILGPIRRIGAVIDGLDKGDLTVRSGITTRDELGTMAQSLDHTLDKLRESMITIAKDSDSLATAATQLSAVSGEIASAVDNTDRQSSSAATEADEISRNVQSVAAGSEEMGLSIREISRNAADAAQVASVAVAEAARATESIRRLGESSAEIGNVIKLITSIAEQTNLLALNATIEAARAGDAGKGFAVVASEVKDLAQETARATEDIGARVTAIQNDTTGAVEVINRISEVIAQINDFQTTIASAVEEQTATTGEMSRSIGEVAAGSSRIAANINDVSSASQATVSGVNQTREASEEVSRTAEELRALVGAFKF

SEQ ID NO: 8604 - protein, 113 aa, Actinoplanes utahensis
MSASIQSDVPPSGTGCVECLEAGGWWVHLRRCAACGHVGCCDTSPAQHATAHFRATGHAVIQSFEPGEDWFWDFAAEQAGSGPELAPPTSRPVDQPVPGPAGAVPADWRSKIH

SEQ ID NO: 8605 - protein, 129 aa, Actinoplanes utahensis
MVSVMTDPADDLIPSVFARDCTSRFVLADITGKWGGLALAALHDGTYRFNALRRRVDGVSEKMLAQTLQALERDGLVRREVQATIPPRVEYSLTPFGERVAAKFKELIDLVEGEMPRVRVAQEEYDRVR

SEQ ID NO: 8606 - protein, 286 aa, Actinoplanes utahensis
MTIAVAGATGHLGRLVVEALIGRGVEPSSIVAAVRSPEKAAGLLTRGVQVREADFDRPETLPVAFAGVDRLLLISSNAVGNRVGQHVAAIEAAKAAGVQLIAYTSVLRADTTPILLAAEHKATEEALAASGVAYTFLRNGWYIENYTAQLPTVRTTGAFLGSAGEGRIAGATRLDYAEAAAAVLTADDVRPVYELGGDQPFTLAELAAEVSRQSGETIGYHDVPADELVTILTGAGVPEGFARILADTDVHIRENGVLDNPGSDLRDLIGRPTTPLADAVADALKA

SEQ ID NO: 8607 - protein, 185 aa, Actinoplanes utahensis
MIGWSGPGSLRGLSLIRIPPCCGPYPSYYGDRVPNAAIAAVTAAGIAHEVVRHGPVSSVAEAAATQGVELRDLVKTLVVRRGPDDFLFVLVPGDRSISWPKLRAVLGVNRLSMPDAATAKAATGYERGTITPFGAATAWSVIADERTRGRTVGLGAGERGVALRVGADAAVAALGGEYADVTDPA

SEQ ID NO: 8608 - protein, 124 aa, Actinoplanes utahensis
MSDRPRKEPGPDHPITVTPTGQRVVVTVAGKVVADTNNALSLRESTYPAVQYVPLADVDRTLLERTGTRTYCPYKGEAGYYSIVVDDVTATDAIWEYAEPYDAVAQIKDHVAFYPDRVESIRIG

SEQ ID NO: 8609 - protein, 336 aa, Actinoplanes utahensis
MLVDFSAPVAASPAEVEAAAVSAELLGYDGFGAAETKHDVFTALTLAARATERISLQSGIAVAFARNPMTVAILANDLQLISGGRFRLGLGSQVKPHIERRFAMPWGRPAARMEEFVAALRAIWHTWATGERLMFRGEFYRHTLMTEFFDPGPNPHGNPPVELAAVGERMTAVAGRVADGLLVHPLSSVAYLAEKLVPALREARGGALDGFQLGLAAMVVLGADEAERSRAEQAVRRQIAFYASTPAYRGVLDLHGWGALADRLNALSRRQDWTAMAAEITDEVLDTFAVAGDPAAVAAGLVERFGATIDRISLYTPYEADRHQLAAVRGALRAAA

SEQ ID NO: 8610 - protein, 114 aa, Actinoplanes utahensis
MTALAVVNAWGDVLGPDGRPVCGGAGTDQPVASFGRENTTLGVLVTDARLSKSDCFLLAQSGHTGFARALHPAHSRYDGDAVVALATGAQPADLDLLRAVAAEVMAAAIRAALG

SEQ ID NO: 8611 - protein, 77 aa, Actinoplanes utahensis
MHLGNWTGDGTGVTVILPPPGTVGSGEVRGGAPATREFDLLHPARLVDRVDAVVLAGGSAFGLAAADGVMAELREPS

SEQ ID NO: 8612 - protein, 621 aa, Actinoplanes utahensis
MSRRGWRCDRSWVKGDRPPHAVRGFADRCGRRGCRDRRGWCARRAECGDSRGDETARAGERLRTVKSGIDHLARHPQRVPGDPMTTLTEPPARRSFFADLGVRHKIGAIIAISVLVSLVAGILATRALSRSASAAERLYQANMTSAATLAALETIAVSTRNDLANLLISRSEADNAKYEKRVQDGFTGFASTLATYKAAGPAGDAATVAALESNWNAYRQVVENTQIANALSRNVDAYVKVRDEQTAPITDKIKAGFVALGQAESADAQKAAAGAQSTYHTNRNVILTVQVLGNLLAILIGVLVIRAVVGALSRVREVCTRLAAGDLTGQTGLTSNDETGQMGRALDTAMVNLRRTVATIDESATSLAGAADRVREVATEIAGSAERTTSQAQTVSAAAEEISRSVDTVSAGSEEMGASIREISQNAAEAAQVAGAAVDLASRTSATMNQLGESSSEIGNVIKTITAIAEQTNLLALNATIEAARAGEAGKGFAVVASEVKDLAQETARATEDISRRVEAIQADTNGAVTAIEEITRVIARISDFQTTIASAVEEQTATTAEMNRSVSEAASGTGDIAQNITGVAEAARSTSEGVERSQQTTAELTRMSGELSALVKGFRY

SEQ ID NO: 8613 - protein, 54 aa, Actinoplanes utahensis
MTGWALPLAGLDPPPLPRPHWPAVPALLAVVAALAVTLGATAVLSGRRTLRRIR

SEQ ID NO: 8614 - protein, 348 aa, Actinoplanes utahensis
MIAVVLAMVRARGGAALMLAVLAAFAVAPVVAAPAYLRAADRVVAAGQVAAADPAERAVSLQAVEGDSRRSTGDPAGQVDLSSTGASLIGLPGFRYAYAAEFPAVGLEPDARTPTRLVHRQDVCAHLVMVTGRCLLGEGDLVLGEETARRLRLAAGRSVSLSYARFDQNPDSQLWVGDGAAKKFFLAGTYRVADPSDVYWGSHGYFAFAETPGGTRAGEPAFTGLASVTAMEHGDVQLAIDGYAGPGALDADRLPALRAGLDEVRRTVTDLGAGDGVSTSANLKLVTSIPALLARIDEGHVTARRIVPVPAVALVLLACLALLLAAAAGAEARRPETAVIALRGARAS

SEQ ID NO: 8615 - protein, 276 aa, Actinoplanes utahensis
MISGRSLVLKVRNGRTAAATVDAVLLNETSGARVVVSFGPVPPGEHAVTRPLDGCDGGCRLLRWEIPSLPGADGKPTPDPVVLHSLARLGPDAELIGPARMADATRWRTVAAGVGLQLSGGPDGLTVTAAPNGGTADSDRVFAVDSLLPLPVLLAGPTPVPWRFAEPEITVLGAGPVPARVTGTAAALPVTGAAGILLDFDTVRRTAGEFSPAGETQVWLTANAPPDVVDRLRAAGVTVLGDESIAGRAARRPGRGTAPAGPFALLCAVSAVFTAS

SEQ ID NO: 8616 - protein, 264 aa, Actinoplanes utahensis
MPTILWGAVRSRAAQACTLLLLTGLPAAVAAAAPRFVLTGTERAATAAAAGVPAAQRTITVHREDDTQGDPAATLAGFGAAVDRTLPMPGAATVLGLSRQMSVTDASGVPTPINVDYRAGFCRRVRLTAGTCPAAAGDAALTTAVATRLGVRPGDLVRIQSTSAAPFLPLRVTGIYEIIAPETGYWADELYRTGSGTDPIYTAAATFTGDQLGRAVLTWSAEAPPALLRGAGGYDLGALVARAGELGDVEDPTGPLRADLALAS

SEQ ID NO: 8617 - protein, 309 aa, Actinoplanes utahensis
MNCCTPSGGDRPAGEVPAVAAGGTHTVDQARVPGQTFAMGDAHGDGHPADGEQPVHPVTVPGFTIDVTAVTVADFRAFVTATGFRTDAEHFGWSAVFHSAVADPERVAGRMAGTPWWLGVGGADWAHPGGPSTVALDDHPVVHVSWNDAQAYCTWAGRRLPSEAEWECAARGGLDRLRYPWGDDLPAGDDWACNIWQGDFPVRNTAEDGWVTTAPVRAYAPNAYGLHQVVGNVWEWCADWFSPRYYAVSPGDDPRGPSRGAARVIRGGSYLCHDSYCNRYRNAARSSNTPDSSTGNMGFRTVVLSISEG

SEQ ID NO: 8618 - protein, 293 aa, Actinoplanes utahensis
MSIEFGVFVPQGWRMDLAEIDDPVEQYEAMTTVARLADAGPWDSLWVYDHFHTVPEPTINTTFEAWTVSSTLARDTSRIKIGQMVGCNGYRHPSLFAKIASTVDVASHGRLLAGLGAGWYEHEWKAYGYEWTDVPERMRAFREAVEIVHRMWTEERPSFTGRHYRIDQPINEPKGAGRRKPDLWLGGGGEKVTLKLVAKYADGSNVGDGKPDVIRHKLDVLRRHCDEQGTDYDRIAKSTSLTVRTGDTVASIRERVEQVAEAGVNYVILYFERVAYDHEPLLAAAQEVVPRFA

SEQ ID NO: 8619 - protein, 345 aa, Actinoplanes utahensis
MVAGKQRITIAAIADAAGVSVPTVSRVLNGRTDVSPQTRELIERLLREHDYRPRNSRHSGRARLIDLVFNDLDSPWALELVRGVEDVTHAAGVGTVVSQVHHRTTATRQWLQNLRARASDGVVFVTSDIAEPVHSELHRLRVPVVIIDPAGGAATDVPTIGATNWSGGRTATDHLISLGHRRIGFIAGPKDLLCSRARLDGFRAAMEAAGVPVDPSLMEQGDFRNESGFLAGGRLLDQPDRPTAIFASSDQMALGVYEAARRRGLRVPDDLSVIGFDDLPDACWSSPPLTTIRQPLAEMGALAARTVLRLSRGETIETPRVELVTKLVVRESTKSLAETRAPAAA

SEQ ID NO: 8620 - protein, 299 aa, Actinoplanes utahensis
MTTTLDSRRTGQAAHTPPPPAGRRSRLLQYNWFGGLAGWLWLLVVLVPIYWIVITSFKLQSDYFSTNPLVPPSSPTLENYRFVLQNDFVRYFFNSVIVTVGAVAPAIVVSFMAAYAIVRGSGLSRFLRTVNGLFLMGLAIPLQAVIIPVYLIIIKLQMYDTLGAIILPSIAFAIPLSVLVLSNFIRDIPKELFESMRMDGATEWGTLWRLALPLTRPALMTVTIYQGLQVWNGFLLPLILTQDPNQRTLPLALTAFQGQYNINIPAVLASVVLTTLPILTLYVLGRRQMLSGLTAGFGK

SEQ ID NO: 8621 - protein, 308 aa, Actinoplanes utahensis
MTIAPPVVRSAPPAASRGARSVSVSWMAWPALIAFTIFGVIPLLGVLVLSFSSWSGLSQNIPFTGLDSWKSVLTDPDLPHALGVTFLIMALSWLAQTPLSILLGVFIAAHKRYRSVLAVLFFVPLLLSQAAIAITFKMLLDPNFGLGASLGWGFLQQDWLGESKLAIGVVIFVVSWQWIPFHSLIYQGGVRQIPAAMYEAAEIDGAGRIRQFFSITLPQLKYTIITSSTLMVVGSLTFFDLIWVLTAGGPGDSTRALAVDMYQRGFRTAMMGPASAIAVVLVLLGLGLALLVRRIGGRDATESQLEGI

SEQ ID NO: 8622 - protein, 441 aa, Actinoplanes utahensis
MKRRSFLSLSAGAAAATGLAACGNSGPADSSKGGSGSGDAASYWFLSGPPGQPIRQGAVDRFNKANPDNQVKVTTFQNDTYKDKLKTALGAGQAPSIIWGWGGGGLKSYVDAGQVDDLTDWFSQNAAVKNKLFPASFGPATVNGKIYAMPAETVQPIIFLYNKEVFEKCGVANPPQTWGELLSILPKFNDKGIAPISLAGQSRWTNMMWLELLFDRIGGPEVFGNAYDGQKDAWSNPAAIDALTKVQQLVDAKGFVKGFSSITADSNADQALLYRGKAAMELHGSWSYGIIKSDGGSFIKDGKLGYFNFPAVEGGKGDPSNVYGNAGQFLSIYSKASDKQKETAKKFFASMLDDQEQQGWIDSGGVPIVQGSNAKLASSPDKDFLTFIYDVSSKAKNFGQSWDQALSPSAAETLLDNIAKLFQKQVTPQQFATNMNAVIGK

SEQ ID NO: 8623 - protein, 790 aa, Actinoplanes utahensis
MTTEQVTPPWRDPSLPVADRVEALLAAMTLEEKVAQLGSRWVGNDMGDTGEDQGYDPEEQHNVAPMQDVFAAGGSIALADAARHGLGHLTRVYGSVPRTPAEGAAELVEQQRVVMASRLGIPAIVHEECLTGFTAFGATVYPAAIAWGATFDPELIERMAAAIGRDMAALGVHQGLSPVLDVIRDYRWGRVEETIGEDPYLVSLIGAAYVRGLQSGGVIATLKHFAGYSASRGARNHGPVPMGRRELTDVVLPPFETAIRAGGARSVMNSYSDVDGVPAGADPWLLTELLRDEWGFTGTVVSDYWAVPFLATMHGVAEDDVDAGAQALIAGIDVELPDTIGFGAGLIERVRRGELSERYVDRAARRLLTQKAELGLLDPDWSPEKSVAAAPLTDLNAAGNQALAAELAERSIVLLEPGTALPVTAAGRIAVLGPCADDARTFLGCYAFPNHVLPRYPQLGLGLEIPTALDGLRAEFPAGEITYARGCEVTGDDRGGFAAAVETARDADLAVAFVGDLAGLFGKGTSGEGCDAADLRLPGVQPELLEELLATGTPLVVVVVSGRPYALGDLDGRVAGLVQAFMPGQAGGAAIAGVLSGRVQPAGRLPVQIPRHPGGQPGTYLQPILGATHAEVSNLDPRPLYDFGYGRSYTAFAVGDLRVSADTVPTDGEFTVTVRVRNTGERDGAEVVQLYLADPVAQVTRPVRQLSGFRRVELAAGAAADVTFTVHTDRTAFTGRDLRRIVEPGELRILVGTSAGDLPCSATVRLTGPTRAAGADRRLTTGVQVRPIAS

SEQ ID NO: 8624 - protein, 400 aa, Actinoplanes utahensis
MPPRINDDERIRRFEAVTDAALSRLDVSDLLDELLDRVRDLLDVDTAAVLLLDEHAQQLVATAAKGLEEEVRAGFRVAVGRGFAGRVAATRRPLRLAEVTADDVVNPILLAKGIRSLLGVPILAGTELIGVLHVGSLTPRRFGADDVRLMELVADRAGVAGRIRSDKMEQAAALALQRSLLPTRLPEVPGVELAARYVPGHAVGIGGDWYDVFPLPTGWLGVVIGDVSGHGLSSAVVMGRIRSALRSYALICDTPAEALTLLNRKVHHFEAGSLTTALYGMVSPERDRIVLSSAGHLRPVLARPGHPGGLAEVPVDPPLGLGRTRPRRNGIVAFPPGAVLLCYTDGLVERRDQVIDTGLAHLTGLIRAENAEAVCATAMSAVDTEQPGDDVAVLAVRRST

SEQ ID NO: 8625 - protein, 478 aa, Actinoplanes utahensis
MTAKQILHNFVGGAAVAPAEGRYADLVDPSTGEVFASAPVSGREDVDRAMAAAATAFEDWRTTTPSDRQKALLKFADAVEARTADLVAAESRNTGKPLGLTTSEELPPAVDQIRFFAGAARLLEGRSAGQYMNGFESYVRREPIGVCAQVTPWNYPLMMAVWKIAPALAAGNTVVLKPSDTTPVSTVMLAEIAAEFFPAGVFNVVLGDRDTGRALVEHRTPQMVSITGSVRAGMEVASSAAADLKRTHLELGGKAPVVVFEDADVAAAAADIAVAGYFNAGQDCTAATRVLVAPAIYRDFVAALAEQARALKTGAPEDEDALYGPVNNAGQLSRVAGFIDRLPDHASVEAGGARVGDRGFFWSPTVVAGLRQDDEIIQNEVFGPVITVQQFADEDEAVRYANGVDYALASSVWTRDHGRAMRMTQRLDFGCVWVNCHIPLVAEMPHGGFKHSGHGKDLSVYGLEDYTRLKHVMHNVGA

SEQ ID NO: 8626 - protein, 423 aa, Actinoplanes utahensis
MSTSAELHRRRLAAVAKGVGSTIAAYVDHAADGTLTDVDGREWIDFASGIAVTNVGNAAPKVVEAVRRQVERFTHTCFMVAPYESYVAVCEQLIAATPGTFEKRAALFNSGAEAVENAVKIARHATGRPAVVVFDHAYHGRTNLTMALTAKNMPYKHRFGPFAPEVYRAPMSYPLRDGGLDGAEAARRAIDVIEKQVGAGNVAAVLIEPIQGEGGFIVPAPGFLPALAAWAAEAGAVFIADEIQTGFCRTGQWFAAEHERLQPDLITTAKGMGGGLPIAGVVGRADLMDAVHAGGLGGTYGGNPVACAAALAAIETMRDRDLPAAARRIGSVLLPALTALKDEGIADVRGRGAMIAVELVKPGGIEPDPVRTAAISQACHAAGLLTLTCGTYGNVLRFLPPLVIPDAALHRGIDILTTAFHDN

SEQ ID NO: 8627 - protein, 163 aa, Actinoplanes utahensis
MPEHVLTGKNLAVSDTGLDEINKQIIDHLQRDGRMSYATLAKTIGLSEAAVRQRVQRLLDNGLMQIVAVTDPLTLGFARQAMVGLRVNGDLREIADRLAAIPEVDYVVICAGRYDLLVELVCTDDEHLLDLLNEKVRVIDGVTAADTFMYLKLAKQTYAWGTR

SEQ ID NO: 8628 - protein, 410 aa, Actinoplanes utahensis
MSFWLETLGPIERRPPLPGDRDADVAIAGGGYTGLWTAYYLAKARPDLRIVVLEAEFCGFGASGRNGGWASGLFPVAEAKLARRYGAAAARAMHAALADAVDEIGRTGIACDYAKGGVISLIRTPGQLRRAGAGAMDAAAARAICGATGVLGGVYSEHCAALHPAKLVRGLAAEVERLGVSIHEDTRVLTLTDGEVSTDRGRVRCGTVVRALEGYTAELPGHRRDLAPVYSLMIATEPLPAEVWDRIGLRRRETFSDERRMIIYGQRTADDRLAFGGRGAPYHFGSRVRPEFDRVPAVFGRLRHTVGELFGIDVPVAARWGGPLGIPRDWMPGVGLHDGIAWAGGYVGDGVAASNLAGRTLTDLILGRDTELTALPWTGHRSRRWEPEPLRWLGINGGLHGTALLDVLDR

SEQ ID NO: 8629 - protein, 643 aa, Actinoplanes utahensis
MQAGRADRAARAGRAGRLRDGRRETPGRGADRPRHAPDGRLGTDPRGPVEPRGRRHPGRHPQWPAHSRRPARRPRRGLRGASQTLSERAAPGHHPGPAGTRPARARPALRGVTVQGVPDSDAFLGALLESLTVGVVACDADGRVVLVNRTIREVRGFPLDGPVPADYVASTERVLATPGRPPMTWERTPLMRALRGEHIVAEDVLIQCPDQPVRVFACSAQPIRDAGGGVLGAVAIGHEVTALHRAERFRDCHLAVEQALKRATTVRAAAPEVLRAVVETLGWPCAELFVIDEAACGGLRAVGHWDTGCAAPDDDFFGHVPRRGEGITGRVWETGRAIWVSDISAHRDLRTSYERERVGICIRRGIRTVLAVPVHDGDTLLGVLTCYAGARERHEELLTVLMDGVAAQIGVFVALRRAEELARQLARAQNDFVDLIGHEMRTPLTSITANATILAEEAAGLDHDGRQMARTIARNAAVLQRIAESLLDLAGLDGGHLTVAKRPVDLAALVGDAVAAAHAPISADLPGELPVPGDPDRLRQALDDLLANAVKYSPPGAPIRVTLCGDETSAELCIADTGIGTREDERDRVFDRFFRGSNVRHQGTHGSGLGLSLARSIIHLHGGTIQLAANDPSGTVVCVRLPR

SEQ ID NO: 8630 - protein, 389 aa, Actinoplanes utahensis
MSATSGFDRTARISSQPSIRGMPRSVSTASGCFSTTISKAACPSGARSTVSPARLHTRTRTAAMSSSSSAISSTATPSACAHRCAPGEVSAHCRAHPIERCAARCGNRSPPRGEKPFHRFAGTHAAPPVPTERIIATIDTLDQVTSQLPIVFIAALGEPGRYWQPVLDRLGDLTTVTYDRPGIGDAPPRPAPRPPVAYSVLADELAALLDARGVPGPVVVAAHSIGSLIARVLADRHPHRVAGLIHIDGSMPQFHLLPGLESPEDGETGDPDAAVLDIVAGQTEVLYAASPKVPTLVLTRTPGAWDGRHPAPPGAEELWLAHQRALARDAGAPLVVADDSGHYLPTVQPDLVAYAIRAVHTAAVTGRPVELDPTALRAAGGHRDRAVTH

SEQ ID NO: 8631 - protein, 137 aa, Actinoplanes utahensis
MTDSGLSIGEIARRTGLTIDTLRFYERAGLLTRPVERDAAGRRVYHQEDEGWLEICTNLRSTGMPLSEIKRFADLVRAGAGNEGERLALLQEHRERVDEQIRRLQKFREVIDYKVAVYAEQVTQGTAATFWTGVGTG

SEQ ID NO: 8632 - protein, 460 aa, Actinoplanes utahensis
MTDRQPDDVDALSATARDHLWMHFTRLSAYRDAPVPVITRGDGCYVWDSAGRRYLDGLSALFVVQTGHGRQELADAAAKQAAELAYFPIWSYAHPKAIELAGRLAEMAPGDLNRVFFTTGGSEAVESSWKLARSYFKRIGKPLKTKVISRAVAYHGSSMGALSITGIPPFKQDFEPLIPSTMRVPNTNYYRRPDENMTPEQFGVWAADRIAEMIEFEGPDTVAAVYLEPVQNAGGCFPPPPGYFQRVRQICDRYDVLLVSDEVICAFGRLGEFFGADRYGYQPDIITTAKGLTSGYVPLGAMIASDRLAEPFLDGTNWFAHGITYGGHPVGAAVALANIDIMQRENLNRHVRENSPLFRSYLEKLLDLPIVGDVRGDGYFFGIEMVKDKATKETFTAEESERLLRGFLSSALFEAGLYCRADDRGDPVIQLAPPLTATETQFAEIEQILRSVLTEAWNRL

SEQ ID NO: 8633 - protein, 466 aa, Actinoplanes utahensis
MGDPFHTPLAEAIGEPYWLMQDGAPAPAEPLTGVAQADLAIIGAGYSGLWTALLAKERDPERDVVVIEAGTAGWAASGRNGGFCSASLTHGFDNGISRFPAEMELLERLGLENLDEIEATVRRYDIDCDWERTGELNVATTDWQLQELLEYYDEARERGLNVRRFDRDEVRAEIDSPTYLGAVWDVDSTALVDPARLVWGLREACAELGVRFYDNSRVEKISAKRGVLRLHTWRGRLEARQVALATGAHGQLLRRLRHWVVPVYDYALITEPLTAAQLAAVGWRQRMGVGDSANQFHYYRLTADNRILWGGYDAVYYNGGRIAPERDLREETFRLLAEHFYETFPQLADVRFTHKWGGIIDTCSRFSAFFGTAFRGRLAYAVGYTGLGVGATRFGAKVMLDLLGGEQTPLTRLKMVRRKPVPFPPEPIRSWVIQVTRRSIAQADRNGGRRNLWLRTLDRFGLGFDS

SEQ ID NO: 8634 - protein, 282 aa, Actinoplanes utahensis
MTTSTLTPPVTAPGAAPRRRFRITGASLMFGYTWLVILWLVLPIFVMILFGFNNPHGKFNQTWQGFTVKWYKDIFGLDELTSALWLSLVIAVISSLLAAAVGTGIGYALGRYQFRGSGTINLLLFATMASPELIMGASLLSLFVSLNTGRGVATIVIGHVLFSISFVTTVVRARVITLDRSIEEAAADLGATAWTTFWKVTFPILLPAIFSGFMLAFALSIDDFVVTNFVSGSATTFPLYIWGATRVGLPPQVNVMGTLIFAAGVLIAVIANLRSRSTSKRD

SEQ ID NO: 8635 - protein, 287 aa, Actinoplanes utahensis
MNRVKRTLAPYLLVLPGGLWLLLFFVVPMATMFSLSLQQGDVINGYRFTGHWQTYVDAISDYRVQLIRSLVYGLITTVVLVVMSFPIAYWIAFHGGKRKSTYLFLLLLPFFVSFVLRTISWRQILTDDGVLLHPLKEAGLLSPGFHILGTSYAVIFGLVYNSLPFMVLPIYVALERIDPRVLEAARDLYAKPPVVFSRVVLPLALPGVFAGVLMTFVPASADYVNSQVLGSASTTMIGQVIQAQYLASSNYPTASALSFVLMAVLLVGVFTYARALGTEDVMNAAAR

SEQ ID NO: 8636 - protein, 416 aa, Actinoplanes utahensis
MFPTSQPDPSVLRGMTQRRLGRRDALRLGGTSALGALLAACGVQGKGKPEASVAPDAVAKFWSGKVKNGKLDFANWPLYMDPKKPQLKKFTEKTGITVNYQEVIQEMGPWFAKVQPQLSAGQSIGFDLMVITNSVQFGQFRSGGFLAPLDHSKLPNYAANAGKSYANEAFDPGNVFSIPWASGITGIAYDIKKTGREITKLADLWDPQFKGKVGMFSDTQELANFGLLAAGLKPAGSGEAEWKQAAEKLKQQKSAGMVRNYYDQSYVDALGKGEVWLTQAWSGDIFQKNVSDGTDFRFVIPEEGGTIWTDNMTIPITAANPVDAIMMMDFFYEVENAASLAEFINYVCPVPAAQDQIKKDAAAASGDDKKTLTMVAGSPLVFPGQSDYDKLHYYIDFNTQEEQQNFQRIFEPITLS

SEQ ID NO: 8637 - protein, 385 aa, Actinoplanes utahensis
MTTSVPHHAAKAAPATGERTGYPAIEFAGVRKEYLSHGEAVPAVKSLDLAIGQGEFFSLLGPSGCGKTTTMRMIAGFEQPTTGTVFLDGKDVTNVAPNKRDVNMVFQSYALFPHLNVLQNVSFGLERKKVAKSEIKRRVGEILEIVSLTGMEKRQPKEMSGGQQQRVALARALVNHPRALLLDEPLGALDLKLRQQMQIELKRIQREVGITFVYVTHDQGEALTMSDRIAVMNAGLIEQLGTPREIYERPSTRFVAGFIGTSNIVDGQVARVEDGFAVLDLGSGERILAPVPGTVQAGRKLEVSVRPEKIDLHRSAPQAVTGSLLSGTVTEVVYHGTSTNYTVATSAGSDFVVFDQNAHDAEDVASRGERVFLTWAPQHSYPIGV

SEQ ID NO: 8638 - protein, 535 aa, Actinoplanes utahensis
MAIVQRISGSAVIAHHVLDPGVLLEAVQGKVLAVAGVPVTAMWHLGHERQVRVDPDRAEVETAGHPHGTTVVLRPDAGAQSVADVVGVPDRFGLVGERLHRDHRAEHLVLDHLVALPQAGHHGRREEVAAVADPPAAGHHLGVRRGAVQEAGHPLQLGRVVDRAEERRGVGRGADPGAAGRLGQRGGEVGGDPLVHQHPGGGGAVLAGVEEAGAGDRGRGGRDVDVVEDHDRSLAAQLQVHLLEVGGGRRGDLHPGPGGAGDRHQLRHRVGHQRPAGVPVAADHVQHTGREELGGDPGEQQRADRGGVGRLEYHRVARGDRRGQFPDRHHQRVVPRRDLRAHTDRLTAYVGGVVPEVFRRGLALQHPRRAGEEPQLVEDRAHLLGPGRRDRLAGVAALGLDQLLGPRLDRVGDAQQRPLPLGRRGVPPDLEPGGGGLHRDLHVPLRGDRGEGVGLAGARVDDRRRPPLVGVREGSVDEVAQHGEFGAHGGVAFRRCGDAHQKWGNLVTSLTDVTRESEVVSNPETEIRSRVAQDP

SEQ ID NO: 8639 - protein, 490 aa, Actinoplanes utahensis
MSVTTPTEGNTPVSTELPVLRNFVNGSFTDTDQGRTSPVVDPSTGEAYALAPVSSERDVQVAVEAATAGFEVWRDTTPAERQRALLRIADAVEARAEELIEAECRNTGKPVAATRAEEMGPVLDELRFFAGAARMLEGKAAAEYLRDHTSYVRREPIGVCAQITPWNYPLVMAIWKLAPAIAAGNSVVLKPSDTTPVSTLLLAGIAAEFLPAGVLNVVCGDRDTGRALVAHPVPQLVSITGSTRAGMEVAAAAAPDLKKVHLELGGKAPVVVFDDVDIAATAAAIAGAGFFNAGQDCTAATRVLVHERIATDFTAALAEAARGTRVGAPSDTAAFFGPVNNAAQLERVAGFLDRTPAHAEVVAGGRRIGDRGYFFAPTVVAGLRQRDEMIQDEVFGPVITVQPFADEAEAVRYANDVRYGLSASVWTQNHGRAMRVSRRLDFGAVWINTHLPFVSEMPHGGYGHSGHGKDLSLYGFEEYTRIKHVMSYHG

SEQ ID NO: 8640 - protein, 444 aa, Actinoplanes utahensis
MSEAQVRADDRAHVFHSWSAQGLINPLPIAGASGSYFWDYDGRRYLDFSSQLVNINIGHQHPRLVAAIQEQAARLCTIQPAFANDKRGEAARLIAELAPGSLNRVFFTNGGAEANENAIRMARLHTGRHKVLATYRSYHGSTATAITATGDPRRWPNEPVAVGVVHFWGPYPFRSPFHSDSEEQESRRALQHLRDTIVFEGPGTIAAILLETVVGTNGILVPPPGYLAGVREICDEFGIVFIADEVMAGFGRCGEWFAVDHWGVVPDLITFAKGVNSGYLPLGGVVISDEIAETFRERPFPGGLTYSGHPLACASAVASIEIFKEEGIVEHARMLGTEVIAPALAELKEKHPSVGDVRGLGVFWAIELVKDADRTPLVPFNAAGAAAGPMNEVAAACKERGLWPFTHFNRVHVVPPCTTSVEEVREGLTILDEALTVADGFYGS

SEQ ID NO: 8641 - protein, 634 aa, Actinoplanes utahensis
MQRRDRREQSRVGHAGGQVEAEAAGAAQGRPITPGAAGAGGGDDRAAASVRPDGAGPAQELPGCVDRAGRQAQLGGDRADRGEFGAGLDRAVADRPAERLGQAACAGVGESREDRLEHFCYSTFQALFGPWSSHNLGRMNQIAHWIGGAERAGRSGRVAPVFNPATGEQTAEVALAGTDEVAEAVAVAKEAAEAWRAASLSRRSAVLFTFRELLAGRTAELAAIVTAEHGKVLADAAGEIARGLENVEFATGIPHLMKGAFSEQAATGVDVYSIRQPLGVVAGITPFNFPVMVPLWMCATAIAAGNAFVLKPSEKDPSAALWLARLWAEAGLPAGVFTVLNGDKEAVDALLVHPDIAAVSFVGSTPIAKYIYETGTAQGKRVQALGGAKNHMIVLPDAELDAAADAAINAGYGAAGERCMAISVVVAVGDIADPLVEAIAARLPKIRVGNGADRGVDMGPLISAQHRDRVAGYIAAGEQAGATVIADGRKSAIADEDGYFLGATLLDNVTTDMTVYTDEIFGPVLSVVRVDTYAEAVRLVNENEYGNGVAIFTRDGGAARRFQFDVEAGMVGVNVPIPVPVAYYSFGGWKASLFGDSHMYGPDGIHFFTRGKVVTSRWPDPGTSAIDLGFPQTR

SEQ ID NO: 8642 - protein, 199 aa, Actinoplanes utahensis
MSACDTLPMSQVTLPYHEGPWSEDDYLALGETDHRIELIDGSLWVSPAPNRPHQHISAFLWLALQATARTAGFQVLLTTNLRLATGRILIPDLVVDNGPPLEIVGEATDAVLVCEITSPSNATSDRILKRALYAEAGVPWYLLVEPDFSDYASLTLRLFRLTGREYVEHALAKQGETLRSRLPFPISISTDDLISPWRE

SEQ ID NO: 8643 - protein, 530 aa, Actinoplanes utahensis
MSKDMPDAPTLLAGRYRLGAELGRGGMGQVWLARDETLERDVAVKLLDLPEELAEGDATRRTLREARASARLSHPSVVQVYDVLSLDDRAWIVMEYVPSRSLREVIESDGPLDAYRAARIGLDLLAALEAAHRAGVQHRDVKPANVLLADDGRVLLTDFGIAAIDDDSLTSRSDVLLGSPLYMAPERARYGVSGPPADLWGLGATLYAAVEGHSPFQRASTMATLAALATEEPDPPQHAGPLTPVLDGLLRKDPDERIVAAEAERLLQRAVADLERSRSVPKPRTPVDDTVQQATDGVRGNRILLVGALIVVLLAGFAVFWFNRPSPRTTTGPAPATTAAIAVAGAEPSAAGSAGVTPSVSVSPSLSGGPSVSPSPANGRPPLPAGWKVYDDATGFSVYVPEGWTTSKSSGSSMRYWRDGKGHVLGIDQTDHPRSDPVADWKSQRDTRLRGGDFPGYDEKKLESVSYFVKAADWEWTFRKNGVQHVNNRGVVTSAHHAYGFWFQTPDADWAKYEKDVLEVVFKSFIPAKD

SEQ ID NO: 8644 - protein, 308 aa, Actinoplanes utahensis
MSLDIPSPGASATSAASAAAGRGGSAGEFIEPAVLGRGDQRRIILARPRYRSRVDHETAITAALAAATVIRDRYGRSLDRVDKGGGDFATAADLAAEQAIHDVLRAAHPGDAITGEETGASGPTGARRRWLVDPLCGTLNYAARTPLVAANVALRDGAHLTAAASADPFTGETYWTDGSSARLRHPDGTDTPLTPSGESALVDINLDPPFPTEPARIVATPGFRARFRPRVMSTTLALLWVSDGRRAAYLTYGDVSDSVHFAAGIAICEAAGCVVTATDGSPWQTGRGLLAAADPGTHRDLLALIRST

SEQ ID NO: 8645 - protein, 297 aa, Actinoplanes utahensis
MRKAESSGGSSMAVQAKQGTGAKPVAGTGGKAQSSGAPRDADELRNEIEQTRAEMGETVEALVAKVDVPGRVKSAAADKVAHVKESAAELKDSAAEKAAHVKDAAIGAAGQIKDKAAKVGGAAEAKPGGGAAEAKPGGGAAEAKPGGGIAEGNLSGGGGAVAGGGLSAVKDEVREKAAQIKESAVERGSHAKEAMTQAAGELRESAASGAESVRAAAMAKLREPGAGEKTHGAGRIAEATAQTSARMGCQAADAAERASAAIGSARRRVVARPREFALLGAVLAAAAAGVALIRRSR

SEQ ID NO: 8646 - protein, 139 aa, Actinoplanes utahensis
MAHTDARSEQATTAELVSRLSEQVSTLVRDELTLARMEMVEKGKRAGKGAGLLGAAGVLAMYGAGALLVAAGAALALAMPVWLAALIVTAVLFAGAGIAALVGRRQVRDALPPEPEEAMASGREDVDAFMTAARTGRSR

SEQ ID NO: 8647 - protein, 342 aa, Actinoplanes utahensis
MRSRLPFALALSTVAALAVSGCTKKNDTDGAPSGSGDRKTYKVAFVPKLQGVPYFEAMNAGGKAAAAALGNVEWLYQGPTQADAGAQADIVRSYIQQKVDALIVAPNDPDSMAPLLQQAKDAGIHVATADTDAPNSVREVFVNQATADGIGQGLTDALLKAMGGKGRYAIVSCGQTAENLNSWIRVQQAYTRQKYPDATIVDTVYAGEDQAKATQMATDLMNAHPDLTGLVGECTSSAPGVAQAVKDAGKIGKVFTVGLGTPQSMKPYLKDRSSSAAILWDVQQLGYLTAWAGAQIAQGKPIQATNDVSDKLPAVTYDAAGKMLLLGPALQITDQNVDQFGY

SEQ ID NO: 8648 - protein, 499 aa, Actinoplanes utahensis
MTTGTPRLRLSGIAKRFGAVRAIQQADLVIREGRVHALVGENGAGKSTMIKIVSGAETADAGTIEFDGEPVRIGGTNDAIALGIATVYQEPQLFGELTVAENIFLGREITRAGRIDWAAQQGRVAELLERLGLPARSANAAVNTLSVAEQQQVSIAKALATEARVLILDEPSAILTDAEIDVLFDVVRRLTAAGVAVIYISHRLDELFRIADEVTVMRDGKTIGTYDMSGLTVRRIAELMVGGVLSDERPHRVVPDGPAVLELRGLGRAGRFADVDVTVRGGEIVALYGLVGSGVSEIAAAVYGIDRITAGEIHIGGERVTPRSPAHAQRLGVALLPANRKVEGIFGVQSIAFNISAGHLRLLSRFGTLLDRGRERGVALDLIRRLSVKTPSERQPISAMSGGNAQKVVLARQLVERPRVLILAEPTQGVDVGAKEEIHRIVTELADSGTAVLVVTSDLPEALRIADRIQVVRGGTTTMSFGPDASQVDLLAAAAGGDE

SEQ ID NO: 8649 - protein, 318 aa, Actinoplanes utahensis
MRNRVTGQELVLVGVIAVLWAALAVGTPAFLTAGSIQPLLVATAPTALVGVGMTIVIITGGIDVSVGGALMVCSVLTAKALVGPGVDPGVAVLLPVAVGGVLGLVNGLLIAYGRVHAIIITFGTANLFLFAGLRIFGSGTVNGIPGTLAFFGRGADGRTLGVPHAFLITVLVTGLAWWYLRHTAGGRHFFAIGGDAVAARLAGVRVQRRVLIAYVVTGLLVGLASCFVIAQGTSTLDQSVGSGRELAVIAAVVIGGTSIMGGRGSVTGTLLGALLVQSVSSGVTQLGWRSQLSDLFVGVFIIVAVGADLLRARARRSR

SEQ ID NO: 8650 - protein, 343 aa, Actinoplanes utahensis
MSRVVKMLLTQRIALLAVLIVAVVVTFFIQDAGGYLTASYDFDYMSAALINAVPLAMLGLAELLVILSGRGGIDLSVGAIVSLAGMVFGFAYGHWGWPLGAAILLTAVCGALLGALNGFLVSYIGFPALIATLATYYADKSLAIVINDQQPISTTPIQHLFAISRSVELPLFGRYVPDVPLGVFTFLLPTVVAVWLLLARTAYGRRLYAIGTNDVAARWSGLPVRDTRFKAYVYAGLLAGLVAVVTVGQFASARPDAGVSGNGMALPAITIAVLGGVAITGGIGRVAGVVLATLLIVWLNAGILLAFIGNEGSQYQLFALGAVLVFAALLNGLTNRRYGGTSS

SEQ ID NO: 8651 - protein, 383 aa, Actinoplanes utahensis
MNLDDLDGFSVEVPSWAYGNSGTRFKVFTAPGVPRDPYEKIADAAQVHRLTGLAPRVSLHIPWDRVDDWAALRAHAEGLGVRLGAVNSNLFQEDDYRLGSLCHPNPAVRDEAVGHHLRCIEIMHETGSTDLKIWLPDGLNYPGQDSLRGRQDRLADALRRIYDALGDGQRILLEYKFFEPYFYSMDIPDWGTSLLHCLALGERATVVLDTGHHAPGTNIEFIVMQLLRQGRLGAFDFNSRFYADDDLIVGSADPFQLFRIMTEIVAAGAHRPSSGVNFMLDQCHNIEEKIPGQIRSVLNVEQALAKALQVDRDALAVAQREGDVLGANEVLMAAYETDVRTALADRREARGLPRDPVKAFKISGYAVTTAAERADGAPAGWGA

SEQ ID NO: 8652 - protein, 128 aa, Actinoplanes utahensis
MEDERLATVRARIDAITEPDPSPAEIALVLRLLRSFAAKTPDAVDRLLDALTKDDPGLTRDEAHALKGSAANIGAAALAAVCSSVEDQARAGGVVDPAAAAGLIRTEAAGALRAVSALADEYARRCPG

SEQ ID NO: 8653 - protein, 400 aa, Actinoplanes utahensis
MRTELYKSAAADDKKPMVLVVDDEQTVLDALSLQLGREFNVLTAPDGERALKVLAEHGRAAAVISDMRMPGMNGIELLRRVQMEYPDITRVLHTGHGDMSTAVAAINSGGVYRYLPKPADTDALRDAIRASVAKHDEAIADRELLDRTLRTSVKALFGVLELSNPPAYRRAGRISTLVGELCHLLQLDGLWEIEVAAMAAQLGAVAVPAATLTKVERGLPLSADEQASVDAMPRIALRLLGDIPMMGEVLAIVRGLTGAPTPAEGRSALAEDAIAVLRTATDYEMLESRGVNAVDAITAIEEREGHYPHVVAALRRLKGVRAVKDTVKSVRVTELEVGMRLIEDVVATNGLVLIGKETVITELMLDRLTNFARAIELIETVLAAVPYRASYQPTAYAGHR

SEQ ID NO: 8654 - protein, 441 aa, Actinoplanes utahensis
MVPHRIDTVGRALSVTSKPHAGPVAAEVTFCAPEIPPPRALETMQMSAVGDAARVAAVRSYQLLDAPRPVVLDELTRLAGSVFETSMSTVTLVEADRQWFAGSTGMPSSGGPLGSSFCGVVVDQRMPLVVADALTHPVFRSWENVVGAPHIRFYAGVPLVDEDGFTLGTMCVLDDRPRDTADRRLDMLHTMAGQAAGHLSGVRNRMLLAEVGDELSRAISREEDFVATVSHELRTPVTTIQGYLELLVDNEELAPYRRMIEPIQRNGERLVRMVDHLLAGTRPVGTPLPLLRAQTDLVTVAEAAMAACRPQAAQRDVSLVLEVAGGAGPFPVPGDFTRLSQAAEHLIRNGVLFSPPGSTVRVLADEFGLSVADAGAGIPADELPHVAERFFRGRFAREQAVPGVGLGLAITQRILRAHEGTLTVMSDGSGMGTTTRMTVIS

SEQ ID NO: 8655 - protein, 534 aa, Actinoplanes utahensis
MRILRRLRLGGRLSVAFAVVLVLLGVAVAIGAVGLNRQSTAAADNRDLMRLQHQVDQQKYFDGDISGWQVAYAWDTRRGDPRKAVDPASENRAGFLADAQALRDLLRATDTGRMTPAERQLFDTLSATWDEYFKADSQAAALYAKGDVAGGDKQILGPGYDLYFAIVQGTDKLVAAVTGRAEQATRTAQRQAATARNALIIAFALAVVAAVLLTVVVTRSVTGPIGRLISTLQAMARGDLTVRADTDGGDEIAVMGRAVDEAITGIRGSVVEIVESGVRLTEASETMRRVSQEIDQAVAEADQQAGLAAASASGVSGNVHTVAAGTDEMGSAISEISRNAGDAAQVATDAVAAARATSATINRLGDSSAQIGDVIDVITTIAAQTNLLALNATIEAARAGEAGKGFAVVASEVKDLAQETARATEQISQQIAAIQSDTGQAVTAIDEISRIIEQISDYQTTIASAVEQQSATTAEMNRGVTEAANGASDIAGNIANVASSTAASRAAAGQAARTAHEVETLAEQLRSAVQRFRI

SEQ ID NO: 8656 - protein, 106 aa, Actinoplanes utahensis
MRIVRYDGPGAVRLALHGELDLATTGRVTAEAEAALATPGVRRLILDVAGLTFCDSSGIDALVNIRTAAQTRGATCQVVGAQGIVHRSMQATGVLALLSAPDRGAA

SEQ ID NO: 8657 - protein, 142 aa, Actinoplanes utahensis
MSALTAYLDVPLHHGAPGAARRAVVAVLGGWGFDDPDWLDVTAVVVSELVTNAVRHGGGCVALQVEAHDRRVIVSVADGSSVVPRRRDPDGAGGRGIALIEALAEGWTVHNHEGGKQVRVRLVPCPGAGTPMASGSARGDVA

SEQ ID NO: 8658 - protein, 689 aa, Actinoplanes utahensis
MQETPRVADMRAEGTHERRVTKPERRCRLFQPFTRLMSAYSTVMAAVLVVEDNPEHQAVLAEIVRRLGHSVTVADDGRAGLATALAEPFDLIVADVDMPHLDGVRMCRALRAAPATADVPVVLITGYLPPGDTRLAEAGAAAVVPKPFSVRELTETLRGCLPVPADGPFLSELMRSLDSGAVACDRHGRIVFVNRAVRDFFGDECATVPIREWPRRFQLRHHDGTPLRPDEMALERALHGEPVHHADVRTSDRQRRPRWLTVNARPVRDASGAVLGAVAAMHDVTGDHQQLRYEKCKAEVLHALVHAREVEHAGAAVLRSLSTCLDWPYLRFWLVDEVSGRLRPAVTHLSPGAEEIPLPPSLRPGEGVAGRCWTTGELIWVADIRAPDSPVMAQVLGTGYRSAGAVPVLSAEQVVGVLTFFTPDRQDAEPALTVLLTGVAGLLGAYLERRRSDELANQLAASIGEYIALVGHELRTPLTSIATYTDLIAESGDDTTIGEVRDLLAVIERNNARLRTLVERLLDLSALESGHAGLTVGTVDLSAVLRDAAAAVTAEAGDGGARVRTDLPDRLDIPGDQARLRQVAENLIGNAVKYSPPGSTVTVTLTADSDAAVLVVTDTGMGIPAEERNRLFARLYRATNARHSGIPGAGLGLALSRAIVELHHGTITLTAGHPDGTIATVRLPLTATD

SEQ ID NO: 8659 - protein, 228 aa, Actinoplanes utahensis
MDAQAMHIANGIVNGPVSAAFVVLAVAALAVCVWRARADLDDRLAPMAGLVAAFIFAVQMLNFQVLPGVSGHLLGGTLAVILVGPWVGALCVSTVLIVQCLLFADGGLTAIGLNITNMALLGTAAGYLLVAGLLRILPKSPAGLGATAFVASVVSVVVASQGFVLEYALGGTTDLSLPWISGTMAGVHVLIGIGEGIIAATTVMTVARVRPDLVYALRKFRKPVEVAA

SEQ ID NO: 8660 - protein, 111 aa, Actinoplanes utahensis
MNRKLFLAAGLLVALLLAGVVSNFASGSPDGLDATARQGCTFDAAGRITGGHCMAQREQAHQMADSPLAGYGIRGLHHAALSTGLAGVAGVLITFGIGLGGFWLVRRRKVS

SEQ ID NO: 8661 - protein, 254 aa, Actinoplanes utahensis
MGAGHSHPLYLDRRGPLHRLAPEVKIVAALLFTVVVVVTPPTLYAAFLGYLLLVALLAAAARVPVGWLAKRASIELPFVLLALALPVLGHGARVTWLGLSLSVDGLHGAWNIFAKGTLGVLASLLLAATTTMRDLILGLDRLRVPSVFTQIATFMLRYIDVLADDARRMRIARLSRGYDPRFLWQVKAFAVGVGSLFLRSYERGERVYLAMVSRGYTGRMPQLTGPVAPAGQWAVSAVLPLLTAGIAVAAGVLG

SEQ ID NO: 8662 - protein, 257 aa, Actinoplanes utahensis
MTALRITGLHYSYPDGRAALRGVDLTLAAGERVALLGPNGAGKTTLVLHLNGILHGGGGQVEVSGLPVTPGDRAAIAEVRRRVGIVFQDPDDQLFMPSVAEDVAFGPANCGVRGAELEARVDEALRAVGMAEHRDQVPHHLSFGQRRRVAVATVLAMRPEILVLDEPSSNLDPASRRELAEILESLPVTLLMVTHDLPYALELCPRSVILDAGRIVADGATSALLADRDLMRGHRLELPFGFDPVAAVRGRRESGAL

SEQ ID NO: 8663 - protein, 152 aa, Actinoplanes utahensis
MAGTLSPWPTTRQGSTQHPVPTLQYLLRAHGHTVTVDGVFGAQTGDAVRAYQRTKGLPDNGIVCAETWLALIKEVGPGAQGNAVAGVQHKFRRESVPDGEFGPETESAVRAFQARAGLDADGVVGRQTWQAIIAGPETGPEAAGPETLAEAA

SEQ ID NO: 8664 - protein, 840 aa, Actinoplanes utahensis
MSSDPGGIVPLEGAEGPCPAGSWPRRVSIDEAFREGKIVTAVLDHEDLVRRLAHPDDTEVASLDAWWRANNYLTVGQIYLQGNPLLREPLKPEHIKPRLLGHWGTSPGLSFIYAHVSRLIKTTGQQAIYLAGPGHGGPALVAAGYLEGTYAEVYPRVGQDEEGLLRLFRQFSSPGGIPSHVSVTTPGSIHEGGELGYVLVHAFGSVMDNPDLLTIAVVGDGEAETGPLEGSWKGISFINPEHDGAVLPILHLNGAKIAGPTVLARKDPAEVRKLLEGHGYAIIEVGGDDLPGMHHRFAQALAEAWGRIRAIQAAARGGAGDGRRPHWPLIILRTPKGWTGPQTVDGVTVGGTWRAHQVPLSGVKDNPDHLRMLEEWLRSYRPDELFDATGAPTGPVRDLAPEGDLRMSASPHANGGRLTRDLDLPDFRDYAVEVKTPAAGRAESTRKLGEMMRDIYTRNDDRFRLFCPDETNSNRLGAVFEVSDRAFMETVTPDDVQLSPTGRVMEVLSEHNCHGWLEGYTLTGRHGMFATYEAFAMVSASQTIQHGKWLQEASHLPWRAKVPSLNILLTSTAWRNDHNGFSHQGPGLIQNVLTQRGDVARVYLPPDANTLLSVADHCFRSRSYINLIVIDKQPQLQWLDMDQAIDHCAKGAGIWEWAGTDDGNSDPDIVLACAGDVVTMETVAAARILMERLPQLRTRVVNVVDLMTLPRPKDHPHGMSETMFRELFTDHVDVVFSFHGYPGAIHQLVHGRPDADRFRVRGFIEQGTTTTPFDMTVRNKASRYHLVIDAINNARRLPSGASELKAWCEAQLEKHATYVVEHLEDMPEVRDWSLQDWAQS

SEQ ID NO: 8665 - protein, 221 aa, Actinoplanes utahensis
MPTLDRQDDVFILDLGDSENRFHPDWLAAVGAALDEVEKADTPKALVTTASGKFYSNGLDLEWLGTHGDDFAQYAQDVQNLLARFLALPLPTVAAIQGHAFAAGAMLTLTHDFRVMRADRGFWCLPEVNISIPFTPGMSALIQGRLAPQVAHEAMTAGRRYGGTDARAAAIVDQAVEAEAVLPTAVRLAATLAPNAGDTLGTIKTRMYATALTALRERVTR

SEQ ID NO: 8666 - protein, 205 aa, Actinoplanes utahensis
MLLSDDWPRLRAVCERDVVHRSGELGRAGWTAALAGVSSQVRWREGTIEAAGRSGGTVSLDGESLLLVPSVTIWPGVAVFADDPWPKAIVHPARGSATLFDPAPPAASLAALLGRSRARLITALATPTSTTQLARTLALAPGAVGDHLAILLGTGLVGKARSGRSVLYSRTPMGDALLHGVTAATPSVPDAAAHRERRRPLPGSP

SEQ ID NO: 8667 - protein, 296 aa, Actinoplanes utahensis
MPATWRPDSAPSTSRSLRGRREGAESEPVKDLDRWSAPLGRSLFNAASAGAQLLGLALGGAAVAAIGARHALLIGAGCHAVAAVTVRFGLPDLTGAASTGSPVRASLTGAGTLLSNGPVRRLLLAQWLPAASMMGTDGLLVAFASGRGFPGAAASVLLAASPAGMFAGELVMGRLVRPAHRPRLVAPLMLLTGAPLLALGAVAFPASVALLVLAGFGFAYGVGLQQPFLQAVPAESRGQSFALLSTGAMTLQGLGPLVFGAAAQLTTPGLAIAAAGLATIACLPLVRPWSGRRGND

SEQ ID NO: 8668 - protein, 749 aa, Actinoplanes utahensis
MRFTDGYWRKRDGLTVVHPAHLQDSVPGPDSLTVYAATRRVRDRGDTLDAPLITVTLTAPMDDVIRVTVEHFQGGVAKGPEFTIGGQPADVTVTASTFTSGTLTARVDTGDDWGLDFLAGDRRITGSGGKGMGVVSGPAGDFVHEQLDLGVGEVVYGLGERFGPLVKNGQSIDIWNEDGGTSSEQAYKNVPFYLTSAGYGVLVDHPGRVSFEVASEMVTRTQFSVAGQRLSYLIINGPTPADVIRRYTALTGRPALPPAWSFGLWLTTSFTTSYDEETVNRFVDGMADRDLPLSVFHFDTFWMREFNWCDFEWDTRIFPDPAGMLKRLAGRGLRVCLWINPYIAQRSPLFAEGKAGGYLVRTTGGDVWQWDRWQAGMALVDFTNPEARQWYAAKLRALTEMGVDAFKSDFGERIPVDGIAWHDGSDPERMHNYYTQLYNRVVFDVLREARGEGEAVLFARSATVGGQQFPVHWGGDNTGNFASMAESLRGGLSLMSSGFGFWSHDIGGFEGLPDPAVFKRWVAFGLLSSHSRLHGSKSYRVPWNFDEESVDVLRTFTHLKHRLMPYVFGAAREAHLTGLPVMRPLYLAFPDDPAVAYLDRQYLLGGDLLVAPVFSAAGDVRYYVPAGRWTHYLTGEIVEGPGWVRETHDFFSVPLLVRPGAVIPVGARHDRPDYDYRDGVTLRLCEPPADRVAVVVPGPSGADTVFTVAREGDEIRIGRSGDALPWRVQLGSGITELRADQDSCTLALG

SEQ ID NO: 8669 - protein, 293 aa, Actinoplanes utahensis
MTVTATRAPRTRIPERVPLRGRHPGRFLILTLLLVLLLLVVAPLLVIAVNAVKSPADYAAHGPLALPHHLYLQGIVDFWNRVDFGLKLWNSFITSLVVAVLGVILSVFNAYALGIGRIQGRIWFLVFFLIANLLPQEVLVYPLYYLSKQLGLYDSLFSIVIIFTVIQSAFGTYLLTSVYTEFPRELLEAAAIDGAGKWRALWRVVVPVSRPTLAVLFTFFFIWTWNEFFLPLIFLISNDNQTVPVALGVLQGDRMMDATTTSASALIGIIPAMVFFLIFQRTLTRGIAAGAIK

SEQ ID NO: 8670 - protein, 309 aa, Actinoplanes utahensis
MDGPDRAAHDGERFPVVKNRGYAVYLLPGLVASTAVIVVPLVMTIYISFTRWTGIGSPRWVGFGNYTRLFADANFWASFGHIVLLILAMAVVPTLLGLVLAAVLFDYVAKKFSDRWASILRSGYYLPQVLPVAVTGIIWGWILHPGYGALNRILETIGLGSLSRNWLGDPKYALYSVMAVMIWCQLGYPIVMFMSGLQRIDPELYEAADLDGASWWQRFRRITIAMIRPELYVVLVTTTIASLKIFGQIFVLTRGGPSNATLVPSYFAYKNFFEKAQVGYGSAISTVLTVLIVILAIVFLRLQNRAERS

SEQ ID NO: 8671 - protein, 435 aa, Actinoplanes utahensis
MTLTRRGLLTGALATTTSVALAACGGGGSSDDGADAKTLTLWHYEGPTSAMGIAWNRAIEIFKQKHPGVEVKFEEKSFEQIQQNAQMILNSDSAPDILEYNKGNATAGLLAKQGLLTDLTDEATRRGWDKKLSASLQTTAKYTDQGIMGSGKFFGVPNYGEYVMVYYNKALFDKFKIAVPTTLDQFTAAMDTFVKNRVTPLAVGGAEYPAQQIFYELALAKADRAFVDDYQLYKNKVDFNGPVLSYGAQTFADWVSKGYLAKDAAGIKAEDMGVSWEQGRFPILISGSWWYGRFAKEVKNFDWGTFLFPGNTLHPGSSGNLWVVPAKSRAKSLAYDFIDITMSPEIQNLLGNSGGVPVAADPAAITDPRNKELIENFTRLTTSDALAFYPDWPAPGYYDVMVAGVQGLINGSKTPKAFLDEVAKPYHENLADLGK

SEQ ID NO: 8672 - protein, 344 aa, Actinoplanes utahensis
MSGGGAVPTINDVARAAGVSPSTVSYVLSGRRPISAETRARVQAAIAELGFHPHAGARALASSKTNVLALVAPLRLDVNVPVIMQFATAVVTAARSFNHDVLLLTKDEGTAGLERVAHSTMVDALILMDIERDDLRLPAIRRLKQPSVLIGLPADHAGIACVDLDFEAAAALALRHLAGHGHRRIGLIGPSPAVYQRQTTYADRFLTGFLRASAELGLRTVSHPCEPGADGVRAALADLDTELPGLTALVVHNEEALRPLLDLLHAAGRRVPQDISIVALCPRDVAVAMPVALTSIDIPAHDVGTIAVETAMRLLDNRRVEFTRLLEPSLAERDSCREIPPSHR

SEQ ID NO: 8673 - protein, 1040 aa, Actinoplanes utahensis
MPAASPPITINRTRPLCRDARPGFGRISGGCCLSHRAPSMVTPMRRSASMRWSAHDVEAIRRPSSSSPASREIAMRKRRGLAALAAALLTLPLTAAPAPAAESYPFRDPTLALPARVDDLVGRLTLDEKLSLLHQYQPAIPRLGIAVFKSGTEALHGVAWSTDYTNGGAKTDATATVFPQAVGLASSWDPALVRQVGAAVGDEARGLHAQNPTVWGLNLWAPVVNLLRDPRWGRNEEGYSEDPLLSGTVATAYGRGLQGDDPDHLLTAPTLKHYAAYNNETGRDRTSSNVPQRVLNEYDRKTFEIPLRADAATGVMSSYNLVNGRPATVDPDLGGLVRGWSDRRLFNVTDAGAPTNLTGSQGYFATQAEADAAIVKAGGDSFTVDDTDGAPTVTALRQAIDQGLLSVRQVDTAVGDALSIRFRLGEFDPDGGPYAGIPASDVDSPAHRQLAREAAASSMVLLKNTGVLPLAAGGSVAVSGPLGDTVYTDWYGGQLPYRVTPLDGISAKSPATYAPGADRIALKDVATGRYVSAADPSAVAATAATAGSAAQFDAVDWGDGVSTLRNVGTGKLLGYNWGPFVTKESEPTGWFVQQQFKVEDQTDGTVVLHYAGYETQESWFGPNTYVTIGADGRLGLGPAASAAHFAREVIADGVAAAATAARRARTAVVVVGTNPFVAGREAHDRTGLGLGARQEALIEAVRAANPRTVVVVQSSYPEAITWAQAHVPGIVWTTHAGAETGHALADVLYGDVNPGGRLTQTWYRGVDQLPADLNRYDIVKTGQTYQYSSAEPLYPFGHGLSYTSFRYSGLKAGGGRVTVAVTNTGKRAGSEVVQLYTHQRTSRDVTAVEQLRGFRKVTLQPGQTRVVSFPLTPRDLARWDVTRQRWVTESSVYDVLVGSSSADIRQRGSVSVRGETIPPRDLSRVTRAETFDDYAGVRLLDETRAAGTVVGGVTAGDWIAFRDAALHGGRTVTVRAAGAGTVQVRLGSPGGRLLGTATVRDTGGVYAYTDVTAPLAAASGRQDVYLLPGPGLRIASFDIR

SEQ ID NO: 8674 - protein, 525 aa, Actinoplanes utahensis
MSRAAARAARPRLFRMAISLEAGEDEDGRRIASTSWADHRIEALRRMGVTIEGARCERQHPPEIRPKPGRASRHNGRVRLIVIGGDAAGMSAASQARRRRGPDELAIVAFERGRFVSYSACGIPYWIGGAVDGPEALVARTPAEFAKAGIEVRTRHEVTDIDLKARRVTVRDLDAGQSRTEPFDDLVYATGATPVRPPWARTGARGVFGVQTLEDGAALDAFLAAERPATAVVVGGGYIGVEMAEAMINRGLRVTLIERSAQPMGTLDEDMGALVAAAVRNLGIDLRTGVTVEALESAHGKVTAVVTDAGTVPAGVVVVGLGVRPAVALAEAAGLPCGDSGGLRTDLGQRVGERVWAAGDCTEVLHRVSGRRMHVPLGTHANKQGRVAGINIGGGHATFPGVIGTAVTKVCDLEVARTGLSAAEAEQAGFGTVSAVVESTSRAGYFPGAAPMTVKLIAERGTGRLLGAQIVGRAEAAKRIDACAVAVWNEMTVGDMTGLDLGYAPPYAPVWDPILIAARKAGDAL

SEQ ID NO: 8675 - protein, 1096 aa, Actinoplanes utahensis
MRQPSRWLTSVLAIGLAAGVTTVNGSLPATAAPAAPAPDTAPDTAPDTGTVAPKESPTGTLGAHDAGLLAAAQAEHKPSVTVIIATGQGRSADVAGRLKALGGTVARRFDQVGYVLASVPTGKVLSAAKLPGVTGLDLDETVKVPEPDVAADRGAGKQAPLPAGPGADTPADNPYLPTGETGSVDFKRRHPTWDGRGVTIGIMDSGVDLAHPALQKTTTGERKIVDWVTATDPLVESDATWRAMRTPVAGPSFTYAGATWTAPAGNYLINRFAESITAASEPAGDVNRDGDTTDVWGILYDPVSHDIRVDVNQNNDFTDDAVMRPYAEKQDVGYFGVDNPATPVAERMPFVVEYREDVDLTPAGLPGQVADFVNIGIPEGLHATHVAGIAAGNDLFGNRNFDGQAPGAKIVSARACSWGGGCTAAALTTGMVDLVVNRHVDVVNLSIGGLPALNDGSSAQAQLYQQLITKYGVQLFISAGNSGPGVNTIGDPSVATDAVSVAASISKQTWLANYGSETRKARQLFPFSSRGPREDGGFKPNITAPGSAISATPTWEPVAGLTTVGYTLPVGYAMENGTSMAAPQATGAAALLLSAAKQTKRTVTPAQLRRAIYSTADPIRGEQTYEQGTGQLDVPASWKLLTRIAEVRGYTSSAAVCTPLAQYLTPPGVGTGIYNRCAASAGGFRPGQTRVVTLSLTRTSGPDRTLLHTLSFQGDRHAFATVPVIGLPLNKTVKVPVRVTAGRGVTSALLRVDDPVTPGVDFEVLNTVVAGLDAVQPAYASTFSGAVDRNSTTSFFVTVPANATTLQVDLAGLTAGSQTRWTAINPYGVPVESNSSPNCYTNYSDPATCKPEERSYDNPLPGVWELAVESRRTSPVLSNPFTLTAKVQGVTVEPATVSLPSVQVGTATPATWTVTNRFGPIAVVPQGGPLGSALSQRPTIEQGGVQDYPVVVPAGVSRLTVVIGSPADPAADLDLFVYDQNGVQVGKSADGDSEEAVTVNAPAAGTYKVEVQGYSVPSGSTAYDYRDAYFSPALGSVDVPGAPVPLAAGAGASVTGSVTVAAVPPAGRHLFGEVTFQTDEGAVVGRGAVEIGTVTG

SEQ ID NO: 8676 - protein, 206 aa, Actinoplanes utahensis
MALLHKAEIRPTKLELLSGWLPTRPWFSGPANPEVTRVAAARFDDPAGEVGLEVMLVRVGDGPVLHVPLTYRGAPLAGAEAIGTTEHSVLGTRWVYDACHDPVFVSVLGEVIRSGGTQAAEEVHDGERVVVREPGLLLRGAGSAAPAPGDPVKVAEGEVVRIETTGGGIELFRTPWAAPLPGDAVLTGMWAGRPEPVVLARLTEGD

SEQ ID NO: 8677 - protein, 277 aa, Actinoplanes utahensis
MRMSMVARVAAAGALLTILAGCSGSGDKSATPTFVSPSAAGGTSPATESTTQESAARQALPAALRHRVPTFTEQAPAPTKVTLPPGPKAPNFARIPTTEKIAFITIDDGWEKNPEALKLFQAANVPVTLFLEVNAIKDNPTFFTPLQGAGATIQDHTITHPNMTHLSYDAQKHEICAGADELKKQYGKRPTLFRPPFGSYNDNTLRAVHDCGLKASFTWMETTDKGIIRFQRPTHLIAPGDIILMHFRPAFIDDFLAVLNIIHKSGLTPARLEDYIP

SEQ ID NO: 8678 - protein, 312 aa, Actinoplanes utahensis
MNGDMLLSIGDLARRTGLTVKTVRFYSDLGVVAPATRSPAGYRRYAADAVARLDLVRTLRELGIDLATIRTVVDRQSTLPEVAAAHADALQAQIRVLRIRRAVLTVAARRGAGPAQLEVIHQLARLSAGERRELIDDFLGAVFAGLHEHPALPAVARSMTPDLPADPEPEQIEAWVELAGLFQDDDFRATLHGMAREMAGDRAADDRTGLPRVLADAIRAQVAPALRAGIDPGSPTAEPTIAALVGHYAHITGHPDDAALRRRFETLLRGMNDPRRDRYLSLLAVVNGRPVPDSLAPMLDWAVAALRARTAR

SEQ ID NO: 8679 - protein, 441 aa, Actinoplanes utahensis
MGADAAPAAYRALLDRPGFRRYAIIGLASKLAPGMAGLSLLLLIGDHYSLATAGLAVSASAVGQGVSAPVRGRLIDRFAAGPVLIGCLAAQVAATVALVATAGRTGPAVVMLTCAAIMGATGPPVAVMMRTLWRRVTDAGTLSTAMALDSSMAGAALIVGPAVAGWLSVAVSPVAPFVVITALTAGTVVLLIGVTATPSRTGSPRHRPGRVAAPPSRQPDRLGTTLPSRPGPVAAALPRRPGLLAAALPRRPGLLATPSLRRLLVANGLFVSAVTATDVVLPGYAREFHAAGLAGVYLGVLSVGSVLGSFAVGAAPALLRRGSGLRQRLGLFTAGSAALALGSWLSPAAVLLFCPLTGLMIGTLFATLRTTGGDLAPPDRVTETMSWLSTMDLTGAAAGAAVFAHIAGSAGSRTALALIPVVLLAATAISRNTPEGAPTPH

SEQ ID NO: 8680 - protein, 572 aa, Actinoplanes utahensis
MSPRMRTVALFVSVGVFVALAGWSVIAALTRPAYDRLADLHVYLGAVRAMRDGIPLYSYAAENGDPFTYPPFAALVFWPLGAVPEPMVQVAWTLVTVAGVMALAAALTVRNGIAGRQRFLVVMLAAATMLLASAPVQSNLRFGQVSIFVVLLALVDALGLLPRRAGGVLIGVAAAIKLTPLLFVPYLWVVGRRRDAIRSGVAFAACAAAAFAVWPAVSGTFWTQAVFTTSRIGDLSSTGNQSLNGTLLRYAIPTSERMVAWTALAGLVCLVAFLCAREYHRRGQVALAAVVIGCATVAVSPVSWTHHQIWTVLAGILLIAGPHRGRIAAGVVVLVTMSVQVGAVLPVGGFLHDNARAWCAVAVCCGGAVSLWPAAAGRVRLLPGLAVVGRPRTALLYCTAAAAGIAGVLAVTHDRAVTAQVYAAANAQDPVWSQVFSSGPCGGMGLRDGRYVCSDLTGPAMAGEQLNFAAGDDGAGHIGIEGQAGPDVVRLVYVPVQGAKPVDVPLWPELPAPKTAPDSDDPPKLLPVVDERSMTTHRFGVRTNDPTDAVLLAYDRNGQVIGTGGDKLHDMS

SEQ ID NO: 8681 - protein, 385 aa, Actinoplanes utahensis
MRRTIFNEDHEAFRQTLREFLQAEVVPNYDEWLHNGEVPREFYKKLAELGLFGIEVPEEFGGAGIDSFKFAAVQYEETARAGVSFGGSGVHVALCLPYLLNLATPEQKQRWLPSFVSGDMMFAIAMTEPGTGSDLAGMSTTAKLTEDGRHYVLNGAKTFITGGVLADRVIVCARTSPPKPDDRRFGISLLVVDTKLPGYSVGRKLDKLGLKTSDTAELAFQDVLVPVEDLLGEENKGFSYLGQNLPQERLGIAYGAYAQAAAAVEFAKKYTQERKVFGQTVSSFQNTKFELAACQAEVDAAQAVADRALEALDAGELTAAEAASAKLFCTEVAHRVIDRCLQLHGGYGFINEYPIARLYADNRVNRIYGGTSEVMKMIIAKDMGL

SEQ ID NO: 8682 - protein, 249 aa, Actinoplanes utahensis
MSRVAIVTGAARGIGAATALQFATEGAAVAVLDLDEDDCADVVGRIRAAGGTAVAHGCDVADEAQVDAVIDKVAAELGGVHVLVNNAGVTRDNLLHKMPASDWDMVMNVHLRGAFLCSRAAQRHMVPQRTGKIVNTSSVSALGNRGQANYAAAKAGIQGFTRTLAMELGPFGINVNAVAPGFIVTEMTDATAARIGVSAADMQAKAAEITPLRRVGQPEDIARVVAFLASDAASFVTGQTIYVDGGRRL

SEQ ID NO: 8683 - protein, 382 aa, Actinoplanes utahensis
MDLTLSAEQQQLRDLARDWVEREVVPHATEWDRAEQVDPKIVGKLAELGFLGLGISEAHGGSGGDFLDYAIVMEELGRGDTAVRGIVSVTLGLVAKTIQAYGTDEQRAHWLPRFCSGETLGCFALTEPGTGSDAGNLVTRAVRDGDDWLISGEKIFITNGTWAGVALVFARTGGPGPKGVSAFLVPTDRAGLTRREIKGKLGLRGQATAELSFEQVRVADAERLGDLGAGFKIAMSALDKGRIAVASGCVGLSRACLEAAVAYAGERTQFAKPIASYQLVQEMLADIAVETEAARLLVWRAADLVDRRQPFGTAASMAKLFASEAAVKAANQAIQVFGGYGYIDEFPVGKFMRDARVQTLYEGTSQIQKLLIGRALTGISAF

SEQ ID NO: 8684 - protein, 212 aa, Actinoplanes utahensis
MPRPTTPLLSKAGIRAAALEIIDQDGLDGLSMRKLATALGVSAPALYFHYPTKEQLLDDVASEIMEQVDVSGFAAGWRDGLLGWARSYRAALAGHPNIVPFLAHGPGQRDASLRRADAIHGGLVAAGWPARDATMIGASTKYLVVGAAMGSFSRGFVDDVQVYLDRYPALGDAHRLREHADAVDRDSFEFALLTFVDGLAARLARSATPPVH

SEQ ID NO: 8685 - protein, 289 aa, Actinoplanes utahensis
MFKSQRLWLDLAGLALSAGLFVAAFHAHAPVQDMLVGVATSFIFATILDMFVTLQNRLADRARVHFFGAELVRRETLLCYPDFVMHDDVRATLNDHNQQMLFQRPHSRFVELTVHRIDIPRVVAANDIQSLLYVSSAFEARNTCPVMITVDTAIVDDCARSFVSFGLSSNDCTHLYANEHADPLFTIIEDEVGSEFIRLRNGSEYRSTKRKQYGIILRYAPNPEEFPERRWLLVAGLGPVGTTATGWYLSQHWRQLAGSVPRDKNFIAVLSTGVYTDHAPHLEEICLDD

SEQ ID NO: 8686 - protein, 288 aa, Actinoplanes utahensis
MTEVLLAGLCTLDILQLVEKYPADNEKVTALTQTVAAGGPATNAAATVAHLGGDPVLLTAVGRHPLAAGIHADLSALGVRLIDLTDTDPGAPSVSSIVVSAGTGNRAVVSTNGAARSVTVPHLAALVDGMRAVQVDGHYPELATAVLTEARRRGIPTLIDAGSWKPVTPRLLPLLDVVVCSADFRPPGISTPHDVAAFLADAGVRWIAISRGDRPLLRWTGGGFTEQPVPATPVIDTLGAGDVLHGALTLAVARRWPLTDATFAEALDEAAAVASRSCGSFGTRAWMS

SEQ ID NO: 8687 - protein, 244 aa, Actinoplanes utahensis
MARIDFEGPVAAVYESGRGAPDGGLDGWRTALAAHLPVAAPVLDLGAGTGLYARLLHTWFGVRVVAVEPAFAMLRQAAPPAHRAVGRAERIPLASGCCGAAWLSTMIHHVGDLPAAARELRRVLLPEAPVLIRSAFPGDQERIALYRFFPTAGAVLDTFPTVAQVRAAFETAGYALREQRRVRQINAATLEDYYEKVRHRANTTLHAIPDAEFAAGLRALRAAADSGVREPAVSELTLLVLSPR

SEQ ID NO: 8688 - protein, 236 aa, Actinoplanes utahensis
MHILSAMGGLVILDLDDTLLRTAAATRAARRLVADRVFPGAADRVLPIWRRVTLLYPDQQFDDLLSVVAALLGTRLPPDLDLRELAAGYQAAALARITARPRVVAAARRLRDVGGHDLAIVSNGDDAVQRTKIERCGLGDLAPAERVVICDGVRIPRKPHPQAVHAVLTGAPAVLVGDRTTDVLCARRAGIPVVRLRARTADLERGAGLRAIARPDALCSAAELYEVTRELLEERG

SEQ ID NO: 8689 - protein, 222 aa, Actinoplanes utahensis
MTTRSLPEETAFRWRQFTGLGTTRVHWDWRGGWRPGRWSYWWYLDLTGAAELAALAADLLAELRLECLDPAVHLHVSLQQVGFTDEVTAGQARALLAAAGRLGLAPLELTFGPADPNPESVVLRVSPWEPIQQHRLRLRRVTEPIVGTLTGADDHFWPHVSIGYVNAVVPAAPIAEALRALPDRRVTLTARELRLVRLNRDDRLWKWDVVGAVPLSAGPARR

SEQ ID NO: 8690 - protein, 217 aa, Actinoplanes utahensis
MADVVRDREQLFARVVPLLGSGRRVLIGIAGPPGAGKSTLAAWLQARVTERFGADPLLVAQVPMDGFHLSNAVLAERGLRDRKGAPETFDRDGFADLLCRARDAQDEIGAPAYSRELHEPVPDAHRIPASVRLIISEGNYLLLPDDGWDRVGECLDEIWYLDVPWEVTRQRLVDRQVAGGRTPEAAAAWVDGNDKRNTGLVVAAAGRAAVIVSPARR

SEQ ID NO: 8691 - protein, 335 aa, Actinoplanes utahensis
MLRKLGFLTIGLFDEVDPRRGHESTLEIIELGERLGFDSAWLRHRHLQFGISSPVAVLAAASQRTSRIDLGTAVIPLGWENPLRLAEDLATVDLLSGGRLHPGISVGPPMNYDRVKDALYPDTAAAEDFSYSRVERLLAFVRGEQATDLRGAIGFEQFSDRVQPHSPGLASRMWYGGGSLRSARWAGEHGINFLTSSVVKAEESEDFAEIQLSHVRAFRAAHPDGDRARVSQGLVVIPTDSATAEQRARYAAYAEQRTPRTTTPQGPARMMFAPDIVGTSAEIAERLEAHAAFREIDEVAFALPFTFGHDDYVQILTDMAERLGPALGWKPASAG

SEQ ID NO: 8692 - protein, 286 aa, Actinoplanes utahensis
MSRPRTRAYLIAAAAAAVLAAGAAVAVAHDRAPDPVAGQWVAPAAAALRPSPTASAKPLPAAKPPAGLPVIEYASGPSGLPADPEQNSTVAPTRALHPTTRIALYDAPGGKPRAYLPPDISGLRTVVPIVEQRDGWVAVLVPSVNRRIGWVPVGSGETVTLRDQLVAQLSEHALIWLRDGQEQQRWTVATGSKATPTPVGRTYVMGTTPLKGDIYLNMGALVLGSVPEQPEKMAAVFQLAHTGIHAWYNKSAFGHSVSNGCLRMPKAAQQKLLDEIPPGTTLTVLS

SEQ ID NO: 8693 - protein, 379 aa, Actinoplanes utahensis
MTDLRTRKPPVATDETVAVDAILDITDDRGWLRADGYLPGPSDLPVAVPDLRRLGLRRGDRVTGFARISRPGKPVTLQLTAVNGRPPGARPDFYQLTALYPQQRLRLETDREVLATRVIDLVMPIGKGQRALIVAPPKAGKTTILHQIANAITRNHPECHLMAVLVDERPEEVTDWQRTTKAEICAATFDRPPQHHTAVAELAVERAKRLAELGEDVVVLLDSITRLGRAYNLTAPAGRGRTLSGGLDSTALQPPKRLLGAARNIEGGGSLTIIATALVENGSTLDTFLFEEYKGTGNAELKLDRTLAESRVFPAIDVAGSGTRHDELLVSPAELTVLGQLRRALTGADRRDTMQQLLTQLGTTPTNTDLLRRVAHSLS

SEQ ID NO: 8694 - protein, 293 aa, Actinoplanes utahensis
MAEEHDIGGSTVRRLQVGAHLRALRLAGGLSREKAGYVIRASESKISRMELGRVGFKERDIVDLLKLYGVTDRSEHERLVALAREASAPSWWHSYADVLDTWFQNYLDLEQAAELIRTYEVQFVPGLLQTDAYARAVIRLGHGHADSSTVERRASLRMQRQKVLRRPDGPRLWAVLDEAVLRRPIGGRAVLREQIATLIETCRSPNVRLQVVPFESGGHAAAGGAFSILRFPHEELPDVVYIEHLTSALYLDRRDEVDHYAAAIGRLFIEAEPPAETPEILTRILRELDTGKI

SEQ ID NO: 8695 - protein, 291 aa, Actinoplanes utahensis
MHTRRIVVGYDGSVEARKAARWALDEAERGGVPVELVYAYEWPSYVPAAAMMPAAAVYPDLDTDLAVADMLGRAVDAATSSHPGVPVRARVEHATAAVALIQRAAEASLVVLGGRRPTGVRAWLGSTSGSVSAHARCPVVVVRGEPRETDPVVAGVDDSEAAGPVLGFAFEQAVVRGVPVRAVHGWSPPDGRDLLCDTNLRAIADERGRLEAMVECWRRRYPRVPVSAEVVVGSPGEVLAQAAAGAQLVVAGARARRALRVALRPSVGRHLLHRARCSVALVTRSRAVIRF

SEQ ID NO: 8696 - protein, 335 aa, Actinoplanes utahensis
MAVKAEYLWVDGTQPTAKLRSKTRILADGAEPPIWGFDGSSTNQAPGDKSDCVLRPVFTCPDPIRGGDNIIVLCEVELIDGTPHPTNTRAACVASAEKYADQEPIFGIEQEYTFFKDGRPLGFPAGGGFPAPQGGYYCGVGADEVFGRDIVEAHMDACLTAGLHLSGINAEVMPGQWEFQIGPVAAPQVADELWVARWLLYRIAEDFGISATLDPKPVKGDWNGAGAHTNFSTNAMRDNYAAIITAAESLGKRRQEHVDGYGAGIEHRLTGLHETAPWTEYSYGVSDRGASVRIPWQVEKDGKGYLEDRRPNANVDPYVVTRLLIDTCCAALAQA

SEQ ID NO: 8697 - protein, 129 aa, Actinoplanes utahensis
MGRAGFPGQGKVRRSMASFEARTAAAPDHVTVFLAGDCDLAARDRLTAALLDAVPRAGEVFVDVSGVGFLDSTGVHALVTAHHAARGRGGRLYVVGAAGSVAAVLEMTGLDALLKAPGGSTAEDGRRHA

SEQ ID NO: 8698 - protein, 124 aa, Actinoplanes utahensis
MPDIDSMSYTEPDDLRTVRVFVAERARALGLPAARIELLTLAVSELTTNTLQHTGGGGHIRVWAEDGRLVCDVVDGGGPRPFGRTMPSAEAIRGRGLAIVERVCDAVYTTAVPGGTMVRICLNL

SEQ ID NO: 8699 - protein, 499 aa, Actinoplanes utahensis
MAVDDVVRELLAAIPAGCTWLVPVTGPDGAIIDFRVAATSDQIHDIYGRGAQRVDGLLAELYPSMVDGPLWRLYVEVLTTGTPATMDEFRFEQSRPGVVADSRFEISVYPVLGGLLVWWARVDEHRRRLESTELLGSLGWAEHELATGGNEWSPGMYRIFERDPADGPLSRVEQAAAMLAEDRGIAEAAWQTLDVGATSDVTVRFRIGDRVKHLRILSDLAHDAAGRPVKIYAVVQDVTARVASRTEIERLSDQVRVGELTALAEHRLARQLQQMIQPVPAGPFRLGDLEAMVGYQPAESAVQVGGDWYCAQTLPDGRVVLAVGDVAGHGMEAASGMAHLRFALVGWLSVGIRDPGLLLRHLNRLCAQLGITGTAVVGVYDPGTGRLPWARAGHMAPMLGRGGRAVDLERPPGLLLGAEADTEFPVADAELRPGDLILFYTDGLVERRGDATRRTTEVRDRLSAVSAAPGPDPLPHIHRLLYAPSADDDTCTLAVLVRD

SEQ ID NO: 8700 - protein, 59 aa, Actinoplanes utahensis
MSRSIGEAAGGSTSIAGSITAVASAAHATTSALGEADASMSELTRVAGELRDVVARFRV

SEQ ID NO: 8701 - protein, 151 aa, Actinoplanes utahensis
MPHTSTTALTFSDAEAGLTWPMGDWAAALEPPTVLIADDDEGIRDLVGTKLRAAGYRTLIAADGRTAMALAVGERPSLVLLDVCMPGLDGLGFCYELHSSPETAHIPVIFISGRAEPDDIALGRVVGAEDYLVKPIDPADLLERVQRLLGH

SEQ ID NO: 8702 - protein, 325 aa, Actinoplanes utahensis
MGAIGLRTPPQIRLGLPKPIREATLTPTAAPSTEALPFRFFPVEVRRVTRLSPSFLRVTFTGDDLDRFAANGLDQRCKLIPPLPGSGLDHLPTGDDWFAAWRTLPDEHRNPIRTYTVRAVRPLLAEVDIDMVLHGETGPASRWAVTAAPGSIACLLGPNADFPGVHGGIDFHPPVGTSRVLLAGDETAVPAIAAILAALPATTCGDAVLEVPVTGDELPLTAPEGVRITWLPRDGAAHGAKLVPAVQAVIGVNGVTGAELEDVDVDADMLWEVPDGSAATDGFYAWLAGEAAVIRTLRRHLVTTCGVDRRAVAFMGYWRLGRAEC

SEQ ID NO: 8703 - protein, 335 aa, Actinoplanes utahensis
MTVATGLPRVPIMTAESRDLIWRPLAVSDAAAMADLFNAIDDEDHVWGQYTEQDAAEELDSPVDDLPTSTLAVFDGATMLGFSAVHYKPAAQVVHRVHAAGAVRPTHRRQGLGTRLMQHGLATAKALHARHHPTLQLVVESVYGEHVHGAVALYRAAGMTSTKWSRHMRHPLGTAIPDAPIPDGLHIESYTAETDEEFRTVRNDAAQALGRSPLSAEEWKVWAVNANFRPELSFLLRDVETGTAAGIVLIVSWEAETAATGVRDAYFRVIATRPAYEERGVAEALISHTLRAAQDQGYGRASLRGDADSSSKEFTMYERAGFITQDTQVHYCIEL

SEQ ID NO: 8704 - protein, 310 aa, Actinoplanes utahensis
MSFFANAETFAGQVVADYPGGRPDATAWSVAWHDDEMDQEGVLSDGFRDMFEGFVADRGATTETLVIGAWGYAAFRPAPIRQLVDAAPRLPRLRALFLGDITGDECEVSWMKVGDVSPLLTAFPALRALQVRGGEDFRFSPVRNDSLRRLVVESGGLGSAFTTAVLASSFPELTDLELWLGTSEYGGDTSLADLRPLLDGTLFPRLRRLGLRNAESADEIAVALAQAPVVARLESLDLSMGTLGDTGATALLAGQPLTHLRRLDLRHHYMSAEVAAAVVGALPGVEVDIDDPQEDDVFDDVAYRYTAVSE

SEQ ID NO: 8705 - protein, 648 aa, Actinoplanes utahensis
MGTAPVAGELHLRRAPRVLRRFPAHPRAPTLRGRLPRQREHRAGHLGLRRARPAHRARPARLSHALPGRRRLLQPAHRTRLGAARAVHRGALGAVVRGDRSRLPRRSARPARDLAGRGPARAAGLHVPQRRRDAPTEPALRRARGGHRGQPRCRARIRRRAAAPAVRAGAGTRTAGVHHPLLRPRHGVRRGRPHRSPHRSRGGVDGAVRGLHPPGGVMIDGSPYQGYLYAYPHKTSYRPLDPRPALADVWRDEPRDALFLYVHVPFCEMRCGFCNLFTRTGAPAEQVTAYLRQLRHQASRVALDGAVFARAAIGGGTPTYLEADELAALFDICTTVMGARLPGIPLSVETSPATATPDRLAVLTGYGTTRVSIGVQSFLDAEAHAAGRPQRRADVERALAAIRDARVPVLNLDLIYGIDGQTADTWRQSLDAALAWRPEEIFLYPLYVRPLTGLGRRAATRDDWDAQRLALYRQGRDTLLAAGYRQESMRQFRLPAAADDGPDYSCQDDGMIGLGCGARSYTRDLHYSFDYAVSVTEVRAVLDDYLSRPPADFAYAEVGFALSPAEQRRRWLIKSLLRADGVDISAYRRRFGADPVADFPQLAVLSDTGLTHPGTLRLTPAGLERSDAIGPWLTSAQVRTAMAGYHLR

SEQ ID NO: 8706 - protein, 444 aa, Actinoplanes utahensis
MAHLSPGPHRHGRIPPPMTAPPRASGLVRPPAAGRSPAPAPEAVPPTRDAAPFPGLDGAPPPSAGAAPSPASGGDPSASLGLASAPAAASGLPSAPAAAPRLPSAPAAAPRLPSASAVAAGSAPVTLLPLPTVRRPAEPAGDLAPLPPTLTVLYRGPLASCNYDCPYCPFAKHHDPPALLRRDRTALERFTAWAAATTETRLSILFTPWGEALTRSWYRDTMITLSHLPHVDRVAIQTNLAARPDWLTAAKPDALALWTTYHPGQVTRARFLSRCTSLLRLGIRFSVGIVGFPEHLTEARALRAALPPEIYLWVNAAEGKHYTPDEEADWTAIDPLFGYSVRPHASLNQPCHTGESVISVLGDGTVRRCHFITTPIGNLYDNSWRAALRPRPCTTTICDCHIGYVHLKPLDLHTTFAGGLLERIPATWPAAPTTNNAGHPRRPN

SEQ ID NO: 8707 - protein, 145 aa, Actinoplanes utahensis
MRISDILRVKGTGVVTVPPDLSVEGLIAKLAHHRIGAAIVSRDGTAVAGIVSERDIVRALASHGPSVLTDPVSSIQTTQVRTVSPDAQLEDVERLMTDNRFRHVPVVQNGHLTGIVSIGDVVKNRIDELETERTTLADYITGDRT

SEQ ID NO: 8708 - protein, 215 aa, Actinoplanes utahensis
MRAWRITSSMRTFELAEMLREVPGTEVTAGPGLVTVHIPAIGDTLRIAFRDVLDADWVHVPTGEPAVQVDLRRGHQSLPLIITVDDVVFTPSYADDLVDPEDHLLVPAMPSLIAYSEMHRDVRALGKALDDPRVQLADEVLAATLTAHRCFLAGAMRVGLWPVRVAAWWEYTSARSAGQVRVARFLPDPRWDELMHGVQEARQTQFEQENLRVIR

SEQ ID NO: 8709 - protein, 446 aa, Actinoplanes utahensis
MTVPRRLHLNAFLMSVGHHEAAWRLPETDPHADIDVEHFKNLARIAERGKLDSVFLADGPVLWNQVGRRPSGVLEPTVLLTALAGATERIGLIATASTTYNEPYNLARRFASLDIISGGRAGWNIVTTADLDAARNFNLDHLPAHRERYERAAEFVDVSLKLWDSWADDAVLADKENGVWGDADKIYPAAHEGHFYKVAGALNVPRSAQGHPVLVQAGSSESGRTFAAKYAEAVFTAHQTLADAQEFYDDLKRRAAEFGRDPDHIKILPGIVPVIAATSAEAQAKEAELNRLIKPEYALPQLAGLLGVPVASLRLDEQLPAELPDEDEIEGAKSRRTLVVNLGRRENLTVREIIARMGGGRGHLTFAGTAVEVADEIEHWFASGAADGFNIMPPVLPSSLSDFVEQVVPILQDRGLFRTEYTGRTLREHYGLPRPVNRNAAHPVLI

SEQ ID NO: 8710 - protein, 298 aa, Actinoplanes utahensis
MSIDITRIGGRIGASITGIDLKQPVAQDDARAIHEALVAHKVLVFRDQHLDDEQHQRFAALFGDLTLAHPTVPSVDGQANVLEVAGGPGARANAWHTDVTFVVAPPKATTLRSLVIPEHGGDTLFANTAAAYADLPEHLRVLADRLWAEHSNEYDYAEHPQFRSTEVEKYHEVFVSTRYRTAHPVVRVNPDSGVPNLFIGNFVTGIIGLSRTEARDILRLLQHYVTRPENTLRHKWQVGDLVVWDNRSTQHYAADDYGDLARKLHRVTVAGDVPVGVDGTKSYILEGDEATHYTPKVQ

SEQ ID NO: 8711 - protein, 276 aa, Actinoplanes utahensis
MSSSTLIFPSAATSAVTAPPVGRRVVRLLSSVVTRTAAIVVLALIWEISPRLGLVDRTFLPPLSEVLVAWWDLVKSGELLEHTEASLTRSLAGFGLAIVISIPLGLLIGWYKPVANLLTPLLEVFRNTAALAILPVFVLILGLGETSKIAIIVYACAWPILLNTVSGVRTVDPLLIKSARSLGLGPARLFQKVILPAAVPTIFTGIRLAGAYSILILIAAEMVGAKAGLGYLINYAQYNFAVPDMYAGIITISGIGLIVNQILILIERRFSTWRTS

SEQ ID NO: 8712 - protein, 267 aa, Actinoplanes utahensis
MTAKIVFENVGKTFRARGTTVTALQDINLQVQDGEFLVIVGPSGCGKSTLLDLLGGLAEPTSGRILVDGKPVTGPGLDRGVVFQQYALLPWRTAQGNVEFGLEAKNVPRRERASRAREYLDLVGLTGFHDRYPHELSGGMKQRVAIARSLAFDPDVLLMDEPFAALDAQTRDGLQDELLKIWEKTGKTVVFITHGIEEAVYLGQRVAVLTSRPGRIKDVVEVPIQARSATEDLRSDPQFAHYRHEIWSLLRDEVSKARTEELEATRV

SEQ ID NO: 8713 - protein, 340 aa, Actinoplanes utahensis
MTTRRNALAGLLGGAFLTATGVAACGSSGGSASGSQVKELRYQGNVGQVTLPELAADLGYLGDVKLKWIGNTISGPQDIQAATTGDVDFGGAFNGAIVKLAANGAPITAVIGYYGVDKDTYTGYYVLDGSPIKTARDLIGKKIGVNTLGAHHEAVIKTYLAKNNLTDAEIKQVELIVVPPVNTEQSVRQSQIDAGALGGVLRDKALTRGGIHPLFTDFELLGKFTAGSYIFRNDFLKKNPDTVKTFVTGVGKAIEWARSTPKDQVIAKFQEIVGKRGRNEDNSALQFFKSYGVAGTAGAITDTEFQTWIDWLSRAGELKKSIKPADIYTNRYNGNAGGAA

SEQ ID NO: 8714 - protein, 332 aa, Actinoplanes utahensis
MVFKKLLGAMGVGGPSVDTVLANPSTYPGAPLTGQVNLTGGTQVADIEHITLALVTRMEVEGGGHDYSTTGDFYRLTVSGPTRIHPGQQMSIPFRIDMPWETPITTAYGQPLRGMVMGVRTEVSIARALDKGDLDPVYVHPLPIHQKILDAFGQLGFRFKSADLEYGQIYGVHQTLPFYQEIEYWPAAQYAHAVNEVELTFVTSPHAVEVVLEFDKRGGLFHSGHDTYGRYTVSHHDAETTDWRSVVDGWVRQAVDKHRSRPGYGGHAAYGAPGYPPPPPGYGHHGGHHGHHGHYHHGSGMGGSVLGAVGGLAAGFVIGEAVEEIFDFGDDD

SEQ ID NO: 8715 - protein, 109 aa, Actinoplanes utahensis
MVYDLAEVTVTHEPGHPDEVVAGQPSTGAVSVTTLDGPGVEIGIWEMTVGAVRDTEAEEAFLVLSGRATIATGGETYEVKPGDLVRLTAGTPTVWRVTEPIRKLYITGR

SEQ ID NO: 8716 - protein, 329 aa, Actinoplanes utahensis
MTKTPVTVTVTGAAGQIGYALLFRIASGHLLGADVPVRLRLLEIPAAAKAAQGTALELDDCAFPLLSSVDVFDDPKAAFDGVNVALLVGARPRTKGMERGDLLEANGGIFGPQGAAINAGAASDVRVLVVGNPANTNALIAQQNAPDVPADRFTAMTRLDHNRALAQLAAKLQVPVADLRKVTIWGNHSATQYPDVFHAEAAGRPVKDLVDQAWLADEFIPRVAKRGAEIIEVRGASSAASAASAALDHVHTWVNGTAEGDWTSAAIVSDGSYGVPAGLISSFPVTAKDGKWEIVQGLEISEFSRARIDASVAELQEERAAVQGLGLIK

SEQ ID NO: 8717 - protein, 153 aa, Actinoplanes utahensis
MAILAPPYRPLSPGFPPLDPARGDGGATIAVTMRFAPLAFLLGFFTPVLEIDGRNVPATWGRVSTPVALGEHHVHVHVPSLLPSRLGAAETTVVALPGRTAELEYRAPMLAFLRGALGPPPQRYPGMALAVALLVAATTAVICGCFGLLTSGH

SEQ ID NO: 8718 - protein, 137 aa, Actinoplanes utahensis
MTVQIWRTVTVGAAAALVTGLCLTVAELGREDSGPVWVQGTEASSEPVTPGAAPPVTHLPVRSAARTTRPGTTTLPDRDDAAAIDGDEAKGEDGSGSDPRFTTCAEATTKGFGPYVQGADPEYDWYPDPDNDGTVCE

SEQ ID NO: 8719 - protein, 1042 aa, Actinoplanes utahensis
MPQRGRGDARLDQLPAGEEPGESLRVARHQRRAGPVVDVGDPAHRLRGVPAAGVREHQQAAGRGRGVVAVQGGVEHRAVGQEVQHRQHQDRHRATGIDHPQPRVAEHRRGIAQVGLDDHGPRIVAEQVAGVEHGGRVVVDVHDPGFRVRPQSDLVGVSLGGDAGAEVDELADAARRRVADGAVRERPVGPGDGADLGDQLGDPGGDRPVHREVVRAAQEHVIHPGGTGPVRIDAHAPKVARIEGINATLVREGTGVESRNELPGLLIDTAPDAIIVSRADGVVTIANRRAHEMFGYPPGALPGIPFDELVPGNGRDGCGTPMRRIPLLGVRRDGRTFPVEVSLSWTPAGTGGTYAIAVLRDDTTQRQTAATRALLASIVQSSHDAIVTVGLDDRVLSWNPGAEMLYGFKAEEMIGVDVDEIIPPDRREDEAQIRRLVRLGARVDRYRSLRLTASGQPIAVAMLVSPLFDEHGTLVGTTGTARDITERERAEARVQAILDAAPDAMLGVTEDGRVVLVNAEAERLFGHPRHDLIHSDVSRLLPDGLPPISAMLRTGGGAAPLDPVRAGGAVSREPERAGGAVSREPERAGGAVSREPERAGGGEQRWAKRRAVRSDGAELPVDIAVSALHTDTGMIVVAAVRDITERLAIEAERRRLREETDRQRLEARMQQAQRLESLGQLAGGIAHDFNNLLAVILNYAAFIIEDAAGSAPAADAEQIARAARRGSDLTHQLLAFARREVIRPRPLDLNAVVTEVHQMLERSLGEHITLTVRTAEALPAVMADPGQLEQVLVNLAVNARDAMPTGGRLTIDTAEVSVDEEHSAARAGLSPGRYLRLRVSDTGTGMPQEVIDKAFEPFFTTKPSGQGTGLGLATVYGIVTQAGGTVQIYSEPGIGTTFTILLPVTDVRAQAAAAEETGAELTGHGATVLVVEDEAALREVTCRILQRGGYTVLAASGGAEALRLVDEHPIDVLLTDVIMPGMLGRDLAEAVTARHPGTRVLFMSGYAQPVLTDHGTLSAEMHLLEKPFTSAELMRALHDELQ

SEQ ID NO: 8720 - protein, 176 aa, Actinoplanes utahensis
MSLQTHRSHTRAVAHRPVLAPHLQETIESLAAGETAREMAARLYLSPNTVKSRLRTLYQQLGARDQAHAVAIGFRLGVLRAPGAAEPDDDRQPVVIGSLNPDSLREIIAELTALLRIVERVRPLPGGHLPDLLRRVGELATSPHDDPRGVLARIAQIAAEAGFTAEGPGAEPPSRR

SEQ ID NO: 8721 - protein, 182 aa, Actinoplanes utahensis
MPDIVEIIKAQHQQVDALLSQAAEEDADQLGLLQEVARMLLPHSEAEESFVYPTIRDKAAETGEEVADGVEEHHQIEEMLKNLLDGSPDDPGWDGTLAAITGELRHHVQEEEEELLPVLAERLSAEEREELGRRFQEATQGTPPAGGHEETRRELYEKAKEQDIPGRSKMTKDELAKAVGEG

SEQ ID NO: 8722 - protein, 100 aa, Actinoplanes utahensis
MSAFRMFRATAIAEAFSWTGLLIGMYLKHVSHTTDAGVWLFGRIHGALFVAYLAATLWTARTERWSLWRTAFALGASIPPLATLLFERWLTRRRPTPLPA

SEQ ID NO: 8723 - protein, 238 aa, Actinoplanes utahensis
MPQIAIGGSGWRAPFWLYTVALLLAVPMVPLIRQPARPASAPAGRELPPLPWRRLRTPCLVTLAGGVVFYALIVELSFVLDGVGVQQAATIGALSALMSLATAVAAGSFARLSGRTPRRLLPIAFGLAAAGFLLIAATPRVPVITAGAVLTGAGTGLLLPTLLTWATNNLGFEERGRGTGLWTGTLFVGEFFSPLLTSGLSAAAGGLRPALGVATAVLAATMPLIVPRTAGALNVTRD

SEQ ID NO: 8724 - protein, 185 aa, Actinoplanes utahensis
MSAEAARAAELLTQLSHPARLRAFAGLVGRGSEGFSIAEMSFLLDMSKPEAGEALGRLAALGLASGTGDGYYRATPQVLRDAAQALVATLPIAPLLREYPQLKGYFTHGFLTSLPPTLSERYEQIGELLARFLAVEGVLTEDEVNRRIAVVAEDVAAVRRMLVETGWLERDRAGTAYGAGRVYVG

SEQ ID NO: 8725 - protein, 654 aa, Actinoplanes utahensis
MVPSYVIDMLGAMSPISRRALLGAAAAAGGGAALGPAALPSLPAQAAGSLDQVQHVIIFMQENRSFDHYFGKLSGVRGFADTSLLRFPSGSDVWHQKRATGTVLLPWRLDTTKTDAQRISDLDHSWSGTHSAWNSGKYDNWIPAKTEKTMGYYTRADIPWQYALADAFTICDQYHCSVQGPTNPNRLYQWSCTIDPNGGHGGPVTDNTEAGYSWTTYPERLQKAGVSWRVYQEADNYDDNPLAWFTQFRNAATTSPLYQRGLLKAASALGAFTADLAAGTLPQVSWVVAPAAKSEHPQYPPAYGADFVQGFLSALAAYPDVWAGTVMFLNFDENDGFFDHVAPPVPPAGTADEFIGGNPIGLGPRVPMTVISPWSTGGRVCSEVFDHTSPIRFVELWTGVRETNISAWRRTVCGDLTSAFDFTSKVTTFPSLPDTAALVAACTQQDSLPDATAPTSSTLPGQETGDRPANPIGYRLTTTSWTDTATNRFWFKTVNSGSIGAGLTAYTVNFRKYQTWQYTAAAGATVSDYFSALTYGGGPYDVDLHGPDGYLRGFTGDVRTWTNTTKAHPEASVVEDGAMGLTLTLTNQGTVATTFTIGNNQVYGASSGPVRTVTVAAGGSSTLTLSTLAGRYDYTVTASVGDGFGRRFAGRVYR

SEQ ID NO: 8726 - protein, 370 aa, Actinoplanes utahensis
MLTATVFTDAPDRPLLLLGSSVGTSAETLWADCASRLYGRYHVVGFDLPGHGRSAPSDAPFTIPDLARAVLDLADRLRPGESFRFGGDSIGGAIGLQLLLDAPERVTAAVLLCTGARIGQPEAWHERAALVRAEGVEAVVAGSDDRWFGAGFPAAGREPLLRALRATDAESYARCCEALARFDVRHRLAEIATPVLAVAGGQDRPTPADGLRLIADGVLHGRLVILDGVAHLAPAESPEVVAFLLDQHFDELRAAGSTVRREVLGAAHVDRATAGTTAFTRDFQDLITRYAWGEIWTRPGLDRRSRSVVTLTALVALGHHEELAMHVRAAHTNGLTVDEIKEVLLQTAIYCGVPAANTAFRIAQRVLDEI

SEQ ID NO: 8727 - protein, 367 aa, Actinoplanes utahensis
MGDLLWPGDHRAGDLLTDAAVVTVMIRVEHAWLTALAETGLARITVPAPDELAGLVTPDDLPALARDAESGGNPLIPLLKLLRARLRGRNTAAAGWLHKGLTSQDVVDTAIVLGLREAVARVRGALLAQTGALSRLADEHRETRMAGRTLTQHAVPITFGLKAAGWLTGVLAARELGLPQRFPWQTSRAPLTRVADAFVTCTDAWGRIANDVLVGSRPEIHELIEGGAEGKGGSSAMPNKRNPVHAVLIKRAALAGPPLAALIHAGAAAAVDERPDGGWHVEWSTLRTLARHTVTAGAQTAELLAGLRVDTGRMLATLHDARPEIDAEQQSITPGVAPDQPYLGATDAIIDAALARATAAPEKGLSC

SEQ ID NO: 8728 - protein, 187 aa, Actinoplanes utahensis
MTAAPGQTVGPFFHLGLEYPGMNELVPPAHPRAVRLHGRVTDGAGEPVPDAMIEIWQADPQGHVVRQPGSLRRDGWTFTGWGRAATDPDGRYRFATVEPGRTTPERPAFFAVTVFARGLLDRLFTRAYLPDDPAALAADPLLAAVDPARRDTLIARRDEQGLIFDVRLQGAGETVFVTYPRLRDAWA

SEQ ID NO: 8729 - protein, 248 aa, Actinoplanes utahensis
MNTQADISQEIEAAARQSSGPQPRIDYPPYRSSVLRHPQQPPQPIDPESVELWAPAFGHRDVADDEADLTIQHAGTPLGERIVVTGRVLDGDGRPVAHQLVEVWQANAAGRYRHQRDQHPAPHDPNFTGVGRCLTDADGNYRFQTIKPGPYPWRNHRNAWRPAHIHFSLFGTEFTQRVVTQMYFPGDPLCALDPIYQSITDPKSRELLIARYDHDLTTPEWSLGYRWDIVLTGSHRTPLDTLDPEDHA

SEQ ID NO: 8730 - protein, 246 aa, Actinoplanes utahensis
MARSVTGRALDLLGAFDAEHRSLTLSDLARRSGTPLTTAHRLVAELRTWGALSREPTGEYVIGRRVWQLGLLAPVQSELRTAAGPFLHDLYGATLATVHLAVRDGLEVLYVDRLGGHESVPVISKIGSRLPLHATGVGKVLLAYAPDDVLGAALQKLTRVTAYTVTQPARLLEQLRRVRADGYATTGEEMSPGACSVAVPVRNGDDVVAALGMVVPDLRRQLPRMVSALQVAARGIGRTLTSVQWK

SEQ ID NO: 8731 - protein, 389 aa, Actinoplanes utahensis
MRTQVAIIGAGPAGLLLSHLLALGGIDSVVLETRSEEYVAARIRAGILEHSSVELLESVGLGARLRAEGDEHRGIHLQWPHERHHLDFVNLTGRSVWVYGQTEVQKDLIAARRAAGQEIHYEVTEVRLHDVDADRPFVTFSDRSGRSVRLDAAVIAGCDGSFGPSRAAVPAAKTFEKVYPYSWLGILADVAPSTDELIYAWHPHGFALHSMRSATVSRLYLQVPTGTDPASWSDDRIWDELATRLGHGQNGWKLHPGPITDKSVLPMRSYVQTPMRYGNLFLAGDAAHIVPPTGAKGLNLAIADVALLGRALVALLGERNPTLADAYSEAAQRRVWRCTHFSWWMTTMLHTSGDGFDAELQLSQLRWVTSSEAGATGLAENYAGLPITY

SEQ ID NO: 8732 - protein, 538 aa, Actinoplanes utahensis
MGWLGEWLGGLPPVLVYAVVGALVAGEAAIIAGMVLPSATALIATGLLANAGVVPVLPALLVAIGAALLGGTVAYRRAARTTGATPPARTGRHWARAERLFARYGGRAIFLGQWVVGARTLMPRLAGRNGVPYRRFALWHTPSAILWALWMVGASYLAGAGYQALAARAGRAAGALAALTLIIVGLLLVGRWLGRHPFPVHAPGRLSLIRRTVARWHPAVLAAVSLALFTGLALVLIEVIPPIVRFSGLAAADDSVTTWARGQWTSDGYWFALSTAGTLAPEVPLTFAVVVALIRFAWRRRPDGLRHGLLPAVMYLAELPSRARSLRRPRGPEPGASQPGASQPGGSPPGVSRPGGLRARGLLRGSFWAALFEAVGPVLPAIVLAVALSLLLDPGWRTAGTIVFPSPTEFDGGGLPLDTAPSILAGMAAGSTAQTAAAIGLLAWLLTDNLRWGWQVTVWTVAAGTLTTAAGCWVYLGWGRLSETVAAVVIGAAWAALNAAIWTARYRSAERPVLDEADQVALAVPDEGLDLLGADRPE

SEQ ID NO: 8733 - protein, 126 aa, Actinoplanes utahensis
MAYRPMTMVDLAGHLRRQQADKVRWKHLWEFLEEYRWEAPESRPALLRDEPAPCGDPQWDALLAALAEQLAAQLDLAPPEWSRPRVLVTPWFPSSLPSKRMEALVSAPAAFRKHGVYLSARDLEAA

SEQ ID NO: 8734 - protein, 723 aa, Actinoplanes utahensis
MPEGIIERQLDVGLVRLNDDLAQGAPLAHPGQCLGRLLQRKRAVDVDVELAAGAQVGHRAEMVRSLFDGEHTQPATGEPAGDRAGRQHAQQRRHRAAPGTGTGSSSSLSTAGGPYRSYTTARIRTRPTSRLVARADKLSDRTGHGHLVTAAVLGLVEGVVGAGHQLVEGVAVGAESGHADADRHADPSTAGGHRLGGDGLAGPLHRRDIGAVAVGPDDRELFTAVTAEHVGVPDGVLDTLGNGADHVVADAVTVPVVDVLELVDVDHRGAERAPPANWQNRRMGAPELVLVLRYRKAVTYGFHALLGALGEHDSPTRYEVRFGETPEQTARHIREAGDTRVLVLWSFYSPDAAALAEELEQIRALADGPHVTHLAGGVHATAEPVQTLDAGWDVAAVGEGESTLISLVDAKGDPAGITGLAYRDTAGNLVRTGKAKQRPLDDFPGFALRWDRFNALEITRGCVYACRFCQTPFMFSARFRHRSVDNVRWHVDQMRARGLRDVRFITPTALSYGSQNEDPNLAAVEELLATCREGIGPRGRVYFGSFPSEIRPEHVTRETLRLVKKYCDNNNIIVGAQSGSDRVLDAAKRGHGVEEVKRAARLGIEEGFRINVDMIFGMPGESRDDVEDSLRLARELADLGARIHAHTFMPLPGTPWRDAPPGDVDPATIREVDRLSRRGALYGHWQKQRDHAARLAAAAQAYPRPGRSRTMLTVHDIRHQDSP

SEQ ID NO: 8735 - protein, 255 aa, Actinoplanes utahensis
MSPRRLLAATALLLLAGCDGSAQAKPPQTPPPTVTAGRSAPPTRAPAPKPRITYPATGSRKFAVASGEAAAPAGDRKGRLLRYHVLVERDIKGVTASEFATAVTTTLRDPRSWTAGGQWRLQRVGPEQKADFAVRLVTPATRDRLCEGATDGYTSCRTHDEVVINVARWAKGVPHYGASLAVYREYVINHEVGHRLGQAHELCPGRGRPAPVMQQQTLGLHGCTPSAWPFLNGVRNRGRIGAYDDPVPPRDRGLS

SEQ ID NO: 8736 - protein, 537 aa, Actinoplanes utahensis
MPVGAAHASGWPVPVDVPVRTEPFPHGPFGRYEPPPTPWQTFRAKYWPGPTATRGRAVPAGVLAGALGFAFLLPLNRSGIGWFLGFLVLALGIVGAIRRSAELPVYERWIRSGWALATLALLLVPAFRNAWWLVTFSILGALGCATLAIVGGRQVRSILFGLVATPYAAISGLPWVRRHLRASRNPGIARRIGFSAVLTILVLLVFGALLSSADVAFSTLLGKAVPEINVGSVFRWVFLAVVGGLIAVAGIYTLSAPPVTSSMDRPGHGRFGLVEWAPAAGALVLLFGGFVAVQFTVMFGGSRHVLETAGLSYAQYARSGFWQLVAVTLLSLVVLAALARWAKRDDPRDRLLLRVLLGLICGLSVVIVASALSRMWAYQKVYSFTGERIFVMSLEILLGTIFVMVAAAGIRWQGRWIPRATVGLAVLMLLGLAVLDPEGYAASRNATRYAETGKIDAWYLRALSADATPALTRLPDPVRRCTLSWIAQDLSRPDPWYAWNLGRARARKALADLGKDAVGDHVDCRRADQFDLPKKRR

SEQ ID NO: 8737 - protein, 157 aa, Actinoplanes utahensis
MRCATASRLSVAVTPSTSLVPRITSRIRAVRAERFRSSVDICGAEPLCCADRPIEEGAVADLPPEQRDPAEPTPAPQLLVMPPTEAIPSMVWPDGGPAWAIPVQIPSGTRGYALFVPMVPAQPSTPVAVAAPASPQRTAPAAGAGPGVVADRPGPAS

SEQ ID NO: 8738 - protein, 270 aa, Actinoplanes utahensis
MARVTSTTCVDHPMTREPYYVQSLERGLAVIRAFDAEHRELTLSEVARHCGLTRAAARRFLLTLTDLGYVRTDGRLFSLTPRVLELGYAFLGGLTLPEVAEPHMERLVGEVRESSSLSVLDGPDIVYVSRVPTSRIMRVSINVGTRFPAYATSMGRVLLAALPEPDLETYLSGAELKPLTGRTIRTPGELRAELRRVRADGHAVVDQELEEGLRAIAAPIRDRSGAAAGALDISVHAARATVDTIRERLLPPLLAATAAIEADLRIGRQR

SEQ ID NO: 8739 - protein, 592 aa, Actinoplanes utahensis
MRTHLRRNRYAAAFARGPGTGAGGRHGRGLRLGQGLQFLRRIVRGCGHRDRGRHPDRRRRPDLPGPVEGLLQVPQHRAQAGGRPGRRGDHARCGQRPVPVRLLQPDLADDRADQEPADQGGRGRRLVDRCAGQGLRCRGGQGQQPDQDRQGPGGQKDLGQHPEEHRRHGHPRVGAQGRRRPEQAAVRRDAVPEHAGRAGRRPDRRRLGGRAAAHHDQAGRRPGDRLDLRRRRPGPDRRRVLHLAEPDRFQARPGEALHRGDQRVADLRRRPPGPGAPDPRHLHQDRREDPRRRGPAEVAHRDQQGVRADDRRPRYPGRHLQHRSGPGQAPAVTSARRGNPVLLGLAGPAGLVLIVELLPRLGLVNDRFLPPASRIAGALADEVATGAFWQSLGDTLYAWAAGLLIAVAAGVLAGLLIGSVPVLRALTASTVEFLRPIPSVALIPLAVLLYGTRLGSTLLLVCYAAFWQVLVQVLYGVADVDPVAEETARSFRFSAWGRVRHVLWPTALPYVFTGVRLAASVALVLAITAELVIGAPGLGKEIATAQNSDAVPTMYALIVVTGVLGVLINLLTRTGERRLLAWHQSVRGEAGV

SEQ ID NO: 8740 - protein, 270 aa, Actinoplanes utahensis
MAPVGERRGGRLMGVLKKWSLAVILPILLFAGWFWLSDDSRSYYAPPLRQILQAFGDTWTLDRLRTDVAPSLVRLLAGFLLAAVIGVGLGVAIGLNRKLRAVLEPALEFFRAVPPPVLVPVIMLFAGIGNGMKVIVIVSGCVWPILLNTVEGVRATDSVVLDTARAYGVTGPAGLTRVILPSASPQIAAGLRQALSIAIILMVISEMFASSNGLGFTIVQFQRSFAIPEMWSGIILLGLLGFALSLLFRLAERRALRWYEGLRAARRRAG

SEQ ID NO: 8741 - protein, 256 aa, Actinoplanes utahensis
MLEVKGLRKVYRSGGREVEALRDLTFTVEGGDLVCLVGPSGCGKTTLLRCVSGLLTPTAGEVRVGGREVAGPPPGMAVVFQEYGRSLFPWMSVRDNVELPLRQKGVARARRRELVESSLDAVGLGGTATAYPWQLSGGMQQRVAIARAVAYEPETLLMDEPFAAVDAQTRADLEDLVRSLWQRLGVTVLFVTHDIDEAVYLGQRVVMLSSSPTVVQDELVVDLPTDRDQLHTRADPRFIELRAHVYEQIQLAKKNA

SEQ ID NO: 8742 - protein, 533 aa, Actinoplanes utahensis
MRKILAATVAASVGLLVGAGTIPVAAVAHSGHDDGYTPPPIDWGTCTRASLKARNAQCGFLTVPLDYAKPNGTKIKIAVSRINHKSADAQYQGVMLTNPGGPGGSGLGLPVIGESVPDHAGDYYDWIGFDPRGVGSSVPALSCDVNYAGYNRPYYVPVTRSLEKTWLKKAAGYAKACDRAGGALLDHVKTTDSVADMESLRKALGQRQINYYGFSYGTYLGQVYATLHPDRVRRAVFDGVVDPRGVWYDANLDQDIQFDKNMDVYFTWIAKYDAVYHLGVTGKAVKKKYYSVLQQLRKAPAAGKIGPDEWNDIFVSAGYYVYGWRDVADAFAAWVNDKDPSLLLASYSEPGAPGADNNYAMYLATQCSDVKWPTNWSKWQKDNWTIYSRYPFITWNNAWYNAPCTTWGAKPGTPVRINGAKAPSVLLISETDDAATPYSGALQVRKLFPRSVLIEGVGGTTHAGSLSGVACTDDTVAAYLATGALPSRVHGNRSDKQCQPVPQPDPTAVSALSKKSAATADTARDVIRAAVGR

SEQ ID NO: 8743 - protein, 117 aa, Actinoplanes utahensis
MRKVVRFMGCYVALSFSTLGAIVALRDTHYVTDAVGVRASLVALASLISLHLSVRALRGSRGALLRLRIVTAIMLVAIVVIAALPGMFPLWFRLEQVACGLLLLTPVIRINRKPALA

SEQ ID NO: 8744 - protein, 213 aa, Actinoplanes utahensis
MAKRRKVGNLLGLHILATLSIEPMHPYEMAARLKEFGKDQDIKIQWGSLYTVVQNLEKHGFIEAAETVRDGRRPERTVYRLTGNGRAELTDWMRELVGTPAREFPKLQAALSVLGVLPPDEVITLLEQRLATLAMENDRMRADLDGNRAVVPRLFLVEAEYRMAIRDAEVTWLTGLLTEMREGTMAGLAAWRRIHRTGEMPTDLSEFMTITET

SEQ ID NO: 8745 - protein, 315 aa, Actinoplanes utahensis
MSDAVTAQELRKSYPGGVRALDGLTLTVRAGEVFGLLGPNGAGKSSTVKILTTLARPDSGGATVAGHDVLRHPDRVRRTIGVVPQRSALDPMATGKDNLRLQGRLFGVRGGQLTRRVDELLERFGLGEAAGRAVRGWSGGMQRRLDVALALIHRPGVLFLDEPTTGLDPEGRAEMWTEIGRLAADESIAILLTTHYLDEADRLADRLAIVDGGRIVAEGTPESLKGELRGDAVHLQLALPPDEPQARRAIAHVAGLRDIALDGRTLSARADDGAAAVPAALAALESAGIGVATVTVARPSLDDVYLRHAGRRYAA

SEQ ID NO: 8746 - protein, 258 aa, Actinoplanes utahensis
MTTLVTHTWWMTNRRLKVLIKQPAFVVILLIQPAIWLLLFGNLFRKVVELPGFGGGSYLDYIVPGVVAMTAVSSNMWSGMGVLEEIERGTMNRLLTTPVARGAIMNALVVEQALSTAVQVAAIVLLGLAAGASYPGGAAGLVVLLVTALLLGTIFSALSNTVGMLVRQRETIIGINTLLLLPLTFLSSAFMAATLMPSWMRRIAEFNPVNWCLAAARAAMRDTPDWGVVLSRGGWLLALAAVMIFLSTRTFRAYQKSV

SEQ ID NO: 8747 - protein, 188 aa, Actinoplanes utahensis
MVAAVPGPERKRGPAPMTSPAQPAGWYADPSGLPATRWWDGQQWTDHLQPGPAVLPPTAGLGGYYPAAAPSGPLVPGAHTVAPPDPEAAAIFAHSAASAGAAFPAARPVAPGPAGGALPAPPAELVDYAIPPVDSAAPLSGFGMPAPAGDPEKRPAAQHATGLLTHPLLLGTLAVVVLVALIVLTVLR

SEQ ID NO: 8748 - protein, 151 aa, Actinoplanes utahensis
MAEHAAAQRRNWLVALGAAVILLILLALTLSFCDRNGGAGTTAGPATTASSETLPPVSGPASRPASASASPGTLSPKTVTTADDPTTKPSPSHSASPSHRPSSKPDRTPAGGVDAGGGSGLDGRRLALLVGGAFLLLAAVITGRFGFGRAR

SEQ ID NO: 8749 - protein, 207 aa, Actinoplanes utahensis
MIRNRRAAVFSVLLAVLGATVTVLGLITDDALPDPPAVTPAWEDVPAPPAPTRSRTHRSQPTALDIPAIGVHTPITPIGLRGDGTLDVPPLRSDAPAGWYDGSPTPGEPGPAVVVGHVDTARDGAAVFYRLRELKPGDTLTIRRSDRSTVTFTVVKVASYPKKAFPSDEVYGPTGGPALRLITCGGSFDRSRRSYRSNIVIYAVEAA

SEQ ID NO: 8750 - protein, 619 aa, Actinoplanes utahensis
MSTIRRRTALRRTTAGAFALGLALTAVTAQASPAAAHSTSAVPNLGPHVTVFDPSQPIADIQATLDAANAKQVDNEMGTDRYAFLFKPGTYGTAEHPLQVKVGYYTELAGLGANPGDVVINGKVEVYNRCLENGGTSNCLALVNFWRTVGNLTVNINGAGQDGCRGTANFWAVSQAVSLRRTQFTGGTLSLMDYCTAGPQYASGGFIADTRAETIVNGSQQQWLTRNSQVGNWSNGVWNQVFSGVVGAPDESAFPNPPYTTLATTPVSKEKPYLFVDAHGRWQVQVPATQKNTSGVTWASAGRTLPLSDFYIAKPGDSVAKINLALALGKNLLFTPGVYDIDRTIDVWRPNTVVLGLGHATLTAVKGATPVQVEDVPGVTVAGLTIDAGTVRSSALLRVGRGHGFGFTSANNPTSLQDVYFRVGGPHVGKAGTALEVNSDHVLIDHTWVWRADHGVEGFTGGDTERWNTNIGTYGAVINGNDVTATGLFVEHFQKYNTVWNGNGGTTVLYQNELPYDPPTQADWMNGPVQGYAGYKIGNRVKTHHLYGAGVYVFNQNNPTIHTANGFEAPQTPGVHLHHIMTVNLSAGVIDHVVNGVGAAADTTKVGVPVYVNDYPAAP

SEQ ID NO: 8751 - protein, 151 aa, Actinoplanes utahensis
MAAFFSLVAGVVVGLIAGWFIRGRSLGAATAPAVVTPAAATETAPTTSPSVSPTAVSPASVSPASLSSSSVSSTAETAVIEPAAEAGTERFDVAETAVVEPVEAEAEVAEPGAETVVIEAVVVEPVAVEEPAAAAEPAAVDEPIVAAELAS

SEQ ID NO: 8752 - protein, 126 aa, Actinoplanes utahensis
MADEPVATDEPISAEEFIDEPIAEEAEEASPIIEPSEDPAPIDAPAPIEDTIGVPAPVHQPDDLTRIPGIGPKVAMALAAAGITTYAKLADSDVTDLKKAVNAAGMRGSASLATWADKARELTVAG

SEQ ID NO: 8753 - protein, 145 aa, Actinoplanes utahensis
MAAITATATASSTSSDRQAAWTRLQTYRRQLAADLIPVQASPQTINTDRAAVAAAEAEVARIEGVRTVTAGKVASTAVQAESAAIASERSSADSQRSSAAVASSAPVPSRSSAAAPASAPAGSRASADTAAVTGLPYGRSLDVTV

SEQ ID NO: 8754 - protein, 586 aa, Actinoplanes utahensis
MSGRRLAVVVTVEHHDDPVLRRYSVPSADVRGLAAVLADPGLGGFDVEFLQDPETWDVYQRLQAVADNRTPDDCLLVYFRGILLSGPGGGLYLATPDTVMQRPADTAVDVTRLDALIHRSHAGQVVIILDGRTGGPVDAGAYFPAAHAADNRSRVLLTADARPEPPTFAGLLADGLRGGAADRNRDGYTGIDEVIDHLRERDPSVRHWTFGTGRQPYLSKVRKPGSDQMALIAELAAAAAGPDLPQAAQARTTLSRLATGSDRVAAAATAALRRTSLRVPDPQITFGQTLPGGPAQTARVPLTAPPLVATSTVTTTGDGLQAVLDGSHLQVTWRPGRSSLTGSVTIDGPTGVAHLSVTGEVTPETSALPKPGTAPQPGPALPGAAPHPGATSQPGATSQPGAASQPGAASQPGAASQPGAASQPGAASQPGAALHPGAVSHPGATAESGSGAQSGAAARSGQSDATGQGGTALEPTLPAPPPRWAGGNGVRPTSGAPAGQPPFSAPVDPWPDAPTSTTPPRPGRRIRGRPHPPGCPTPALTTGSSARPPHPAPTTRSPARSPLPVPRIRTPTAPRPPARMTRRRVP

SEQ ID NO: 8755 - protein, 757 aa, Actinoplanes utahensis
MTPTLSPAGPWPGDQPSGRGAFYAQQPGFGWQQAPANPSDSAAPPESVGPADSADSATPAEHWTTAAGQAQQSSDPAGPWPGTSDPAGPWPGTAVPGQSWPSRGTPHEQSDRTTVSWEAGSAAAAAGGWPRSTDPATDPAVPHRPESPVPTGPQWPGQAAAADQATPPEPPTWPPPPHPSAAPSTAPASGVGPGGSSSRVSWIGPNDWPSTADTPGHGPTGAPGHGPIGAPGPGRAGIPGAATAGAAGPGQAGIPGAGIAGAAGPGQAGIPGAGIAGAAGPGQAGIPGAGIAGAAGRGPAGPGSPPAPPSGTGPADAPGVSGPHSGSETTAWGGVQSPSGWQQAQTAAPANPAWPTSPAGWPAAPGWQQPGVASPAAGGDPAYANNPPQEKRRLRVAGILVLALLLAAGAYLGIRYAAGRGREQAAPPPTVAQTLTGTPPSGQATGPATTTPAPASLGTPVVLNTIKGVGREPEGVVVSSDSKTLFVADQGAKQVFVVDAASGKAQPVDVPNTPRFLTLSKDGAKLYVSMFENDFSANGLAVIDTAKRSVITSVKTGPRPFQPAVAADGRVWLPIHNGARVEIYDGTTLARLSQISVPPNPHWIAFTPDGSRAFTSDHESSRVSVVDTASLAVLNTITVGRSPHSLAVTPDGGTVVVTNYDVDTVETYDTRTLKLTQRYQVGKLPQAVLVSADGAHAYVVNEGSDTLSVLDLPARKVAATIPVGDSPRVVGLSPDGLRLYVTAGRDGAITVLKAADG

SEQ ID NO: 8756 - protein, 456 aa, Actinoplanes utahensis
MPTDSGVDRARLSKLAERERAAFAERHPRSAAAYGRADHLFGRVPMTWMNKSAAGFPVYLKTARGNRLTDVDGNDFLDFCLGDTGAMAGHSPAPVVAAVTRRLGELGGATTMLPTEDAAAVGAELASRFGLPFWSFALTATDANRWAIRLLRAVTGRSKILVNSYCYHGSVDESLIVVGPDGRGRSREGNVGAPVDVTETSRVAEFNDLAGLERELAHGDVAAVLMEPALTNIGIVLPEPGYLAGVRELTRRYGTYLVNDETHTFSAGPGGATRAWDLAPDVLTIGKAIGGGVPVGAYGLSAELADALLGRADLDLVDMGGVGGTLAGNPVSMAATRATLEEVLTEGAFATMTATATAFADGVQKIVSAHRLPWSVSRLGARVEYRFADPAPRTGTESAAGADAELEDFLHVYLANRGILLTPFHNMALMCPETTLDDVSRHHEIFDAALSALTAS

SEQ ID NO: 8757 - protein, 1082 aa, Actinoplanes utahensis
MTDGTGWRRWTGTTGGVLGRLRRPVEGSGPAAVPQPRPAPWMAGGPGDELVERGRLQTRLRELLLAGDVALHGIGGIGKTTLAEQVVRLPGLRDRFPGGLLWATVGQQRTGAALAALVGDLVEQLTGERPGVVTPAQAGVRLAAALAHRPPVLLVIDDVWTAEQLEPFLDGPGCRRLITTRVAGALPEDLPRIEVGGMGHDEATALLTRDLPGLALPDLTALLALTGRWPLLISLVNGVLRHRVAPHQLIDQLGAYGWVALDLAVPGERERAVEGTAEAALELLTESDRRRLLELGIFPGAEPIPDAMTDLLWAGTGELNAGEAAGLRATYARLGLVKPTADGLRVAGVLRAYLRNRLLDPEIAQVNRRLLEMARPRSGGPWWTLPATERHLWRHLAFHLREAGWWDELFATVTDLRRLARQIPMLGVAAAVADLDRVPDPRAGALRARLSRGASLFAPIEPADALADVLLARLSGAPELAAGVTEFAAAQRGRAGLTARWPLPDVGPDSLTRVIGGGPGWLDAVAVATGWIATGGASGVITLHDPASGDVLARLTGHPGAIKALAATYDGASLISAGADGTLRLWDVDRRQERTLWTTSGEILGCAAAPASHRIAAVSAAGELIVLDVAGNWRILGHRGGERLVGCTFYDDDRVLTASDEGAVVGHDLRSGRRKVLVMAGKDLVAGLAAGPSWVALGGVDGTIRIQPIRGGGETVTVRGHQGCVSTIVAFGDRIISGGEDGTIRMIDRYGAQVAVVRAHPGWVTGCVIGPDRRTLMTTGSDGTVRVWDLPRLGQETVGGPVDWVDSCAVAPSGTSLISGGRDGVVRRWEIGGGGGAVLWAGEEPIRRCVVGPCGSWIAAASPSRTILLREPSSSPADGWEVEELPGALGCAAAPDQDLLAWWDDQGAVTVRSVAGGEPLHRTCDSPIRAAAFLPGHRLILAGAGGELAVWQCRKNRLRPLLPSRRAEVRAIHVVRDRITVIDASGVACFDVRTLRRTGCAAFAETAVTHGAVSADGSWLATTSQDGELRIRPLTGDLQPVAAMRVDGALHECAWGGDSLDLFAAGRRGMYAFTFRPPRPAP

SEQ ID NO: 8758 - protein, 425 aa, Actinoplanes utahensis
MTGTGETPGSDNSAPDPTSHQPTDPTAPPPAGPPTDPTAAPVEPPVRPAAPGEPPQPHTPPAEPVSEWARPAEGAEPPPQPWTPPHQPFPQPPPPFSQAPTGFPAPGNYPAPGASALPGHPPTSPPGHPGAQPPGYPGAQPPGYPGAQPPGYPGAQPAGYPGYPAGVFPGQPWPPLPASPGSRRRGGVLAAVITSVIAAIVLLCGGSIYALSHSGDRSHGGAGDDYPFTLPSGFAFPTDDPSGNPFATPSATSTEPQPSVTAAKDIYDLDQVCDANVYFPDAPKRAGKAPHPVVLLVKTGPDDVRSQDPVFYLQEEGTAKSDENTWAARGPGKVQMAACMDRTTEGKKIRTCKYTDPDPETVTLYHASWRLRVYEVATHRLLLDKKLEGTETACPFSVFVGKDKKIYAKVSDHTALGALRNLVEK

SEQ ID NO: 8759 - protein, 366 aa, Actinoplanes utahensis
MIRIQHVALRRVRLPLVHRFRTSSHAKRELEHILVALTDESGATGWGEIASPSGPFYSAETVESCWAVARDHLKPLTLATGWDHPADLAAVLAKVRGNHFARAGFDVAAWALWSARQGTALSAALGGTRDRVAAGVSLGIESTIDELLEQVSARVTEGYQRVKLKIAPGWDVEPVRAVRAAFPGIPLHVDANGAYPAAETGVFRSLDSAGLTMIEQPYAPRDLVAHAALQETLQTPICLDESVEEVADLVTALRLGAGRILNIKVSRMGGLTAAVRAHDLARAEGVPVWCGGMHEFGIGRAANVALSSLPGFTLPSDVSGSDKYYARDITTEPVVCDSGFVTVPATPGLGWEPDLGYLQERTVDRV

SEQ ID NO: 8760 - protein, 210 aa, Actinoplanes utahensis
MTSRGTPAERFDRNVQRRSAQVLKQRVLEQQRAEFDRALQWAAEHDAIERAAALIVSARRRFLVGNGKSLSYASLLASDLSAGLSGVHLVDGAALRPLDVLSDIRQGDLLIAVSLERYRRETVEVATAYVRHGGDLVLITDAEDAPLAGLATARIVVGTGSASYVNSPTSTVLALHLLATLTIASSKGAGRRLRERDALAAELDLHVEET

SEQ ID NO: 8761 - protein, 274 aa, Actinoplanes utahensis
MDVVVRQLDGIAEWTAAGLLYRSVFGYTAPEWGLNPRLLAALRENGGTVIGALGENGELVGFCYGFTGLQDGEIYHYSQAAVVAPAAQGTGIGRLLKHAQAAAARLTGARTMRWTFDPYALRNAHFNFAVLRATGLRFLPDFYGEPGTDRVLVSWNLDQAVPSDTAQPPTIVPPIPGTSPATRHADGLPATGHADSMPGAGGGVGAGRGRAGPGDGRIVVAAGERVAAPDPADRGWLRRELVTRFAEGGRLVDVVRPDGDPGRVAYLFATEDGA

SEQ ID NO: 8762 - protein, 307 aa, Actinoplanes utahensis
MSSSAIARLQRYVLAESPTGDSRGLGALAEMLEADAVAAGFSVGREAHPTGDHLIWSRAARGVAGEPLLFLSHYDTVWPVGTLSGMPWRVDGDVIRGPGVYDTKSGIVALLAAVAAVDRPHPEIRVIVVADEEVGSPTATGLVEAEGRRAGVVLGLEPPHPGGDLKTGRRGSTRARIEVGGVEAHAALDPGAGVNAIDELVDQLLRVREIGASRPVLVNTGTIGGGGRTNVVAGQAYADLGLRFADPEDERVVLGELAGLRAVRARATVGTRLLSHRPTWRPGPAGDRLLARIAGIAAAIGQPLDGR

SEQ ID NO: 8763 - protein, 96 aa, Actinoplanes utahensis
MDLSGVTSMLNDNERRALAELERDLEHDPDFSARMAGLGVVQPEPAFPIVPVLCALLFITLPLVMMFFGWPGALILLDLFTAVVAVIMIRRRAVTG

SEQ ID NO: 8764 - protein, 102 aa, Actinoplanes utahensis
MTTISSISNTAPYQILQAQAPYRPQPRPQDAADPGDGRQVAGLADPEKLTRVSDLLDMDTSDVTSAATSASSLVSLLQDRGVDFSQLRDVLNRTGDLLDVRA

SEQ ID NO: 8765 - protein, 172 aa, Actinoplanes utahensis
MNDDTEVLPRTPTDIEHDDLNSAIAHAAPKRWWNRTTLVLAGLVLLVGGFLGGIQVHKRWGSSSTSSTSSSSAPSGSFSGAFPGGAGLPSGGFGPTGPAAPGTSGTISRIDGNTVYVQTAAGQTVTVRASDTTTVSKTTPATVADLTAGLRVTVQGATDSSGVVSATSITTG

SEQ ID NO: 8766 - protein, 394 aa, Actinoplanes utahensis
MSATEILRFALRGLSANKLRSVLTMLGILIGVAAVILLVAVGNGSARAIADRISALGTDTLTVMSSSRSSGLTMKVADALDDPALAPDVKSVSPVVSTSATITYDGSDHDVGSFVGTTPDWFGASNFPVRTGALFTADDEAQARRVVVIGQTVAAELFSGVDPVGRQVTVGGALFTVVGVLDSKSSGGFSDANDTAVAPISAVRQVIAGYGTLSSILVEARDSDHVDTAQGEIATILDRKTPAGSDGTAAYRIQNASQLLATQTETADTFTTLLGAVAAISLLVGGIGITNIMLVTVTERTREIGIRKALGAPRRVVLSQFLIEATLLSVIGGGLGVAAALIGSRFSIVGVQPVVVPGSVLLALGVSVLIGLFFGGLPAARAARLRPIDALRYE

SEQ ID NO: 8767 - protein, 238 aa, Actinoplanes utahensis
MPVTRPVLDVRDLYKVYGEGETQVRALDGVSLQVDRGDYVAIMGPSGSGKSTLMNIIGCLDVPSHGRYLLDGYDVSRLSDSQLALVRNKLIGFVFQAFNLIPRTSAVANVELPLAYSGMRAAERRRRAMFALDVVGLADRADHEPHQLSGGQQQRVAVARALVTEPALLLADEPTGNLDSHATEEVLHVFDEVNAAGRTIVLITHEEEVGARADRLIRLLDGRITADLRQDHVGRHAA

SEQ ID NO: 8768 - protein, 397 aa, Actinoplanes utahensis
MRALRRPSTAINALLALLIVGAAIWGVNLIRSTTSGNQAKATDLRTVTVSQGTVTRTVTADGAVASASTAAATFTTAGTVTSVKVKVGDKVAKGQLLAQVDATAAERDRKLADANLAAANDSLARAEKAGTDTTIAENAVTSAKLAVDDARAEVDGTRLTAPMAGTVTAVNGSLGGSSSGSAGTSAGTSSGAAASGGSGASAGSSASTSNGFIELADLTRLQITAAFSESDATALKAGQSATITWNALAGAETTGKVLAVDPTATTSNSVVTYGVTISLPDPPDGAKPGQTVSVAVVTGSVDNAVRVNSAAVTATGRRSTVTVLGATGQQEVRQVEVGLQGDDAYQITSGLTAGERVVVPTSTTSTGSGAGFRTGSGFGAGGFSGGGAPPAGGQGGR

SEQ ID NO: 8769 - protein, 513 aa, Actinoplanes utahensis
MRRSRRVRRNPGRRVRRVCRNPGRPGPLPRVAPFRTAAPCRTAGRRCPAGRPRASYRRVRRCCRCSCRTSHRRRRAGPRSTGRRRRGGDASSACLLQRFGPVRIREQPQSTIMSKLLGQNRTKHRNRLIGAGIVVAGIVGGALLAVVHSHQQGGATSTIVAVRVGKGDVTLDVATSGTVRPATTRELSFAVNGTVASIAVRAGSKVKAGQTLAAVDATAATAAVTDARNTLTDAKSRLTDARDQAARVTAAATACATAASDRGLLATAASDRGFLATAASDRGFLAGADVSPTATVAVNSCTTRGYPDTGNDPVLTAQQAVNRAGEAVTRAEAALAGAVITAPIAGTVVSVAGSVGDTVSSGKTFVTLADTYTMQVEAAFPEADAGSLAVGQSATITLADHDDALTGTVVQVDPVGTSDGTLVRYGAVLSFSAPPSDLLVGQSAQVAVRVGETRNVLRVPSTAVHDISGGSGTVLLRVGGRSSERTVTVGLRGDQYTQVTDGLTADDQVVRSW

SEQ ID NO: 8770 - protein, 232 aa, Actinoplanes utahensis
MTPPYRAPPPRPGVNDDIQARQRLRRHNRALAELAATKTELVSALLHELRTPLTAALGMLEMLPEQTGDPLLDEALPMIARNLRRIERSTAEIATISGIESGSLPLDRISFDLPALLGEVALAAGAECSADPATGLITGDPARLGEVFSRLLAAVRALNGPAAIEATLAGTEWHVAFPLPEGQASDRLFTSGGAGGNAMALILARAVAGRHGGSVGVHSAGGTAYLRIVLPV

SEQ ID NO: 8771 - protein, 149 aa, Actinoplanes utahensis
MTSPPCAFAVSGRLPRRYWVAASEEDGVTSVLVVDDDPTVLEIVETVLRSGGLDVDACRDGRDALRVAHEHVPDLAVLDVTMPGMTGLEVCRALRGDAETADIPIILLTGRGQWLDVASGFDAGADDYLVKPFTAQDLLTRVEALTGRL

SEQ ID NO: 8772 - protein, 645 aa, Actinoplanes utahensis
MVDDGERITGGRLSRWTVGRMLSAGFLLALLSLAVVGTSAYLRIGDLLHDQPPLQHSHMVLGDIGALNDSVRVFDKVARDDRPSADRWADALRGSAATVQERLDNLRHDAAGDRVHQEYLGQLQPLFTGRLDALLRAADGATPKPDVDTSAMDALITKMHQHEEDQLDDRLQAARSSATMTRQLILWVSVATLALVALVARWITHRITAPARQVTAAAQRVLEGDLTRRAEVTGPLELAQMARAVNASMTAMVTAHDEALAATAAKSAFLATMSHEIRTPMNAVIGMTGLLLDTPLDTRQQELVETVHASGGALLVIINDVLDFSKIEAGELSLDERPFDLRSCVQQAISLVALTAGGKGLHLSSHLAPDCPAAVLGDAGRIRQILVNLLGNAIKFTDHGAVTVHVAADAAPGQPDRIEVRIAVRDTGIGIPADRLNRLFRPFTQVDASIARNYEGTGLGLAISQRLAEAMGGGITVDSQPAQGSTFTVTLLLRPAGPAEQPAPLPAVPAAVRPLYVLVAEDNPVNQRVAELLLERRGHRVDIVADGAAAVEAVHRTRYDLVLMDVQMPILDGLAATERIRATPPPHGAPYIVALTANAMVDDEAASRRAGMDAFLAKPLRETDLDTILAEAARHTPEAGPTLAS

SEQ ID NO: 8773 - protein, 79 aa, Actinoplanes utahensis
MERAAATGDTRNLARLAHGLRGSAATLGAVELAALCADLEARAHQHPANSITLLRDLHTQAAEVSAIMRRLAADFAAAA

SEQ ID NO: 8774 - protein, 202 aa, Actinoplanes utahensis
MGRPMSAKDLILGRIRAALRDAPAAPDIPRTYRRDFPAADLELLVDRLLDYRAAVHRIPETAIAATVSGLVRGPVVIPPGLPPSWHPATALIDDDLPRDRIAAAEAVLTAAAVAVAETGTIVLDASPDQGRRIISLLPDIHFVVLRPAQVVASVPEAVARLGAGRPLTWFSGPSATSDIEFNRVEGVHGPRHLHVLLLDGEA

SEQ ID NO: 8775 - protein, 471 aa, Actinoplanes utahensis
MSTFLGMPATAPRGVGHLRGDEPFPAAARTALADDQLRRNLRHATTTIRGRSGRVIAELPDWQELRAAGSAIKASVMARLPELLEELEARVTDRGGVVHWAADAIEANAIVTRLVQQAGADRVIKVKSMATQEIGLNEALEAAGIQPVETDLAELIVQLGHDRPSHILVPAIHRNRAEIREIFLRAMPGVDPDLTDDPPVLAEAARRYLRETFLSTKVAVSGANFAIAATGTLAVVESEGNGRMCLTLPDTLITVMGIEKVLPTWPDLEVFLQLLPRASTGERMNPYTTMWTGVTPGDGPQNFHLVLLDNGRSAVLADPAGRSALHCIRCSACLNVCPVYERTGGHAYGSVYPGPIGAVLSPQLTGVADNASLPYASSLCGACFDACPVRIDIPSILVHLRDLAPHPAAERAAMRAAAFAMNHPRWYASAQRAAKLARIARRRGIPLSAWTDARDLPEPPAQTFRDWWAAR

SEQ ID NO: 8776 - protein, 459 aa, Actinoplanes utahensis
MSHRFAAVDLGAASGRVVVGTFTGDGLDLAVVHRFPNEPVRAGGTLYWDILALYRGVLDGLARAGPVDSIGIDSWAVDYGLLDVSGALLGNPVHYRDARTDGIAARVPDLYAVNGLQTLPFNTVYQLLAAADTPQYATAATLLMIPDLMAYWLTGEIGAEYTNASTTGLLDVRTGRWATSLIADLGLRADLLPPIRRPGDVIGRFRGIPVVAVGSHDTASAVVAVPACGGDVAYVSSGTWSLVGLELDRPVLSAASRTANFTNEGGVDRTIRYLRNVAGLWPLQECMRGWGAPEITGLLTAAAAEPLLGAVVDLDDPIFLPPGDMAGRIRRAAGLSNDASPARITRCILDSLALAQRRAVRQAAELAGVTPGVLHLVGGGARNELLCRLTADATGLPVLAGPVEATALGNLLVQARAAGVVSGGLDAMRALVRQTQQIVRYEPRGDDGPWRAAAERVRG

SEQ ID NO: 8777 - protein, 676 aa, Actinoplanes utahensis
MTNPAVAALIARSHRLGADPRTTNYAGGNTSAKGAEVDPVTGEPTELIWVKGSGGDLGTLTEQGLAVLRLDRLRALPGVYPGVEREDEMVAAFDYCLHGRGGAAPSIDTAMHALVDVPHVDHLHPDAGIAIATAADGPALTREIFGDRVRWVDWRRPGFQLGLDIAAVQRAHPRAIGVILGGHGITAWGATSDECEAHAQEIISTAAAYLERHGRREPFGNVRTAALPRQRRRERAAELFPIIRGLASTDRPQVGHFTDDDVVLDFVGSERLAELAALGTSCPDHFLRTKVKPLVLDTAPDAPLAAITQRLTELREGYRADYRAYYDRHATADTPAIRGADPAIVLVPGVGMFSFGANKQTARVAGEFYVNAITVMRGAESISRYAPIDEAEKFRIEYWALEEAKLQRMPKPKPLAARAAFVTGGGSGIGRAIALRLAAEGACVVIADRDVTTARAVADEIGGTDAAIAVEADVTDAAAVDAALDAAVLAFGGVDLVVNNAGLSLSKSLLETTEQDWDVQHDVLAKGSFLVARAAARVLIAQRMGGDIVYISSKNSVFAGPDNVAYGAAKADQAHQVRLLAAELGDHGVRVNGVNPDGVVRGSGIFAAGWGARRAAVYGVPQERLGEFYAQRTLLKREVLPEHVANAVFVLTAGELSHTTGLHVPVDGGVAAAFLR

SEQ ID NO: 8778 - protein, 978 aa, Actinoplanes utahensis
MHRRRWIAGVAVAAVVGGVPVPVLGAVTPVAKINFQPATAAVPGGYTADTGAAFDGAQGWVRQDSLSSTAHVPLDLTRNTRDRARAGIDQRLDTIIHLQYGDVGGTNGIATAGAWEYAVPDGTYQVTVSAGDQPAYDSRHTVRVEGVTAISGFVSTAAAEFRPATVTVPVSDGRLTVDAIGGVNTKLNYVEISRVTADPPTGLTATPGDAQVALAWSGNAASYRVYRGSTLLATVTRASYLDTAVTDGTAYEYHVTTDGGSSATVGATPAAFALKVDFSDAATAPAVGYVRDSGGAYTSTRGYGWVDLGEGTPVDLTGNGRNRNPAAGQSDPRLATFVHAQLPAGAPGVATPGAWEAAVPAGVYTVTVAVGDAGTAVDSVHWANVEDQNAIAGFRPSAAVRFAAATRTVRVTDGRLTLSPAGGTNTKFDYVDIASVPAAGAVPAVRAGTPANGATGVSPTTSVVEDLVLPNGGVAAASLTASTVTLTRLSDGAAVPATTITSGGGDVINLSPTAPLAVGTAYRFTVTGGVTDVTGTAFTPYSIVFTTGTGGNPGGPAAFDKVVGVATGASFTSVLTGPDGRLYAGTLDGNVYRFPINADGTLGTPLIIGSVRANAAALGLPGAPARTIIGMAFDPASTAAAPILWTTDNYEYVGPLDVPDWSGRIGRLSGADLGTYTPVVTGLPRSVKDHETNSLAFGPDGALYLTQGANNAMGAADSTWGNRAEHLLSAAVLRLDPARLPATLPLNVQTEQGGSYDPYAGNAPLTLYATGVRNAFDLVWHRNGHLYTPTNGSAAGGNTPATPATLPASCARRGYTGPVVPALTNVPAAETDYVFDVKSGRYYGHPNPVRCEWVLAGGNPTAGADPFEVAAYPAGTAPDPNFDLAGTYDAGLHASADGAIEYRGGALDGRLLVVRYSDGQDIETFDVAASGALSNRTVGITGLTGFSQPLDVTEDVTTGNLYVTELGAARITLLKPHA

SEQ ID NO: 8779 - protein, 56 aa, Actinoplanes utahensis
MVGPGRRRGGRSSVGVTRLMEEEAMTTIGRSHAAHTWGLGRVWTRLPLVRKHRWLI

SEQ ID NO: 8780 - protein, 482 aa, Actinoplanes utahensis
MGGTRPAFRGTHGILLCMRKWSPLIAVCLGTFLLLVDVTIVVVALPSIAGKFGADYADLQWVLDGYALALAALLLGAGSLADRYGRRRTYLIGIVIFAVSSLLCAVAPNEQALIAARVLQGAGGAAMFACTAALLNVTYHGHDRGVAFGIWGAVNGAAAAAGPLAGGLLTQHFGWRWVFLVNLPVCLVAVWFTVRGVTESKAPWGGRFDLPGTLTFTVAAAAVTYGLIRAGDAGWTDGVALGAFGAGAVALVAFIIAELRSDHPMLDLALFRRAPFAALILAAFLTQAAAFGYLPFATVWLQQVLHNGPVDAGLVGALPMAAASLVVGAAAGKFLQKVSPRWTVGLGLLLIAAGDLLQARLDAGSTGRILIPGLIVVGLGVGCVLPSLSSAVLAEVPRERSGMAGGALNTFRQLGFALGVAVFGTIFADRIGAAHGRPAGFADGLHQTLYVAAGTALVAAVVVLAVVRRRADTPAPEPVKVG

SEQ ID NO: 8781 - protein, 345 aa, Actinoplanes utahensis
MHSRMPCVPLNAGLVPPILADLDSRYGGVVEIDTLDRQVTHALRINGRAGYREIGAVLGVSDQTVARRYRRLREEAGLRVVGLPNPIELRYETWTLRLRAAPDAALAIANALARRPDTTWVSLTSGGTEIACSVHVPASSDRKALLLQQLPRTPRLVAVSAHCVIHNFVGGAVGPDLRDDALTAEQKAALSPPRTTSPAHLTPGDAPLIEALAWDGRLSYTELAASTGWPETTVRRRTQELFGSGSLYTDVEIEPEVFGFRAAVNIWLSVAPSRMASVGAALAAHEEIVFAAATTGPTNIQTAAICRDMPAFYRYVTERLSLLDGVERIESAPVLKHVKQVGAVR

SEQ ID NO: 8782 - protein, 134 aa, Actinoplanes utahensis
MTRGSRIDRAGREMASCRAVEALRLILLFVHLVGFALLLGGSIAQFLSGTFRISPAVLWGSIIQLVTGLGLAAPLRGGGDHEPDPAKLVVKLVIAVMIFIMVFIPRKREAVNKGHYIGIITLTLANAAVAVFWR

SEQ ID NO: 8783 - protein, 420 aa, Actinoplanes utahensis
MPGHRPVRWGAADRAAALHAHLGVRCGRRLADRGRPAHGRRLKCFILGAMLTYGEGSRRPRMRFNQRSSEGATGLGQQPRNGRAPSVKDVAAAAGVSLGTVSNVLNRPAVVSGGTRERVERAMAELGFVRNESARQLRAGTSRALAYVMLDGGNPFFQDVAEGIEIAADAADLSLFVCNSGGRVEREAKHLDRLVQQRVQGILITPVDPDAAHLADIARRGIPFVMVDRLSREGGHCSVAVDDILGGRIAVEHLIDRGHERVAFVGGPSSIGQVRERCQGAREVWAEFGRPAGDLIHVPTEALTVSEGRSAGERLAGLPSRRRPTAAFCANDLLALGLLQHAVTAGLRVPDDLAIVGFDDIDFAAAAAVPLTSVRQPRQELGRTAARLVLDEATDPDHEHEQATFVPALVARASTGAARR

SEQ ID NO: 8784 - protein, 188 aa, Actinoplanes utahensis
MRSRFAPAALLCACLAALTACSADDSDAAAPTGATTRGSAPVAGNDSAPAGNGSTPAAGNGSAPAAGNGTAAAGAPGPGSTDDRTVCHLVDQAGSVMKAGISQVQRSDGHVEPADAKNVFTTFHTAIDNALAKAADSDVTTAARAVSKEIGTAAAAPDPISAAANAGFDVLSTKLTTACQSAGVTINF

SEQ ID NO: 8785 - protein, 260 aa, Actinoplanes utahensis
MRCRRPGRCCSRSACWGSSGCWSPPAGCRSGRRCCSASAPRRSRWTSICCRSPPSWSSAHCCRCAGRRNSQIPQHRRSGTVRGVNFGPGKRRRFENVGGWWQHPGMEILPGEGVALVKVGETRDVVEARLGPPMHAGISARAVYDTEPTLVVDYDGDTVELVELGFSADGGEQATLEGVQLTYRFMDDVLDELISLGHRPEPFDIGYTFPSGFTIFSMGYRSATDLDPSASPDDPRPVVEGVGIAPAEYWLGPAEESASR

SEQ ID NO: 8786 - protein, 383 aa, Actinoplanes utahensis
MTILTEQAAEDFVAARALAPGRPGFVGVAVDLLLDPESAPSARRPLRHGFLDARSPRVAVVSGPPSPGIEIALRRMSDDLAAATRVTDQQGLTVLPFATDTVHPDSPAHAYGTATAGLRVGLEAGLDEDGPLGLRRRWVLAHTLAPVLAAAFANAPLTHGRPSGWRSVRQALRRDLPVLPGHAVAALPAPRVPGHVTEGFGARFAIDPRTSWAAAALDAPTVTGRSLRDRLRAGARLTESDLLRHLTAVRPPVAARGHLEIDAVDRQPGHGWRLPAAMITALLDDPRAAEEAYAATVHLAGEPPVVGAGRPRRAHRPGAGRRRAGLLPGRLRQLRPQRRRPRAARRPGRLHRRVRQSGPLPRRRPAGPHHRPGLNRPRLNGRF

SEQ ID NO: 8787 - protein, 345 aa, Actinoplanes utahensis
MLGYRPGVNEEFPGQPASDPLASAAPASDALAAPPTAPLYDAPPTAPLYNAAPAYPTPDPPATLPFPAPAQPASAPPAYQPPAYQPPAAAGFPPPGFPPPGFPPPGFPPPPGYPGQQPGYPAAGYPFGPPPSGIVNGFAIASLIFGVIGGVFFAIGFGIAALTQIRKRNDRGRGLAIAGLSLAGCWILGIVTAVIIGVAADDTPRANDLTTGSRPTSIATTPTTVPTEAQDVRTEKLAPGDCIETLVEQETVRDLPVIDCSKPHEGEVYTVFTFPKGDFPGDTLVEKEADKRCGRSLDPYAKGKYARADYFYVFPSRESWAFDRGVTCIAAAPKHGRYVGSMVNR

SEQ ID NO: 8788 - protein, 54 aa, Actinoplanes utahensis
MTGRFFAAADGGDRNTLMALLAPEGDADGRVAVVLNTANPDKLSSVQAGTVRIR

SEQ ID NO: 8789 - protein, 262 aa, Actinoplanes utahensis
MMNVNVFCRCRPGAESPGRDSDRNSRTSQGRGGAADLAGRPAECGPGDVKGRRVMELPEIGSEMFLALGEGVNFRSRLESVDGEVFSVAAPLETAGPSGFLPGYEFDVFWVPPRSRVVMPVLLKSVTDGAPFRWNLFPTAEPVISNRREYARGGAGAPIRLFGEWGPQYLQGRMLDISEGGLRFWVPEGKMFKEGEQLRALVWLGNGEAELKGRVYAVREAGDEPGHHVVLIFKTVDPLAQMIRQYVIAWEIGERRKARQRA

SEQ ID NO: 8790 - protein, 292 aa, Actinoplanes utahensis
MRISIWPGAGQSWSGILEATRHAEETGWDGVWIADHFMPNAGPGRDPLAPTLEAGTLVAGLAAAVPRLRIGTLVYGNTYRHPAVLANMAVTADHISGGRFTLGVGAGWQVNEHEQYGIELPPTRQLLDRFVEALQVLHGLLRTPKTTLNGEYYQLTDAVCEPKPVQHPLPIMIGAKGEKRMLGVVAEYADMWNTWGHPEVIAHKSAVLDRFCAEINRDPRTIERTAQALTVVDGPLPDNLPVPVIGGSRAALADAIAEYRAAGLDELIIPDGLLGTGAEKLKDMDVILGLVR

SEQ ID NO: 8791 - protein, 247 aa, Actinoplanes utahensis
MDGRVNHDEVMALFDRQMRRDMPGAERGLRYTRNAGTAQDWNAVVWSDLDEETADAEIAEQVRYFAGRGVGFEWKTYGHDRPADLGARLERAGFVPGEPESLMIAPIGELDLDVAPPDGVRLVPVTDAAGLALLIRASESAFGEPAGSWRHQEPASLRAFVAMAGDEPISGARMEVHEGTAFASLWGGGTVEKWRGRGVYRALVACRARIAADLGYEYLQVDASDQSRPILLRLGFAAVGTTTPYHR

SEQ ID NO: 8792 - protein, 173 aa, Actinoplanes utahensis
MASRPARCGSSSTCCRPPDRPPGGRGPCCSTVVDRAAQRSWTVLLNRRGPCCSTVVKRRCWRVVGSGGSRSATGTPAISRHVMRIDLETDARNARSRAAIERVGARFAGVLRNRSKSWAPGEDGLLRDSAMFAITAAAEWPDCRDRLVRQLEAGGKSGGQPGTSPVGWARESR

SEQ ID NO: 8793 - protein, 258 aa, Actinoplanes utahensis
MGPSIPDGIGGSVYCRAVPDPVTSRGNVTAKRSAAASPRRGAPPLKTKAEKRAEAKAAKARARAQRKRRELLTIGGAAVVVLALVVGLIVWIGHSSSDSGSGSAGTASAAASDAAAPPSAAAEPAATFPPLPVGADPALGKKPKVTKGAGKLTALKTTTLIKGTGAPVQAGQTISVNYVGVTYADGKEFDESWKRQEPFSFPAGGGQVIKGWDQGLIGVPVGSRVQLDIPPALAYGEKPAGGQPAGALRFVVDVLSAA

SEQ ID NO: 8794 - protein, 128 aa, Actinoplanes utahensis
MATFTLYFDNPFWVAVLEIPDAGLVRATRHVFGSEPTDAELYQFLLRFGGTLLSRAEANPPAPATDRPRRKPRLAVTGLGTAAQQAVKKELEQRKQESSLRSRTQREEHDAHRRQVRQAKARARRRGH

SEQ ID NO: 8795 - protein, 287 aa, Actinoplanes utahensis
MNAMDRRELADFIRRCRERIRPEDAGLTSGPRRRVPGLRREELALLAGMSADYLMRLEQARSPQPSIQVLRALAFALRLDDDERDHLYLLAGQRPPAGRLAGNHVRPGLLTLLGQLTMSPAQIVTDLGDLLAQNALAETLFGSICPAGPHDHEQDHNLVWRWFNDGRLRASIPEEDHDYCSRMHVADLRAAVARRGADPAAAALVQRLRDSSAEFAEVWDRHEVAVRRNSRLRLQHPTVGLLELDFEMLLTPTEDQRLILLTAPPGTPTANYLDLLRVIGQESFQET

SEQ ID NO: 8796 - protein, 303 aa, Actinoplanes utahensis
MRAIVFQEFGGPEVLRVTEADVPEPGPGQVRIRVRAAGVNQLDHKIREGAMAQVFPTTFPATPGLEAAGVIDATGEGVTGPAPGDEVIAFTDTGAYAEFALATVVAPKPAGLSWAEAAALPVAGETAQRVLGLLGVKAGETLLIHGASGAVGGVAVQLAVASGATVIGVASPANHDYVRSLGAIPVAYGEGLIARVREVAPQGVDAVFDAAGYGALPDSIDLAGGSTERVVTIADPAARTLGVVFSAGAQNTVEGLTDLARLAGTGALRLTVAGTYPLSDAGRAQVQSATGHTRGKLVIAVPD

SEQ ID NO: 8797 - protein, 131 aa, Actinoplanes utahensis
MAVDGLSRVFAALADPTRRDMVVRLAGGDATVNQLAEPYRMSLQAVYKHLKVLEDAGLVSRPPGPQPRSVRLEPDVFGEVGVWIELYRRRAEERYRRLDSVLGAMDDNGRPDRHGHGSDRSERDEQEGGAQ

SEQ ID NO: 8798 - protein, 157 aa, Actinoplanes utahensis
MSEAKIEADEKLPIIRITRDFAGTPEQLFRAHTDPELFAQWCGPDSTTARIEQWDARDGGSWRYVAVRGDEEYGFRGCFHEVGPRRIVQTFTFEGAPDGVSLETLTFEDLGDGRTRLHGQSLVDSFEARDAWLRSGMETGVAEGYAKLDALIAKGAI

SEQ ID NO: 8799 - protein, 372 aa, Actinoplanes utahensis
MIDESEAFLHLGESGDDLRAVRLQDGKAFLLVAVSGGDQLSVTTDRLDRHAGGPQLCTGRDPVEVELAVAPPTGGGAVNGSDHQAGTFVVAQGVHADPGATGGLGDGHTHGRDGGRGFWCRPRLDFEHARNPSVLVMTATLISGANKGLGFETARQLIAAGHTVYVGSRDIERGRRAAQQLGARAVQLDVTDDASVAAAVKTVEAEEGLDVLINNAGIQAELSENNVVIGAAELTAEVMRQTFETNVFGLVRVLHAFLPLLQRSTNPVVVNVSSGLASLTRVTTRGHAAFAYPGVAYPASKTAVNMITAQYAKAFPNMRINAVEPGFTKTDLNKNTGRQTVGQGAEIIVRMARTGPNGPTGGYFDAEGQLPW

SEQ ID NO: 8800 - protein, 223 aa, Actinoplanes utahensis
MIGPRTMSTASMKGYAVILKLKLCVLVASCAVVAAPAGPASAAPDATTTAADPAVAFVELRRAMALTGTKVADSSPFNLHVAGRGSGYCLDNFASGEGRNNSPVGLWTCNGGRTELWRWRIFNQNIYYGVELVNNASGRCLDYPASMGNTVGAQFNVYDCRDGSAPGQNFHLTNASGGVAMESQATNNAVAVDAFTSKWHGDGSPVGLWYYSSPGNAFQHWYQ

SEQ ID NO: 8801 - protein, 211 aa, Actinoplanes utahensis
MSARRDHDVTLIGPVQASTVRKADSGFGPSAFTIDWDTRTATCPGGQTTTNWREATSHRGTPVSRIRFLKTQCQPCPVRSQCTTSGSRNLTLRPREEHEALQLARADQSTAEWKRRYQPRAGIEATISQGVRSFNLRRSRYRGLAKTSLQHQFTGAAINVNRIGAWLDGRPHGLTRMSHFAALRPGPDDLRRPTRTVPAGRPRGGGAGCSE

SEQ ID NO: 8802 - protein, 221 aa, Actinoplanes utahensis
MREVNRLERCIETMRAALNALSVLAPTWVAALADAEWFDRYSDRPEQYRLPAPGTRKRIALAEQVGADGSRLMTAVFAGDAPAHLRQVEAVEVLRQTWVQEYAITSTDDGQERIVWRHPKDCPPGAVRLASPYDTDARNAVKRDTSWSGYKVHLTETCDPDEVHLITHVATTVATTPDTGMIAEVHRDLAQRDLLPSVHLADAGYVNARIWCPPAVTTTSR

SEQ ID NO: 8803 - protein, 420 aa, Actinoplanes utahensis
MSRPTRRLVIAVRADPVICGHSGEARNLAEVALHRGFDDVRLLTWPIPALQAAGLPLKPLDRLLPYSDGITVERPEAVGDYRVPDGRHLAGLTGRLVELLSDGVPTVCLSMYLVPHTQVINDAVTAARAAGFNPQVHTIAKAVGSDVTNVIRSCLREGRFGAATVLMTTFLASDEVVAVSEYTKDEIIASAEEVDAHCGTSFASQCRDRVTVSYPPIDSSAFLSLGDDAIDEALEKRGLKRGKYILFLSRVARAKGIYDLVIAYGQMQCREEVPLVVAGNGPALEHVRAMAKEDERIIFLNDVDDDEKPLLMAGCAAYALPTKPEPDFVETFGIALAEKMLAGGGPIVTTLTGGTGEAVGDTAIIVEAGDITALAEALDRVVLDMPETEKRAMESRARDYAMSFDRTAVFDSLFPAGPPA

SEQ ID NO: 8804 - protein, 710 aa, Actinoplanes utahensis
MGNTHPGATSPLGMVSACAYSGAYPTGYGRYAKNTEGVPEEMFERTEASGFTHFQQSGTGAIRKYYNYVRVTPMVQPLDDLGQSWALHDERAEPGYYAANLDTGVRCEITVGEKVAVHRYTFPDHHSARVVIDLSCGGLAIDLGRTVPLRAQVESMGHGCAQGTVVMEGVPLSVHLEADAPGWRQMLWYDRRLIPGGTRLDFDSIRHTTLRPFGMLFMGSARAGQTIEVRMGFSLRGCDQARENLRRECGTGEPAFEKVRLSTKQRWRDHVGRVRVDGGTEARRTVMGTALYHSLIKPCFADDESPFWPSSGPWAFDICTMWDIYKTQIPLLQAIAPDRAMDLLESLIRVCEEEGNFPIGYRMARGADRFFRQASALAHTAIADAHALGRGGVDWGWALVHMVDDLRRMYGEDFFEHGVVHPITHTLDLAYAHHCTAKLARALNDRRLADDLERRSHQWVNAFDPVSGLLRDSEFYEGGKWNYSFRLLHDMAARIELSGGDRGFIDKLDRFFGYGAEPVKQPGVSPQPAEMALGYALNRFEGLNNEPDMEAPWAYHYAGRPDRTAEVVHSALTWQFGTGPGGLPGNDDSGGLSAWYVWASLGLFPVAGQNLFLVNAPAFERAAMRVGDEEFIIETSGHVDTPIGVDGLDRDPPAQYVQSATLNGKPLHAAHLSATDVHRGGRLHLKLGPEPSTWGHGNRPPSHSFTPFKE

SEQ ID NO: 8805 - protein, 408 aa, Actinoplanes utahensis
MSALDIVGDDLKTELPSGETIRFAHLDYAASAPCVEAAAQAVGELLPRYGSVHRGTGVRSQTSTVAYEVARDVVAEFVGARPGDHVIFTRNTTDSLNLLARALPAGTTTILFDGEHHANLLPWPNPLRLPTPASPHFAVQALQNALRDLRTPAVLAITGASNVTGEIWPVRELADVAHTYGVRVVVDAAQLAPHRPVDLDELGADYLAFSGHKLYAPFGSGVLVGRGDWLDAADPYLYGGGASATVGERPGEQTWAAGPARHEGGTPNLLGATALAAVCAALLVADRDELHRHEQALLARLRAGLVAVPEVREVSIFGPEHPRVGIVSLVLPGHDPARVAHLLGREHGIGVRAGQFCAHPLVRRLTNTEKSDICGTNGAGLLRASFGLGSTVSDIDRFVTALADTVRS

SEQ ID NO: 8806 - protein, 257 aa, Actinoplanes utahensis
MSSFEQQWTRWHDEHETRRADKHGFLAITGLHWLTETPQRFPDAPGEWSTGPEGVLVTLAPGEELDGIPAGEHRFPPLAERADHTVGWGEAKLEIARRGGHDVLRPRHPAHETLVGYRGTPAYPPAEEWVVTGTFVPFDEPRPVTVGSVAEGLEHVYESPGRIEFTADGRDLALTAFNGHTPGSLFVLFTDATSGVTTYPANRSVAIAPPAADGTVTLDFNRATNLPCAYTEFATCPLPPAENRLPIAVAAGEQLPR

SEQ ID NO: 8807 - protein, 361 aa, Actinoplanes utahensis
MEELLAPAEALIGIRSTADRPAELHRALGLVLDLVGPGFTTRRFESRGRPSALLTHPDRPGRPRVILNGHLDVVPGTPSQFRARREGDRLYGRGAHDMKVAALVLATVFREMAGELPYPIALQLVTDEETGGQDGTGHQLAQGVRGDFVIIGEQSGLRVVTESKGLVRARLIASGLGAHAAYPWLGSNALLTLLTAVQRLIARYPVPAEEAWTTTANLARIETGNQAVNQVPADATAWFDIRYPPEDAALTGRSIPEIAGHLRSIVGAEVEVQVDAVGTPHRADPSGAGVRALQEAAKAVGYSGELLRKHGAADSRFYFPLGIDAVIFGPTGDGQHGPSEYLEISSLQPYHDALTRFLQSR

SEQ ID NO: 8808 - protein, 197 aa, Actinoplanes utahensis
MTAPTLLRPVTTPGPLTAAARLLAESLLGGMGDRWLHTRGVAGRAAELAGPLGVDADLVTAAAWLHDIGYAEPTVVTGFHPLDGADHLTRNGWPVRVAGLVAYHSGARFVAAARGLSGSLAAYPDERTVLADALTYADQTVGPSGLRVDPAARYAEVLLRHGPCSLNALVDPERGPYLRGIAGRIEHLLAARALQRD

SEQ ID NO: 8809 - protein, 416 aa, Actinoplanes utahensis
MRMDHVTGRQRGTALVALALGGVAIGLTEFVAMGLLPEMTRDLLPAAWARSHEDAVAQAGWVITTYALGVVAGAPLIAALSARMPRKRLVLGLLALFTVGTVASALAPTFGLVLVARFVAALPHGAYFGAAGLVAANLMGPGNEARGFAVVLGGLTLSNVAGVPVITLIGQSSGWRVAYLVIAGVFLLALFAVLATVPQTPTPAGASIGAELRALRRPQVWLVAVTAAVGFGGFFAVDSYIAPVTTEVTGLSTRAVPWALVAVGLGMTVGNAVGGWFADRNLRRATLTAFSTVIVAAVIFALTAHSTVGLFLGSFLVGAASLALGPAMQARLIAVAPGAQLMGAAVNQSAMNTANGLGAALGGLVIARGYGYLAPAWTGAVLAAIGLGLAAVSFAADRTFRRSLTAVHHRRPTLWR

SEQ ID NO: 8810 - protein, 270 aa, Actinoplanes utahensis
MTADLFDASAMYDDDYLHFFARHPAEEAGRAAAGVTHGPAVPAAGGGPATADVVWRLLGLAPGMTVLDLACGHGSLAAALAARGCRVTGLDFSEVFLARARSDAAARALDIDYVPGDMRELPREWTGRFDRVVNWSTAFGYFDDAVNRHVLDEIVRVLRPGGRLALDLDNQVRFLTSWTPSRITVALGNGDLLADRHRFDPLTGRFEVERTVVRDGRARTLTFVKRLFGFPEIRDWCAAAGCTTVAGHGEDGEPLSAEHRRMVVVAAVRG

SEQ ID NO: 8811 - protein, 532 aa, Actinoplanes utahensis
MTGPSRRRTEPAHPPAVTKDLAAMRSVTPVVARSLPLLLAAGATVSSATTPASAATAAVKPAAAILASTTVPGARDSLTPAQRLAAVQSAKQINYYPAGGSWTRMWTDFDAKKIDADLAKARALGADSVRAIVFPSAFGYPTPKPEYAAKLAQFVSLAAARGMTVKVTLFDWWDGYSDVAGSTTWANALLAPFRNDDRIISIELQNELDPTDPAAIGWAKKLLPVIRKAVPGVPVTIPISSSAGVAGLSTLKSAMAATPLDYYDFHLYGNSERALASIRQAQAAVAPAPLVIGETGTNTLQSSEGEQAAYLARVFAAAEVAGVNAVAPWTLNDFAAGSIPDSGVARIPEQYWYGLYRADSTAKPAAAVAKAEWNGAPSPTGLMDLGFENAAGQTPWRSYLSDLGTPTRTQTAARSGKWSVMLTNTGKTAAGSPSYRVSPIEPVQPGRRWHAEVWVRGKNETGSTQIALSWFDVNDRWIGGASSADLPSGTTDWTRLSVDGVAPAGAASLQVHLKSGADTGTVWFDDVAISAS

SEQ ID NO: 8812 - protein, 525 aa, Actinoplanes utahensis
MIRRRRQGSDRLGGSREATGQRWTAGRVSAAGYGSVIGLLALGGAAAHLGIDGAQAQRAPIDRAYQALDTLSSLRSQLQDAQRGERGFVLTADEHYLAPYTSAATQVPQSLARLRQLLGADTAHRQTLDDLQASATATVDYLGLAVTQLRDEGFRDARPDVLGTAGTETLDRAGRFIDTLRQDQLTVLHARQQQQQEQESRALWLVTAALGAASAIALTAWRATRSPAPSPPAEPAAAVETFSASDSASEPAEETWHTPLRVLLAEDDPVNQKVAQFMLGKLGHRVDTVGNGLEAVQALRAADYDVVLMDVQMPILDGLEATRLIRSEFPADRQPHIIAMTASVLAEDRAACRASGMNDYLPKPVNLPDLTSALTPLLDLGHDLPGDDGESGDARTAPDADRESEVRARLDDISDGAPSDPERTLLARLLRSFTTGTPAGIDRLAALFTAGDVPGVRAQAHTLNGSASNIGAVHLAGMFAAVEADARAGRLPRNAATMAAIRAEYAAVVPVCERLADELSAATAH

SEQ ID NO: 8813 - protein, 543 aa, Actinoplanes utahensis
MGVLLDDREQRRLAALHEYRLLDSPAGNELEAVVRVAATVARVPTATLNLIDENRQCQLTTVGFDGGDSPRSESMCAIRFQTGEFTYLPDASLDPTYRANPWVTGVHAKVRFYASAPLVTPDGYALGSLCVFDSEPAELDDEQIARLKDLADVIVALFERRRQARLNAELAAIAEARQRWTDTLLETIDVAVVACDRDGRLTLFNRAARDWHGLDADPGVDPNDFADRYFLFDIDGETPLPADRVPLLRALHEGSVSNAEMLIRRRGGDPVHVTVNGRALVGPDGIPLGAVVAMNDVTTDRAQQRAIEHARRELAAANEELRRSNADLTNFAGAVSHDLVAPLAAVGGYLELLEDVVTGQPRDWVDAASRAVTRMRDLIGSLLDYARAGSAPIRRTPSDLGDILTSVIADLNAEILASGARILSPAHLPVVSCDPVLARQLLQNLIANAIKYRHPDRRPCIVITAARAEEAWAVTVADNGSGIPPDQRRRVFDMFTRLDGTSASGHGIGLSSCLRIVDRHGGTIHVTDNEGGGTKIIFTLPDR

SEQ ID NO: 8814 - protein, 409 aa, Actinoplanes utahensis
MSITGDAQQRVGPDEQVRVEQERLAALHEYRLRDTPPGEELQAVLRVAATIAGVPWASLNLIDERSQFQLVTLSRAPVQCARDDSMCAVTVESGRFTHVPDARLDPVYRNNPWVTGVLGDIRFYAAAPLITPAGHALGTLCVTDSVPHHLRPEERAQITDLAAIVVAFFERRRQARETAELAATVQARQRWTDTLLETIDTAVIACDASEKVTLWNRAAREWHGRSGEGDPRGTDVARRFGLFEPDGVTTIPDDELPLQIALRRGITVTGREMMIRRPVGEPVHVRVNAGPLRGPAGEIQGAVLAQADVTADRRRRRLIEEARERLAAANAELERSNADLTNFAAAVGHDLIAPLAAVGGFLELLAMEGCPEAAAGSAEVTRMRDVIDGLLAGALADRARPSGPARGRR

SEQ ID NO: 8815 - protein, 237 aa, Actinoplanes utahensis
MDFLKPFVLPVGDQSPERHEFHDLYLPGEIAAPRPAILIVPGGPLPAEVRPTQRDWPVFQGYARLAARRGMIGAVVEHRLYSPAEYATGAANVAAVVETLRSDPRVDENRLAIWLYSGSALFAADWLREPPSWLRVLAMSYPVVEAFPGWPADERFTPVAAVAEAGDLPIVLTRVGREQPIIAGPVNRFVEAAVASKADLEIIDLPDGQHTFDAKDDNDESRAAINRAMDLVTAKLA

SEQ ID NO: 8816 - protein, 628 aa, Actinoplanes utahensis
MQSADNMSVRPRRIGAALGAALLMTVAGCTGDDEKPFAGELPPPGATWETLDPAEPGTVDGSQEPTTNAQQQDGNVGQAGAGSGGIGTAAGGSSSGIDQGAGGDGGRALGPGGTVVATPGVHGHGGGLGVGGTVVQNPPLGPGGTGVGGPGLGGTNSSTNNPKNPGNVAAPGVGGVPGVGQPGPGQPGTGLPGAGQPGLGQPGAGQTGAGQPGAGQTGAGQTGGGQTGAGQTGAGHPGAAQPGSAHPGGGAPAAQPGGQHAPGQGPVGQPISHPIGQQPGHPGQPGHPGQSGTGQNGHPATGPATPVVGGPVIVQPIVNHRPPAVEPPATSHHSSGNVHSDRPVTHARPATHARPSGQHRAVRASRPTWVRDLDRPISANRSCDRFHGGITDITLTNGWWDNSQVCGDTDSQIYLLTHSGMPVALPQADDDYGRMRRFHDDLLARINHDAFPFDSHGFGDDRWAGGHRGAGGGVGHRRGGWDDGNTDGGWGNGDADGGWGNGDTDGGDWDGGDRWTTGDARDLGDLRAAANGWSGDDLGRHASRDCDKPSRPKRRAKAAAVRNDAVTRAETSAAADDADARRSTGDDPAATGDRDHRTAGDGSDQEKATDRFDDHGDGIAITYPVTDD

SEQ ID NO: 8817 - protein, 839 aa, Actinoplanes utahensis
MVRWPRLVVVPLALAGMLALAGLTLGRIYADDLLFRLVAGAAIGSIGAGVATRRLPSWSAAPVSAVLLATYTALALKLAAGHAGLTTPFPSIVRDALVNGIPRLLTALIPVESTPDTVVVPVVATWLAGMAAVEVGVRARRVLLGTLTPMCLYAGALYVVGPNAGPAVAPTLGVVALVVAALAVSVDRDPAAADLPAAVRARSLGAAAVGLVAVVGLAAVVGPWISGQVGGDPVDPRRYVEPPQVDSLDESPLNRISGWMLAPGQQLFTYQPASPPAGRATTVRVRLAVLSDYDGVTWKVGALYRNAGRVLPESTRPPGTDVTELRQRITIAGLTGRLLPAVATPAELSGARVAFDAGTGTMIRPEGLTSGLTYTATSEVPTPDLNLLPTAEAPAGDAVVRYLTVGDGVPDPIQKLAEHLADGNGGAFDRASAIEQFLAGHYRETPDAPSGHAYPNLAYFLFGPRGRGGQEGTSEQFAASFALLARLTGLPSRVVVGFDAPAKGGQVTGGDAIAWPEVLFDGLGWVPFDPMPTSDDPRPVEEDFTPKPTTPPTTPPQTDTSTGSAPPSTPAAAAAVRPGGGLSGPVVAGAASGSVLLVLMAAGLTVMRLRRGLRLRRLGKGSPDQRITGAWREFTDALRLAGQPVPGHLSATEMAAYAAAPPAARRTALLRRATPVAPSRPSSMSAAPASSASRSPSASPVGPSLSSASTSASSVAASTSAWSVAASTSASSASASSASASATAAGSSSPSSVPSPAQAAESVEVGDAGAQPPLPPLPPLDALVDAVNTVGFAPGAAAAGQADRAGAQVLAYAAALRERQSWWRKIWWTVHPGPLRWHR

SEQ ID NO: 8818 - protein, 370 aa, Actinoplanes utahensis
MTARGIGLLAAAAVLLAAGFGYHYPDLALLGAAGLVAAAGALAFAFWRPRLRVHRVAEPDRVARGDAARMRLTVGNTSRFRAASMIATDRCGGTSVPVPLLRLLPGADTTAEYPVPTGRRGIVPIGPLRITRGDPLGLVRLARTYGEVATVWVHPRIHLLRATPAGMARSLDGRIDKVPQGTITFDALREYVIGDELRRVHWRSSAKVGELMVREQLDTAEPTIVVLLDDRDTAYPDPEAFESACEAAASIVAAAVREDLPVGLHLVTTVATGPYLDVLTEVQPRPGDLTATVRRMRAQRLGDTLVFLTGPGGRTDLGAVSSLKGTYPVILAAILGDRDAAPVPAGDRLIVIEAADGAEFAAAWDGVRGW

SEQ ID NO: 8819 - protein, 393 aa, Actinoplanes utahensis
MGAERDPVEDVLQEVGRGGVCVRLQQQQAQHLVDPDRLQGEDVHPLGLAEPGRRRRPGQPAELLDEDRLVTSEPLPPSYVSGFAQVAGQLAERIGTVVLGKPEVVRLALTALFAQGHVLLEDVPGVGKTTLARAVAASIRGQWRRIQFTPDLLPSDVSGVTIFNQASRAFEFHPGPVFANIVIADEINRASPKTQSALLEVMEERRVTVDGHPHPVPRPFLVVATQNPVEMDGTYRLPEAQLDRFLVKLSVGYPDEDVEIEVLRGAAGRSPDALEPVTDTGTIGEMVKMALQVHVADPLYAYAVRLAAATRNHPQVRVGVSPRGVIALTRAACAYALINGRGYVLPEDLKALVEPVFAHRVLLSADAQLRGVTATDVLADAVNTVHVPLPASA

SEQ ID NO: 8820 - protein, 871 aa, Actinoplanes utahensis
MSSADGASKRRLPSRGYLVTMGTVLALAGGLGLTVLGLGQADKAVASFDAASWVWSRAKGEMSRVNGVTARIDTRVDVGQARGHGLEVTQSDRFVILRDVNTGAIGSMDLTDLQTYWNQRAAPGVGVSVALHNDTAFIVDSVQGRVQQVDPASLQGIGQPITLPPGITGGQFDGRGRLWVVAPSEGTVIEITPAPRAGAGTAAQAQRVRTETVGGASHDFKVTTLDDGVAVLDRTTNELVRVGDTPTTHATLPLTGPGTLAAHTDGGTVAVTVPDTRQVVGVDPRGGIKATFTVRGGGTQSQLQPAVSWEGFYYVADADGGTVHVFDQAGQEQKPIVFQHPGGSLELDVREGYLFINAPGSSIAQVVDNQHGVRPVDKYADDVPGGTPPKVTTPPTPPRKKPVKPAVTKPGAPRNVRAAAGNAEARVTWQAAPDNGAAIAKYVVSGNNQTFTVGAEQRAYTVTGLTNGETYTFQVHAVNAKGDGPDRSSNPVKPTSEVPDPPGTPQAAAKPDGSVTVTWPAANGQGLAIDRYTVTAVSEGGTAPVGDAKDTSISIPAGQLDFGKQYAFTVVSVNEHGAGSKSSAISNSVVPFSKPGKPDNLDAATVADQPGAIRVTWAAPADNGRPISRYVVTAGGRSTDVADGTAATLTGFGAGETVAVQVVAVNEAGPGDPASATARTVAAPTVTITGTTTTFNAATVGFSVNAGGGTAACSLAVSGGTGSGGSCSSLKASGLKPGTDYTFTVTVKNAAGTVTKQATKATADLYGTATCINGSTGDQKTYCNADVDGRNGNEIFTVTRQNDAQQAGWVPNGTRLKTYCKKSGEEVYAFVYNNNKRSTWWIQIDYKGKTYIPWAWLNLDGGDDLGNLPNC

SEQ ID NO: 8821 - protein, 884 aa, Actinoplanes utahensis
MMLGAGHWAVTRAQAYLDQVPTAPVRLEPAHRMPRSGLTLPPAPVAPPGPAVRDDPPAPVAPPGPAVRDDPSAAAQPTATWPVIPHQGNPWSTAPAGRPPASSHQDAVGRAAPNRPASSHQAAPSQAGPDDTVRSRPASGHSVDSSAPGGAGAPGAAAVPPSIPAQREPQAAGQQSPAISVAPAPPRPFGLLPPPSALGFPPPPGADGPASSPDVASVLPPPPSAFSVPPPQRDRGDTLAPPPVAPLTPGIEAAPGTPSVQGAQPRQDDAVPETRGTGRTQGRSGSPWEPVPQSGAEPAGPVETPFRELEPGVFGVAGATSAQDAPALYHRGSQDAVVVQRQDPIVMPLADPPAPQAARPNPITVSGPVPAHNAVPVRPEPSRESRSESVAPGVSGPDRSASPASDRVMKGSPWAHVPAIDESTKALPTLSTSSDAPPRQRTSSHVAQQTTLESAYDNAPAPEKDPAAREAARQAARAGAAQEAAAQEAARQSAAQEAAAQEAARQAAREAAAQETAAREAAAREAAAREAAAREAARQAARETEAAHRAARDGAGPGGSENLTAWPDFNGWPEQAGGPTPWSGQPEIQHVPAPLPPVQRPDQQAAQAVWPATGHPQEAGPQGGSARPDVPSSGYQQEIALPEPTPWDAGQSGAGQREAGQREAGQREAQREAGQREAQREAGQWEAGALEAFPQRAVQPGVYPAQMPGGGVYHQGADGVWQGGPATPVTGGAAAEVTAYDSGGNRKRGMALFAVIAATIAAVVAVGAMVFTLAQQTRKGDDDHGQPGAPTLTGAPPGNVKLADRGTRILVGWTDPSNASVSFMVTMAHPGEQLKPVSTVGPGVTTRWIDGLNASLDYCFAVVAVYATDKFASSPQVCTERGKK

SEQ ID NO: 8822 - protein, 342 aa, Actinoplanes utahensis
MGDRRTGIGWWRWVRIRRSGTRRGRQVFRFEVEPVTGPQVRWMFAKRLQGWSVAAIARSLNERGVLSPGAYDRARNRHRQATLWTVRTVAAILANARYTGRQVWNRQFTDHREARPGDKRSSLGPVRVWNPREEWETSQERTHPALVSDADFLRVQQTSAVLEPVDGSSRRYALTGRLLCAVCGRRLVAHWMNKKPGYRCRHGHTTAHPTDVAGPKWVFWAEARVFATLAGQHLELADLQDAEDLGTYLRAYDLVVVCGLGTVAIEAAAVDEPDFALPSAVVQPRPGDRAGEPVVAVRREPVQLALPLAEPRRRSRRMMLAAASEGEGQKAENPTRYRVQRE

SEQ ID NO: 8823 - protein, 40 aa, Actinoplanes utahensis
MKGDGMSITAIPKRAVLHVYHHGNRGTIALTSDNSAVDSE

SEQ ID NO: 8824 - protein, 644 aa, Actinoplanes utahensis
MSISEPDQDGPRVTSSLREEPDYRAAATAFEHLPVIVSMWEGAELRGVAGNRLFRASIRDRPFLGLPLREALPELAGQEVFETYERVLSTGVAEAVREWRMLHEVDGRTIEEFYTTHFTPVPDDTGTVRGVLQTGEDVTAQVLRRREAEAKAAVSQERYLAAQEVVLALQSNLLPATLPVLPAIDLAAQYAVAAAELQAGGDWFDAVPLPDGRVALVVGDVVGHGAPAAAAMAQLRPVLREALRSGVDPVGAVDRLDAHASETPATRAATVCLVVLDPSDGALTLVSRAHPAPLVCAPDGDTRYLEGGGGGPLGVGAGRSRASVHRLKPGETVLLYSDGVVERPGEPAAEGAARLARIAGGAVTTRSDAVPERTTDRLCALIVERVTRGGYVDDVTVLAAQRLVEPVAPLVLDVPAEQQALAGLRDALTAWLTALGARRKDLLAVPLAAWEAASNVVDHAYSGSRTGRLRLDASVDSGGRLRLQVADDGRWRERTASSGGRGLPLLRLLTDEVTIERRDDGTTVTMLCTLGHPTVIGLTASTPTLVEQEPFDVVPVRRDPTVLSVRGPIDASTTALLRTGTLRHGAGLEGPVVLDLEQVTFLASAGVQLLHELTHDGRVELAAPVGSLARHVLDLTGLSALSSE

SEQ ID NO: 8825 - protein, 952 aa, Actinoplanes utahensis
MAGRYQGVVVGSSLGGIEALQLVLGRVQDLVDVPIVVAHHISPSASRLEKVLGRTSRLPVRWATDGGPVEPNVVHLCPPRSLVRWEPDGTFTVRGHEARSSLGLVDELFSSAADALGHHLLAIVLTGAGSDGTAGARTVRNTGGTVVAEDEETATASGMPGSVVRAGLADLVLPLAEIPGMLDRVIGLGRSLPLPELVAAEAVFASGGEMGALMAATDWTHSALGPVERWSPVLRSTLAMALGSDLAMCVLWGRDLVLLYNDAYRDIIGGKHPTVLGRSAASAFPETAHLNDPLFRRIRDTGRGLLQHDQPTPYMRDGELEEAFFTFSYSPLYEGPEIAGLLATVVDTTHQVQGGRRLRVLHRLATGALVEGDAESVVCDRVAAVLADDPEDVPFALLYLVERAGIKLHLAAAVGLEPGGVAAPRRMSVSDATAWPISAVVRRAEPHVVADLPDGFRGLVCGPHPEQPTKALVLPAGRHPDGSTAAVIVLGVSARIPLTVTYRSFFDLVAEQVGASLTAARRRQEARERIAALTALDRDKTEFFAGVSHEFRTPLTLTLGPLEQLLDTPAAGLRPDEVHTAVRLAHRNALRMLRLVNTLLEFAQLEHGRRRLRLEDVDLAALTTDLAGVFRSAVEKAGLELVVDCPLLPRTVPVDPEMWERIVLNLISNALKHTFTGSITVALRLRPNHVELEVVDTGIGIAADQLPLLFTRFHRVRGARARSHEGSGLGLALVQQLARLHRGTVRVRSMVGRGSRFTVWLPLTQRRPTEPTADDHPEARNEHRRAFAEEAELWLNGQDLPAGIQDAAPPAPGLPGRKPAVLLVDDNPDMRAYVRRLLSDRYEVTAVADGRQALDALVERGFDLVLSDVMMPELDGLALLTQIRTDPRHRATPVILLTALADPGSTVAGLAAGAHDYIVKPFTARELIARVEAQLALAKLRADPAPGPGTTS

SEQ ID NO: 8826 - protein, 385 aa, Actinoplanes utahensis
MPYQREVLVAPQREDYDEIALRYADACATADSARAERLREDMIRAVLPMAERLARRYRGGSEPYADLVQVARVGLVKAVNRYDPERGSFTAYAVNTIRGELKRHFRDHAWAVHVPRRMQEALLELTCLENELTRELHRRPTDAELAGQVGVPADEISRIRSAGSAFRPVSLSTPIGEGDLLLGDTLGNPDGRLEDAADRLTVTELLDYLPSRERRIVHATFYERRTQTEIAAGLGISQMHVSRLLARALSWLRAGLLTDQVPRWPVTGDAPEELFALHTRLPARGELQISVVGEVDRDNADRLRVALLELIRHQPACARVTLELGEVPLLDAAALRVLRSVYEAAQARHVRVTATGASAFLRRLAVIAGLGSMLADNTAEDLSRR

SEQ ID NO: 8827 - protein, 284 aa, Actinoplanes utahensis
MPWLPSWRSGSGFRRSPGVPEHVVNLRRSANWLAAALRETGFPSVQVWDTEDGPAVYAAWCAEPDAPTVLIYSHHDVRAAKDEEWDETAPFDPKIRDGYLYGRGASDAKGQALAHVWGLRAHLAATGRAHPAVNVKVLVEGEEETGSAHLRQLLQDNRDRVGADLIVFSDTLLWRADHPAVCVSMRGTMLAKLEILGPLQDVYSGAVSGPAPNPVLEMSRLLAQLHDDKGRITVPGFYDSVVEPSQRFRGELAALPYSDADRLERSRTRSVGGEAGYMVLERPP

SEQ ID NO: 8828 - protein, 66 aa, Actinoplanes utahensis
MVTAVPVARAALDSRALGEVQELMSQRYVEHRARVGGHRRGFADHSRFTAAYRTSYGRLPRQTLHT

SEQ ID NO: 8829 - protein, 657 aa, Actinoplanes utahensis
MSDGSQHLDGTGDLEAVRESYEQLPVALGTTRGTEHRFVAANAAYRFFSAERPILGLPAREVFPEVLAQEVFVYLDRALETGEVQSGREWHIQLDRGAGLEDIFIDFTISPVAGADGVNAGVNIMLVDITEQVLEKRAMQRRAAEAQRRYEAARGVVAELQSALLPTALPVLPRVQIAASYLLADADTAAGGDWFDAFPLPGGRLALIVGDVVGHGVAASATMGQLRVVLRERLAATGDLPAAIDAVDRIAVTLPGGRATTVCVVVLDPSCGTMVYCTAGHPPPLVIGEQEPRYLPATGAGPLGVGSRFPVSQEKLGTSEILLLYTDGILERPGRDVPQSTVELARVATESAADRIFHGQFPTAVDRLTIQTVELLTRGSGHSDDITMLAAQRVTAPARLDLRVPARSETLTELRVRLQAWLDTARVGAHDADAIRHAVIELAANVIDHAWIDSPDEHWFTVTADLTDTGHIHAQVTDRGRWREPAPSADRGLGLHLSSQLVDDLRLTHDEQGTTATITYRVHHRARLLSTADLAPAPAVRPAAQNELLLILDQPHAPQPRIRVDGPIDTVTADEFDRAVRTAGSAGVRTLTVDLTGVTHLASAGVAALHRLTALHQASKTRLRLYAPTGSPADMILSLVSLTHETVDPGYPENTIQ

SEQ ID NO: 8830 - protein, 320 aa, Actinoplanes utahensis
MEQPAAQTSSIELRGTDTVEEFLNAAYGTGMRLRDTGTPPVLRHERVDAGTFAVETAHQSADLKFQIDALRKIVVTRNSSARLERGCDGTTQRYEPGALFLMSHPNRPYTVRWHPGTLDNCIIDADSLAKVAATAPGRRAEPLRFTSLEPVSKRAAASWWATRTYAAELLAGPHPTTPLMLSGIAGLLAAATLTTFANTALTDPTIEDRHDASPSTLRRAIAYLEAHPADDISTADIAAAAHVTVRAIQLAFRRHLDTTPTAYLRRVRLEHAHQDLMAADPATTTVTAIAARWGFADHSRFTALYRETFGTTPSRTLRPG

SEQ ID NO: 8831 - protein, 141 aa, Actinoplanes utahensis
MVENDMPSVRLLVADPADPHVARVEARGSFDRGSCHQLTAAVEQALSTGRHTLVIVVRHIIDLDAATIRALLTCRELALTGGGSLRVVNDSGIVARLLDLSDTRRLLCPPDPTASIPAESAAADNLGRPVVALRPRTGEGR

SEQ ID NO: 8832 - protein, 280 aa, Actinoplanes utahensis
MVRRDVVVIGGSAGSHKPLRQTLARLPADLPAVVLVAVHTAPGARGGLADSLASSCTLPVRAAVDGTRLEPGCVHLAVPDRHLIIDDGHVLRLSDGPRQNRVRPAVDALFRSAARWCGPRVVGVVLSGSLDDGAAGLAAITAAGGTALIQDPAEARFPSMPQAALRIVPGAVTVPALDLGDTIAETTGKPSTTDGRPPEPLIWETDMIAYGGSNTPDRGQPVALGCPECTGGMYVIRTGLAAHYVCHVGTRTLRSHCSRRATTAPRRRSGPPSAPCRKKP

SEQ ID NO: 8833 - protein, 244 aa, Actinoplanes utahensis
MATSQHPEHVTPHHRPLADAIVGLAETPDHVSGVEIHLKVIAALAADRVAAADYASVTTLQGDEYTTVAASSDIASAVDEAQIADGAGPCLQALETGEPVGVTDTRATMDWPGFHAVAPALGLQASVSVPLYIGRSTPIAVLNLYGRDSSTMEPLIVGVAHLYATSRELALGIDPPPVRDPGAAKLLDGYARALAVRTCIQRAVRLLTELGGHSSDDAYTTLCERAAEHGNSLSVEAKDLIHRK

SEQ ID NO: 8834 - protein, 36 aa, Actinoplanes utahensis
MSIDGAFDLVDDAGDLMASDTMELSGRSIKVLRRRT

SEQ ID NO: 8835 - protein, 217 aa, Actinoplanes utahensis
MASAPAVRTALLKCLVEQPDALVVDLAEMVVTEAAAASVFLAAARQASHWPGVPVLLAAPDPQLAQLLSQGYRRLTVHPSVQQALNAPIRQQTSTIKDTLLPTSGAARHARALVTEGCLRWELPHLVGPASVVVGELVSNAVVHAQTMIDLRLSMGRRYLVVAVRDGSDALPVLPAPASADPLDVRGLLLVQSLAHRWGTLPAHGGKVVWATLSRST

SEQ ID NO: 8836 - protein, 161 aa, Actinoplanes utahensis
MRRVFNSEDDVSTAGQEPSVTFAYSSAPRLHIDGITPAADGSVHLCLIGELDQEETDRLHAGITDLAHRYASAPIHIDATRLTFLDSAGIRALLICRKRLEQAGSRMSMPRVHPHVFQVLQITGLLDVFGVTEQTAGPAGEPTGHADEFIPAASGDEREAG

SEQ ID NO: 8837 - protein, 334 aa, Actinoplanes utahensis
MATMITAGRPVTRTMPAPALTIGVEEEFLLLDPVTGANLPIADQVAAALPESVRPRSRREMRRSMLELVTGVCTGLNEVRAQLSEQRRAAADAAEAAGARLVAVGATPVAELDSSMPAGQRYHDLADRYGPVAADPAACGLHVHVGVADRELAVQVCNHLQVWLPVVRALTSNSPLFLGVDTGHASWRSVQLLRWPSIGPTPYFASARDYGRTVEDLISSSMVLDEASIYWYARLSPTYPTVEIRVGDVCTDLDDTVLVTALVRAAVATAIADIPGRDPRSAAPRLRAGRRELALGPLRAQRRPGRPAARARPARVGARRRVLRHGQPRPVEVR

SEQ ID NO: 8838 - protein, 194 aa, Actinoplanes utahensis
MGRCGRPAGVRAGGAAAAVQVRDGRELILLGQLTCRDHHPVVLAEFERGFAAGQAQSTIAQLNAYGVQSWLPEVEGPVDLGEPEHRAVLSMLGHQSQREVLRNRFRTAAAMAAQVRAQGRHLGGRPPYGCRLVDAGPHPNKVHAQWGRRWHRLDIDTVTAPCVALAPLRCMTRFLNRRTKGSRWRHRASGPRVP

SEQ ID NO: 8839 - protein, 279 aa, Actinoplanes utahensis
MAFAIAAFHSAEGRQAVQALLARSGHTVAHFRTGAAAVAGALAKRPDIMIADTRLADMSPVQLGDALRARPETAGIPLILCGSVDAESKRMAQDLHQRVFRALLTPRSLQSVISAALAVRGGSPDAAVAPRSAGDTPTAAAPATGEQWRVLLVEDDDSIADPLVEGLARYGITADRVATGVAALAAPPATMVLLDLGLPDIDGIDVFQQLRHTTDVPVIMLTARGDEADRVRGLELGADDYLGKPFSIRELVARMRAVNRRSTTAAANQGRITAPTGLR

SEQ ID NO: 8840 - protein, 474 aa, Actinoplanes utahensis
MTRRLLATYVTFALLILLGLEVPLGYAQSRNEQNQAFEQLEHDAEVLAAFIDSALARNDMLQIEVLARESAQRLGGNVEVMDAHGQILASTYPPERPADSPTARSDVDAVLRGQGRVSARMSTAADVRTMSVVVSVHPGLQPHGALEVNVPATAVTTRVQHFELMLAAAGILLLAAAAGTAFALARWISRPIRALELATRTLADGPLPVTLPVDSGPPEVRRLAVTYKTTAERLNTLITSQRSFNGHASHQLKTPLAALRLRLENLEPDIAADGHNNLQAALHETDRLARMVELLLAMARAEQSALPQEDGFLTDTIDRRICFWEPLAISRGIHLATSGPVDVGVRAVPTAIEQIIDNLVSNALRVAPHGSTVTISWHVIDQADSAPEVELHVIDEGPGLTAEQRTQALVPFWRAPSAGTGGTGLGLALVRALAVASGGTAELRPSGTGGIDAVVRLPAGSGRSHQQLSAMPSN

SEQ ID NO: 8841 - protein, 721 aa, Actinoplanes utahensis
MARSRGGKKLVSAREQSVDALFGTESFGLDYYQREYVWEEPQVARLMNDLSRKFLDQLSDEHSLGDVKSYDPYFLGPYIICTADGRTSLVDGQQRIITLLLLLIYLHRQAVAAPKARSKAGQLLTLIMSERFGRRTFRVDVDEYDACFNALLNGRGFDVAGARPSVRRIWQAYQYIDLHYPAQLRGDVLIMFIDWLLYRVSLVVMDAGDRERAEEMFQSINDCGVRLSPMDHLKRFLLSDAEEDPSEIEGAWTTMVSALEDVEKGAAFAYLRAVFRARFPEAVGRPGPSLNDATHEWVRVHEREIWPNRKSGDRARLVTEVLYPFHTTYVTMLRARSEINPGLRAVRYNAFNGIAEQFDLTLAALRSGDSEIERKQKAGLVANFLDLFYVTQTLGDESVEQRHVDELVSSVMPAVRLSESVQELGRVLGDQAADWPVRLDLISELRYDTKRRFVHYVLTRLTAWVEMGATNGETDPTDRFLLRRHHDRDFEIEHLFTSTASKYAHKVPDARYYGFLRNRIGALLLLDGLDNGSYGGMLLEDKLAMYRKDTRLAGMLNPDFFQRGNVRLRKFLTSEGLFAMIATYDPSTALEPFIDARGRFYREIAKKIWSLDALGLAPPPAPGPVATGRRTRYGVRFQDLVQTGLLSAGDRLFGRRRGQMYYARVRPDGRIETAAGVASAPSKAMEDAVGVAGNGWAFWSAEDTKERLDAIRQQYLDRFGR

SEQ ID NO: 8842 - protein, 221 aa, Actinoplanes utahensis
MDTTILVKQFADDHGAVFLEVIRTSPEPIRAQAIKALLVEAGVKKADVDRRWTAFQRALKLHPQITAANGKYGWSVERKPARDSLDVLAGNLLAKLPPWLVQPLVQNVAAALDAGESTVSGPTSHEFEEARLVADLAVAVEVLQSRGDTIAEVAKLLMDETRRKRLWPLGRPGETVPFDPDSHEAEVTMPNPGTVVRVVRSGYLWRGGGEPVVAAKAVVAL

SEQ ID NO: 8843 - protein, 60 aa, Actinoplanes utahensis
MLCGSRAFWLVVAVARSVPLPPLVPRLTLPDRQGQRREAVALVYAGQPKRRTTPARPLAT

SEQ ID NO: 8844 - protein, 65 aa, Actinoplanes utahensis
MNSSTIWFKSSYSGAAGHCVETAFLENNKVGVRDSKNRSGPALIFTAAEWDAFVAGVKANEFDRR

SEQ ID NO: 8845 - protein, 230 aa, Actinoplanes utahensis
MGRSKTLTSRKALTAATLVTTVGLTLAACTVEHPRGDKTTPPAANGSAGTPSMTFDEAYRKVPMNGTANQPITWDVTSTPDTEEVLAARRSFAFLHWEKQATDWAPILPIGRYLYTDDYYASVFAPFITSTSPIEDPWAGPIWVKSVGVEQMAPDRQRVTFCADLGNWHHGSEKPYAAPGHRGVIQSYEMQNVESGDGERHWLTDRVFNPDIDRQAKYGSACTKWAVHKP

SEQ ID NO: 8846 - protein, 142 aa, Actinoplanes utahensis
MVEQVMGKVTGKIPVPVVGDLANNYVNDLLTQAQQRDMVDNHGHAVFKVADALGAARNTSAHLTEQSLYNSGKLHDLPDSLIVDGHPKPRETWTHNDFQDWQEYKNGRGQSVVGIAADHGADAYQNGWTWARTILGGSDGTE

SEQ ID NO: 8847 - protein, 677 aa, Actinoplanes utahensis
MSHLTLRDLLEFDAAPWHAAADAWQRLARGIDATSEQLLAGTRDLGEVWPEGEGSAAALRKAAMLRAEVENSYLPAKRLADAFDQHAYAMKAMRDIAAGIIYSAQQAGYTVDTAAVTITAPATAYMGGNLDRTGREIGSLLADLRTVVENARSQDVSTAAAINSNVPSPKTGFGASPASAITRAQELANKLKDPTYEPTRDELDELRNLIMLYGTDKAFAHDVLTALGPQGLLQLDGTLATYQLDYPGKDVNSALFSRDTADMVRDLQNGLGVMLATATTPTGTRTGPHGETRLPGQYDLPSQWVSDLMTAGRSTMNIGDPSSPGRFVEGVYGYQLLGPLLHHGDYDAGFLSTVGGDMVDFEMSKGENSALWNHAHRPDNLRLDWTQGHDDNHVPAGLDPMNGLMEALSHNGAAGRDLLTGVTSFTSDGPLGGRLPRLDYLLTDRNWSATADVAGGPGWTADVLQHGSDYHNTALDNFGVALQHATMDHPGPQARHIVESIIYETGVDEQAQYYPNGVVPGHGTSTDFKSTDLINPQLRQPLATITSGYIYEINANISESHEAIPGVTIEVDRNHLVRFLADLGKDPGAHNTIADAEAAYALGSYDDILSGRQNPHADMTDHLNAMEHVSHNYGSVLGALDHGAAAATHTRRAPNWTRSPTNTSRTTTRSWTLWSSR

SEQ ID NO: 8848 - protein, 108 aa, Actinoplanes utahensis
MMFGWGMPVLQVDAEALGGIGRNVADAFTTLQGAVTASGARLAPAPWPVSAAATAAQAAEKAWSADLRRLTGEIDEYGRSLTAAAQTYQGTDRDNAHDLHGGGAGAGR

SEQ ID NO: 8849 - protein, 146 aa, Actinoplanes utahensis
MLIATLAYFPTSCDPADHSCAPLPVGSSSVIFSPFWGGFLLAGYLSYRARVTVDSEGIRVKAVLDNKLHPWSTIHDVRVVKVRRYTNYFRTGTERRLEIRTEGRRGIVSWEELPVPKAGLLVGKKKFDRQAELFWRAWNAQRSSRY

SEQ ID NO: 8850 - protein, 189 aa, Actinoplanes utahensis
MPVGPASSADLWLSAGVRVRPPSVPSVESVVARFVVVQEVRVPATATWTALVDWPRHGRWAPLTAVRTVTDRPDGVGAAFVARTGRGPVAFDDPMTVVGWEPPQGDSPGDRPGRCEVEKTGRVVRGRAWFSVTPLPDSRSRVVWAEDVTVSPHRVTRFAGPLLALAGRLGFAATLRAFARDIEGVAPRR

SEQ ID NO: 8851 - protein, 133 aa, Actinoplanes utahensis
MISADRFAPDGLDVSTVIDRATPDCTAATALALRTDPLLGTFLTGSDPGSILVCNSVPLRFRFRTAARVVRLTYAGEGEHTFVAQLTDGTLVDCPVGAAPQVSYTAPEGKAIASVVFSGGDPVAVKQLAYTEG

SEQ ID NO: 8852 - protein, 284 aa, Actinoplanes utahensis
MDRAERPRLRPAPVTVSLQPDRLDLRPGRSGDVTVRVTNTGTLVSHYDLVVRGIPAGQAVADPPRVELNPGDTRTVALRITVGEPGPPYAGRHVLGVVLRDAASARCEELTVTVAEAASLDLTVRPEAADGEPAAEYELALTNTGNTPLATRLGAQIADRGVECTLSPATVTVGPGATATARLAVTAPRPWTGNATRSLGVVAAAGSLRAEKQVLMRQRPRIPVGLMWVAGPLSAALVLAATIGGTALVLRRPRRRPPRPRRRRRRRGRRPSSSSTSTARPATR

SEQ ID NO: 8853 - protein, 777 aa, Actinoplanes utahensis
MGQSARRRLSVPARRVVAGLSTLTGVAGLAAAAVLGAGHGYHAAAPHLLAGAAWLPSAGPGEVELLDGSNAEVAARVPVAAATHDFDVVQHGSDAYVVDAVNGMVSRVSGATMTASPPVALVPGATTGVRVFAGDGVLYAVDTVHGLLAVLDPETLALRGTPRPLAVATDPGAAVLDAHGVLWALDTGAGNLTVVRGGESVVRRRVVTAGAGRLLLAGGKPVLVDLATAEASTLDRDGRSTATVRIDLGDDRDPAIGGSPDDARVYPTLRGTVSVCELTVNGCGRAITLTAAADRLGTPVENRGRLFVPEPAHGRVHIVDPVSGHVIRRTVLRPPGDLRLFVHDGMVFFNDPRTWRAGVIREDGSVVTVAKYDKRTSSRATMSPNAPVPTEPAPTPSRSVTSTPRVHVAGENPRRPSSSPPPVTPEVAVQAARPTVMVGEPDELNLIVTPGTPAPQSVIWTFGDEIGAEGPGVAHTWPVPGTYDVEATATFAHGVVVSARTSVQVTDRPTLAVNAPAGGTVTGPGIACPGDCDEPLDGRSGTLGLTAVPAAGFVLAGWSGDCAGTAPECVVDTTTSRTVGVTFKRLPISLIELAPSATWDSGEGPAQAEAVRALGPPGSEPAPPTNPPVLVYAYAQGLIPLNDGSAPAVLELQPSTLYDVKDPLDPWIQGDFALPSPVVSGDQFRSRIAFRVRPEWEGNVTDGDPVPGALFAVEALMPDDHWKQISGYQFRAPEATIHDFNFDLGPAEGATKIRIRIYAGELPGREQFLWIEPSVQG

SEQ ID NO: 8854 - protein, 786 aa, Actinoplanes utahensis
MRRFARRLAAGARVLTGVVGVGTMAVVGAGHGYPAQAPHLLTGSAWLPSTGPGEVELLDGVNTEVAARVPVVPAAHDFDVVQQGADAYVLDTADGTVRRVDGATMTATPAVGAVPGATTGVRIFAGDGVLYAVDTAHGLLADLDPATLAPRGRPRPLAAATDPGATVLDARGVLWALDARTGNLTAVRRDRRIVRPAAVTPGAGRLVLAGGKPVLADLATGNAYALDRDGKTTTTVRLELGGEPDPAIGGSPGRARVYPAYRGTVSVCDLNADGCSQAITLTAATDRLGTPVESGGRLFVPEPAHGRVFVVDPATGSVVAQPTVLRPAADFQLVARDGQVFFNDPRTRRAGVIRMDGSVLAVAKYDKNAAGPGAAPTTTPPPTGPRPQPSATSAPAPQPTRHHPSPPSSPAPAEDPTGSAMGQSGPPSKPAPSASPAPPVKPAVTIEASAPTAMVEDLVTLDLVVTAGSLKPDHITWTFGDGTDDTGPRVEHQWDKPGEFTVEATATFPGGAVASADVKIVVTVRPVLALMAVYGGKVTGPGVDCLADCLIPFDGAPTRTLTAVPDPGFVLFSWGGDCSGTDPVCVVDTTKNQVASVTFHRVAVSLTEMATAATWTGGRGAPASRGEIFDPNSTAQKAGGRGFALVHPPGSWILEDGVAPAPEYLETHPSYTEPGSTQDGWIQGDFTLPSPIIFGDHFRSRIGFIQLDPRSGVSVGEADFAVSVVMPDGTAHEVFRTRDKASDRVMPDVDVSLSSWPGATTIRLRAETDGPSSQDWCAWVNPRVEG

SEQ ID NO: 8855 - protein, 941 aa, Actinoplanes utahensis
MGAPAGRHRVPAADRSQPGPGRADLQRGAAGRNRLPQPSRVRARRRLAAHPLEVQRAYRPVDGAAQRGPERAAPHDRAGHQRGRLRRRVVRTRGPGRRLAVGGRAARRVPARTAYDRRRGHRRGRGRAGPHVRAGSAGRRPPRPGRPGPGRAARARPRTERRLAGRGDRPARPGRAGRAPDDQTPVPDAQPGAVRRDLPGRDAAARRRVGRRDQPRRIRPRLERVGTPMRTGPLHQAEIALGTAAVAVTAPVYGAFFVGRGYLLPLLVAAAGGATMAVLAALTHLRHAWTAVAVTGGFLVVAVYAVLPGTLRYGIPTGTTLSTLGTGVSFGWIRMLTVGVPADVRGELLITPALVLYLCGFAAAQLSLRTRSLFAPAAVPPLALLAALPLTAGRTAGAMTITAVMLLAGLTQVLIRAVRTEGAEGGSRLAGRALFGLPVVVAVVAAGTGFAKVAPIAGHQRFDPRTVVPVPLTIEDTINPLAALKSRLREKNPPTLFTVRGSGLDRVRTAVLDTYDGAEWTSHDRFLLAGHELAPGPGTPHGVQVGLHVRIDALEEPYLPEAGWPEQITGSGIGYAVASGVLATPAKDRHGLSYDLVATVRPRDAGARTARPFVPSPRYLALPADFPVELRQEAQTLTAGTAGDYPRLVALETRLRALRYDPATPPGHSLHRLRGLFGLGTNQVAGYAEQHAAAFAVLARSLGYPARVATGYLLRRRSPAHGVYTVRSTDAYAWAEVSMAGYGWMAFDPTNPDNRHTPAPPPNPVPKSQPQVRPGDVAPSMVVRPDLAAPVQLSPWDWALIVAAALVALAILLPVLVVAEKQRRTRRRRRGTPAQRISGAWRESSDRLREAGVPIHRAWTVLETADHARRRLGDTTAPVATLAPLVGAALYAAEPPAAEAAEEAWRADAALRSALRRERGLPATMAAWIDPRPILIRDRSN

SEQ ID NO: 8856 - protein, 328 aa, Actinoplanes utahensis
MTAPGESGTGNLSWVRDRVRALVDNIEHVVHGNTEVVRAAVTCLLAEGHLLIEGVPGVAKTTLAKAIAHSIGGRVHRIQFTPDLLPTDVVGVNIYDAANQRFEFHSGPVFANIVLADEINRASPKTQSALLEAMGERQVSVDGRTYDLPAPHFVIATQNPYDHQGTYTLPEAQLDRFMMQLRLGYPAPEHEMRVIGDAIDRRLPEQLSAVTDTEELLRLIEVARTVHVAEPIRAYVVAVVGGTRNQPDTVRLGGSPRAGNALAMAAQARAATEGREYVLPDDVKAMAVPVLRHRLVLTPEAAIRGATAASVLDGILAAVPVPQTATAR

SEQ ID NO: 8857 - protein, 56 aa, Actinoplanes utahensis
MFPLGVDIGGTTVAAAVWRRGRAEQALLAARRPGRDTVLPLLGTAAPVLVRGVPRA

SEQ ID NO: 8858 - protein, 252 aa, Actinoplanes utahensis
MAQFAAEQLYALARRAGFGPDAAATMTAIALAESGGDSRAVGPQGPGLWPIDPASFPDLAARHDLTDPPGCAAAAFELSGGGTDFSAWRSTHAEPVARFLRHRRTAQAAATAYGDGPGRGLWTPASPAVEPPPDPGVEHPLDSGVEPPPDSGVEPPPDSGVEHPLDSGVEPPPDSGAEPPPDSGAEAARGGVIAAPASCPAGAEGVQGGGIADPASCAGGTGGRAGADDRDPARRAGAAVPGRARGLPPAAS

SEQ ID NO: 8859 - protein, 639 aa, Actinoplanes utahensis
MDDAPAWEVLADTLLQREALICRIAEGRPPHDSAGLYPGRDDDLDRVLGGLPGLDGPGSAAADSVREHLAPELERARKLFTEAVDAGRDVFALVVHRAGLTLAEAQVLAVLCAVDLSPARMRLVTYVQNDIRLPRPTLATLARMTGDAGSLSPDARLHTTGLVETPRDGPWARRCPVPADRLLWSLRGIGDPDPDLPHGARLIGRTAATRPTAPVLLLAAGRDAETRTRAVIDRCPGRGLLITAPPQTDAAWCAVVREATLGDRVVVLDLPGEPGPRAGHEILRAAHLSWALTSAVDLPLAALPRALWEDLPAADPHADAGDWSAAFGTAPGGRLTRDQLGLVVAAAGGNPARLPQAVRRLAGGHLDHLTTRLRPRRRWSDLVLPDRQAARLREVITRYRRRAVVYDGWGFAAVPSTGVVALFSGPSGTGKTLAAEVVAAELGLDLYRVDLATVVSKYIGETERNLERVFDAAAAGELVLFFDEADALFGRRSEVTDARDRYANIEVAYLLQRLENQDGIVILATNLHRNIDDAFLRRISVHLDFEPPDEAARQRIWELAFPSGAPADDLDLPFLAAQFRVTGGTIRNAALGAAFEAAENGTTITMGHVVRALRREFDKMGRLCTEADFGRYYALIDLT

SEQ ID NO: 8860 - protein, 217 aa, Actinoplanes utahensis
MLDLLDEALESFLRAAVPLGADVAVSFDAPDRDWAARLSGRPTVNLYLWDVRRNLGEQEAGEVLTTGPDGRRTRRGALPRVDCRYLVTAFTSEVRDEHALLGRALAALLRETEIDARLLPEPIAAVRPLPSVRIAASDGRDNSDFWSALGGQLKAGLDLLVTATIDAVPLPQPAGPDVVQRVLRLHDKSAATLLETINLPNGGTDESLPGAAVPLPE

SEQ ID NO: 8861 - protein, 1102 aa, Actinoplanes utahensis
MSVPVLPTVEPDEAGRTTVPRTVPASTAGAPTSLIPDVVLDGIHAAVTAIPGYPLLTQVIGVDPITGHAVTTAPQQLVESVLTGAGPFGAATGRVLAAAGVVDEALAAIHVRLAAHRITLARIGDEIAAAWAELSVTAGIDGNAAMLGRHVGGMVADVRAAVAELIETVLSMVRRVVADLAGPLLQRPGVRPVWELATQVFRYDPLRGAEVRVPTVEILTGFLTVIGREQTIDQLRERGVLQSAADWLDTRLETFAGIRDDAVRLFADAWAALSPESLPRLLDTLPQLAERAITLIRRILSFGADLLGKALALVKDALRGALAQRAARVPGYPLLTVLIEQDPLTGARVPRTTASLIEGFLGLLPGVGAAAAERLAEAGVLTEAAARIEAEVARLGIGADMVTGLFHGIWDSLELADLLDPAGACERVVARFGEPLGRLVAFATVVVEVLITTALKLMDFPPELLTSIVADVAGALADIRRDPVGFLLNVVRALRLGFAAFLDGIAGHLLRGLGSWLLRGLAGLGVAVPDGPMTTSAVLDMAMQVLGISAETLWEKVAVRLGPERTAALRNGTARLGEAWQFVTDLRDQGLSGILAHLADRVGALWDTLIGLATDWIMTQVVQRAAARLLSMLDPTGVMAVVNGCVAFFTAVRSAIEYLRDILRIVEGYTRTMARIARGELTPGAEQVTRGLADAVPVAIGFLAAQVGLGNVPEKLVELIESLRALIDRAITWLFDQAVRLGSGALNALRGEAPGAPAGHEGGTQLAELAFALPFPVGPEEHELIADVDPRRLVVHSTPTTITDLIAANPGTTLQADHDRYVAAVDAFKQALDERARTGSDAAWADAEKTAKKKLAAVKKAMETLVATITPLKGFDPAVPGTSAPGIGTEAYWDGNRPLSLQNGSLTAHRIWHLTAEHVIPFDLGVKLWNAVALGAPERDGGKEVTSQRIIMIYRGAGDLKTTRRDPVTGFTEREISRLFGRAVKEADFPARVRSIGYRDDGPVPGAATQAEQARRELLDAIDRAMCQATQVSVGRTRWAVETEWASRGNGFATTNGQRRGESAPTPTGSQIEATADVQRRDILLLVTHAVEHALEQIERSE

SEQ ID NO: 8862 - protein, 144 aa, Actinoplanes utahensis
MVDLITTQTFVLEIDSVEVGSFRKVSGIESETETIEYKEVNKDGKMIIRKQPGAMKWADITLERRIDVSQVLWNWRKDIITGDVDKGRRNGAISAKDSKGDVVARWEFVAGWPSKWTGADFDAGANDIATEKVVITHEGLVRVK

SEQ ID NO: 8863 - protein, 74 aa, Actinoplanes utahensis
MSLHTEFPFTLPKGYVDEEGTLHRTGVMRLATARDEIEPLRDPRVRENESYATVIVLARVVTELGTLPPGSTRE

SEQ ID NO: 8864 - protein, 45 aa, Actinoplanes utahensis
MIERLFASDFGYLQDFYQLINFGDPAALDALEPGAPFPRVSVEVV

SEQ ID NO: 8865 - protein, 156 aa, Actinoplanes utahensis
MLPGDHRVPDPPWTGRFVLSVDGLEIGTFVEVGGLSVTIEVEEITEGGQNQHTHKLPGRMKWPNLVLKRGLTNAGNLFGWFTSCSGEGFTRKGNQLDVRNGEVAIRDGRGRAVQTWRFTDAYPVRWTGPRLAATSRDLAVEELEVCHSGFTMAAGR

SEQ ID NO: 8866 - protein, 223 aa, Actinoplanes utahensis
MDQPAKAYIEVERTGERIDCLFNPAELTVVKANTWQAGEAKGVDAPLLRFQAGQSATIALSLVFDTTRTGGDVTSYTSKLLNLLRVDPDLPSNDPARASGRPPWVKFHWGELHSFRAVIDRLQVRYTYFASSGRPLRAKADLTLRQLQDEHEHPLQNPTSHTPAPHSVHVVRPGETLDRIAAARYADPGQWRLIAAANGVLDPLDLPAGTSLVIPERPVRRDR

SEQ ID NO: 8867 - protein, 546 aa, Actinoplanes utahensis
MTADRGLDTVAITVDGAPLPTSLYPRLIRVRVQESIHLPDQFTIRFEDAHFQLFDQHRFRPGTRVEIAFRSDADPVVVTSGEVTTVEVAPGVSGRHELVLTGLDLAHRLARGPRTRSFTGMSDGDVAARIAADHGLDADVDATGAAQDYVLQIAETDLAFLRGLAARTGFDVWVTGGTLHFKRRPSSRVTPPPMRWGDNLLDFSARFASAEHCDEVVVTAWDPVEKRTVTGRAAEPEYGTDAPAAAQSAEAARGAFGRTVRRTGQVPASGLAEAEAYARSLLSKASGSEVVLRGLAKGNPLIAAGARVQLERVGQRLAGGYRVTSAEHDFGAGGPYLTRFVCGTRDAGELADLLRPAPGAEPRSLISAVVTSNADPEKLGRVRVRFPTLSEQDESAWARVVTPGGGPGRGMQWLPEVEDEVLVGFELDDRTRPYVLGGLFNRRDVPPDPDVARDGAATRRVLASRCDHRLTFDDDSPGAVELALSGGDSALRLTGDESALRVAGALKVTGRTIEIAATDRLVLRAPTVEITADAELRAAGRPIRLN

SEQ ID NO: 8868 - protein, 131 aa, Actinoplanes utahensis
MPNAAREGDPVTGTDTHLVLVPGPGGPVPVPQPLPFAGTLVSGLSPDVLIDGRPAAVVGSGVVNSPGHLPVPPGTGFVNPPLNRGTVLSGSLTVLVNGAGLARLGDPVTTCCDVPGAPATITAGSPGVVAG

SEQ ID NO: 8869 - protein, 132 aa, Actinoplanes utahensis
MSDLIGAGWAFPAGVTPAGGVRLARGGDELDGAIRMILGTAPGERVMRPDFGCALWEQVFAPVNPATLGLIEQAAREALARWEPRIVVEDVTASADGEAAVLVTVGYRVRATNDRRNLVYPFYVIPGEEPTE

SEQ ID NO: 8870 - protein, 647 aa, Actinoplanes utahensis
MSLPAPDLDDRTFQDIVDEAKRRVAAACPAWTDHNVSDPGVALIELFAWMTEMTIYRLNQVPDRLYLKFLELVGITLASATPARTGLLFRLDGPARDTVVVPRGTRVGTARGRDGDQVVFMTDADLRVTVPEVIACRTRTGGTDTDHTGELRAGEARIAVFPGVAAGDALYLGLSADHGGNLLQLDLAVAGAHGAGIDPEHAPIVWQYWNGGGWEDVRVLTDTTGGLNRPGTVEMLIGPVQGELVIGGVPAHWLRCVLRPAAGQTGYRTSPILRSVAIGGYGGLAPALHAEPAPGELLGVSDGRPGQTFVVRRAPVLPRADGETVLVVPGNGAGQPEEWTEVASFAGAGPDDRHLTWCGATGEIRFGPRVIDRHGQARSFGAVPPENAQIRVTGYRFGGGARGNVGAGKLTVPLSAVPQLRTVTNPEAATGGADPETTDNARIRGPLALRSADRAVTAADFERFTTEVSGVARARCLPPDEPGGPVRLLVVPATARSPRHLGLDDLRLPEAVGEDIRQELDGRRLLSVRVRVEVPRYQGIRVSAGVRATATVSADVVGQDAEDALYRFLDPVAGGPGGHGWPFERALGVGDIYLVLGAVPGVAAVTSVNLTLTDLWGEREDAPGGQEVPLVPSALFLSDRHTVAVAW

SEQ ID NO: 8871 - protein, 167 aa, Actinoplanes utahensis
MTWLLAQLPQTMARDPFLAGFVTGCQQVADSVRAQIDDLEHELDVDLASPEMLAYLGSWLAVSLRPATTPAELDDQRRLIRAVGSVIGYRGTCYGLERLLSALTGAHVTIGDPGGVALPGEPDRPGGDVRIEMSGTGRCDVAQVHAAIREELPVGVGYRLVVAGREQ

SEQ ID NO: 8872 - protein, 77 aa, Actinoplanes utahensis
MIGMTADEHAARAAELIDEAERLYQICLVDYHTNINEDDHSEEPYVPGADLAMLTATTQLAQVHATLALRGPAAANG

SEQ ID NO: 8873 - protein, 132 aa, Actinoplanes utahensis
MVPLILSHIKIIFILGGMTEPMRDPSFWVLTALAPEPRHGYGVIREVNRLSDGQVTLQAGTLYAALDRLTSLGLIEADREETVDGRPRRYYRLTTDGAAALDAETERRRAAVAAATAQLSARRRLGLSLSTS

SEQ ID NO: 8874 - protein, 469 aa, Actinoplanes utahensis
MSERLARRYARLLRCYPPGPRRAEMLGTLLECAPPGRDRPTAVDIVNLTRYGLRARLGRPASTSVVLLSLLVALVCGLLGAATGARLGWMLQKPLPSGAQARELTTAAFPGLPVLGGGDAPPFVPASGADGGEVYGFAEYWVRNTPETRDVPAYTRGVRDRLAGAGWQIRDDVTAEQDDEQASWSAGFTATRDDLILNYSAYYVKDHPWYDSDGSAGFQLSRTTPPWPARFAVPAGLLAACAGWLLFGWASRRSEGRPARTRGAVLLVWSAMLVVAASLYFICLWYTQPGPLEGRPLWTTLDQLSGAPTTLVFGLGMLALVTAALPARHRILAAAALVLFMVVAMNGRPSWTRPGCTPSGPPAALPAAEVATGLTARVYVTGDASAEQRNIAQAAIWHVPSVRSTAWSGDVTDQDYRDAYCGGGRITGASRATLPGFWLVELSSPGGFDGLVAEVGGLPGVAAVRHSAP

SEQ ID NO: 8875 - protein, 484 aa, Actinoplanes utahensis
MTGLRSVRARSALAAAAAAAVILTGGGLWARHFVGQQQLEAGRRSAVQQVNAMGLAATTIGTGGAEELRPAFYPDVTFEVVDTTGAVLSASPDLAPYESDGRAVMPAADPLPGDISMDTPEVSATVRLADPPGDHALDGRTVTGVRIQGAPVSMTDHPELGPTFAVYVFVTPLAAERAVATVDRILVGAVPLAVLVVALVAWFATRRALRPVEAIRARTAEVTASRLADRVEVPATGDEIAALATTINAMLDRLQRADRAQRRMVSDAAHELRSPLAILRAGLEVAQAYPDRTDWPATAATAVAQAQRLTGLADDLLLLARLDAGTAPPQPEVDADVVAVLSRMAVETITRDGVTVTGPAGPPVPVRLARVPFERIVRNLLDNAVRHAGRRVEIRITADPAAAGRTRLRVEVADDGPGIHPGDRDRIFDRFTRVDAARDRHAGGAGLGLSLARELATQLGGILRVADRPVPGATFELTLTVTAA

SEQ ID NO: 8876 - protein, 230 aa, Actinoplanes utahensis
MLHAMRLLVIEDEPELATILQRGLTAEGYTVDVAGDGRVALDLARFEDYAGIVLDLMLPGLNGYRVCATLRREGIRTPILVLTAKDGDYDQIEALDTGADDFLSKPFSYPVLVARLRALVRRGPAAVPVRLTVGDLVLERAARTCRRGTVPITLTPREFAILDLLAHRAGEPVTKLEILRQVWPEDVDDPNLVEVRVGRLRRKIDLPFGRSSLRTVRGTGYRLVDDRAAA

SEQ ID NO: 8877 - protein, 462 aa, Actinoplanes utahensis
MIVLSHDVVPAARATPVRRSGAVLAWSGAGGLAVIYLLLSLLNHRRLRTTGFDLGIFEQAVRSYAAGRPGLVPLKGPGFPQLGDHFSPVLALLAPLYRIFPTPVTLLVAQALLLAVAVVPIMSLAHRRLGAFAAVTAGAGYGLSWGIASAVGFDFHEVCFAVPLLSFSLAALADRRLRAASGWALPLLLVKEDLGLTVAVIGLLVAAFGARRLGGGLAAAGLLGTALAMGVVVPALNPDDAYAYSAAVGSGLQHPVTAVKLLTVLALLAPTAGVALRSPLAWVAVPTLLWRFASGNPNYWGTGFHYSAVLMPVMMLAFVDGLTRRRPAADRTGAAATRLVLVASLAVTGFLLPRYPLAQLASAPIWRGDPRGTAAHRVLDLIPDGATVSAANRLVPQLTGRTTVTLFGLDYPGPAPRYVVVDLEVDDWPLPRDIRLARVEALVAAGYRTVTRDSGFVLLERP

SEQ ID NO: 8878 - protein, 153 aa, Actinoplanes utahensis
MSSPGSPLLSSRQFVTFEVAGQFFGVDVDAVQEVLSYSEYTPVPMAPTAVGGLFNLRGQVIAAVDLRVQFGLPRRDMTGLVMNVIVRHDGEPVSLLVDRIGQVAYLDAQMFEEPPATLTGPSRALVTGAYKTEGRLLLVLDVAECVNTSRVTA

SEQ ID NO: 8879 - protein, 274 aa, Actinoplanes utahensis
MELGTAVIPIGYESPFRLAEDLSLADVLSRGRLQAGFSAGTPPHAELLGPLVFDGDWRGFDLSHGRIARLADNLRGDYLGGPDTVIRSPGNTQRPRLQPHNPGLIDRLWYGVGSATSARWAGANGLNLLSGNIVAGERHDDFAAAQLHLLEEYRRDVAPGRPARVAIGRVIVPTDSADRTTRDRYRAYAASRHDRTGKPQGERRILFAPDLVGPAAEIVERLTADPVLARVSELRLELPYEFRRDDYEQILHDTVRLIAPALGRRGAAPAAARA

SEQ ID NO: 8880 - protein, 209 aa, Actinoplanes utahensis
MSATWEQPQPWAVPLVSVSLGGGEARTCRVTRQADGTLRLGLTGFAMIGVDATLLWTQNNRGCSIDGTVIAPPAGSLPGVYLRVDGAAGGIQRRRTERVRVQLPAAVRLPSGQLFPGRTVDLSAGGAHVTVDLEEIGDEALIRLVEDLERDVLIEVQIGLPDGLAGITCQVRAGGDEPGDVRLLFINMNPEVRARVVRFVEASAPAVVG

SEQ ID NO: 8881 - protein, 414 aa, Actinoplanes utahensis
MLEPTTNTDTTAAVRPLRRRTLLTATLAAGIGLAAGIGPAVPAAARRRSTGGYVLPAPTGTAGVGTVALHLRDTSRIDPWVPGRRAREIMIQIWYPARDLRGHLPEPWLSPGAVPHFAETFGLPADRILSTRTHGRTGAPVLRRTGGHPVLLYSPGLGGDRGTGTVLVEELAAHGYLVVTIDHTHDASEVEFPGGRVEVAALPPDLTDEVVVQAAAVRAADTRFVLDQLAVLDAGGHPDVGRRRLPDGLRGAFDLHRIGMFGHSLGGSTAAAVMHDDRRVKAGVNLDGTFVGPAAAGGSTRPFLLVSSDHGPGAEDPTWNTFWAAHRGWKRQLRLRDSVHGSFNDGIALYPQAGTEIGLTPQQLADLVGTLDPARSIGIQRTYLRAFFDRHLRGRDGRLLAAPDPRYPEIDFVR

SEQ ID NO: 8882 - protein, 363 aa, Actinoplanes utahensis
MPAGAARTWRVAVHTLAGLPLGVLGLALTGVLPVGAVYCAGWSLLYAGPGDWPATAGFVLLAVVAPGLAPEAARRLTGVQRRRFRVLLGADIPPPVRPARGRQIAYHLLACFTGVAFAVLVLVAPWTAARVARADTALARALLGPGRRAELSMRVESLARSRADVVAATDAERRRIERDLHDGAQQRLVSLAMNLGMARATLAGTSGPAMRAIEDAHDEAVQALAEMREFVRGLHPAVLDDRGLDAALSGIAARAPLPVRLLVDVPARCSPVVEAIAYFVVSEALTNVSKHAGATRAEVIVERAADRLRVVVTDDGRGGATTGGDGTGLVGLARRAAAVDGTFALHSPTGGPTTITVELPCGS

SEQ ID NO: 8883 - protein, 213 aa, Actinoplanes utahensis
MRIVIAEDSVLLRAGLTKLLTDGGFDVVEAVADAVELLRAVAAHRPDVALVDVRMPPSHTDEGIRAALVIHHEFPAVAVVVLSQFVEERYATDLLSVRTSGVGYLLKDRVAHVPDFLAAMRRVAAGGTALDPEVVAQLLVRHRADPLQRLTPRESEVLRLMAEGRSNNGIAGELRVSHSAVEKYIGSIFTKLDLPHTDSDHRRVLAVLRYLRP

SEQ ID NO: 8884 - protein, 115 aa, Actinoplanes utahensis
MRHIRIKGAPTGLERGVTIDPAPLFTPYKIGDIDLANRFVMAPMTRQFSPGGVPGEDVAAYYARRAPHVGLIVTEGTYVDHPSAGSSDRVPRFYGADALAGWRAVAEAVHAAGGP

SEQ ID NO: 8885 - protein, 217 aa, Actinoplanes utahensis
MAAFATAARDAQLAGFDGVELHGAHGYLLDQFLWAGTNHRGDGYGGSLANRARLGAEVVAAVRATVGPDFPVLFRFSQWKGTHFDARIADTPGELEQILAPLVDAGVTGLHVSTRRYWTAAFEGSPLTLAGWTRKVTGLPVVAIGSVGVAQAFRGETEEPAPTLSVAPLLELFERGEFDLVGLGRALLSEPAWPTKLRAGRLADIRPYDKADEARLS

SEQ ID NO: 8886 - protein, 147 aa, Actinoplanes utahensis
MTRDDAGAALADLADLILNVGRLVRARTPDESPDVVPLTETERQVMRIVDLHPGAAPSEIARRTRLQRTNVSTALRGLEGKGMVSRAATAGRGVAVHPTELAAANLRVLRAAWARELAGDLGDDLDAVRRCTDLLGRLERQLTADEP

SEQ ID NO: 8887 - protein, 394 aa, Actinoplanes utahensis
MSITQAPPTARHRARLALILGALSAFGALTIDMYLPAMPGMADELDAGATLVQLTLTVFVVGLAVGQVIVGPLSDAWGRRRPLLAGMALYVTGSLWCALSPTAGYLIGGRVLQSLGAAAGTVLARAIVRDLYQGTAMTRFFATLMVVNGVAPIVAPVIGGQLLTFTTWRAVFLVLAAVGAILLVTVALALPESLPRERRAPAHPRATLRAFRTLGTDRHYLRYVVAAALMFAAVFAYISGSSFVLQDAYGLSAQQFSLVFGLNGLGIVVFGQIGGMLVGRVTGEHTLLRVSLSIAVLGSAGVLVCAVAGLPLPLLLAFLFLPVAMLGIVLANATSLALAGHGSAAGAASSLQGLLQFLVGSLAASAMTLAGPATAITMGATMVICSIAALATLR

SEQ ID NO: 8888 - protein, 535 aa, Actinoplanes utahensis
MMIARIFAPLMLAVTNRRVGTKILLAVATMAIATVAVGIAAISGMRQMRAAADYVYQQNLVPITQVTAMQRSAGVTKASLLTAALSRQGVEARFDQGEDAAFDAAFAAYTSSDMRGREAEVATVSDAVHTYRKLRDEQLLPAIRNHDRAAFVSVWGGAMTTTSDRLDGSLQKLVGIETGVAREKNAATADTFRQAVIVLGVVSVVGMIAAGLFGAAVAGSISRRLNRCVTVLRSIADGDLTARTEVTGSDEVAGLAATLDRTTAATAAMVGGMADDAAFFGSASQQLSEVSTHLSTAAEQTSGRAVAVSAAAEEVCRHVQTVAAGAEQMGASIAEIASNATEAARVSARASSSAERTNDVLAQLDHSSAEIGDVVTIINVIAQQTNLLALNATIEAARVGEAGKGFAVVAGEVKTLAQETAKATQDISERVAAIQRDAAEALTAVAEIAEVTGQINSYAGTIAAAVEEQSATTAEMARSVAHAATGSSDIAVAVAEVAEVAAGTATSATQTRATAGGLAERAGVLQRTATSYRTA

SEQ ID NO: 8889 - protein, 203 aa, Actinoplanes utahensis
MAGRREHNKRETRRSLQDAARRLFEERGFDEVCVEDIATEVPVSRRTFFNYFDSKEAALVDPGPSRVDTLAALLAGRPADEPLLNSLCTVHIQFLMTDPEDLAARMRLVRANPALRQRWITAIETFDAEVVRWACTRTGLPPEAVYPQLLAGIAGTVSRLAMEHWDPDTAPERLAEVISCIYRLLAALGNDADLPPADRGCEH

SEQ ID NO: 8890 - protein, 614 aa, Actinoplanes utahensis
MNFRQSAVVVHGIHAAYIPVAYAAVTLSAVAAAVAPPRMLMFGMLAVGPAFVAATARPVAVLGVGGYALAAAFTVSTWQGLLGTADQVLRLMLIVVMTVVSWSVARHLGLLLRAATVAAQERQMLAAVVEQSADGIIVTSLDGVVTHWNGGAEQLYRQSADQVVGTGFGRFLPADRQAAFGRALASLAAGERVHLDEARRIRADGAEMLVSVAVSPIRDETGEVVATASTERDITEVKRREAEERLARERSARAARLESLGQLASGVAHDFNNLLAIILNYADFLTEEVTEDGSRDLARIRDAADRARALTGQLLLFAKQESATVEIVDLNEVVSASSELLTRTIGANISLLCRPHPQALPVSANRGRLDQILLNLVINARDAMPDGGVVLIETGRAPGRRVRMTVSDTGCGMSPEVKDRLFEPFFTTKPADRGTGLGLATVYGIVGDAGGSIQVDSTPGVGTTFEILLPLAGDTTGQEPEPDAHRPVTGHGERILLVEDDEFVRDLVVRILNGNGYQTVPLDENAAGDADVAGAAVLLSDIMLRFRSGPAIADQLRTRHPDLRVVFMSGYSDEELRHRYDLSAATGILQKPFTAVELLAAVGTALTPAVSRRG

SEQ ID NO: 8891 - protein, 570 aa, Actinoplanes utahensis
MRKPWSARAILAPVVAATLIGTAACSGSSGTTTNQAAPPPKASENQINPKSRDQVKDGGTLTWALSGFPANFNYYELDGTDVDASYVNLAMMPQLYNYEADATPVWNKNYLASEPVLKTDPKQVVTFELNPKATWNDGAPITWEDLYWQWKSTSGADKAYNISASNGYENIESVAKGKDDHEAIVTFKTKYADWQSLFTPFYPASTNKDPKTFNAGWQKSPLKTTAGPFKFDSADATAKTITLVRNEKWWGDPAKLDKIVFRAIEPNAQVDALANGEIDFVDIGSNVDAYQRALKISTAEIRKAAGPNFRHLTINGTSTVLSDVKVRQALAQAIDRTAIAKALTGPLGIDPKALNNHIFMSNQAGYQDNSGDIGKYDVEKAKAGLDAAGWKLNGDTREKDGKKLEINFVIPTGVKSSEQESQLVQNMLAQVGAKVKINAVPVDDFFDKYVTPGNFDMTVFAWIGTQFPVSSAKSIYANPTKNAKGELDIQQNYARVGSPELDTTFNNATAELDKTKAATLANQADAQIWQEVHSLTLYQRPELIATKKDLANFGAKGFASVIYENIGFVK

SEQ ID NO: 8892 - protein, 713 aa, Actinoplanes utahensis
MTDAIVTRYPSPAGGSGAGAVEPLLRVDDLSVTFRSPAGPVTAVRGISYDVRPGEVLGIVGESGSGKSVSSLAVMGLLPDTATITGSATFEGQQLLGLGDKQLSRVRGRRLSMVFQDPLSALTPVYTVGDQIAETIRIHQDIKREAAAERAIELLDLVGIPNPRQRSKGFPHEFSGGMRQRVMIAMAIANDPALIIADEPTTALDVTIQAQILEVLQTAREATGAAIVMITHDLGVVAGFADRMLVMYAGRVVETGQVETVYQRPRMPYTMGLLGSIPRLDMGERQRLTPIDGVPPSMVDLPAGCPFAPRCPMKIQVCEETEPELLGVVIDGAGHLAACHRSPEIARKELTNVDVFPTTVVPEATGPARLPREQRPVVLEVNELVKEYPITKGGVLRRKVGSLQAVAGISFDIREGETLGLVGESGCGKTTTIMEILELAKPTSGTIAVLGKDTAAMSRKERFAIRRDLQVVFQDPLASLDPRLPVSDILAEPMATHGVPAAEREKRVRELLRLVGLRPEHADRYPAKFSGGQRQRIGIARALALEPKVLVLDEPVSALDVSIQAGVINLLEQLKVELGLSYLFVAHDLSVVRHIADRVAVMYLGRIVEIGTANQVFEAPEHPYTQALLSAIPLPDPVKERSRRRILLTGDLPSPANPPSGCRFRTRCPKFANELDDAQRQRCLDESPALTVRDTVVPDHESACHYAAPVKAI

SEQ ID NO: 8893 - protein, 302 aa, Actinoplanes utahensis
MTTDTESVVVGAPPAPRSVSRNRLVLRRFLRQRLAVVGLIVVVLMVLIAYLGPLFYKWKYDQLDFEAFQSPPTPEHWFGTYQTGGDVFSRTLRGLQKSLVIGLLGAGASTALAAVAGAFAGYFRGSTDMVIRVIIDLMLVLPSFLIIAIFSTALRDGSWLLFIVLLAGFQWMITARVVRGITQSLREREFVQAARFMGVPGWKIILRHILPNMASLLIIDATVGVSSIILAEVGLSFFGFGVQPPDVSLGTLIADGSGAALTNWWQFYFVAGVLVLLVLAVNLVGDGLRDALDPNSEIEGAK

SEQ ID NO: 8894 - protein, 332 aa, Actinoplanes utahensis
MGKFLLRRVGYLVVLALVATVVAYLLAATQLHPRSRYEGRNPAPAAAVVDQRLNELNMNDKTPLVERFTTWAKGVAHGDLGKTVDGESVNTEMSRRMWVSLRLMLIGSILGTLLGVVAGAYGAIKQHKWSDQTLTGISFVLLSVPTVVLAVLMKNGGIWFNQASGHESNPLVFTVGEITPGLDTWSWAGLSDRFGHLVLPTIVLAIGVNGFAFYSRYQRNSMLDVLGSDFLRTAQAKGLRRWSALTRHGLRTALIPMATFFSYQFALLFVGATFTEKIFGWHGMGEYFVDSITKNDINSTAGVTLFVAVLVLIAGLLSDVVYAMLDPRVRAS

SEQ ID NO: 8895 - protein, 52 aa, Actinoplanes utahensis
MTTRRCAVKIPAGGRSAANAVTGPHLRGRGAEAALQPRRAGAGPGRPGDRRS

SEQ ID NO: 8896 - protein, 143 aa, Actinoplanes utahensis
MVIAGGARLRRGGRDQRHPPTRAVMPVALAACGFVRLIGGGPARHAPAGWSTTEPPPPVHARRGRRRGPGCSCRPPGSGRRPPRSRDGGGAVAPTRSPTNAAAFRTSSTSKRSSIVGNALGVSVRPQGLLPDFDPPRVVLQES

SEQ ID NO: 8897 - protein, 303 aa, Actinoplanes utahensis
MLEMGVTTHSDDIVTAYLAPAESADMARRARREITGTGAPGDCFRRAGRHAGILPARLREALARLRAGSLDAVVAHGLPADPTDADAPPLLGLTWLGMLTRQLGHEFGYPAEQNGTLVHHVRPRPDRAATQSNASSAVDLRLHTEIAFHDVRPDFVLLYGVRSPEPRPATRLVRVADAVRNCSPETVQRLRRPQFRINAPDSFSPGQAVAENVAPMGGTLRQPTIRWHSSITGVDDVDQCAIAEFQAAADREEHLVRLAPGSFLAFSNSRCLHGRDAFEAHYDGHDRWLLRTYVRHDLTRGRG

SEQ ID NO: 8898 - protein, 373 aa, Actinoplanes utahensis
MNTAGMLDLDDFRRACQGVLDAARWSYLAGGAGHDDAVRENEAALRRLRLRPRPLNGVADPDLTVDVLGFPAAMPVLLAPTSPLRLFHPDAELAVSRAARRAGVLPIVSNDSHHSLTEIAKQGPCWFQLYCYGSRADVVRTIRLAESVDARALVVTIDNSHPSRRVAMLRSGFATPPEVEFGIHRESGFSDGAVPPDTRLPRWPLTWELLDLIRSQTRLPVVVKGVLHPADAALLTDRGVAGLIVSNHGGRQLNDSIAAIDALPGVVAAAAGRLPVLLDGGIRTGGDVVKALAAGAAAVCLGRPYVWGLTLDGEDGVLAVLELLRAELLDVARQTGLRALRAVPADLVAPPPPSFTGRGGGPHDPAHQGALRA

SEQ ID NO: 8899 - protein, 400 aa, Actinoplanes utahensis
MTTAPPVPANLSRAGLIQEYDRDRLGFVMDAVRRFGPVTELSPGTVLVADGEVAHDVLRRTNRDFLMDRDRAWRPTGSRRGEDALESWMSARRAMLSALSGGLVAEHLSWYSGELTGLLDAWAARGGTGDPLTPLVRLSTDAFLRLCAGPSSRGADRREPAAAVAGLLDSLTPIVGSSYELPWFLDRLTPRRRRAVRAQHRLAESLGALVDRAPSGGLVAALRDAGVPREPLVRILISATIAGRLVPAAATAWTLRALAVHQPDDEPAHIVDEVLRLWPPTWLIHRTTHGEEISGDWRFPARTAVMICPYAIHRDERHFPDPAAFRPARWRDGRLPAGAYLPFGGGPRWCVGTHLAKAQLVEAVRVFRRYRLTDTSDAVTLDTRSTLYPRGLALGVGRPA

SEQ ID NO: 8900 - protein, 649 aa, Actinoplanes utahensis
MDPGHLGRRPGRAGGHAGPGEAVPARHLVRRVRGAAVPGPAPGARGRRDPDRHRRPAGQPRRDRGTPPGARRRPCGRGDAPVADRPLARGRAGVGRGLRAAGDPAGARRGVPAGAPGPDHHSGDQRRVHRPARPARPAARSGRREVPGDGPGRRARSAHPVRGRRGDRGQPARPRRRAARRARRQPPGRLGRAGGHPRADPQVHGGVVTAPFTQPTAEEFRAATTELRELNAPYARERLIFRPPVESPGQVRRLEAACQTVFEGLDAVLREVCGGDVLRMARLCRATEPELQFLTHQTDQNWSTVARPDVISSGGRTVVVEINGDSPAGLFGLHDIIARAQAAFQRPAPQAPARPAVAMRGLLDSLERSFGRLTGTVAICYWRHEQQAGPLDWQYELFARELRRHGVDAVHCALEDLRMDDAGVAYQGRPVQVIYRYFESPEPTEHDEFTLLKQLFALAGAGLVGLFTGYRAEVLASKAALAVLSDETVVDRLDADLRDRLAAHVPWTRVLEPRRTTVEGADVDLLPWVAANRERLIVKPVRGHAGKGITVGREVSARAWAEAVGAGVRGGAGDHPYIVQQVFEPDRLPVAFTDATGRATVTETPSVNGVFIVDGRAVAVLRRYAVNATGTININPFSGYAPSPVWTAS

SEQ ID NO: 8901 - protein, 503 aa, Actinoplanes utahensis
MGRGGRRRGARRGRRPPVHRPAGLRTGPAAGGVHRRDRPGHGHRDTVGERCLHRGRAGGGGAAPVRGERHRHHQHQPVQRVRPVAGLDRVMRWHPAPTLFAAGASASLGDGIRYAAFPLLAVHVTTNPISVGAVSAALSAAHLLFGFHVGAAVDRFDRVRLLRSMQLTRLAVVLVLFGAVLTGTASLPLLLVTAFLLGAAELAADTAVQSLTPVVVRDAGLERLNAGLTAAQSIGEDFAGPAAGGLLFSLSPAAPFAVFAAAIGGSWAVLTRLRVPGRVAPPPGDRPSLTAEAREGFRYLVHHPSLRAQALWATAMNLGVAAANATLVLYVVQRLHLGDSAYGLLLTGAGIGGVAGAVASPWTIRLLGRLGTMITASLVAGVVTLGIACTTSVAVIVGCQFLAGFSGVSFSVVGRSLRQSITPDALMGRVTGIYRLIGFGSLPLGALAGGAVAHWLGLRTPFLLAGALMVVSTLTLGLLTRRAQPPAATTAATAGRQVAGVPG

SEQ ID NO: 8902 - protein, 269 aa, Actinoplanes utahensis
MIWFITGASRGFGREWAAAALRRGDRVAGTARQPCDLAGLAEEFPETFLPLRLDVTDRPAAVEAVRRAAAHFGGLDVVVNNAGYGHFGMVEELAEEEIRAQLETNVLGLLWVTQAALPILRVRGGGHIIQVSSIGGLVAFPGLGAYSASKFAVEGLTQSLAQEVAAQGIRVTLVEPSGFRTDWAGRSARHSAESPEYDLVRAARDRRPTARRVGDPRASAAALLAVVDDPRPPLRVFFGSAPLDIVTREYEDRLETWQAWQHLAVAAES

SEQ ID NO: 8903 - protein, 409 aa, Actinoplanes utahensis
MTDLKSSPAPSRRLILLMALACGVGVANVYFPQAITPLLARDLHISESTATTVATMAQLGYAAGIFLLVPLGDRLPRRRLIATLFGVVAAGLFLAGISSSVPPLLAFCAIVGAATVVPQILIPMAADLAGPTSAAGTVGILQGGLLGGVLLARTFGGTLGQLLGWRAPYLIAAALAVLLAIALVVALPATAPSSTERYPALLATSLRLLRTQPALRWSCLYQFLLFGAFTAAWTSIALHLTGPAFGYGTSVVGLVALVGAASVFAVPVAGRQIDRRGPDVISVLCFGGLLLAAAVLLTGTWHGVPGLIGLTAGMLLLDVSVQTSQVANQARIFALVPGARSRLNSVYMTAVFLGGTCGSWAGARIYLHFGWGAVAALVAVAGVAALAGHLLRLRITAPAGRRESAEAAA

SEQ ID NO: 8904 - protein, 238 aa, Actinoplanes utahensis
MATPTPQARAMSRINRRDGAGDDFRSVTTTPRKWVWNLYNRFPGNGSNRFLRYGAGVAAEPFRQGAGRLCLDFTRTLRRRGHPDAVEELPTPAAVLAWVTQFGPVPATVASLPPADVQRFREAVFTLVTKGPAGCAATDLDLVNRIAAAPPPIPAVQPAGTLDWTAGDPVAATLSLVARDALDLATTPAASRIRECADPACSALFVDNSRPGTRRWCAMSACGNRAKKTAYRDRATAG

SEQ ID NO: 8905 - protein, 168 aa, Actinoplanes utahensis
MSVTTSDFTSLMARVPGPVVVATTVDPDGRRWGFTASAFSSLSLSPPLVLLCLAKSASTHAAFVRAERFLVNVLAADQAAVAARFARSGEDRFAAGDMRPYELGLPGLPGAAARAACALDSVLEGGDHSILVGRVLAVTVAEPAPLVHCDRAFARPVPLDQLAVARSR

SEQ ID NO: 8906 - protein, 470 aa, Actinoplanes utahensis
MEQRSYDARFVVVANRLPVQSRVAADGALLWERSPGGLVSALEPFLSRRHGAWVGWPGVAGVDVAPFTDGGTTLVPVRLSEQDVRDHYDGFANATLWPLYHDVVVRPTFDSRWWAGHVRVNERFARVAAETCAPGATVWVHDYQLQLVPEMLRRLRPDLRIGFFLHVPFPPVELFQQVPWRAEILRGMLAADLVGFQVPAAAVGFAEAAVRFAGARRAGPGSLFVEDRAVRVDAFPISVDAPAWDRVARRPEVRLRAAQIRAELGDPARVVLGVDRLDYTKGIDVRLRAIHEMLADGQIKAADTVVVQIANPARERVDQYRAVRDRVERLVSAVNGDHGRVGRPVVHYLHTMVDQAELAAFYLAADVLTVTPLRDGMNLVAKEYVASRHDGGGVLVLSEFAGAAAELPQALPVNPHHGDDVKAAFRRALELDPAEGVRRMRAMREHVFAHDLTDWAQAFLARLDDPAGEG

SEQ ID NO: 8907 - protein, 355 aa, Actinoplanes utahensis
MPNMKAVQLLAPRKTVLAEVPVPATPADGLLLKTRCVSICSTDISFFEGHLFPSEYPVILGHEYLGEVVDIGPEFDGGGVDVRIGDRIVYWGQTDYGGFAEYRSLRPIFSGQILEDVFWADRHFFDDDRAAAVKVPDDLSDLEASFIEPTTGALRSVLTNPPQVGDRVLILGTGPIGIIAGSVIQRLLAPNRIVSMDANPARNQHAEEHFSQHAYLPHELIDTVPESTFDYVFDTLPTISGVPEENDPRRVAMRKLKPGGHYVLYGASQEMQKFDTWLMLAKGIRISAAPFDVTHFPMHKTANVITSAMQMLRSRIVDGRRLLSHVCRFDDYDGLVDVLENYRHTTSLKTIVDFR

SEQ ID NO: 8908 - protein, 391 aa, Actinoplanes utahensis
MLWEPPETGEQSEWLSRVAALAPLIERHRAEADRERRTPQAVFEALRDAGIPRMWVSTEFGGGQVGLHTGSLVIQALARLDASVAWQMGVQGAIGRISDYLPEQTARELFKQSGGLVVGAVNPAGRAEETAGGYRISGRWGFASGSAFADWLVCAAPVHRDGQPVLRGSAPELRMLFVPVSAVRLLDNWHTLGLRGTGSNDFEADDVFVPAEYTVDQAAMLRPPAGRFSRAYPIGYYDFGPFTSASTAAGVARDAVATVTELVRGKVQTGGSGSLARSHVVQDRLARATMHVHTARTLLRDTAERVTESGESGGERLTATVRLTAATVAELAVQAVDIAYDLAGSTSLYETSRLERAFRDVHSAVKHITLAPQHFEMVGQYLVGGELRVRR

SEQ ID NO: 8909 - protein, 387 aa, Actinoplanes utahensis
MVYGDDSVRSPQETRVSAFVDEMFGDLGRADQRRWARIYLRGMLTARGKKTVQEIARSVGAESFVARGLRQFINFSPWDWGGPRRRLAEMLWDAAPGQALTVAVSAIPKRGSQSVGVQRRFVVAAGRTVNCQLVVSLFLATGRQLVPVDWELVLGPEWGADRARRARARIPDSVEARPVWRHVLDVVRRSARFRAGLPLVADLSELDEVWPLVVALAGRRELVIAVSPGQRIPACRAGRPGDGTSPTVGELLQAAAAGRARHSVTVPDPDGTPRTVAVQSVALRGGRGADLWLLGEWSPESRRFTRYWLTNRADRPGTTLELGRYADRTAGTLAELRRDFGVLDYEGRSFPGWHHHMTMVSAAYTLQLIDVCSAVLQAAGAVFPGTI

SEQ ID NO: 8910 - protein, 514 aa, Actinoplanes utahensis
MTEIDTSLAADYVVVGAGSAGCVVTERLSASGEHTVVVLEAGATDPRSIPELRIPMLFPRTFGSEVDWGFTTVPQAGLDGRVIPYPRGKGLGGSASINAQLWTIGHRADYDGWAEQGYPGWGYADVLPYFERAVAERLPLAGIRYPSPVTADFLSAAALAGHAPAGEQQEGTLLARANHVDGLRHSSAEGYLDRCAERDNVRVVTGGRVRRLIFDGTTATGVEVEIDGEIRQVRANREVLLAAGAVGTPHLLMLSGVGPAGHLAEHGIPVVVDAPAVGRNLADHLLVPLAFAGRGFESPGVSAGPEQMRAYLRDRTGPLNSIVSEALTFLRTDPDLPGPDIEVVFLVLPYGEHKTSAEHGFALGVILLRPESTGSITLRSADPSDAPLIDPGYLSDRADLDTVVAGVRAAQRILEQPVLSRWRGEPLTDGALSTDRAQIERYVRATGLSIFHPVSTCRMGPGDDSPVDLSFRVRGVRGLRVVDAAAMPSIVRAHTQAPVTMLAERASEVIISGR

SEQ ID NO: 8911 - protein, 445 aa, Actinoplanes utahensis
MATGLLLGASLAVPATPALATTSALAADTTRTPATPAYTVDLTSNGTGGTWTGHESVTFSNASPTPLTEVYLRLWDNYHGSCPSTPITVSNVTGGTASALTVGCTAMKITLPAPLAQGASGSIGFDLSIVVTSGVDRFGHDGSYYFIGNALPVLAVRDAAGWHLDPYTDNGESFYALASDYTVKLDHPSSIVVPATGTSTDVAGGSGRTVTTAVGRQVREFAWAAGPFAKTSGTTAAGVKVNVYRVGSIGAGSATSMLNTATAALDAHAARFGAYPYGEADVVLDNGFWFGGMEYPGFVLDLVSTTALAHELAHQWFYGIVGDDEYTTPWLDEGFTDYATDLYFNKTGSGCGITWQSSAEKVTNSMAYWDAHSSRYSTVVYGYGKCTLHDLRRLIGSTAMTNLLRSYAAAHWYGISTVADFKAAAQAAAGSTDLTSFWAAHRVEG

SEQ ID NO: 8912 - protein, 238 aa, Actinoplanes utahensis
MRIHAAGTLLDGDLTVPPDAAGMVLFTQNGPRDRAVAAALHEVSLATLLIEPLTAPERGDDTRRFDVDLVADRVIGTLRWLRAQPVTTYLPIGLFGAGVNAAAALVAAAARPGDVQTVVTRGGRVDLAGGALAQLMAPALFIVGERDQRLRLLNEESRQAARSHADMCVIPGADRFFSGTQALRQVTVQAADWFRIHLAAPVPQRPPEIDTALPVEHSSLIDMFPAPSTTQERCPDDA

SEQ ID NO: 8913 - protein, 149 aa, Actinoplanes utahensis
MTRSVTTENLGAWLLKGNADTADLAGRFAREPRVERWCVRPGYRLDLMRAGQPVLFWASGSRRRDLPYGIWGWGRLRGPARRGGPEAGWWVPLDLVIAEPGRRLRRDELRGDPVLAGLEVLRQPQGSNPSFVTGAELAAIRRRWISDDR

SEQ ID NO: 8914 - protein, 184 aa, Actinoplanes utahensis
MSDEPTVATPGGDRSDQPEEATVALPGAAAEASLTKADKSEISDGADEATVAFSGSTPVDDEKTAVLSEPAEAGKAAPVGKAAAAGAAAAAGKATETAKVTAPVKAVGTAGSADEATTVLSPTGTDDEAITVIPASSRADTAEEATTVMPAGAAAQPPEENTVALPAADRIIALPATRPTPLAS

SEQ ID NO: 8915 - protein, 153 aa, Actinoplanes utahensis
MFCMIGNQVLGHEEVAKMVTTAGHQLANHTWSHPTKLGEKPSRVARKEIEQAQLKINRTTGYTPKLFRSPGGDWSPQLLHDVAMAGLLPLDWSVDPRDWTMPGVPTIEKKLLAAHPGQILLCHDGGGDRSQTFQSLSVVIPALKARGLKFVAL

SEQ ID NO: 8916 - protein, 438 aa, Actinoplanes utahensis
MLPEQVGDWVLHELPRLNEAILNQHAPPELLVTELCEHVLPGLPDPTQLTPVQAQRLVVHLGFAGASVARHYQEHTPGGTEHPERAFDVLTAGEERIPFRRYFAGLAQHTGTGHYDRDSYASLVRWNVGTVRVRLHGEVVAELPGVFDDGRIRSYTGTAGEERFFLLVKQGEAIELAVNCALEPLTAEHASLICEKARHRVREATVLLAELRRLFRDFASRPAEETMAADAFMDVFRQFAAHWTPGDIPPSGALDPEALKRDFLLGIDEPEYDRQARRLFPALLDQERTEIGNLMSDCPLPCRVLAEVGVDEADLRLSDEGDLRRLVAHHPALIDWHRLLTMHAQVSGAHLMLSKKFLFKPQRQRDAAGLGDQHLVSNRAGTTGMTETYLERLTRARQRHTLAALRPVLIPENRDPGADPAVRSDRGAAAPVVLELTG

SEQ ID NO: 8917 - protein, 642 aa, Actinoplanes utahensis
MSGTDDGVRQGTRELPGRDQLMALIDHTSSVIYMRNADGRYMLVNREYERLFGLRREDIVGLTDHDLFPPATADAFRDNDLQALAGGVPVQMEERVPGDEGERIYLTVKFPLINGDGTPYAVAGISTDITERSRAEAALRDSEERFRLLAEHAQDIIFRYRLAPEPAMEYLSRAVEQITGFTAEDFYADPELIENRIEPEDRPVFERSWRMPRSGTTSFRLRRRDGEVVWIEQRAGAVTAPGGALVAVEGILRDVTERMAAERERAELERQLRQSERLDSLGQLAGGIAHDFNNILAVISGYADMMIDELGDEHPSKPDANGIKQAAARGAALTRQLLLFSRSEPSRSELLDLNAVASDMLRLLGRTLGEDIELGTELVADLPPVVMDRSKLEQVVMNAVLNARAAMPAGGRLTISTGREHGGAGDDQVCLAVTDTGCGMTPEVLARAFEPFFTTKGRGSGTGLGLATAYGVVTDAGGTITLESEPGRGTTLRVRLPAGTEDAAGVTPAAPAAEDAAGDGRRILVVEDEEMVRDIVCRLLVKAGYQVFAAPHPAEALRMCRDEALAFDVLLSDVIMPGMSGTQLAAELRRDRPGLPVLFMSGYTSGPAPGGQELPTDAPLIRKPFERQTLLDEVHRLVTERV

SEQ ID NO: 8918 - protein, 121 aa, Actinoplanes utahensis
MVAPAGVLSPASVSIPLADAAALPIVGLTAWQALFDHAELTAGQRVLINGAGGAVGGYAVQLAKNAHAHVIAAGPVRGADETIDHTATEVPSAVREPVDVVLNLAPVDPARLAGLLTVMRD

SEQ ID NO: 8919 - protein, 100 aa, Actinoplanes utahensis
MARVSTAATAASSQVNGPDGSRAPAGEVHAWLPGTNQTLCGLALSRTRLVRFPHQRFDYRASDVTGAGDDIGFICPKCVAATTPRDQRDGRGWKRVAPRP

SEQ ID NO: 8920 - protein, 168 aa, Actinoplanes utahensis
MRMVLMADTHVPKRARDLPAALWAAVGAADVVVHAGDWVDAGLLDALEARSARLLACHGNNDGPALRARLPEVARAELAGLRLAVVHETGPATGREVRCAARFPDTDVLVFGHSHIPWDSTAPGGLRLLNPGSPTDRRRQPHCTYLTATVTAGRLTEVTLHRLPVRPS

SEQ ID NO: 8921 - protein, 171 aa, Actinoplanes utahensis
MILTAHPEITVDYEPTAAEVDAALRGNSERTRRQFLLSVVLLLAAGLGLIALGTTGSGALFVVLGVVSLLAGLFCVLLVAGIKQVRQRMAARLCVPTTVTLGAERYSYQMASGPGETRWEFTTVAISAACWTLAAANRIVLVIPKRALTEVQQAEFGAFLAGRDPKLVKTV

SEQ ID NO: 8922 - protein, 342 aa, Actinoplanes utahensis
MPADETPARPPTLNQVAARAGVSLKTASRALNGEPYVSRATERRVRQAADELGYRLNGLARELRTGGTSALVGLISGDLANPFYSAVASGAERELRRHGLLLITVNNDEDGDLESSQVQALVERRVRALLVIPSGGGIDAHNVPLVFLDRPPPAGRAADSVLIDNDGGARTAAAHLLAGGHRRIALVADLARTASQQARITGFTAAMRAAGNVDWEPYVRTDVHDAATAGRVVTELLALPFPPTALFTTNNRVTIGALRALRDHPVRPALVGFDDFELADVVGVTVVAHDTVEMGRAAARLAYDRIGGYTGPPRTVIIPTRLIPRGSAERPAGRLLPGGPPS

SEQ ID NO: 8923 - protein, 1032 aa, Actinoplanes utahensis
MLRTLAVATVLVAAAFATPASPAQAADADLTSYVNPLIGTDDSNSPNPVGGGAGGSTFPGAIVPFGMTQFSPDTPTASPSGYRDRDRTIESFSLTHFNGAGCPNNEDLPILPVTGALGSSPGNAWTSYASGYTKANETASPGYYKNKLDKYGVTAELSATTRTGALRLTYPATTTAQVLINDSRSATGDRAGNVSISGNRVWGEHTAGGFCGGRTYKIYYSILFDRTPTGFGTFSGGTVSAGSATASGTQTGAYVTFDTSSNAVVNATVGISFVSVANAQNNATAEAASFDTVKAAANAAWNSALNRVQVTAGGATDLQKFYTALYHVFSNPNVASDTNGQYMGFDNAVHTSSFPIYQNYSGWDIYRSWAALVAMVAPEVMTDIVKSMVLDGQQGGLLPKWSQQSIEDFVMPGDPGPIVVDEAYQFGVRGFDTAAALTLMKKSATGGSTQGYVLRGNEGTYESQHYIAGNPSETLEYASSDFAISRFALALGDTATYNTYATHSQYWRSLFNGESSYIHNRSGGFPWPLNPATESPYTEGNAAQYTWMVPHNLGGLITLMGGKSTAIQRLDHHFTQLNGGLSLPYFYVGNEPEHGVPWAYHFAGKPSGASDAVRRVMSESFTTGAGGLPGNDDLGATSAWYVWSALGLYPVTPGADTLAVHGGIFPSVLIRRSTGDLTISGGSATSPYVQSLSVNGKATTHNYLRYADLASGGSVTYSMGSSPSAWGTGSGDTPPSFGDGATPPIAEPDLGANLAAGKPVISGSAECGSSETAAKAVDGLLRNNSKWCTGGTPKTLTVDLGSAQNVSSVVLKHAGLGGETTGWNTADYTIQTSTDNATWTTVVTVAGARNSRSYLPFPARAARYVRLAVTTPSNNGDAAARIYEFEVYGQSSAPADLALRRASSADSSCAATESPDRAFNGSWLGGWSDKWCSQSTSRWLQTDLGGTTHIGSVVLRHAGAGGEYPAWNTRDFDVLTSTDGSTWTVRASVRGNTADSTTSTINADARYVRLDVITPTQDGSAAARIYEMDVRG

SEQ ID NO: 8924 - protein, 536 aa, Actinoplanes utahensis
MAETSATTSSSPGGRPAATIGRKLALIFASIGVLFGLVSVVVYRSVNTLTDTAGKVEHTYQVLDRIDALRSSLKDAETGQRGYLVTGQDAYLAPYQQALTDLGTEQQQLRSLTADNPKQQKRLDDLAPLVDAKLAELQETIGLRRDKGFEAARTVVLTDKGKAVMDQIRAVAEAMSTEESSLLGVRAAAAASAKRTTQVTIVAGLVALLAGMAAAATLITRQTSRRVSRLRAAITSLAGGDLTSASGLTTGDEFGMMGRDLDHAVDSVQTMMAELAATVTELSTSAHQLAQLGGDLNSGADEASGKAIAASESASLINASVESVAAGAEQMTASIREIAGTSAQAAAVANESLEIASSTSRQISELGQSSTEISDVVRLITSIAEQTNLLALNATIEAARAGDAGKGFAVVASEVKDLAQETARATEDITRRIAAIQSSSEAAGVAVQRIQQVIGQINDYSNTIAAAVEQQSATTNEMTRSITEAAENSRLVRTSFAAVAQVTSTTADAAQASRRAADHLSALAGKLNSVVSRFRY

SEQ ID NO: 8925 - protein, 690 aa, Actinoplanes utahensis
MSSRARWAATAAALLLGLSLAPLPAQARPATTVAAPAISLDAGQHALIRFRLTGQAALDRLVASGADLAAHPRSDRGGILADVVVDAAQLASLTRGGAVPVQLIQQETHRAVASRGIAVAAADTLHFLQAYWWTTGGKTFLQTQVATTATGDPDVEITVTWTTADGKTGTYPLIRFEDSGEYQYHYALPQPLPGRPVKVTASSSLGGVSRPATPATWPGATPPPAPAGYQKDFVAAYMTPTDIRARIKRLARQYPKLVDVIDLPNRTQGYRRTAVAYLGDPAAAAVVVESVKFGDQGGNGIQVRTVDPGAPNRPLAASYADRVLTVRLATDAAGKTISTTDDVAAVISAKYPQRFRATVETGSAGLPMPVVAPVRLDDGLKGTEVSKKPWTVQALRIGKVRDGSKIGVLAYSQEHAREWATPLVTLEFAERLLANYATDPATRDLVDNVDVFIIPTVNPDGANYSFNDFNFQRKNLVDHCTGASRDPKYRDSWGVDVNRNYTVGSFFDGYVGGSANCLSGTYSGTGELSEAESRNVIALATAHPNIRFAMNVHSYGGYFMWPPGAYRADGRVTLPRPSIDESKFFLDSARRIVGAIAASRGTVTWPAYTGPVADVLYSAAGNSADELYYELGIDAWDFEVGNDRWNDTTQQWEGVGFQPPFDEAHAESQEYAGGLIELVRVARDSQAAVH

SEQ ID NO: 8926 - protein, 336 aa, Actinoplanes utahensis
MGSTMRFRIGLADLASASLAYSPLQEAALSLRMWSHPGYYVEQTGWFQRMRADFDALPDRDLLRALVASNRFVPDFLTPRPATTRPALADELALLRATPPELVGPDLERTFRPHDREVPPLLAELAADPEAMLDRIARALAGYWDRCLAPRWWPRARSVLEADLIYRARMLAEGGADALFADLSHRLYWEDGVLTIRWDGPLEIARDRVDVNGRGLVLLPTCFARGAITAIDPDLRPVIIYRARGLGTMTESLRPPPAFPALRRLLGEPRARLLLMLDEPASTTELAHRLAVTPGAVSQHLRVLYESRLVDRARHGRVVLYFRSALGDSLRAGTDQ

SEQ ID NO: 8927 - protein, 412 aa, Actinoplanes utahensis
MGSTVAETATSLLPRDPVVRRLAGMVLVNTLGNGMFMTASALYFTRVAGLSVARVGLGLTIAGACGVAASLPAGRAADRWGSRRVLLLLCLLQAVGMAAYTLVHGFIVFLAVVCAETALDRAAGTVRNTLYADTLPPETRVPGRAYLRAVTNVGIGAGAALAAVALQADTRGAYLALILGNAATFLVVAAILPAIPAKRRPVRGTAAGPAVASRRNALTDRPYLLVTALNALLSMQFAVLTVGIPLWVVRETTAPHAVVGAILLLNTVLVVIFQVRATRAARNPAQAARACRRAGWLLAVYCLLIAGSHGFGAVPATLLLVLAVTIGTAGEVLSQAGGWLLSYDLAAEHAAGAYQGVFNAGSSAGIMLAPALITVTAIDHAPWGWAVPAAIFAISGAALVPAVRWATRSPAA

SEQ ID NO: 8928 - protein, 331 aa, Actinoplanes utahensis
MGPMTALFLAADGGNSKTDLVLGTADGEILAMVRGGTSSPHNIGLDGTIEVLGKLIAAARAEAGLAADTAIDAIGVYLAGADLPDEVTALHEAVTAQGWARRVRADNDCFALLRAGARLPDAVTVVCGAGNNCVGRAADGRTARFVALGPVSGDWGGGHDLADYALRAAARGEDGRGDPTALSAAVAGHFGLPTVEAVSIALHRGHLSAARIPELAPILFQVAAAGDEVAAALVARQAEEILAQHRVAAGRLGLLPRPHSVVLGGSVLQARHPLLHDRVLAGVRAQAPFAEVTVLDSPPVTGAALLALDALEAGPAAERALRGIFSGRVPA

SEQ ID NO: 8929 - protein, 418 aa, Actinoplanes utahensis
MKIAVVGGGSTYTPELVDGFARLGTMVTELVLIDPSAERLDIVGAFAARIFAQYGHPGKVTWTTDLDAGVTDADAAVIQLRVGGQRARISDESFPLECGCVGQETTGAGGLAKALRTVPVILDVAERIRARARPGAWIVDFTNPVGIVTRALLDAGHRAVGLCNVAIGFQRRFASYLEVPPGSVVLDHVGLNHLTWERAAFVDGVDRLPELLSRHLSDIAGQVDVPAEIISMLGSVPSYYLSYFYRHDGHVREALGAPTRGQRVAEIEATLLDMYRDVTLTEKPALLAERGGAFYSEAAVGLLASLFGLDDDAVHSVNVRNLGTLPFLPADAVIEVSARAGRTGPDPLPVTALPPDLAGLITHTWSYEELALDAALRGGRDRVYRALLAHPLIGQHERATALTDRLIAAGRDHLAWAR

SEQ ID NO: 8930 - protein, 289 aa, Actinoplanes utahensis
MSLVLDRPIVRAAAERRRIRLAWIARHSIAIALGIMFITPVAYLVLLSLMTSDQALTSDYWPNTWHPENYVRVFQATPLPHYLFNTMLYAVSATVFTLASSVPAAYALAKLKFRGRNALFLTVICVMMLPPQVVTVPLYLMWARYGLTGSLAPLIIPALFGDAFCIFLLRQFLLTIPSEYLDAARVDGCGEWRTLLRVVLPMARPGIAAAGLFQFFYCWNDYYGPLLYTSENENSWTLSLGLASFRTVHHVDWNLVTAATVLAMAPLIIIFFFAQRSFVQGITLTGFKG

SEQ ID NO: 8931 - protein, 308 aa, Actinoplanes utahensis
MLGVRLRRGAVTLSFLAPALLGIGMFFVYPLISAVYFSFTKFDLLTVPQWVGLDNYRRMAGDPFLLQAVRNTLWMVAVFVPVRMLFTLGMAMMIAQFKRGAGFYRTLFYLPSLVPPVAATIAFVYLLKPGTGPVNHVLSMVGIDGPLWFNSPAWAKPSLVLLGLWACGDLLIIFLAAVLGVPESLYEAASLDGANAWHRFRSITLPTIRPVLLFAAVTGVIYTLQYFDQAAVAGSIASGQATVGAGISQSFGYPEGSTFTYPLWLFTVGFRYSALGYANALAIALFVVALAITVVLLRRAKAFSGEES

SEQ ID NO: 8932 - protein, 434 aa, Actinoplanes utahensis
MPYALFALASAALLVTGCTPAPKETKIADPGTQVSGTVELWHFFTEREAQAIDQVVGDFTASHPNIKVTVKSGQDDSKVTQAIGAGNGPDIGLSYSTDIVGKFCSSGAWVDLTAYINRDKIDLNQLNATTRSYTEFQGKRCAMPFLADAYGMFYNKDLFAKAGIAGPPKTLDELTEDAKKLTVRNADGSLKTVGFLPLYDYYENAAAHLAPSTGAKWLTPDGKSAVGADPNWKTLLNWQKSLVDWYGYDNLTRFKAGLGDEFSADNAFQKGQVAINIDAEYRLAFLKDQSPKLKYGVAPLPTTDPARYGGGYVTGNIMGISKNAKNPEAAWELIKYLTTDDAAVTKLAGLLKNVPTTTKAIADPGLNADPDFKTFIDIFRNPNSMTTPPSASGPAYQETFGQFLTSYQSGKGGDLDQGLAAADQKINSVMSLGG

SEQ ID NO: 8933 - protein, 387 aa, Actinoplanes utahensis
MTRLAGSSKLLRAMNESAALAHLLDPGMLTRADLRRLTALSTPTISEALRRLTEAGLVTVVGHDSGRPGPNAEIYAADPDAAYAVAVSVRDVGASGTPSLAAALCDLTGEVRARFESRVDFLAADPVATLTDAVDQLLVTAGVPADRLRHVQLGVPGSYDARTETIRLVHVPGFGRPGLVPAIAAALGTEVGVDNDVNLAAVAERRRGTGQDAEGFALLWIGQEGLGLAIDINGTLLRGTRGGAGEIGYMPVYAPDSADRKLDLQDLFGGGAILELAREHGLAGDTPAEVVAAAPAEFLEVLADRIVAGLAAVVAVLDPYLVVLAGPVARAGGDTLLAAVNRAFLRAAPLESSFAVTAIDDDAVLLGALDAGLAAVREALITAIRDS

SEQ ID NO: 8934 - protein, 277 aa, Actinoplanes utahensis
MPLHIRRRTIAYAALSLLIPGIAVTYGLLPADAGTVTPSTVVAVASKNLDDPAKKEVAMEIVSAAENSSLDWRAQFAYIEDIGDGRGYTAGIIGFCSGTGDMLELVEAYTATEPSNGLAKYLPALRRVNGTDSHSGLGSKFVKAWRAAAADPVFQAAQESERDRVYFNPAVADGKADGVRALGQFAYYDAAVVHGYEGLRAIRKRALAKAKPPAQGGDERKWLNAFLDERVVEMKKEEAHSDTSRIDTAQRVFLNKGNFDLNTPLDFKVYGDPYHIG

SEQ ID NO: 8935 - protein, 215 aa, Actinoplanes utahensis
MLGDDDALDTSVLTERQRRILGVIRDSALRHGYSPSTREIADAVGLASTSAVARHLRALEDLGFLRRGRATRPIDIRMFLRAGDGPRRDPGTIGVPVLGEIAAGAPIPAQETADEVLSLPRDLVGRGSGLFALRVRGDSMIDAAICDGDLVVVKQQPEAYNGDIVAAMIDDEATVKVFRRRAGHVVLQPRNPAYADIDGDRATILGKVVSVLRSV

SEQ ID NO: 8936 - protein, 231 aa, Actinoplanes utahensis
MRRPACVRRLDAMTIDTGPAIRTPASRAAALPVALVAGLLLGVLDFLWIKFVPGPFGGLGNSVAVWAVAAFLLTFRHRWTLRVSLLAAGVQLIVAVPAYHLAAALIQHDDPANAYDTTALAWAGLGVVAALVFGTGGALARGARTPDTVRHLALALPGAVLFAEAGLQLRRIGEPSYSTGALTAYAAILLFLGLLTTVLMVPAWRRRGLVLALALPLTAAGFVAFDLTGLH

SEQ ID NO: 8937 - protein, 160 aa, Actinoplanes utahensis
MQGDARVIEFLNEQLTAELTAINQYFLHAKMQDNWGYTVLAKHTRAESIDEMRHAEVLTDRILFLDGLPNYQKLFALRIGESVREQFECDMKIEVEAVDRLRRGHDYMRSVGDITSARIFEDILADEEHHVDYLETQLGLIEKLGEPLYLQNVIEHPEAG

SEQ ID NO: 8938 - protein, 63 aa, Actinoplanes utahensis
MFVCICHHVRERDVRTAIRCGARTEASVGDACGAGTGCGSCLDRIADLIEEEGCADTRLPSAA

SEQ ID NO: 8939 - protein, 451 aa, Actinoplanes utahensis
MSPVSPGTRWLAAAAAGATVAAGAVLLTTGTAEAGTISGPLYRDPDTAVARWVAAHPNDSRTAAIRDRIASQPASRWFADFNLGTIGSEVAGYVNAANAAGQIPELTVYGIPDRDCGGASAGGAPDLNQYQNWISAIAAHLGNRTAIVLLEPDSIALQTCLSADQVTARDEALATATRTLKAANPNAKVYLDAGHSAWNSAGEQANRLAAAGVANADGFYSNVSNFNPTSAEVSFGKAVISALNGRGISGKHQIVDTSRNGGASGDWCGDDNTDRRIGLYPTTSTGDGDVDGYLWVKPPGEADGCRYAAGSFQPDLAFSLANGVPNPPSPSSPSPGSPSPSSASPGSSPAPNPGGAACSATYRVTSSWQGGYQAAVTVTAGRAITGWTVGWTLAGGQTISQAWNGTLSVSGSAVTVRNVSWNGSLASGATADFGLIGTGAATTPALTCTAA

SEQ ID NO: 8940 - protein, 390 aa, Actinoplanes utahensis
MDIAGRHEFRVLAAAHPRLPLLLTAGRLARRLRRVPRVGWVTADPLTARRILNDPEHFTLLGEGGVGHLWAQVLGDWVYEIFDGPGHHRLRTRTRDLFTDESARQLTDRVIGPRLARAGAQLRAGRTVDVADLARVLVGRIVADLLRIPAADHDDAYRQIFSTGEELAALALGTTASTHLAPETVGRARAIVARLTANVAGSWRTAPPETVLGRCRELGLDQRQAEGLATLLMVAGTETAASAMARTVALLHDTGAQHRLRAEPDRLPDAVREGLRVTTPAPLIGRAVSADVTVDGRRLRAGERVLMLTWTANNAAGGFDLDRGYLPEQRQLWFGAGRHLCLGAPVARAEIAGLLRTLLAGDGPWRIGRRTYRRRVLIPSYASLPVSIAA

SEQ ID NO: 8941 - protein, 159 aa, Actinoplanes utahensis
MTSPTPGRQAAGCASGLGCGVVVLIVAAAPLALVWLVLRWAGVHLPSLVTVLHGPPAGTGWLALSTIAALAVLVVGAGLVAWMFLSDSVPEPLPRRVYLVWLIPALPVLDLVSIVVAWICRALGHPDAARLLGTGPWLAGAALATVAAVVYSGLVANDR

SEQ ID NO: 8942 - protein, 150 aa, Actinoplanes utahensis
MTLESWLRHWGSRGAVAAELFVHPQTVSYRLNRLRDLLGPDLDDPAARFELLVVLTHRATRNSMAAGAVPDEDAAMSGTPEGFTYRIRKNGDVEILHHGRPAGVLRGPVAARFLADVDTGDPQELMARVTGNYRHGNERAARNHPRNRGR

SEQ ID NO: 8943 - protein, 161 aa, Actinoplanes utahensis
MTTPWRRVPADLAAAMRPRLPAIVPAIAEAVAAADPAVAETAGAKFDRDVHTAVRVALDRFLDLAGTDDPALPPRIREVFVALGAAEARENRGPELLLGGLRTAARLLLRAASQALVDARAGAPVAVEEIIDLSDATSAFVDELATACTDGLARQLREQAG

SEQ ID NO: 8944 - protein, 796 aa, Actinoplanes utahensis
MAAARSAGTRRQGVVTPGFCHPVLTTGQQIARRTTVLHTLIGVTMVPVTPDTPGSDPAVKHRMSRRHVVDMCRTMLDRGYLKATEGNVSVRIPGHELYAVTPSNYDYDRMRVEDVCIVDFRGRHVPDEGGAGGLVPSIECGMHANIYRERPDVNAIVHTHQPYASALAFLRKPIPPLTDEQVRFLGREVAIIDYAPSGTGFLAKNVQKKVKSGDNAFIIANHGVVAVGTDPSRAVFNMALLEKVSIAYLMALASEAGKVYTIPATIREIAFSKLKRDEARIASQIVDAVEPVRVAEDEELPSVAEVVTAQTSDESHGYMISEYLDVPDTMRRLKALVDQPIRGLRHDALLDTLDYFATRCTASREITERAKRFIPGGVQHNLAFNYPFPLAIDKAEGAYLTDRDGNVYIDFLQAGGPTILGSNYAPVNAKVADVIRESGPVTGLFHEYELKLAEIINRYMPHIEMYRSLGSGTEAVMAAVRAARAHTGKKMVIKVGGAYHGWSDTVVYGLRVPGSFRMNAKGIPWGATGRTREAFPHDLGTLKRKLVENRARGGTAAVIVEPFGPESGTRPVPHGYNAAVRRLCDEFGAMLIFDEVVTGFRTGMGGAAGYFGVTPDLTVFGKAVSGGYPMAGGVGGGADVMSVFGSGLDGKSGAHIQVGGTLSANPLSCAAGYFAIQEMARTNAPVIAGRAGDRLTRGLQKLIDKYGLPYVAYNQGSIVHLECSGVMLLDMRNPLKLLKENKARKTLMEQMGAAYAAHGIITLAGSRMYTSMADTDEVIDDALSRFDQVFALVEGV

SEQ ID NO: 8945 - protein, 529 aa, Actinoplanes utahensis
MAVPPQILAVDLGTSGMKAALVAADGTVTGWAERPVPLVVLPGGGAEQDPIAWWDALAEVVADLGRAFPDHLRAVTTICSSTQGEGTIAVDAAGAPLTRCISWLDMRGAAHLRRQFGGFPAYDGISVRRIARWLRLTGGMPSVTGKDPAAHMLFVRDEMPAVYARTQTFLNVLDWINLKLTGRTVATVDSILTSWVTDNRKADAIRYAPSLVAASGIDRDKFPPIVSCTEVIGTLAPSAADHLGLPASVQVVAGAIDNTAAAIGAGTVRDNEPHLYLGTSSWIAAHVPRKKTDVGSGIASIPCALPDRYLMTALQATAGANLTWLRDKIVEFDDPLVSAGHVSRDEGTIFDAFDKIIPSVPAGADGVLYMPWLYGERAPVDDPHLRAGFLNISLQTTRSDLLRAVFEGVALNTRWMAKAVDRFLGTPVSTMVITGGAARSSSWCQIFADVLGIEIRRDADPVVVNARGAGWIGAVGAGMINFADISDLARNDQIFTPGPNHAAYDDIYKIYTTLHKRLAPIYRSLHQKT

SEQ ID NO: 8946 - protein, 1010 aa, Actinoplanes utahensis
MGPRTVLEVLAELAPAAGERTLDVTRGAQPFVWLETAEKAPRDTTVERLAGLAALHRDERILHRGWGFLAGRAEVDGKVRRIRLPLLSQPVRLDRSLLAYKVVPAGDLEVTPLVEDRELAAALEAAPGLATPGWLEATGSRSWLQSVAGATGFTVDRVLEHRQRIPAEGLHLIAAPALFVVRDVFGVGLADSLRSWAGRELGGTALAAIYGAGAAPAGTGDEPAGRCGDPVISPLPLTGPQRQVVVRARSEPVTVVSGAPGSGKSHTVVAAALEVVDRGGSVLVATQSPHAAEVLARLLSRYPGPPPVLFGSGHAALEAELTAGAGQGVPLSLVRSGRERVQAAAAAVRRQQAEIRHALAVEAAAASLPDLQADLPRLSAIAPGAFDGSVDLTEIRRLLDAAGAGGGWTSPPGAGNAGAGNAGAGNAGAGNAGAGNAGAGNVDGGQSGGWWGRWRAKRARRKAYRLAGAADDVPASVLVQALTVATAQRAAAQLAATGGTDLGAPWAALHRAEAELRTLAGAAMRDAARSSVRWTPDARRAAGALATALRAGRNRRRELLARMEAAPLVGALPLWIGTVADVEDLLPPEPGLFDLVVIDEASHVDQIRAAPVLARARRALIVGDPRQLRFVSFVSDVDVTQVLDRHGADERLDVRRVSTYDLAAASAPATWLAEHHRSVPHLIDFPARRFYGDRVSVMTRTPPADATDAVDVVHVQAAELVKGVNEAEVEAALKQVERLAAAGVRGIGVVSPFRAQAEALEAALLAALPAERIGELRLRVGTVHAFQGSEAEVVIVSLALLDGDPPSRRRFVTDAQLFNVMVTRARRRLIVLTSLTRPAGLLGDYLEHAEEPRPVAPAPVEPGGWAGELAAELRRLDVEVRAGYRVGPWIVDLCIGGAVPAVEERGEGAREGAVPAVEEPGKRARASAAPAVAERDAGMREGAGLTGGGQFVGVLCAVHPDGPEVHAERQAVLHRAGWRLVDAFPSRWQGDVRRAALELAAAVGSGRTPA

SEQ ID NO: 8947 - protein, 195 aa, Actinoplanes utahensis
MRSETRTASPPVAVKIVISGGFGVGKTTFVGAVSEIEPLVTEAELTEKSIGVDDTSAVAQKTTTTVALDFGRITLDQTLLLYLFGTPGQDRFAFLWDDLVDGALGAIVLVDTRRIEDCFPAIDYFEDHDIPFIIGVNTFDGSRHFDHAEIREALGLAGDLPLVDCDARRRDSVKKVLVALTERVLTRRLERAAMS

SEQ ID NO: 8948 - protein, 111 aa, Actinoplanes utahensis
MNPDDGPIVRPFMITGGRTEPMHDGLRIETQLYAAPAALSAPLRFESRRIVELCQRPMSIADLASAVGVPLGVVRVVVADLITDGFVLVDQAPGELSTTLIERIRDRVRAL

SEQ ID NO: 8949 - protein, 141 aa, Actinoplanes utahensis
MSVEAPADRHQFNWMLGNFVHQTDGVRDAVAVSSDGLLIAGSDGLSRAEADQLAAIVSSMASLARTASRRYEFDGLKLIMIEMRRGFLVISVIPGGSCLGVVAGGDSDLGLVGYEISRLAERFGDLLTPALIAESRRSLPR

SEQ ID NO: 8950 - protein, 729 aa, Actinoplanes utahensis
MARRTERDQTIRGRVVRMLALPLAAMLALLAVIYGNEIGRYRNATATAHRVTLILGLQSLIQELQNERGLTVAVIGGNTAFRDRIAPARARVDSQRATVRSALGGTASAALDSLTDLGRIRDRADAGQDARDDTFDAYTKLIEGLGDDTRHLEIVDDLDLRRDAESLEMLTEVKEATAQEWVFLDGVITAGRFQTGEFSRLLAIAANRDLALGEFDEFADPQAAAAKTALLSSGAAQQARAVEAAALRAGDRQRLQADAGSWWASVATMLDEMTALAGQIGDHTLARAQDLRERATLRLGVLSAIVLLCLAGSAYLAIGATRSLAEPLAALAAEADRLAGERLPVAVRRAAAGDDAGPPDPIPVIPGASAEVRRVADALDRVRTTAYALATEQARIRRGTAESLADLGRRNQNLLRRQLGFITRLEREESSPGGLANLFELDHLATRMRRNAESLLVLVGAASPRQWPGPLPLSDVIRAAVSEVEEYRRVVLRRLDDAMVQGTVATGLAHMLAELIENGLTFSPPDVEVEIHGRRIGDGYLIAVCDQGVGMSEEDLARANQRLRGEGDFMTGPAKYLGHYVVGRLAAEMNADVRLTPSAVTGVTARISLPADLLAADLPIAPSPAPAPPREQPRTTEPVRIRPRALEVDYVVVTERQTPPELGGPDRTANGLRKRIPRARRAEPAPARTSRDDTTVNLIDSPDAVRDRLTALRDGIQRGTFVTTSEEHR

SEQ ID NO: 8951 - protein, 1053 aa, Actinoplanes utahensis
MRRRCLQFTAALSASLLTTAVLVQVSATPATAAFASNDYCLGECSDILPPGQNGDADLAQILAHQVLGTMPPHADDQLAPYANLAYHYTGLTPQQINTFFNDSSYGVAAANVASTVTPRSDVSIVRDKALGIPHVTGTTRAGTMFGAGYAGGQDRLFLMDLLRHVARGSLTSFAGGAVGNRELEQSVWRNSPYTEADLQAQIDALRAAGTRGAQLYDDVVQYLAGVNRYIDDCMAARDCPGEYVLTGHLDAVTNLGGPEHFTPTDLIATAGVIGGLFGGGGGTEMQSALVRVAARAKYGATAGDRVWRQFREQNDPETVLTLHNGQSFPYGAGDVNATGVAMPDPGPTPQPIVFDRTGSALTGGGTSTIAGSLGSLTIGSASRGMSNAAVVSAANSATGHPVAVFGPQTGYFAPQLLMLQELQGPGISSRGVAFSGLNLYTLLGRGPDYAWSATSSIQDITDTYAVRLCNLDGSVATTASTSYLYHGTCTAMENLTRTNSWKPTTADSTAAGSYRLTVQRTRYGLVTWRGTVGGAPVAFTGLRATYGHEADSAVGFQMFNEPEQMGTAAAFTTSASHIVFAFNWFYVNSTQNAMYTSGAQPVRPVGADPELPTWGDAANEWTGWNGATAHPQAVNQDYFVSWNNKQAGDFSAADGNFSFGAVHRADLLDAPLKAGVAAGVRYDRASLLKVVEQAALTDLRGREVLPVLLRVIDTATVTDAAQAAALAKLRAWLANGAVRRETAAGSKAYVDADAIRIFDAWWPKLVQAAFTGGLGDPLFGALVDALQINESPSGGQTGPVSTLPTSANESQAHKGSAFQYGWWGYVSKDLRAVLGDPVPGWSTTYCGGGAVGACRGALLSSLGAALSEPATVTYPGDTHCSAGDQWCADAILQSPLGGITHGLVGWQNRPTYQQVVSFPARRGDSVANLAAGRPGTASSNQSGYPAGNAVDGRPDTRWASSRADNQWLQVDLGAATPVARAVISWESAYAKTYRIETSPDGTTWTLVAAVAAGDGGTDGVALTPTTARYVRLTGLTRATGYGFSVYEMEVYSR

SEQ ID NO: 8952 - protein, 123 aa, Actinoplanes utahensis
MIFGRISAALITASTEPTSTARWMLCTRSNSPATSPSFSVRTAARSSSSSAASELRSAPVAAPTRASRSRIRGSAAVRVATSPLKTTAAAEAPPSTEANDPSTASTVIDGLSRLENTTNAPPW

SEQ ID NO: 8953 - protein, 331 aa, Actinoplanes utahensis
MRRAPLPLLVLTHISGTPSWCRTVDTNDDGLMPRRRYELRDRIAGLDPERDHLEIYQLSAGREFPWDYTRALEFALFRTYCVPSISRLLAATGEFRLRPQKRYDDTALLMAEIAAHGYDSPRGREALKVINRAHGRHSIGNDDMVYVLSTFVYDPIDWLDRFGWRPLHEHERLAAFHYYREVGRRMGIRDIPAGFADFAAFKRDYEARHFVYSDTNRQIGDYTVGLFAAWFPRLLRPAVRLAVRGMLDERMLAAFGFTPAPRWVGAVGEAGLRARARVLRFFPPRRTSVLGISPGNRTYPGYPRGYRPADLGVSPSSGPASAADGPAPAAR

SEQ ID NO: 8954 - protein, 437 aa, Actinoplanes utahensis
MSTPDVTVVVAVYNTMPYLTECLNSLVRQTIGTGRMQIVTVDDGSTDRGGAELDRFDRRYPGLFTVIHQANSGGPAGPFNRGIEAATGRYVFFVGADDRLGPEALERLVKAADEYGSDVVLGRVVGVNSRHIYQDIYQSSQPDVDLFDSPLPRSLANTKLYRRELLNQHGIRYPEDMKIGSDLPFTLAACFHARRISVLADYDYYFAVRRFSATNITYLSRHGLRIETVEKIMTFVANLIEPGERRDAIMVHRFDHEVARLLEDDVLKLDRPTQEQLHRTVGRLAGEYLTDRIAAQLGPETRIRLAVARHGTVDDLIAVIRQDAEGGVPDTVERGGRRYAAYPGFGTLPDEVFDVTDVPDWDAKLDATGFTWAGDQLVITANGGSPGSVSAEEIPARVERTGKGVTIRLDVAEVLARSGDSGQRRAVSAQPGDFDPA

SEQ ID NO: 8955 - protein, 421 aa, Actinoplanes utahensis
MLVDNGVNGDSRVQKTARSAAEAGWDVTLLGCSPDHEEHRWQIGPAEVRLLPMGGGGGASGGGGGLKRRLVERGGLPLALARKARKPVERAQVRYWLGKEGDRAWRRLEPGLWNYERAFGPVIDELAPALIHAHDFRMLGVGARAKQRAAAAGRSVKLVWDAHEFLPGARPRRDNARWLPAHLAYEREYVPFADAVVTVSDALAELLQREHGLATRPGVVLNAPAQAGADDVPDLRLLCGLDPATPLLVYSGSSSPQRGLDTIVEALPELPGVHLALVVENPSAPHIQALTAASDRVHAVPYVPADQVFRFLSPADVGVIPIHHWPNHEIALITKFFEYSHARLPIVVSDVKAMAEAVRATGQGEVFRARDAADLARAVRAVLADPKRYRAVYDAPDSPLPGWTWEAQADRLNTIYQELLG

SEQ ID NO: 8956 - protein, 533 aa, Actinoplanes utahensis
MHRSDSPADVLYLALGPRRLTAAGAHTARLAAEGHSVTLAVTSENVNTPAGVTVRRVTSPAQARALAEAAEVTYAGDAEALAAVYGLATRLEPSADPRRRPGPADLAVVTPWYPSPDDAFAGAFVRAATGAVREHFARISVLHTQSWFYPPGRLRGQLLGVAAERQAVSSGNTVVFDDAEGEVARVAVPTPAGGDYLAYADEQTAALRSALPTGRIEAPVVHAHTGIMGGVVAARLARPDARLVVTEHATYLSKVFAQPGARHRYARMLDRADALLCVSASLRDQLAGFFPAHTGKLHVVPNAIDFGAFTVRPEPPKAPHRWLYLGRLMEHKGVLTLIDAFAAVAAEDPALTLTLVGSGPLTDTVDARIAALGLTGRITRRPPVEPDRVTALLHEHDVLTHASVRETFGMTIVEAVATGTPVLVALSEGPAETLAGLSGVAGETFAPTTDPAVIVAAYRRLRDGFGTLDMAAARAALDARYGRAAVAAQLLTAYRGGSSGGTPMPIPARPQRSGAVLPEAATRAARRVIRKFR

SEQ ID NO: 8957 - protein, 190 aa, Actinoplanes utahensis
MVLVLLRHTGDRALARAMRAGLGLSTVGMLLPVYWMATSIHQRTVLDANGRPVTMYQGHGVGGDPDGTGMPITHWNATGGDIRVPHFVGLHAVHMLLITAGLLAVAARTRPWLTEAVRRRLVGIMALAYGGLIGMLAWQVNRGQSLIHPDARTLIGLAGCLVPAAVAVTAVIMSARRVGEPHLMAAPTTA

SEQ ID NO: 8958 - protein, 223 aa, Actinoplanes utahensis
MPTDGEAAVPSLPRAPNLCEIIGRRVPTDGLTSRNHAGTEPAQHPLVHFRRPPSCSWAEFHGSVDVMTAAFEDLPFSEFLHRPAAAAERLEVVRALRLRRRDADDLALMRVEQLDRDGVVVDLTARLLAGLVRTQPPGAVRAVLAEALPWVTFLPEADVDQLLMELIAVAQGAASLANLSPVAVLLTQWRHTAEVHADPALLEILTREPEGDLGQAVVGTEVQ

SEQ ID NO: 8959 - protein, 555 aa, Actinoplanes utahensis
MLFNPATADFARFDAETRRLLRATVDFFEARGKRALIDSYINRTWYADFLDFAAKEGLFATFMTPGGDGDKRWDTARNAALSEILGFYGLDYWYVWQVTVLGLGPVWQSANADARAHAARLLDEGHVMAFGLSEKGHGADIYATDMVLTPAGDGTWRANGTKYYIGNGNVAGLVSVFGKTDDGYVFFTADSRHPSYHLIKNVVNKQMYVSTFELRDYPVREQDILHTGQAAFDAALNTVNVGKFNLCTAAIGICEHAMYEAVTHAHRRMLYGKPVTNFPHVRRELADAYVRLVAMKLFSDRAVDYFRSAGPDDRRYLLFNPMTKMKVTTEGERVIDLMWDVIAAKGFEADTYFDKAAMDIRGLPKLEGTVHVNLALILKFMPNYLHHPVSYDPVPTRDDPADDEFLFRQGPARGLGAIRFHDWRIAYDKFAELPNVARFRRQADALCELSVAPEQHADLDFLLSVGQLFALVVYGQLILEQAELTGLDAQLLDAIFEVLVRDFAQYATDLHGKTTTTDEQAAWALAQVLRPVADEARTAAVWEQVLALVGAYEMR

SEQ ID NO: 8960 - protein, 182 aa, Actinoplanes utahensis
MMPGMALEHAILVSLLERPGSGYELARRFERSIGRFWTATHQQIYRVLKRMEADGWVTALEVGQDGRPDKREFSVSDTGRAVLTGWLHEPVQPEAVRHDLAVKVRGAAFDDAAGRAALIDEVVRYRAEHEDLLARYLAGEKRDFSEKKGQKLQHVVLRGGIAYERMLLAWLDDVLTTLREEF

SEQ ID NO: 8961 - protein, 271 aa, Actinoplanes utahensis
MSVDEPIRIGLALGGGAVRGAAHIGVLDALDRAGLSPSVVTGTSAGALVGALYAAGRTPAEIASLAQTLRWARLVRPGRTRKALFETSKLGLFLDSSLASVDFADLKLPFAAVACELTTGREVVMTDGPVASAVLASAAIPGVFPPVERDGHLLVDGGMVTMVPAAAARRLGADLVIAVDVSGPLPRRPPTTLLHIMVAVSTLQPGGTDRLAEESDLVLCPEVDEYAFWELGRIPEFEQAGRVATERALPLLRALIEAWSARRAWERERNR

SEQ ID NO: 8962 - protein, 753 aa, Actinoplanes utahensis
MTRTRLPWRILAGNPDRKVVDVSHTAYRTCPLCEAACGLELTVDEGTVTAVRGDRDHVFSGGFLCPKGATFGRLTDDPDRLRRPMIRRNGRHEEVSWAEAFAAVQEGLRPIVERYGPQAVAAYLGNPNVHTMAGGLYVTPLLKALGTRNVFSASTVDQMPKHVSCGYLFGSPLAIPVPDLDRTDYLLVLGANPWESNGSLATAADFPGRLKAIQARGGRFVVVDPRRTRTAEHADEHLFIRPGTDAFLLFGIVHTLFAEGLTKLGGLTSYVNGVDEVRRLAGSFPPERVAAVCDVPAERIRGLARELAAAPTAAVYGRIGTCTVEFGTLTSWLVDVVNVLTGNLDRPGGVMFPLAAHLRRGSSGGRGFRTGRWRSRVRGLPEVKGELPVATLADEIETPGDGQVRALLTVAGNPVLSTPNSERLDRALAGLDFMVSVDPYLNETTRHADVILPPLDATRKGHYDFSFLALAVRNFAAYSPPVLPPRPDERDECDILAQLTLIVSGRDGEPADLHEALLSGALGKVAEATGRPVDELRELVTGDGPAERLLDVALRTGAYGDLFGAAPEGLSLRRLIESPHGVDLGPLRPRIPEVLRTPSGLVELCPPELAAEADRLLAAVDRPRPEMVLIGRRHLRSNNSWMHNVPALVKGRDRCTLQVHPADASRLGLADGGSAAVSSRAGSLAAPVEVTDRVMPGVVSLPHGWGHSLSGVRLAVAAAHPGVNSNVLTDELVLDPLSGNSVLNGIPVELKPA

SEQ ID NO: 8963 - protein, 219 aa, Actinoplanes utahensis
MTTTDIRPYLRGLAVFAGDLPGFDPAAAPPHPETLFVDWLVAAVDAGVREPHAMTLSTIGDDGVPAARVLILKNVDATGWQFAVHAASPKGRDLSRHPGAALTFYWPAQARQIRVRGTVRPEPPDRSAADFLARPAGSRAEASLGRQSRPLTDRETLDSAVRAAHERILADPGHVVPEWTLHTLTAGTVEFWQGDHQRRHTRLRYTRTDPTWTRDLLWP

SEQ ID NO: 8964 - protein, 286 aa, Actinoplanes utahensis
MDAAHPDRRHRRILAGRPSAPAHPPPLHPHRPHLDPRPTLALTMRLSEGAVDVAGGRELTWDGCVNVRDLGGLGRVRPGAVVRMEAPTRLSRHGWAAAWAHGVRTVVDLRHASECRPEVASRPPGITTVRVPLEPPGTPFYERWQRIDNLASPLHYPAMLAEHPELVVAAVQAIATAAPGCVVFHCAGGKDRTGLLALVLLTLAAATPGEIIADYLLTFDRMRRRYAELGAGDQLTAVNELLNGHDTTIAASLTATVEALTMPDYLLDNGLPEADLVALYARLTTC

SEQ ID NO: 8965 - protein, 192 aa, Actinoplanes utahensis
MPITSARFVWPIGDGLVLMPRTPAIAIAYHALLAANHARLALWSPGLGEPTPEGTRTALATAAAAWLAGTRLPLAIGVPTGNGHNLVGATNLTIDAPTASAELGFWVDAAAEGRGIVSRTLHAVLDHAFGDLGLHRVEMRTLTTNHRSHRLADRLGFLREGVLRDAVRFPDGPRDVAVYALLAKDFTPPAAR

SEQ ID NO: 8966 - protein, 156 aa, Actinoplanes utahensis
MSGLRSSQVAEAAGVNLQTLRYYERRGLIAEPERSLGGHRLYPAEAVTVLRVIKAAQRLGFTLDEVAELLAAGRHRHGRPDAGLQERAKAKLAEVQAKIADLEVIAGTLRAAVDAGCDDLVACAGQPCCPIPFVTIAGAAGSAAGPMRGGVEDVSR

SEQ ID NO: 8967 - protein, 87 aa, Actinoplanes utahensis
MSLADRVRRLLPAGLVGLAGLACAACCAIPALLAAGAVSGAGWAAAGDRMPGAAVVLAVAAGGAWWWTARRRHRAGCAGGGCACATR

SEQ ID NO: 8968 - protein, 367 aa, Actinoplanes utahensis
MGVDLGGGIEFYAGPPVLGAPDDLDAVIRGFIDGATSRLLIAVQELDSRLIAENILAARARRVRTQIILEGDYLREEKPVADPWAATGENEGNRVIHAALLRAGIDLITDLNPDIFHQKFIVRDPGKPTAAVLTGSANFTHTDTGTNPPDMLDKPGNNLNHVVVLHGRQATDLYLAEFERLRSGTFGALHERVEPRPSEFRLGGLRVKPVFAPDQGPEMEIMKQMLKATERVDFAMFTFAQSSGIDDTMGWMLKAGIPVRGVLDRGQGSQKWAATVPLKKAGAQLYENTPGNGVRKVHHKLMVIDRRLTIVGSFNYTAPAATLNDENIVVLGDLEETDPAAIAAQERLAGYALAEIDRIITELARPA

SEQ ID NO: 8969 - protein, 247 aa, Actinoplanes utahensis
MRKFVAGMAAMTAALTLAACGNGKSDEPYFVGEASSAAPASAAPGPAESATAESSSAPVTAKSASPKPSATTPVNVKYVFPVVGNNSYAHTHHDYPASDVITNCGNTFRAVTGGTILAVTRVDTWKASVNAGATRGGLSISLLGDDGVRYYGSHLSKIDAKVQVGARVTAGQTIGKVGDTGDASACHLHFGISPPCARTGDWWNQRGTVYPWPYLDSWKAGTNKSPVDTVKKWKAAHGCPTKPTVDG

SEQ ID NO: 8970 - protein, 119 aa, Actinoplanes utahensis
MVPLAVLSTTALLPVAAHPPRPVVLALLFVSGLAGAFSVPLNSLFGRAVPAAYRARAFGVAMSGLCGIQGLAMLAAGAAAESLRPSLVVGTAGLAATVAILAVLLTWPSRRPAPVASPA

SEQ ID NO: 8971 - protein, 42 aa, Actinoplanes utahensis
MPGQPAGYREIFAVREYRHLFAANLLSLIGDQLTAVALAFRA

SEQ ID NO: 8972 - protein, 478 aa, Actinoplanes utahensis
MRWPRATAPAWIVHAGFVTSALAGGVGYALGGAHARAVVYTLIVLLSIGLFGQALLAGHLTHRRPWLVAIGGLVLLLVDHLIWPYWIIDGHLGRAEGRPADLVLAAAHGLFLIGASMAVRHRMSADAGGIVEAAIFGACTGGALWACLFQPHLAATATPIGAAQVLTDVLVLCAVAGCLLRMAVVATGPARGTLGYLLLTVLLTGSALAVGSVGAPHRGTLSGLLMLIAFLTIGFGAVHPGAPATVEPDTVTERRPGRFRLSWLGAALSVNPAIAAIQAAHGVAAPDPQLPVATLLVIPLVMVRFRQLTGQRERAEEVLAYQASHDELTGLFNRRRIMAEIDTALTGPHDVTVLLCDLDGFKPVNDRHGHAAGDHVLRTVGERLTTLTGPAHAVGRLGGDEFLVLCRGGTPDEIAALRATIQATVLAPITLPTGSVAVGVTIGTAQAPAGGRTDRATLIAQADARMYDAKPRRRHPAA

SEQ ID NO: 8973 - protein, 186 aa, Actinoplanes utahensis
MGSSRLAGMDAPEMINAGELVLKRWEPEWAGELTAAVRESLPELTPFLPWAHDDYGPEDSRSFIARSVENWDAGTEFNYAIFTTVGEVIGAIGLMTRLGPGTLEIGYWLRTPWAGQGRMTVAVGALTRVALTLPGVRRVAICYDEANKASAAVAAKAGFVEVGREHREPTAPGETNILVTAERTAA

SEQ ID NO: 8974 - protein, 222 aa, Actinoplanes utahensis
MLQRLIHIGAAVIITAVATTGCAAPKYTYVKNSEQKTYFKVPHEWHATATGDLDDVLSGTNPDSANAAARQQMWWSVAYDADADPNAGHLLTGRVTDQPIVYARVAELTEHQRNAMSLDTLRDLFLPVTADARESAAQTSTLSGFELVRDEVLTPAAGLHGVRVVFDYELSDGVLHTFDQTALVNNTGDKLYLLIIRCSTSCYKDRSGELDTIATSFTVRSK

SEQ ID NO: 8975 - protein, 790 aa, Actinoplanes utahensis
MPRVTRKRLPFWDRVKFLLLFAIAFFALVWTDMADDPLLPFQDALYNRLHSGVGVGIIVLAGLEVLRQLHYLHSEHAAWYHRLWTHGIFGGVERLTHRVFSDWTRFRLLRVFKWLLFLGLLAVVLGAVLDTSPAMAVFGIPALLWRAAPMFLQVIFILFIAVGQFAAIFWFLSRGGVEVYYPDDVKTRFTDVWGQDHVLERVKENIVYLERPEAIEGQGGYVPGGILLWGPPGTGKTLMAEAVAGETGRPYVFVDPGAFINMFFGVGVLKVKGLFRKLRKLALRYGGVIVFFDEADSLGNRGALAQGGPGGGFPRSTPAPFRDGCHGFSYLSDQSRWNLTRDSVMYGGGMGGGGGGMGTLEALLTELSGLKKPRGFVNRHVRRALGMRPKPPPKYRILVMMATNLPEALDEALLRPGRIDRIYKVGYPSKAGRVRTYQGYLAKVKHELTEEQVDKLATITPYATGATIKDTVNEALITAIRDGRDTITWRDVIRAKQLKELGPAENVEYIERERHAVAVHEACHAVVAYRTRHHMEIDIATIEKGSGYLGMVASIPPEDQFTTWRSHYESDILVSLASLAGERMFFDGDSSSGVSGDLESATAVATNMEGVWGMGSTVSSYAASSRLGTGTPGALPKGDKNDLSARRALADRIEDSLGEMLERAATILKENRREVLALAHALETHKTLTGEDVIAVLEGRPGPLIDGTVYADDRFIAEVESYHRAALAAHRGHGRLSTALPSRAVPEPLPVPVDGPADLPTGSEIWRRPDPVDANGATPEIPQQRDSGPS

SEQ ID NO: 8976 - protein, 110 aa, Actinoplanes utahensis
MSADAIVTYRTSADGRTLHALLLAPELDVDVADELRDSLEKAVAGSPCRELALDLAEVTFIDSYALGALVGARNSAAAAGLTMVLTRPSPPVRQAIAVTGLAEVFGVEPV

SEQ ID NO: 8977 - protein, 247 aa, Actinoplanes utahensis
MDLQHAALLLLGGVGSGLTGSIAGLASLVSYPVLLAAGLPPVAASMTNTVALLAAPAGTAAAARRELRGQGPRIVRASVVCAAGGITGGVLLKITPSSAFALIVPFLIVLGALALLFREGLQDWYTRPGRRPPLWLATFLIGIYGGYFGAAAGVLLLAAMAVAASEPFAVTNAVKTIVLGAANLTAAVLYALTGPVDWPAALLLGVGCMLGSSLGPAVVRRSPERPLRIAIAVAAAGLAVYLWSQAL

SEQ ID NO: 8978 - protein, 103 aa, Actinoplanes utahensis
MSNGGANQQWDFRSTGSGWVQLINRNSGRCLDVASGSIADGADIIQYTCGTGGNQRWQWLPTGGYYQLKARHSGGCLTLAADAVDLEQATCATGATTRQWSRA

SEQ ID NO: 8979 - protein, 391 aa, Actinoplanes utahensis
MRRAIVSLLVVCQSTQALIFGGIALFLPLIRTDLGLSFGQAGTLAAASSLTYALMQVPSGLLADRFSPRVLFLTGLLGTNLLAAAFAVLTSYDMLLLNQAFSGFFRALVFAPGLLLISREFPDDRRATAMGLYVAGGFSSNILLSSTGPLLVGPLGWRLLFVLFAGAGLLALLLYRRAAGPAEPRPATDHPARIGDLPGLLRHRIVWLTAVIQFARLAVAQGFTFWLPTWLVVDRGQSLAAAGLVAAVGAALTAPSNYLGGYVSDRIGRPLLVISGSLAVLAVGLTLLTYVPGLPAVLAVVGVISVVVQVYFGPLFALPIAVLGPERAGLLSGFGNFCANLGSFAFVYALGAVKDATGSFRAGFLSLAALCVLALVAAAVARRVPAPARQV

SEQ ID NO: 8980 - protein, 985 aa, Actinoplanes utahensis
MRSHLAGAVAVLAVLSPVPAHSPAPAPAPTGYLSTHAGPGRFPLAGAPLLTGAGDYPGVLRVAGDLRSDLAAATGATEKGGRDPIIVGTIGHSTLIDKMINAGRLDVRGIAGRWETSLEQVVDHPLPGVRRAFVIAGSDQRGTIYGAYDVSRQIGVSPWHFWDDVPVPHADALYVLPGRHSQGTPKVKYRGFFINDENPDTGTWAPGFFGPGKAPGHPGGLNANYYAKVFETMLRLKANYLWPAVWGRAFAEDDPANHATASYYGVVMGTSHEAPMMRGIEEWNRHPAGTGEWSFRRNPDAIKDYWRAGIQRMHDQDIEGVVTLGMRGNGDVGLPDGDGIDLMDSIISSQRRILADAGMLGVPQVQTLYKEVQRYWDQGYRPPDDVTVVFCDDNWGNMRKLPDPSLPARGGGYGMYYHFDYVGDGRNYKWADTVNLTNTWEQLNRAYTAGVDRLWVANVGDLKNDEEPTQFFLNYAWDPDAIPVTGINGWERRYAAENFGTSLSAPIAEVLSRYGVLQSRRKPELLNRRITVDPAVDPRTDPSAVRYDDQGNPFSLTAYREMDRVVAEWQTLAARTERIRARVPEALRDAFFQLVYYQIKATANLYELRRAEFTNIAYAAQGRAATNDLADEAEARFAEDQALNTYYNTVLAGGKWKDWQLQPKIGYGNVARYGPNAPWQQPEKNNVALPDEIYPYLKRIEVPAGASLGVALDGGDPSSLPEFSPWQAQPGQYLDVYNRGTTPFAYTITAGQPWVHVTPAGGTVTKQVRAFVTVDWRRAPAGVTDVPLRVEGAGGAVVLRAPVRKPVTTPRGFAEANGYVSIPATGFDHHTGRWRVLPGIGKSGDGITPLAAFPAAGQPGSVGDRGQLDYTMTLTSAGPVTIDTMLMPRNGRQRYAISVDGAPPQTVDAVAATGANDTTMNRQWARNTSDNVTVTATTHQIAAAGPHTVSFRALDPGVVLQRLVVDTGGVKDSYLGPPTSRRYRP

SEQ ID NO: 8981 - protein, 411 aa, Actinoplanes utahensis
MKRRALLAGSAGALAAGVPLDRHRPEPAWVHTWTAMPQLTEPGNLPPAPFTGSAAVLVDTTIRQTVHTSIGGRRLRVRFSNAFGTTDLPIDGAAVALPVDGRAGVAAIVPNSSRRLTFGGQPSVVVPAGAQVVSDPVPMPIAARADLTVSVYSGAGQAGLNLTSHPGSRTTSWLVNGDALEQPDLTGGAAVDHWYLVSGVEVIASRAAGVVIIGDSLTDGRGSTINGNDRWPDQLTARLGDPRLAVLNQAAGGNRVLHDGLGPNVMARFDRDVLGVSGAAWVLVFEGVNDIGTAAATEAEQGRVVAALTAAYRQIVQRAHARNLRVYGATITPFGGNTGYDDPGGLRERARVAVNGVIRGGIFDSHVDFAAAVADPAAPSRLHPAYDVGDHLHLNPAGYAALAAAIPRRLF

SEQ ID NO: 8982 - protein, 170 aa, Actinoplanes utahensis
MVRHARRVGRPPGHLRAVTVTPGIGWGCPHPGGRSDGWSRPVTLRRFIGMDIAMNAQPTAARVETATKVATVLSTVALAGTVAVAAHGGTVNTFMWVRGALLPIVAVVLYRMAAGGSPRALDRIRVLTVIMPIAIVGVDLIPGVCPLWYAAVQAVCMIPVVVAAVLSRRV

SEQ ID NO: 8983 - protein, 659 aa, Actinoplanes utahensis
MTRRPADSTGVPDQVFLLANLVIMVAYAAITVAIVVPVRRAGQLRSNKLATATALIFFSCAVGHGLHALGGILALAHGSPHPARHPGFSALWDAFTAGVACYYWSLRRSYGVLLSKGAIYLDPWSRHRLDEAGARERAARDVAEAHRATLATVVEHSDDAIVGLDPDGLITAWNHGAERILGYAAEEVLGRPITMIADDATGAAEQREVMALIRGGARGHSYEARRLRKDGTPVDVALTITAIRDQTGTITGFSTVARDITAAKESAERQRAVQERTQQAQRMESLGNLAGGVAHDFNNILAIIANYTEFAIEETTGNPAVQADLIQVRSAAERAANLTRQLLTFTRGDAIQPRDVPLDAALAEVHGMLERTIGEHIHLVVTPPRTPLTVHADPGQLQQVLLNLAINARDAMPEGGTLVLEANTADLDGNEVNMQPPLPAGRYARLLISDTGEGMSPEVAQRVFEPFFTTKPRGKGTGLGLATVYGIVTEAGGSINLYSEPGVGTTFRIYLPMVDAPAVAGPADRPDDPPRGAGRTVLVVEDEVALSRIITRILTGNDYHVVVASDGRQALELAAQHPCDVLLTDVIMPGMSGPRLAELLTARHPGLPVVYMSGYSNGLLGSTHVLDEDIAFIEKPFTAADLLHKLGAALDIHQHVYRD

SEQ ID NO: 8984 - protein, 30 aa, Actinoplanes utahensis
MRILTAALPGRQARRGFNCAGAGMRGACPP

SEQ ID NO: 8985 - protein, 330 aa, Actinoplanes utahensis
MPALTDTPPLPAHLQVEVTSACNLRCTMCLVRYRPPVNKLAGAMRPELFHALVAELPLRQLTLQGLGEPLLSPYLPEMIASAVRRGVRVGFNTNGTLLSRRRADELVASRVDWLHVSLDGAGPAVYEAIREGAHFDTVIANLAGLVAAKRAAGSATPWIRVVFVAMRDNVAELPALVRLLAGIGVNELRVQNLSHSFDDATADYTEIRDFTAAQALWTGADLDRARAAFAEASAAARDSDLNLRLPHLDEREATGGGCTWPWDAAYVTSTGVVQPCCMVMGDDRVSLGDLNTASFTEIWHGEPYRDFRRRLNSAEPPDVCRGCSLYRHTF

SEQ ID NO: 8986 - protein, 667 aa, Actinoplanes utahensis
MVTLFSSNRPTTVDEYTEWNAKALARESVSRRSALKAVMAGAGGIAVAQFKLADAAFAAGGGTAGTAGVVVSGRHLSFVPGRDGIPQAAMAVTAQLVSKTGSLPKNLRAFVEVGIAPGHYGARHEADIQHLVGQYAIPGGPIGSQFYLKAKITGLRPDHIYHYRVRLSDGTVSGDAHFTTAPGSGHHSGHFGLEPAKPFTFTAFGDVGTNNAPVDPAYAWGQDPASVTANGGAWPKGVFDNNYYNAADPVGGATGTDPKPAVTQTNLMASQHPVFTLLAGDICYADPSGSGLPADNTNALAGGAAPGTNLYNPYVWDVFFNQIEAQAAFTPWMFATGNHDMEALYSETEFLGGSDTHGYAGHLKRLDMPGNGPKTCPSVYRFVYGNVGVISVDANDLSAEIQTNTGYSKGAQLTWLEDTLKAWRTDGGLADRIDFIVAFFHHCAYSTTNNHASDGAVRSALDPLFSKYQVDLVVQGHNHLLERTDPIKNGRRTKGAPDGSTIFPATDGVTYITAGSGGRPRYPFRPAPSAGAPAPTGITPEGVELLPEGQRYRGYQPAGGVNTTENNTENIVNSYYWSTEGTAINASGYPSGTKVPETVDWSQVRYDDYAFIAVDVVPARRGQRTTFTIRTLADALPGSGQPYSEIDRITLARTAGLSRIRTLHHGH

SEQ ID NO: 8987 - protein, 49 aa, Actinoplanes utahensis
MQQGDFMFSTKRSRIRALALTGSLAAAGVTIGAVTFDASAAETAAPAPS

SEQ ID NO: 8988 - protein, 154 aa, Actinoplanes utahensis
MPPLVTAVPKDIRPPDGSQPIGAFVVTAGTQNYTCVVPAGATTGGYTGNSVPEAQLLGTGGRIHHFAGPSWQSERDGSLVTATKTAALPPRAGAIPELLLQVKTHSGSGILDRADYINRLYTSGGVAPATGCTAGQTVSVPYKALYVFWDAPAA

SEQ ID NO: 8989 - protein, 113 aa, Actinoplanes utahensis
MRSIRSRDPEASDMTVRSVMSQMALHVESGVTLAGAGREDMLLRLGEHSLMIGVDRGTHRIRYRLPARPRWDDNGEPLPPEIAGNLREIVTEISLFWGQEPEFLIEEFGRPDV

SEQ ID NO: 8990 - protein, 327 aa, Actinoplanes utahensis
MTLTLPHELTEPLSWIGLEWPEADEDQLQATGKAWIDHGTRMRAHADQATAAARQVWLENEGAGVDAFERWWNGDDGPGRHLQESATAAEMIGGALVAMAGVTLALKMAFIAQLTALAVEVGQAVATATVTAGATLAEIPGWIALTRVAVRKLIHEAMALIEREIATLLRKAAKMMEKAGARTLAEKTVVRGQRTAFRGLMHEVENADVRSPLHGANFYSGLQPGGEKMRAYAEKQVNGTTSLTLEMTPGGKRFDDMKLFESGSPVNGDQAMDVWKRLSERYAQNASGEATAWTHEAWSGSVWYTREKPALQVNPNITKINEIDPFP

SEQ ID NO: 8991 - protein, 203 aa, Actinoplanes utahensis
MVTGRLRLDPDRVADAGRDLAAIAGRIADDVTSLEAAVGGAHPWGADETSSVFALAYRAVAETALDAMASYAEQVGYAAAALVMQARSVAAADAEAASSLYAVSGLPGATPPVPGADPTTPTPAPAPNAPGGVTGENTGGSSAHPAPAPAPAPAPGVLTPAPGTVSSPGPAPSATGLTAPYSSGPTSAPASSGAGPAAARSGV

SEQ ID NO: 8992 - protein, 177 aa, Actinoplanes utahensis
MGDNSYGGAAGGSYGGGPAGGSYSGPSVGGSYSAPPAGGSYGGPSVGGSYSAPPAGGSYGGPSVGGSYSAPPAVGEAADGRVWLELGGDGRIAELYLDPRVVHLPLGELRDALVTAFTMAQDAVRDRAEAATARYAETVVPDRLKAALAEASDTAERRFAEVSVALYDLSRRADRPW

SEQ ID NO: 8993 - protein, 225 aa, Actinoplanes utahensis
MPLTPADIHNVAFKKPPIGKRGYDEEEVDAFLDEVEQELIRLLEENNALRNQAQRGGGNPAATMVITNEFADLQAQLERLQEARARAEQNARNVQSQLERARSAAPSGAMPTIGDDDRNARVLMMAQRTADEHMRDAQRESESVMEGARAKAEQLTAEAQMKAGTIESDARRNHAEAMDSLVEKRAALVEEIDKLGQLASGYQQALTNHVTQQLMDLTSGPDAAE

SEQ ID NO: 8994 - protein, 408 aa, Actinoplanes utahensis
MDNSGTTDQARLNREDEEERDLVRPPDVNRAANRSATRLELFFDLAFVLFVGRCADLLAEHQTLSGGFRFVAVLVAGWWAWASTTLYANRFDTDDAIFRLLTLTGMAGVIAMAAAAEQAIGAHARWFAAGYVLLRLMLVLGYLRVWWNLPDARAGIRPYLWGHAAGAACWAVSLAVPGPARYALWAAGVLVDLLGPTLATRVPDAPPLHMEHLPDRFGLFVILVLGESVAAAVVGLHDGRWAAPVVVAAACGFLAAAALWWSYFDLSGGAAKRRLVQEGGERTRRGVHDFYVYAHLPVAISLAAVAVGLEHAIRHGADDHLPAGTRAVLGAGLAGYLLSAAVIQAVLSGRRRAALLWPGLGVPLVLILTLLPGLSPVALLASCAAVLVGGVITGVLQHRAGVIRVAKV

SEQ ID NO: 8995 - protein, 406 aa, Actinoplanes utahensis
MTQTTVVLILVVITALGFDFTNGFHDTANAMATSIATGALRPRVAVLLSAVLNLVGAFLSVQVALTVTNAVVRIQNSDGTPKADLLADGGQALLLIVLAGLVGGIVWNLLTWLLGLPSSSSHALFGGLIGAAVAGLGWSGVKWTGDGTKLDGVLGKVILPAIMSPVIAGAVAAVGTWIIYRITVGVAQRFTENGFRWGQIGSASLVSLAHGTNDAQKTMGVITLALIASGEWTDTGNIPLWVKVACALAIALGTYLGGWRVIRTLGKGLVEITSPQGMAAETASAAVILSSSHLGFALSTTHVATGSILGSGVGKPGARVRWAVAGRMVAAWSITLPAAALVGAVMWWLGDLVGGLGGALLIFAVLVALSVFMYLRSRREPVDQHNVNDEWDTPAARPRETAGAAS

SEQ ID NO: 8996 - protein, 105 aa, Actinoplanes utahensis
MHNLTLAFEGAWKVLLAGLILGAGLPAVFALGIRSLAYGAGGDAEVHAAGGSGPKPHRLGTAGGYLAFAVVLLGIALGITFIVATGFGKALSFEHLYPTIIDRKH

SEQ ID NO: 8997 - protein, 106 aa, Actinoplanes utahensis
MNEQRSNFVTRALGWLRAGYPEGVPRRDYVVLLGLLRRKLSEDEVRRIAQELAAQAQPGDGPITGADIEEMISQTMLQEATPADVVRVSAHLAAGGWPLADPPPAD

SEQ ID NO: 8998 - protein, 301 aa, Actinoplanes utahensis
MTLTQHAPSVRTQPGPTDNQAVLIVHGRDRTGIVAAISAVLGKHDANIVSLDQYSDNPHGGAFFQRTVFALDHLKARLPQVEADLQAKLAEGFDLEYTLRDLSVPKRVAIFASKDDHCLLDLLWRHRRGELPITVSMVISNHADTANEVRFFGVPFFHVPSAGPDKSAAEAQHLQLLQGNVDFIVLARYMQILSGTFIERVGVPIINIHHSFLPSFIGAGPYAKAKQRGVKLVGATAHYVTEDLDEGPIIEQDVIRVSHADTVADLQRRGADVERAVLSRAVRWHSEDRVIRHENHTIVFA

SEQ ID NO: 8999 - protein, 474 aa, Actinoplanes utahensis
MSLPPPLSDSRVGFGSRASAASSWSVTIGCRRRPRMARFAYRIGSPSPAARPAATRSAHPRSLPSGWVSPMPSVKLSPIATYRIPALPPSAPQLISPSVTSADPRLAGSRRPGDQRLAGAPRSRTTSRSRTRREACSQVDPHQPVPAFSGRTPGQNPLFRYVMSRPGLPRPPLSGTRWNVTATLDSQRYCPPPPVTHGDRIAWWDVTVAEVPGYRPLTLDLFRPTAVGHPLPLIVWIHGGGWLFGGNKDAAHGRIADRILAAGFAVARVTYRLSAEARFPAQLHDVKAAVRWLRRNAAGLGLDPSRFGVWGESAGGHLAALIALTGDDPDPALTGRSGVPGVSDAVQSAVLWYAPSNLLSMAAQNHPEGRPDHDAPGSPESRLVGGPVQELPAESAAASPVTYVTGDAPPMLLLHGADDRTVPAGQSEELHDRLAALSAPVCLRLIPGAGHRFTGVDLDPLISGSLQHFTATLS

SEQ ID NO: 9000 - protein, 265 aa, Actinoplanes utahensis
MNLRRSVCLAVSAAAATVTLLSMSGAAHAASAQTVQRSKPAATKDTDRDGMPDRWEIANGLNPKKNDARADRDRDGLSNRAEYRAGTNPRTADTDRDGMPDGWEVTNGLDPRADDADDDADSDGLTNTQEYDLDDDPQSEDSDDNGVLDGDEDADRDGLTNAQEYTLPGYDPTDADSDGNGVSDGDEDLDDDGLTNAQEFQLGDDPQAADSDDDGVLDGDEDHDGDGTSDLDELTDGSDPLGGDDSGSPDDTTDPAGPGDDAPAN

SEQ ID NO: 9001 - protein, 283 aa, Actinoplanes utahensis
MTLDRRAELGDFLRSRRARLDPGELGLASHGQRRVPGLRREELARLAGVSVDHYVRLEQGRTLHFSESVLDAVARALGLDPVERAHLYRLARPFPAGGGAGGQRVRPGLLRLLHAVGDVPAYVIGRNADVLAWNPMASALLTDFGAVDPRVRNMARLVVLDEGIRRLYADWPAKVRDVAGYLRLDAARHPGDPRTRALVDELGAASREFRAAWAEHGLKDKTHGAYVYLHPVVGRLELGFEALRLPDDPGQALVAHTVEAGSPSETALRLLAAWAAPAVPATR

SEQ ID NO: 9002 - protein, 352 aa, Actinoplanes utahensis
MRTRELGTTGMELSTTGLGAWVMGGAGWQYAWGPQDDADSIATVHAAVAAGVNWIDTAAAYGHGHSEEVVGRAVAALPPADRPYLFTKTGLVWDDPARRDTPPRRLMTAASVRRELEASLRRLRTDHIDLYQVHWPGDGRLLSWGPPDGAAPVGATELEEYWQTMADLRTEGKVRAIGLSNHGVAELDRAARVAPVDAIQPPFSALVREPADQIAWSAAHGTGVIVYQPMHSGLLTGAVDARRVAALPADDWRRGHPDFTTGLDRNLRVVDALRTVADRHRVPVAAVAVAWTLAWPGVTGAIVGARRPGQIAGWQPGADLTLTGRDLDEVAAAITAAGVGSGPARPGTTVGP

SEQ ID NO: 9003 - protein, 165 aa, Actinoplanes utahensis
MTAEGAVPDGAAVRFRDPAIRLPELAADEIDVVCPHCGCRAVVSADPVQGAVAMHSPRRFVCTRCVTVAQWPPKVGVSRWGGPIDPYFHLPLWFQARCCGGRTLWAFNEAHLTLLADYVGAKLRERHPREPGLTMVARLPGWLKAADNRTEVLRTIARLRHRPTR

SEQ ID NO: 9004 - protein, 287 aa, Actinoplanes utahensis
MPGQRGCQHGGAASRVRFGAMLSRRALLRTGLAGLAGVAVGAAGAREIPHWLGWDRPPVLGGYAAAADQLDGLHQPGVAVRYFVDTSEPLVAFTFDDGPAPHWTPMVLDALDAAGVPATFFMVGSRLERHADLVRGRMDRHAIGNHTWAHDDLATLDLGAVTRNLQRTEQEIRRHFDRQVTLLRPPFGHIGGSTMLAADQLGYDVVLWSKAMREQLFHDDPMGQARDIVDSVRPGSIILAHDEGDDKRLVTVHGLAAMFDGLRKRGFRMVTVPDLIAAGTSPSQGSH

SEQ ID NO: 9005 - protein, 178 aa, Actinoplanes utahensis
MGHPPGRRTRDREPAGSLSGMYPSPHVRVSDSDREAVVARLSTATAEGRLTIEEFSERSRSAYAARTWGELSRVLYDLPGDELVATPAAAAAGSRLPLLALIAGALPLPLALCAQVVLPAPICAVTAVVLGIMALRGPADTVRHGRRMAIGGIALGGLGVLAIVTGIAQFLFGGSLDA

SEQ ID NO: 9006 - protein, 200 aa, Actinoplanes utahensis
MRVAGRTLVVTGAGDAIGRAVALEAARRGARVAAVDTDPAELRETARQVVAPLLLSTHLLSPGPAPTGIEALPRAVLDRWGQVDAVIHCAPDGTPVVARAFLPTLRLRPEAHLVHVADSRSPAADRAAAKAFAHELRAETTLFVAMVFPTDPRRPYQAARDILDGMERNAYPARIGSDRRIRDVRGVAALLMARLRELVA

SEQ ID NO: 9007 - protein, 398 aa, Actinoplanes utahensis
MRLSQRALSAEPFHAMAFGRRAGELEAAGHDVVRLGLGEPDFGAPPAVREAMRRVMDGRPLPYTPAFGLPALRAAIAGFYRERHGVQVDPARIAVTPGASGALLLVAAATTDPGDEVIVADPSYPCNRQLVETFGGTVVTAATTPESRYQLDTAAVDAVWSERTRAVMVASPANPTGTSLPFADLVEVCARARARDAWRIVDEIYLDLADPAADGTPPRTILSADPDALVINSFSKYFGMTGWRLGWCVLPEALVPAAERLAMNYFLCASTPAQIAALECFTPESLAVCEQRRRELLARRAIALEGLAGIGLPVPVPPDGAFYVYFDVSGTGLGAWEFCRRALEEAFVSVTPGRDFAVATAESHVRLSYAASREALREGLARLSRFVQQLRRESAPGR

SEQ ID NO: 9008 - protein, 366 aa, Actinoplanes utahensis
MASTLSTSKTRAAMRDAARVSAQTLLILLLLYVFLELLGMAWSVLWPLVVALLLTTLTWPPVRWLRGRGWPPALAASLVTILFLALVAGIVVLIAVPVSAQSGKLGQGVVDGIQTVRDWASGPPLRISDDQVNSGLNSAVDKLQASVGSIANATLAGVSTIVNGLVTTILALFLMFFFLKDGPRFLPWLSRQLPGRLGDDVPAIAGRSWNTLSAFVRSQAFVGLLDAVFIGLGLWIVGVPLVLPLAVLTFVTAFVPIVGAVFAGLVAVLIALVFNGWVKALIVLGIILLVQQLEGNVFQPMIQSRGLGLHAAVVLLAVTLGGNLAGIVGSLLAVPVAAIVSVIWNYLREQLSDPEPIPAEVAEQTD

SEQ ID NO: 9009 - protein, 397 aa, Actinoplanes utahensis
MPGRHCVTFYRQVGSIPPKRHTQHRRPDGGLYAEELVGEEGFSSDSALLYHRGIPSAIVDARPWQLPDQSLTPNTPLVPRHLRLHDLEYKDADPVTGRRLVLGNADVRITYAVSSEASPYYKNAIGDECVYVERGSATVETVFGALTVGRGDYVIIPRTTVHRWVPDGGEPLRTYAIEASSHIAPPARYLSRYGQFLEHAPYCERDLRGPVEPMLAEGTDVEVFVKHRGGGSIHVVPEHPFDVVGWDGCLYPYAFNIADFEPITGRVHQPPPVHQVFAGQNFVICNFVPRKVDYHPLAVPVPYYHSNVDSDEVMFYVDGDYEARKGSGIGKGSISLHPGGHSHGPQPGAVERSLGAEFFDELAVMVDTFRPLDLGEAGLASDDGRYAWSWSGRGPSA

SEQ ID NO: 9010 - protein, 336 aa, Actinoplanes utahensis
MVLVRPRSVRMTATPAPPPSRAAADVPAHPTGIPPHSGADLPPHSGARHPDRSGERDPESVFDPFALFARFFDDAALFPPGNAPMAAAVPAFLDRLATPHAPLVGPFIAPAARLAEVAAHLRPAGPPLDIALIAAPADLPAAVDKIDKTPGMRLVAVEAPVAVDAAHTRSAVRVIADSLPPGLPAAVEVPRTAARDEVLDALAGTRCRAKLRTGGVRADLFPPVEELAATIRACITRSVAFKCTAGLHHAVRHTDPATGFDHHGFLNVLLAAAHPDAAETHLARTDAARIAADLRAWSPATAVRARAAFTGFGTCDLADPVNDLAHLGLLPERYPA

SEQ ID NO: 9011 - protein, 41 aa, Actinoplanes utahensis
MTWLHLPEATGFGLTNLPYGIFSTPAGTAAGSPTAPGAAPR

SEQ ID NO: 9012 - protein, 369 aa, Actinoplanes utahensis
MPGARTGVAIGDHVLDLAGLTGDPVHATGSLNAFMAQGPDTWAALRSMITTWLTDPAHQERVTPHLVPRDGVTMHLPFEVADYVDFYSSRDHAENLGRMFRPGSPALTPNWTHLPIGYHGRAGTVQLSGTPVTRPQGQSLVDGTPALGPSRRLDIEAEVGFVVGTPSPLGTPVPLSDFPAHVFGVCLVNDWSARDLQSWEYVPLGPFLGKSFLTSISPWVVPLAALSAARVKAPTRDEPLLPYLDDSAEPWGLDLTLEVRLNGHVISRPPFAGMYWTPAQQLAHMTINGASLRTGDLYASGTISGPTRDQRGSLIELSWNASDPLTLPDGSTRSFLEDGDEITITATAPSPDGSRLSFGTVTGRVLPAR

SEQ ID NO: 9013 - protein, 128 aa, Actinoplanes utahensis
MRSMVLAGLIPAVLVPGAAQASPCPTTDVLGTYAFGRAATIGAAGETAGVWTVAGTRSGIAGDDLIVTYTPRYTAAATETAVYTALFNQVARPDVECDRVGADGVAKHVWVTYRCRTGVAPNYTLLVR

SEQ ID NO: 9014 - protein, 334 aa, Actinoplanes utahensis
MRELLRPIVVAPMAGGPSTPGLVIAAGHAGALGFLAAGYKPPEAVEAEVQEVRKADVPYGVNLFVPSSPPADVAPLERYRAALQPEADRYGIDLPPLRLSDDDHFAAKVDLAVSHRIPLVSFTFGIPPAAVVTALRSAGCAVLITVTSGAEARQAVAAGPDALIAQGGSAGGHASTFSPATYTGTRATRDVLAEVLAVARTAADIPVIAAGGGDVAALLAAGAAAVQCGTAFVLSDEAGTRPAQRAAMLSGDHRETVVTRAFTGQPARALRNRFVDTYSSIAPIGYPAIHHLTAPIRAAAARRGDASALNLWAGVNHASARPAPVAAVIDALRG

SEQ ID NO: 9015 - protein, 179 aa, Actinoplanes utahensis
MSYPPPNDPYGQPQQQAYGQPIPQQPYGGQQPYGAPAPGYGPAVTYASWGARVGAYLVDMLVILPFAIVALFFRPTVDPVTLQTHFSPMYFIILLLAVVVSFYNRVFLDGKGQSWGKKALGIRLVDAATGQPIGAGKAFLRGVAHFVDFIICYVGFLFPLWDEKKQTIADKIVGTVVVK

SEQ ID NO: 9016 - protein, 134 aa, Actinoplanes utahensis
MRAFSVPERIGGFGVLVAGAAAVWPAFTDGTGLGAPCPMRTLTGIPCPGCGLTTAAVALVRGHVGAALQANPVIFGLAALAVAVGPLVALRAAGVLEAPQPWSPTGRRRMGRLAGLLAAASWLFQLHRLGVSWA

SEQ ID NO: 9017 - protein, 1724 aa, Actinoplanes utahensis
MLSVTDTPQVRPSGPQTAELSGLEIVEELGRGAFTMVHHVRRGEHDYALKRPLADAGELPELRTAFQREAALLACIDDPGVVGVHAVGEIDGVPGLVLEHLSGGALSDLLVYGILSQERCVELAAQLTRGLAAAHRVGLVHRDIKPDNIMIAGDGRAKLIDFGLAQLGRDTDADSDQAVGTFLYTSPEQSGMLRRPVDGRSDLYSLGVVLFECLTGRLPFEADDVGELLRLHLAAPVPDVREKRPDVDPALAAVVHRLLAKDPDDRYPDAAGLLSALRHCPGGASAEEPAASRWPMCGRDAEADRLARRWERARAGLGGVVLIHGAAGSGRTRLAEHAAGLASVSAMPVLWGTCRPDEPAPLAVLREAVQASMARVQRLADEPRAAAEKNIAEAAAAAGVAQVIKIFGDLGLLDVSGQPAAGDEHVFAAGAAFLGDLARRADGMLLVIDDAHLLDNATRQLLAALAPDLPSLPLLVLMTDTGDGAADLGVPGTLELTCTPLPPPVVGEVVASRLPGAAVPAELARHVTVRTDGTPLAVVSYLMRLLDAGLLGPLWGTWHLDTVGADALPSASGIRDLLAARLAGLSEPVLDVLTTAAVAGVRFRPEGLPGDGERTALEAGLERHVLEVRAGGWYAFVHPQLRDTLLERLGPDELRQRHAAAAAALERLPEELRDEAHAYAVARHYQRAGDAAPIADRRRTAAAAGLRALADQAPEEAVGYLVEAIDGDPAPAAAMLHSLAEAYLRAGRFPQAEATLDRALAVEPDRVARARMHLTRIELAHTIWDDTRALEAARDALTELGRPLPRHPLLLILSTLAYAFAGAVVRRTKIGFGRAEGQRREVLAALTAVLDAGGYAAIIGLRLREAGILGMRAMYAVNRLGPSPEYARVYALVGYVSSLIRLRSTGQRCQRRAMRIATDLGDPVLIAYVDWINGCSMLLGGYDDGSTWEKAITRNARWYEPAQLLPGYASQGLRLLLRGYPADAEREYERGLRGVADPALTYGTSLSMLGAMVPAYQGRFGEAAAAVKRLRDAIPPGTGTRVQHANILVAAAAVLLEQGEIGESFDEVMAEFRGLGLRTRDLMVQHKWILAFAAHARLIRLRYSSDEDRPARLAEAVTAIRELGRAGGSPLIKLSYRLSQASLAQMSGDQERGLKLADEAEKTARALDAPMAHYEICKIRARALRALGLNHEADRQARSALALATFYGWEQRRRQTRTEFGVDEGASTHRRTVAERRGPATGRNRRLEALQQVSTAAATVLDPQQLAQVALDETLRILGAERALFFLLDEAGEPVRFAGRDAAGELTDTMEYGATLVRRVAETGEAVVVTGTEQGAALGSRSAVAHGLRSILVAPVQFKGRLIGVVYLDSRLARGIFTDDDVDVLTAVSSHVAISLETARAAQLHLAVQAAQQQQALAETLRASLAELTSILEPDRLLRRLSGTLQSTLGAGSSCLVSPDGEVLEPAEIAGGRLTPDEVALVGGLTEPALLDPAGTGGLRERLLAGDPVALAVPLDGRDGRAGTVLLGGAALDDTSRQVAAALATQGMTAYDNARLFSRVQELATTDELTGQHNRRHFYAVAGALVQAAARNGRPLAAAMLDIDKFKSVNDTYGHGVGDEVIRTVARRIRAVLRHSDVLGRYGGEEFAIVLPDHEGEAMELAERVRMAVGGEPVATQAGPLPVTISIGLTRLGDDDTALDDLLARADHALYRAKEAGRNRVMAD

SEQ ID NO: 9018 - protein, 277 aa, Actinoplanes utahensis
MPRPCRNVLFVLTRLLAALLTLPAAASTGSAVAAPAGPPRTAVTHPAAHIVRPGDTLPAIAARYGLKARQLQRWNDLPADFVPHPDSALRLSASYRPRPPWHTRVEPVTTPTAPNCPVPATALRRVWVTYEDFNGDPHDGSLIVNESIVPATQNAFALLYAWHFPIMAMEPLAENMPDLTDRAALTSGYECRNIAGTTRWSQHAYGLAIDVNPRQNPMIRGDYLDPPNSAPWIPRGPYLPGMIHPGGAELAFTSSGFHWGGRWHSLKDYMHFSPNNH

SEQ ID NO: 9019 - protein, 349 aa, Actinoplanes utahensis
MRRMISTEHRGRRAAGSLKTWAAGAVGVTLAVAVTPHAALASASPDLRAESTQLTDVVQAGSTIDLPVIVDNVARAGEEGTTAHGVSISIMAGADSFVTRHDNCWYGAYSTTCRFPGVVVAPGDRYALSPETPLAYRVAPDTPELENARVLYSVHAMSSEDDQPPWDTRQGDGPSLVLVAGPGAKPADDRNNAGTITFRTGPNPTDIVAVGTQVSATGGESVPIAFGVRNDGPAFIDPTSGRAASNGEPVWVDFAAPSGTEVESIDSRCAPFVDGAVDRSRAGAAGFARYECGLGVIDLDGYPVGWSELWSGTLKVTGTVSGPGTVTAHISQAEGDPANDTAPIEITQS

SEQ ID NO: 9020 - protein, 153 aa, Actinoplanes utahensis
MSYAVDFTTVSTTGLESSPVADALAGLRANEARYFKNKYDHVFTVEPATEATATVDWVSHILKAERGIVIASPPLEATRFQVENIKMAYVFYRSGLSINVMYTVDEGGKRAVGFKLSDGMDIPEELGAFKFARQKSKLAGTIRGSYFVIKNEY

SEQ ID NO: 9021 - protein, 201 aa, Actinoplanes utahensis
MSANLLALIAVILLLTYFAILVALHVRDTRHHPLRDAVSDYGVGPTAGRFRIAVIANSLGILAMTGALADELGLLGFTHSDYVILLLIPITRLALAFFPAGMDSTRTTWTGRIHLILAILSFTFVYLSVAQLTTPLTSFTSDTVGLLLLTLRWLAAFGLAAVVITMLAPALRPFFGLAERIYLATTNLWFLVVALFLTFHR

SEQ ID NO: 9022 - protein, 125 aa, Actinoplanes utahensis
MPAASAAYCGGMPTQRLVAHLRELGFSPYEARCYAGLLGAGPLTGYAVAKLTGVPQPKVYETLRRLVARGAAEQAPGPPIRFTAVDPQDLLNRLAAAHAAQIAAVRAAAEQLLALKIGSRRSEHY

SEQ ID NO: 9023 - protein, 50 aa, Actinoplanes utahensis
MTASGSAGAVCSSPPEPGLSTLDVRAILPGHGEPLPAGAKEILQKPAASI

SEQ ID NO: 9024 - protein, 125 aa, Actinoplanes utahensis
MKGDAGPVLIEVINPAGDRAARDIVGQVAQAPRRCPSYDEGKPGTPDALHMVTMPLSVPKLGNRSAGVHFEVDMTSPRVTVHGKMIAVSVRGVVVTVLLANLEPPDQHELETITRTAVRKVQHQR

SEQ ID NO: 9025 - protein, 148 aa, Actinoplanes utahensis
MQMIRHKSLKMALAFSVSAGMGLAVAAPASAASVWTPVKNTALAQLMTDAAAPSLVTGTTLLPAGVAGARLLPSGSPAGPVPGWLKKALLTGKDLPEGYQPVPDALKAFSDTGSKVGDCGTKPADTKPGDTKPADTPPTGTKPPVLAS

SEQ ID NO: 9026 - protein, 187 aa, Actinoplanes utahensis
MPNHLHFLTLAAAPPDHRDLRGISPGGSDRAGARRQHPHSRAPGRYGPRMSALPKELRDLIESGPIAHLSTTNANGSPQVSAIWIGLDGDDVVSGHLGWRTKLRNIERDPRVVLSFDAPRRPGVFLAEHAVLRCHATLEHTGRAWDLLDRLAKVYLGPEQTFPAPRAEGWIARYRVDRVGGVGPWTA

SEQ ID NO: 9027 - protein, 337 aa, Actinoplanes utahensis
MDHAHEHEHEHHDHGHDHDHGGHSHGVAADADRRWLSLALGLIGAFMIGEVVAGLIAHSLALLSDAAHMLTDAGAIVLALVAMRLAARPPRGGYTFGLKRAEILSAQANGLTMLILAVWLGVESIRRLIEAPPVAGRLVLITALVGIVVNLGAAWAMSRANRSSLNVEGAFQHVLNDLFAFIATAIAGVIMVTTGFTRADPIATLIVVVLMVKAGVGLIRESGRIFLEAAPTGIDPPALGARLAGVPGVVELHDLHVWQITSGQPALSAHVLVAEGLDCHAVRSDIESLLRRDYKITHSTLQVDHADTDPTRSTGYEVDLADPGGHCVDSHGESYRV

SEQ ID NO: 9028 - protein, 402 aa, Actinoplanes utahensis
MADPLNPTLMTRMRATLGRERDASLLEALRTAGRVAYDELMAAEKVREQLGADGTSVWNAPVAIGSQLLAAWNGFVLQTLGETFLDADYAANPGTVGYVPPVTYEQTARWFSAVEGWVSRARQARVNPDYDISAELGLPAGLPMWAEVEPCPPEHLSALLAAVPPVREHVDVALFALEKAGVPDNRRKAFNRLKQLVAEAAAAADYAVGLRTTQHNPALHELIENNLKQALELWFHAGQLAAMPGLLDSYRALRPIARPDPATLPGGARFDPWCLTDRVTLPRWQRDHRAIQAISELWEYDPDPAATLAVKADIDAALAAGDITPLRTPGGGTCYYECPWSALYVVRRPVRIAGRRLQVLQQFTMEAAADDMPRGLPFRRGILIGPFFPTNEVEYCDPDGRH

SEQ ID NO: 9029 - protein, 256 aa, Actinoplanes utahensis
MDVNLWVCGRRGHLTYAPVEEEFRARLHAETALGPVWRCLRCGDFVLGEPRLSGPAADAPLVPRGRALRDAIVLRLLAVERFVKGILVLAAGWGVIQFRGSRDAVQRAFHEDVPLLKPFTDKIGWDLQHSAVVDTIRRVVEARSDTLLWAGIALIGYGVLQLAEGTGLWLLKRWGEYFALVATSLGLPIEIYELTERFTWFRIATLVINVAAVVYLLVSKRLFGLRGGHRAYEAERHEMSLMEVADAAGDPIRVGG

SEQ ID NO: 9030 - protein, 187 aa, Actinoplanes utahensis
MTFLWSYTEALAGGDVGWWRAATRHAADLLEADHWWLDPPALVPVQHLLVETTALLSYALARSVDGDPGAVTGAQLGGWAAARPLPLLDETVPDSLEGSLSLLQWSRIFEEQRLRQQNDFARLLVAAGHRLPATGDPVADLWQDLVDRENSGRRYGLAGRLPGPALALGLGAVRQQFVSAGGAAGGR

SEQ ID NO: 9031 - protein, 316 aa, Actinoplanes utahensis
MTSTAPATPGPHRAWRRWARYSLLAPVALLAVAMLRTRLPDPVSILGALRGADRRWAVSALAAGLLSQLAYAEQQRRLLAAFAVHVPPRRAVAMTYVRSALSMALPAGAAASAAYAFQIYRRHGATSAVSAAATLISSVVTALSLGLLCAATWSVPLTAALLAAAAAVPWIRRRPALSRRLTALPLLRRPAVRRALRDARTVEPRTWIAVLLAGLVNWLLDMGCLLLAADAAHAGIGWDRLALIYLTVQIVRQIPLTPGGIGLIETSMLAGLIAAGTTQAAAAVAVLIYRLISFWLILPAGLTAHLLLRRHSRTAA

SEQ ID NO: 9032 - protein, 479 aa, Actinoplanes utahensis
MTGRELGPAPGALCNDYCSLMGEHFDLVVLGAGPGGYVAAVRGAQLGLSTAIVEEKYWGGVCLNVGCIPSKALLRNAELAHIFQHQADTFGIDGKVTFDFGVAHRRSRDVADGRVKGVHYLMKKNGITEIQGRGEFVDAHTLRAGDRTITFDNCILATGASTRLIPGTTVTDRVVTYEEQILDAELPERIVIVGAGAIGVEFAYVLRNYGVDVTIVEFLDRMLPLEDEDVSKELLRHYRRLGVDVRVGTRVDSIEETAASVRVTVSKDGRTEILEADRVLQAIGFQPNTRGYGLETTGVRVSDRGAVEIDDYCRTNVPGIYAIGDVTAKLMLAHTAESMGIVAAETIAGAETMALDYRMIPRATYCQPQVASFGWTEAQAREQGFDVKVAKFPFTANGKAHGLGDAAGFVKIISDAAYGELLGAHLIGPDVTELLPELTLAQQWDLTVTEVARNVHAHPTLGEAVKEAVHGLAGHMINL

SEQ ID NO: 9033 - protein, 268 aa, Actinoplanes utahensis
MICTNCGSTAAPTAGPCPGCGRPTPDPAAGMFPDPLAAPPTTALGGSLTDPRYPATRAMPTSPYGVPVDPYTGPTTGDPFAATPPAAYSGPTSGAPGYAPPAYSPPATPPATPPYAPPGQPTGYAPPGQPAAYGQPAGLGQPVAYGQPAGLGQPVAYGQPAGPGQPVAYGQPAGPGQPAAYGPPGQPQYGPPYAAYPGPGPAPSQVYTIVSYVFGGLAVVLGAPFTAIIGLALAGFGKKRHEPHGELAIKIVSGCLVLSGVIWLLHRN

SEQ ID NO: 9034 - protein, 365 aa, Actinoplanes utahensis
MATERRVAIWRSAMLPGSETFIRNQGDALTRWRPTYVGATRMESVLSRPDDVIAFPGGKGFLRLRLTGTSPQLRDTLAGVRPDLVHAHFSGDGWLVSHTARELGVPLVVTAHGHDVTRQPSSPGAKGVRYRRNLHSVFQRATTVIAVSEVIRQQAIRWGADPAKVRVHYTGIAVPATVEPLPKRWDVVFIGRFVAKKGVDDLLTALSMLDEPRPRVLLIGDGELLPAMRDRARESRVDVTFAGSLPPDEVRRHLLESRLLACPSKTAPDGDTEGLPTTILEAAALGLPVVATRHSGIPEAVVDGETGLLSPEGDPAALAASLRRLLADEELRQRLGEQGRKHVTAHFDLTEQTRGLERLYDEALG

SEQ ID NO: 9035 - protein, 321 aa, Actinoplanes utahensis
MSSEPDVSVVIPTCNRPELAVRAVRSALGQTHQNLEVIVVVDGPDEATVAALDEIGDSRLRVIVLPERGKAPNARNTGARNARGRWTAMLDDDDEWLPAKIERQLALATAATSERPVIACRMISRTPRADNVMPRRLPEPGEPISEYLVVRRGLFYGDGFVQTSCIMAPTELWLKVPFTVGLRRQQELDWTLRALREPGTELVYAAEPLVLWHQDENRERISLENPWQEQLDWLRANRELFTPRAYAAFTLSVLSSMAAPTRNAKLFRELLAEARGHGRPGAVDYLTHMQIWALPPSMRHRLRDLVVGRKAPEQPVATDGN

SEQ ID NO: 9036 - protein, 385 aa, Actinoplanes utahensis
MSKTSKRRRRAPRWAFWTVVFGTVLLVGGGGGAIGLKATVAAATSSIDQTTLIGSAAPAEEKAKVSLDGPKNLLLVGIDQRPDQTNGEPLRSDSIILLHINKDHTSGYMISLPRDSYVNIPAYDNGAQKWGGGRTKINAAFAFGTRGLKGDDALKHGFELLTMTVKELTGITPDAGAIIDFQGFRDVVNVLGRVCMYVDTTTKSIHLGKDAKGNTAHPYAINPNGTLNHKIAGVTPNIYKKGNQCFSPSQALDFVRQRDLLEDNSGDYGRQRHQQQFFRAIINQAMKDGLDSPTKLPKLLGAFGKAMTVDTRGVDLADWALSMRSLKPDKLITIKSNEGKLNSQTIPGVGSAEILSPDTMDLLKSLKRDDVATFLLGHPKFVATS

SEQ ID NO: 9037 - protein, 116 aa, Actinoplanes utahensis
MGAGCLPAYSRVVTNRTPRLEIEYCTQCRWLLRAAWLAQELLTTFPRDLGEVALVPGIGGVFEVRLDDETLWSRKPDGFPDLPQLKRLVRDRVAPGRDLGHSDRAATVTPEPPATA

SEQ ID NO: 9038 - protein, 175 aa, Actinoplanes utahensis
MADSVVYDQIPVVRAIGRGTTSLAAFHDALVTMECGFYNLVRLSSVIPPSTTVDASGKAPVPVGAWGDKLYCVYAEQHATQIGEEAWAGIGWVQRRDGRGGLFVEHEGTSEAFVREQIKASLGDLVKGHEDEFDGPDFVVHGAVCTGDPVCALVLAPYETASWRGMTATQPPGMN

SEQ ID NO: 9039 - protein, 139 aa, Actinoplanes utahensis
MRLPRLIFLLFNADRAVRRWIDARSADTGIGASGAGVLFYLAGHENALIGDVTAALGASPSGMSGLVNRLERSGCVSRSPDPADARAVRLTLTPRGRESVTRARDLVDDLNQQLTAGFDEAEVAVIERWLEHVSRRDFR

SEQ ID NO: 9040 - protein, 290 aa, Actinoplanes utahensis
MRTKETVRIPVTTGGAITATVFTPEEPAAVLVVHSATATPQGFYAAFAEYLAADGIAAITYDYRGTGRSGSPRDHRDVGMRDWIGVDAPAVAAWAGDRFPGLPRLAVGHSLGGHAIALGAAGTDPAASVIVASHLAAITTIPSRLERARVRLLLHLLGPASARLLGYVPASRLGLGEDLPAAAMADWGRWVRMGNYFFDDPSMRARERTATLTGPVLAVGAADDPWSTPPQMDVLTTHLTGADVERRTYTPAAAGVPMIGHHGLLRRTLSEAVWPDLLAWLRAHAARARK

SEQ ID NO: 9041 - protein, 326 aa, Actinoplanes utahensis
MSVPLPAGREPGRLAAVVRRQGALAVLVAVVVISLAAFPGFRSADNAGTILVAAAPPMLIALGMTFVIITGGIDLSVGSLYALGGVVAAWASQYGFAAALAAPLLVCGAIGVLNGVLISRTGMAPFIVTLAALLGARGLMRSISDEGSTTYLVRSSAFHDLGTGAVLGIGLPVWVGAVLVGAGIVVLNRTRFGHAVHAIGGSEDAAALMGLPVRRIKVAVYVLSALLAGLAGAINAAKLGSGVTVLGSGMELDAIAAVVIGGTLLTGGSGSVAGTVAGVLLLGVIQNLINQVGNVNSNWQQVISGAFLAVVVVAQTYLVRARRSRN

SEQ ID NO: 9042 - protein, 320 aa, Actinoplanes utahensis
MSTETLTRRPRAAVSAAWLPRYGVYAAILLLAAYNVAFTPYFLTLSNLRIQLIQAAPVVIVALGMALVIGTEGIDLSVGSVMALAAALIPLYLGYGVVAAILVSLLAGVAVGLINGVLVARVGLQPIVATLALFVGGRGLAVVVSGGRLKDIRNDDFLYLGSGDLLGIPVLVWIAALLVLAVAFVIRRTVFGRRLLAIGGNRPAAELAGLPVRKVLIGVYVFCAVLASIAGLLSVSRIQSSDASAVGLLIELSAITAVVVGGTPLTGGRVRVLGTVAGALLMQLVVATMIKHDLPPSTTEMVQAVIILVAVYAARERRTR

SEQ ID NO: 9043 - protein, 503 aa, Actinoplanes utahensis
MALLEVAGVSKAFPGVRALDGVSFTLQPGEVHALVGENGAGKSTLIKVLTGVYQPDGGEVRYQGEPARFGTPLDAQRAGISTIYQEVNLVPLMSVAHNLFLGREPRNRFGLLDEARMVREAGELLAGYGVRTDVRRRLGTLALGAQQMVALARAVMIDAKVVIMDEPTSSLEPREVETLFGVIRDLHARGIGIVYVSHRLDELYQVCDAVTILRDGRLVHTGRMADLDRRRLVSLMLGREFGDDFTSFTGAAESAEPTGEPVLRVRGLTSRPRLDDISFDVRPGEVVGLGGLLGAGRSETIKAIGGAYPIDAGDIEVGGTKLGRPSTVRAVRAGVATQPEDRKAEGIVPGLSIRDNIALAVLPRMTRMGLVSDKKIDEVVRTYMSRLRIKASSPDQPVGDLSGGNQQKVLLARLLATGPKVLLLDEPTRGIDVGAKAEVQALIDELAAEGLGVVLVSSDAEELVEGADRVVVLRDGAVVGILSGDRVTTEDLMATIAEAADEH

SEQ ID NO: 9044 - protein, 363 aa, Actinoplanes utahensis
MFRNVAFVRPRSVAATFAAAALLLGAGACSKAEDSGTAGTASAGPAASQVVQSAAASGPTCTLEQYGAAKLDLKTAQVGFSQSEKEANPFRIAETQSIKDEAAKLGIANLKTTNANSQFTKQVADVEQMIDGGVQLLVIAPLNSDGWDSVFAKASAKHIPIITIDRKINATACKDYLTFIGSDFAEQGKRAADAMAKALGNKGEVAILLGAPGNNVTTLRTSGFKDEIAKVAPDIKISFEQTGNFSREDGQKVAEQLLQSKPNINGIYGENDEMALGAVTALKGAGKKAGDVKIVSIDGTKGAVQGIVDGWFSAVIESNPRFGPLAFQTATDFFGGKPVGQDIVIQDRAYDESNAKTDVGSAY

SEQ ID NO: 9045 - protein, 159 aa, Actinoplanes utahensis
MWRNRSPDRSGIEKPGPPVVPSMGRMDIRIQASFLPHDDAEAAIGFYRDVLGFEVRKDVGFKDMRWITVGAKGQPVSIVLHPPAADPSITDDERRVIAEMMAKGSYAAVTLATEDLDGVFERLVAGGADVVQEPADQPYGIRDCAFRDPAGNLIRINQL

SEQ ID NO: 9046 - protein, 144 aa, Actinoplanes utahensis
MGGLEQRLRDLKRLRQVRDRIDRDYAQPLDVEALARGAHMSAGHLSREFRSAFGESPYGYLMTRRIERAMALLRRGDLSVTEVCFAVGCSSLGTFSTRFTELVGISPSAYRRTAADATDGMPNCVAKQVTRPVRNREARTAGRS

SEQ ID NO: 9047 - protein, 298 aa, Actinoplanes utahensis
MTETGLRGVFNILATPFTADLGVDTASIGTLVDGVLATGVDGVTVLGVAGEAHRLNAEERSLVVATAVEAVAGRVPVYVGASHDDTATVVQAGTEARKLGAAGLMIAPPKGWTAGEALTAHYREVADSVGLPIVLQDFPAASGVDLTPEQMAELVAAVPLITTIKLESLPTPVRTARTRALLPPGRTILGGMGGMYLLDELRHGSAGTMTGFAYTEALIDICRAWADGDVARAKSTYTRFLRLLVFEQQAGVGLAVRKEILRRRGFIADGSLRQPGQPIDELTAADLTELLADLGLAG

SEQ ID NO: 9048 - protein, 239 aa, Actinoplanes utahensis
MADLRGAAAEALAGTGVAAVAGTGLLPLMPPAAVPDFLAAWSRLEPDAYLPGGSTFRRRRYGRIAAVPGADGEYRLDDLPGAPFTQSAATIPLYRGAARRFAPVGTSFLRSSALRTLLRFDLDVIGRLEPRAFGIGIHLIRVTVGPDHPENPAPEGRHFDGHLYVAMHLIGRESCSGGSSLVFMPGDDKPVFSTTLTGRLDTLIVDDRRVEHEVSPVRALGPGAVRDMLLVDFDPLDDI

SEQ ID NO: 9049 - protein, 289 aa, Actinoplanes utahensis
MSAFRNYAMSLISASVTVVIGLLSDIVFKLSNNETFIVVSTGAVVSLAVALIEQRMNSDQKEFRAHITAEMAEKLDLFRMIDEIDDPQLRAEVFLLARRLSIGEVPSHIAAIRTPMLYDRARSTVYASNVSLTRPMLYRWDSLARFRRIVEVSGRRSAEGVTFTRTFFLSRRQIIAPDGRWDERSWRTLRAQTEAGIAVRIVWAEDLELDNLPPHRKLVRDLTIFDSLEAVDTTGVQVIYRHPSDRLREFLDIEKEQLKYSESFDRYTGVELVDLEELAAAEVAGSASG

SEQ ID NO: 9050 - protein, 680 aa, Actinoplanes utahensis
MLILGWHGGIRPEWDDLGPGWSTHDGAAVLLRDGQIVAAVEEERLNRVKHSNFFPARAIARCLEIGGVRLPDVDVVAMNFQERTREIFPADAGLPSPNAFLDDPSSGTPTVRDALREIFDRHFATDVADRLHFCHHHQAHLWSAWGPSGFPEALGVSIDGSGDALSGMVARAGEAGLEVLREWPVPHSLGDLYSDSIRLLGYRRFDEYKVMGLAPYGDPRRFRSLFEQFYELRPEGGFRLATRAERWGLIHDAGLLPLARRSGQPFTTLHSDFAAGLQEALETVVLHVIRHFATSTGLRRMVYAGGVAHNCTLNGRLLHEGLFDEVYVQPAAHDAGGALGAALHADHVLGGGGRAAMPHLSLGTDLPSASRIADRLAAWSGLVEVTRLTDPIGTTARELAGGAVVGWVHGRSEFGPRALGNRSILADPRPAGNKSRINEMVKKREGYRPFAPSVLQEHLAGLVEMPAARADLSFMTYTLTIRAEHRELLGAVTHVDGSARVQSVSRSRQPRYWALIDAFRELTGVPALLNTSFNNNAEPIADSVDDSVVCFLTTGIDLLVVDDFLVRRRPGLDLAEQARTLCPGVPLSRKLVSRPAPDGSGFHHSIEATASAHFVQQRVDVSAGLHRVLSLADGRSTVAELCSAAAVTEAAQPGILRELITVWERRAVTMRPSGSVRERA

SEQ ID NO: 9051 - protein, 195 aa, Actinoplanes utahensis
MIARRLGWERNLLRRTSDRVESLVMFVLVLTFLAGAPLLAWWAGAASYRADVRARDWERAHVFQVDAVLVEDSGTYGAIGTRTAAPQAARATWIAPDGTAHSGLVQTPTEVHAGARIAIWVDDTGRLQAPPLRHSPTSQGILVALCAILCLAAFLAGLHRTTRALLDRHRCASWAREWRVVGPRWSRDPRWRRRR

SEQ ID NO: 9052 - protein, 484 aa, Actinoplanes utahensis
MTGWPAAPAIYEIDTWPWLTGLTRRFGRPVTLGDVPAEVWDEVAAPGMDAVWLMGVWERSPAGLAVARVNDGLQRAFRQALPDLAPEDVVGSPYCVRRYRADDRLGGPAGLAAARAELNRRGLKLVLDYVPNHVAPDHPAVVRHPDWFIRGSEDDLAADPTGWFHAGGRVIAHGRDPYFPPWPDVAQLNAFAPGMRAATLAVMSQIAEQCDGMRCDMAMLLTNDIFAGTWGRWAGPRPDDEFWPALIGELRRRHPEVVLIAEVYWETEWLLQQQGFDFCYDKRLYDRLAHEDAGSVRRHLAAGLGYQERLIRFLENHDEPRAAATLPGGRNRAAAVAMATLPGATLWHDGQFDGRRAHLPVFLARYRDEHLDPGLRDFHRRLVRLAPAVRRGRWRLLGTSGWADNESHQDLLAWAWEAALVVVNYSGRPAQGRVELPWPSLAGRAWRLVDRLDGRVFERSGSELAAEGLYVDLPAWGFHVLTLS

SEQ ID NO: 9053 - protein, 382 aa, Actinoplanes utahensis
MLREAELVHAVRGLRDEWAYWAELAGTEPMAKHTSQIEAITRLLGAGLDRADTFELVLDLFHVWDFFRAKLLLRRVGPLSRILAVADELAWAVYRPSVLAAGVAAGRKEPPLVFLDRGAVPFAAARGAGYRDLLPRGVRTTAGLTAVRELPVPVIGIPWYLTGHLPGVLLVAHEAGHHVEDDCGLTADLPAALAGLDAGTAARWTPWLGEAFADVVATVACGPAYPMILAEALRDAGDGAGAESYPPPADRLDLCRGAAGDDRTDSPAGSVGHRMATARYAGLGDRSLRDVLTHPDVARAEVGAAGLLRGLGSALTDVRAVLPAAALAFLADPPAYDTMRVDSRAVDEILALRPRGPRAGNDPAAAEARDLAAAQSLVKALS

SEQ ID NO: 9054 - protein, 1555 aa, Actinoplanes utahensis
MTDQRLAEIVRLLAAGRSLEDIQRDCLPESWRRALRVCAAAGDFDRALYDTVLAAHGAPDAPALDELTGRGLLERAGDDRWRIRRSEAVAWMGEWQPARDRLAALEADIAAWLAGRGPQIERLRHLLVADPAAAIALFEAEFRAADRNRDFARCQDLIDVLGDPKRLTYAGPEVAALRLERAGYLRARLFWSATWSRSAQYLEPDGLAGQADALLDGRGPRVWQVFAPTGTGKTVQLQWLIARRCVPAEFDIPCARIDFDVVDPVVSARYPWLLLLDIAEQLERRWARRVFERLDRFASYRGLLDRQDSQQARAAAEGLTAQDPERLERAVSEIFVRRFNDAAGAGPVLLVVDTMEEVLLGPGADDLLRALARIVAQCPSLRLILAGRYDLRERAGAALAAFGDVRPVALGDFTPEQTGRYLREIRHITDPDLVAAVVERTGGHPFLVAMFADLIAEEPATSPADLRAYRDPALRLLIDRVIRRIPDPDVRWLVRYGVVPRRLYYADLHMMWPFLVSGRSGVTDRDDPRADRHHLAGDDGVFPVGGEVSAKEAVWRRLLDYAAQRSWVSEPDRDGRLVVFHQKVRAPMRELIAAQPVALDLHAAFRQRFDDLAAAHPQAPAPFEREAYYHRVQLGDPGAQRYWDARIRARRAAGDLDGLAGLARDVLTGDYPDGVIEPGQRADALVWLAYAAIERARRAGAPAADPLWNEAEGFLARADRLRTAAQLPAGGLAVAMYAATLCVGDRSTEAASLVVAALPKASADDRIDLLRVLADAAGHASGVIFAEALDLAGQRRPDQVEPLALALARDAEKAGRFDRALDWCRRAGGVRARLREAELLISAYQPGTALEVLARVRPDAPAERVERHRLCGRACGRLGISEAAVGYLGSAVEAAGEVTDGRRAALLARVHQERALVLGDLLLLDEAEHDLKLAAALWSQAGFTEGHPESAYLHHRFLVRQVGDLRAAAALQRPPVPADDRIGVLWDELVAERLDQDRPEPVTGPPQQVAVVIAARLARDWAAHRHLLGPLAEAMGRISPPSARLGVLAELARHPGPAPAEEVARLREVLTWPPDHPDDGPAQLPLLAVLERLAGDPDRAAVVLQPVSRADPLLGSRMLDAAAGRLAQPETLLPVPSYPLLRAVGLRRLALGTGAAAWYAEAVRLCRSVDRPSRWAIDIYREAAEHLGDPRLRAAATDLDWRLGRMFGGPEPESLVAVAALAAHPLTWPAGVPQTFYELQVRLVQDWRALTLELGRALAAPVPPDRLDSDDVLLHGLPWELATPAAPALWRAMPSRARPADVRWLQYALTTLGAVVEVDGVLGPETGAALDCRDLTPPLRGEPLARLRGSVARDRGARRLSAVVVQAVAGTSHEDYGYHVADLYQRCGYQVRSVPGLEQVLADEPAVLHVCGRLDYRDSGPHFRLGPGSVLEPSDVVRLLRSGRPGREPVLVLDPPYPGSPYDVPWQIVLRNLFAAHVFAEGCVPAVLATGLIRSGGDYVLTIADGLAHGRSPLDLVRAIRPAGVPDGRPLDFKRDDELLAARSTTLFAAPTALL

SEQ ID NO: 9055 - protein, 645 aa, Actinoplanes utahensis
MSTVDAELAVAADQRTVTLTVAGRPPATATITGVLDPAHFDGALDRRIPAETRGKLGRELFDAVIREDTARLWNEVDEDGTPLRLRLRIPPPLRGLPWELLASGADRLALRRGGTLWRGGPPRAGAEVDGPLRVLVVVCNPTDRQVLGDEELAGLTGAAAECPARAHIEIVDGPDRDRLAKEIDRLRPHVLHFIGHGMPRVPGRAAALAFNWVTAGRPQGAGWELASTEVGLMMSDDWTPRLVVVNACRTAADALDQVGGVAEAFLRAGAGAVVAMQADVESPAAATFAGLLYQGIFAGLGLDRAVAAARTELARTTGDTGEWAIPVLTCRTDPADVVRTGFRRPAEQIAGLTARPEYQMLRNFLDHAPGRRDAWWALDPLTATPPRSLLVVGGRSGNPHKPTGKTWFTRFSLLTYFLRGYRVTYVDLGVPLARPDGEHALTKTWLHVLQMMREACTDPGQAEPLPAAAFAGFDALFGTLAGEPAGWSGERWRFDENRPRAAEQRDRILDGFRTALAAAAGDRPHVIALDNAEQVLPESFDSAIYPSLLRPVAAAGGGLRLMLVGKADWLAARLPGRDQAYWGPVVTIGDFEAPQMMRLARDYCRRRGLPFELLKPVFGAICGVSPQAWVTRFDEVLDVIGPVAP

SEQ ID NO: 9056 - protein, 260 aa, Actinoplanes utahensis
MGDSLGSYRSAMRDAWHGWWINWPLSQRVRVGDVLDTSGGTIRPAGDLTKYGVAGAAAAAAPPADFLYDANGSAQVTFKLSGTTPPGFSALAQADAGALVSFKGDTSVLALFTGLTQDRFADTRAVAGNLVKQFWNGVWAPELAGVTDVVTAAAGTVLAASDTDASAELRVDATVGAGPLKLADLAGNVAVARSSRVGLEWSGTEVTPFYRVFRLRRTWLHRVATDYGPRQPGRGAAPEAVPPLLVDEARDDPDAVLEPL

SEQ ID NO: 9057 - protein, 331 aa, Actinoplanes utahensis
MPGMQQRKLGELTVSALGFGAMGMSHGYGPGPDREANIGLLRAAVERGVTFFDTAEVYGPWVNEELVGEALQPVREQVVIATKFGFVIGADGRQGAGVDSRPENIRRVADASLRRLRVDTIDLFYQHRVDPDVPIEEVAGTVRELIAAGKVRAFGLSEASAATVRRAHAVQPVSAVQSEYSLWWRRPEEELLDTLGELGIGFVPFSPLGRGFLTGKIGADTVFAENDMRNGLPRFSAQARAANQALVELIGRIAAGKGATPAQIALAWLLAQRPWIVPIPGTRRLERLRENLGALDVELSPADLAEIGSAADRAGVQGERYPEKMERMTNL

SEQ ID NO: 9058 - protein, 91 aa, Actinoplanes utahensis
MRTVIRGIVVLALVAGGGAGMVGPAGAAPAVTFKNCTELNKKYKHGVGKRGAEDRVSGSTKPVTTFSVNNDLYAANKRLDRDKDGIACEKR

SEQ ID NO: 9059 - protein, 600 aa, Actinoplanes utahensis
MALPIEDYAIIADTQTAALVGRNGSIDWLCVPRFDSGAIFAALLGEAENGHWTIAPSGEVVTTRRRYRDDTLVLETEFETAGGVARLIDFMPPRTDSPSVIRIVEGVRGQVDFGMELRLRFDYGHVVPWVYREGGALVAVAGPDAAWLRTDVPTRGENLTTKADFRVRAGERAAFTLTWRPSHLPSPAPLDPAHELGVTEGYWRGWVSACTYEGEWRDAVVRSLLTLKALTYAPTGGIVAAATTSLPEKLGGVRNWDYRFCWLRDATITLQSLLFSGFQSEAIAWRKWLLRAIAGNPAELQIMYGVAGERRLDEYLADWLTGYDGNPVRIGNAAAEQFQLDVYGEVMDALHQGRRAGLKADDPSWGLQVKLMEFVEEHWQDPDEGIWEVRGGPRQFTHSKLMAWVAADRAVKAVEEFGLDGPADRWRRLRDEIRQDILDKGYDPVRKTFTQYYGSDELDAAMLMVPLVGFLPGDDERVAGTVAAIEQHLLVDGFVQRYTQHPDADVDGLPPGEGAFLACTFWLADNYALMGRHDEARETFARLLALRNDVGLLAEEYDTTTGRLVGNFPQAFSHVPLIDTARTLTSALAPTEARASEGLR

SEQ ID NO: 9060 - protein, 284 aa, Actinoplanes utahensis
MTSAVASPLRTDFERSVASYWNTNRADPVNLRLGEVDGLYHHHYGVGEPDLSVLDGPADTREQRIIAELHRLENAQADLLLDHLGPIRPGDALLDGGSGRGGTSIMANARFGCRVDGVSISEYQVGFANEQAAQRGVADRVRFHFRNMLDSGFATGSRQAIWTNETTMYVDLFDLYAEFARMLGFGGRYVCITGCANDVTGRRSKAVNRINEHYTCDIHPRSDYFKALAAHDLVPIAVTDLTAATIPYWELRARSEVATGIEQAFLTAYSEGSFHYLLIAADRV

SEQ ID NO: 9061 - protein, 338 aa, Actinoplanes utahensis
MIASGPTGLGTSAARLFGRVDRDEPELFCPAPLRDDRALGERVNDAVVQWAEKAGIYPGRLDKLRGANFGRFMMLAHPATSDPDRLLAATKCLVAEWAADDYYVDEVSLGADPMVVGSRLANLYSVVDPASLTPRYQADFEKHHRLQPISVAFRTAMEHLAEYASVTQLARFQHQMAILFVAWSQEADWHANRRTPPVWEYLVQRHLNSYLPPMILVDVLAGYELSPAEFFDPRVRAAFTTAGNAAVLVNDLYSGRNESETDHNLPTVLVSGERLTPRAAVRRTVEIHNELMHTFVTSAASLSASGSPQLRRFLADTWAWLGGSREWHATSGRYHSSN

SEQ ID NO: 9062 - protein, 469 aa, Actinoplanes utahensis
MATPTQSEIREEEHEEQRQSLSTAAARNLTTTTKTAPQMQEITSRWLLRKLPWVQVAGGAYRVNRRMTYRIGDGRLSFTNVGAQVRVVPAELRELSVLSEFDDADVLAAMADKFVQQEYQPGQVIVEFGSVADHVYVIAHGKVNKVGVGNYGDPVNLGVLADGEAFGEKSLTDEERIWDYTAKAMTAVTLLAMPRSAFTALLGQSDHLRTHVEQFRAKNRRPQNKHGEAEISVAAGHTGEPKLDGTYVDYELTPREYELSVAQTVLRVHTRVADLYNEPMNQVEQQLRLTVEALRERQEYEMINNREFGLLHNADLRQRIHTRGGPPTPDDLDELLSMRRGTRMFVAHPQAVAAFGRECTKRGIYPPMLEQDGGTFLSWRGVPILPCGKIPVTETHTTSILAMRTGESDQGVVGLHQTGIPDEYEPSLSVRFMGISEQAIMSYLVSAYYSAAVLVPDALGILDHVELSH

SEQ ID NO: 9063 - protein, 328 aa, Actinoplanes utahensis
MLRLFTAASLAAGVLVAPGAAWAADTTTSLTSAEMYAALKSVAGTTAPAEINGYGGDFSVTASLSGATQTGSALFAADPATGLGYYTTTGTAVGGTGGGYGAAGKGDYHYLDDPTTRAAAKMAGYASAKYVFAADSKLTLDSWAGENLPAPSSMVVSDPRHAGTKVAHDDGTTDYSYVDDDKMTWTFTVNTAGAVTAGKMSGSGLEDTFRYNYGPQTITLPAGDQVIAQATLMKAMAYLTMAADVKRVATTAAKTTEKKAAGKTVTVSAVRKYAASEASAYNRNAEFKVIAVTNIKGGAHVSAKNPFTKVSVSYTIKAAGKHAVVTKG

SEQ ID NO: 9064 - protein, 403 aa, Actinoplanes utahensis
MPDGQAMSDAVHDESRLAALRTYQVLDRPRPAVLDDLTRLAATMFDTPMAAVSLVDRDRQWFAGNVGLADAETPLDVSFCARLVPTRKPLIVPDATRDPHFRAYRNVTGDPHIRFYAGAPVIDGEGHVLGAMCVIDDEAREIGDRQIDALTSFAGQAATHLTAIRGRLRLAELGDELARAAQREEDLVATITHELRTPVTSIQGYLELLAENDDLEPYRRLIEPIHRNGRRLVTMVDHILAGTRPHDAPLPAPVGPIDLNTAVAAALTACRALTGLRTTPVTIHPASPAPILADLARLAGAIEQLLRNALLFTPADRPITVRVTGGGRPAVEVRDSGVGIPQDELPYVFDRFYRGQHARDQAVPGVGLGLTIARATILAHLGTLEVTSDPHGTTARITFPALD

SEQ ID NO: 9065 - protein, 188 aa, Actinoplanes utahensis
MSPDDVVAVIMQRLADQHRVVPAYVIRDAVEAALRRRFPDGPLAEIRIPPDLAADLVAGFGSGAATAEDDSATMPAVLSGDETGRLLAALGLAVHVAAFNLDRDRLHVAQILNGAAAALVALGAASRAAHADGTSAVLLSPATLRTVRTVMVAVLQGIRGRSWQAEHLDPVTTTAMFTDVLTMLGAVP

SEQ ID NO: 9066 - protein, 231 aa, Actinoplanes utahensis
MSPRRVPVSRRDRPAKPPLSRAGAVAVGLRIMREEGLERLTMRRLAAELDTGPASLYVYVQNTAELHGAILDELLADLPVPAAGDGWRGELIELLCGYTRTLFAHPSLARSVLTLRPSGPHYLRLVDAILGLLLAGGVPSTQAAWGVDLLLQLGTATAAEQGTRDETAGADDETALFTMAVREAPAGEFPHLAQTRDHLFTGTGVERLKWAFSALITGIETVATTDPTHPA

SEQ ID NO: 9067 - protein, 378 aa, Actinoplanes utahensis
MTTPVTIVGAGLGGLTLARVLHLHGIAATIYELDASPQARTQGGMLDIHDYNGQVALRSAGLFDEFQKIIHSGGAATRILDRHGVVHSDESDAGDGSRPEVDRGQLRQVLLDSLPEGTIRWGSKVTAVTGIGGGRHELTFADGATVRTDLLVGADGAWSRVRPLLSGAQPSYTGMSFVELDLLDADVRHPGPARTVGDGMLFALGPGQGFLAHRETDGSLHVYVALRKPAEWIDGIDWADTARAKALLTGEFPGWAPELHALITEADGPLVPRTIHALPTGHRWQRVPGVTLLGDAAHVMSPFAGEGANLAMLDGASLGEAIAAHPGDLDKALASYEGELFPRSAAAAAETARNLVLCFDDNAPQSLLDRFAADHDAR

SEQ ID NO: 9068 - protein, 775 aa, Actinoplanes utahensis
MVQRRVQDPERVAAVRATGLLDGAESAGLRRLTRLASRLLGAPTALVSLVLDDRQVFATQLGLPRPWAEQGGTPLTHSFCRHVVDGDEPLVVADAREHPLVRDNLAIEEIGVVAYAGMPIRVDGQTLGAFCAIDQVPRIWSESELAILEDLAAAVSSEIELARAVQLAEETSAVVRRILDVSQDAYVSIDANGLVQEWNPAAERLFGWVRDEAVGADLSKLIVPEAHREAHRHGLDRVRESGRSRLAGQRLELPAVDREGRTFPVEFTLQTTSMSGGRPVFHAFLHDISDRRAAEEQLRRQAELIDAAPAAIIVRDPDGTIRFWNRGAEQMYGWPAAAAVGRNIHRLLSTVFPKQVAEVDQALEEVGFWEGELVHRRADGRTVVVLSRHVSRPAAGGGGREIIETSTDITERRRAEQAREESERRFRVQFHQSTIGQVIVGLDGNILHVNDAYARMVGRSAAELTGYGVIQLTHPDDRDGDTEALAGLFAGEGDSYERIKRLVHADGHSIDVQTGVRLIRDADGRPLHLIGIVQDITEQVRAERERDAAQVVLAERNDQLQRANQLKLDLMGMLSHDIGTPLTAILGYGEVLSEAELPPQLSNLTARIITGAHRIDELRHNVLAMCKLDAGELTTVRQPVPLAAALRDAADGADAAVPIDCPADLCVLANPAHLRQIVVNFLTNARKYGGGATRVTVTVAGGEVVVGVHDAGAGVPEQLRAHLFERYTQAAENAAEGHGLGLHIVASLAEANGGRVSYEPGDPAGSVFRLHLEMG

SEQ ID NO: 9069 - protein, 168 aa, Actinoplanes utahensis
MEPISEAGIRASFVNCSKGEAGRIKLPPDFRDTPWGDLDFYGFVDPSAPQRAVIVVPGGDAGPIGILLRKAESGRAGAGRSSMCQVCLTDHAAGGVSLFTAPLAGAAGRNGNSVGEYLCSDLACSLYLRGKRQPKLRLVRFEETLTVAEKIDRALLKLIAFTARVSRA

SEQ ID NO: 9070 - protein, 264 aa, Actinoplanes utahensis
MTAVRDRFRELHEAGTFVMPNPWDAGSARLLANLGFAALATTSSGFAATLGKLDQQVTRDELVAHVAALTAAVPLPLNVDAERCFADDAAGIAETVDLLAAAGAAGLSIEDYDPAAGRVETLETGAERVAAAARACRRHGIVLTARAENLLYGIDDLDDTIARLRAYREAGADVVYAPGLRTAADITRVVTDVPAPVNVLALAGAPSVPELTELGVRRVSTGGALAWAAYGALRDAARELLTSGTTAFRDRALLEAEREAAFQD

SEQ ID NO: 9071 - protein, 408 aa, Actinoplanes utahensis
MAATQYVGDIERDRLAALQAYEVLDTEAEHDFDDIVMLAAQLCDKPIALISLIDADRQWFKARYGTDLCEGPRAGSICSHAMYDEDVLQVCDARRDPRFAACPTVTGAPHIRFYAGAPLISPLGKPLGTLCVADPEPGRLTDAQRHGLRVLARHVVTQLELRKYARDVHALHQRVQTAEQIKDEFIARVNHEFRTPLTSIHGYLEMLGDPELPTANRDGFLQRVQRNSDRLLALVDDMLLAAQVNAESREFHRVPADLAVLARTSAAANRPLAEAKGLSIVADAAAPVFADVDPRRMGQALERLILNAIKFTATGTITVTAASRDGRSMLLVQDTGIGISPADQARVLAPFRRSADAERAEVQGLGLGLSIVKAITEGHEGEVTIVSSPGQGTTIALSLPAAGPYPEL

SEQ ID NO: 9072 - protein, 712 aa, Actinoplanes utahensis
MFSDSPSVPNGWLVHPPRPEATPMNLRMLPSTVRFALLYLVAVGAGQLSVLGMPGALPVVWPATAVAAVWLISRTDPVRRWADAGVLFGLTTLALAAAGADLRVALVHGLSAMIEALIFAGAAARWLPGLWAPVAERGGARPMTTLRDLLRVLIMAVFAGLAGAAIGGLGEQFLTHDYAPTSIAMWLVRDVVSVLLFGAAARRLADLRLDRDAWPETVIVCALSAGAYFYVFSVNETLPIGFALMAITVWVALRLPTVLVIGHVMLFGTTAAVFTLHGHGPYALMRTTDPGVPGLIVQLYIAVLALVGLALAFSRDERTALIERLRASEHEATEKAGLMTTIVNSMTEGLAILDQTGHLVLRNPAAGRLLGSTSQVTAGSALGSDYGFFHPDGAPLADAELPYQRALAGEDVQPMDVLIRNAAVPEGRIVRFNVARLAGSGGPQHVVVVFHDVTADRRHRDELMSFAGVVAHDLLNPLTTIEGWAEVLEAELAGYKPAERVSRIQRAAARMRTFLNGLLAYTAARDGKLMPTTINLQLLLTDIANSRYDQAESNGTTPPQFAFGPLDAVEADPVLTRQLLENLIDHALETAMPGVPPQIGVSAQPAPNGMLRIDILDNGRGIPAGLSQAVFTNFHRGEGTGGSGLELAVCKRIVERHGGTIEAIPNPYGSGTRMTFTLPAGRSAYARTLENQWQQTQSPRAQQPGATALHPR

SEQ ID NO: 9073 - protein, 728 aa, Actinoplanes utahensis
MSRWRDRPWFRATALSALVALAGCAGSLGVGTVLRRNEKATTDVQMDRRTAAAVAAVQAETRRYVDTLRTTAASVGAQQTLQADEYAAITAPLHSMKLAGATSIALVVPAAADQVARVQQTWRDRGATGLTLHPGPSADHDFSVLVAELDGRSGTTGIDLMRAAAPAAALAESRRTRQIAVSDTYQLLVDQSLPPERRQNSFVLAAPVYRGIQQDFLGWLLLGVRGQDFMGATLNAAGPGLADLRLTANRADGQPVTVAAMRHGAGDDLRRVVDIPVADSTWTLHVTGSRRGLPGAGNALPAAVTGAGLLLSLLLTVLIWVLVTGRERARLTVRSKTAELVTEQAEVNRQAGLLRAVLDGISDGVGVVGPDGAFLLHNPAAREILGRDEEDTDGAGSWQEHFGLFRPDGTTPFPTDDMPLVQALAGERVDQVEMVVRNAAHPDGRMISVSARPVETGEGQRGAVAVFHDITERKRVETELRGFAGVVAHDLKAPLTIVTAYADLVSDALDDLAAGAGVPTLEQARHGTAKVLHGAGRMQRLITELLDYTAARDATLRVERLSLRALVDDVVTTRTDAPDQEADARPDVFVGPLPDVEADPVLLRQVVDNLVGNAIKYTPPGRAARIDITARTGADGEVRVRIADRGIGIPDGEHAAVFGTFHRASNGAAHPGTGLGLAICRRIVERHGGHIEAAPNPGGGTVFTFTLPATPPGEPSRTTPARASIPTG

SEQ ID NO: 9074 - protein, 413 aa, Actinoplanes utahensis
MNRRSLLQLALGTGAASVLAACAGPGGSSSSSSHPSGGELSFAHWRAEDKDVFEKIIKDAGLAVRQDISPSNDYQSTALQKIRGGSVGDAFTAFRGAQFLDIAKAGIWSDLTGKPLVQKFAPTLITAGARDGKQLGLPYQLVFNTPLANTDLLAKAGVNAAPKDWDGFLALLEALKGKGVTPIAWPGGDAANAGQLLNVMVVNNAPTDDALGRIETGEAKVTDDWFLTVLKQYQQLKPYFQQGATGTGADAALALFAQGRAGLLATGSFQVGGVRKLGGTFPIDLLAPITTTADKARYEGVFNATFILGVNTGSARQDAALAWLTHLSDPAVAGVYANGTSQHVTVQGVEYTNPDLKALAPWLTRKTTLAPRFQFTNLDVRGAVENAAIQVVGGKSPEEAAEAAQKIVDQKKK

SEQ ID NO: 9075 - protein, 289 aa, Actinoplanes utahensis
MTVRKIGLLLFALPALVLYGGFFLLPAVQGLRYATTDWDGFSPSFRSVGAANLTAVVDHDDLFRNALTNNLKFLLVVVLGQTALALLLAVLLAARSRGSTWLRALFFLPTVLSSVSVAFIWKFVYDPNFGLVNTLLSAVGLDRFRSAFLGDEGTAILWVAVAQIWFHAGQMMVIYIAGLHQIPEELYDAARTDGAGRWQVFRHVTWPMVGPATALVIAYTTIQSFKAFDLILGLAGNPPRSGLDVLSTRIYSTFANSQLGYAAAESIVFMAAIALVTILQNRAAKWVHG

SEQ ID NO: 9076 - protein, 267 aa, Actinoplanes utahensis
MTRRLILTTYALLIVVPLLVIAGGSLKTSRELFDSPFGLPAHPTLANYAKVLADGDLLGVLGNSVLVAAVSVPLTLFLGSLVAYAVARLPRWPSRVLFGIFAIGLAVPAQAVMIPQYVQFDRLGLRNSLIGLMLVNIVVTLPVAVFILTGFLRTLPAELYEAAELDGAGLWATYRRITVPVSAPSLAATGIFLVVMHWNDLLYPLLFIDDPAKRTLPLALLDFQGEYLTDYPLLFTGVMVASLPMVLAYAFLQRHFVAGITAGAVKG

SEQ ID NO: 9077 - protein, 399 aa, Actinoplanes utahensis
MGLLDRFVSPRRRFAALAVRVARRTPGVDRAVSRPDDFSIAIYRTGATGPAHLYLANIFRETEGATPAERRERLAKLVRIMAAPPPQDDWETVRPKLRPVLRPVTFGSAGPPGMRPPISRAALPYLKELVVVDQPEAMAYVVPDRVDEWGVSAEEVFTQARENLAGMARTSLDQPWPSGQPLISMLDDGDAYFTSLLLAPGWLAEVGERLGGPVLAFAPDNNTLLLCPLPETTAEPFYALVDQHFKEAPRSLSPVGYVAGPQGRTIAYTPPLGHPHHLSARRAEMVLALTEYQGQTNWLAEQYAQAGVDVHIGGLLSAEPIGGLPETIAVWTAGVSTLLPKADAIVFVHPDSGPQFSAPWDAVARRVTLEAEPLLAPARYRVDDWPAPDILASLRQEIA

SEQ ID NO: 9078 - protein, 751 aa, Actinoplanes utahensis
MAPIDEEEAGLRVGAPADHAAGLAAVRLSLTDAVRKMGVGKAVRNLRTLNQVDGFDCMSCAWPDPQGHRHAAEFCENGAKAVSWEGQRETVGPEFFAAHSIDDLSGRSDHWLEKQGRLTHPMVRREGATHYAPISWDDAFALIGAEFRKLSDPNEAVFYTSGRASNEAAFVYQLFARAVGTNNLPDCSNMCHESTGTALSRTIGIGKGSVTLEDLHRADLIVVSGQNPGTNHPRMLTALEIAKRDGARILAINPLPEAGLLRFDNPQKARGLAGSGTALADRLLRIRSNGDLALWQAIGSLLLRRGVADREFIESSTVGFDAWARHVAAVDRDAVLTATGLTWAEIEAAADMLASATRIVHCWAMGITQHRNAVATIKEFVNVALLQGMIGKPGAGLCPVRGHSNVQGDRSMGIWEKPPAAFLDRLRDEFGFEPPREHGVDAADAVRVFRDGRAKIFLALGGNFVAAMSDTEVTAAAMRNAALTVQISTKLNRSHLDAGRTALILPTLGRTEQDHTGGRVQRITVEDSMSAVHASRGRSAPAGPLLRSEVDIVCGIAAATLGDRHGIPWASFAEDYGRIRERIGRVVPGCDDYAHRVDNGGFTMPHPPRDERRFPTPEGRAVFTVSPLQVMSVPAGRLVLQTLRSHDQFNTTIYGLDDRYRGISSGRRVVFISAADLAELGFADGDRVDLVSEWDDGERRAEQFRLVEYDTPKGCVAAYYPETNPLVPLDSQAEESGTPTSKWVIVRLERR

SEQ ID NO: 9079 - protein, 193 aa, Actinoplanes utahensis
MGDRAPGTPVNPAAAGWAETAAARVVAWARTLPAGPAGRRVLVIEGRSGSGKTTLAVAVAARLPAPIIHMDQLYAGWDGLAAGVEALRDRVLEPLARGRPAVWRQWDWAAGRYTTEHRVPDGDWLIVEGVGAGATGCPIAGTVWLDSPDDLRRERALARDGDLYAPHWERWARQEEKLPDVRGQAGLIIANGA

SEQ ID NO: 9080 - protein, 276 aa, Actinoplanes utahensis
MTEQRIGVSGATGQLGGRVARRLADLGVPQRSLVRDVSRAPRLPLAEAAAAPFHDRDACRAAMAGLRTVLMVSASETPDRVVQHRTFVDAAAEAGVEHLVYISFYGAAPEATFTLARDHWATERHILGSGMAATFLRDNLYADFLPMLAGEDRVIRGPAGDGRVAAVAQDDIADAAVAVLRDPGRHAGRVYSLTGPEALSLAEVAEIVGARYHPETIDEAYASRAGYGAPQWQVDAWVSTYTAIAAGDLAGVTTDVAELIGRAPITVAELLARPRR

SEQ ID NO: 9081 - protein, 452 aa, Actinoplanes utahensis
MVRTRPSNEVLARCLAELRWSPRTLARRINAAYGPGTISESAPYHWRDRGRVPYPPVAEYAARVIAEALGRPIATDALWTRASDSPEAASRGLLDILDRAASDGERLPDVAREYLCREPGPLSRAREHGSGVELVRSAERGVDALREAAAGAEGLDALGYVAAQFQATRLLLGQGGRSDGLNRRLLLVLAELAQLAAWLAVDADRHRESRRYLVTGLRAAHEGGSRRLLAHLLRDLSANMALQGRHADAVAIGEAALAAAAGTRATGAFAAGQLAYAQALAGDTRSACRTADQAAGWIAATPGGDEPEWVRRVAADTAGPMAARTLLQLARDERARGRRASARTLVRRGISLLRPPTLLEPDHPHPRAALYEGIYLAGGHVISGELEQACVAGRTVLDRWDRVRSRRGAHLLREVLTDLRRSGRDRGVREFVAHAERRLRLIDGAGPEVPPP

SEQ ID NO: 9082 - protein, 267 aa, Actinoplanes utahensis
MDHDHHDDIFDRGLQFDLKTLLGRRRMLGLAAGVGLAGLAAATPAFAKASDDSPLAADAAACRTIPTETGGPFPGDGTNGPNILTRSGIVRSDLRTSFDTGSATAGGVTLTLRLTVLSAATCAPYDAAAVYLWGCDREGRYSMYSAGVTQENYCRGVQAAGSSGQLTFTTIFPGCYPGRWPHLHFEVYPSLARATSASGKLKTSQLAFPADVCRTVYQSAGYQASIPNLARVSLSTDGVFRDGYSQQMVTISGSPQSGYLASLTITV

SEQ ID NO: 9083 - protein, 562 aa, Actinoplanes utahensis
MNADVKTPLTAAGELAMLVDRAARLVRDPQRRVALARDGIERATALGDEVARVRCTAMVTEFTARHGQPVDALSTALSLIGEAVVLGDPLATAQAHHTAAMCLHLLDCVPESMEHGYEALDAYRKSGDAYGEGRVLSLVATLLAEMGDRRQALELLEQAHGLFLACADASGAATMLAMMADGQREIGDPVTAAETGERALRLFGDAGMPVDAQRAMTAYAHVLADLNRLDDAERWLGRAGAHNRLPDGAIANQGYEMHRLLVLVRSVLNPSMRWDAARETLERVIALAGGLRSQRSEALAESLLAEVLHATGDDAGAYDHLLRCRELADAATRGAQERRTQALRVRFEVAQAQREAERYRRQAEAQAAIIAELEQARATLAGQMADLQRLNEEVLHLSRTDPLTGIANRRRVTEHLTALAERNHRYDAPPVAIAVFDVDRFKSVNDGYGHEVGDRVLVALSRLMADHLRVIDLPARLGGDEFVIIMPGLTVEGALRACHRLLEAVRRHPWQQLTPGLAVRISIGVADGTGVTDPDEMLRHADAALYRAKEAGRDAVVTASRP

SEQ ID NO: 9084 - protein, 129 aa, Actinoplanes utahensis
MRKTTRSLTLAGAGILAAALASPAQASPVNVPDAGGASGQAQRSDDVAGFYNTRAACEEISRIGSAIGAWDAPDCRTAFHGVRRIFVLIVDFNDDGQPVPAGGPGTGFPGGGQQGPGAGPGGGQQGPGA

SEQ ID NO: 9085 - protein, 77 aa, Actinoplanes utahensis
MPIVAVPVAVPLSVVPVVVPVAEPLAADCTPMLTDEAGAVPGCPAPGAVPGSPAVPGSLADGVGWAAVPGSLADLAS

SEQ ID NO: 9086 - protein, 119 aa, Actinoplanes utahensis
MRTATKLAVIGGGALTALAMTALPAQAGGKPDTGSACADFNRIGAETGLWGRYDCADWRVDHSDRVLIVRHHGAATVRVDDRWPVIDIGRDLPRAGDLPQVININGPSGAYTIPVRPPR

SEQ ID NO: 9087 - protein, 68 aa, Actinoplanes utahensis
MLPGRRHPGPQPPAMAPTTMKGSCPAATRSGRGASGGSFDRSSSQAKKRTSGRRLPLTRSRMVPVSIG

SEQ ID NO: 9088 - protein, 371 aa, Actinoplanes utahensis
MTHIRLLVGTRKGAFILTSDGTRKDWRVDGPHFAGWEIYHLNGSPVAPDRLYASQSSGWFGQVIQRSDDGGRTWEPAGNDFTYTPPVGDHLWYDGTPRPWEFKRIWHLEPSRTEADTVYAGAEDAALYRSTDGGRNWAELTALRQHSTGPTWQPGAGGMCLHTILLHPTDPQRMYVAISAAGAFRTDDGGTTWQPINAGLRSDGLPDEDAEVGHCVHRLALHPSRPDTLYMQKHWDVMRTDDAGGRWREISGNLPTDFGFPIAVHAHEPETIYVVPITSDSLHYVMDGRLRVYRSRTGGERWEPLTAGLPQEHCYVNVLRDAMAVDTLDDCGVYFGTSGGQVYASADSGDTWAAIVRDLPPVLSVEVQVLP

SEQ ID NO: 9089 - protein, 512 aa, Actinoplanes utahensis
MRLFGSRQTAPEVSRPTPRDVEALEELILALDAAIDDVTAWRITVASTVESYDFGYGAVWLADGGQLRLLHEVGRISGQVQAAGAGTVTRGDTGLIGQAFRTRQAAVAENPADCRDCRRCEAAMRAGMVAGVALPVTRGSEVLAVLEYYSASPLHLDAARREKFGAITRIAERARTSAVAAAELRQAADDRNAITTVVNRLGAAQDSATALRAALDAVRSAFGWAYGSYWEVDPDENVLKFQVESGSAGDEFRRVTLAATFAEGVGLSGRAWRSRDLVFVRDLQELTDCVRAPAAGRAGVRSGVCFPIMSGDRVVGTMDFFTSDYIELSESRAAALRNVQQLVNQRLAVLRAGESSAANARALLDSVDRLRNASGDATAVAEQAVSRASAMTTEVAALGQASAAIGDVIKIIESIAEQTNLLALNATIEAARAGESGKGFAVVAGEVKELARETAEATQKVAEQIAGIQASAETVATGIHTTSETIGKMDAVQIRMNEVLAEQAEMARALQG

SEQ ID NO: 9090 - protein, 427 aa, Actinoplanes utahensis
MGGYGWQVVLVVVLVLLNAAFSGSEMALISLRESQLQRLEKQSRSGATLARLARDPNRFLATIQIGITLAGFLASAAAAVSLAQPLIKPLGFLGDAAKPAAIVVVTIVLTFFTLVIGELAPKRIAMQRAEGWALLVARPLDVLASLSRPVVWLLGKATDLAVRGAGGDPDAGREEVSAEEIRDMVAQQQEFTPEQRTIISGAFEIADRTLREILVPRRDVLILPADQPAPESLRRLVEGGHSRAPVTGPLGLDDVLGVVHLRDLIGSDGPVREHMFTPLFLPETLKIADALRQLRTQRQQFALVVDERGSIDGIVTMEDLVEEVVGEIYDETDRDVQSVVREEDGAMLLPGTFPIHDLPDIGVEIDEADEGDYTTVAGLVLARLGHIPTVPGELVAIDGHTAEVVEITGRAITRLRLRPLDQETVDA

SEQ ID NO: 9091 - protein, 411 aa, Actinoplanes utahensis
MLTIIALALLGVVLGFAVLRPRGLPEAVAAVPAALLCVALGLVPAGAAVAEARELLPTVLFLAAVLVLAFLAEEHNVFGYAGAVVARIGRGRPGRLLTAVFAVAAVTTAVLSLDATVVLLTPVVLTVAARAGVRPRPHVYACAHLANSASLLLPVSNLTNLLAFAASGLSFAGFAALMAAPWLAVIAVEYLIFRWFFARDLAGTAQTPGDPGPAPRYALIVLAVTLAGFAALQPLGVQPAWVAAAGAAALAVPLLRRRMIGVPALVAETNPAFCAFVLALGVVVLAVRSHGLGDRIDALVPHDAGLSALLAVAGLAAVLANVLNNLPATLVLLPAAAHSPGLLLAVLIGVNVGPNLTYTGSLATLLWRRILHVRDAAPRTRQFLLLGLATVPLCMLAAVLALWVGLRVSAL

SEQ ID NO: 9092 - protein, 209 aa, Actinoplanes utahensis
MSLGDMTIAHVMSACDMTTITGMVRWEPGAGGRLREAALELYVERGYEQTTVAEIAQRAGVTARTFFRHFADKREVLFAGSQELQDGLAQAVRAAPPATGALGAVEAALEVAAEWLGRDHPHSRQRQSVVEANPELRERELIKMARIGAALAEGLRRRGVPDPEATLAAEVGIVTLRVAFGQWVSRPEPSDLGALMRETLSALRAVTAR

SEQ ID NO: 9093 - protein, 73 aa, Actinoplanes utahensis
MHVFVTGASGWIGSATVTDLLRAGHRVTGLARSDAAAARIAALGATPLRGDIEDLAGLRAAAAAAEGVVHLGY

SEQ ID NO: 9094 - protein, 137 aa, Actinoplanes utahensis
MHGAGDHGFLATLVTIATTRQVAAYVESGANRWPAVHVEDAAALVRLALEAAPAGTVLHATAEQGVPTRDIATAIGAGLGLPVASIPADRADEHFGWMARFFTMDAPTSSEATQQLLGWKPTGPTLLEDLSAGHYFA

SEQ ID NO: 9095 - protein, 211 aa, Actinoplanes utahensis
MSLSSMAEDSALRLQGTPGVSPKAAAATAAAVTAEEMVKGAPPDDAKTAGENAARLSAGTSVTGSVLTQLVKYVPTETISVYLAVQAALGTVAAPPGHPECEADFTSRWVWLLLLAVATVLLTIGLAYRSQKQVAPTARFKVPLVEPAAATAAYLVWALSLPTTPLKDVCSYNATAWGPVLLLAGTTIIATTAYIFGKTITWQKVLQDADR

SEQ ID NO: 9096 - protein, 330 aa, Actinoplanes utahensis
MPIKRYGVLRAAVIDRRIETSDTPHYQIQLRAGGIDYRAAVNVRSQQSPPELLYLAVDAFAHPVLDQLRRLPDGFTELESRSGGPALDYIRSNLFQRPDMRPVPTAEPGPENDLGDFLDHHVRRALGDADARAYVFGQAWGPEAIEDKIFHFSPGNGVHDVHMNQGNEGRFAGDDGVYQDGALLLQFGDAWVAIFLAFQSQAWHTDDITGHKLPDVPGPGPASTDRRVRIVAALADPAGPAPERETVTLVNAGPSDQDLSGWALLDRAGNRQALRGAFPAGGALQVTLTAPVALGNRGGTITLLDAAGLKVDGVAYTADQAGREGWTIVF

SEQ ID NO: 9097 - protein, 186 aa, Actinoplanes utahensis
MLYGTPTTRRRDAQRNRAAIVLAASEVLTEGDPVSLMPEIARRAGVGQATLYRHFPDRPTLIAAVIEYQLERLEEAASVLLAHPEHFRNLLRSVLHAQIAMRGLVVLIRRLSVAAQNRYRQRALAALGGPLRRAQEHGYVRADLVPADLTLLFTMVQGVAEAAADAAAARAAADRSVDLMLDGVFI

SEQ ID NO: 9098 - protein, 106 aa, Actinoplanes utahensis
MLGTVTFTDPHGPGTLRVSRWPHPPADVAAALTAEERSIRLPGYHRTRIDDTVWEYTWTDPAAGPMRGVRRAVPTTTGTYVVEWRTPRNQWAADLPKLAIVLETLD

SEQ ID NO: 9099 - protein, 331 aa, Actinoplanes utahensis
MYVGITGVGAYLPEREVTTDELQDGVARSGGIRLPGGLFRRLTGIQRRRIAGPDEYASTLGVHAARAALHRAELDPLDIDLLLFASASRDMVEPATAHIVQTELGSRAHALDVTNACNSFVNGIDMARAMILAGRARRVLVVTGETPSRVMRGRVDSIDQARRSFAGFTFGDAGAAVVVEPVARGGILDVDTETQSQHWAVGGIPGGGSRHPRGDEHTYFAGDGHRLRGVFEKVGASILDRVRARTGLELTDYAKVLVHQVTLPYLDRFVEVTGVPRDRLEITVDGVGNVASATLGVQLDLVFDDLAPGERVLLMGLGGGVSIMTMVWERS

SEQ ID NO: 9100 - protein, 245 aa, Actinoplanes utahensis
MTPLWVIVPAFDEAARIGATLDALAAQTDRDFTLLVVDNASTDATAGIARDFARRAPFPVHVLSEPEKGVGCAVDTGFRHAIAAGARMLARTDADCLPRPGWIAAARRALSAGDVLVCGRITARHDEHGPLGRAAFAGLVGLAAAFGRIRPAHRGDAYLAPYRMHAGNNMAITARLYEACGGMPRRPSPTDRTFLNRVRATTDRIVHSRDMVVENSTRRLRAYGVIRTARWYLDRGSGPLTPDPR

SEQ ID NO: 9101 - protein, 111 aa, Actinoplanes utahensis
MLDELDAGLRPGDDTTALLRRRRITRGDLADLRLRYAAALHARGLRPGDTLGVAVRPGPRALAVLLAAYRIGLRIAVLDPSAGPDVLLARLSLARPSLILADAAAQAVAGC

SEQ ID NO: 9102 - protein, 311 aa, Actinoplanes utahensis
MVIFTSGTTTSPRAVVHTRAGLGAGMRAVTALVRPRPRVPVLGGMFFVMVPALAGGAPVAVPARRPRDLARQITGLCPQATYLTPPQLRAALDAGVPMRGRVYSGSAPVTATLLNRVRAAGADEAWCVYALTEVFPAAAVEAAEKAAHSGDGDLVGTLLPGVRARLTDRRELQLAGTGVCDRYLGAEPHAWVSTGDIARLDGDRVVLAGRAKDMILRRAENIYPGLYEPSLHVPGVALAVLVGVPAGDGDEEVVAIVETAPGADETAVRAALREPLHRMGSARPDRIVFATVPLTGRSRKPDRAAAAAMCR

SEQ ID NO: 9103 - protein, 252 aa, Actinoplanes utahensis
MPMRTLAVIVPAYNESTSIRATLAALAAQTDRDFTLVVVDNASTDDTVAVVRAFPTPFPVEIVTEPERGAGTAADTGFRHAIANGATLLSRTDADCRPAADWVATARRHLTAGADLVCGRSTPRRDEQPTLAERYVFPAAVRAAALYGRYRKAHRQAGFRTPYVLIHGHNLALTADLYQRCGGTAREALEAGSEDVTLLNRARRHTSRIVRAEDLVVEASLRRLRAWGARRTLLWYWDRRWRPDTTAEVHVR

SEQ ID NO: 9104 - protein, 143 aa, Actinoplanes utahensis
MSRRDRRVYLSSHPLLFALLAATRGRGVRRIGATVLAHSTTAFRDGLTRVPLDRTAAGTTGGAAGELTGGDLLFNQDGSEHRGARRGLALGAGEVDRLRPVWNAVLDHGLAPLAGGGTIELVELAAEMAGATAAALLRVDLAS

SEQ ID NO: 9105 - protein, 156 aa, Actinoplanes utahensis
MLAVAAINTTVAAVPRAAAWCADSDLWHYAETHLEALTSEMLRVTAPTPLLPRVAAADGVIDGCPVRAGDRLILVTRHAVDAHRRQPCPADPAPAQTAQLVFGTGPHACPGARLARLQLSDALQALARFRPRVVSARVDRRSALPAWSRLTLAPTR

SEQ ID NO: 9106 - protein, 333 aa, Actinoplanes utahensis
MTDPAGWNGRTGTPPAAGNEPTGTRVAGGDGAAGTRPAASNGLAGTRVAVTGASGFCGSAVARAAAAAGADVICLGRRPGPVGEHRFWDATRTLPDLTGADLILHLAAAVGDPPPGRVAAAAFHAVNVDGTARLLDAAAGRPLVWVSSASVYTPSPHPIREDQPLGGLTAYGRSKAAGERLASAGGAVILRPRAVYGPGDPHLLPRLRRAVRGGRVLMPGPDIPLSLTAVENLADACLVAHRWPAGAYNVADAEPYRRDAIIAAACGVPVQHVPLGAARAAATVATAISRLTGGEAALSRYALEQLTTPVVLNISRALSQGWRPARTFADFLR

SEQ ID NO: 9107 - protein, 206 aa, Actinoplanes utahensis
MIPTSAAEAEPVGRRRGRPPDPHARSRILTAAETLLDEAGYLNVTIDEVATRAGVSKKTVYRFWPHKPALISDLIVERSAVLPVPDTGDTRRELATLFGMIIEYLTAGHGRTMALLVAATHDDPATLTRLREQVVAPRRDIARNVLQRGIARGDLPADVDVDALLDLWHGLVAYRISGRPAALHRHTVDQLVDLALTGHVPRLPQT

SEQ ID NO: 9108 - protein, 325 aa, Actinoplanes utahensis
MPTPSGRLARPPAWNATVPRQLLWFMLVGALSTVLQTIVYVSVRDVLAATWASWLALLVVTPANTEAHRRITFNVKTTAVARLHGEAGLTSVVVYLANLAVAPWFAGIAGPHPAPLTESLILAVTGSLIGGARYVILRGWVFAARRHTPVPSTTAAPKLTDPRAAGLKAAGAGASGTGDLDDLDTVDPGALVTADRGTGDFAVGGLAPEAPPSQLVGAATSAGTAGASDDRRRNAPRHGRPPRIIPGEPAAPHSTAQQCVPGQAADGSFAGTLPLAALACLGTMAPIPAARLCLGQPGTGVLNQRPPGRLRTWHRNRRRHLTARS

SEQ ID NO: 9109 - protein, 117 aa, Actinoplanes utahensis
MALALPIAASFAVISALALIMARLVDTDRLDRNAAFGIRTAGTKRSDQAWKAGHRAAQPLTRALGITGLCFAILILGVAFTGARTVVTVTAVLGYAGMVTLLALMAHRADTAARSSS

SEQ ID NO: 9110 - protein, 188 aa, Actinoplanes utahensis
MPPQNLPPRDAIRRAAGDLFVRDGYGATTVRAIAAAAGCDPALVIRHFGSKEGLFLATVSVSGDLTAILAAPLDTIGRELVRYVLDGAGSPVAGVYRALLSASDRPEIKDRLRASMHDVFVSPLAERIGGAYPELRARLAAAQFAGLINAFWLVGDPVLADADRDAVITLYGDAIQRLLTCDDPAPTV

SEQ ID NO: 9111 - protein, 483 aa, Actinoplanes utahensis
MAGSDAAASGAAGSGAVASGVAGSGTAASGVAGSGTAASGAAGTGAAKSGAAGSAAGTPAAATEAACGIGKFAATSEADLAKITVLDPGPLAPDLPALADVRLAPATGEVVAGNHTGRSDATASYADAKLLGMHLPGLPLHDAVAAQHAPGGPRGPVDVTLATLNAGGLATARLGTATAAATWTDGYHCGRTGPLTRATTMVQGLSLLGGAGGVPAIQAVDALTHLTRRTSLLTVGPTGSTRSATALVKLGGGRIGVRSGAGVALGDVILFSGTPQEITAKVINQPTLEVVAGGDRKHSTVTYQPATLAVTSAGKPVPGLTGDQTSVSLNLLGRLAADRPASPLSVRISVGKVTRHLSDTVVRAEAASLRVEVKLGSAHLLDVALGYLTVAATAPCRIGAPVPRDRVPATGQPGDTPGDTQQTTPATQVVATTTPQPGTPGSGSGALALTGSNVAAVGLGGLALIAGGLTALFFTRRRYTAKH

SEQ ID NO: 9112 - protein, 35 aa, Actinoplanes utahensis
MPIARAAKNVPSLTAPRRANRASRPRGAAPAVLAS

SEQ ID NO: 9113 - protein, 582 aa, Actinoplanes utahensis
MTTVAPRPVQTRSWPVRRQVRGSWLARTIRTTDAKQIGIMYMATAFGWFVIGGILALLMRTELARPGLQLLSPEQYNQLFTMHGTIMLLFFATPIVFAFANFVVPIQIGAPDVAFPRLNAFAYWLYLFGGLIALGGFLSPGGAADFGWTAYVPLSGGGHSPGVGGNMWVVGLAISGVGTILGAVNMITTILCLRAPGMTMFRMPIMTWNILLTSLLVVLVFPFLAAALFALAADRILDAQVFAVATGGPMLWQHLFWFFGHPEVYVVALPFFGIVTEIIPVFSRKPVFGYKPLVAATLLISGLSMSVWAHHMFATGQVLLPFFSLLSYLIAVPTGMKFFVWIGTMWRGQLSFESPMLFSVGFLVTFLLGGLTGVLLASPPVDFHVHDTYFVVAHFHYVLFGTIVFAVFAGIYFWFPKMFGRMLDDRLGKIHFWLTFIGFHTTFLVQHWLGAEGMARRYADYLPGDGFTTLNTISTIGSFILGAATLPFLYNVWKSYRVGELVTVDDPWGHGNSLEWATSCPPPLRNFDRMPRIRSERPAFDAKFPELAVEGPGGTPEEGSLLRGEQLEGGLEPGRHHKRNSD

SEQ ID NO: 9114 - protein, 505 aa, Actinoplanes utahensis
MMSYPVVRLRIVRGDPSILHVDLDAMFAAVEQRDKPSLRGKPVVVGGVAGRGVVSTASYEARVFGVRSAMPMAQARRLAPWSTAYLSPRFAAYKRTSQVVMRLLAEVSPLVEQVSIDEAYVDLAAVGGDLSVRAVTELATDLKARIAVATGGVTGSIGAASSKLLAKIGSDLHKPDGLTVVAPGDELAFLHPLPVNRLGGVGPATEQRLHRSGVRTIGDLAAVSLEHLTDWFGQSHGAGLFRLARAQDDRPVVSEREAKSVSAEETFDVDVTDPVRLRHELDLLAARVAGRLRSGGLAGRTVNIKVRHGDFTTLTRAFTRDHPTDDGRLVAQLARRLLAELDTSGGIRLLGVGVSTLADFAQDDLFAEEHAAAGRGALIGLLPAATVPDEPAIAAPEEPEPAVPAAEPAAGPVVWRPGQDVVHDAMGAGWVQGSGLGRVTVRFEGPLTGRGPVRTFAVDDPRLHPGEPPEWVADPQPRPGEPPDRADDSGPTAGDPADGPGADGG

SEQ ID NO: 9115 - protein, 468 aa, Actinoplanes utahensis
MLGSPLTIRSLTTGYDIIPGTTFPVRRERRSRLMAQDGLTRQSTLYRAGTVGRRPVVPADFAELERRARRVSSAAAWAYVAGGAGEGRTMRRNRAAFDRWAIVPRMAAGAVDRDLSVDLFGTRLPSPLLVAPVGAGALMGPDSDVAIATGAAVTGTPYIFSNQGCNPMEESAAAMGDTPRWFQLYWSKEERLVDSLIARAEAIGAGALVVTLDTTVLGWRPRDLNLGSLPFARGLGIAQYTSDPVFREIVAERARQPQDRPRVTLGAIRALLRMSRNHPGPFWANLRSPIPRASVETFLDIYSNPGLSWEHLATLKGRTRLPIVLKGILTADDARRALAVGADAIVVSNHGGRQVDNAVAALDALVEIRAALGPEPTLLFDSGIRTGADVFTALALGADAVLLGRPHLYGFALAGAHGVAEVIRNVIAELDLTMALTGVRTIAEITRDRVRAEPAGPLGGIPSMKEVD

SEQ ID NO: 9116 - protein, 619 aa, Actinoplanes utahensis
MAGRRSADRDRPADRGDPGRDSDPAVTAQLGNAGRGVRFAGRPGAAPADQGTGRRAGRAGPGRVPVRGDHRGADLRREPRAPADPAAADPAVRADPVRPADVPRLFNGQRRPADPGRGRGGHRCGLPAGLDPDRFLRGVRRRGHRSAAVLAHRRPDRDPHRGDRRALLSRTARVAQADDRGPPPLLRGAGGPAPGRKSPALAPPLAADRPRVPVRRRHDRAIRAYVHRGAAGHQLPGYHERRRRIDGQRRLIGCRAGRGGGRLSAMHSAFTVTPAQLPALLLQVAVVRPVFLWGAPGIGKSSLVRDFAAALGLECVTLVGTQLAAEDLIGVPELRDGRSRFAPPEAIARDEPYCLFLDELNASSPEVQKAFYSLILDRRIGSYELPPGSIVIGAGNRTSDNALARPMASALVNRMIHVHLRAAWADWSRWAADAGIHPWVLGYLTERPDHLWATPPKTEETFSTPRSWHMLSDALHSCGDTVDEDTLRLLAGGTLSPGHAGAFSGYVKIVRHRYGLDAILRGDAGWPSAPGDRDLLYFLAEAFRARLVKDLPAAKDRAPASVRQFAHQAKALLVELAELNLECGRLVIAADPDGAPVLPAWFLVEVSRDLPRLVAARAA

SEQ ID NO: 9117 - protein, 591 aa, Actinoplanes utahensis
MGKKSAQVDPQVAAFQAAAGSLRAHPMFEQLFRGFQQPSATVTLVEDSGIGFALVDAGGRIRANRTKRLDVAEWTWVIAHCLLHLGFGHLDPSAARDPAYQHVACLAVTRFQRAVKLGREPGQFPAVLPSADEHRLLAAWRRSGVPAAFAGCGAGTPDLGAPAPESTAGWTDRFARGLSAAATAAVDVAGGARGSLTGPAAPKAAWDRAMSWFTGSFPLLGGVAAGFTVVADAELARGWDIAVAAVSPEAGEIYVNPRCGLDGQQWRFVLAHEMLHAALRHGDRVGPRDPYLWNVACDYVINGWLVEMGVGVMPDGLLYDPALAGSSAEAVYDLIAGDLRRMRKLATLRGRGRGDVIGEPLPWAGRRAGGVDLDEYYRRALLTGHAYHHSGGRGLLPAGLEAEIRVLEQPPLPWDVRLARWFEEHVPAAVRQRSYARPSRRQASTPDIPRPGWHRPEQVVPRGTFGVVVDTSGSMDERLMGKALGAIASYATVREVPAARVVFCDAAAYDAGYLPVDDIAGRVRVRGRGGTMLQPAVDLLERAADFPRDGPLLVITDGECDALRIRRPHAFLMPRGARLPFTPRGEVFSLR

SEQ ID NO: 9118 - protein, 162 aa, Actinoplanes utahensis
MQLAQVLDILRQLLLTSAHPEIAAVDRFGTDPAPGGPSPAGLRVRYDTGSEAYLWGAVWPGETPLPVPEILPPPSLRAARAAAFAAQLLDAARPAAFRSWELLALPDLGPADARGKVPLGVRITCADGPAFLIRATAAGGPTREPDTEPHPGYRIPEALTAG

SEQ ID NO: 9119 - protein, 127 aa, Actinoplanes utahensis
MPVRFLLNVLWFVFGSGFLLAIGYGIAALICFALVVTIPFGIAAARLAVYSLWPFGRTVVDRPGAGAASGLANILWVVLFGWWIALHHLVVGIMQCVTVIGIPFGIANFKLVPVAFWPLGREIVDVP

SEQ ID NO: 9120 - protein, 89 aa, Actinoplanes utahensis
MEINGLFTGIVFGLIIGALGRLVVPGKQHLPIWVTLLVGVVAGLLGTFVATAFGVDDTPGIDWIELALQVGLAALGVALVSGAGRRRRL

SEQ ID NO: 9121 - protein, 404 aa, Actinoplanes utahensis
MARVRAALYLDFDNVFSGLIKQDPDVAIQFAKDPGAWLVRLTTSLTVDGPRRWLILRCYMNPGGWVPNPDTEANQPRLYYSQFRPFFVNAGFEVIDCPRLTHTKNAADIRMVVDAVDALADPVPYEEFVIGSGDSDMTPLLVRLRRADRRTTIVSPSDAAEAFTAVADRLITSQELLELVQGEPVDSDEAPVDPEQPVSYEQFRDLVTWRYTAATGPLNLASLAHDLRRQLGPSVDETSWFGNGGFVRALESLSLPNVKFSNHFLWDAARHDPPEAGVSTGPAPEPVGRLSALLSLPRLTREMWPPIYQSLAEYAAAHHFNLTEATRWARDQLAAQGVDVSRSAIAFVTRGTAFGGAPLYRQPPPNATEIAAAFADNVLSRAEAAAIALSDEETAEVRSWLGAA

SEQ ID NO: 9122 - protein, 114 aa, Actinoplanes utahensis
MTMDATLAGHLQELRRGTVVVASLTVLRSPGYGYSLLETLSRAGFEVEANTLYPLLRRLEAQGLLTSEWNTDEPRPRKFYRTTAQGDAIAETLRGEWARLDTAIGDLDLNGSAK

SEQ ID NO: 9123 - protein, 326 aa, Actinoplanes utahensis
MTNLVDRYVFTALRRIPEQQRADIDRELRASIEDAVDARVDAGETREAAVETTLTELGDPERLADRYAGRPGHLIGPDVYPLWRRLVTTLLWTVLPIMATISVVVQLFEDADIGKIIGGVVGTTLTVGTHIVFWVTLIFWIVDRSGAAKGLRPRWSVKDLPKYEAARATIGQLITGVVWSALLILALVLQQFTFTDVPLLDPANWTFWWPLIIALFVLRALYHVGVHRVGGWTRTVAAVNLLLTAAYTVPLVWLVSSGHFFNPAFHGFLDVHGGDVRDWTGTAIIAVLVVGGAWDVIDSVVRAERSRRGLAPARVPGSGGGYGLGC

SEQ ID NO: 9124 - protein, 124 aa, Actinoplanes utahensis
MTTVLVADDDADIRDLVAFKLEQAGLEVITVGDGQAAVEQARAHHPTLAVLDVSMPLLSGIDVCRMLRADPSTAGMLIIMLTARVQEQDVEGGFSAGADDYVTKPFSPRELVSRIQALLTRTRT

SEQ ID NO: 9125 - protein, 149 aa, Actinoplanes utahensis
MFTHMSVGHQLCLSLHFRGRRRPRRHPGIRGGFGTGFGRNRSATRVRLGCIPAAVSWFPSNHRATSNGPGGPMTALMNDVRTEALFVSDLQRSQQPTAELIREAVSATVDRLGENGCAALVAQEFGEHPDCAIGRMRWARSAVRLAFAA

SEQ ID NO: 9126 - protein, 600 aa, Actinoplanes utahensis
MPFAYLHRDGADHVEVLTGDVITVDVLADIPLDPGRPVLAVVPYRQIAERGFDCVDDGAPLECLLVDAVTTRPLSDFPAGELRVSGGAFDRDDAEYGQIVEEVLRDEIGHGEGANFVIHRVFQASVEGDPVAAARAAFGRLLAHEQGTYWTFLVHTGQRTLVGATPERHVSVTDGIVMMNPISGTFRHGSGELLDFLRDPKEVEELYMVLDEELKMMATVAEHGGQVAGPYLKQMSQLTHTEYLLAGRGSLDVRDVLRETMFAPTVTGSPIENACRVIARHERRGRRYYSGVLALLSVSDDGTQSLDAPILIRTAEITADGTLRVPVGATLVRHSTPAGEIAETHTKAAGILAALGAATIAVRTQPPPAPGDEALRLLAARNVDLARFWLDSREAGALVVPALAGRTAVIVDGEDTFTAMLAHQLKALGLAVSVVPWSSPVPAADLLVVGPGPGDPADPVDPKMVAMRAVVADRLAVGLPLFAVCLGQQMLALRLGLPLIRRDSPYQGLAREVELFGVRRRVGFYSSFAAVSPAGSLDSVHGPVEIARDPVDGTVHAVRGPFFAGVQFHPESVLSRDGIDVLRELLPPLLADVVSPLPNG

SEQ ID NO: 9127 - protein, 253 aa, Actinoplanes utahensis
MVQGDREPHLGPPPRVESPCRPRCGPRRRSAARVPAALFTGVEIAGHRANAGRMPIEERTAQAVDAILLRQHGVITWQQARRHLSEKAIRHRVRSGRWRRVHRGIYLAHSESCTRQQYLWVASLGAGNGRPALLAGVTALQVLGLQRLPADPLPIHVLVHISRPDRDPPPGVRVHRTRRLSMVDVCPTIAPPCTTAARALVDAVEWATDGDDATRVLAAADGQRLVSPEQVRPVLARLPRLSRRRLLERALAA

SEQ ID NO: 9128 - protein, 192 aa, Actinoplanes utahensis
MEAIYYFDPACPFTWTTSRWLTSVAAERGIQVHWRAFSLSILNGDNTPEQYRPMMAASSRALRLVEALRADGREDRIGAFYTALGDRTHEAGTPITDAIVAEAAEAAGVEKAGEILDDPAWDEAVRESHETALRLAGPGIGSPVLHLAGAARGLHGPIIGEVPDRAESLAIWDATAALMRIGTFFEVKRGRG

SEQ ID NO: 9129 - protein, 90 aa, Actinoplanes utahensis
MAEPHVTLDPLSLNPVEQKLRGPLEDQLSSALQAATVKVRQRYSGESVEQVTTMLLDQARAGLHPDIAAGFHPDHEQLRHVAEAIVSTAN

SEQ ID NO: 9130 - protein, 874 aa, Actinoplanes utahensis
MVRTDVSERDRLAQADSGEQPWRAWGPYLSERAWGTVREDYSEHGTAWDYFPHDHARSRAYRWNEDGMAGVCDDRQTFCFALALWNGKDPILKERMFGLGGDGGNHGEDAKDYWWYQDSTPTHSWMRWRYHYPQAEFPYDQLVRVNGQRSRTESEYELVDTGIFDSDRFWAVTVDYAKAGPHDMCIAITVSNRGPEKASLHVLPTLWFRNTWAWGLPNRPVPELTGTPGRLTGRHRSIGQITLDAEGKPPALVCDNETNAQRLWGLPGRSPYPKDGINDFLVDDAPTVNPAGTGTKGSLHYLVTLKPGATRTIRLRLTQSDAPPAPLDLGRGWTAVMRDRQAEADAFFAGIIPAAATEEEAAVARQGIAGLMWGKQFYHFDVKQWLVGDPGNAPPPPGRRHGRNNGWWHMNSFDVISMPDPWEYPWYAAWDLAFHCVSISRVDPGFAKSQLLLLLREWYMHPNGQIPAYEWSFADVNPPVHAWAALRVFEIDGGRDYDFLSRVMHKLLLNFTWWVNRKDVGGNNVFEGGFLGLDNVGPFDRSAALPVAGVLEQSDGTGWMAMYALNLLDMAINLALHDRAYEDMATKFFEHFTYIAEAAYRQGLWDEEDSFFYDVLRLPDGHKVPLKARSIVGLLPLAATTRLTSDTLNRLPEVNARVRWMLHNQTDYGDVISARRLGGADRRRQRLLSMVGQEQLLRILARLLDPEEFLSPYGLRTLSRAHLEKPFTVSLGGSDFTVGYEPAESTSGLFGGNSNWRGPVWMPVNYLLVEALREFAEFYGEDLRVEYPTGSQTKVSLNEVADDLARRLIALFVPDSTGRRPIYGMTELFQTHPDWKDLIVFPEYFHGDNGAGLGAWHQTGWSALVVDLILTLHD

SEQ ID NO: 9131 - protein, 609 aa, Actinoplanes utahensis
MSTVRPITFGPQVCTDLTSGSSREWLVPDGVGGYAMGTVTGLRTRRYHGLLMVAGDTPASRMLGLASLDPVVTLPSGARVRLACHEWAGGAIEPQGHTLLSGFALIDGIPRWRWRIGDVVIERELAMVTGRPAVAVVHRLISGGPVQLAVEALCTWRDQHSSGFSGMSLPVADGCVFAGAYRIAGPGFAAAGERFRKVHYRAEASRGLPAEEDLWYAGSFHAALDAPGNICEIAAWAGELDDPPPPAARVVDGARARNRRIGTDPLTLAADAFVIRTRTGPDVIAGYPWFGAWSRDTMISYEGLFLATGRVAEGRELLTAYAAHLSEGMVANTADTGRVEYNTVDGTLWFMHAVDRHVTVTGDTDLAAELGPSLKSIIHHHIAGTRYGIRADPHDGLLRQGAPGEALTWMDARVDGVPITPRSGKAVEVNALWINALATLDDSFAPLLHQARDSFARSFPTLSGLLQDVLGEHTLRPNQLLAWSLPHAPLRPDPAVLTRIGAALLTPMGLRSQAPGTPGYHGRHRGGPAERDTAYHTGTVWPWLTGPYVSAWRRLGRDVPDVLADIDHHLAEYGLGSISETADGDAPHTGTGCPFQAWSVAEHLRVRKF

SEQ ID NO: 9132 - protein, 491 aa, Actinoplanes utahensis
MDRTRLWRLWLAFAALCALFRCAGQLAGLPFHVYEIPYMIVTCGAPLAIFAGIAINRPARRSGWVVLALGQVSYAVADVIFSYNVLNNSEQAEPALSDVFYLTSYVLIGAAVLVFIRRRTPGWHLASAVDALVLALSSGLLSWVFLVGPVAFDPTISLPAKLTEAAYPVLDLVMLLLAVRLVLGSGARSVALGLLFAYLGTMFVADTGYAVLGILTAQNASEPFTGGLYATSIGLLAACTLHPSMRDFETRSQVAPPDATPARLTMLTCAVLMVPGLQFVEHQYGRDLSIPLTSSTCAVMFLLVMVRMAGLVAAQRRAADTDGLTGVCNRRHFEQVLAAECRRAARVGYRIALLMIDIDHFKKINDTYGHPGGDRVLRELAQRLATGARAGSLIARYGGEEFIALVPHITGDDLPLIAERARLAVSGLPIPVTGQTLITVTASIGAAAATGPLADPAELLRAADEALYAAKSAGRNRSVIAPEVRAPAPAA

SEQ ID NO: 9133 - protein, 161 aa, Actinoplanes utahensis
MPASDYVRNLRDRVGQELIMFPTVSAIVLNDRGEVLLHQRSDNARWHLIAGLMDPGEQPADAVVREVEEETAVQIKIERLAGVVSHDVTYLNGDQCQMVNVFFRCRATGGEAQVNDSESLAVGWFPLDALPELDSFTQRMLALALDENAPPYFAAPGEGGF

SEQ ID NO: 9134 - protein, 223 aa, Actinoplanes utahensis
MISVVLADDQALVRAGFRALLDAEPDIRVVGEAADGVQAVTLVRATRPDVVLMDIRMPGVDGLEATRRIVADPVCADTRVVILTTFELDEYVFEALRTGASGFLVKDTEPVELLRGVRAVAAGDALLSPSVTRRVIGEFAGSGTGRRPEPPRELDQLTDREREVMALVAEGLSNDEIAARLVISPATAKTHVSRTMIKLGARDRAQLVVYAYEAGLIRPGWLA

SEQ ID NO: 9135 - protein, 477 aa, Actinoplanes utahensis
MRKRRKRATRACGPPVEPGGPPWRRRIRDAHRGWPPGATVITAVVHLGGVSNLIAHGGLYRPWDVLTTLTLMAGPLALFWRRQAPILVFTVAATATIIFATHAMPHLAYAAAAAVALYWVARQGRRQAALICGVTAWAGWVGVTVGLSGRLGLNPGVRPVAGQTCLVAVLLGLAVLLGGAARIRAENYAEQARTRAEQARAREEQERRQASEERLRIARELHDVLGHHLSLINVQAGVGLHLMDQRPEQAREALTAIKSASAEALREVRSVLGVLRTEGEAAPRQPALGLNRLGELTATAGIPVRTTITGEPRDLPAEVDRAAYRIVQEALTNVRRHAGPQPEADVAVSYLPAALYLSIRNGGPAPSPAPPGPPALPLAGDGMVGVRVSGPAPAGDDGNGVVGVRAPSSPPGGDGESGSGIVGMRARAEALGGRLEAGRPPTGGFLVTVILPTGRPEPDEPAAPDTTDNRVTTKGNR

SEQ ID NO: 9136 - protein, 274 aa, Actinoplanes utahensis
MMGPSHALSGAAAWLAGSWALDQFADYHQSPLMIGVGTAMAAGGALMPDFDLSGKVTTNQGGATVARTFGVFSLFVAEVIEKISLGIYTATRQSRDPKRDHGHRTFTHTLPFAALVGWGTTALAAHYGKWAVVGIIFFMAGLALRGLFEKWAEKAGWLIVTLAAAAIAWFTAANLPGDRGYPLLGFAVGAGCVVHLLGDMITKNGVPIFWPIPTGRGRMWRMVGIPNRFAVKVGGKTETVILSTAFTIVSVVSLIGLFAPVLLDRLHLNLWASR

SEQ ID NO: 9137 - protein, 280 aa, Actinoplanes utahensis
MTPAGGRTPAASGTRAATTVTDVTTAADAASPPDPPPDGSTSPADPASAGETPPAGPAGRPRRVRGEQTRELILGTALRLFQERGYAETTMRAIAREAGVAVGNAYYYFDSKEHLIQGFYDQNQLAHRSAAARVFASERTFAGRLRGVLHAGIDVNAPYHAFAGTFFKTAADPSSPLSPFSPASAPSREAAIGLFREVVSSSGLRLDPQLRAQLPELLWLGWMGVILFWVHDGSPDQRRTRMLIDGAVPLIDKVVKLSRLPVMRPALHQALGLITALRGT

SEQ ID NO: 9138 - protein, 188 aa, Actinoplanes utahensis
MDPKMWMYLGYLVVSVALTIWVGTTLARNGMVFLTDVFADDRLARAVNQLLVMGFYLLNLGYLAIAMRTGDRIGNAAEALEKLSGKIGWVLLVLGALHLSNVFFLGRYRRGRLRPAAPTPGRTPFPAYPPGVMPGLVVPPVGPVAYPYAAGHPAAYPPPPYAAAPARSPAPQQSTVGSAAPAAEGTPA

SEQ ID NO: 9139 - protein, 162 aa, Actinoplanes utahensis
MVPIVVMGVAGCGKSTVGAALAARLGVPYGEADDFHPAANVAKMHSGLALTDADRAPWLAAIAARIATAGEQGLVVSCSALKRAYRDVLRGPDPRTFFVHLVLTPEVATARVSARAGHFMPSTLVASQFATLEPLAPDENGLGVDATLPLDKIINRVLGRLA

SEQ ID NO: 9140 - protein, 1199 aa, Actinoplanes utahensis
MTQSVATLRELLAERVLVLDGAAGTMLQGARLSPADYRADLIPADHEQDVTGDPDLLNLTSPDVILDIHRQYLAAGADIITTNTFTATTIAQADYGLEHLVRDMNVRAARLARQAADEAEAADGRPRFVAGDVGPLNVTLSLSPKVDDPAYRAVTFDQVKTAYAEQIAALAEGGVDLLMIETVFDTLNAKAAIAAAREVAPDLPLWVSVTIVDLSGRTLSGQTVEAFWRSIERARPLVVGLNCALGAAEARPHVAELARLSDTFVAAHPNAGLPNAFGGYDQTPAETGALIGEFAASGLVNIVGGCCGTTPPHIAEVARAVAGAAPRVVAPPAPTTRFSGLEPFAIGPDTGFVMIGERTNVTGSARFRRLVEADDYQAAVDVALDQVRGGANLLDVNMDADLLDSERAMTTFLNLIATEPEVARIPIMIDSSKWNVLEAGLKCVQGKAVVNSISLKEGPDLFLRQARRIRDFGAGVVVMAFDEQGQADTTERKVEICGRAYDLLVEDGFDPTDIIFDPNVLAVATGIAEHNGYAKAFIDALPLIKQRCPGARTSGGISNLSFAFRGNDVVREAMHSAFLFHAVRAGLDMGIVNAGQLAVYQDIPADLLELVEDVLFDRRPDATDRLVTFASTVTGSGAKREVDLSWRDAPVEQRLSHALVHGIVDFIEADTEEARLKLPRPLDVIEGPLMDGMGVVGDLFGAGKMFLPQVVKSARVMKRSVAYLLPYMEKDKTESSRGQGRVVLATVKGDVHDIGKNIVGVVLGCNNYEVIDLGVMVPAAKILETAIAEGADAIGLSGLITPSLDEMVAVGAEMQRRGMTLPLLIGGATTSKQHTAVRIAPAYDGATVHVLDASRVVGVVSDLLDPERSAKLDEANRAEQERLREQHEKRHAQPLLTLAQARANRERVDFTGLPTPTFTGVREVQPTIAELREMIDWQFLFLAWELKGKYPAILNEPVARELFDDATAMLDQIIADGSFQARGLYGFWPAHAEGDDILLDNGHGFPMLRQQTEKPAGRANRCLADYIAPAGDHLGGFAVAIHGAEKLAARYEAEHDDYRAIMVKALADRLAEAFAEYLHLKARREWFEPDAQPKLEDLHAERFRGIRPALGYPACPDHSEKKDLFQLLDTGRIGVALTESYAMTPAAAVSGLIFAHPDAKYFTVGRLGKDQIEDYAARRGVPVGEVERWLRPNLAYPID

SEQ ID NO: 9141 - protein, 546 aa, Actinoplanes utahensis
MLVAVLPDGRLQDLRADGRPVGAPHPAPDLPAAIAAREAAEQPRWIWAATADTYPALLRAGVRVARCHDLELTEALLLGHAGRWGEPRGLAAATARLRGLPVPADRPRPEAEPPGFAQGALFATFPTAVAVSAEDLIAVYADQQRRLAQTGHPGRFRMLAAAESAGSLIAAEMGHTGLPWRADVHDRLLRELLGPPQPVGPPRRLAELTAAINEAFGTHGLHPDSPAEVVRAFARAGIQIPNTRRWVLRRVDHPAVAPLLEFKELYRIWTAHGWSWLDSWVHDGRFHPEYVAGGVVSGRWGARGGSALQIPKVVRRAVLADPGWRFVVADAGQLEPRVMAAVSGDRGLARAAAGGDLYAELARDSFDGDRAKAKIALIGAMYGQTGGDAIPALAVLRRHYPTAFEYVEQAARVGENGGLVRSWLGRTCPPAAGPGRDAGLDPPDEVAPPPGRARGRFTRNFVIQATAAEWALVLLATLRTALAGTPAELVLFVHDEVVVHCPADQAEQVAETIRECAARAGRMLFGASEVRFPLDVSVVGCYAEAK

SEQ ID NO: 9142 - protein, 300 aa, Actinoplanes utahensis
MTNLVTNAPAVAAKPAAADKERRISPLNGVAHIALFLWALATAGPLIWVVLASFKDNTEIFLGKPFSLPAHFSFKTYADAWSEAHIGQYFLNSVFVVVVSTAGTMLLGAMAAYVLARYRFPGNRALYYLFVSGLAFPTFMAIGPLFGILQSLSLLNTYTGLILVYIAYSLSFTVFFLTAFFQTLPAEIDEAAMMDGAGHLRRFFQVMMPMAKSGLVSITIFNIVGQWNQYLLPVVIMQGAGADSKWVLTQGVANISTSAGYHAEWSTLFAALTLSILPMIVVYGIFQRQIQAGLTAGAVK

SEQ ID NO: 9143 - protein, 301 aa, Actinoplanes utahensis
MRHGKYPFIIGFLVVPLALYLTFVVGAYLQMFQLSFTDWSGFGGFKYIGFDNFVKLWDDPVFWIALRHNVFLLIFLPIVTIAIALFFAFLLNVGGRSKGGVTRGIWGSKVYRIIFFFPQLLALAIVAVIFGRVFGSDHGGMLNGLFPSSWSPWLFLADERFALTCILAVLVWQAVGFYVVLFSAGMGNIPQEIYEAAALDGATKITLFFRITLPLLWGTLQVAWVYLGIAAFDAFALVNIMSVNKGGPNNATQVLSYQIFLNAFQNSQAGYASAIGVVLFFLTLTFAALTLRVTRRDAANA

SEQ ID NO: 9144 - protein, 474 aa, Actinoplanes utahensis
MSEITTSRRTLLRRAAAVGLVAAPGVSFLSACAGSDDSGTTKQATGTKSADNPLGIDPKAGVEIVIFDGGLGTKYATDVDTPLFNTKWPDAKVTYSATQQVSTTIKPRLNGGNPPDMINNSGSDIMDFGAVVKAGQAADLTDLFAAPSLDITGKTVAETLVPGAVQQGTYDGKPFAVNYSFTVFGLWYNKKLFAKNSWTIPTTWADFTALLDKIKAAGITPFGYAGANASYYMVRAIMTSAAKIGTEQVLKDIDNLKPGAWTNDAVLQAAKAWGEVGNKYIDKSFLGLKHTEVQLQQDQDKVAFYPCGSWLENEQAASTPATFEYAMMAFPSVTTSDKLPATAINAAAGEIYFAAAKGKNPQGGKEYLRTMLSKKAALEFTKLTKSLTVVAGAADGVVISPGLTSANDALSKAGQDVFMGYLFDTWYKKLDDASREAANQLMFKGGDAQKFCDTMEAASQAVAKDSSITKFTRS

SEQ ID NO: 9145 - protein, 299 aa, Actinoplanes utahensis
MAVVATTVPRRKKADRHADGTMTVGRTPLGNFLANAGGLLFAIVMFFPVYWVLITSFKPQTEWSSFVPTFLPESPTLDNYKSAFNAPGFKTSLINGIEITCMAVLAALVVGFLAALAVARFKFYGRRAIILVVLAVQLVPFVALLIPLFLMLQKADLIGNKIIGVTLVYVVLLLPYTVWTLRGFIAGIPRELDEAAMIDGCTRGQVFWRIILPLTGPGLVATSVYGFIQVWNEFIIINTLNDNDHQNLMAWLMQNQTSHGTYWGPLMAGSIITSIPVVIFFLAVQRNIASGLTAGAVKG

SEQ ID NO: 9146 - protein, 329 aa, Actinoplanes utahensis
MYAVDSPATRTPTGPAGSGAKRPVGRRRARRGSEEGSGLPWLLSTPALLLLAALLAYPFGRMLVISFQKFGVKQLWTGAAAPWSGIDNYIDTLSDSAFWSVVGHTVLFTAVSVVLSVLSGLGVALLMRRVGRTVRLLMIIAMMFVWALPALVQAQIFKMMTDSDVGVLNYLIDKLPGVSFENHSWFYTPTQGWIVITACVLWAGIPFLAITLNAGLTQVPKELMEAATVDGANAWQSFRNITLPILKPLLVIVTTLSVIWNFGLFTQSWVLRDGKPEPEFHSLATYLYAQAFAQNKYGLGSAIAVLTILLLLGAMTVYIRQMFKIGEVD

SEQ ID NO: 9147 - protein, 435 aa, Actinoplanes utahensis
MKRKIAVAAALAATLLGAAACGSKSDDSSTTSANGKVDGKGKTIKVWLMVDAQSGWKGVVDDATKRFTDATGANVTVEYQQWANVLTKLDATLAGTDVPDVVELGNTQFPKYVDAGAFAPLDKKSFENSDSWLTGLSGPCESDGKTYCVPYYAGARVLIYRTDLFKAAGITAAPKTYDEFLADADKVQAANKDPKFGAVYMPGRYWYSAMSWVKANGGDIAKKDGEKWTGQLSSPASQAGLQKWVELVKKYSKADVTKDEADQYLVFSQANAGMFYGNGWEQGSAEQVKKDPNDPNSALVPTKVKGKLAAAPMPGIPSLLGGSNVGVPVKSKNSELAAQWIKYFTDSTSMAGLAKAGALPNATAVLDAAASANPTLAVPAEAAKNSWAVPASGKWADVEKANILKDMLSDILTGKKSLADATAAADQKIADTLNG

SEQ ID NO: 9148 - protein, 349 aa, Actinoplanes utahensis
MAEPEMDGTAKTAVAFSPARDQAAPGGSDHTSRDRLEQGFWVRGEPRAAKEKSDPMDHPASDGVLVRVRTLLPEFTGALQRVAEQVLTDPAAASRATIVELAERSGTSPATVTRFCRALGFDGYADLRLGIAAETGRARSAGWTVDIGREIQPNDPLERVLGQIMAADTRAMHDTASLLDLAEVERAAVAIAAAPRVNIFGASGSALVGEEMQFSLHRIGIPVWAWTDVHNGLASAALSRPGDVALGISHSGETGETIELLAEASSRGATTIALTSFPRSPLAELADIVLLTATQATTFRPDALSARHPQLVVLDLLYVAVAQRTHERSHAAFQRTAQAVHGHKAVKDT

SEQ ID NO: 9149 - protein, 906 aa, Actinoplanes utahensis
MLAARGEDVAVRDVVPRRRGDRGAQGDEHRRVVGEQGEGDQALLGLADALEGFVRVDAEQFEEAGCLRRVGEQVMAEDVREAFARHVRGHRQEHEAALGAVAAPAGRRVVKLERFVTAGNNIIVRCVTGEQLRDVELGERAQQGEVRVDEAGVRGHRVPQQPLGEYSLGPLVVHLVAVPDQVGVGRGALVRHHHRAQSVPDGGGDRDQRIDRGDRDVPVQRAGPVQLEQPRVEAAPGGQGGQTGGGVHVLDHRVRVHRERHGVEAGRAQDLQGDDRVLAAADRGQRPPAGLDRGGRGQRAGRLDGQLQHVREPVAVRVLGEPVGVDPGEPGGHRGGDRARRHHPGRGADLVVAHPGDHVQQLQHPAQGGGVARRRGHRQRDRLGEAQRLRPVQHVVERGDPGRLVERGRGEAHDVELHPGTPVFWPTGNISSVRRAARLGRFARFSRHKPDLDDGEGDDVRLADLRGRSVAVWGTGREGRAAVGAIAAHEPSRLIAVNDGAGYLDDPWNDPRAPLAGGEHAFAALASADVVVRSPGVPSTHPFMAELRTRGVPVTGGSALWMADHAAATVGVTGSKGKSTTSSLISHLLAAVGRPNAYGGNIGVPLLDLPPAELYVLELSSYQCADLTDSPRVAVVTSLFPEHLDAHGGEREYYRDKLNILAHGPELIVVNGADERLRDEIRGVSDRSGFPPVPAAADDSRFRVEDGTVFCSDDPLFPRSALALVGRHNERNLCVALAVLDGMGVDVVGLRADLEAAVRSFPGLPHRLTEIADPSGVTFVDDTLSTSPYSAMHAVEAYEGRPLTVLLGGTDRGLDYAPLREFLASRELTVIGLPDSGPRILAELSGLPKVTTLPAEDLADAVRLAREVTPAGGVVLLSPAAPSYGRFRNFEHRSEAFAEAIRATAS

SEQ ID NO: 9150 - protein, 108 aa, Actinoplanes utahensis
MEIRMTFSRTEGHAFTVWVEPEGDCVELPQAQRAVFSFRGPDGMDAQLTHHPDRLVIWRPPDTEVWLSVDGDEFHQVAGFADIPAPGLDSSGAGLSVPIRDIVEDLFH

SEQ ID NO: 9151 - protein, 295 aa, Actinoplanes utahensis
MEIDDHLLGAAPDPVRPVLAAAALSSLRLTTGPECAPDTTDTRLGGVPLLPPGAAWPYSPSGNPQSFLGQLNTDEVNARLGEPLLPPGTLLGFFYDWREQRWGFDPADAGHWHVSSTPLSCATAPPLAAGLTATTDSFSTTAMADEPESFVAHQARLTPVLTIPAIDEPPVDATREHHRWQRHDRVQDFYGSLENDDGVPLHRVFGWPDALQGPMRLECQLAANGVHHGNPAGREAARVAELTPGAADWLLLCQLDTDDTMDWAWADAGRLYFWIRHRDLAAHAFHRTWLVLQCP

SEQ ID NO: 9152 - protein, 418 aa, Actinoplanes utahensis
MPGVPKARPIGGAGTEFPSVTPAEYAAHFARNTTRRSAAADGMDPGDTMALRDTQRLLSTSLTFAGGTDEVAARLWEALLQAQPDLLTALPGTAGSQAGQLARALTWLVHRLDDPPAVVAGCGRLGAALAECGVQWKQLQLVGAALAEAVRAGMAPGVWRQDFDQAWRWTWQHVYEWLVHGGTLIAYQPTVWDTEVISHELRRPDLAVVRLRPFLPMPYRPGQYARVEVDAVPGIWRPYSLAGAPQLDDVIELHVRAKTETGVSGTLVHDTRVGDRVRVTRAEGDMGLPAEPGRGVLMIAGDTGVAPMKAMLAQLAAVRDPRPAVLFWGVRNLRELYDVDSLMAIAREAPRATVIPVISEGDPGPYPFGLVTDAVATYGEWSRHEVYLAGPPLMLAATALALHQLGVSPARIHHDAPE

SEQ ID NO: 9153 - protein, 488 aa, Actinoplanes utahensis
MVAPAPIFPHVPPIDIHSAATDLPIQGLRPDPIDHARPQRAGRDGPVLEVGGRIVDHAEPLHHPAGADVAAHRDRQDLRQVQLAEAEAENGPGRLGRIPVPPRAGGQPPADLHPVHRGVLVDRVETGHPDELAGRGHLDRPPAPAPGHHGPAEILDRRGGLGQRQRAGEELANPRVGVHRRPDRQVGVRPLAQPQPLGDQFGGHAGRFYPRCGGGDRRGRQNDRVPAIVITDPDDPRIGDYRALTDLELRTRWEPPNGLFIAEGELVIQRALRAGYRLRSALVDEKRADQLTGLPPDAPLYAAAPAVLESITGFHVHRGILASFHRRPLPELPDLLAGARNLAVLEGLNTHTNLGALFRSAAALGIDAVVLSPSCADPLYRRAVRVSMGEVFAIPYTKTETWPEPLTTIRDAGFTLLAMTPAPDAVALRDLTAAQRDRPALLLGAEGPGLTPAALGASDVRVAIPMHNNVDSLNVATAAAIAFYELTR

SEQ ID NO: 9154 - protein, 224 aa, Actinoplanes utahensis
MSISHRQTASGRPLRVAPAWVGAATPTGRATDHHLLPVRDAVWIWSVRRFARLALWALPAAAVLYGWFTLGVNVPPGPLPVGLLAGWLTSIALIALAGLLAGSRTRRVALTGLLVTLAGATLLLPLVALPEQTATAAVSITTGQVRILLDVARAVCGGGMLLLGWAVFRSQLVNPADGVLLMLAAVALGAGNYAVKPLPTVGALLLLAAGMGLAWTGGRLVPRT

SEQ ID NO: 9155 - protein, 370 aa, Actinoplanes utahensis
MGAVIAVLVIVIALFAVITIVRSIRIVPQQRMDVVERLGKYQRTLSPGLNLLVPFIDAVRSKVDMREQVVSFPPQPVITSDNLVVSIDTVLYFKVVDPVRATYEIANFLQAIEQLTVTTLRNVIGSLDLERALTSREEINRHLSTVLDETTGRWGIKVTRVEIKAIEPPPSIRDSMEKQMRAERERRATILNAEGHKQAQILTAEGEKQAAVLRADGDRQSRVLQAEGQAKAIRTVFDAIHQANPSQKVLAYQYLQALPQIANGSANKVWIVPTELTKALEGLGGALGGLANMVGDVPLAEVHSDEVALEAAAAAQAAAAEAARVNDEVREAEAQVSADPDVTAALGASPQVPPSSALGGADYQGQQHQA

SEQ ID NO: 9156 - protein, 158 aa, Actinoplanes utahensis
MRGRDTIVDVAAVLWIILAIALAIGEAFTATFLIIFFAAGAGAAALAAALGAPVLLQVIVFAVVSGLSVAAVRPIIVRHARPALETGDTAFGIEAMEGHHGTVLETVDAGHGQIRIDGEIWQARPFDGKETFEPGERVRVVTVRGATALVWHDDLPDV

SEQ ID NO: 9157 - protein, 436 aa, Actinoplanes utahensis
MTLLPETARRVDEIAARAQAQGRAPSLALAVVRDRAVLHFAGAGETPRPDPKTQYRLGSITKTITATLVMQLRDEGFFALDDLLYRHLPGTPIGGVTLRQLLGHISGLQREPDGPWWERRDGGDVAQLLAGLTHEKLTGPPFRRYRYSNLAYGLLGAVVSRVTGQSWTDLVTKRVLDPLGMKRTSYLPVEPFARGYVVHALGGTLHEEPRPDAGAMAPAGQLWSTVTDMAKWAGFLADPAPAVLARETVDEMCSPVTIDDLESWTSGHGLGPQLFRVGERVYAGHAGSMPGYLAHLAVHRRSRFGVVVFANTYALAGGSLIKELSLRTLTTVLDSEPAAPVPAWQPPAAPTGEAAEISGRWWWMGGEFDIAPDGDGLTMTGRLGRTRFRREAPDRWRCVSGSDEGEVLRILRAPDGTVDKIDIATFVYSRDARDLA

SEQ ID NO: 9158 - protein, 283 aa, Actinoplanes utahensis
MNRMKALPILAGAAGMTFVGGSVAVSGHLAGAPALTVQALRYAVACLLLLGWSACTRTPVRRPRGAEWRWLLGVTVAGLLVFNIALMHGARHAEPAVLGVAVACVPILLAAGGPLLQGHRPAARTLLAAGVVTLGAIGVEGLGRADRIGVFWAVVTFLCEALFTLLAVPVLGRHGPLGVSVHATGMAVVLFGAAGLVTEGPGAVLRLHAGDVLAGAYLAVAVTAVAFVLWYTCVTRIGPGRAGLLTGLAPIAAALTGMGLGGPAPRPLVWLGMATVAAGLAPS

SEQ ID NO: 9159 - protein, 393 aa, Actinoplanes utahensis
MARRWRGPISGSDFLQLRTADAPAKGLTGWLADGLRSAIAAGRLAPGSRLPATRLLAAELGVSRGVVVQAYQRLVDEGLAGARTGSGTVVARDAAVAPRPAADRRRTLHELRLPLSTPDGIDLNLSPGVPDLAAFPRAAWLRAERAVLDRVTAADLGYGDPGGTPVLRAALAGWLRRTRAIRAEADDILVCGGVAQGQALLAQVLRVRGEAVVAVEDPGSRGSRDQLAYWGVRGEPVPIDESGLIVEQLRRTGLATALLTPAHQFPTGVVLAPERRRELLAWGGLIVEDDYDAEHRYDRAPVAALQGSAPERVAYLGSVSKSLAPGMRLGWLIAPRRMQAGLLAAKHASDLGSSALPQLVLAELIATGDYERHLRTVRARQRARRDALLALAS

SEQ ID NO: 9160 - protein, 72 aa, Actinoplanes utahensis
MAAGLHLLVELPAGTDDVAAAERIRETGVLVHPLTWHRLLPGPPGLVIGYAGHTPDRLLDGAARIGRAIPAR

SEQ ID NO: 9161 - protein, 309 aa, Actinoplanes utahensis
MRCGWPHLLRVTCEQGYVASRNLVATRSVTRACPKGRITVRVMYGEDVMAGNWRRRKTIPEVDAEPDLVVEDADSGFCGAVVGFELGAVVLEDRFGKRRNFPLAPAAFLLDGQTVTLRRPAPRAVAPQRRVTASGSIAVARVTAQVAKASRIWVEGIHDAALVERIWGDDLRIEGVVVEPLDGIDDLHAHVREFRPGPQRRLGVLVDHLVPGSKESRIVASVTHPDVLITGHPYVDVWQAVKPERVGLRAWPVIPPGRPWKEGVCEAAGVREPADMWRRILSCVHSYKDVETPLINAMERLIDHVTVLG

SEQ ID NO: 9162 - protein, 267 aa, Actinoplanes utahensis
MPRTLARMSPAADAATRTAHRSTRFVAWVRAWRAGLVPFDDLAAEIAEDEEHLVAEAPGTWTDVPLGQGLPIFAKLHPDDIRLVLPVPGDPRGLPGPGPLTGAALLAGEAVVTPEFGVVPEVRRHTSGSGVEFETVVWRVLPAPGHRPVFQMGAAEAEAQLTAALAEATTRLTRLDVAQWKPELAGALQQLRRPESTATLPPGFDPRSRRLFARASVLAQVLALAGTNAPGGAVNGYEAQQRDEALRPLTAACRQALVAACNAPLHP

SEQ ID NO: 9163 - protein, 169 aa, Actinoplanes utahensis
MTADRHAHCTYCGARFVPDQAWPRRCAACGETTYRNPAPVAVALQPIGSGLLVVRRGIPPAHGSLALPGGFIEYGESWAAATVRELAEETGLEADAAEVRLFDTRSAPDGTLLIFGLLPELADGSGLPTTPPPEEALGLEVLHEPVPLGFSLHTEVAGRWFDLSRSGRL

SEQ ID NO: 9164 - protein, 135 aa, Actinoplanes utahensis
MTDRGTGEVVAAAWVCVRDRRLLVVRAHGSDAFYLPGGKPEPGETDAEAAVRETAEEVGLTVGDPRFFRTFEAPAHNRPPGTRVRLVCFTGEADGVPAPANEIAELAWFSSADADRCAPAIRLVLGELVRAGRID

SEQ ID NO: 9165 - protein, 162 aa, Actinoplanes utahensis
MPAWEESYLGQLRGSVGPERVLITVGARAVLRDPGGRVLLIRRSDNGRWALPAGTMELRQTLGECAIREVREETGLTVHAITPFALYSGEQLTISAYGQPYQHVTLAVRADIWSGELLRETDETIDAAFYPVGELPETAGPNTRRTLDDLARFEAGAPFTLA

SEQ ID NO: 9166 - protein, 223 aa, Actinoplanes utahensis
MAVLAQGPARRHRHDGPSPRQRGPGVGEHEIVRTPGRAARRRRGVPALFSLGATGLLAAGGVLLLSTLIPPLFGWSSSVVMSGSMCPAIQPGDVVVTSPPAPRDIRAGFVVRFHDPSRPRRPILHRILTIDEHGMLVTKGDANRVVDSAPVPRSAVTGLGRLRVPYVGLPVLWWVRRDYLRLIVTGLVLLVLCALTSVGRTARPPLPGRRRAGTARAAGRPTT

SEQ ID NO: 9167 - protein, 259 aa, Actinoplanes utahensis
MKERKAIESWLTDMDGVLVHEGEPVPGAPEFVNRMKASGKPFLILTNNSIYTPRDLQARLTRMGFEVDEQSIWTAALATAQFLADQRPGGTAYVIGEAGLTTAMHASGYVLTEFDPDYVVLGETRTYSFEAITKAIRLINGGARFICTNPDATGPSTEGLLPAAGSVAAMISRATGVKPYFVGKPNPMMMRSALNAIGAHSETTAMIGDRMDTDVLCGLEAGLETILVLTGISSRMESETYPYRPSRIVNSVADLIDEI

SEQ ID NO: 9168 - protein, 348 aa, Actinoplanes utahensis
MVYDAFVLLSFGGPEKPDDVMPFLRNVVRGRGVPDERLAEVREHYMHFGGVSPINQQCRDLLAAVRAEFAGHGIDLPAYWGNRNWHPMLADTVAQMRDDGVERALGFATSAYGGYSSCKQYWEDIAAARKAVGPKAPVIMKLRQFHDHPGFVEPHAEAVRAALGTLDPARRASTRIAFTAHSIPTGMARNAGPTGGRYTAQLEETARLVQARAAEDVPWDLVWQSRSGPPQVPWLEPDINDHLTALAEKGITDVVVSPIGFVSDHLEVLWDLDNEARETAERLGLGYARAATPGVHPRFVSMVRELVEERLGEQPHNRLGTLPTWDVCPTECCPPATRPSAPRPGAPA

SEQ ID NO: 9169 - protein, 255 aa, Actinoplanes utahensis
MSGLLAGKRLLVTGVITDASIAFSVAKLAQENGATVVLTGFGRLSLVERIAKRLPETAPVIELDVTNQEHLDALASRVREHVDGLDGVVHSIGFAPQSALGGTFLETPWEDVAQALHVSTYSYKSLATACLPLMDQGGSIVGMTFDATKAYPLYDWMGVAKAGLESASRYLAMYLGKHGIRSNIVSAGPLRTMAAKSIPGFSDFEDAWTRRAPLGWELENPEPTARAVCALLSDWFPATTGEMVHVDGGYHAIAA

SEQ ID NO: 9170 - protein, 234 aa, Actinoplanes utahensis
MPRTVLVTGGNRGIGLAIAQAFAKQGDRVVITHRGSGAPEGLFGVQCDITDAASVDAAFSFVEAEIGPIEVLVANAGITDDTLLLRMSEEQFERVLDTNLTGAFRVAKRASGKMLRAKWGRMIFISSVVGLYGGPGQVNYAASKAGLVGMARSITRELSTRNITANVVAPGFIQTEMTDVLPDSRKAEIIKAVPAGRLASPEEVAAAVTFLASDSAAYISGAVLPVDGGLGMGH

SEQ ID NO: 9171 - protein, 402 aa, Actinoplanes utahensis
METTGPRRRNGAMGPLVRLAVGRETARPPVRGRLRFTLPLILFVLVSLGLAAWEELSTTREIPALLVGIIAVGSVLPVAVSYRWPVNAWRLTFLMIFLGWVDHAPGDPWPWNAVQILATLFVLGRLAAVSASPVTLGATTLTVIAVLLLGGANSGGAAVLIVAITALGNIASHRRRTRELLAEQTELNEQERAKRAVLEERTRIAREMHDVVAHHMSMIAVQAETAPYRLPALPDEARDELASIAGAAREALADMRRLLGVLRAEHQEADRAPQPGYAEIAALVITARRAGLPVTGELGEVAGVGEAAGLAAYRIAQEALANAARHAPGGPVRLTARAAGDDLELSVTNELTTPPEPGHRPGHGLIGMRERVALLGGELSAGPDGAGAYRVLARIPRQPETR

SEQ ID NO: 9172 - protein, 215 aa, Actinoplanes utahensis
MIKVLIADDQAMVRQGFGALLAAQPDVLVVGDAADGAAAVTAARELNPDVVLMDIRMPVMDGLEATRRLAGGPRILILTTFDLDDYVYEALRAGASGFLLKDAPAADLVQAVRVVAAGEALLAPSVTRRLIADFAARPRADRPRPVALNALTPRETEVLRLIARGRSNQEIAADLVVAEQTVKTHVGRILMKLALRDRAQAVVFAYETGLVAAGE

SEQ ID NO: 9173 - protein, 59 aa, Actinoplanes utahensis
MRRDTTGSGHGRDVTACSLPARHAAEVGGPTMKNLIAPLGFTVMTAWVVLLFVLTSHNA

SEQ ID NO: 9174 - protein, 316 aa, Actinoplanes utahensis
MIRFLAPWWLLTLLPVLAVAGAYVWRQLRRKSFAIRFTNVDLLRTLAPKGLGWRRHVSAVAFLLMMAALACSTARPSVDTKQPLERATVMLAIDVSLSMQADDVAPTRIQAAQEAAKAFVNELPPTYNLGLVSFAKAANVLVAPTKDRSEVLAGIDSLTLAEATATGEAVFTSLDAIRSVPGDGANGAPPARIVLLSDGYRTSGRSIEDAATAAAGANVPVSTIAFGTDTGVVDIRGQLQRVPVDRLSLQELADRTKGYFYEAASVSELKKVYQDMGSSIGHRTQPREVTQWYAATALLLALIGAATSLLWTSRLP

SEQ ID NO: 9175 - protein, 315 aa, Actinoplanes utahensis
MSLPATPPPAPPEEAARAEAVLARLQLLVTRKLDGLLQGDYVGLLPGPGTEAGESREYRPGDDVRRMDWPVTARTTLPHVRRTVADRELETWMAIDLSASLDFGTAKWLKKDLVIAAATAITHLSARGGNRVGAVVGTGTGTGGDVVRMPARPGRKEAQGLLRGIARTAIRPGRTDLGALIDTLNRPPRRRGVAVVISDFLAPVDGWARPVRRLGVRHDVLAIEVVDPRELELPDVGVLALMDPETGALHEVQTADPRLRERYAAAAGEQRAAIARTLRAAGAAHLRLRTDTDWLLDMVRFVAAQRHARTRGTTR

SEQ ID NO: 9176 - protein, 423 aa, Actinoplanes utahensis
MLCAGRPRGKPPGDEVNATRFTDFRIHPVSVPVPADRAERSTCSADSALGCADPRDGGEWSLCFQERRVSLDRRHPRRRTGDRCGGPVAQPSTPETETTPEGAAPVPPAHDASQLERAMFEVKRVIVGQDRMVERMFVALLARGHCLLEGVPGVAKTLAVETLAKVVGGTFSRVQFTPDLVPADIVGTRIYRQSNEKFDVELGPVFVNFLLADEINRAPAKVQSALLEVMAEHQVSIGGKSHEVPDPFLVMATQNPIEQEGVYPLPEAQRDRFLMKIIVGYPTDAEEREIVYRMGVSAPEPKQVFTPDDLLALQRRADQVFVHNALVDYTVRLVLATRAPAQHGMPDVAQLIQYGASPRASLGIVRATRALALLRGRDYALPQDLQDVAPDILRHRLVLSYDALADDVPADQIVARIMQAVPS

SEQ ID NO: 9177 - protein, 74 aa, Actinoplanes utahensis
MLVDMVEELSPQCSAKGCRASAAWQLLWNNPKLHAPEYRKTWLACDEHRVSLGAFLEARSFLREVTAFESSPTL

SEQ ID NO: 9178 - protein, 167 aa, Actinoplanes utahensis
MSTPPIDALQPWPDTVQWRPVSRKLITVELLGLAVWQTVLVLGLGIAWLFLRQWGWLAGIGGVLLIGVWRAVVAIRAVRAWGYAERDNDLMVRHGLLVRTLSIVPYARMQYVDVTAGPIERAFGLATVQLHTAAAASDARVPGLPHEEAARLRDRLTTLGEDRAEGL

SEQ ID NO: 9179 - protein, 419 aa, Actinoplanes utahensis
MRRRLHPLSPLLHGAKTLAVMIAALSWQTLRQLGLAHFALVVLAIAVGAVIFSAVGWWNTGYQVVARELRISDGLLWRRHRAIPLDRLQSVELRRPLLAQLTGLAELRLEVVGGNKAEAPLAYLSVREAAALRERLLSLSGSAPLPLPAVPQENLLLAVRNRQLLFSQLLTPQAFLLPIGVAWVITQFVMEGSWTFIGIASTVTAMAGVLLQPIRRVLRDWDFRLARDAGGRLLLRYGLTETRSQVVPLHRVQAVRVTWPFLWRLTGWLHLQLDVAGYHNPEHGRDSGSDRLLPVGDPAAARLLIGAVLPGVDLATLATSPPPPRVRWLHPFELRFMGVGLHPDVLVTRGGRVSREMTVVPYARLQSVRVEQGPLQRLLRVATVYADAAGGRSGVARDRDLAEAWALADELARRARLAS

SEQ ID NO: 9180 - protein, 130 aa, Actinoplanes utahensis
MELPEFAPGLSARVELTVTDADTAQSLGSGDVPVLATPRVLALAEAATVAATARHLPGGITTVGVRAAIDHHAPAAVGRTVTAQAALTRVDGRTLAFDVTVRDGATVIAEVRIDRAIVDRQRFIAKALGD

SEQ ID NO: 9181 - protein, 360 aa, Actinoplanes utahensis
MLRPARTVGKMRNIPQLSQKRIYPVTEPQAGFPRALARGFRHRRRRGHGMGYAVVLGEALIDLLEAERGGELIYRQAIGGAPLNVAVAVARLGGRVEYAGTLGTDVLGDRIAAFLAEAGVGAAGVRRVAVPTTLAVTTFQGAEPAFTFYGEPPSYALLTADDLDPATLAGGDLLYTGSICLLREPFRTAARRAWADFTGLRVFDPNVRPKLLPDAAAVTALRDLVEEFFATADLVKLSSADVELLYGDADVAAAARRIRALGAGAVVVTCGARGAHIAAAGDAVLVPAPVVAAVDATGAGDSVMGALVSRLLAEGRPADAAGWRRQVRFALAVAALVCERPGGATAMPTPAEVTARWGEL

SEQ ID NO: 9182 - protein, 180 aa, Actinoplanes utahensis
MPTVLAGLSMGMAVPAPGPAVFLPWKAGRQAITYDAALVPPGATALVEFSSTGQNLWIRLEVTGLVPGHTYGAHMHVAGCGKNPSAAGPHFQHHHAPAAAGDGDPRYANPSNEIWLDFTADAHGGAVVRREQHWMFAHEQPPRSLILHAEPTRTGPGTAGTAGARVGCLNLPFGNGTGGR

SEQ ID NO: 9183 - protein, 490 aa, Actinoplanes utahensis
MAQQDGGTQPAPKTESHDPAFPEAFLAFMRTGWREDPIAVAPLPEVPNYAKRRAALSEAFPGETLIIPSGNEKVRANDTDYPFRPGSDFFYLTGDRDPDSVLILHPTASGHEAVLFTRERNSKESDRFFRDRNGELWIGRTHTLAEKSTELGLETASLGHLGSALAQSAPGRTRVLRGLDPNVDRTVLAYEPDRAKPRDRELAWVLSELKLVKDEWEIAQLQAAIDATVLGFEDVARVLPADRGVKERLLEGVFGLRARHDGNDLGYGSIVGAGAHATILHWVRNTGVTTPGELLLMDMGVEGHNFYTADVTRTVPVSGTFTPLQRQVYDIVHASQQAGMDAIRPGVLFKDVHQACMRVLAEGLHDLDLLPVSVDEAMAEDSTVYRRWTLHGFGHMLGIDVHDCANARNETYRDGPLAEGYVLTVEPGLYFQPEDELVPAELRGVGIRIEDDVVVTADGCRNLSDGLPRTSAEVESWLAAQREAGPRLPG

SEQ ID NO: 9184 - protein, 179 aa, Actinoplanes utahensis
MLHCAACRPWGGRVEVAVRFQRVLCAVALTGLVAGCTSTAPDEPKFTQPSVAASAPPWTEPDAYSYVLTRGCDAAKPAGRYRAKVRAGQVAGATRIGTPDAPNPSADVDLGPVTGEQGEEIDVPTLAGLLEMARTTADDGGQVTTEFDVKDGHPVRVTLNTTGAADGAECWSVSDYRIG

SEQ ID NO: 9185 - protein, 129 aa, Actinoplanes utahensis
MTTQADLDQLTDFFGRYGAALTIGDVVGIAGCHALPGMVVADSYSFTFSSPAAVALSFLGAAPTYREQRIVAAHAQILGVQRISAALAMVEVEWEYLDSEGGAVPGERYRYLVRIGADGPLITTVIASR

SEQ ID NO: 9186 - protein, 925 aa, Actinoplanes utahensis
MTVASLDTFGAKSELRVGDASYEIFEIDKVEGHDRLPYSLKILLENLLRTEDGANITADHIRALGNWDQNADPSVEIQFTPARVLMQDFTGVPCVVDLATMREAVKDLGGDATKVNPLAPAELVIDHSVIADLFGRADAFQRNVELEYQRNRERYQFLRWGQTAFNEFKVVPPGTGIVHQVNIEYLARTIMERNGQAYPDTVVGTDSHTTMVNGLGVLGWGVGGIEAEAAMLGQPVSMLIPRVVGFKLSGEAPAGTTATDLVLTITEMLRKHGVVSKFVEFYGPGVSAVPLANRATIGNMSPEYGSTVAIFPIDSQTIDYLKLTGRTEQQVALVEAYAKRQGLWLDPNAEPDYSEKLELDLSTIVPSLAGPKRPQDRVLLSAAKSAFRDALPNYAAPHGHADEASEESFPASDAPANGVDDEADKPHLFSAALGATGRTSKPTRVKGDDGVEYELDHGAVVIAAITSCTNTSNPQVMIGAALLAKKAVEKGLTRKPWVKTTLAPGSKVVSDYYDRAGLTPYLDKIGFNLVGYGCTTCIGNSGPLPEEISAAINEADLTAVSVLSGNRNFEGRINPDVKMNYLASPPLVVAYALAGSMDIDITTEPLGTGSDGKPVYLNDIWPSAQEIDEVIAQAIGAEGFSAAYQDVFAGDQQWQSLPTPTGDTFAWAGDSTYVRKPPYFEGMAAEPAPVADISGARVLAKLGDSVTTDHISPASSIKADSPAGRYLTEHGVPRAEFNSYGSRRGNHEVMIRGTFANIRLRNQLVPGVEGGFTVNHLTGEQTTIYDASVAYKEAGVPLVILAGKEYGSGSSRDWAAKGTMLLGVRAVIAESYERIHRSNLIGMGVLPLQFPQGQNAESLGLTGTETFSFEGVTGLNDGTTPRTVKVTTDTGITFDAVVRIDTPGEADYYRNGGILQYVLRKMLRG

SEQ ID NO: 9187 - protein, 82 aa, Actinoplanes utahensis
MTDDNSVLNRIHGLVEEEHQLRSELGQGKISSTEEHARLKELEEALDQCWDLLRRRRAARETGNDPEAEKAHSVSEVESYLQ

SEQ ID NO: 9188 - protein, 305 aa, Actinoplanes utahensis
MREHDTYGPTTMRRGRRKFDDDEASFVKSGRLEPALKEDPDLPEVGDNWSSWDGALHGPQPRPDWVRTEHGAVDTELGVLKTGKEADVFLVRRWLPATGETSMLAAKRYRDGEHRMFHRDAGYLEGRRVRRSREMRAMTNRTAFGKEMIAGQWAAAEFDALGRLWQIGQESGLVCVPYPVQLSGTEVMLEFIGDWETGEAAPRLAQLRSGDGDLESLWQQMTDALSVLARAQVAHGDLSPYNTLVRDGRLVLIDLPQIVDVVANPRGAEFIARDVTNVAGWFRSRGLPVDPEALTARLLFEAGLQ

SEQ ID NO: 9189 - protein, 268 aa, Actinoplanes utahensis
MDLQLAGKRALVTGGSRGIGLRIARSLLAEGADVAIVARDGERLAKAAAELAAAGHPGRIVTVRLDTGDDASVRAGVQRVREQLGGIDILVNNAAVPGGGPGGPITPSQTTDRQFVDAVNVKVLGYLRTARAVAPDLIAQGWGRIINISGLAARLSGDFVATARNIGVAALTKNLADELGRHGVNVTVVHPGATVTERTPALIAAAAEQWGVTVDEAERRRAERTAIGREVTAEEVADVVTFLASPRSVAITGDAVTVGGGLIGPIHY

SEQ ID NO: 9190 - protein, 216 aa, Actinoplanes utahensis
MPLVFLALDDTLLDRSGAFRLWAKGFLDEIGASQDDLDWLVAVDADGLTSRWDLADQILDRYQLRVPAIDLVDELHEGPLTYERLDPMVGCALEIAADAGLVPVVVTNGTTDQCEGRIRRTGLDRYVADWVISEQAGVSKPNPRIFALAAQRVRMRLAGAWVLGDSPEADIGGAAALGLPSVWLHRGREWMDTRFAPTRTVGNVIQGISAIMATRS

SEQ ID NO: 9191 - protein, 192 aa, Actinoplanes utahensis
MPRVSQDQLDARRHEILTAARGCFARFGYEGATVRRLEEATGMSRGAIFHHFRDKESLFLAVAEDDAVTMAETVTRNGLVQVMRDLLDRAGTSDGDTAGWLGTQLEVSHRLRTDPAFATRWAQRAAAIADATHERLQRQREAGVLRQDVPVEVLTQFLELAYDGLVLHLATGRPPGDLARVLDLVEDAVRRH

SEQ ID NO: 9192 - protein, 120 aa, Actinoplanes utahensis
MSDFDTMVERYLAIWNETDADARRAAITDVFAEDVSYVDPIAAVRGQDELSGLIGAVHQQFPGLVFSLGGAVDAHHEQGRFTWHLGQPGQEPLVIGFDVAVLDGSGRIAQVFGFLDKVPA

SEQ ID NO: 9193 - protein, 247 aa, Actinoplanes utahensis
MSAVGQLLRTWRDERRLSQLDLSGRAGVSARHLSFVETGRSRPTREMILRLAEELDVPLRHRNELLLAGGFAPAFTESDLDGPPLAVVLDGLRQVLAGHGPCPAVLVDRHWTMVDANAAIDRFTRDCAPELLEPPVNVLRLALHPDGLAPRIENLAEWRTHLLHRLDRQAAATGDPVLRGLRAELAGYPGGELTGEPVGVVVPLRYAGLNFFSITAVLGTPRDVTLSELAIEAFLPADAATATALRE

SEQ ID NO: 9194 - protein, 256 aa, Actinoplanes utahensis
MGRMDLGLAGRVFILTGASRGLGFATAQALVADGARVVISSRDERNVADAVAGLGGPEHAVGVTADLADPGTPRELVDVTSERYGRLDGALISVGGPMRGTAAGLTDEQWTAGFETVFLGSVRAARTFAAALPEGGAIGLVLSTSVKSPLTGLGLSNGLRPGLAMVAKDMADEFAPRGVRVLSLLPGRIMTDRNRELFQATGDAATAAAEAAASVPLGRLGEPAEFGRVAAFLLSPAASYLTGIAVPVDGGALRTL

SEQ ID NO: 9195 - protein, 164 aa, Actinoplanes utahensis
MSDVLGPGLRVLFSGINPSLYSAETGHHFARPGNRFWPTLHGAGFTDRLLHPSEQHLLPALGLGITNVVARPTARADELSRDELTAGGQVLTDLVRREHPSFLAVLGVTAYRAAFARPRARIGRQPDLLGGVPVWVLPNPSGLNAHFQLPDLIREFTALREAAF

SEQ ID NO: 9196 - protein, 640 aa, Actinoplanes utahensis
MTSWNMLRSIQSADKVAKHQIKPGTSRRILRFAEPYRRDIAVFLVAVVFDAVIGVATPLLAGNVINAITRGGPAASVTVIRIALFIAGLAIADALLSLAQRWYSARIGEGVILSLRTRVYDHVQRMPLQFFTRTQTGALVSRLNNDVVGAQRAFTSTISGVLSNVIQLVLTAVVMVSLSWPITVLSLALLPAFIIPARRVGKRLAEITRESYNLDAKMNATMTERFNVSGALLVKLFGRPDTEAAKFGERAARVRDIGVQQAMFSRTFFVAMLLVASLAQALTYGLGGWLAVRGDVSAGTVVTLALLLTRLYGPLTALSNVRVDVMSALVSFDRVFEVLDLAPGIAEKPDATPIPAGAGRIEFRDVRFRYPSAAEVSLATLEDVATLDRTENTPVLHGVDFTVEPGQLVALVGPSGAGKSTTSMLVSRVYDVTGGAVLVGDVDVRDATLDSLRDTVGVVTQDSHLFHETIAENLRYARPDATEEQMWAALAGAQVGDLVRGLPDGLDTVVGERGYRFSGGEKQRIAIARLLLKQPSIVILDEATAHLDSESEAAVQRALSTALRGRTALVIAHRLSTIREADLIVVLDQGRVVERGTHEQLVNAGGLYADLYRTQFAGASATYPEEDIEIVTVPAGTVEP

SEQ ID NO: 9197 - protein, 259 aa, Actinoplanes utahensis
MTADNAAGEVGVRYEQDGPVATVTLCRPDVLNAQTPAMWSELSDISRKLPGDVRVVIVRAEGRAFSAGLDLSVARGDGDSSLARLAQLSATDCADRIAGFQTAFTWLRSPSIVSIAAVQGHAIGAGFQLALNCDMRVLADDARFSMAEVTLGLVPDLGGTKRLTELVGPSRALEICVTGRRIPADEADRVGLATAVVPRADLDAAVADLAAAVLAGDRNAVAEIKGLLAGASGRSYPEQDRAEREAQTRRLAELSGRGE

SEQ ID NO: 9198 - protein, 75 aa, Actinoplanes utahensis
MAATGTATSTEKGRRIVGSERQSLAKDLVKRYTSGESIRALAASTGRSYGFVHRVLTESGVQLRQRGGARRRKKA

SEQ ID NO: 9199 - protein, 534 aa, Actinoplanes utahensis
MITATGLELRAGARILLSPTTLRVQPGDRIGLVGRNGAGKTTTLKVLAGEGIPYAGQVERTSEIGYLPQDPRTGDLNVTGRDRVLSARGLDSILAEMQKLEVQLEESSEEKLVRRYGQLEDQFSALGGYGAEAEAARICANLGLPDRALAQTIGTLSGGQRRRIELARILFANSGQNGKGILLLDEPTNHLDQDSIAWLRGYMAQHKGGLIVISHDVELLDAAVNKVWYLDANRAVVDMYNMGWKTYLEARETDERRRRRERANAEKKAGALMAQADKMRAKATKTVAAQNMAKRAEKLLGGLEEVRSSDKVAKVRFPSPAPCGKTPLTGHGLSKSYGSLEIFADVDVAVDRGSRVAILGLNGAGKTTLLRILGGMLQSDTGEVRAGHGLRLGYYAQEHETLDVDRTILDHMRSAGSEQTDTELRKILGAFLFSGDDVDKPAGVLSGGEKTRLALATLVCSGANVLLLDEPTNNLDPVSREQVLDAIANYPGAIVLVTHDAGCVQALKPDRAILLPDGDEDAWSDDLLELVELA

SEQ ID NO: 9200 - protein, 311 aa, Actinoplanes utahensis
MELNENAEIDTSQVEDVRGSGGGGGGFGGLPIPIGGGGLTGIIITVILLVVGGYFGVNNLGGGGGGGSSKADNTKIRNECKQSDKLQKLDCRNVLYINSIQAYWATEMPQAFGKQYEKVNTTIFRSRVNTGCGAADSGVGPFYCPADNHVYIDLTFYDQLAKELGAPGEFAQPYVLAHEYGHHVQDLLGTEAKMRQAQNADKSQANLQSVRLELQADCYAGAWAKGATGTADAKGNKVFTSLTDSDIQQGIQTAGQIGDDTLQKRGGGTVNPAEFTHGTSADRQKWFRTGYDSGDPTKCDTFAPGAVNEGD

SEQ ID NO: 9201 - protein, 210 aa, Actinoplanes utahensis
MGERPAAGGGKWVDVAPERVGRWLENFGTRHGPYREIGLTLIAADGAEASLHAPPGVGEPATVAELTAAALAPRRFGLLLARKGAVAAGVVDGGELVMSKVDTHYVQGRTAAGGWSQQRFARRRDNQAKAAAADGAGIVGRILLPEVRTLTALVTGGDRAAVEAILADRVLAPLAALRAGRLLDVPEPRHAVLVSAIAMARAVPILIREP

SEQ ID NO: 9202 - protein, 225 aa, Actinoplanes utahensis
MSLTEVVMARLTTAFEAARDPVRAPAMAAYMRDQFRFLGLSATARRAAARAVLAGLPRPDEAVLVDIARACWARDEREFQQFACDFLTAGLPATSPGSLALAEELITTKSWWDTVDPLATHFTGGLVRRHPELCRRMDDWSAADDLWLIRTAILHQLHYGAATDTDRLFDYCTRQAGHPDFFVRKAIGWALRHYARTDPQAVRAYLTAHAARLSPLSLREAAKHL

SEQ ID NO: 9203 - protein, 436 aa, Actinoplanes utahensis
MPAGRRTVANPEKEPRVRRGLAGLLAAEAISLLGSRITFVALPWLVLTSTGSALLAGVAGFAEMLPYVLAGLLGGPIVDRAGPRPTAVAADVASMIAVIGIPVLYATGAVPYHTLLVLIAVAGALRGFGDTAKRALLPRVIAAAGLSTERGTTLYDGISRVATLLGLPLAGLLVAAAGPARVLLADAASFGACALLITLFVRAGSTGQPPADDEEGGYAAALRCGFRHVRQDRLIIGIMSMLFVTNLFDQAYATVFVPVWVREGPHGPAALGVLGSAFGIGAVAGNILWTIVGPRLPRRSTFAVCFLLGGPAQLFALSLSDRLWPVLAIAALAGTLMASINPILLAAVYERVPVRMQGRVMSVLIAFSWAGIPLGGVLGGWAADDLGLRTGALLAGIGYLLVTLAPFVSSAWHALDEHRAPGRVAERGEPSLTSAG

SEQ ID NO: 9204 - protein, 231 aa, Actinoplanes utahensis
MGVVAELILIRHGQSLANVLFPQADEGELLEIALSGPDAEVPLTERGEAQARAVGAWLAGQPADARPEVVVTSPYLRARETWRIAARAAGVALPEPRTDDRLVDRLLGDLEMLTRAAVAARFPGEAARLAEAGPWEYCPPGGESFADIRVRLTSFLDDLHRAHAGRRVLVVAHDAVVLMTRAVIEDLDWEELAAVEKSAGAVRNASITRFTDDGGTLRLDRYNVIDHLPPA

SEQ ID NO: 9205 - protein, 200 aa, Actinoplanes utahensis
MSAPFLAGVVAGYGIAVPVGAIGALIAGLSARTSLRVGAAAGLGAATADGVYACVAVAGGAAVAGVIAPIAGPLRWLGALVLLALAGWTAWGAIRHPSTGARDERPTTPLRAYAAILGLTLLNPATVIYFAALVLADGGAGGGPWFVLGAFLASASWQLLIAGGGSLIGRLLTGPRGRLITALSSSVVIAVLAVRLLTST

SEQ ID NO: 9206 - protein, 281 aa, Actinoplanes utahensis
MDTFIAPDGLRLALHRAGSGDPLVCLPGGPMQASTYLGDLGGLSAHRLLLIPDLRGTGDSPPPDDPDTYRCDRQVPDIEALRQRVRLERFDLLGHSAGASLALLYAVAHPDRVRRLILVNPSPRAVSLEISDLDRRRVAEERRAEPWFPEAFAALERIQTGQATAADGRALAPFIYGRWDAGTQAYSAREADQKNRVAAAAYNAEGAFDPAAVRAGLAALQASVLLISGEMDLQLPPKSAAEYAGLFPHAELAMVPGGGHFAWLDDPDWFTQKVAGFLRGA

SEQ ID NO: 9207 - protein, 272 aa, Actinoplanes utahensis
MQGQPETVGGDEGVHPEILCANVDPLGTRRARPPAGTVDRAELSVGRSRLTTVVAFTGDFETHLTAGAGQVAALAAFAAEHGLTFLHIELDRGVTTSQPMLTLRGSGGLADRLDVAHQWCRRLREAGITPTRVKIEASPWTDGVPQHDEAAADQPAYRYFEHHLKLRLPPGMADLIALTDLVEPHGARLSRNALKRSADGAEIRFVNQRCHRVGLASATSRLDRLVAALRDAGHDIVSVEQEYVVHDDNLRIDDGWLPREEPVDTSWTPSRR

SEQ ID NO: 9208 - protein, 86 aa, Actinoplanes utahensis
MDAEPALTLMRGIARAVEHSPGTGPALTLMRGIARAVERSPGTGPALTLMRGIARAVERSPGAGPAPGAVTESAIATYERAARHAA

SEQ ID NO: 9209 - protein, 248 aa, Actinoplanes utahensis
MTPTPPFSELVTLVEERSAALREAAAAAPDMGARVPGCPDWSLRDLVAHLGEVQRFWALVVTEADPSGPPPRERYGSTFPQSDLLEWLGESTRLLGAALRAAGPDTPCWAWWPVEAAPHTVAAVARHQVQEAAVHAFDAMEALGKAEPLPAAIAVDGVSEFLATGLGSRGAWPHRPARVQYQAVEGPSWTLDLSPAGATADPAASGEPVTRVHGTASDLVLHLYRRIPLDAVRIDGDREVATQINAWS

SEQ ID NO: 9210 - protein, 265 aa, Actinoplanes utahensis
MSDTESVQTVAHGHAHHDHDGHGHEGHNHGDHGHDHGHDHAAGGPGHDHGHDHGHGHSHAAEGDTARTVASAPAGVTSAADDEVPAWLAQERAAAAASGEPVEVPAAGVSAGAAAGDSANGDSANGDSAAGDPVAGVAVAGVAVAGVAVAGEKAAPGKKASVDDVEEAMKDVVDPELGINVVDLGLVYGVHVDDDNVVTLDMTLTSAACPLTDVIEDQTRQALTTGPGGGLVQDFRINWVWLPPWGPDKITDDGREQLRALGFNV

SEQ ID NO: 9211 - protein, 151 aa, Actinoplanes utahensis
MLLDALYQDIILDHYKHPHGRGLRDPFDGEAHHVNPTCGDEITVRVSSDFSDISYDGLGCSISQASASVLHELLQGKDAATVAEIHHAFVELMQSRGAIEPDEDVLGDGIAFAGVAKFPARVKCALLPWMAFKDAAVRAGVEVGASPEVKA

SEQ ID NO: 9212 - protein, 409 aa, Actinoplanes utahensis
MSYDVARVRKDFPIFEREVNGHPLVYLDSANTSQKPVQVLDVMRAHQERHNGNVSRSVHTLGTESTEMYEGARARIASFIGAGTPDEVIFTKNSTEAINLVAHAAGSFLRLGPGDEIVISEMEHHSNLVPWQLLCERTGATLRWFGITDEGRLDESELDALVNERTKLVSVVHMSNVLGTINDVTRLVERARQVGALVMLDASQSVPHLPIDVRALGVDFIAFTGHKMLGPTGIGVLWGRFDLLAQMPPFLAGGSMIETVTMAKTTYAPPPARFEAGTPPITEAIGLGAAVDYLTALGMDNIHRHEQDITAYALEQLGSVPGVRIFGPASPVGRGGTVSFGVDGVHPHDVGQVLDALGVEVRVGHHCARPVCVRFAVPAMTRASFYLYTTTEEIDALARGLDQVRKVFG

SEQ ID NO: 9213 - protein, 300 aa, Actinoplanes utahensis
MLAARLPLRPAHRRALRTARHRPGGGLPRRDPRRRHPRFHDTEQWSTAVSTLEIRDLQVSVKLPDGELKPILAGVDLTITSGETHAIMGPNGSGKSTLAYSIAGHPKYEITGGSVTLDGQDVLALSVDERARAGLFLAMQYPVEVPGVSVANFLRTAKTAIDGEAPKLRTWAGELRGAMEKLQMDPSFAQRNVNEGFSGGEKKRHEIMQLELLKPKMAILDETDSGLDIDALRIVSEGVNRVRETGETGFLLITHYTRILRYIKPDFVHVFVGGKIVEEGGPELAEELEVSGYEKFLAKA

SEQ ID NO: 9214 - protein, 373 aa, Actinoplanes utahensis
MTTIAPPSTKSQVLRSFDVTDFPALTGLEEEWRFTPLKRLRDLVKATKLDGAAPSVEHGDLPAGVTVSTAADVDPVLTPFDRISALAYGSAATVTVIEVAAEAEPTEAAVIRLVGKGGAAAAARTVVRVGRFAKATVVLQQTGTVTLADNVEVIIGDGAQLTFVTLAEWDTDAVQAQHVKFRVGKDARVQHVQVTLGGDLVRQFTSVEYAGRGGDAELWGLYFADAGQHHEHRQLVDHSVPDCRSHVGYRGALQGTSAHTVWVGDVLIRAAATGTDTYEINRNLILTDGARADSVPNLEIETGEVAGAGHASATGRFDDEQLFYLMARGIPEGEARKLVVRGFFAELINKIPVEELRERLGDAIEARLVEAGA

SEQ ID NO: 9215 - protein, 473 aa, Actinoplanes utahensis
MTDQIVTQEEHLAALGKYEYGWADADVAGAAATRGLSEAVVRDISAKKSEPQWMLDLRLKGLRLFDRKPMPNWGADLTGIDFQNIKYFVRSTEKQAASWEELPEDIKATYDKLGIPEAEKQRLVAGVAAQYESEVVYHAIREDLEAQGVLFLDTDTALKQHEDIFKEYFGTVIPVGDNKFAALNTSVWSGGSFIYVPKGVHVDIPLQAYFRINTENMGQFERTLIIADEGSYVHYVEGCTAPIYSSDSLHSAVVEIIVKKNARVRYTTIQNWSNNVYNLVTKRATCEEGATMEWIDGNIGSKVTMKYPAVYMTGPHAKGEVLSIAMAGEGQHQDSGAKMVHAAPHTSSTIVSKSIARGGGRTSYRGLVQVLEGSAHSKSTVKCDALLVDTISRSDTYPYVDIREDDVNMGHEATVSKVSEDQLFYLMSRGLTEDEAMAMIVRGFIEPIAKELPMEYALELNRLIELQMEGAVG

SEQ ID NO: 9216 - protein, 314 aa, Actinoplanes utahensis
MPTLTRPFAAWLRPLALATLVANVALIVTGAAVRLTDSGLGCPTWPKCTDESYTTTAAMGVHGAIEFGNRLLGFVLAALAIAGFLGALGRRPRRRSLVRLSVAAGLGVPMQAVLGGITVLTHLNPWVVGSHFLLSVALITVSYAFWRRIDDGDAAPRALVPAPLRPLAAITALASLAVITVGTVVTGSGPHSGDRGAKRNGLDPAAVSQVHADLVFLLIGLSAALWFALRAVPAPDTAVRAAAVLVAVELGQGLIGFVQYFTHLPVVLVAAHMLGAGLVWWATLAVLWSLRTRAAVAGDLETTTTPAPEPVPAA

SEQ ID NO: 9217 - protein, 292 aa, Actinoplanes utahensis
MPTGRRVALVTCAAFPDLWDDDHPLRDALRSRGVAVDAVRWDEPDADWAGYDLVVVRSPWDYVARHEQFVAWARSVPRLLNPADIIVWNTDKRYIGELAAAGVPVIPTGFVGPGEAWTPPSSGEWVVKPTVSAGSQDTARYRLPAQAAQAQAHVGRLTAEGRTAMVQPYLAAVATEGETALLFFPDESGELAFSHAIRKGPMLRQTGEHVIDVGSEEITPRTASEAEREVARLALTAVPGGSKRLLYARVDVIPGPDGAPQVIELELSEPGLFLLTAPGAADRLADAVLARL

SEQ ID NO: 9218 - protein, 91 aa, Actinoplanes utahensis
MTLTSEIKSFAAGHGGCKAVIEYVGKRGARIVLVGGDGEWSDQFAQDTGVAREACEHAGVEVENEWERELLEQMRPSNDLWRSMARRSMAR

SEQ ID NO: 9219 - protein, 320 aa, Actinoplanes utahensis
MSMITERSVQRRSPGVAEPAPREETRRERMAVFRAYLALTKPAIVELLLVTTVPTMMLAAGGWPDLVTFLAVLVGGALAGGAASALNCYIDRDIDVLMKRTKRRPLPSHQISPRAVLIFGLALAVVSVALMAVLTNWLATALTAFSIFYYDVIYTLWLKRRTPANTFWGGVCGAAPVVIGWAAVTGSIAPMGWALFAVVFFWQMPHFYALAIKYKDDYARAGIPMLPVVRSVARVNFEILLYTVLTVASSLAAWPLGTGLGLGWIYGSAAMITGVLFLGESVRLVYQTRNGGMVKPMRLFQLSITYLTVLFMAIAVDALV

SEQ ID NO: 9220 - protein, 704 aa, Actinoplanes utahensis
MGANDSALHWSDLDRKAVDTVRVLAMDAVEKAGNGHPGTAMSLAPAAYLLFNRVMRHDPTDPHWAGRDRFVLSCGHSSLTLYIQLFLSGYSTSLDDLKALRQWDSLTPGHPEYGHTPGVEITTGPLGQGIGNAVGMAMAARRERGLFDPQAEPGRSPFDHQIYAICSDGDIEEGVSHESSAIAAVQKLGNLTVIYDDNQISIEDDTRIAKSEDVGARYEAYGWHVQTVDWRSSDPYVEDVEALWDAIQAAKAVTDKPSFIVLKTIIGWPAPKKQNTGKIHGSALGKDEITATKALLGFTDEPFAIDDEVVKHAQQAVERGKAAHAEWNEAFAAWGSANAEAKALFERLAAKRLPEGWAAALPEFPADEKGLATRAASGKVLEALAPVLPELWGGSADLAESNNTTMKGEPSFIPAEYATKEFPGHEYGRTLHFGIREHGMGSILNGIAVHGGTRPYGGTFLVFSDYMRGAVRLSALMKLPVVFVWTHDSIGLGEDGPTHQPIETLTALRAIVGLDVVRPADANETAWAWRGALEHHDRPTALALSRQNLPTLDRSKYASAEGTLKGGYILSEASSGTPKVILIASGSEVAVSLTAQERLEAEGTPTRVVSMPCQEWFFQQDTAYQQEVLPHGVKARVTVEAGIRMSWDRLLGDAGEAVSIEHYGASAPAKILFEQFGFTADNIVAKANASLAKVGVITGHTTGN

SEQ ID NO: 9221 - protein, 378 aa, Actinoplanes utahensis
MTDRLAELSAQGVAVWLDDLSRVRLTSGSLDKMRREQHMVGVTTNPSIFQKALSDADAYDEQLRDLAAQRVTVEEAVRLMTAADVRAAADVLRPAYDASDGVDGRVSIEVDPRKAHEAEATVAEAKTLWWLVDRPNLYIKIPATMDGLPAITATLAAGISVNVTLIFSLERYRAVMDAFLSGLEQAKANGHDLSKIGSVASFFVSRVDSEVDKRLDKIGSDEAKALKGKAAIANARLAYEAYEEVFGTDRWTALKQAGAHPQRPLWASTSTKNPDFPDTIYVEELIAPGTVNTMPESVIVAYADHGTTRGDTVTGNYADAKQVFADLAKVGVDFDDVVKVLEEEGVEKFESAWKDLLEGVTKSLKAAAGGAENPSDAA

SEQ ID NO: 9222 - protein, 505 aa, Actinoplanes utahensis
MGNPLRTAQDRRLPRIPEPCALVIFGVTGDLSRKKLIPAVYDLANRGLLPPGFVVVGFARADWGDGDFESLAYAAAKKGARTPWREDVWQRLSSQFQFVPGSFDDDADFDKLSETLDQLRERNGIQGNTAFYFSIPPAAFPLVLNQLNRTGLADSAKLGGWRRVVVEKPFGNDLQTAVALNALVDDVFNPADVYRIDHYLGKETVQNILALRFANSLFEPVWNSKYVDSVQITMAEDVGIGTRAAFYDASGAARDVLQNHLLQLLALVGMEEPTSFDPQEVRAEKLKVLKAISLPADIASGSVRGQYLPGWVAGERAVGYLEEKNIPADSTTETYVAVRLGIQNRRWAGVPFYVRVGKRMPRRVTEIAILFKKAPHLPFDPADVEMLGNNQLVIRVQPDEGVVLKFGSKVPGTAMEVRDIAMDFQYGEAFTESSPEAYERLVLDVLIGDRTLFPDAAEVEQSWRVIDPLEAAWAGTTPEPYRAGEWGPRASDELLEREGRAWRRA

SEQ ID NO: 9223 - protein, 332 aa, Actinoplanes utahensis
MIGLWDTTGNEVVKALAAERRSAGGVASGLALTLIAVVEEKKVREAEAAATIAAAAHPCRVLIVVRSDLDGRSRLDAEIVVGGRLGPAEAVVMRMYGRLALHAESVVIPLLAPDVPVVTWWHEEPPDSIANDFLGVVSERRITDSAQAPDPVAALRQRAADYAPGDTDLTWTRITLWRTLVAGAFDTTEARVTGARIVAPEKDPTAWLMLGWLKSRLGIEPVLEHTDRAPRMHSVELQCENGDCVRVTREEGTALFSRTGQEDRYMPLPKRPVGDELAEELRRLDADQIYAEALGAMAGLSGLDNRPAARVHVWKDPALAARAASTTDAMAG

SEQ ID NO: 9224 - protein, 238 aa, Actinoplanes utahensis
MSETLVVVVPDADILASTVAARLVVRIIDAQAARGSASVVLTGGRVAAKVLRQLGELPAAAAIDWSRVDLWWGDERFLPAGDPDRNETQAREAVLDALPLDPARVHAMPATDGPDGDDADAAAARYAAEVTAAGAHFDVLMLGVGEDGHVASLFPGHPVLAAQGVAVATYDSPKPPPTRITLTLDTIRRAGEVWLVAAGPDKAEPIGAALRGADLPAAHAVGVHRTLFLLDQAAAAKR

SEQ ID NO: 9225 - protein, 320 aa, Actinoplanes utahensis
MRGRAGVLPQRRHVADPDPALDQLGVRRLDVVDHQLQAAQRAGRHLRHRALADHDRAAAARRGDLHDPHLVAHHDVVVDGEAELLGIELLRPVDVGHRNDDHLKSPVHGHHAAIRRLRQVSATIRAYRSSDLDAIYDICVRTGDAGRDARGKHSSDRLLGDIWAAPYVILEPEHAHVLDDGTGRAVGYIIGTADTEKFVRRYRDEWLPATADRLTGGDPRDELMLSLHRRPERMLHPALAAYPAHLHIDLLPEWQGRGQGRGLMAAFLAGLRAAGVSRVHLGMSPENQGAYAFYHRLGFRDLPVDDDPGALYLGRNTGPL

SEQ ID NO: 9226 - protein, 113 aa, Actinoplanes utahensis
MSSGSAIRGSRIGSSPMRPDERTEPAPRRQVKYFCAAGHDSLIWFAAEAPAPDTWDCPRCGQPAGLDRERPPGRSRTEPYKSHLAYVKERRSEEDGAAILEEALAKLRQRRGR

SEQ ID NO: 9227 - protein, 84 aa, Actinoplanes utahensis
MPIGFAYTLIVLLIITSILLTLLILLHRGKGGGMSSMFGGGVTSSLAGSSVAEKNLDRYTVLVGVLWFACIVGMGFWLKSKTGS

SEQ ID NO: 9228 - protein, 263 aa, Actinoplanes utahensis
MGDVTRKPIIAGNWKMNLNHYEANLLVQKLAASLTGEQLDRVEAVVLPPFTDLRTVQTAIEGDKLTIRYGAQDISKHASGAYTGEIAGSMLAKLGCTYVVIGHSERREYHEESDELINAKIKAAFAAGLTPIFCVGEGLAVREESGHVAHCTAQVDAGLDGLKEDQIKQIVIAYEPVWAIGTGKTATPDDAQEVCGAIRARLTEKFGADVAEAVRIQYGGSVKAANIAQIMAQPDVDGALVGGASLDAEEFASIVRFPEHVAR

SEQ ID NO: 9229 - protein, 398 aa, Actinoplanes utahensis
MKTLDDLLGEGVSGRRVFVRADLNVPFDKSNPGVISDDGRARAVLPTLIALRDAGAKVIVASHLGRPKGAPDPKYTLAPVAARLGELLGSDVLFAEDTVGPSASAAVQALQDGQVLLLENLRFNEGETAKDDAVRGAFADQLAAFADFYVDDAFGAVHRKHASVYDVAARLPHFAGGLVVKEVEVLRKVSETPEKPYVVVLGGSKVSDKLAVIQALLPKVDKLLVGGGMCFTFLKAQGHEVGKSLLEDEMVAVCADLLEQAQGRIVLPVDVVAATEFSADAQHDVVAASAIPADRLGLDIGPKSTELFASAIAGAKTVFWNGPMGVFELAPFAAGTRGVAEAITKIDGFSVVGGGDSAAAVRTLGLDETAFGHISTGGGASLEYLEGKTLPGVAALEK

SEQ ID NO: 9230 - protein, 333 aa, Actinoplanes utahensis
MTIRVGINGFGRIGRNFFRAALASGADIQIVGVNDLTDNATLAHLLKYDSILGRLPHEVKATADEITVGGNTFKAFAERDPNNLPWGDLGADVVIESTGFFTDATKAKAHIDKGAKKVIISAPAKNEDITIVMGVNDGLYDAAKHTIISNASCTTNCLAPMAKVLNDTIGIEKGLMTTIHAYTQDQNLQDGPHSDLRRARAAALNIVPTSTGAAKAVSLVLPELKGKLDGFALRVPIPTGSATDLTFTAARDTTVDEVNAAIKAAAEGALKGILVYTEDPIVSADIVTDPASCIFDAGLTKVIGGNQVKVVGWYDNEWGYSNRLVNLVQLVGA

SEQ ID NO: 9231 - protein, 326 aa, Actinoplanes utahensis
MAMTAAVKDELSRVDVPKPCCRRAEMASLLRFAGGLHIVSGRVVVEAELDTGAVARRLRREIADVYGYPSEVHVLASGGLRKGSHYIVRIVKDGEALARQTGLLDVRGRPVRGLPPHVVSANVCCAVAAWRGAFMAHGSLTEPGRSSALEITCPGPEAALALRGAARRIGITAKEREVRGVDRVVIKDGDAIAALLTRIGAHSSVLAWEERRVRREVRATANRLANFDDANLRRSARAAVAAAARVTRALEILAEDAPNHLTSAGRLRLEHRQASLEELGALADPPLTKDAIAGRIRRLLALADKRARDLGIPDTEAAVTPEMMAC

SEQ ID NO: 9232 - protein, 361 aa, Actinoplanes utahensis
MTARPVRVVAFGGGHGLGASLRALRHTAAELPLDITAIVTVGDDGGSSGRLRVERDALLPPGDLRQALAALADGHPTSQLTATLMQHRFAAMPEPAAATGVRNDAGPSRAAVEALPPVVRGPRLERRADRSKDTLAGHTVGNLLLLGLMELLGDPVRALDHAAAMVGAHGRVLPMALHAVGIEADVIGADPARPDETVTIRGQHSVAVSGGRVTGVRLEPADPPACPQAVAAVLAADWLIFGPGSWYTSVLPHLLVPGLARAIVASPARRLVTLNLGTDKETHGLSAAGHLTTLHRCLPELRVDTVLADVKWAGEPEPVRVAAREMGADLVLAPVAVADGSPRHDPEALGVALVPVLGAAR

SEQ ID NO: 9233 - protein, 304 aa, Actinoplanes utahensis
MTEAMPGFGADGVVDPDEAGTDLVVVTGLSGGGRSTVARALENVGFYVVDNLPQALMLEMAELAFAAGGAARRTAMVLDVRSRAFSTDLAGAVRALKERGFSPRVVFVDADDEVLIRRFESVRRSHPLQGDGRLADGIAAERKLLAEAREQADVIIDTSHLNVNQLRRRVEELFGGEDARKLRITVLSFGFKYGLPPDADYVLDARFLPNPFWVPELREHTGLEEGVSSYVLGQEGATDFVATYAGLIAATAPGFEREGKRYLTVAIGCTGGKHRSVAITEELTSRLSAMRLSAHASHRDLGRE

SEQ ID NO: 9234 - protein, 669 aa, Actinoplanes utahensis
MSVPGTTVVVVPDPSTYRPAPGTIPDAPGVYRFRDPSGRVIYVGKAKSLRNRLNSYFADVWSLHPRTQQMVTTAGAVDWVTVGTEVEALQLEFSWIKEFDPRFNVKYRDDKSYPFLAVTLNEEFPRLQVMRGAKRKGVRYFGPYSHAWAIRETLDLLLRVFPARTCSAGVFKRAGQIGRPCLLGYIGKCSAPCTGQVTAAEHRVIVDDFCDFMAGRTDAFVKRLERDMMAASEELEFERAARLRDDIAALRRAMEKQTVVLGDGTDADVVAFAEDPLEAAVQVFHVRDGRIRGQRGWVVEKVEDLSTGDLVHHFCTQMYGESAGETDVPRELLVPALPEDAEALADWLSARRGSRVSLRVPQRGDKVDLMATVARNAGEVLQRHKLRRAGDLTTRNKALEEIAEALGLESAPLRVECYDVSQNQGTDVVASMVVFEDGLARKSEYRRFAIRGNADGSGMDDLSAMSEVMRRRFARYRAQPGADAPRDEPEPPAEELGEATGELETADLPGIDPLTGKPRRFAYPPQLVVVDGGQPQVNAAAAVLADLGITDVALCGLAKRLEEVWLPGDDYPVILPRTSEGLYLLQRVRDEAHRFAITFHRQRRSKRMTESALDSVAGLGETRRKALLRHFGSVKRLAAATPEEIIEVPGVGRRTAEAVLAALNGPGGG

SEQ ID NO: 9235 - protein, 87 aa, Actinoplanes utahensis
MADVPSGGGIIQGDYVITQPKQGTFKAFTKICTHQGCEVSEVKNGTINCPCHGAKFSIEDGSVAGGPAPKPLAETKVKVDGDKIVAA

SEQ ID NO: 9236 - protein, 80 aa, Actinoplanes utahensis
MTSGADQVLEGRYMTDVQTGTGVDTQAEPAGPASTRRVVLLGAGGLGAAAVLSACGTSTTTTNPNGSDFAAEPAPAGLAS

SEQ ID NO: 9237 - protein, 1006 aa, Actinoplanes utahensis
MSYPVVRVACLLSNTCTERLVVADRLTIRGAREHNLRDVNLDLPRDAMIVFTGLSGSGKSSLAFDTIFAEGQRRYVESLSSYARQFLGQMDKPDVDFIEGLSPAVSIDQKSTSRNPRSTVGTITEVYDYLRLLFARTGIPHCPVCGERISRQTPQQIVDRVLAMPEGTRFMVLAPVVRGRKGEYVDLFAELQAKGYARARVDGVVHQLTEPPKLKKQEKHTIEVVVDRLSVKASSKQRLTDSVESALGLANGIVLLDFVDLAEDDPERERRFSEHLACPNDHPLAIEDLEPRVFSFNAPYGACPECSGLGTKKEVDPELIIPDEEKSLAEGAIQPWAGGTTQEYFLRLLEALAKAEGFKLDTPWRALPARAQKTILHGSEDQVHVRYRNKYGRERSYYTGFEGVVQWIERRHNDTESDWSRDKYEGYMRDVPCSVCGGARLKPEVLAVTVAGRSIAEVCNLSIGDCAELLAGLELDDRQKMIAERVLKEINARLRFLVDVGLEYLSLDRGAGTLSGGEAQRIRLATQIGSGLVGVLYVLDEPSIGLHQRDNHRLIETLVRLRDLGNTLIVVEHDEDTIRTADWIVDIGPGAGEHGGHIVHSGTVEGLLANEKSPTGAYLSGRRSIPLPATRRPQTAGREVVVHGAREHNLRNLTVPFPLGQFIAVTGVSGSGKSTLVNDILHTVMANQINGARQVPGRHIKVTGLEHVDKVVGVDQSPIGRTPRSNPATYTGVFDHVRKLFAETAEAKVRGYGPGRFSFNVKGGRCENCSGDGTIKIEMNFLPDVYVPCEVCKGARYNRETLEVHYKGKTISEVLQMPIEEAAEFFSALPAIHRHLRTLVDVGLGYVRLGQPATTLSGGEAQRVKLASELQKRSTGRTVYVLDEPTTGLHFEDIRKLLIVLNGLVDKGNTVITIEHNLDVIKTADWLIDMGPEGGSKGGLVLATGTPEELAEVPDSHTGQFLRHTLGLSGSGAGSPAAVARAAKANGEKAPAAKARATRSRAKAAV

SEQ ID NO: 9238 - protein, 608 aa, Actinoplanes utahensis
MSHPSGRIRPVRAVEEVAGKRDETVVTEARSGFGGWRRTDLWVLLSFLALAGLVMIQLWIDPNGRVLAGNRDDHGIFLFMLAHGERVVFHGAPLFFESHLNAPVGVNMMANTAILALSLPLAPVTHFLGGGFSVVFLITFGLFGTAAAWYWLFARHLVTSRRAAVLGAFWCGFAPAMISHASGHVNFVNQYLVPFIVWQVLRLREPGRAVRGGLILGLLLVLQIFINEETLLFTALTLGVFVVSWSLLRRDEARAVAGRFVAGLAVAAGTASALCAYPLWYQFFAAGNYHGQPFEPDKIVTDLLSIGAYPRQAVAGIGPVARRLSLSPTEDNTFFGPFGLVMIIVAMRMLWRSAAARSAAIAGLVLLVMSFGPRLQVAGFRTWIPMPFALISHLPVIDLVSVSRFAMVPATIAGILLALAVDRVGELTPVHRRRFWIGLTLALVPLIPKPLPVVAGDPLPPFLTAGIWKQYVPAGRTLVPVPLPEVTYGRTGQRWATLENLDFAVPGGYFMGPVNPPSDTTGSWRAPATFTNTILVQAQLTGRRPVLTGADRERIAADLAYWRAAVVVLVPQAKNVDVLRATLVDALGRPPQPVGGVEIWTVPAHPQE

SEQ ID NO: 9239 - protein, 343 aa, Actinoplanes utahensis
MSYDLSQLGWDELFVSAFRPYDRADSRPGRVLRADRGVSTVLTANGVTRASLGGNALLDAARDPSRLPCSGDWVVLRDWPDRRVTLELVLPRRTTLIRRTADKDSSGQVLAANMDTVAVVEPIFPEPGDARVERLLALAWESGADPVLVLTKSDTTRDPRAVARQLGELAPGVPVLPVSVQRGTGLEPLRELAGPGRTLALLGRSGAGKSTLANALAGASVMPVQAIRDADGKGRHTTAYRSLVTIPGGGGVIDTPGIRGVGLLDTGSGLERAFADVTELAGHCRFDDCGHESEPGCAVQAALGDGSLPPRRLASWRKLHREVVVQSRRRTVRLATAPRRRDR

SEQ ID NO: 9240 - protein, 233 aa, Actinoplanes utahensis
MTIDPLVLMTDVDQATDNLLRAAGELDDSAIGEPSALPGWTVGHVLTHLARNAEALTNLLTWARTGVETPAYASREARDAAIEAGAGRPLADQLADIRTAHERFADAAAAMPAEAWTFRYPSLMPSAAVVPWARLREVEVHHVDLGRGYTPADWSDAFALRLLREIAGDLPESAPPMVLHPAGVDHPLLIGSGDGPAIGGPTRSIAAWLAGRADGADLTVSPDGELPQPARWK

SEQ ID NO: 9241 - protein, 238 aa, Actinoplanes utahensis
MAGRPRRRRRPDRLPGRGAPATSEVEVTYDGTAPGTRDLGGGLTLRKVSVGPMDNNAYLLSAGGEQLLIDAANDAATLLDLAGPAGLATVVTTHQHQDHWFALDEVVKATGAASLAHEADAGPLPVVTRTLRDGDTVTVGGHELEVIHVVGHTPGSIVLALPEPGGGRVHLFTGDSLFPGGVGNTRGVKENFASLIEDVERRLFDRFPDDTWFYPGHGKDSTLGAERPHLPEWRRRGW

SEQ ID NO: 9242 - protein, 237 aa, Actinoplanes utahensis
MTTLRDQLADLAGSPGAPTTVQAEADLARGRAALRRRRILQSAAGSALVVAVAAAAVGFGSAGGPSGAGTPLAGGTTAAATSAPAGTAAFDLVSYTGKQPAGFSVDRVPAGWEVQGVTESSLTLAPVGAKPHNSAVPQGDVADSDPNSYVGKVAVMLQSVDEHGAMPGKPEKVSVGGREGFFAKRSDAGDGITLFVKQPNGINLEVQVWDGIHWSRDQIVAFTAGIHVNPNAKQGRG

SEQ ID NO: 9243 - protein, 170 aa, Actinoplanes utahensis
MRSERDEQFHRFVVSRRSGLVRTATLLTAGDAHLAEDLVQSVLTKLYVAWPAFQRADNPDGYLRRVLVNALTDERRRWWRRREESMADVPDVPAADPGGTGETTDGLRAALRQLPPRMRAALVFRYFYDLDVAATADALGCSEGTVKSQTARALDRLRAVIGPSLTTVQR

SEQ ID NO: 9244 - protein, 43 aa, Actinoplanes utahensis
MPGHGSRRFSGGAGRSPDGDGDEFAACFRRACNPGVAGTVREV

SEQ ID NO: 9245 - protein, 203 aa, Actinoplanes utahensis
MNLRHDPSRWGVPQQQPPVPAPGPLFPGWLEERLFDQRIVMLRGHLSSEASTSISAALLTLDAAGQAPIQLHVACPGGDLSAALAVVDVIDALVSPVHALVTAEAGGAALAVLTAADRRAGYRHARFKLSEPRAAGVTGTADEVAAAAGQHLRELEEVVVRLAELTGKPRSRIEDDLSGGRSLSATEALDYGLLDEVITPKAR

SEQ ID NO: 9246 - protein, 141 aa, Actinoplanes utahensis
MPPKKKTHEVTLALEAGNAAMVDLGKMLGPTGANMRAVKVEYDEATAKNRGEIIPVIVSVYEDRSHTLAYKTPPTSFLIRKTLGIQSGASNPLTQNVGTLSATQVREIAERKLPDLNANDLDAAIKIVAGTARSMGVKVAS

SEQ ID NO: 9247 - protein, 185 aa, Actinoplanes utahensis
MNNFEVSACSTKKGTAVAKTKVKAALKTAAGKTYWTHEAPQLKLNYPLVKAIAWHESGWQTNVFNCDGGQGLMQLMPDTVNMINGRFGVSYNVSNYQENATAGANYLAWLTRYMSQKAFDQDKVFDLSPGKCRTHSSWCLLNITIAAYQAGPDAVLQNLKTKKLPNPAYVDSVRSLMADCFCDKY

SEQ ID NO: 9248 - protein, 762 aa, Actinoplanes utahensis
MEQADTSKLFTSSGGVAALVVGFLVGVAVGGVGEGVVSAGSGLLCSGAGESDGTDCATGALPADFWSSPPPNRPQPAVIASIATTANKRTFIDVVLPVGISMKTLTVAISLHGAREYLKKFSRPPDMTPCHDRQPGPGTMGAMQTRTDLRNVAIIAHVDHGKTTLVDAMLRQGGQSHARGEMAERAMDSMDLEREKGITILAKNTAISYQPAEGDPVVINIIDTPGHADFGGEVERGLTMVDGVVLLVDASEGPLPQTRFVLRKALSAKLPIILVINKVDRPDARIKEVVDDTYALFFDLDADEDQIEFPIVYACARDGIASLNQPADGAVPSDSADLEPLFSTILNTIPAPTYTEGAPLQAHVVNLDASPFLGRLALCRVHQGTIRKGQTVAWCKTDGTIANVRISELLITEGLERKPAESAGPGDIMAVAGIPEIMIGETLADAENPIPLPLITVDEPAISMVIGTNTSPLVGKVKGAKVTARMVKDRLDKELIGNVSLRVLPTERPDAWEVQGRGELALAILVEQMRRESYELTVGKPQVVTKVIDGKVHEPVERLTIDAPDEYMGAITTLLATRKGRMEHLTNHGTGWLRMEWLVPARGLIGFRTEFLTETRGTGIMHHLYEDHEPWFGDLRTRQNGSLVADRAGAVTPFAMINIQERGQLFVEPTTEVYEGMIVGENSREDDMDVNITKEKKLTNMRAASADNTEKVIPPRRLSLEQSLEFCREDECVEVTPNAIRIRKVVLDQTARARTAARRKHQ

SEQ ID NO: 9249 - protein, 333 aa, Actinoplanes utahensis
MNVSAWIWFATLVALVAVLAVDLLIIGRRPHEPTMKEAGGWVAFYVAFALLFGVGVWAVSGGRAAGEFYTGWLTEYSLSVDNLFVFVIIMGRFAVPRRFQQKVLLIGIVLALVMRGAFIAAGAALISQFSWVFYIFGAFLVYTAVTLVKGGEGDEDEFKENLLIRWAKRALPLSSSFGDGQFRVVTAAGKRLFTPMLIVMIAIGTTDLIFALDSIPAIFGITKEPYLVFTANVFALMGLRQLFFLLGGLLERLVYLNVGLAVVLAFIGVKLFLEALHTNSLSFINGGDGLHWAPEIPIWLSLLVILGTLGAATVASLAKSARDRKSDLITAGR

SEQ ID NO: 9250 - protein, 110 aa, Actinoplanes utahensis
MILEVTLIDILPGREDDFAAAYQLARPLIAGAEGCHGLRLKRGHESSNRFLLLVEWDSMDAHDHNFRRTERFAQWRASIAATLAQPPLTEYFTDLPALAGRPDADHDFFA

SEQ ID NO: 9251 - protein, 90 aa, Actinoplanes utahensis
MRRRSRSRPWSPWEGTAGVVDSTGRVTIRPVGVGTASACWVPAAGIRTEPYLPALPALPALPVLPVLPVLPVLPVLPVLPVLPVLPVLAS

SEQ ID NO: 9252 - protein, 701 aa, Actinoplanes utahensis
MALDIPRLDGRFEVVSDYQPAGDQPAAIDELERRVRRGDRHTVLLGATGTGKSATTAWLIERLQRPALVLAPNKTLCAQLAKEFRELLPHNAVEYFVSYYDYYQPEAYIAQSDTYIEKDSSVNEEVERLRHSATMSLLTRRDTIVVATVSAIYGLGTPQEYIERAVKVKVGGEIDRDKLLRRLVDIQYTRNDVAFQRGTFRVRGDTLEIIPAYEELAVRVELFGDEVEKLYYLHPLTGEVIREVDELIIFPATHYVAGPERMERAIRDIEAELADRLAEFERQGKLLEAQRLRMRTTYDIEMMRQVGFCNGIENYSMHMDGRTFGEPAYTLLDYFPDDFITVIDESHVSIPQIGGMYEGDASRKRILIEHGFRLPSAADNRPLRFDEFLERVGQMVFLSATPGNWEMEQAQGEFVEQVIRPTGLVDPQVVVKPTKGQIDDLMHEIKLRTERDERVLVTTLTKKMAEDLTDYLLENGIRVRYLHSEVDTLRRVELLKELRKGDYDVLVGINLLREGLDLPEVSLVAILDADKEGFLRSGRSLIQTIGRAARNVSGEVHMYADKITPSMRDAIDETDRRRAKQIAHNEANGIKPQALRKKIHDILDDIYREAEDTDSAIVGGAGRQMSRGKAPVPETRSKARAGNGPAREGMARAELAQLIQDLNEQMLGAARELQFELAARIRDEVSELKKELRGMDAAGVK

SEQ ID NO: 9253 - protein, 401 aa, Actinoplanes utahensis
MLRVGLTGGIGAGKSAVSARLAELGAVIIDADRLAREVVAPGTDGLAEIVAAFGDGILGADGGLDRPALGAKVFGDEPARRRLEQIIHPRVRARTAEMIEEAPAGAIVVNDVPLLVETGLAPTYHLVVVVTANREVRIGRLVRDRGMSAAEAAARIGAQADDATRQAAADVILPNEDDLAALRARVDALWRDRLLPFERNVRAGTAARKAPELHIVPPDPGWPQAAERLITRIRHQLGDADVRHIGSTAVPGLPAKDIIDLMLSVRTLDEADALAGRLAAAGFPARSGEWADNARGLPGQTWPKRVHGSSDPGRPVILHVRVAGSPGWRFALLMRDHLRAVPAARDAYAAAKAELALRFPDRAGYAAAKEPWFDEEAAAAEAWATATGWQPAAGESSPRAD

SEQ ID NO: 9254 - protein, 500 aa, Actinoplanes utahensis
MTSSIEATSSANKVTVDDLGSEEAFLAAIDETIKYFNDGDIVEGTVVKVDRDEVLLDIGYKTEGVIPSRELSIKHDVDPAEVVSVGDHIEALVLTKEDKEGRLILSKKRAQYERAWGTIEKIKEDDGVVRGSVIEVVKGGLILDIGLRGFLPASLVEMRRVRDLQPYVGRELEAKIIELDKNRNNVVLSRRAWLEQTQSEVRTEFLNKLQKGQVRKGVVSSIVNFGAFVDLGGVDGLVHVSELSWKHIDHPSEVVEVGQEVEVEVLDVDLDRERVSLSLKATQEDPWRQFARTHAINQIVPGKVTKLVPFGAFVRVDDGIEGLVHISELAERHVELPEQVVQVGSDVLVKVIDIDLERRRISLSLKQANEGFVEGEEHFDPTLYGMAATYDAEGNYIYPEGFDPETGEWLEGFEKQRETWEKQYADARERWEAHTKQVQASRDADAEAALNPAPAGGVTTSSSTSSSTSTPARSAEEPAGTLATDEALAALREKLAGGKN

SEQ ID NO: 9255 - protein, 278 aa, Actinoplanes utahensis
MTEIPTIEKAASARPAADERSRAFEDETRHANRSWWDLDADDYQDEHGAFLGDVDFVWCPERLREADAGLLGDVHGRKVLELGAGAAAGARWLRRQGAEVAAMDLSAGMLRHARAAAARSGVEVPLVQADALALPFRDGAFDIVCTAFGAIPFVADSAAAMREVARVLRPGGSWVFSVTHPMRWIFWDEPGEDGLVARNSYFNRSPYVERGDDGRMTYLEQHRTLGDRIRELVAAGFVLRDLVEPEWPEGHEGIWGQWSPLRGRLFPGTAIFVCDLPG

SEQ ID NO: 9256 - protein, 70 aa, Actinoplanes utahensis
MAEENLKKGDKVTWRSHGETVHGQVEQKITKRTEAAGRTVAASSDDPQYRVRSDKTGRDAVHKPGSLHRG

SEQ ID NO: 9257 - protein, 107 aa, Actinoplanes utahensis
MADLYADFRAAVTMTPAALRTWLGTEESKEVGQKSSAGAESVGHDSGRRILRLLEKKKSELTADDEEHMRKVVGYVHRHLAQRPAGDVRETKWRYSLMNWGHDPLRD

SEQ ID NO: 9258 - protein, 131 aa, Actinoplanes utahensis
MSMEQTVITAVPRPAGGLGIEFDDAILIEGPGLAAAPLEAPRATAFAAMFKALGDPVRLRLLSMIASAPDGEACVCDLSSAFHLTGPTISHHLRILREAGLVDSDRRGTWVYYRAVPATLILLAGLLQPAS

SEQ ID NO: 9259 - protein, 899 aa, Actinoplanes utahensis
MSDDATTPRLLLLDGHSLAYRAYHALPVDNFSTVTGQATNAVFGFTSMLINMLRDEKPTHIVVSFDLSRKSFRTERYAEYKAGRSETPAPFQGQVSLIQEVLQALRIPVVTKENYEADDVIATLATQARAAGMEVLISSGDRDAFQLADEHVTILYPVRGVSEVWRMTPEAIEAKYFVPPSRYRDKAALVGESSDNLIGVPGVGDKTAAKWINEYGGLDGVIAQADKIKGKAGESLRAHLADVIRNYDLNALVCDLELPLRPEDVRWTGWDREAVHQVFDALEFRVLRERLYSYLEAVEPEAESGFDLEARVLRAGEVAGWLTEHAAAAPVGVAVTGAFGRGTGQVTGIAVATGSGPAAWFDPAALDEADEQAVAAWLADPARPKVIHDAKPALLAFRAHGWELAGVTTDTALAAYLAKPDQRGYDLTDLALRYLKRELKVDAPDNGGQLALSFGDEAEDTAAEEGVMLRARATLDLADVLIAELSQDGGESQRLLAEVEQPLSVVLAEMEGKGIAADTEYLSELESTFGAEVKAAQQAAHEVHGREFNLGSPKQLQEILFVERNLPKTKKIKSGYTTDADALQDLFAKTEDPLLAHLLRYRDMAKLKSTVDGLLKSVSDDGRIHTTFNQTVAATGRLSSTDPNLQNIPIRTEEGRRIRRAFVVGGGFEQLMTADYSQIEMRIMAHLSEDAALIAAFNSGADFHAVTASSVFQVELGEVTADQRRKIKAMNYGLAYGLSSYGLSNQLTISNDEAKTLMEEYFQRFGGVRDYLQSVVAQAGKDGYTATILGRRRYLPDLSSDNRQRREMAQRMALNAPIQGSAADIIKVAMLKVDAALRASGLTSRMLLQVHDELVFEVAPGEREPLEELVRREMGGAYPLAVPLEVSVGTGRDWNGADH

SEQ ID NO: 9260 - protein, 253 aa, Actinoplanes utahensis
MTEMVRAENVHKSFGALEVLKGVDLVVPQGGVSCVLGPSGSGKSTFLRCINHLEKLNAGRILVDGELVGYRERGGKLHELGEREVARQRQSIGMVFQRFNLFPHMTVLDNVMEAPCRVKGENKGEVRERALSLLDRVGLAAKVGNYPGQLSGGQQQRVAIARALAMRPKVMLFDEPTSALDPELVGEVLEVMKGLARDGMTMVVVTHEIGFAREVADEVVFMDGGVVVEKGAPAEVITNPQQERTKAFLSKVL

SEQ ID NO: 9261 - protein, 335 aa, Actinoplanes utahensis
MTQATESERARPAAIKAVPVRHPGRWAAIVVLMVLVAMFLHLIITNHAFNWSFIFSSYAPGKRGVMFTEPVLEGLRGTILLTILSMLIGVTLGVVIAIMRLSPNKVLSSVAWAYTWFFRAAPRLVLAVIFGNLNILWSRIGFGLPFDRQIGRLFGIDNFDGQFFSIRSVDLLAGFVAGMIALGLSEAAYMAEIVRAGIQSIDTGQSEAAVALGMSRGQVLRRVVLPQAMRVIVPPTGNEVIAMVKDTSLVAYVPVAGELFFQLTQVEARTFIVLPCLVAALIWYLIICSVLMIVQFFVERHFGKGYGAAGQARQRLRDIQVEQGGRMTVTGEGAP

SEQ ID NO: 9262 - protein, 300 aa, Actinoplanes utahensis
MFRITPGRRAILGVAVAAALTVSLSACGKETDTSSGSAAAPSASTDTSLAGKVPADIKAAGKLVIGTDSSYAPSEFLDTDGKTVTGFDVDLFNAVGQKLGLTTEWQSATFDSIIPGVSSGKYTVGVSSFTINPDRLKVVNMISYFSAGTQWAAKAGSTLSLDDACGKKIAVQTATVQVDDLTARSKKCTTAGKAKITVDQYQKQSDATNAVVTGKDEAMLADSPVVAYAVKQTNGQLALLGDIYDSAPYGYVVDKKQTEFANVIAEAVKSLIADGTYKTILDKWGVAAGGITTPAVNPAS

SEQ ID NO: 9263 - protein, 236 aa, Actinoplanes utahensis
MLLELKDITLLYGRIQALHGISLTVGQGEIVALIGANGAGKSTTMRAISGLRPVAQGSIMFDGEDITKLRADLRVVRGVSQSPEGRGVFPGMTVRENLEMGAYTRRNRAEINEDMERAFTLFPRLKEREKQVSGTMSGGEQQMLAVGRALMSRPKLLLLDEPSMGLAPMLIQQIFDIIVEINQQGTTVLLVEQNAQQALSRAHRAYVLETGRIVKQGTGQELLHDPAVKDAYLGVA

SEQ ID NO: 9264 - protein, 289 aa, Actinoplanes utahensis
MSEPHIETPEEADRANSEPVSFSKPDPDVKPAGDVLLEMDDVTLRFGGVVALNGISFALRRGEIFGLIGPNGAGKTTCFNAMTGVYSPTSGQIRFQGQSLIGKKKHEITRGGIARTFQNVRLFPEMTALENVMVGADAHFKTSVLSALFRLPRFWREEREGRAKSLELLRFVGIAHRAGEVSRNLSYGEQRRLEIARALATNPTLLCLDEPAAGFNPAEKEDLLNLIRKIRDSGVTVLLIEHDMRLVMGVTDRIVVLEFGKKIAEGTPAEVRDNPAVIAAYLGVPTDAA

SEQ ID NO: 9265 - protein, 375 aa, Actinoplanes utahensis
MSAVADKPVTGTPKPSRQLRGWLGRQPAPVRWAVILGFVVLAYLLPYVDRIPGIGPQIVTTGVDWPTALFEMSYYVLLALGLNVVVGFAGLLDLGYVGFFAVGAYVTALLTSPDSVLHTQYGWLVAIPASLAVTMLAGVLLGWPTLRLRGDYLAIVTLGFAEIIRIIATSATWARGDRGFSSIPHPPGKLSDGSPLFGVTDAIPYFWLGLSVVILVVLGVRNLDRSRVGRSWLAIREDEEAAEIMGVRTIKFKLWAFAIGAFIGGLGGVLFSGETGFINSQTFVLQFSILVLAGVVMGGSGNIAGAILGGALISYIPNRLRGIQDPVFHTDLYEYRFALFGAMIILIMVVRPQGLIPSRRRAMELKDREKEAAPQ

SEQ ID NO: 9266 - protein, 316 aa, Actinoplanes utahensis
MNVSGLIQNFGPLTITGLAQGAIIALFALGYTLVYGVLRLINFAHSEVFLLGTYACLIVWGWLGLDQNSATPSVGGVLLYLVIGLVVAIVASGLTALAVELVAYRPLRKRNAPPLAFLITAIGASLVISEVVGVATHRNPRGVPPLIQPKDVISIGNTHITNLQLLIIGLALVMMFLLDRFINTSRLGRGIRAVAQNPDSAALMGVNKSRVIALVFLLGGLMAGIAAVMYDLKIGVTKYDAGFLLGIEAFTAAVLGGIGNLRGALLGGLLLGLLQNYAAGLFGTQWLHLASFVALVLILLFRPTGLLGESLGRARA

SEQ ID NO: 9267 - protein, 393 aa, Actinoplanes utahensis
MRRVPTLKQVLARAIGGVALIGLLAGTAACNKDTSSDTASGSNCGYKLAFFGALTGSAANLGVNIEHGFELAVNQYNEKKGSTCITVEKFDSQGAAEVAPGVARKLVTDKKILGIVGPPFSGESEAADPIFQEAGIPTITPSATRTSLSTKNWKIFHRAVANDDAQGPAAASYIKDVLKAQKVFVADDQSAYGAGLADVVKTKLGSLVVQSDKTEGDGKQADFSALVQKVTSSGATAFFYGGYYTNAGLIRKQLTGAGWKGTLLGGDGMKDPGLAKASGNAAAVGTVVTCPCSPPEQAGQDFNNAYKTKWGEAAGTYSDVAFDAANILLQGIDAGNTTADKLNTYLSTVNYKGIANTYKWTDKGELDPTLIKVWAFKFDESGDTKADQEIKAS

SEQ ID NO: 9268 - protein, 206 aa, Actinoplanes utahensis
MADTQAGAERRRVLIAEDEALIRLDLAEMLVEEGYDVVGEAGDGETAVRLAEELKPDLVILDIKMPIMDGLAAAERIAGGRIAPVVILTAFSQRDLVERARAAGAMAYLVKPFQKSDLVPAIEIALSRYSEIAALESEVAGLTDRLETRKSVERAKGELMTKYAMTEPQAFKWIQRTAMDHRMTMREVADRILAEGQESGGAPQPS

SEQ ID NO: 9269 - protein, 280 aa, Actinoplanes utahensis
MLWSGSSPLTAARAGMWGFLMFAGAAWLVVGWSVLRLEPTDLARVAGPIVLFGAVCEGLRALAGTRTWWLNAVLTVLFAATGTVMLLSDDTGWTTTASLIGWYLLVRGAVDVAVGIMTRGVDRVWSLVVTVGVLETALGFLAASPLARGAQTIVVILGALGVLRAIADLVTALRLREIAAKGRDLLELPPERATGLTGYSAGHADYEGPKHRARQGATESFHDQVVRTTADLDRMLAEAGITGPRVPKKKAPDIQDLPPAPDTLEGIENAAAPEKSAGGH

SEQ ID NO: 9270 - protein, 293 aa, Actinoplanes utahensis
MTQQPLQGQAAVDQLLEILDLKQVDAATFTGDSPQTGAQRVFGGQVAGQALVAAGRTVDPARIVHSLHGYFVRPGDPTEPITFHVETIRDGRSFSVRRSTAQQYGKTIFFMSASFQALEDGLDHHEPAPSGVPAPEDVPTMRDWVARYPSRRAAFNASPQAVDVRYVGQPGWVPPGDRDAEPQQRVWMRIDGRLPDDPLIHACALTYASDLSLLDAVLSYHGEVWGPGGVVGASLDHALWFHRTFRADEWFLYDSASPSAGRSRGLASGRMFTRDGRHIASAVQEGLLRRVGA

SEQ ID NO: 9271 - protein, 479 aa, Actinoplanes utahensis
MAVTRRVKIVCTMGPATKSPERMLGLVEAGMNVARMNFSHDTRENHREMYELVRSAATQADRPVAILADLQGPKIRLGKFADGPHRWETGDRVVITSDDILGTKDRVSCTYTPLPLEVKAGDRLLIDDGKVAVEVTGVVDGKDIQCLVTEGGPVSNNKGVSLPNVAVSVPAMSDKDEEDLRFALKLGVDLVALSFVRSPEDIKLVHKVMDEEGRRVPVIAKVEKPEAVDHLEAIVLAFDGVMVARGDLGVELPLDQVPLVQKRAVQLCRENAKPVIVATQMLDSMIENSRPTRAEASDVANAVLDGADAVMLSGETSVGKYPVLTVSTMAKIVATTEGGGLGVARLQHDPKTHGGALTIAASQIARNIGAKALVAFSQTGDTVRRLARLHCDLPLYAFTPVSEVRNTLALSWGVETFLTDFVEHTDDMFRQVDAKMLGLGLAKPGEYVVVVAGSPPNAPGSTNTLRVHQLGSLVDPSAV

SEQ ID NO: 9272 - protein, 489 aa, Actinoplanes utahensis
MPDPNGFLRYERQLPRRRPVPVRIMDWKEVYPPAGEELIRDQATRCMDCGIPFCHDGCPLGNRIPDWNDLVRTGAWDAAIESLHATNNFPEFTGRLCPAPCEAACVLGIADDPVTIKQVEVEIANHAFARGLVPQPAPAASGKSVAVVGSGPAGLAAAQQLARAGHAVTVYERDDRIGGLLRYGIPDFKIEKHVIDERLAQMSAEGVEFQTGVEVGVDITADDLRERYDAVLLAAGALAGRDTPETPGRHLNGVHLAMDHLVPANRIVAGLQDTTPIDAKGKHVIIIGGGDTGADCLGVAHRQGAASVTQLDQYPLPPEFRTGVKDPWPTWPVILRNYAAHEEGGDRVFGVAVQEFVGDADGNLVAIRLAEVSVRRIDGVRTVSVVPGSERELRADLVLLAIGFEGTEDQPLLAQFGLTRNRRNVLDADAGWQTGAEGVFVAGDMHKGASLIVWAIAEGRSAASAIHDYLGSAGELPAPVRSDQQPLSV

SEQ ID NO: 9273 - protein, 1509 aa, Actinoplanes utahensis
MYDPAFERDACGVAFVADIHGRRSHDVVAKGLSALIRLDHRGARGAEQNTGDGAGIMIQVPDEFYRAVTDFDLPEAGAYATGLAFLPTDPDEAARAIKVFEKYALVEGGDLLGWRDVPVNPADLGATAEDARPAIRQVFLAAHRLVDSPAGRAGERLTGIELDRVAFCIRKQAERESSQRGVAAYFPSLSSRTITFKGMLTPEQLPEFFPDLTDERVTSAIALVHSRFSTNTFPSWPLAHPYRLIAHNGEINTIRGNKNWMAAREALLSTPNLPGNIKRLFPINSPEASDSASFDEVLELLHLGGRSLPHAMLMMIPEAWENDPGMDPARRAFYRFHASLMEPWDGPAAVAFTDGTVIGAVLDRNGLRPGRWWHTRDGLVVLGSEAGVIDLDPADVVAKGRLQPGKMFLVDTAAGRIAHDDEIKAELAAAEPYAEWLHAGLIELADLPPREHVIYTHDSVLRRQQVFGYSEEELKILVGPMARSGAEPLGSMGTDTPISPLSSRPRLLFDYFHQLFAQVTNPPLDAIREELVTSLGTTIGPEANLLKPGPASCRQVVLPYPVIDNDELAKLLSIDEDGDLPGFKAVRVSGLYPLRDGAAGIKARLTQICRHVSEAIEDGVRILVLSDRDSNADLAPIPSLLLTAAVHQHLVREQTRTQVALVVESGDCREVHHAAVLIGFGAAAVNPYLAFESVDDLIATGALAGIEARKAVRNYVKALGKGVLKIMSKMGISTVSSYCGAQVFEAVGLDNKLLQRYFAGTSGRIGGVGLAEIHAEVKARHEKAYPANPAERAHRRLEVGGEYQWRREGEIHLFNPETVFLLQHATRSKQYDVFKRYTSKVDELAGAAGSLRGLFRFDSDRTPVPIDEVEPAAEIVKRFSTGAMSYGSISAESHETLAIAMNRLGAKSNTGEGGEDVERLYDPERRSAIKQIASGRFGVTSEYLVNADDLQIKMAQGAKPGEGGQLPGNKVWPWIAKTRHATPGVGLISPPPHHDIYSIEDLAQLVHDLKMVNPASRVHVKLVSEIGVGTVAAGVAKLKADVILISGHDGGTGASPLNSLKHAGTPWELGLAEAQQTLLLNKLRDRVTVQVDGQLKTGRDVVVAALLGAEEFGFATAPLIVSGCIMMRVCHLDTCPVGIATQNPVLRERFTGKPEFVENFFLFLAEEVRELLAELGFRSIEEAIGHAEILNVTEAIDHWKAKGLDLAPILYVPELPENAARRGVVAQDHGLEKALDNELIALAQPALIKGKPVRAALRTRNDQRSVGAMLGGEVSRRYGGNGLPDDTIEFTLRGTGGQSFGAFLPRGVTLRLIGDSNDYVAKGLSGGRVIVRPAEDAPFTAEDNTIAGNTILYGATAGELFLRGRVGERFAVRNSGGAAVVEGVGDHGCEYMTGGTVVVLGPIGRNFAAGMSGGKAFVLDLFQDLVNPELVDLAPLTDEERDTLRSLVEKHHAETESAVAERLLKDWPAAVERFTAVVPRDYKRVMELIRTAEAAGHNVDEAVMGVTGA

SEQ ID NO: 9274 - protein, 289 aa, Actinoplanes utahensis
MARAESDHFDRLEQFYDALPRPWARTEEIGSLVLFVRDGEGWPYYARPRRGAPTPSAADLTAARARQRELGVPESFEWVHETTPDLLAVARSAGLEVLLAPLLSLDPQALVPDLPVPGATIRLLDPDDPDLAARLAASRAVARLAFAAPAYRTPAEVALVIDGAGGTERDAAAGLGVSEEQVRQTREMLAGGDYEMAVVESPAEGTLATGISQRVGDVAEIAGVATLPAARGRGYASQLTATLARNLLGRGVELVFLSAGDDDVARLYTRVGFRRIGTACIAEPAAAPL

SEQ ID NO: 9275 - protein, 314 aa, Actinoplanes utahensis
MPPRQRTGAGGPAPAVAHLEDLYDALVAGLGDTEIRTGFEVTTVRTGPRDRPAVGDGRTLIEADLLVAADGIDSRIRAALAPESVAVGSGFAAWQAVIPGYRVPRLIGGRALGGETLGAGYRFVSIPLGAHAAGKGGIYWVATAAGAARPEPPATQLALLQRWFAGWHEPVGELLSLTRPEELVPQGVRELRPLPRTYAFPSGPGGVLLIGDAAHAMPHHLGQGACLAFEDAATLRALLADAAPGEALLRAMAGYTRLRQPRTTTVVRQNRRMSAVVQARGRLALRARDAALNHMRPRILGRTLDPVSDWSPPD

SEQ ID NO: 9276 - protein, 68 aa, Actinoplanes utahensis
MRTAVVVGAGPAGLATAGALARTGWQVTLVERAERIAAPPTAVVLWPNGRRALDSLDPDGAWSASAAP

SEQ ID NO: 9277 - protein, 398 aa, Actinoplanes utahensis
MNFALIPSPTTSVWHLGPLPIRAYALCIIAGMVVSTLLMEQRLRHRGVAPWVSLDLVVWAVPFGIIGARIYHLITSPQDYFGSGGDPVRALYIWEGGLGIWGAVAGGALGAWIAARQIGLPLSIFADSLAPALPIAQAIGRFGNWFNNELYGKVTTAPWGLQVHEMDSANPGHASQVDGQPITLPDLYHPTFLYEAIWDLGVGGLVWLLDRRFKFGRGRAFALYVMAYTAGRCWIEALRTDEANHFFGIRLNVFTSIVVFLGALIYFIVVRGPRAYAVPIDAPDTEPVAAAPAASAAEGGVSTVDVDATPAVKKAPVAYQIVTEDRFRAYQETGVLPPETTAGHDDSAPQATPVVDRADEPASSAAPAAPVVDRADRSGEPEEPAGPVETADRPAGDR

SEQ ID NO: 9278 - protein, 217 aa, Actinoplanes utahensis
MGDIGWLLRSLPVMAGDLPRFDPGDTPDDPFQLFRCWLGAAVVAGVREPHTMFLSTVDEQARPDTRVVMLRDLDARGWQFVANRTSAKGRQLTANPAAALGLHWHEQGRQIRVRGTVVDLGPEAAAADFLGRPQGSRLATLNSAQSDVIADPADVGLAAAEAERLLAEHPDFVPASHVLYAVAPDSVEFWQGDASRRHVRLRYRRTSDGWHREQLWP

SEQ ID NO: 9279 - protein, 274 aa, Actinoplanes utahensis
MSGTVRIAETFAKARSEDRAVLVGCMPAGFPTIDYSIEQMIAMHEAGCDVIEVELPYSDPVMDGPVIQKASDIALAGGVRTRDTLKIIEAVASAGATVVLMTYWNPIEKYGVDAFARDLAAAGATGLITPDLIPDEAGDWIAASDRHRIDRTFLVAPSSTDERIAMTLGNCRGFVYATALMGVTGARKTVSSQAPDLVSRIRAIDPDLPVGVGLGVGNGAQAAEVAAFADGVIVGSALIRCVLEAPDRTAGLDRLRALSTELAEGVRGRFDAAS

SEQ ID NO: 9280 - protein, 413 aa, Actinoplanes utahensis
MTVPTLPDLAGHFGRYGGRFVPEALIKALDELEAAYRSAKVDEAFQAQFTDLLLNYAGTPSLLYRATRLSERLGADIWLKREDLNHTGAHKVRNVLGQALLAKRMGKPRVIAETGAGQHGVASATAAALLDLECVVYMGETDTERQALNVARMRMLGATVVPVTNGSRTLKDALNEALRDWVSTVETTHYLLGTAAGPHPFPEIVRDFVGGIGVEARQQCLDQIGRLPDAVAACVGGGSNAIGIFHAFVPDSAVRLYGFEAGGDGVETGRHAASITGGSVGVLHGNRTYLLQDEDGQTVESHSISAGLDYPGVGPEHAWLHDTGRASYEPVTDAEAMAAFQLLCRTEGIIPAIESSHALAGVAKIAPRLREELGRTPTIVVNLSGRGDKDVHTAGAYFGILDPVETVVPGENT

SEQ ID NO: 9281 - protein, 285 aa, Actinoplanes utahensis
MTSDQAEAGSGGPVRPQNVLEEILAGVREDVAARQARTPLEQVRELAAAAPPAIDAYAALRKPGVAVIAEVKRASPSKGALADIPDPAELAGEYAAGGARCISVLTEGRWFGGSLDDLDAVRAAVKIPVLRKDFVISSYQVHEARAHGADMVLLIVAALEQNALVGLLERIESLGMTALVEVHNEEEADRALEANAKVIGVNARDLRTLEVDRSVFERIAPGLPQNVVKIAESGVRGPHDLIRYASAGADAVLVGEGLVTQKSPRDAVAELVNAGNHPATPRPVR

SEQ ID NO: 9282 - protein, 92 aa, Actinoplanes utahensis
MATDQNGFAEVSRALVAIAADVVTGVQRVVVGPDNMRTARDNAWSAIEADRARAAARAETSRAVAAMLASGRTRRTVAATRHRTRQVAATVR

SEQ ID NO: 9283 - protein, 53 aa, Actinoplanes utahensis
MVAAGGVLAARHGHEWAAMSARYERKPQVSAVSAPDGNRAVWDALDRGDDPTA

SEQ ID NO: 9284 - protein, 502 aa, Actinoplanes utahensis
MTSGATLPDEAAFVRIHRRVVPVTRKLLADGETPVGVYTKLAGGPGTFLLESAEQGLAWSRYSFIGVRSAATLVERDGQAAWLGTPPDGVPLDGDPVAALRATVAALTGGAVPDAGLPPLTGGMVGYLSYDLVRRFERLPATAADDVPLPELGMMLATDLVVLDHHDGSALLVANAVLAEDASEADRRAAYHHAVGRLDAMTTALSRPTPPMVSTVERRPPGEPVSRTAPGDYQKAVEQAKEAIRAGECFQIVVAQRFERPTDANALDIYRVLRATNPSPYMYLLRFDDFDIVGSSPEAHLKVSANRTALLHPIAGTRWRGATPEQDAALAAELLADPKERAEHVMLVDLGRNDLGRVCEPGSVEVPEFARIERYSHVMHIVSTVVGRLRADRTAFDALAATFPAGTLSGAPKVRAMEIIEELEPTRRGLYGGTVGYFGFAGDMDMAIAIRTALVKDGVAYVGAGAGIVADSDPVAEEQETRNKAAAVLAAIAAAETRRAAR

SEQ ID NO: 9285 - protein, 121 aa, Actinoplanes utahensis
MIVSDAETSLDASIAARLKRTPDGLVAAIVQEHGTGEVLMLAWMDDEALHRTLTTGRATYWSRSRGEYWVKGATSGHHQRVRRVALDCDGDALLLTVEQTGAACHTGAHNCFFDELPREGQ

SEQ ID NO: 9286 - protein, 296 aa, Actinoplanes utahensis
MEPTSSPDNPRPAPGLARFWQVRPHPDSAAEIPVAAPTEHRRPVDPLELGLPTDLLTGASMAFSVRGASPFGPVAAADGPHGANGSAGEPGDPPAGDPFGLNRAASRGPGAARGDHSGRPPARSRHGDSDHSTPSDPEPEGTQDVESQEPAAGSPVRETSFGGFRLGGTGRFLFGGRTHDAQPGVNGHGPAEESSAAEETPGDAQVAEAPVDEESTGTAPEDEPADDAPPEAGQDTADAAERDENGREHMNGRAGAPGYAQAPDMPGPAEAPAADGPLDDAAEPHPAAGWASVPVP

SEQ ID NO: 9287 - protein, 42 aa, Actinoplanes utahensis
MVAGEPNAKLVSGAAGGWSTGVRLAGICGVAGVGGAAGGLAS

SEQ ID NO: 9288 - protein, 263 aa, Actinoplanes utahensis
MYGVASVTPAGPSAPQPGSVTPPPLEFQPFPESGLSGISVGTGRRGRTDDAPHGAPDGTPLDGTPLDGAADTTRGLADETLRGASGNAGRGLIDDVYRVPAPDAPRGLTDEALRSLADGELNRGLTDGEPGPAARRSASLEDAEPVRRPGRRAVPDTDDTGLDGAAGDEESAAVIRPTVWDEDAARHFRAAWHEVKAEFVDDPVNALTRAHDLLTDAVNELTEVLLAERDDLDPLRGTDTPDTESMRMAMRGYREFLERILSL

SEQ ID NO: 9289 - protein, 280 aa, Actinoplanes utahensis
MPSARDSFALGRELFNAVLLLRLALPNLGKPNRCPEVLVMQPSPAEIARTLAAGHLPAVAHIACHPGPLPVRHVTDAQGRPLLLVPAGSALAAALRPQPGNDDAALVLDIRDVPPMVTSPVIGRVWVSGWAARLDGDEERAAALDYADTDACGDLLDVGGTQAIYRLDVAEVRFERGGHLVEIDPDDYAAAAPDPLRAVEFDLIADLADHHSAEMGDYVRRQLGPAAHPGDEPRVVRMDRYGFVVRLNGRSARLAFPRPVSDRQDLAHLLHPILCRRCAA

SEQ ID NO: 9290 - protein, 226 aa, Actinoplanes utahensis
MTSTSGHRLGLPKLGKANRNRRTALNNSRPKAKLSRALGIPLTRKCVKYFERRPFPPGVHGRGRRKSSDYQVRLLEKQRLRHQYNISEVQMRAAYDAAHRAGGKTGENMVTLLERRLDATVYRAGLARTIYQARQLVVHGHFTVDGRKVDRPGYRVQPGQVIEVRESSRQKPPFQIAATGAHLDGPTAPYLSTALAELRTTVVRVPQRTEVPVLCDEQLVVEYYAR

SEQ ID NO: 9291 - protein, 587 aa, Actinoplanes utahensis
MSAEGTLATIRRGLALSPELRTGLGGTMVLALLQMAGRVAVPIAVQQGIDHGVRAPGGPDVGVVVRIVGLTLGALLISTLCGYLMTRRLFTVSETALGGLRSRTFRHVHDLSMLHQQSERRGSMVSRVTSDVDQISQFLQTGGVQLLLAAGQLLVSAAVMFAYSWQLALVVLLAFGPALGVSRLFQRRLRAVYQASRERTGVMLGAVAESVVGATVIRAYGVAGRTQARLDTSIDSLRVAQQKALRTSVTSFSSGEIGAGLALAGVVVTGVWLGVDGKLTVGQLTAFLFLVTLFIQPVQIATDMLNEAQNAVAGWRRILDVLDVEPDVADPDDRGVELPAGPLSVRFADVSFRYPGGPIVLAGVDLDLPARRKYAVVGETGSGKTTFAKLLTRLMDPAQGRVLLSGTPLTSVRFSSLRSRVVMVPQDGFLFDATIAENIRFAEPSLTDGQLTAAFAELGLGDWLAGLPAGLQTPVGERGEALSVGERQLVALVRAYVADPDLLVLDEATSAVDPATEVRLQHALDLVTRGRTTVAIAHRLSTAQAADEVIVVDAGRVVQRGPHARLVAEEGSTYAKLYASWLEQTRS

SEQ ID NO: 9292 - protein, 609 aa, Actinoplanes utahensis
MGSVRPETPANAYQSGRKLTSSASRDVLGRGLRVLGHAIRTEPRLFTVGTIGSSLFGLLIIANSYVVGWVIGHVVVPAFAEHRATASRLGLVAAIFLGVSALRVASIFGRRLGAGYMQFRLQARYRAAVTRRYLSLPPAWHQRHATGTLLSNANSDVEAAWAPIAPLPFAVGTVVMLAGALVSLFLTDWVLALVGATLFPALFGLNLVYSRRMSPRQIRVQQNRATVSAVAHESFDGALVVKTMGREADESRRFGVFVDELRDSLIAVGRLRGLFDPLMDSLPSLGTLAVLLLGTWRLRSGAIGVADLVSVAFLFTVLAFPVRAIGWVVGELPRSVAGWDRVQAVLGAEGDLAYGEGTLPGTGPAELRFDRVSYRYADGPEVLHDVSFTVPAGRTVALVGATGSGKSTIASLAVRLVDPESGTVAVDGVKLPDLALSALAGSTALVPQIPFVFDDTVRGNIALDRPEVDDTRVRTALELAQAARFVDGLPAGLDTPVGERGTSLSGGQRQRLTLARALAGKPRLLVLDDATSAVDPRVEAAVLGALRGADAGASILVVAYRRATIALADEVVYLNRGRVVATGTHTGLMAAHEGYRELVTAYEKAEERR

SEQ ID NO: 9293 - protein, 597 aa, Actinoplanes utahensis
MGAATAARRAPGRALAQRPTHRPGRPAPGRGAGRGDRRRVPAGAHRAGPAGPDHRGRRRARPVLLRAAAGRDGADRRRPGDRRTVAGRQARLLNWPTRNGPDWLSRRGQSGSRFKVMTARLSVSQGAALSIGAVLGTGLISLPALAAAAAGPAALVAWLALIVLSAPLAWTFAALGARYPDGGGVATYAGMAFGRRASAAVGWCFYFAVPLGAPVAAAFTGGYVAGAVGGGRTTEFVTFLGVVTAGYAMNWFGLRVSGRVQLVLTGTLATLLVVTVLAALPHLDLGNLHPFAPHGLAGIGSATALLVWGFAGWEALSSLSAEYRNPRRDVPRATMLAVAVVGVLYLAVAAVSVLALGPALAGSRAPLADLLAIGLGGPVRAITAVVSVVLTLGAVNAYYAGSSRLGVALAADGALPARVFGGRRRSLTFIYVASILCALLPLGLRTSALLVTGCFTLVYVFGTAAAVRLLPRGWSRAVAGVAFVAVCGLFWLNGWPALLSLVFAAGALIYRFAVDRAAGRAGTVRSGAGAAASRTDAGAGSAIGAAPDTHPASGARAGSEQFGQKCQALVDERGVDGAEAEDEARPVAAVPAQVVDR

SEQ ID NO: 9294 - protein, 547 aa, Actinoplanes utahensis
MRWARARSSPGTNWSSEQRDRGTGEQGHPHAAQQADRGHGQDHQGARPEQSTTDPHATSPSGGRLRLPGLSVSARLLPTGIPDCLYRSGVDLVIDGRTTAAVYRALRAAIADGRLPAGHRLPASRALAADLGVSRGSVAGAYERLAAEGHLTARVGAGTFVAVARTPRPAPRAVPDPLRPRAGWAFAPVLTSGSVPAPKYDFRIGIPDASLFPFDTWRRMVAAELRLRANGPGTYADPYGHPALRAAIARYLGYARSIRVTEDEVLVTNGVQHALDLIGRVLLRPGDTVAVEEPGYPPARALFASLGARVVGVPVDDAGLVVDRLPAHARIVYVTPSHQFPLGAVLSLDRRRQLLDWARRRQSAIVEDDYDSEFRFGSRPLEPLRALDRCGRVLYVGTFSKTMLPTIRTGFVLTPPGLRDALAAARQLGDGHGQVAMQAALARFIDEGQLARHVRRARREYAARHARIAGLLSDISGCEVLPSAAGLHVTVLMPRDQPDISEIAGKRGLAVDDLSRYGGDRPGLVLGFGAVDPALIDEGLALLAELL

SEQ ID NO: 9295 - protein, 638 aa, Actinoplanes utahensis
MPGCSSPATAIALLCGNNDVNVPRFSLRRRLMALEVPYRSIPDMLFQRVAKTPDAQAFAGPNATDTGMDWLTWRQVGERTRAIAAGLRELGVGLEDRVAILSSTRLEWILADLGINVAGAAATTVYPTTEPEDTAFIVSDSGSKVLIAENPKQALKISGAPTAITKVVLIDGPADAGATPPQITLAELEELGAAALRRDPELIERVIAELTPEHIATLIYTSGTTGRPKGVELLHRGWTWEGVAQNDLGLFNPDDLHYLWLPMSHAFGKTLLCGILHVGVPTYVDGRVDKLVDKLALIRPTLMCAAPRIFEKVYNKTVTSGLAGGGLKAKIFTWAVATGKRKVALEQAGKPVGAVLSAQYAVAEKLVFAKLQERLGGRLRVLVSGSAALSRDIAEFFAAANLPILEGYGMTEASAANFVNRNGRLKIGTVGEAIGDLEIRIDTDGEVLMRGAPVMRGYHNLPEATKEAFTDDGFLRTGDIGELDADGFLKITDRKKDLVKTSGGKFIAPSAIEGAFKAVCPYTSQAIVVGQSRNFVTMLITLDEDAIAVWAADGPLAGKTYAEIVAAPETHKLVEGYLAELNGKLNRWETVKKFAILPRDLSIEAGEITPSMKIKRRSVETNFADQIEKMYEGSLAQI

SEQ ID NO: 9296 - protein, 235 aa, Actinoplanes utahensis
MSLVRRVTPSALSTNLVRRVPQLLLGLFLYGASMALMIRSGLGLNPWDVFHQGLSERTGIEFGWIVLLVGIPVLLLWIPLRQRPGVGTIANVLLVGFSADAVLAVLPPGSGLPARIGLLVAGIVLNGVATGLYIGSRMGPGPRDGLMTGLARRFPRLSLRVIRTSIELLVLGAGFLLGGTVGVGTVAYALAIGPLVHLFLPKLTVGERRRTTSAARPPAASEAGRSPEQHTPVEA

SEQ ID NO: 9297 - protein, 484 aa, Actinoplanes utahensis
MTTSVRGDQLARLLGRWHSLPGRHRSPDYAALAAAVRGLLADGRLALGVRLPAERELAESLGVSRTTVSAAYRALRESGHLTSRRGAGSWTTLPHGHRVATSGLWTPDDDLDMIDMGVAASAAPVELVPAARAAADDLPRYLGSAGYHPTGLPELRAAVADIYTARGVPTSAEQVLVTSGTQQALDLVLRLSVPAGAPVLVETPTYPNALAALSARRARISTHGMDTATGWDGEMLLGALRQTRPRLAYLIPEFHNPTGHLMPAELRERLVATAHSTGTELVADESFVDLPLDDPAMPPPVAVFDRHSRVMSIGGMSKPYWGGLRIGWVRASAPMVQRLAAIRVGVDMASPVLEQLVAVHLLRLAPEIVAARRAQLRFRRDALVTALREQLPEWRFFVPGGGVTLWVEMDGPISSALSRAAEDVGVRLAPGPRFGLDGTLERFLRLPFTLPADDLTEAVRRIASVRHDLDRTPRPTWRTPAVIA

SEQ ID NO: 9298 - protein, 113 aa, Actinoplanes utahensis
MPIRTITVPVKDLDAARALYTRLLGVEPYADAPYYVGFRPDGGPELGLDPHGDVAAGPIVYWHVDDINAELTALIAGGGTEERPVHDVGGGTLIATFRDADGNLFGLHQGAAS

SEQ ID NO: 9299 - protein, 151 aa, Actinoplanes utahensis
MPAARHHCGMGAGGWNWNDAWIFVSAVIAERLERDRALHAALPVTGATLADLIAAADFLHHSVPARAELEESVRRLAGAGLITVADDIVQVAPAGEQLWRTRPFSGLSSAVMTLQTQLNRAASPGRSEWTLEESTYNAAVREYSLRLADGR

SEQ ID NO: 9300 - protein, 253 aa, Actinoplanes utahensis
MTVAVRVIPCLDVDAGRVVKGVNFVDLRDAGDPVELAAAYDAAGADELTFLDVTASSDDRGTMLDVVRRTAESVFIPLTVGGGVRSVANVDVLLRAGADKVGVNTAAINRPELISEIAERFGNQVLVLSLDVRRAAGQPSGWEVTTHGGRRSAGLDAVEWAARVAELGAGEILLNSMDADGTKAGFDLELIRAVRAVVDIPVIASGGAGAVEHFPPAVAAGADAVLAASVFHFGDLTIGEVKTSLRDAGNAVR

SEQ ID NO: 9301 - protein, 241 aa, Actinoplanes utahensis
MTLQLLPAVDVADGQAVRLVQGAAGSETAYGDPLEAALAWQNDGAEWIHLVDLDAAFGRGSNADLLAGVVARLDVKVELSGGIRDDESLTRALATGAQRVNIGTAALEDPEWCDRICGEYGDRVAIGLDVRGRTLSARGWTRDGGDLYEVLTRLDKAGAARYVVTDITKDGTMRGPNLDLLREVCAATDKPVIASGGVSTLDDLRALATLEPIGVEGVIAGKSLYAGAFTVREALDVLARA

SEQ ID NO: 9302 - protein, 106 aa, Actinoplanes utahensis
MSKERARRRAERLVVLEREKAARARKVARRQRRRALLNRLRLPRLGSDGRLYHRSRRQRIGIVLVPLIAIAAVWILIPDPALRILLTVLIVLAAPAMVVVALGRRS

SEQ ID NO: 9303 - protein, 206 aa, Actinoplanes utahensis
MAARVVILDYGSGNLRSAERAVARTGADVTVTSDLTLAAEADGLVVPGVGAYAACMAGIDDLGAGPVIAGRIAQGRPVLGICVGMQIMFESGVEHGVQTKGLGLLPGSVTRLHAARIPHMGWNTVTVPAGSRLLAGLAADTRFYFVHSYAAQDLGALGDAAVTTAAHDEPFAAVVERGALSVAQFHPEKSADAGFALLSNWVTALR

SEQ ID NO: 9304 - protein, 203 aa, Actinoplanes utahensis
MTRTGRIDRVTNETKVLVEIDLDGTGKGDLSTGVGFYDHMLNQLAKHGGFDLLVRTEGDLEIDAHHTMEDTAIALGEAFAQALGDKRGIRRYGSATIPMDEVLVRAAVDLSGRPYVVHDEPLLTPYIGPVYATSMTRHIFEAFGHAAKVTLHVDVLRACRPGGHPDAHHVVEAQFKAFSRALREAVEIDPRNAGSLPSTKGVL

SEQ ID NO: 9305 - protein, 359 aa, Actinoplanes utahensis
MTTIDDLPIRDDLRGKSPYGAPQLDVPVRLNTNENSYPVPADVAEAIAKAVQAELHDLNRYPDRDVIALRTELAAYLGHGLTMANVWAANGSNEVQQQILQAFGGPGRTALGFGPSYSMHPLLAQGTGTGWIGALRDPDFGLDPERAVAEIRRHDPDLVFVCSPNNPTGTTLDPAVLEAILGVARGMVVVDEAYTEFARPGTPSALTLLPGHPRLVISRTMSKAFGFAGGRLGYLAADPAVIDAVQLVRLPYHLSAISQAAARAAVVHRASLLATVEAIKEQRDRIVATLRSRGVRVADSDANFVLFATGDQDQRAAWQRFLDRGVLIRDVGLPGWLRVTAGTETETTAFLNAAEEILS

SEQ ID NO: 9306 - protein, 436 aa, Actinoplanes utahensis
MLNRIDLRGSRPDPRGLLPRAQLDVSVAVERIRPVVEAVHQHGFSAIREATERFDGVTLERLRVPAEAITAAADTLDPAVRAALLEAIRRARKVHADQRRTDTTTKVVDGGTVTERWVPVRRVGLYVPGGLAVYPSTVVMNVVPAQEAGVEGLVVASPPQADNGGLPDSRVLAACALLGVTEVYAVGGAQAIAMLGYGADGVDAGDRCEPVDVITGPGNIWVTAAKRLLRGTVGIDAEAGPTEIAILADETADPRHVAADLISQAEHDPLAASVLVTDSTALADAVDAELAARVPATKHAERVRIALTGEQSGVVLVDDLEQGLAVVDAYAAEHLEIQTRDAREWALRVRNAGAIFVGAWSPVSLGDYAAGSNHVLPTGGCARHSSGLSVQSFLRGIHVVEYDQAALRDVAGHVVALANAEDLPAHGEAVTARFGR

SEQ ID NO: 9307 - protein, 235 aa, Actinoplanes utahensis
MSDRLPVFPLSTVLFPGLVLPLHIFEERYRALVRELSARPAEPPAEFGVVTLRHGSEVAEGFGDGPVPDPAPVGAGDLFEVGCTAELRHVSELPDGRFDIMTVGRRRFRVLAVEQGTEPYLCARVEWLPAEDIPDPAADLLRPRVLAAFQRYLTLLRPSADILDQMPEDATVLSHLVAATAQLTVEERHALLAATDTVARLRAELRLLNREAGLLARVRAVPVPLSDLARPASPN

SEQ ID NO: 9308 - protein, 249 aa, Actinoplanes utahensis
MQPEDSVIVDQPPAGPSWWRPQRGGSHRSLRRTLATGLGSAAVIAALGAPVGLLWHTLAPRVEVVDAGSSGFLVTDPAEQFIAADGWLTLLGLGFGLLVAVLAWLVLRRDRGPALLLGVVAGAAAGIRWVAVPLGQMIGRADYTHWKATAAKGDTYLAPPQIHAHGPTLVAAFVAAIVLTLLAGWSNDPDLDSPGAQPGYGPNHGQYEAEPPGSAPFRAQQLSSDSPGAPDPTAAPAPPAPGPADQPRG

SEQ ID NO: 9309 - protein, 1176 aa, Actinoplanes utahensis
MSDSFVHLHVHTEYSMLDGAARVKELISEAKRLGMPAAAITDHGNMHGAYEMYTQSKAAGITPLIGVEAYVAPDSRLNKSRIKWGRPEQKSDDISGNGAYTHMTMWARNAVGLKNLFRLNSRASIEGQLGKYPRMDFDIIAEHAEGIMGTTGCPSGAVQTRLRLGQFDEALKSAAMYQEALGKDYYFLEIMDHGLSIEKRVRDGLLEIGRKLNIPPLVTNDSHYTFEAQAEAHDVLLCVQTGSNIADPNRFRFDGNGYFVKSAEQMRAVDSSEAWQQGCRNTLLVAEKVDIEGMFTFKNLMPRFPIPDGFSEEEYFRHVAFEGLRKRFPAGIPDTHVTQAEYELGVIISMGFPAYFLVVADFIQWAKNNGIAVGPGRGSAAGSLIAYAMGITDLDPLPHGLIFERFLNPERISMPDVDIDFDERRRAEVIRYVTEKWGDDKVAQIATFGTIKAKAAIKDSARVLGYPFAVGDRITKAMPPDVMGKGIPLSGIFDKEHKRYNEAGEIRQLYETDPDVKKVIDTARGIEGLIRQTGVHAAGVIMSAEPIIDHIPLMRRASDGVIITQFDYPTCETLGLLKMDFLGLRNLTIIDDANKNIELNHGAPLDLLALPLDDKPAYELLARGDTLGVFQLDGGPMRSLLRLMKPDNFEDISAVLALYRPGPMGVDSHTNYALRKNRLQEITPIHPELEEPLREILEPTYGLIVYQEQVQRAAQILAGYSLGQADLLRRAMGKKKKEILDKEFIPFRDGCREHGYSDEAIQAVWDVLVPFAGYAFNKAHSAAYGLVSYWTAYLKAHYPAEYMAGLLTSVGDDKDKMAVYLAECRRMGIQVLPPDVNQSAGPFTPVGRDIRFGLGAVRNVGGNVVEAIARCRKEKGEYTDFYDFLSKVDAVACNKRTIESLIKAGAFDSMGHSRKGLLAVHAEAIDAYAGVKRNEAAGQFDLFGAFGDSAGSSATVAMPTIPDSEWDKRDKLTFEREMLGLYVSDHPLAGLEQVLQSNADISIAALNEDGSVQDGQVVTIAGILTGVQRRITKQGRAWASATVEDLAGGVETLFFPNTYELIGQYIAEDAIVVVKGRVDRRDDTPRIMAMDMSIPDISHNPDSKPVVLTMPITRVTPPLVDELKDILVSHPGDTEVHVHLQNGKRTTVVRLVAARVAATPALRADLKMILGPAAVA

SEQ ID NO: 9310 - protein, 261 aa, Actinoplanes utahensis
MLRRTLGKPRVLAFANPKGGVHKTTATVLAAATIGSVRGRGVLAWDDNELRGTLGLRAGSARHARTIKHLLADLDRIEGLHGDALLQELDAYLRHASDGSYDVLAGEENPRFAQRLDQGTVRRVTDLLRRTHDVICVDTGNNVESVNWQTVMRMADQLVITTVPREDAAFTADWMLDVLEESGMGDMVANAVTLISCPSPGALPLLADFKKHFATRTRAVAVVPYDPALEVGSSIEYGDLQPETRQAWLRAASVMLEPFAE

SEQ ID NO: 9311 - protein, 173 aa, Actinoplanes utahensis
MDGTETGWGRPAEPAPRWRALLDRARHGHRAEEPADEPRADPAAVPQQWGQQQPPAPPTRASARPVNPLENRGYEGQRQAEPRYGAAEPQRPMPQRPVNPLDPRWQARPDQQQHSFFEPAPRSPQPVTPPPAPPARADYPPAPGYPPQVPQPNGHPATNGYGQPPAAPHAYAS

SEQ ID NO: 9312 - protein, 332 aa, Actinoplanes utahensis
MGPAHRVRAVLVRFGGGSLRLQIMTGVAAAATATLVLAVAWAGHSGDPSGGDPGDVVRVGVIEGQTVGGYLDSSRRELSMLTDPSGPAAGDTWALVSLRDYTAPAQLPALLAGATVAQVYARVPLPGVRTQVSLIPVYSMPGDVTAGMLDAALVRDREQADLSRLERSLTGEGQREQRLRTTYGTAALVAAQEAAAYRAGCSCVFAAVIRAAPATLGGIASRPGVRGVDPAPEVRSLDHTEFRPPRPEESGLVTADPSVRPVPTATPGVASGSPGRLPSSIGGTVTSHSSGRGPGRSPSVAVSSTAPADVPSEDEVGTAQASSVASIAEPGR

SEQ ID NO: 9313 - protein, 309 aa, Actinoplanes utahensis
MSDTRSLPVPDGLDGMRLDQAVSRLFGLSRTAAADLVESGDALVDGAPRPKSDKVAAGSWLEVTLPRPVTAPVLVAQPVHGLSVIYSDDDIVVVDKPVGVAAHPSPGWTGPTVVSGLAAMGQNVATSGAAERQGIVHRLDVGTTGLMVVAKSEMAYSVLKRAFKEREVDKRYHAVVQGHLDPLRGTVDAPIDRHPTADYRFAVMSGGKPSVTHYDTLEAFRAASLVDVKLETGRTHQIRVHFSALRHPCVGDLTYGADPTLAARLKLNRQWLHARELGFLHPRTHDEVRFVSDYPDDLKFALDVLQDAG

SEQ ID NO: 9314 - protein, 219 aa, Actinoplanes utahensis
MRAVRQPDPGGADCRLPVRDSLCVMQATGGTTLNADKAPRFAARAVAVLGATALLALALDQWVKYLSTEHLDPNEPVRILGGLIYLSLLRNSGAAFSFGDTHTWIFPVITLVVIGWIGWMATRLRSVPWALALGLVLGGALGNLADRLFRAPGPFQGKVVDMISVFAPYAEKFPVFNIADSCLTVGVCLAVLLELTGRQRDGSRLKNTKNEQVETEETA

SEQ ID NO: 9315 - protein, 94 aa, Actinoplanes utahensis
MVSVPVRVRPGAGRTRVGGGYPGPHGTAVIIAVAAPAVDGHATEAARRALAAALGVRAAAVSLRVGATSRDKVFTVDAPAAEVAGLLAALVAER

SEQ ID NO: 9316 - protein, 279 aa, Actinoplanes utahensis
MIPASFPLILVAVVCLAIGLVRGSSSLLIASIVASLLAAVALVIGARRNAAAHRPESPDDDFPPPPAPRRTTGAPSDAHDSAPAGDAFAADSRYAEPPTFASAPPTAPEPPAGGQVYEQRAAADHGEPVDLPPATDDAGAAGTHLPDETVVTPVPAADYQAASSTIGAARGGHDDDQSWRRPMATDAGLDDGFGEPDADDPDDEPLPQAVRPADAVQVARFDTEVLVVDGRPRYHMADCPHLVGRLTEPLPAAEAVELGFSPCGLCRPVDRLLGANARR

SEQ ID NO: 9317 - protein, 270 aa, Actinoplanes utahensis
MPLTPADVHNVAFKKPPIGKRGYDEEEVDAFLDEVERELARLIEENNELRAQVERGGRGGAPAGPSADPRLAAELNDLKGQLDRVQRDKTAAEQAARQMQAELEQVRAQGPGPGAGPTGADGEQQALRVLMMAQRTADDHVSDARREADKLLSDARSKAEEVTREARAKADALERDARQRHQEAMGGLDAKRTALQKHIEELKQFEREYRTRLKAYLESQLRDLDGRGQGLEAEMARADASRAVGGSGGLAAAGLAGSYGGRSNAIETGR

SEQ ID NO: 9318 - protein, 101 aa, Actinoplanes utahensis
MLSIVFQILYLLVYFFFLVLLSRFVLGAVLQYGRRWQPGRGASAALEVVWSVTDPPLKALRRVIPPLRIGNVSLDLASIVLLVILFVLMQLVLLQLILNYR

SEQ ID NO: 9319 - protein, 245 aa, Actinoplanes utahensis
MSTFRKAAVWLGLAEEEDERDYEERGYRESSYRSSRSDRHDRDQDRYSSGDRYSGDFDDEEEDERPAPRRPVRSERTERTSRLSDRASSVRAELDRDDEDRIERSSVRSITRPAAVAPEQPSALTYSTRENLALAPQPVHQPQVQQRPIEDEQRYQITTLHPTTYREARTIGEHFRDGTPVIINLTEMDESDARRLVDFAAGLAFGLRGTIERVTNRVFLLSPANVQVTAEDKAKIAEGGFFAQS

SEQ ID NO: 9320 - protein, 237 aa, Actinoplanes utahensis
MEFDEGRRAELAANLRAVRERIERARVAAGRPPGAVTLTAVTKTYPASDVLLLAGLGVTDAGENKDQEAAGKAAEARAAGVALRWHFVGQLQRNKAKSVASYADVVESVDSVRLVTALDRAAVAVRDSPLEVLVQVSLDGDPQRGGASGDDLWRVSDAVAASDGLRLGGLMAVAPLGEDPDRAFARLAELAGALVSTHPGATTLSAGMSGDLEAAIRHGATHVRIGTSLLGMRNSLR

SEQ ID NO: 9321 - protein, 379 aa, Actinoplanes utahensis
MTPPHNYLAVIKVVGIGGGGVNAVNRMIEVGLKGVEFIAINTDAQALLMSDADVKLDVGRELTRGLGAGAQPDVGKNAAEDHRDEIEEVLKGADMVFVTCGEGGGTGTGGAPVVANIARKLGALTIGVVTRPFSFEGKRRQVQAEAGIDELRNQCDTLIVIPNDRLLALGDRGISMMDAFRQADQVLLSGVQGITDLITTPGLINLDFADVKSVMSNAGSALMGIGSARGDNRAVEAAERAISSPLLEQSMDGARGVLLSIAGGSDLGLFEINDAAQLVTDAAHPDANIIFGAVIDDALGDEVRVTVIAAGFDGGSPSYKPVETVRNKVLPQAEPRSSAPVSSTSLTPHQAPSAPATPAPRKQILFDDVDVPDFLKNGS

SEQ ID NO: 9322 - protein, 255 aa, Actinoplanes utahensis
MAGPGTRNWRLVRADTDAVPPSARRFMARARQRRLRAALPWLIGAGVLLVAGGVAWLFYGTAVLGVRTVDVVGVQTLDAAQVRAAAAVPDRQPLARVDLGDVSARVRGLAAVDRVVVTRAWPSTLRIEVVERVAVAAVPGRSGFTLIDRAGVPFRSAERKPDGLPLAKVATPGPNDANTGSALKVLAALSDELREQLDAVSVISPVAIRLELRGGRVVIWGDDTESDLKSKVATALLKNRASEIDVSAPKIVTIR

SEQ ID NO: 9323 - protein, 479 aa, Actinoplanes utahensis
MVNTAELTPAGEMTAEELGSVHLIGIGGVGMAGLARLLLTRGIPVSGSELREWPALAGMRALGGTVHMAHEASNLDGVDTVVYSTAIPKDHVEMVEARRRGLRVLHRSEALAAAMTGRQTIAVAGTHGKTTTTSIMTVILQHAGQDPSFVIGGELSAAGSNGHHGSGPHFVAEADEHDRSFLIYRPHVAIITNIEGDHLNNWGDLETLKAGFLEFGGLADGFVVTCADGPGTEELIAGLRAQGRTVYTYGESADADLRITDVVSTVSGVRYTAILHGETLGEFKLALPGKHMGLNSAATVLTALKLGLPLAKITEALESFPGVRRRFERKGIAAGVRVYDEYAYHPTSVLAALRTLREVAGDGRLLVVFQPYRVYRTRDLQAELAEGLALADQAIIMEVFGPGETRGPGEGGLALTAAIDLPADRKVFVPDWDDVPAEVVRRSRPGDVVVTMGAPPISLMGDELLAALAEADLTPDFAG

SEQ ID NO: 9324 - protein, 368 aa, Actinoplanes utahensis
MVQLRSVVLAGGGTGGHIYPLLAFADALRRHFPQIRITTLGSPKGMENQLIPAAGYDLRVIPAFQLPRSLNFDLLRTPDRMYKSTHAAGEILDEVQAEVVVGFGGYVSVPAYLAAWRRELPIVVHEVNVPPGVANRMGMKFTKRVAVGFPHQLEQAESLRNARLVGVPLRTGITRMDRPALRPQALYHFGLRPDLPVLFVSGGSSGARTINLAVAAAAKRLAHAGIQVLHVQGGRNDPFEVPDDLPVPYVVVPYLSDMQLGYAAADLMLCRGGAITVAETTALGMPAIYVPYPFSNQEQRRNAIPVVEAGGGMLVDNSELTPEWIERNIIPLARDRQRLAAMGHAAGRYGRRDGDEQLLRFVLEAVDR

SEQ ID NO: 9325 - protein, 469 aa, Actinoplanes utahensis
MVTSMACPPDDDVGMADDRTRQDRPSLSRQLLPAVHGLLARPLSSYYLLIASSGMLLLIGLTMVFSASSVQSYAADGNAFSGIANQAVFALLGLVAFWVFQRLPAITLRAVGKYVLGLAILLLVILDVLVEVKHVTENHSAQVGPLRVSLLWLSFQGLVIQPSELAKLGIVLWGADMIARKGPALSRWRELAMPLFPVVGLLFLLVGYNDVGTMLVLLALIVGLLWAAGVRLRVFGALGVFGLTGIALLIAAASRGGGSGSTDAPNYRVQRITAFLTPLDKCDPNGVCYQIVQGRSAIFEGGWFGVGLGKGALKWGWVPEAQNDFIYAIVAEELGLVGCVVVLALYAVLAYSGFRIARRSADPFRRLAAAAITTWLVAQAVINMGGVVGLLPITGLPLPFISAGGSALVVAMAAIGMLASFARAEPDAARALNARPTPRWVRLVWAPLPPVPPQRRPGQPVRTGGEGRR

SEQ ID NO: 9326 - protein, 371 aa, Actinoplanes utahensis
MRAVIVAAAVAFLISLFGTPIAIKVFSALKAGQPIRTIGPATHMGKKGTPTMGGVAFILATVFAYVAGHLALTTLPDRQIAQERPTMTALVLLGLFVFCGAVGFLDDFLKVRKRNSDGLSAKGKLLGQLLVGTGFGIAALYFPSTNGETVASEHISFIRDVSWLDVGKVGSVMVFVFVIMAMSNGVNLTDGLDGLATGSSILVLGAYSLIGFWQYRHWCGDNDYRLTNELTQTHCYQVRDPLEIALIAAAAAAACVGFLWWNTNPARIFMGDTGALGLGGLIGGLAVATRTTLLSVIIGGLFVIITMSVVIQIISFKTTGKRVFRMSPLQHHFELAGWSEVNIVVRFWIIAGICAAIGLGLFYSDHLAVMG

SEQ ID NO: 9327 - protein, 463 aa, Actinoplanes utahensis
MIPMTLAEIAAVTGGHLVNSDGSETVTGGVEYDSRRVGPGGLFVAFAGEKADGHDFGPKVVAAGAAGVLGTRDAGAPGVVVEDQLAALAKLAHEVLTRLPELTVVGLTGSSGKTTTKDYLGQLLSRLGPTVAPAGSLNNELGFPYTVLQAGRETRFLVLEMGARGIGHIRYLTGIARPSIGLVLNVGAAHLGEFGSIEGTARAKGELVEALPADGVAVLNADDPLVAAMASRTGARVLRVGEAADADLRATGVTVDSAGRASYVLHHGLEVRNVRLGVAGRHQVANSLAAAAAALTAGMPLDDLATALGEVGIVSGRRMDVIERPDGVTVVDDSYNANPSSTAAALHALAAMGAGKRTTAVLGYMAELGEHEVSGHAEVGRLAAELGVDRLIAVADNARPILDGAAAAPGWRGTALFAADQAAAIEILQSDLRADDVVLVKGSRYRTWDVADWLRRPEEVQPT

SEQ ID NO: 9328 - protein, 500 aa, Actinoplanes utahensis
MSGIPRPETVAPLPLTRLAELLRATLHGGDIDVTGVTHSSGAVRPGDLYAALPGANRHGAEFVDAAASAGAAAVLTDPAGRDAALAAGLPVLTVDDPRAVLGAAAAAIYGEPSRRLTMIGITGTAGKTSTSYLVEAGLRAAGRVTGLVGTVETRLGDFTVKSVRTTPEATDLQAILAVGVERGVSAVVMEVSSHALVMGRADGIRFAASGYTNFGQDHLDFHPTSEEYFAAKARLFDGRSAVGVLNRDDAAVMSLATPETVTYSAAGDESATWWASDVRPSAFGQLFTAHGPDGVTVETGVALPGLHNVANALLAIALLVATGIDPRVAGAGVRDCRGVPGRLEQVPAQSGILGVVDYAHKPNAIVAALAALRDLATARGGRLICVIGAGGDRDRGKRPLMGEAAARGADLVIVTDDNPRTEDPAFVRDGVRRGAEDAHAGKVVEVAGRRAAIVEAVRLAATGDVIAVLGKGNEQGQEVNGQVLPFDDRIELAAALEGRA

SEQ ID NO: 9329 - protein, 606 aa, Actinoplanes utahensis
MTGGSGPGREPARRLRPVPAEPPKLANSTRRLRLGTILALSLFTMIGIRLVVLQVATSPAEVDKLVDLRNDRMHSIKLPAARGSILDRDGNILANSVEARYIFADPSNPRLQNDIPGTAAALARLLGVPASKLAASMQPKMVDGKASQFSYLARGVDVSVANQIEALKKPGIYTHADERRELPGKDLAANLIGFIGDDQHGLEGLEARYDDLLHGTDGMWVFESGKGKLDGPIAGGYQQETPAKPGGSLQLTINSFTQWNAQHILDAEAERNHATVAGAVVLDVKTGEILAQASYPYYNAAKALEYQPSDRIDVPTAVVTDPGSTHKAFVIGAALQEGLITPDSTVEVAPAIVEGGKTFNDSHVQPKGSRLTIAGILAYSSNVGTIQIGSRLGKDKIYEYQQKFGLGKATGEGMPGEAPGELLAPQNWSGSAKGSVPIGHSVSATLVQMAAGYGAIANDGVYIQPHLIKATVSGTDHTTTPAPAPETHRVLDAKIAAELRTLMETVVEDSEGTGVKAQVPGYRVAGKTGTGKMVVDGEYTSHNASSFVGMAPAENPRYVVAVAMDVAKGTGGEVAAPAFAQIMSDTLLRNSVPPSTTKPPTFKIHG

SEQ ID NO: 9330 - protein, 393 aa, Actinoplanes utahensis
MGIWRYGCAAGPVRISRARQHGNEPSGTRAGGSMGVDMGEPRGAHVPVLLERCLELLGPALARPGAVHVDFTLGLGGHAEAVLERFPEAVLIGLDRDTEALAHSRHRLARFAERIHLVHAVYHELPRVLDELDIPAIDSGLFDLGVSSLQLDEADRGFAYAQDAPLDMRMDQSRGITAEEVVNTYEPGELVRILRQYGEEKFAPRVVSAIVRERQKARIVSTARLAELIKDAIPAAARRTGGNPAKRSFQALRIEVNGELDVLESAIPAALDVLSPGGRLVVMSYQSLEDRIVKRALTARARSTGPIDLPVELPGTGPTLRLLTRGSELPSEAEVAENPRAASVKLRAVERIELGKTANQPGGAGRERPRMVAEHGGQGRRRPGLNQEGEGKA

SEQ ID NO: 9331 - protein, 143 aa, Actinoplanes utahensis
MFLGTHTPRLDEKGRLILPAKFRDELAGGVVITKGQERCLYVFPMPEFQRIAGQLREAPVTNKAARAYSRVFFASAHDEVPDKQGRVTIPTHLREYASLGRDLVVIGASTRVEIWDRQSWDDYLSASEEDFADIQEGVLPGGL

SEQ ID NO: 9332 - protein, 276 aa, Actinoplanes utahensis
MHEHRSSHGRRMSGAGTAALSLGLCLCAGQLIGASPAVAAEATPVTTAANTVRAVAPAAAKTLVQPRLTTTTTARRITAGSVLKVTAKVINPKTGKIAKGTIRLQGYRGGKWQTWATKSSTGAVTFTTGPKSSIYIRTLFTGTGYAQTSSSRMLITVRANGGARVLAEAKKHVGALYKFAAAGPKRFDCSGFTLYVYKVAAGRSLPHKADAQQRYGSAVSKSQAQPGDLIIFRSGSYGYHAGIYAGGGYMYDSPHTGARVGKHKMYGSNYVVRRIA

SEQ ID NO: 9333 - protein, 406 aa, Actinoplanes utahensis
MPLRAIVATTASKTAAALSRAAGRGDGSVIGGWIGLKIDPDLLAHLSSGRAVALVSGTNGKTTTTRLTAAAVGVLGRVATNSYGANMPTGHTSALAKEGHTPFAVLEVDEHYLAQVIDATRPKVVALLNLSRDQLDRAKEVAMMAQLWKTALAGHPEIRVVANADDPMVVWAAAGSPQSIWFSAGQRWHDDSFVCPESGHPIERANGDWWCTGCPLRRPTPQWVVEEDGVIDPRGDWHLVKLQLPGKVNLGNAATALAVAGEFGVRPIEALPRLSRVTSIAGRYAQVDRDGRNIRLLLAKNPASWLEAFDMADQAPTLLSINARDPDGLDTSWLWDVDFAPLRDRPVLITGDRAFDLAVRLQVNQVPFRHVHTFDEAVAQVPPGRLEVIANYTAFQDIRAVLDRVN

SEQ ID NO: 9334 - protein, 237 aa, Actinoplanes utahensis
MNDSTLRIVWIYPDLLSTYGDRGNLLILAHRAAARGIPVETYEVRSDMPMPTTADIYLIGGGEDGPQALAAQRLIADGGLHRAVSQGASVLAICAGYQLFGHSFFAKGTKCAGLGLLDITSDRGESRAVGELRGDIDPRLGLPPLTGFENHGGRTHLGAHAAPLARVTGGIGNDGQTEGAWAGKIIGTYSHGPALSRNPALADLLLRWSTGADRLAPLDDSWADRLRGERLAAASPA

SEQ ID NO: 9335 - protein, 90 aa, Actinoplanes utahensis
MTDTPDHHTSVPSRRKRLVRLGLLAVVIGALAAASALLPLRDIGDAVVALGPGAAVAVAVLGGLLLSALVPRTAVTVACGALLGAAIGAV

SEQ ID NO: 9336 - protein, 124 aa, Actinoplanes utahensis
MLQARAGGRLARLDGWLNRRGLAAVLLVRFLPLAPFGLIGYAYGTTSVCRKRYLLGTTIAAIPSTVTYAVIGAAVASPGRMNAITIAPAVVSFILSTAIVLRWRHTARRDAATAPSTADSAVRA

SEQ ID NO: 9337 - protein, 931 aa, Actinoplanes utahensis
MVKMSETDNPFRYTAALAGEIELRWQRYWAENGTFHAPNPTGELADPGHPRAGAPKLHVQDMFPYPSGAGLHVGHPLGYIGTDCYTRFQRMAGYNVLHPMGFDAFGLPAEQYAVQTGTHPAVTTAANVERYRQQLRRLGLAYDERRSFSTTDPEYYRWTQWIFLQVFNSWFDPEQGRARPIDELIASYEAGERGAAWATLSPAERRKVIDGHRLAYVSEAPVNWCPGLGTVLANEEVTPDGRSERGNYPVFQRSLKQWMMRITAYGDRLVDDLDALDWPEPVKLMQRNWIGRSQGAHVDFAVDADRITVFTTRPDTLFGATYMVLAPEHALVSKIVPAAWPAGTKEAWKVAGTPAEAVEAYRVTAAAKTEEERTADGKVKTGVFTGAYAVNPVNGASIPVFIADYVLAGYGTGAIMAVPGHDQRDFEFATVFELPVVRTIATPEGCEGAYVGDGEVINSEFLNGLNKDEAKAAMIAWLEERGKGAGATTYRLRDWLFSRQRYWGEPFPIVYDETGLPIALPESMLPVELPDVDDFSPRTFDPDDADTEPETPLSRKKEWVQVELDLGDGPRMYTRETNTMPQWAGSCWYELRYLDPHNDHALVDPANEAYWMGPQRPGDPGGVDLYVGGVEHAVLHLLYARFWHKVLFDLGHVSSFEPFRKLFNQGYIQAYAFRDARGVIVPAEEVVERDGKWYHGDQEVAREYGKMGKSLKNVVTPDEMCDQYGADTFRVYEMAMGPLDVSRPWETRAVVGSQRFLQRVWRLVVDEETGAIRVTDAELDPKSRKVLHRVIAGVREDMAELRFNTAIAKLIELTNTLTPLATVSREAVEPLVLMLSPFAPHLAEELWGRLGHAGTLAYADFPQADPAQLVADSITYPVQVNGKVRGRVEVAPDTPEAEVRAQALAAVAEALGGKEPKKVIVVKGRLVSVVV

SEQ ID NO: 9338 - protein, 793 aa, Actinoplanes utahensis
MSRPPRGTYHLEEARDNADLGRADRTAVERRVPHRDAGHHDQHRAGHRGQECDGAAGPRGPAGRGSPADRGRAGRRQDQTRQGPGPLHRLLGPPDPVHSGPAAQRRHRGERLQPGDPGLRVQAGRRLRQPGGRRRDQPRLAEDPVRAAGVHGGTAGHRRRHHLRAAGAVHGGGHPEPDRDGGHLPAAGGAAGPVHRPDRDGVPGPPGRAGHARPARRPRPAQRHPRGGRCRTGPPADRHGPRGARRGRRPAVRDRPGHRDPGGPRDPPRRVPAVHPAAAAHRQGGRRAGGPRLRAPGRPAGAGRAGARAPADPDRGRPAEPAHHGHHRLGDRAPAADPGGQPESVRHPDRRHAVRVPGAMTMREALRGLTTRGRSFLAAAIAAGISALILGERDLLRVAVLLAALPLLAAAYVGRSRYKLACTRSLEPGRAPVGSSARVILRLQNLSRLPTGTMLLEDRLPYALGSRPRVVLERLGAQQASSVAYTVRADVRGRYPIGPLVIRLTDPFGLCELTRSFPSVDQLTVIPQVTPLPRVRLAGEYAGTGDSRARSVAVHGEDDAATREYRRGDDLRRVHWRSTARTGELMVRREEQPWESRATVVLDTRAIAHRGEGPTASFEWAVSAAASIAAHLREAGYKVRLVTGDGSDLDGSEPGGDGLILDALADVKLAAAGDLALLVEQVRRRSDGGLVIGLFGTLTTAEAQLLGQLRGNGATCIGFAIDSDTWVPMTAGDRQESDREHAAASLALVRGGWRSVPVTHGDTLPALWPTVGRGSQGFAYRAAMAETVSGVTR

SEQ ID NO: 9339 - protein, 821 aa, Actinoplanes utahensis
MTGRRRLGLVAAGATLLGSAPLATIFDTWSWLLRVVLTVVMIAGTAVLTRTLRFPSWAQALGMVAGLLITLTWIFPSGHELLVPTPATLAHFGDLIQQAGDDTRAYAVPVPDRDGLLFVATLGIGVVAIVVDLLTAVFRRPALAGLPMLAIYSIPVAVYLDSVPVTPFIIGACGYLWLLVADNVDRVRRFGRRFTGDGRDVDVWEPSPLASAGRRLGLAGVLVAVLLPLIVPTVNGGLLSQLTQGGSGAGGGLGKGGGQINLFAKLSGQLNQTTTVNLLKVRTDEKDPFYLRFGVADLLSNDGFSNQPPGGNTLKAGSLPDPHHDGATDQVAFQQHHADIEVSDLLRQSMAPMYSNPIAIKDLSGNWAYDPNQQVLYSNRSNTGKQKYSIDYLRALYTPAQLRTAPALGPDDPMRKLFTAHPDNKYVDTLVAGLVKGKTNDYDKIRAIYEFFSRKNNFNYSVSTQSTGNLSDIEAFLRNKTGYCQQYAAAMAWMVRDAGIPSRVAFGFTRGTPQDNGAYVITNRNAHAWTEVYLQGFGWVPFDATPAGSVAGASRSNWAPDTDRTATPTASATTAPVAGASASAAAAGTGKRPNRADDGSDLATGGTFESDQQSWTGLIVGAVVATMIALLLVPALRRVLLRRQRHAATVGPPPATSVDPGIAGPSGAVTGIEVSPGSAQARADAHAAWDELIDTMVDFQFAVDPTETPRLTAQRLVKEALLEADAAGAAELLGTAEERARYARQPMQGAELTTALRRVRAGLAHSTTGWVRLRAALFPPSILLSWRLGLAEAGTRTMEAAASTGDFLTRFNPRRLLPRGR

SEQ ID NO: 9340 - protein, 130 aa, Actinoplanes utahensis
MPLSEHEQRLFDQIERSLAEDPKFASAVRASDPRFHARRRLIIAAFVIVLGLALVVYGAASGTVLLGVAGFVVMLGAAAFAMQSRKRGQAPDLKSVGGTASRRTRQGRKGNGGLLDRLEDRWRQRPEGHR

SEQ ID NO: 9341 - protein, 438 aa, Actinoplanes utahensis
MSAVPAAGADPGGSSSAADRLSGAGADPGGLSSAADRLVDAGVDPSGPAPDDGLHPDALRTVHPAYGSGSLADLLPSVSAVLGVPGAADVLGLGARLDGVDRIAVLLIDGLGAYQLPLAAPHAPVLADLAAGGRGHAATLTAGFPSTTPVSLVTLGAGVPPGAHGVLGFTVRRPDGRPLTHILWDDDPDPRRWQPVPTRMELAAAAGVRVTVVSRPQFEGSGLSLAANRGGVYRGAADGAAVADGMLAALREADGPALVYGYHPDLDHFGHEDGVGSPSWRAAARGVDRLLDRVVHGLPPRSALLVVADHGQLNVPIEGRRDIAAIPELRDGVVGVAGESRVRYLHVADGARDDVIASWRGVFGAEASVLTREEAIAGGWFGPVPAAHAGRIGDVVVICHGRAVAIASGWEPVKAGQLVAYHGSVTAAEMTVPLLIAR

SEQ ID NO: 9342 - protein, 93 aa, Actinoplanes utahensis
MRAASALVTDPEGRSGPRDTLRRRYDAETAAALLRTAGFEVEQTHGVRVVADLLPAAVLDEDPQAVLELELALSAQPPFRDIASQLHLFARRP

SEQ ID NO: 9343 - protein, 127 aa, Actinoplanes utahensis
MDTAIARTGRPLVTARTAAVWAVLRRELERNAGRELTVLDVGGGTGGFAVPLAEAGHTVTVIDASPDALAALTRRAADAGVAGRVRAVQGDGDALAGLVEPGSADLVLCHAVLEVVDDPARVVTATS

SEQ ID NO: 9344 - protein, 124 aa, Actinoplanes utahensis
MLLRICTGFVAAVVLATAAPAAAARPESRLVLTYAGETGRPAAVRLTCDPDGGEHPKAAQACAELGRVGADPRRLKPADRLCFMLYQPVTAQLRGTWRGRPVKWTQRFGNGCEMTRATGVLFAF

SEQ ID NO: 9345 - protein, 1095 aa, Actinoplanes utahensis
MWAAPGPEQVADPLVVDGDGGDAPAWTRKREPYRAAPGLVRSDAEVAYAELHCHTNFSFLDGASHPEELAEEAARLGLTGLAVTDHDGFYGVVRFSQAARELRLPTIFGAELSLGLTRPQNGEPDPEGTHLLALANGHDGYARLARVISQAQIRGGEKGKPEYESLEQIAEILHDHVLVLTGCRKGTVRQALATEGMDAAAWELDRLADLFGRSNVAVELTDHGHPYDGDFNDALCTLARERRLEVVATGNVHYATPARRRLATALAAVRARRGLDEMDGWLPAAGTAHLRSGAEMARRFRDYPGAVANAAMYGEGLSFDLNLVAPRLPDYDVPPGHTEMSWLRELTMRGARVRYGEHHPKAYAQLEKELRMIEELGFPGYFLVVYDIVDFCRREKIYCQGRGSAANSAVCYALWITNVDAVEYDLLFERFLAPERDGPPDIDVDIESDRREEVIQHVYQKYGREHTAQVANVISYRPRSAVRDMARAFGFSAGQQDAWSKQIDRWGDVATADSDIPEMVVDYANAVQNFPRHLGIHSGGMVICDRPIIEVCPVEWGRMPGRSVLQWDKDDCAAVDLVKFDLLGLGMLSALHYAYDMIEDELDIGTMRLDDAEVYTMLCRADSVGVFQVESRAQMATLPRLKPTRFYDLVIEVALIRPGPIQGGSVHPYIRRKNGLEKPDVPHRLMENALRKTLGVPLFQEQLMQLAIDVAGFDPAEADQLRRAMGSKRSVEKMERIKRRLYEGMAGNGITGELADDLFHKLSAFASYGFPESHAMSFAYLVYASAWLKRYHPAAFCAALLNAQPMGFYSPQTLVDDARRHGVEVRRPDINRSDAMATLETTPDTRRKAGVGEAPQVWGLGGPAVRQGLRSVRTIGADLAELIENERREHGPYRSMTDLARRTGCSIANLEALATADAFASFGLSRREALWAAGAAAQDKPDRLPGTVTGTEAPTLPGMSEVDLLVADVWATGLSPDTHPARFLREQLTGAGALSIADLGTVAAGSRVRVGGIVTHRQRPATAGGVTFVNLEDETGMLNVTCSPGLWLRYRRVARSSAALLVRGRLEKVEGVLNLVADRLDALHPPVTPASRDFR

SEQ ID NO: 9346 - protein, 583 aa, Actinoplanes utahensis
MRGGDVGVEEGVRTLMVWCPDWPVVAAEIELGVPGDGAVAVMANNRVLACSEAARRESVRRGLRRRDAQGRCPHLIVVEHDPGRDARTFEAVVAAVEEVAAGVEVVRPGACALAARGPARYYGGEEAAAERIVEHVAQTCAVESQVGIAGGVFAAGIAARGGQIVAVGGTAGFLAGMPVDALDRPDLADLLRRLGAKTLGEFAALPAGDVLTRFGFDGALAHRLARGGDHRPLAVRQPPVDLAVTETYDEPLDRVDTAAFAGRVLAERLHERLAGHGLACTRLGVEAVTADGQELHRVWRHDGLLGAAAIADRVRWQLDGWLTGGRRSGPARPTAGLVRLSLIPDGLLAHAGLQPGLWGDAGAERDRAHRAFSRVQGLLGPESVVTPVIGGGRSGSDQVRLVPWGDERTPARPAAVHADPIPGLVTVPVLDRAIAPDLPGRENGGTAPRKGAAAERGAAGAADGVRRNRGEGVGLPPWPGRLPRPSPAMVLPEPLPAVVHDELGLPVGVSARLELTGTPASLAVGRSAPLPITGWAGPWPVDERWWAPEEARRRARFQMSLADGRALLLSLAAGQWVVEAIYD

SEQ ID NO: 9347 - protein, 323 aa, Actinoplanes utahensis
MAGRMISGTAALAELVRPASEAAEPGAHRMLPVASELGNLLPGRGLRRGSTVAVAGGRVARAGGGTSLMLALLAAASRAGSWCAVVGLPALGALAAAETGIVLERLALVPEPGPDWPTVVAALIDGVDVVVTAVPGPVSASIAGRLAARARQRGSVLVPFGDWTGADVTLRVGRGNWEGLGDGRGRLRRREVTVLAGGRGAAARPKELTLWMPGLTSRPGTPAALPVGSAGMPDAPPVRPVAVPTLPDLTADPPGSTLPAPGNRPLRAVPDLTASTPGPEHPEPGASTSRRGGASARRGRWGTGPRGGERARHEVPAGASAGE

SEQ ID NO: 9348 - protein, 298 aa, Actinoplanes utahensis
MASSTAHGLMPVPGLTAVSGPDPGRAAPPAPAAPSRPPSVPAASDRPSSALAASDRASSALAASDRALSASAASALAASAPASALAASAPASALAASAPASALVAAASAASIPASSTQAVSASAVSGPASPVSAASGRGLGSALVVPGPVGVGSARAEMPTVPAHMLPQRTPAQLLAIARQGLAEAAHTAPDGLRYAAAHLAALRAAAALLAARARPGAPGRRTKATSVWSLLVMVAPEFGEWAGYFALGASKRAAAEAGIPQVVSAREADDLLRAAEQFVTVAESSLGFSYQPPLAA

SEQ ID NO: 9349 - protein, 352 aa, Actinoplanes utahensis
MGWWQIDADTLAGSRFVLSPLAETTAGLMRLRWDSAEHPADRPWLRAHRPAYRARLAADPITARLVDAALRPHWIADFMAPPPEIAERSFAAEVAVIRATVPAAARQHIAEGLAGGLPVGLGREDPGVRASAGLDREDSGTRSLAGLPAELDRDDLGERMAGLLTWLWQTAIAPDWPRRRRILEADVLARTRQLTQGGWQAALNGMRDGMRWLGGGRLQINAYDYPPRDISGAQLLFVPTTLGRGWAAWENPDPTRYALIYRASGVLAEPGRAAPGALERLLGAGRAGVLVALAQPKSTSQLVAITGLGLGSVGRHLRVLLEAGLVMRRRAGRSVLYTRTPAGESVVRAASV

SEQ ID NO: 9350 - protein, 407 aa, Actinoplanes utahensis
MRTYRQLFRVPGFAPLFVTSCLQNAAVTVAGLALATGVWDRTGSPLLAALSMFGPSLAQLAGATLLMSAADRWPPRAALTGVAALTGLLTAVLSVPDLPVPALFGVLLATGLVASVGGGVRNGLLNDLLPAGGYLLGRSMLNVSVGVTQIAGFAAGGALVAVLSPDRTLLAAAALHLVAAGLARVGLARRAARDPGRLSVAATMRVNARLWAISGVRPIFLGLWVPNGLIVGCEAMFVPYAPAGAGLLLAASALGMLAGDVLAGRLLPPVWRRRLAPFLRLLLAVPYLPFLLHPALPVAVVLAAVAAVGYCSTLLLQERLVELTPAEHRGQALGLHASGMLTMQAVGAALAGTLAELSSPAVAISGMAGASVAVTLALAGPLRATAGREPTPATAEPTAAAEPTAAA

SEQ ID NO: 9351 - protein, 649 aa, Actinoplanes utahensis
MSTEINVPAVVAPVRERMSQRPLSKWLLAHRVQPVGPESENPAHEQAWWKVMCLTGVDYFSTLSYLPAIAALAAGALSPLATLLIVALTLLGMLPMYRRVARESPHGQGSVAMLEHLLPFWRGKIFVLVLLGFVCTSWIITITLSAADATVHMSENPNLPSALHGHQVLITVVLLLILGFVFLLGFSEAVGVAIPLVAIFLLLNAVITAVGLADVFGTPGALSAWTDRLTEHGSGFFDVLGPAVLAFPALVLGLSGFETGVSMMPLIKAADGEARVRNTRKLLTTAAAIMSVYLIATSFVTTVLIPQKEFEAGGQANGRALAYLAHLKLGEVFGTVYDISSILILWFAGASAMAGLINIVPRYLPGYGMAPEWGRAVRPVVLVYTVISIGITIAFGADVNAQAGAYATGILAMMVSGAVAVTISAFRARHRGATIGFGVLTLVLLYALADNIIEKPDGIAISAVFIAGIILVSLISRVTRTTELRAERIEFDEPARRFIADSIRHDGELNIVANQRQDGDEAEYAVKEGEQRGMNPVPGRADILFLEVDVVDPSEFSEVLAVHGIEVGSHRILRVQSPAVPNAIAAVLLALRDATGVRPHCYFEWAEGSPLGHLFRYLLFGRGDTAPVVREILRQTEASPDKRPRVHVG

SEQ ID NO: 9352 - protein, 271 aa, Actinoplanes utahensis
MTQTIVITGASSGVGLAAAEQLAARGDEVVLVGRDPGRLDAAVQRVREAGGGRAPRHFRADFERLDDVRELAAGLLAELPRIDVLANNAGGIIKRPRQTVDGHEATIQGNHLAPFLLTHLLRERLTGGRVVNTASAAHVQGRPGTRFTDDPKSYSPWRSYGASKAANILFAAEAARRWPDVCSVSFHPGVVRTNFGEGRLIRLFYRYAPGLVTPEAAGELLTWLCTTPAGELENGAYYVKRQVTRPAAHARDPRLAAELWDASLTATGLAG

SEQ ID NO: 9353 - protein, 224 aa, Actinoplanes utahensis
MTHVALHVWRVPRSAVGSAMLRMAFARRHLAGLRFGKFLGTGTGTGFGPGDTDLTRWAAITVSDAPVRFPVWERIAVNGARIDLEPLISRGTWAGRTPFEPTGRRPDGPVLALTRARLRPARALTFWRAVPAVVREVHRAPGLLARFGVGEAPIGWQGTVTVWRDAADLVAFAYRQPEHRAAIARTPADRWYAEELFARFAVLGISGDRSVLGWTADEGERAEA

SEQ ID NO: 9354 - protein, 192 aa, Actinoplanes utahensis
MRLVAWQPDDLLRRLDDVVGVYGEAMGYRQELLQTRRGYIGSHVRRPGFRAVATLTTEGRLMGFGYGYTSAAGQWWHDQVRFALGEDDRRQWLTDCFEVVELHVRPAAQGHGVGARQLRALLAMAKGRTVLLSTPEADEQASRAWRLYRRYGFADVLRHFYFPGDERAFAVLGRELPLAERPLEDAPGIAGA

SEQ ID NO: 9355 - protein, 457 aa, Actinoplanes utahensis
MAAPGARAARRARCAARQLPGLARLRAAADDRAGRRRRPGRRPAAVRRPAGARPVDLDVRLVGARPRRLPVAAGVRGVGRADHGRRGPPAARPAARTRMIVAWLILPPLLLITAHTAVNALLLRRPRRAATSTERVAVLLPLRDEATRVTPCLRALLAQRGVADLTVHVLDDGSTDGTADVVRAVAGDRVRLHTGTPPPPGWLGKPAACQRLADLAGDVDVLVFVDADVVLAPDAVAGAVDLLRRAGADLLSPYPKIVGAGRLVQPLLQWSWLSFLPLRAMERSARPSLAAAGGQWLVLDRAGYRRAGGHAAVRGEILEDIALARAVKRAGGRIALADGSGLATCRMYESWDELADGYAKSLWASLGSAAGATAVTLLLILLYVVPPLLAPFAPLPAVLGYLLGVTGRMIAARATGGRVLPGTLAHPVSIVLFGYLIARSFRLRRAGRLAWRGRPVP

SEQ ID NO: 9356 - protein, 478 aa, Actinoplanes utahensis
MSDIVVVGAGVGGLAAAIRLAEAGHRVSIHERSGVVGGKLAAYERDGYRFDTGPSLLTLPDVFTGLGLDLRPEPLDPVVRHFFPDGTVLDSSSDHETFLARITDALGGAAARDWDRFWRRAERIWHASWESVLRRPVTAASLARLSWRLGDLAAIAPGRSLRSLGRRYLRDPRLRMLLDRYATYSGADPRRAPAALAAIPYAELAFGGWYLPGGLVTLAEALLARCEKLGVRVHLHSPVASIATTGARVSGVRLGDGTRLAADVVVSNVDAVTLYRDLLPSPKPLARLADRSLAGFVLLLAVRGETPRLAHHNVFFPRDYDAEFDAVFGGPGRRARPAGDPTVFVTRAADPAVRPAGDEAWFVLVNAAPHGTSWSTVDWLRAGLADAYRDRVLEVLAGRGLDVRDRLIFAETRTPADLAASAAAPGGAIYGTAGGLVRPANRAPVDGLFLVGGSTHPGGGLPMVTLSAEIVAGMIGSN

SEQ ID NO: 9357 - protein, 573 aa, Actinoplanes utahensis
MPENEWPDDPRPPDQGEWSQPHHEPPPGRGRALLAAAVVVLVLLAAGGIAWRLMSSRGATPVAQPTAPAPTPTAQTAPPCPQPRLRVAAAPEIAPVIQQAAAALSQPGQRCSEVLVQAAEPGAALTGKPDVWVPSSSVWLALAKSRGDVYTTQGASLAWSPLVIAGPESIASLFAPNGVTSWSGLVQGTIQKRVPAVRMPDPTLTTTGLLSVYAVGQATVKANPDAGIAQLQALTLRSRLENAAADPAELFAQMGKQTDAATAIYQVGVFPTTEQQLLTYQKSQHDVRLSGSAPADGQIDADYPYAVRKGAPADLVESLREAITPDALTTAGFRATATKNALRLPAPAVLAGAARQWSAYKSVAFQVLLLIDASGSMNEKITDRAGRSVTKAALLRESGTSAAQLFGDDTSLGLWFFGTPTADSPAHTEEVPFGPVIATVDGKSRRDLLAAKIGEYRPVANAGTPLYQSVLDGVAEMRGRAKPDTATVVVVLTDGSDGGTKYRMSNADFLKKLTAGADPAKPVPVIAVGYGPAANATALQAMAKATGGQAVTVKNPADLAAGIAQAFLAAHTH

SEQ ID NO: 9358 - protein, 249 aa, Actinoplanes utahensis
MGEFHDPRLVEVYDAECPWGWDDDFFMAVLAERSAHRVADLGCGTGRLAIAMAAAGHEVIAIDPAPAALAAARRKPGGTRVRWLQGSAERLAPRSLDAAFMTGHVAQSFVDDEEWDTVLRGLRRALVPEGRLVFDSRDPDDRPWQQWNPQDSWRTVVLDDGRVVEAWSEAEQVGLNTVRVTGRYRFADGGELANSATLRFRTEPELRDSLREAGFRVERIYGGWGREPVGLSGDGEFIVIAVATPRLMS

SEQ ID NO: 9359 - protein, 310 aa, Actinoplanes utahensis
MQLQQLRYFLAVVETRHFTQAADILGVSQPTLSKQIHTLEMSLGAPLFERMRGAVTLTVAGETLLPMAQRIVADADAARDAVQDIVGLRRGEVRLGATPSLCSSLVPAVLRTFRADHPGVKLHISEGSSHDLTAGLLAHTLDLALIVQPEHGVDPALVAIELLRESLVVASVAAGPPPTVGRQLELSELRHTPMVMFREGYDIREVTLHACERAGFAPKFAVEGGEMDAVLAFVEAGLGVALVPSMVLANRPLLRATPLAPPGMRRTIALAQRRAAVLPHAAAALREVVLDHIGSGRLPFGVRALERPST

SEQ ID NO: 9360 - protein, 246 aa, Actinoplanes utahensis
MAVDTPIPKTKNAAGATATPTPRKVVRPSSVTLKIIMAVSGILLVLFLYVHMIGNLKIFLGATDFDHYAHWLRALGTPLLPDMWYLWIQRTVLTVAVIAHIWTAAVLTIRAKKARPVKYAHRPKVQGSYAARTMRWGGVIVLLFIIFHILDLTTGTVNPVGDHEHPYANVVADFAPHRWYVTLFYALAIVAVGFHLWHGIFSAARTLGQQTMRGQRRAKTIALVLSVVLVVGYLSVPFSVLTGLVD

SEQ ID NO: 9361 - protein, 648 aa, Actinoplanes utahensis
MAETDFWKEGDPVVDKAAPDGPIETRWERRKFAAKLVNPANRRKLTVIVVGTGLAGGSAAATLAEQGYHVKSYCYQDSPRRAHSIAAQGGINAAKNYRNDGDSVYRLFYDTVKGGDFRARESNVYRLAQESVNIIDQAVAQGVPFAREYGGLLDNRSFGGTQVSRTFYARGQTGQQLLLGAYQALERQIGLGNVEMNTRHEMLELIIVDGKARGIVVRDMITGEITTELADAVVLASGGYGNVFFLSTNAMGCNVTATWRAHRKGALFANPCYTQIHPTCIPESGSHQSKLTLMSESLRNDGRVWVPKAQKDTRRPADIPEDERDYYLERIYPSFGNLVPRDIASRAAKNVCDEGRGVGPGGLGVYLDFADAISRLGRKAVEAKYGNLFEMYQRITGEDPYETPMRIYPAVHYTMGGLWVDYDLQSTIPGLFVVGEANFSDHGANRLGASALMQGLADGYFVLPNTINNYLAAGPFKKIATSDEAVVSARKEVEDRIARFLSIDGDRTVDSFHRELGHIMWEYCGMERTEEGLTKAIGLIRALKEEFWTRVKVPGKGEELNQNLEKAGRVADFIELGELMCIDALHRRESCGGHFRAESQTPDGEALRHDDEFGYAAAWEYFGADGKPTLHKEELVFEYVHPSTRSYK

SEQ ID NO: 9362 - protein, 247 aa, Actinoplanes utahensis
MDIKVRVWRQSGPSSSGKMVTYDVKGISPDASFLEMIDVLNETLILSGDDPIAFDHDCREGICGACSMVINGVAHGPEKATTTCQLHMRHFSDGDVIDVEPWRAAAFPVIKDLVVDRSPLDKIIQAGGYISAPTGTAPDAHAAPVPKKDADAAFEAATCIGCGACVAACPNGSSMLFTAAKITHLGLMPQGQPERDSRVIDMLQAQDDAGFGGCTNMGECTEVCPKGIPLSLIGRLNSDYRKAVAKR

SEQ ID NO: 9363 - protein, 132 aa, Actinoplanes utahensis
MTPQEIFVRMRERWLSGDATYDEAMLAEDVVVETPFAAPGRPTRTEGRERVLEQARAGRAGFPVRFDDCRAVVIHETGDPEVIIVEYELVGTHTVSGRRAAAPFIGVLRTRDGVLAGWREYQHTMAIAAATA

SEQ ID NO: 9364 - protein, 186 aa, Actinoplanes utahensis
MPPDADGPPLRADAQRNRARILDAAETVFAERGATASTDEVARRAGVAIGTVFRHFPTKNDLLAEIMKRLLRRLTADAGELAGRGDGLFEFFRRLIGEAAAKRSVVQLLAGSGLEIRLPQTIGQLEWAVGGLLTEAQAAGTVAAGVQLPEVMALLVSLCQGALHGGWDETLRERTLAVVFLGLRAA

SEQ ID NO: 9365 - protein, 73 aa, Actinoplanes utahensis
MADGRSARAHSRGAHTLPAMPGALPVHHVTAAAALRAYDVRQSALFLIRPDNYVGCATDDPRDILDHLPLISG

SEQ ID NO: 9366 - protein, 380 aa, Actinoplanes utahensis
MRRNAVLFVLISLCSGFGGSALALAAGLWVLDLTGSPGLAALAGLGTYAPVLAAPWLGALVDRFPRRPLLITVDVLVGLAILALLLDPAPTGIYLVLLVRGIGYVLLDAGETALLPAALPAGLLGDVNGWRSSAQEGMKLVAPPAGAALYAWHGPRPVLLLCAALPLVTALLYAMVRLRAAPAVPAAGPALDRRGVRAGLTELWRAPMRTPVLVAAVAIAVSGFTNAAVLRHLVDDLHRPSTYLGVLSGLQGAGAIAGGLLAGRLLARLRPARVAALGATLFAAACLTWALPWWPAMPVGSVLTGLGLPWTLIAGITAIQTGTPDRLLGRVGATGSMVMFGPITLGIPLGSALSGAGARPPLIIGAALTLGVALAARVSR

SEQ ID NO: 9367 - protein, 83 aa, Actinoplanes utahensis
MRESAAELHRRIGADRRWDARFPRAALVREILSSAPDAPPGALFDLVAGALADLSGPPVPRLPAPMRAAVDRLAASLAAASPD

SEQ ID NO: 9368 - protein, 40 aa, Actinoplanes utahensis
MTDLSALRAIRERRARLDAEELALIDQARRAGATWPALAS

SEQ ID NO: 9369 - protein, 235 aa, Actinoplanes utahensis
MVSELPRTLKVLWGVAERPTRGPQPALSLDRIVAAAIGIADRDGLAALSMARLAERLGCAPMSLYRHVANKDELLVFMQDAAPGEPPRLPPGWRDGLAAWARALRAVLAAHPWILQATAGRPPLEPGQLAWLDRGLSAFAGTPLSHRLRGEMVMAALYLARGEAQISAVLLSGVPDVVADYGALLARFVTAERFPALAEAVADGAFAEAAGPDESFEIGLARLLDGIELLMSTFD

SEQ ID NO: 9370 - protein, 208 aa, Actinoplanes utahensis
MTRWWRRPWIVPLAAIVVLFVTFSLPPYLSFDPARSRVPQPPTLGVAHFWLLVPHVLFGSVALGTAVVQIWPWFRQRHPVAHRRIGRLYVFGGVLPAGVCALTIGAFTPYGPVTRASDVLLALLWLTVTTAGWRAGRRRRFGEHRRWMIRSFALTASIITNRIWGAVFVIGLTPRLDTTFHGDAGLLTWVASSAAAWLGWTVPLLLAS

SEQ ID NO: 9371 - protein, 88 aa, Actinoplanes utahensis
MRRRSPGVNLCTVALMIVLDSTIVAVAVPVIQRDLGFTPAGVAWVINGYLVAFAGLLLLAGRLGDLLGTRRICLAGLLVFTAASLLCG

SEQ ID NO: 9372 - protein, 358 aa, Actinoplanes utahensis
MGDDRTIAAVRARAVDLRLDRPVETAGGVMATTPLVLIDVHTRDGVVGRSYVRCYTPLALGPLASLVGAVGEALVGSSAAPLTAERAMRRMFRLAGPQGLAGMATAGIDMALWDARAVAAGLPLVTLLGGEPGPVDAYASLRVMDARAAAAEAQELLGLGFTAFKVKVGGRSLADDLAVIRTLRAVIGPDARLMADYNQSLTVTEAIERVRVLDHEGLYWIEEPTTAEDFAGHARIAEAAVTPIQLGENWWGVSDLAKSIAARAGDHAMLDVMKIGGVTGWLRAMAVADAAGLPVSSHTFPEFSSHLLGVTPSATYLEYLDHARPILTEPVVARDGQVWIADRPGAGITWDEAAIARG

SEQ ID NO: 9373 - protein, 406 aa, Actinoplanes utahensis
MVLRKVDAATGVGRRRLLGWGGLAAAGAVTGGPPTRAGADRLPPDTLPGGAYDRYVARLAAQGRFSGVVMLSHRGRTVLSRAYGMADRERGIRIRESTAFTLSSAGKPFNAIAVLQLAQQGRLRLTDTVGDHLDGFDRDVARTVTIHHLLSGTSGLSIPDEDVQRIFRSRAEVHEYQLRWARQSRLVGIPGQQDREHVGAETVIPALIVETVSGMSYWDYVEQHVFRRCGMTGSAFFTRPQWLTDPRLAHPYMTMADGSRLDAVRHLDRGSPLGYLRDRNPGRAFIDAIGDGGFATAPDLIRFAHALRDGTLLDRPWADVLTAPKIPLGPGAFGTYGPPAAITGGQWAVQRAGGNPGVCANWSIYPDTGWAGVILANRDDVPLPEMIGQETLAVTGVAPADGGSGG

SEQ ID NO: 9374 - protein, 145 aa, Actinoplanes utahensis
MSAVLVLNADCGPLHRVSLRHAIRMLFRQVAVVHEARPDATIGVYQVPTVVRLVSYVVTRWRRGRGPGWSRAGVLARDRRTCGYCGEPATTIDHVLPRSRGGGNEWLNTVAACGRCNNRKGDRTPAEARMPLRVTPYAPAWVTFA

SEQ ID NO: 9375 - protein, 385 aa, Actinoplanes utahensis
MPAAAASRRPARTRRPWRTSRPAPGRSPAAGHAARPGTRSAPCRHATADRPRRAGSSSRVDATCSPPRARPPARYGSGVSLGLPSRLPGTPSIGDLVRGAAPTFSFEFFPPKTPDGERLLWQAIRELESLRPSFVSITYGAGGTTRETTVAVTERVATETTLLPLAHLTAVDHSVADLRNVIGRLAGAGIRNVLALRGDPPGDPMGEWVRHPDGVGYADELVRLIRESGDFSVGVAAFPHKHPRSAGVKDDTRNFVRKCRAGADYAITQMFFDADEYLRLRDRVVAAGCHTPIVAGVMPVTRMATIARSTQLSGAPFPPALLRDFERVAGDDAAVRELGIETCAAMCARLLREGVPGIHFITMNRSTATREVWQRLAPAEVAASA

SEQ ID NO: 9376 - protein, 356 aa, Actinoplanes utahensis
MTNSPLDEAGLRSRVDKALTVFLAGQRDRLLAIDPALAEMSATVSEFVLGGGKRLRPAFAYWGFRGAGGADSDAVVAAVAALELVQASALIHDDLMDRSDTRRGVPSVHRRFEKLHAGEGWRGSAAGFGDCAAVLLGDLALVWSDELLHTSGMAVADVQRARPIFDGMRTEVTVGQYLDVLTQATGDTSLERAGKVAVYKAAKYTVERPLLLGAALAGAAPGVHAAYSAFGLPLGEAFQLRDDVLGVFGDPERTGKPAGDDLREGKRTYLVAAAFGALDAAGRAELDAALGDPGLDEAGVARLRTVIRDSGALAATEARIDELMTASIGALDAAPIDQDAREVLRRLADAATRRSV

SEQ ID NO: 9377 - protein, 111 aa, Actinoplanes utahensis
MTYTTAAVLGVLAALTLDVLILRTRLVGRLVFWATYPIIFVFQLISNGILTGRDIVMYDPAAILGPRLVHAPVEDLLFGFALVLGTLSLWVALGRRGIQRTPRAGSRRTDE

SEQ ID NO: 9378 - protein, 108 aa, Actinoplanes utahensis
MRHLSYVAVLAGCLAGALWLEPILRVNVLRRWRRLLLAVLPMAVVFTLWDLAAIAAGHWHFDPAQITGVYLGGGLPLDEVLFFLVVPVCAILGFEAVRAVLRRPAGDE

SEQ ID NO: 9379 - protein, 255 aa, Actinoplanes utahensis
MVGRGRARPAGHRAQPGRRRRRRRRRGHRHGLLAGRRQTAGDQQIRPGRADQPERAQRDNHDESAPRPGVGLRRHGAPLHQRPGKRAQAGRGDVRPLGALSRAAAQVVLDRTPGAGQLTAHPSPQAHQLFSDLVWHAVRVSEPVITEPAAWINLPDLSERLDVSISKVHQMIRDGDLLAVRRDGIRVVPAELVANATVLKHLPGVLNVLRDAGYNDEEAFRWLYAEDAEVGGSAAIALGGQQAREIKRRAQALGF

SEQ ID NO: 9380 - protein, 667 aa, Actinoplanes utahensis
MDTTVADTLIGTTIDGRYRITGRVARGGMATVYRATDERLGRPVALKIIHPSQATNVQFVDRFTDEAKTIARLTHPNVVAVYDQGRHQGLPYLVMEFVQGRTLRDLLAQRRKLTAVEALAILEQMLAAIAAAHRAGLVHRDVKPENVLVAEAPSGGISDLVDAVVKVADFGLARAIEASTVDESGQLMATVAYVAPELVQAGQADARTDVYSAGIVLYEMLTGIVPYDGADPVEVAWQHVDNDVPAPSLLVPGLPRALDELVARATRRHPAERPTDAGRLLTEVQAVRDNLGAINLQTALMSQVPARPLGGDATTIVPAVPAADATAVVPPVPGGHPPAGRQRPSWARLPEQTGNRSAPHGRAAEEPPGEGFFADKRRVRLFSLIAVIAVVVLGSTWWLALGRYSDAPNLVNLPKAAAENAASHAHFGVFYGQPQYDDKVAKDSVVSQNPAPGERTVRGETLTLILSLGPEVHAVPDLTGQEAAAAKGSIEELGLKYKEGKGAYSDTVPEGVVISTDPKTGTELKPGDTVTVVLSRGRAPVTVPNLVGMNINDARSKLQELGLSALERTRQSNEPADQVLAQTPKAGAGVEKNAEITLDVSAGPPQVTLPDLNNQNCNQAKGTLEGQGLQVQVNNLNPLNPNAAVHGQNPGPNTPVAPGSTVQITCY

SEQ ID NO: 9381 - protein, 287 aa, Actinoplanes utahensis
MLLDRRIGSHTRTSGGLAKAALPYADAAGSETLQVYVANSRGWALPPGDPKQDVLFRDGIGERGLPAYIHASLLVNLGSPTVLTVERSLAALEHALRRGRAIGATAVVYHAGSSVDEAHAEKAMHQLHEQLLPLLETAAAEGLPRLLVEPSAGGGRSLASKVQDLEAYLAAVEGHPWLGVCFDTCHAWAAGHDLATPGGMTETLDALVTAAGPGRLQLIHANDSKDACGSTRDRHETIGKGTIGAAPFAELFRHPATAGVPIIVETPTVDHEGHAADIALLKNLRDT

SEQ ID NO: 9382 - protein, 405 aa, Actinoplanes utahensis
MAYSKKSRAVAGAAVAAAVLATGVASQSGAFAAGSTDPVLLGAEFTDRFPAKATGGAVIPVTVTGGTVGATPAAFGALHIAARIGGISAGVAWVDETHLKITAPATGKATNATMQLFRKGAAGPMSGAVVAYYPGVVSVSPSKISSEGGALVTINGNGFLGIDPDTPGAVTFGDVPATAITVVSATRITAVAPEGANGPATVRVKSDGGTSEVSGGGKVNYRGALSVDTTDDPTAKASGGPLLLKIKGGTVGASAKEFTAERIVVRLDRKALTATWVDESHVKVVMPPRLTDTATLTVTHDDIPGDEATVSIAPVVTNLSAKTDTLAGGTKVLVRVAGADAGNATSFSFGDHPADCAKQGSGSSLSFQCTVPAATDPGPVPITFTSGTGKQSHFTAASVFNYTDN

SEQ ID NO: 9383 - protein, 500 aa, Actinoplanes utahensis
MTKTTRARRATALTAAVVAVAGTVAVAIAEPSAAYSATGTIRVASDVFPVVTSISPLMGAPDGGTPVTIVGSGFQDIDTDNLSTVLFGDVPATGIWVVSDTKLVATAPPGTGNVLVKVVTDAGTSKNVTSMFGYRLKLSADFDSVTAKATGGAEIPVTVSGATVGSTASQFAALKVTAKVGGIPTTKVTWVDDTHVKVVVPATTRAVPSKLQLVQDGFTGPESTATVNYAPVITSVTPGAVAVAGGDTIRIVGSGFGGVDPKDPDAVTVGGVDASYFQVVSAGQIDAVVPAGAAAGYAAVKVTAPGGASAEAARIAYRSALTFAGDQYLRANGGVHLLTVTGGTLGANLADYAAAGISVRMGASKLTATYVDATHLRVTLPVLTTDSLALTIYQETVAGPVATIPVAPVVTSLSAVSDTVGGGSTVKVKVAGPGVTTASNFLFGTYAAVCPGSGSGSGLVFTCVVPAAAAAGPVWVRFTSGSGTASRFTPAASFSYTDID

SEQ ID NO: 9384 - protein, 339 aa, Actinoplanes utahensis
MVDLRSDTVTRPTDGMREAMATAVVGDDVFGDDPTVNALEEHVATLFGHEAALFAPSGTMANQIALQLVTPPGGELLAGADAHVVTYELGAAALLGGISTRTWAATGAALNVDRIAAMIRPPGFPSVPTAAIAVEQTHNLGGGGVIPLGTLRDLRAVADAHGVALHCDGARIWHAHVADGVPLASYGALFDTLSVCLSKGLGAPVGSLVIGSRDRIARARVIRKRMGGGMRQVGILAAAGRYALDHHVERLAEDHARARRLAEGLAPLGVVDPALVRTNLVPLDLTKAPLDAPELAAAAARRGVLIAAMLPKLARLVVHLDVTDDDVDEAISVLTVLLA

SEQ ID NO: 9385 - protein, 463 aa, Actinoplanes utahensis
MRREWHQLSHPGVATSRPSTDSAEDEALGLDRWRELPRVQMPPWPDMAEVASVCEVLSNVPSIVAPYEVDQLRAKLAEVCEGRAFLLQGGDCAETFADNTESHLLANARTLLQMAVVLTYGASMPVVKVARVAGQYTKPRSSLTDSLGLPAYRGDMINSLDKDETARIADPQRMIRAYANSAAAMNMLRAYLAGGLADLHGLHDWNKDFVRASPAGERYEAIAREIDRALDFIRACGMTDNEALRTVSLYCSHEALALEYDRALTRVSGDKAYGLSGHFLWVGERTRQLDHAHIDFISRLANPIGVKIGPGTSPETAIELCEKLNPENIPGRLTLISRMGNGKVRDALPPIVEKVHATGAKVVWQCDPMHGNTHESSNGYKTRHFDRIVDEVLGYFEVHRGLGTHPGGIHIELTGEDVTECLGGAQGIEDLDLPDRYETACDPRLNTQQSLELAFLVAEMLRG

SEQ ID NO: 9386 - protein, 496 aa, Actinoplanes utahensis
MGKTLRRALLAGAVVIGASASIPLVSANAATACATAWSASTAYVKDNVASQNGHNYTAKWWTQNESPATHSGQWDVWADGGACGGTTTPTTSPTASPTVSPTVSPTSSPTSSPSTTTSSPSNPGTGGKNVVGYFAEWGVYGRNYHVKNLVTSGSAAKLTHILYAFGNTTGGQCSIGDSYADYDRAYSAAESVDGVADTWDAGALRGSFNQLRKLKKQYPNLKVIWSFGGWTWSGGFTQAAANPAAFADSCYNLVKDSRWADVFDGMDIDWEYPNACGLQCDTSGPDAYNKVITALRTRFGTNFLITSAISADGSNGGKLDVADYASGIAKLNLVFPMTYDYFGAWDAKGPTAPHSPLTSYTGIPKDGFYSDAAIQKLKSKGVPANKILLGVGFYGRGWTGVTQAAPGGTATGAATGTYEAGIEDYKVLKGSCPATGTVAGTAYAFCGGNWWSYDTPATIAGKMAYVKNQGLGGAFFWEFSGDTSNGELITAIKGNL

SEQ ID NO: 9387 - protein, 156 aa, Actinoplanes utahensis
MTIFDVDIDALTGGTTDLDRYRGSVLLVVNVASRCGLTPQYDKLQPLYDTYRDRGLVVLGAPCDQFGHQEPGTATEIDEFCRATYGVTFPMTAKIEVNGAGRHPLYQGLVGDGPDIQWNFEKFVVAPDGTVAARFAPGVEPDDPELVATIEKLLPH

SEQ ID NO: 9388 - protein, 225 aa, Actinoplanes utahensis
MSIHVIGVDAYALGWVGVELRDGAFGRAVLASTLYEIVAGSSGAAVIGVDIPLGMLPDRWRAADTLAADQLGPRRGSVFRVPPRAVWAEPDFAAANRLCRELTGAGLSRQSWALRPKLLEANAIWERHPGLLFEAHPEVSFRTMAGEPLPYAKKTWSGQSRRRELLARHGITLPDRLGPAGQAPPDDILDAAAVAWTAHRVATGTALSFPSPPEEDNGSKIAIYY

SEQ ID NO: 9389 - protein, 617 aa, Actinoplanes utahensis
MRVQPRQQLLEIWQAVLDYSFRDGRWHWGGRDGRNSISDAEQLLCILGPATTIRAFTLDQPDRVEDDVLDAMRALGGRLDIPITLLRVVEEYLTTYTDATGTPTFAAEGYFRVAETQEEKPSPEQLAQPVVDSFAISLSLSLAIIGFARQFRSNLKRRSARADIDKLEAMASKRLTAAMIGLLRSFTVDIFEVDSREGRALVRTVNQRGLATRRIVPLIQESLQEIRASLRDVTMGSGAGLADDLDHPDRLFECGWSWGVVRDAPAIVTSEKVGDQPAGFAEPAPYIYFTALALDAIETLLSPRTRQLGLLNEEQLRLSQGLQLRWDLTQSYWSTIATANIGGARWPLEDIPWQRITENESEYYSLHVSSIVVQDLVRKRARDVDLDRVGLVLEELANRSRITRRVYAGDKSYQVHAPGFPIELGGSDADIGPALTWYLSDFAPLLLKRTISLAGLLGDPDLRGRMLELADEIWGQLDSRRLPGERRRGLWDQPSLVFEDYDVRYDAPSWYHTKRVVDCLVTAAEVLSSPPLRSTRLTDHAGDLLSEADHLYDQELLQGSPNGGQAMRTELQELQSRLQRARSVLDEKPGTAAALASDVLLRLDRFAAARSDLDGES

SEQ ID NO: 9390 - protein, 301 aa, Actinoplanes utahensis
MLVFATSDKGGTGRSVTTSNVAYQCALGGHDVCYLDFDFGSPTAGAVFDVDTGKLVVDGGGLHSYLLGTVADPHRCDVFADSERLSMRERPLGAGRLTLLPGDSGGGEFPSTPEMIRRCKELLVRLDQEFDVVFVDLSAGRSYALQMALAAMAGVQPAPTTRWLVYHRWTQQHIQAAASLVYGEHGILATGLTLGHDRERLLGQLRFVRTAMVSPAAQGLTAEQAAWVKDWNGDLQNLARERGAGALYLLGSVPLDPVLQWREQLITNHDLTVSRIANRATADAFAELAQLIVDDDVWDDR

SEQ ID NO: 9391 - protein, 326 aa, Actinoplanes utahensis
MTGPQAHYEERSAQPRVEQLPLAHLSIELGHLYKEDFAGGIEQFRRHFRQIRPYVAAARDRLAGMLEPGRTPRVSTCFMIDDYFDRFEDPPAAVVDELVKAAAENDLTIDYLAREAGCARAGEVSPAELVLDRLVADPPPGTDGVWQPPQESGWLTNGDWPPGAAAPPAMSARTGPARPTENARNRHSVFFAVEIFSTVSGSRLWACPHLAAVWQLMRLGLLRHHGRPVAPARPAGEIPATWAEMPAVLQLNAAAAPFHAYRTHSVLARRFLNIETAVGIVLSQVAVDEEVRLQVARRAAGEGFALSDNLLERIAYVFDGETARLV

SEQ ID NO: 9392 - protein, 348 aa, Actinoplanes utahensis
MDRHRAAHPRPPRAEHPAGAGPADRIGGVVNRLSATNGDPGERGVSEVVRKVGVALITGGVAFALTNLAHQDPILSVTLSVLIGGSALVVQFLVDFESRLREVQIGQRDQARQIRECVDERFRAISEATELYGLMEDSMVQTEVLSQLIRHSTRIGPNSSALAHRLAQRELHRMAEFLKELGDGGEAIYDGEDRDWLLGLTCSAEKCIDATSLTTVDGGGMWSTDLGQRYLDAQREAVQRGVRVRRIFILDRPDPQGADRLDEVYRQHADIGVEVRVLDSAAAGQLRRTSLFDFILFDGVIGYEVTTGSWIDESAPPIVVNTRLVLRPSRVEERRDRFSQLWEAARPR

SEQ ID NO: 9393 - protein, 303 aa, Actinoplanes utahensis
MLPTSAALPADVGVRLLALTTGAQVLRTDRPMPYVVSPDRLTGVDCQVPIGARRTARAIGTVTTRALLVGGHVLQSSARTTAVRSEQNRRLPWSHYLARPHTVEIVGKHRERDTAEAYLATTPVSPLLNLGAIAGHTAERVRGSSMIDSRVPFRSGRITLRWTAMLGDTQPDSVRFTVEGEGRRTVRVHTRDEDALPGVVALCEDLALHDWLLTTLTGMVARAPLSGPRAPAALDRIRPALDHLLHLWMPGARLEVTTRRFWDELERHAGFGRQWTATVQRIRDHLALSTLRELGRLTGSAAS

SEQ ID NO: 9394 - protein, 360 aa, Actinoplanes utahensis
MDRTTIDRAMSPYCHLTHPDPLSIVDPFARFVYAGPMSQRADVVVIGAGVSGLTSALCLAEAGFGVRVHSADPPGRTTSCAAGAIWGPHLVAHERALGWALRSLAVFRDLAADPRTGVRLVDGVEASRGDLVTPRPGAGPDDVRRCDPATLPPGFTNGWRYRVPLIDMSRYLDHLCARLAGFGVEMTIGEPVTAAALPGFGPVVVNCTGLGARDLIPGDPVAPVRGDLLVTGNPGITEFFVEHDDDADGLTTYVLPQGDRVMLGGSRRTGDYSTLPEPAAARAILDRCTAAEPRLAGVQVLRHHVGLRPVRDRVRIGPDETHPHVIHNYGHGGGGVTLSWGCAQEVVAVTAAAARTIRPR

SEQ ID NO: 9395 - protein, 257 aa, Actinoplanes utahensis
MAASPRPEIRELDQMDEFEAAVGVLCRAWGAENALDLINASTLCAMAMARNYVAGIFVQGEMVGAAVAFRGPDHLHLHIAGVLPGQQNLGLGYRLMEHERDWAVAEGLSSIQWTFDPLVRRNAYFYLTKFPVTVQSYRRNLYGSLTDGVNDGDDTDRLVVAWEFGAGRPAPGLAPVDAPFDPGFWDFGRSSVALLPVEDGAVLLVPTPADIDALRTKDPDLARTWRIGVRAGFQKALGSGYRVTGFSADGWYVLRPQ

SEQ ID NO: 9396 - protein, 267 aa, Actinoplanes utahensis
MAQQTVALLGTGKMGEAVLAGLLRSGWPADRIVVTARRPARGAELTGKYGVTLAGNTAAAGRAGIVVVGVKPQDAGPLLDEIAPELSPGTLVVSLCAGLTTGFFAGRLPADTPVIRVMTNTPALVGEAMTALSAGAHATGEHLDAAEELFRPLGATVRVPEYQQDAVTALSGSGPAYFYLIAEAMIDAGVLLGLPRAVAHRLIVQTAAGSAAMLRDSGEHPVLLREAVTSPAGTTAAALRELERHGVRAALLAALEAARDRAAELAG

SEQ ID NO: 9397 - protein, 342 aa, Actinoplanes utahensis
MRIGVLTGGGDCPGLNAVIRAVVRKGVTAYGHEFVGFRDGWKGPLEGLTKPLGIAEVRGILPRGGTILGSSRTNPFKIEGGVERIKANLAEQGVDALVAIGGEDTLGVATKLHDLGVNVVGVPKTIDNDLNATDFTFGFDTAVNIAMEAIDRLHTTAESHHRTLVVEVMGRHAGWIALHAGLAGGANVILLPERKFDVEQVATYVTKRFQVEYAPIVVVAEGAQPLDGQMVLHNQELDSFGHVRLGGIGQWLAEQLEEKTGKEARTVVLGHIQRGGTPTAFDRVLSTRFGLQAIDAVHEGDFGKMMALRGTDIVRVPLIEGTGELKTVPLSRYEEAEVFFGN

SEQ ID NO: 9398 - protein, 495 aa, Actinoplanes utahensis
MSTLLDRPRKAGREASADTGRWWALVVLSLAQLMVVLDATIVNIALPTAQASLHFSNADRQWVVTGYALAFGSLLLLGGRLSDFFGRKRMFLIGLIGFASASALGGAANGLEMLIVARALQGAFGAALAPAALSLLSTTFTEPAERGKAFGIFGAISGAGGGIGLLLGGVLTEYVSWRWCLYVNLVIAALAVAGAMLKLKDEPSGAHGRIDVPGTIAAVVGLVGLVYGLGKAETDGWTARGTLGPIIVGVVALILFVLIERRVEHPLLPLRVVLDRNRGGSYASIAIAGAGMFGIFLFLTYYLAVVLHFTPVKTGLAFLPMLGSVMLTATTAGSILAPKVGPRPLVPLGALVAAGGLLLLTRLDLDSTYASGVLPGLIVIGLGLGLVFAPTQNAATSGVEHRDAGVASAMINTVQQIGGSIGTALLSSFAATAATDYAKGKQPSQLLQLQAQIESYHTVFWWSAGFFVLAAVVALVLFRTGPLDVDPDAPPAMAH

SEQ ID NO: 9399 - protein, 218 aa, Actinoplanes utahensis
MTETTRPLRRDAQRNRERILHAAHDVFAARGFAATLDDVAHHAGVGVGTVYRRFPTKEALIEAIFAERLEDLVSLAEDALALPAGWDGLTMMLRRSIEMHAVDRGLRDAALCVGVGKQHFAEVADHLVPLVQELIDRAHAEGSLRPDVGLHDLPVIMATVTELAQHSSAGRPAVYRRFLELIIDGLRARPDNGDLGPAMTQADVEAVVDDCVPSIKRT

SEQ ID NO: 9400 - protein, 164 aa, Actinoplanes utahensis
MVYRYFYDCEFIEDGRLVDLVSIGVVDEFGREFYAVSTEFDDSRAVPWVRRNVLDKLPSPADKAWRSRERIREELYEFLMEPLRGRNEQMELWAWYAAYDHVALAQLWGAMPALPREIPRFTKDLRQRWDDRGRPALPEMAGRHDALVDARHNLARWQAMGSGS

SEQ ID NO: 9401 - protein, 317 aa, Actinoplanes utahensis
MSSQSLSVNTSSPSVIVTLAVRRIWVVCRDNPAVPEDEILRIALRDQWHLNPSGITALPRAVMSRDWEVTAGRERYVARLVETAARLPAEAGLAAAVHLRGVRISAGEPVRTLAGQLTAETPLGALAVLRRPPGRHLDGADPIDQQWWGERLGAVHRALDGFVHPGLRPWQPVEADAAHLDAEPWLRPAVAAAVTAATRLTVTDRLTYGVLHGDPAPEAFVLDVDTGRTGLLHCGTSGTGPLVYDVAAAVIYAGGPDRAAELLDGYRCAGPVAADELEAALPVLLRLRWAVLAERSARRGCPTGLAAAREALTSMPG

SEQ ID NO: 9402 - protein, 228 aa, Actinoplanes utahensis
MDHRMPDSGDALTGVEMFAGLEPDVRQRVIAAAVPRHYRKGQILFVEHDPGDSLIIMKRGAVAVFRTAPTGERAVLTVVRPPDVLGEVSLLDALTRSASAEAIEDSQALSLSRAAFMDLVHSNPRILDAVMRSVGGLIRRLTEQNADHVFLDLPGRVAKTLVRLSGESQAPMITIELNQSQLAEMAGGSRQSVNQAIGSFANRGWLRTEGRRIVVTDVQALKRRAGMN

SEQ ID NO: 9403 - protein, 250 aa, Actinoplanes utahensis
MARRPRFVPFLRPGTPAASAERTAVFYWLLKLVVLGPVLKLVFRPHVEGLANVPRSGPVILACNHLSFSDSIFTPLVMKRKVTFVAKAEYFTGKGIKGWLSRMFFVGAGTIPVDRSGGEAAQAALDTLLRVLREGNIAGIYPEGTRSPDGRLYRGKTGVARLALESGAPVVPVALLNTDEIQPTGTLVPTVKRVRMRIGAPLDFSRYADSRGDRFVERAITDEIMFELMALSGREYVDVYAAKLKDPQPA

SEQ ID NO: 9404 - protein, 266 aa, Actinoplanes utahensis
MTAGGARRGRRDNGLDATDYAVAGDVDPRVGEHLLDVLAGDGIAAYLQPTADLNPILRATTLPARPIDRLYVDRLHLDTAREHLQQVTGGVPPTPPAEPAPAPRPQSEVDAEWDRIIAGFHTTVDPAAAPWPESEGTTSDADRKDRSRPVGEDGRPVNRRRTDPPPPEPVVYPVIDPFGFPDVADEDERYVPPPPPPLPHISKYTVAGTLGVILGFVLFLFPTLIPVDRNFVMFFGFAGIVGGAITLVWRLRSGDDDDEFDDGAVV

SEQ ID NO: 9405 - protein, 471 aa, Actinoplanes utahensis
MRQSSLVVVAHRLPLNDSAAADGACEWRQSPGGLASALHAILQQTPATWVGWSGVVGPAPRLPDIGSLRLRPVALSDDELRGHYEGFANATLWPLYHDAVQQPVFQREWWETYRAVNQRFAEAAAEVAGRNAAVWVQDYHLQLVPRMLRELRPDLLIGFFMHVPFPPPELFMQLPRRVELVHGLLGADLVGFQREQAAHNLAQLAKKLLGADATDDAITVGGRTVRTGAFPVSIDVAEMSALAARPDVAAHARQLRHDLGEQKRVLLSVDRLDYTKGIEHRLTAYRELLRDGYVKVRDTVLVQVAVPSRERVDSYRDLRDRVEGEVGRINGEYGRVGEPAIHYLNQPFDRWELAALYRTADVMVVTPLRDGMNLVAKEFVAARADGTGALVLSEFAGAAAELDEAFLVNPHDLDGLKQTLLRALEADPADLAARMTAMRRHLAEHDIHAWARAYLTALDHTGRLAQRLGAR

SEQ ID NO: 9406 - protein, 259 aa, Actinoplanes utahensis
MTGFDLLRFDDWTDPVPPAQREIVSRLPDEDRGRPPVVFVPGLGHGGWAFAEHWLPHTAGRGFPAYAVSPRPGGDLRALVHDVVQTAAGLPRQAVLVGHGVGALVVARALGRYPARAAVLAAPVLDGWSALGSAVRANPAGTLPALFGGRLRLSARQLFSAGVPAEQASAYLGRIRPRPRVELLRRVRPPRPVGAPPVLVAGSPDDRVVGRKALDRAAAAYAGAPLMFPGMGHELMLEPSWAEPIDAVLDWLDKQLPRA

SEQ ID NO: 9407 - protein, 447 aa, Actinoplanes utahensis
MHDSPDIGDRRDAVCVVGAGPSGLTAVKNLRELGFQVDCYERETGVGGAWNWRHDRSPVSAGTHLISSRPLTEFPDFPMPDTWPDYPHHSQVLTYLERYAAHFGLGEHIWFGMEVVSAAPTGDGGWEVTTRSTGGGTSRTSRYAALIVANGHNWDPRKPEIPGEFRGRVMHAGAYKDPAVLRGRKVLVIGGGNTGCDIAVEAAQQAAQVWHSTRRGYWYAPKYVLGRPADQVNDRLLRWRLPLRLRQWLYRRTVRLTTGDLTRFGLPAPDHQPYETHPVVNSQLPYLLGHGRITPVPDVTAFDDAAVELAGGQRIEPDLVITATGYRPRFEFLEPGLLDADEHGRPDLHLHTFARKNPTLVVIGLLQPDSGLLPLAHWQSVAAARWLRLRLTDPARAAAVQQRESAKPLSAWSRRRVVDTERHWFEVDHVAYLRCLQSLLTEMEPAA

SEQ ID NO: 9408 - protein, 225 aa, Actinoplanes utahensis
MSGVPLRVLSWNVHGLSDDRAALTGLVRELAPDVLIVQEAPRRFRWREKSATLAGECGLVVAAGGLPALGNLLLVDLRVAVGQTWNLRYPLTPGRHLRGAFFARGRVRGASFTVSGSHLATDPAERPAQAALWKDELSALTGPVIVAADLNEGPGGGAWRTVEDGLLTTRDDEPTYPASAPSRRIDALFVTPDVTIERYEIIATDRARVASDHLPILADLLLPPD

SEQ ID NO: 9409 - protein, 418 aa, Actinoplanes utahensis
MRVRWPVRRRRLPGSGPLRASARPGMPAGPPGRAGVGTGRPRPDGSGRLRTSGPWARRRPPKVARARPVAWIMCGARKRPRIAGPGRAMAPGTATRCEEGTGSVTLTIGIDVGGTKVAGGVVDEHGNVLASNRRPTPADDPAGTRDTIVEVAAELAAQYPAATAIGIGAAAWIDAAGSTVLFAPNLAWRDEPLRDYVSKAVGLPTVLENDANVAAWAEFRFGVAKHADDSMVMITVGTGIGGGIVLNGKLWHGANGIAGELGHLQSVPDGHPCGCGRLGCLEQYASGNALVRFARAGARQEPERAAKLLELAGGDALAITGRQITEAARAGDGVAMDAFAQIGYWLGVALADLAQSLDPQILVIGGGVIDAGPLLMGPAERTYRDQLAQRDRFPVAEVRAAQMGNVAGVVGAADLARR

SEQ ID NO: 9410 - protein, 354 aa, Actinoplanes utahensis
MAGSARDEAERLVAAIIARAATAGVSAAASAASSADAGKVAGAAVSGTAKLVGNTVDGFFGMLNDVARGGAGQPGTPGPGGRWATGSPECCVCPVCQAIAAARNPSPETVFKVVTGAGDLAGGAAGVLRGLSSLAGAVLGERSRPTRKSPGGGAGRQAPGGERQAPGAGRQPTSGERQAPSPGRQAPSGEWQAPGAGRQATGEGRRAPSSDQAWSAATRAADPARPTNPHDLAETTGSVSAAGVPARPVDRDESGQTAGRVAGQAGVAQAARPAGSPPVTGQAGYPSAADQAGSPRPATTVRAASWTGAVAGADASGSDREADPWAAATADSAREAEEARARARAAEQAVALAS

SEQ ID NO: 9411 - protein, 150 aa, Actinoplanes utahensis
MADTSTQSIQVAAPPARVAEVICDFPAYPEWAEAIKQATVVEEYEDGYAAQVAFRIDAGVMADEYTLEYAYADDLSRIEWHLVAPSKTQKSQEGAYELVPTADGGTTVTYTLAVELAIGMLGMFRRKAEKMIMDTALKELKRRVESLPAA

SEQ ID NO: 9412 - protein, 538 aa, Actinoplanes utahensis
MLALVAVLSLIASGDPRQLGWVALLAVAAVPAFVARRHPVLAPAGRFAEVIVTGLAAGFIAKASTGAVQGFGAEAILPYLAVPLLTAALRRKPTEGAALLGVAAVAMVAGGALAGPKTVLAGTGYLAAGGQWLVLGAIVTFAAEAMRQFLQPAEATPQPYAEATRLLTQLRSVARSLPGATLDPGGISEHLLEELRAVTPGHRAAVLSASGGGRLVVLAQTGAERVDWETTLDADSAIADAWATQQPHVASRSQARTHRGGEVSSLVVPLVAGVRTIGLVILETDAAGAYPSPVVQSVTEVTEPAALRLEAALLFDDVRSLATNEERQRLAREIHDGVAQELVMVGYGIDNAQATLPEGAEETAEELRALRGEVTRVITELRLSLFELRSEVDRNGGLAAAIAEYARTLGTSAGLRVHFTFDESTARLPAATEAELLRIAQEAITNARKHAGAANLWVTCTVDPPYAEIEVSDDGKGFADNRPDGRYGLTIMAERAERIRGRLKITPRHPSGTTVAVVLGTPPRRDSVRDSVSAPEGE

SEQ ID NO: 9413 - protein, 222 aa, Actinoplanes utahensis
MSTSPAPTTRTKVLLVDDHDLIRKGLRHAFERDRQFEVVGEAATAAEAVRQAGALQPDVVIMDLRLPDGSGLEATRALRKNNANMGIVVLTMYAGDDQLFGALEAGASAFVPKTAPADEVVAAARHAASAPSAFTAADLAEAMKRRLAPSGPQLSPREGQVLRLLADGMSVAGIAKQLFVSESTAKTHISKLYEKLGAANRAQALMTALRLGLLEAPDAPKF

SEQ ID NO: 9414 - protein, 138 aa, Actinoplanes utahensis
MLLDPRGQRFAAAITSIVIALVLITGSGWLALAQAAVFAVTAYRPKWGPYPWIFRLLVTPQPSEPAAPVRFAQLVGFAFLSVSAAGYLAGAETVGLVAAAFGLLAAFLNAAFGLCLGCEAYLGIRRLTGRNAEGVGNV

SEQ ID NO: 9415 - protein, 159 aa, Actinoplanes utahensis
MARWAAFWKDEPQFAPEVEGALVRMKHILRRIERADAAAFARNGDDFTLQDYKTLHVLMIQPWPTEATPAQLAEAANVTRAAMTSRLDRLEAAGLVTRTVDAQDRRRVLIRPTPAGRDRWSADIFAGMARDQEALRVLSLEELEQLNGLLRKVLHSLGE

SEQ ID NO: 9416 - protein, 401 aa, Actinoplanes utahensis
MTRDFRLLAAGQTLSWLGTGFQTVALAVAVFAHGGSVRDLGLVMAASVLTMLAGTLFGGVWADRLQPRHVMVVSDVIRMLSTAGLALMFRGGGYHLGALCALTVVSAGAGAFFTPAMSALKPLLVPAVDLQRANATLSMLQTGCGVAGPVLGGLVVAAVGAPAGFAVNSVSFLASLVTAALIRVRVERGPHEPMLRELGAGWQAIRSRDWLLGGMLSATVYHVANGIILVLVPLIAWQRLGGAHAIGWISGAEGLGGLLGSALALRVRPRRLLRAGWLTLMLMPFWALSYVWPGRLTAVLAGAIVGYGGLMFFAVAWETAIQDRVPRTMLGRVASWDYLTSFLAMPVGNALAGPLTARFGVDRVLVACAFVLFAAAASPLLIRGSRDLTRSAEPAGVAAHA

SEQ ID NO: 9417 - protein, 159 aa, Actinoplanes utahensis
MDPVGLAAVGVVLVAGAGVGWWRRRTDGGVRQTGAVDTVDRALLVRLGVEPGRVTLLQFSTAFCAPCRAVRRVSAEVVALLPEVRHVEVDAESHLDEVRELDIWRTPTLLIVDGAGRVTRRATGVPAKPQLIAALAESGVRGDSGRLGGPGQIAGAADQ

SEQ ID NO: 9418 - protein, 660 aa, Actinoplanes utahensis
MPDADTARPATADHPPPAAVPAAGASPPTTEDDQPVVLEAGGEGELELPYWLTSTQEAADTTFLQMLRRLPRLLRQAWLLGWRASPGTTVAVLVLQVAAGVAGALGLISVVGVFDGLLQAGPTPERVRAAVPSLLFLVAALAVRGLLASAATAAHGRLSPAVYEAAENRLLDLTTRVDLATFDDPDWRDAMERARDRGIDAAQQVVDFGIEVLTHVIGLVAAAGVLAVLHPALLPLLILAVVPTGWAAVRAARAGYRSRLRLIAVWRRQRMLAYLLAAREPAAELRAFTVRRFLLAEVARLLRISTVEEIRMVTRQVRTNLAGQALSGLLTGLAYVTLCWLLWTGRMELAAGGAAAYAINIGISKLRELAFSANRVYEYGLYFADFQGFCELSEARAEPASEVPAPATFGEIRVDGVTFRYPDAERAAVDGVSMTLRRGEIIALVGENGSGKSTLAAVLAGLYRPQQGTVSWDGVDVTRFRPESVRERVAVVMQEPTRWPLSARANIAIGRHDRPASLAEVRESARAGDAHGFVTELPRGYETLLSRHFTDGADLSGGQWQRLAVSRAFHRDAPLLICDEPTANLDARAEHEVYGRLRGLAAGRTVVLITHRMASVREADRIYVLDHGAVVEQGGHDELMAAGGLYAQLFTLQASAYQSA

SEQ ID NO: 9419 - protein, 171 aa, Actinoplanes utahensis
MTEKIFPAEADEARFWSLIESAWTALGDEPARLRHELLTGAPGTDPYAIDAWLDRFVEQLTALSADLSSAELTALDRVLERKLHDLDRADIHEVTDGSDDGFLYARGHIVALGRAYYDAVSADPQKAVVDADCEAMCYLFANLHQERFGSWPETGSGISRESGSNSSGWSS

SEQ ID NO: 9420 - protein, 376 aa, Actinoplanes utahensis
MARTLLVTNDFPPRPGGIQQFVHNLAVRQPAGSVIVYSSTWKGAAAFDAEQPFEVVREDTGMLLPTPAVARRAGELARAHGCDSVLFGAAAPLGLLAHGLRRTAGITRAVGITHGHEIGWAALPGARSLLRRIARGSDVITYLGEYQRVRLDRALHGLTDLRRLAPGVDVDTFHPGVDGSAVRKRHGLADRPVVVCVSRLVPRKGQDMLIRALPELRRRVPGAALLLVSGGPYRKTLATLARDHGVESDVIFTGSVPWAELPEHYAAGDVYAMPCRTRAAGLDVEGLGIVYLEASATGLPVVGGDSGGAPDAVRDGETGYVVGGTDLAGLTDRLTTLLSDPDQARTMGQAGRAWVEKEWRWETQAARLTNLLTPPA

SEQ ID NO: 9421 - protein, 418 aa, Actinoplanes utahensis
MTPRMWALVSFGVLLVALVLVAALTVPWHRAPAPRADQVAALGRFPAEQVARARQFRAELRPGTYGSMLLGLVVALALGLTPLGARLVELAGRPFGGHWLGRAVLGGLLVVLVGELLTLPFAAWRHTIVVRYGISTQSWGGWGTDLLKSFAVSAVLGGLALAGFFAVTRFAPRWWWAFGAAGAAGLVVLLSFVLPVVVEPIFNRFTPMPAGPLRAELIALAAADGVPVKDVLVADASRRTRAVNAYVSGLGPTRRIVVYDTLLTEATPDEVVSVTAHELGHAKDGDVLTGTLLGALGAALAVIAIYLLGAWTGLLRLAGVDTIGEPRAIGLLLALAALAGLLAGPGQAFVSRQIEARADRHALDLTGDPQTFEAMQRRLGTVNLSDPDPPTWELLMFATHPSTVQRMAAARAYARGER

SEQ ID NO: 9422 - protein, 69 aa, Actinoplanes utahensis
MIIDCGRCVERTDECTGCLVSVLAQTPDGIADLTPGELRAIEVFELAGLEVELLETPEPPVRVALRRTA

SEQ ID NO: 9423 - protein, 456 aa, Actinoplanes utahensis
MSAPLNPDDRPAEEAAAAAVDVTPEPILPEVVRQRIMTLAAAALPGLPADEIPVVLRRVARFAPNRRARLGGREIAAQLTADPLFRQRIGARIVTDAGDLGAAVTSGVAPAAADPVEVAALAYLARPDGWRDLIEAAGDVVRADADSHALADRIRAAEQRATRAEHDRAVARVEADKLRDELARVREELGQVREEARVAAKALRETQAAQKRAADLLATEKGRAARVALDHEAEVRRMRSRLADAEAAAATGKQAAKDARAVDDARLWLLLETIGQAATGLRRELALDPTDKLPADFVADAAADRPGAPERSQARAQDTDDPGRLDQLLALPRAHLVVDGYNVTKRGFADMSLEQQRKRLITGLGGIAAQTGDEVTVVFDGAERVHGLPPAPRGVRVLFSRKGTTADELIRQLVRAEPPGRPLVVVSSDREVADGVRRHGAYPMGADSLLRRLARS

SEQ ID NO: 9424 - protein, 603 aa, Actinoplanes utahensis
MLPAVAQPAYVQGTLDTLLSADGSVDPAAVSLADTTFVVLDLETTGGAPDGGGITEIGAVKVRGGVPIGEFGTLVNPGEPLPPFITVLTGITEAMLRPAPPIETVLPALLEFLRGAVLVAHNAPYDVGFLKAACARHGYPWPAPRVLDTAALARRALTRDEVPNRKLGTLAQFFRSAVQPNHRALDDAKATVDVLHGLIERLGSFRVHTLGDAIEFAKAVTPAQRSRRHLADGLPHVPGVYIFRAADERPLYVGTSKDVATRVRSYFTAGEKRARISEMLTAAVRVEAIECAHPLEAEVRELRLIAAHTPPYNRRSKYPERVVWLKLTAEAFPRLSVVRRFAEDGATYLGPFSSRRTAELAAAGVYDAVPLRQCNHKLSLRTRTPACALAELGRCPAPCEHEITPEEYDLRAAAPFRVATSGDPGPVIEAILARLDTLSDRRRYEEAATVRSRLIALLRALIRMQRLDALTRLPQVVAARRDDRGGWEIAVVRHGRLAAAATSPPREHPRPTLDAALLTAETVLPGPGPVPSATAEETERILAWLERGDTRLVETSGDWVSPARGAARFAVLLSRAEAAASAQDSTVRLSVTDRSDDARSLRL

SEQ ID NO: 9425 - protein, 596 aa, Actinoplanes utahensis
MDVDAGHGAALGRALPAATSPSPLSFTRRLRSLLSFQGNDDDPVSTLAKTHRTIHPAADVALLRRSYAIAESMHRGQFRKSGDPYITHPLAVAQICAELGMDTTTLVASLLHDTVEDTSYTLEALEGDFGPEVTHLVDGVTKFDKAFYGKAAEGETIRKMIVAAGKDVRVLVIKLADRLHNMRTLDARSPASRARIANATLDVLVPLCDRLGIQALKRDLDDVVLFHLEPDAFARIDEHVRNRPGWGDYLADVSAKARVALRRSRVDAEVTARPRHYYSIWKDTVAGGHSVPLDLPRIAVVVDGPETDCYAALGAIHGRWRPVAGRFKDFIASPKNNLYRSLHTTVVGPEGRLVEVLIRTETMHRYSEYGVATSYRYPKVSDEPPGADQLTWLKRVLDWQQDTTDAAQFLDSLRCDLAEAQITVFAHGNAYELPSGSTPVDLAYELGPSKGDQCLAATINGRLAPLSSPLRDGDVVEIFSENDGHVEVEPNAPRGPRREWLGFVKSSQAQMQINRFFDERNEPGISIADKVRLGRATIGLTLRKHDRGLASEVPLRRLAEDMGYPDLETLLVAVCERTVEPDSVVEQLIAMVDHPD

SEQ ID NO: 9426 - protein, 187 aa, Actinoplanes utahensis
MNLPRQLRGLAYQVFYGLPLPMRRHIARAVSPKFLVGAVAVIRDAEAAEPGRILLLRQPPGRGWGLPAGLLKRGELPAVGAARELHEEAGVRIEPGDLRPGDPNAIVHPNGGVVDTVWFGWVPASSTPLAVDGGEVLEARWWPVDDLPKLTWPTARLLGVYGIGPKAGELPPSVPSSSAAPSRDLPQ

SEQ ID NO: 9427 - protein, 325 aa, Actinoplanes utahensis
MTHRPPRPWSSPVTHSPTGPAVAGSGTPRSPEVCGVVLAAGEGQRLRPLTATVPKALCPVGNLPLLDHALRRLAGLGLLGPEDVAVNAAYLADQVVAYATGRAHLSVEPDGPLGTSGGVARLRKWIDGRGVLVGNADAYLADPFRDPGRDIEALCDGWSGDTVRLLTKPCRPGEAGGFSGNRFAGFSLLPWRYVATLPDEHSDLVRTAWRPAEAEGALELIGYEGHYLDTGTPSLYLEANLHAAGAGLVDPSAEVTGTATGSVVGAGAHVAGTATGSVVGAGAHVAGRITRCVVWPGATVEPGEDLAEVIRAPGGLTVPAAGLGG

SEQ ID NO: 9428 - protein, 95 aa, Actinoplanes utahensis
MNTAIVHIDCATDSIPEVAEALAALDGVSEVYSVAGGVDLIAIVRVPRFEDIAEVIAGRISKTAGVINTESHIAFRAYSKHDLEDAFAIGLPDAD

SEQ ID NO: 9429 - protein, 337 aa, Actinoplanes utahensis
MRRKIVFAVITTVAAVIGVGVAVLLAGNDFRIDVRRLSVPGPAGALDAVLTTPAGGVPRGLVVMIHGDGPVEATHDGLYQPWFEAAADAGFATLSWSKPGVGRSAGDWLAQSMAGRADEASRVIDWARGRPDVPHGPVVLWGASQAGWVVPRIVAVRDDISAVVLAGPAVNWLRQGRYNLLAELSHDGAGDAERDRALAVSDRTRQLLDEGATYRTYRARSGDPEPMDEARWGFVARNYTSDATADLRAMAGRHVPVLLMLGEHDRNVDVAETAATYRSILGDRYVAVAMFDAVHSLARPVVAESDAAGLVIAVFRPRALLAPGVLDTYRDRLERLR

SEQ ID NO: 9430 - protein, 195 aa, Actinoplanes utahensis
MTLEIGSGFTEAERTRVGLLYWAAFGRKLRLAFRDEATGVTRVTAALLPDRMLIARAGGAVTGVCGFHRDGHGAADLSWSRLRPQAGRASALRALLALAPLERHPQAGVLLLDGVAVDAALRGRGIGSALLAAAEEQARRQHARWVQLSVVDTNPRAEALYRRLGYQPVSKGSIGTLRHLYGFERFTTMRKRISA

SEQ ID NO: 9431 - protein, 280 aa, Actinoplanes utahensis
MTPAPRTVVEAFLPADGAAALDQLYDTANAAGLDDQPVRLTIRRMVAAGEVTQSGRGRRGTLALTATGRERLRRDRLALHLALAQDRGQAPWDSRWRLLAVSVPETDRAARDAMRRDLLAAGAAPVSTGLYASPHDLSAMLGPLDTSATVAGTPGADTPGTGALFRAIATDLDVRGVTDPAEIAEMLWPAAPIIDRYAVADRAVELAGSLRPGADTRAVLLRQLRLADAWELAMRQDPLIPPELRGDPWPPATIRRRWHTAWTELAAQLPDQLLYRGWLP

SEQ ID NO: 9432 - protein, 536 aa, Actinoplanes utahensis
MKRRKLDPAEATANFAKGVDDRFQAATPLRALLNKVFPDHWSFLLGEIALFSFIVLLLSGVFLTLFFDPTMKEVTYHGSYLGLHGVQMSGAYESSLNLSFEVRGGLFMRQMHHWAALLFMASIVVHMARVFFTGAFRKPREINWVIGVLLFLLGFFAGFTGYSLPDDGLSGTGLRIASAIMLSLPVIGTWLSASIFGGEYPGELIIGRFYIAHVLLIPGILLALISVHLGIVFKQKHTQWPGPMRTNENVVGERMFPRYAMKQGGFFMAVFGVIALMAGLFQINPIWLFGPYLASEVSSASQPDWYVMFMDGLVRLMPNWQIYIPFGDGYSIPPLFWPAVVGLGALFTLPMLYPWLEARKLKDNRSHHLLQRPRDNPERVGIGMMAFTFFLVATISGGNDVIADKFHISLNAMTWAGRIGLLVLPPLAYYVSIRICLGLQQHDREVLAHGVETGIIKRLPNGKFVEIHQPLGPVDEHGHPIPLEYRGWVVPKKMNKIGALAPAVKGFFFPIEKPAEAPVSPAPIGATKREEITTKR

SEQ ID NO: 9433 - protein, 365 aa, Actinoplanes utahensis
MTAHHGVAGEPVDVTDPKLTRFDIVKEGLRRDDIEIVTYESQFPGPNSKAERRMVRSISFLFIFSGLAALAFLVFYIVWPWKWALGTTRSDFFTPILGVTLGLSLFSLGIGILAWAKKLLPHELSIQQRHGDPSSDEDRLITGQTMMYVADELGVQRRPLLKGAIGLGLAPLGLAAAAPLVGGLIQNPHKGPQQMMDHTGFDPVPNGGKPVRLTREDGTPIRPEDVSAGGQMTAFPGIPGGATNRYADSPTLLIHLRDADAAKARANADSDKNGRNKGSMWGNYVAYSKICTHAGCPASLYEQQTNRLLCPCHQSQFLITDNAQPVFGPATRRLPMLPLSVDAEGFFVATSDFKDTVGPDFWERP

SEQ ID NO: 9434 - protein, 282 aa, Actinoplanes utahensis
MTSDTPARRRARVFSRRRGAPSRARRRVGAAVRMLAALALAGGVYTAFTPGAFAEDNSQLSTAAQQGKELFDNSCITCHGRDGQGVQDRGPSLIGVGSASVEFQVGTGRMPMTRQEAQAEQKKPQFTPDEIKQIAQYIQEIGGGPQIPTGELVENLKNNPEALARGGELFRKNCTSCHSFTGAGGALSSGKYAPSLHDATAEQIYAAMLTGPQNMPVFGDNQLTPDQKREIITYITQQLQQNKDPGGVFNLGGYGPATEGLAIFLVGITILVFTSLWIAGKS

SEQ ID NO: 9435 - protein, 198 aa, Actinoplanes utahensis
MTAAAIDKSRIHSLTRPNMVSVGTIVWLSSELMFFAALFAMYFSIRAAAPGMWAEHTRELKIPYATTFTTILVLSSVTCQLGVFAAEKGDVFALRRWFTITFVMGLIFVLGQANEYRNLVHEGVKLNGDGYGSMFYLTTGFHGLHVTGGLIAFIIYMIRTTMGRFTPAQATSAIVVSYYWHFVDVVWIALYAMIYWLK

SEQ ID NO: 9436 - protein, 323 aa, Actinoplanes utahensis
MQSVEFASLADGSGDTGLPPFTAAAIFTRFHFVSLIAVGLLVAAALYLYGVHRLRQRGDHWPGGRVAAFVAGGLGSIAAVSVTGIEGYDTTLISVHMVQHMVLSMVGPIFLALGAPVTLALRVLPTQPRKALLAVVHSGFVRVLTFPLVAFGLFVANPFILYFTPLYRQTLEHAWLHEFIHVHFLITGCLFFWPLLGLDPLPNRWPYPGRALLMVLSVPFHTVLGLTIMQASDLLGGDWYPSLHLSWMDPHADQVTAGGILWAGGEIVSVTMLGILVMQWIKQSEREARRIDRALDRVEMEEATAAAKITDPPNTDRPGPEAG

SEQ ID NO: 9437 - protein, 150 aa, Actinoplanes utahensis
MKWGTKLSDTATTQYTVLLYSDDAAVRDRIRLAIGTRPAADLSVEFTDASTWEECRRLLDDYEIDLMVLDGEATPAGGLGIARQTKDEYPDPPPTCVVIARAADRWLAAYSQVDATLLAPLDPVTTGQTVAGLLRARRSGVVPLGALPRT

SEQ ID NO: 9438 - protein, 352 aa, Actinoplanes utahensis
MGARTWPNLTSSLLRGEELAAADTAWAMSEIMAGNATPVQISGFAVALRAKGETPAELAGLVEAMLSAATLVELPPETRAAAVDVVGTGGDRANTVNISTMAAIVTASAGVTVVKHGNRSASSTTGTADLLEHFGIPLDLGPAGVNRTVAEAGIGFCFAARYHPGMRHASVTRRELGVPTFFNMLGPLTNPARPRAAAVGCFEPRMAPVMASVFALRGDSALVMRGEDGLDEFTTAAPTRLWLARDGRVDEMLVDATELGLARSEPNALRGGDASYNADVARRVFAGESGPVRDAVLLNAAAAFAAQGGFPGDFRDTMRAGIARAAEAIDSGATTKLLDRWVTAARAAKTAE

SEQ ID NO: 9439 - protein, 117 aa, Actinoplanes utahensis
MGGLRALVAEKSGKRLQHTAGDARNHPRGVTTSEGHSGNPTFPTKEKPVHERELRCVICDGDMLFETPPCDDGHDDCPELVCTRCGAAEVVAPIVVHLWMEPKGPRRIAPHQRTAAA

SEQ ID NO: 9440 - protein, 141 aa, Actinoplanes utahensis
MKTEYKIFLGVSLFLFGAATVYGLYTKGQQHQTEWVGTVALILSGLLCSMCGGFFWFVARRIDLRPEDREDGEIAEGAGELGFFSPGSYWPFGIAFSAAIAGLGLVFWMWWLLAFGLLCVIFTACGMLFEYYSSTRQPAEH

SEQ ID NO: 9441 - protein, 309 aa, Actinoplanes utahensis
MGARSSATRPRAIGRAAGLGLGGAMLLALLAGCSVEDVGSKFGHFGWPGRGVSLQAHEMYDLWIASVIAALVVGVGVWGLIFWCVIRYRKRGDELPVQTRFNMPMEVLYTVTPVLIVAVLFYYTAIVQTDVDKLSKNPDQIVQITAFKWNWEFDYRDGMGKDAHTVASTVGSSDVIPILVLPVGEKIRFEETSKDVIHSFWVPELLFKRDVMPGNIRNVFEVTLDKEGRYVGRCAELCGTYHAFMNFELVATSQAKFDQFLAAKKAGQSTQDALSAIGEQPFATKTQPFDTRRGTHTWNQSGSTVAAGK

SEQ ID NO: 9442 - protein, 378 aa, Actinoplanes utahensis
MDYTGDPPVYLDAASAAPLHPVAREAMLAALADGWADPARLYAAGRRAQQLQEAATSVVADLLGVRADELSFWPSGAAAAQAAVLGGLAGRRRAGRVLVHSAIEHSTVLHAAATTEAVEVGVTREGRLDLAAWAAAVAAPGVALASLISASHEAGTVQPVAAAAEYCAEAGIPLFVDAAQSVGRIPVPPGWSLLSASAHKWGGPPGVGLLVVRKGVRWISPTPQDDLYRPRPPGAADLPAIVAAAASLRAVTAEARAEAVRLSALVDRIRERVAATVEDVEIVGDPVERLPHLVTFSCLYVDGETLLHALDRHGFAVSSGSSCTASTLRPSHVLEAMGVLSHGNVRVSLHRGTTEADVERFLAVLPGLVAEIRKEAGF

SEQ ID NO: 9443 - protein, 48 aa, Actinoplanes utahensis
MPGVAIGEIIRVLADDPAAANDIPAWCRMKGQEFVAGHGQRFDVRRTT

SEQ ID NO: 9444 - protein, 166 aa, Actinoplanes utahensis
MVLAVFAGLPGVGKSTLAAAVAAELPAAVLAVDTVDFALQRYAVHEPRPGYAAYGVVAALAEAQLRIGHHVIIDAVSPVKAARDLWVELADRIGVPLRVVEVVCGDDAEHRRRVEARYETRDHEGVPDWVRVLERQSEYEPYLGPRLVVDTHLAQDPAPQVVAYLR

SEQ ID NO: 9445 - protein, 325 aa, Actinoplanes utahensis
MKIAVTGSIATDHLMHFPGRFADQLIADQLHKVSLSFLVDDLVVRRGGVAPNIAFGMGKLGLRPILLGAVGADFADYRSWLERHGVDCGSVHVSDVAHTARFVCTTDDDLNQIASFYAGAMSEARNIELAPVVDRLGGIDLVLISANDPAAMIRHSQECRTRGYRFAADPSQQLARMDGSDVLSLIRGADYLLTNEYERSLLETKSGLSGDQVLDEVRIRVTTLGKDGVEITGKGIERIHVSVVPDVIGEDPTGVGDGFRAGFFSGISWGLGLERSAQVGSLVAALVLETVGTQEYEIRPADFGKRFAAAYGEAAAAEIAPHLPA

SEQ ID NO: 9446 - protein, 122 aa, Actinoplanes utahensis
MTTEAHTESTEATAPTGVILTDVAAVKVKALIEQEGRDDLRLRIAVQPGGCSGLRYQLFFDERSLDGDVVSDFDGVEVVVDRMSAPYLAGATIDFADRIDAQGFTIDNPNAGNSCACGDSFS

SEQ ID NO: 9447 - protein, 375 aa, Actinoplanes utahensis
MCCHTAGVRVLICPDKFAGTLSAPEVAQAIADGWSVPTDELVLRPIADGGPGFVEVLATALPGRRIPVRTVDPLGRPVAGEILYANGVAYVESAQACGLHLLTTEERDPTTTTSYGLGLLLTAAVESGAAQVVIGLGGSAVNDAGAGMLAALGAAPLDEAGYALPYGGAALIAAAALGGVPRLRQVALVAATDVDNPLTGLHGASNVFGPQKGATRQDVLRLDAALGHFAGVLEKAFDLEDLAIRPGGGAAGGIGAALIALGGRVTSGIGLVSDLVGLDRELDAADLVITGEGSFDHQSLRGKVVAGIAGGARDRGLPCVVLAGRNETGYREAAAAGVTETHTLVEHFGSVRQAMAEPARGLRELAERIAAQWSR

SEQ ID NO: 9448 - protein, 475 aa, Actinoplanes utahensis
MRTGIRRPGSAVASTSTKPGPPSAIGRSTSSSVGTDHPSAIAWATSGADRVPANLSGQISTRTPAVWQHTPRGRSYRPTPCATMFSVTSTWTEPANTPVALLLLGKGTDPASERGVDCPGDLPAPSDPDLVARATAAKAALGDRVFVLGHHYQRDEVIQFADVTGDSFKLAQQAAARPEAEFIVFCGVHFMAESADILTKPEQRVILPDLAAGCSMADMAVLGQVETAWEHFQDLGIATDIVPVTYMNSSADIKGFVGRNSGVVCTSSNAKRALDWSFEQGSKVFFLPDQHLGRNTAVLEMGFDLDDCVLYDPHKPHGGLTDEQLRNARMILWRGHCSVHGRFTLDSVREVRERVPGVNVLVHPECRHDVVRAADQVGSTEYIIKALDAAPAGSAWAVGTELNLVRRLALAHPDKQIMFLDRTVCYCSTMNRIDLPHLVWTLEELVAGRVPNVITVDEKTAREARVALDQMLALP

SEQ ID NO: 9449 - protein, 451 aa, Actinoplanes utahensis
MTDDVLIVHGGTPLQGQIRVRGAKNLVSKAMVAALLGESPSRLYDVPRIRDVEVVRGLLGLHGVKVSDGAEDGELVMDPTNVESASTDEINVHAGSSRIPILLCGPLLHRLGHAFIPDLGGCHIGPRPIDFHIKALREFGAVVDKTPEGMHLSAPNGLHGAKLELPYPSVGATEQVLLTAVRAEGVTELRNAAIEPEIIDLICILQKMGAIITVHTDRVIEIQGVPRLYGYEHKPIPDRIEAASWAAAALATRGEIEVLGARQADMMTFLNVYRNIGGELKITDDRVARHGVTGAEGGIKFWHPGNELKAVALETDVHPGFMTDWQQPLVVALTQARGISIMHETVYEQRLGYTEALNSMGATIQVYRDCLGGTPCRFGRRNFMHSAVIAGPSKLHAADLVIPDLRAGFAHLIAALAAEGTSRVYGVNLIKRGYEDFEQKLAALGAHVERP

SEQ ID NO: 9450 - protein, 249 aa, Actinoplanes utahensis
MATRTSSRSWPPSAPTSNAPELLFHVDQRRGVRHTAPFGYARVVSPLFRRKPADLVEDATASVTETPSDDNRRKNYTPSKKELGVVTPKRAPQGRRVEAAPADRKEALKLMRERQRTERAEASEGMRNGDERFLLARDRGPERSLVRDIVDSRRTIGSFFIAGAIVVMVGSVIKNQSVQLASNLLWALLALAVVVDSVFIARRIKKAVTARFPDTTQRLGSLYLYGIMRGLTFRRMRVPKPKVELGAKI

SEQ ID NO: 9451 - protein, 454 aa, Actinoplanes utahensis
MAVRLGGRARGPMVTAMRRRTLAAAAAAALVASGVPTAARAATSGAGVLNGSAERDLTGWTATAQAGAVGLRRVSGLRGAPAGTAVELSRPAASGAWAYALAAQNVSFVAGRTYRMTAWVRDVAGGGGRFGIQLANGAWEHRPSGVAEFVTLGGTGWRPVTRTFVATSAGCPDTAFYLSLPADRAFTLQVTALSVTAVAAPVPPRVSGAPARVLSFAGPAGSAPDAAVWNHDVGAGLWGNGELETYTADPRNAALDGSGQLTLTALRAGTGFTSARLTTKGKVSIPAGSYVETALTAPVGAGVWPAFWLLGTAIDTVGWPACGELDVFEGTGAQPTLAKSAAHLADRTDPGRDRQYGWGEGGATTDLGMPLDVAPHRFGVYFDASVVRFYVDRAPTMTLWASDANASGRVWPFGKPHYLLLNIAVAGDVDSSATVFPRTMTVGPIAVWRGGVPF

SEQ ID NO: 9452 - protein, 457 aa, Actinoplanes utahensis
MWRAGGRGPAEPHRVDAGPGGAGRAVAAGLRGVRRRDLRDQREPGLLVGGFGGAGQRVHLRRAGFRVVSDHGVRPVVPRPVRVRPRFRLRRLPTRPGAARPPGPAGPAGLGRLRRTPGRAGRGRCRRRRLAGRHPALQEHRIMIKTKDLRKDFAVRVKNGRFRREKRVVEAVGGVSLTIEPGEMVGYIGPNGAGKSTTLKMLTGVLSPSSGTVEVCGLRPVPQRTRLALRIGVVFGQRSQLWWDLPLHESFRLLRHIYRVPAAEHAARLRRCRDLLDLDAFLDTPVRQLSLGQRMRGELTAALLHGPRVLFLDEPTIGLDVVSKQAVRSFLAELGATGDVTLVLTTHDLADIERLCERLVVIDHGRVVHDGSIEALHARYGSRRSVVADLTTPLPPDFALPGATLTGVEADRHRVTFALDDITAGAAVAALVAAVPIRDLSVVEPDIEDVVARLYAG

SEQ ID NO: 9453 - protein, 286 aa, Actinoplanes utahensis
MAGKDASVLTISPDGPFRGWTTTFGALVGSGFRRYTTYRQATMAGTFTNVVFGYLRCYVLLAVAAGTHGGRPGGYDAEQLATYVWLGQGLLSVVMLWGWSELAERIRTGDVAADLLRPVPPVTAYLAADLGRAAHGMLTRFVVLLTVGALCFPMRAPARWQTAPLFLLSVLLAVVVSFGCRYLVNATAYWLQDARGPIMFWTLGAGVLGGLYFPLRLLPGWLAAALRLGTPLPSILQSPLDVAAERDGPGLQLALVGVQLCWAVALLALAGFVQRRAERRLVVQGG

SEQ ID NO: 9454 - protein, 1757 aa, Actinoplanes utahensis
MPGGGAGPRGPQGPGGPVPPHPGGPMSAPQAGGPQQSGQAQQQSGQAQQRFGGPEAYPARPEHESGFGAGRRAMPEAGRSGDGSRPVSPAYGSARPAPAEAFPTRGGRAPEGPFDLRPMPQERNSPAPTRPAAQPIRMTPPQPAVPPATMYPDGPGQTSGRPGQTPGQHGVRPDQGTGQPGMRPDQRPGQPGMRPDRGFGQPGARPDQELGQPRRWPDPEAGQGPIRPGRVPGRADQTPVTPGHGQVPGAPGYGRENRGWAADQPVSGVASAPVSGIAAPPVSGIAPVSGVAATPPPGIAPVSGIAATPPPGIAPVSGIAATPAPGIAPVSGIASAPVSGMASGGQWPVDDDERNRLMDTQRIDFGDHGVRKPVPAPESFAGSQPVAVPEPITAPDPVAVQPPVTQPPVEAPRGASQPVAVPEPAATEPRGLGWLLSMSGLGAEMPVPETSPLAAPEETVVVESLPPTGWFAPSVDDEEPAVPEAPDSETPSSAPGARWEGGAASAERDAQPAGELEIRVLDLQVDGVVDSGVADAEATQARPAGEDAGHSGAAWDLTGSGRAEDLAGLAARDADRGMLPRAGAGRHERPGFDEPDESGAGTEVGEYAEDVRPGRHGRVEAEPPVPVVTGISTETSPPTIDPMVAELAEDTAHRTPAGIAGDEVSPAAAGIVGDDVATTTTGILGDDVAATTTETVTDDVAATTSGIAAEGARETDAGFGGADVPEVSGGFGGTEVPETTVGSFVDEVSPAAVGSAEDAAPLGPAEPVAEEDLSTVAESVAEEVFRTADEPIEETAGVTAVEPVVQEESGAPVAAAEPGVDGGSVIADEDFDVAAGSAALADDVEGERAGGDATTAAPADVIAEPEAIAGPDAIPAPEAGAEADVVTDAESGGDPGSLRETDAAADAVVTHAGVLAGAEVVGDTGGRAESGADGNVVAESPGDPVGPATAGLPLSGVPVWPPLSVASVIASAVAAGTRSAGEDDNEADPVGTAHGAAPAVIAESDAGSAATAEGDTGSAATTEGNADAAGTAESDTGSAGTAESDADAAGTTEGDAGSADSDAGDADSAGEVAALGAGVLGGEVRDGGASGDVASAGAGPASGDAHDTSEPGSTAAHHHGGTGPAFALADDTTPEASAAVSTIVAETAADGTDSESAPGGPETGAETAEIVTPAPAGPDPAPVDTEGVPDAEDALPADAHTGHADGGTVGSSERAAAADDRTGKSADLATGDRAEEAGPAPEEDRTTEADPEPREDRAVEGDPEPREDRAVEADPAPEDIREKAADAASSRESPAAAADPAPVTGRTEEADEAPIRQRREQRAPADRRRADPEEILAAYPWMFDPRTLREQVDEPDRLWDLSDRLTDRLEFAERDNVRAGLLSLRAVVGRVLGELDDALADGRAGLRHAEASGEARTVAVARARLAHVLQWRGEFAEADRLYAEADSAELPARVRAEIRELAGRSAFEQGRFLEAVNHFERALDLCRDSDAELVERVEVALDVMARRSGDGWGPYPRSREQLLNLPPAPTPLRDDGTGLWGYAAAVEPRYAQAQPFAEGVAWVRRPDSPAWELIDASGAVLIGADSGYRDAGKFAEGLAWVSREAEGGWVAIDRGNRLIVPGGFEEARPFRRGLALIRRGGWGAVDKHGRIVVQPKYRQFSTVLSAGGPIDGFSDEGFAVVDAGTGAGVVDRTGQPVLPPVHRAVVLHPSAFLIADEAGRWGALDRQGRPLVETRHTERADAVAEVLRLKPDSRPVL

SEQ ID NO: 9455 - protein, 332 aa, Actinoplanes utahensis
MEFRHLGRSGLLVSEIAYGNWITHGSQVEEEAALACVRAALESGITTFDTADVYAGTRAEEVLGRALKDERRDGLEILTKVYWRTGPGANDSGLSRKHIMASIDGSLRRLGTDHVDVYQAHRYDHNTPLEETMEAFADVVHSGKAHYIGVSEWDASQIRAAKALADDLRIRLVSSQPQYSLLWRVIEAEVVPASQELGLGQIVWSPLAQGVLTGKYKPGQQPPAGSRATDEKSGAGFIARWLQDDVLTAVARLQPLADEAGLTLGQLAIAWVLHNPNVSAAIIGASRPEQVRDNVKASGVKLDDGLLKAIDDIVEPVVTRDPALTTSPAKRP

SEQ ID NO: 9456 - protein, 263 aa, Actinoplanes utahensis
MTYEPVYTRTPRNAFVPSPIFVGIVAIFAVSGVLIWTGFGNVGFDAFLFVVSGWVVSLCLHEYAHAVAAYFSGDLTVAERGYLRLNPLKYTHPVLSIVLPVIVVILGGIGLPGGAVWVDHRYINSRAKDSLISAAGPATNVLLALVAALPFLMGLGPDSVFDGHIAFWQALSLVAFLQITASVLNVLPVPGLDGGSILRPWLSPAYRRAWDTFAPFGFLLLFVALWQTSLGGYFYDVVYRIADHLGLNPLLVSDGYDLMRFWT

SEQ ID NO: 9457 - protein, 65 aa, Actinoplanes utahensis
MPWSWRYEDVDGKPVDGPAETFSSQADAESWIGQEWRQLQAGGVGTVTLVEDDRVDYQMSLQPAE

SEQ ID NO: 9458 - protein, 238 aa, Actinoplanes utahensis
MSEDRWSSVLVLGGIRSGKSAFAESLVADAPAVRYVATAVGGEDDPEWLARIEEHQRRRPQSWSTEETGADPARLTELLTSAPAGDTLLVDDLGGWVAAVLDPARQPNDDEADVAALADAVRACAARLVLVSPEVGLSLVPVTPVGRAFADALGTTNQALATACDGVVLVVAGQPAWIKRVTAPAVTTPVTQAPVTQAPAALVTAPATPAPPPPPPVVVTPQGPPTPDADEATVVLPA

SEQ ID NO: 9459 - protein, 312 aa, Actinoplanes utahensis
MISGAHEGGAAAGADPADTERRVAETEQGGGLLGRLAGQAGADLAVIRVADSGAMEDGPVADEQSVEAAIRQGWQLADDAVDAGRDAVLLAGLGVGLEAVATAVLAAATGAEAAATLPRVLQPGGRLDDHAWMVRCAAIRDALHRIRQEPRGAVDILRQLGGLDLAVATGVLLGASARRLPVLIDGPLGIAAGLVARDLAGQTRHWCLLPEAGTLALVRQGADVLGLTPVLELGLDLGEGANALAALPLLRGVLGLAAALPVHPGLLAGHEDAGLADAYAASLGDSDATADAALDVLDDGPTSFGNPAPSRS

SEQ ID NO: 9460 - protein, 381 aa, Actinoplanes utahensis
MVFPATLTRPKVTGKLSLMSAEFFRSPLHERHVALGAKLAPFGGWEMPLEYAGGGVLKEHAAVREAAGVFDVSHLGKARVLGPGAAEFVNSCLTNDLHRIAPGRAQYTLCCDPSGGVVDDLIAYLYGPDDVFLIPNAANTAEVVRRLAEAAPPGVTVTGQHRDFAILAVQGPASADVVAKLGLPAGHEYMSFTGATLAGAPLVVCRTGYTGEHGYELVVPWDTAFTVWDALIAAGVRPCGLGARDTLRTEMGYPLHGQELSLDITPVQARTGWAVGWSKPAFWGRDALLAEKAAGPRRTLRGLELTGRGIPRGHMPVFAGDTPIGETTSGTFSPTKKIGIALALIDTAPDLPDGATVEIDIRGRRTGARLVKPPFVTPSVR

SEQ ID NO: 9461 - protein, 101 aa, Actinoplanes utahensis
MFPTSREHRPPGGPAPTSWSARVTQPTLSLVDSDPAELTVDAIVIGLHSQPDQDGALLPASGAESIAAAFDGRLTATLALLGATGAPGEVTKLATLGTLAS

SEQ ID NO: 9462 - protein, 387 aa, Actinoplanes utahensis
MPDDADAPAVLRATLEGALLGGYRFAGYKTKPQKGHREPVAELQVHVPDAADEAATAELTRAAVVGRAVRLARDWVNMPPNELRPAGFADRIAAEATKAGLDVEVLDFDQLKAGGYGGIVAVGQGSEAPPRLVKLTYAPEGVAEPKRVALVGKGITFDTGGVSIKPAAGMWEMKSDMAGAAAVAAAMLAVAALKPGVAVSGYLAIAENMPSGSAYRPGDVITMFNGKRVEVFNTDAEGRMVLGDAIARACADGTDYVFEASTLTGGQVISLGKRISGLMGSAEAIALVQAAGDAVGEPAWPMPLPDDVRKGMESEIADICQTNANLDRAGHMLQGGVFLREFVEPGVEWAHIDIAGPGYHAGEPTGYWTKGGTGVPIRTLLRVVETL

SEQ ID NO: 9463 - protein, 108 aa, Actinoplanes utahensis
MGWFRRRPRSTGPGGRPVDQADLDHLTQFVRSRRGVEAFVEPRTTVTETTVLLVAHDGEWTRRRIGSPEVARRFALRLSLPIYDVRLLGYPQRMRDFNARRKRAAQPD

SEQ ID NO: 9464 - protein, 463 aa, Actinoplanes utahensis
MSQPNGGTFDIVILGAGSGGYAAALRAAELDLSVALIDKAEVGGTCLHRGCIPTKALLHAAEIADQTRESEQFGVKADLVGIDMAGVNAYKDGVVGRLYKGLQGLLGHNKNITLVQGAGRLVGKDTVEVDGQRYTGRNVILATGSYSRSLPGLDVDGTRVITSEHALKLDRVPASAIVLGGGVIGVEFASVWKSFGADVTIIEALPRLVAAEDEEISKTVERAFRKRKINFKVGKPFEKVEKTADGVKVTIAGGETLEAEVLLVAVGRGPTTANLGYEEQGITLDRGFVITNERLHTGVGNIYAVGDIVPGLQLAHRGFQQGIFVAEEIAGKNPAVIDEAGIPRVTYSDPEVASVGLTEAKAKEKYGADKVTSYNYNLGGNGKSQILKTAGFVKLVRVEDGPVVGVHMVGARMGELVGEAQLIYNWEAFPEEVAQLVHAHPTQNEALGEAFLALAGKPLHAHS

SEQ ID NO: 9465 - protein, 248 aa, Actinoplanes utahensis
MPTSVTMPRLGESVTEGTVTRWLKQEGERVEVDEPLLEVSTDKVDTEIPSPAAGVLTRIVVGEDETAEVGSELAVIAGEGEDAGAAAPAPQQQAEAEPEPAALTTPSTEKPVEEEAPAPQTAAGSAEGTEVKMPALGESVTEGTVTRWLKQVGETVEVDEPLLEVSTDKVDTEIPSPVAGTLLEIRVPEDETAEVGGVLAIVGSASSAPAAAPAPRSPPRGSRRPSRSRSRSRSRRRSRSASPTRRRP

SEQ ID NO: 9466 - protein, 222 aa, Actinoplanes utahensis
MVESLQVSAQLTTVVEVDVTKIATLRNKAKADFQAKHGVKLTFLPFFALATVEALQQHPVVNSSIDVEAGTVTYHGAEHLGIAVDAPKGLVVPVIKDAGDLNLAGLAKRIADLADRTRNNKIGPDEIGGGTFTLTNTGSRGALFDTPIINQPQVGILGLGAVVKRPVIVNDPNLGEIIAPRSMVYLALSYDHRIVDGADAARFLVTLKERLEAGHFEPDLGL

SEQ ID NO: 9467 - protein, 307 aa, Actinoplanes utahensis
MRIVMAGASGFLGARLAARLRQSGHDITRLVRKPVPGAGPEVAVWAPSQGRLDLSVLAGADAVVNLAGANIGARRWTAQYKNVLRSSRLDTTDTIARTIAKLPAGDRPRTLLQSSAVGWYGDTGDREVTEEAPAGTTFLADVCRVWEAAAHPAEDAGSRVVLLRTAPVLDRQGSLLKPLLPAFKLGAGARIGGGRQWMSWIALADWLGAAEFLLEREDVAGPVNLVSAEQCTNLEFTRALARRLHRPALLTVPGPVLDLALGELAGEAQRSQRAIPGVLRGAGFSWMYPDIESALAAALDPEPAKAP

SEQ ID NO: 9468 - protein, 628 aa, Actinoplanes utahensis
MSVTAPAPAASADPPSEPAAASGREAREWPVHLAFAVVALSFAVYVTCGLWADPYTHVLADNVGDQAFFEWLMGYGYYTVTHGSDPFFTSLLNAPLGVNLAANTSITVYTVLMTPLTHLAGPQVSFVTVLTLNLAGSAFAWYLFLRRWLVGSAGAAAVAGLFCGFAPGFISHANGHLNWTAGWVAPVVIWQVLKLREPGRWLRNGIILGVLMAVGFSIAAEGLFYTALACAVFLVMWSLSRSVRTEARDAFLTVFRALCVTGLVAGALLAYPLYMHFAGPQTFNGTGFNQRYFVEDAASYLSFPNRSVAGWLGWHADLAPNRTEETSFFGVPLVLLILVSFVVLWRRADAGRRATLRAVGAVGVVFFVLSLGPRFNLQKHEYPDFPLPYAALVHLPLFNSALPIRFALVVVGVFGILLALILDQLITRKIPSGSLLHTALASAAVIGLLPIVPLPVRIQFRTPEPAFIAQGLWKNYVPEGGTLSALPFGANVTADAQRWQAYTMARGGRQFRIPDGYFLGPQTTGDTGRKQPGRIGAPPMATDWLFLRAAWYGYITTLTNGDRAQARADFEYWGLDAVFLPSTITGSDHQTLNRTAVESTARDLLGEPEVVGDVLVWRIRRGVDPVDR

SEQ ID NO: 9469 - protein, 233 aa, Actinoplanes utahensis
MAHPSRSRPRRPVGTRRYGDTLAVVTTSVLTVLRPGLVDYRDAWDEQKRLHEAVADGAQPDTILLLEHPSVFTAGKRTEPADRPWDGTPVVDVDRGGKITWHGPGQLVGYPILRLPDPVDVVAYVRRVEQLLIDVCAEFGVATERVEGRSGAWVRATDGGLDRKIAQIGIRVARGVTLHGFALNCDCDLANFERFVPCGIRDAGVTSLSAELGRPVPVAEVMPVVERHLATLF

SEQ ID NO: 9470 - protein, 404 aa, Actinoplanes utahensis
MLIDLDAAPAPAPVRRPSGTRWWKLLAAAAVLLPVGAAAVPALPPPFPMIASTGGQATLDSVCTDRALYAAHRAAGPGAGAVIVARPLVAGGPDWQVRVPLDGGELRLTVAGPVLIADAEGTVTVLDVATGRVRWRPPDGSTVAPFGDRALVSYFDSDTGEARLRLVDLASGRTRWTRPGYAAAAALDPAGFRLIMLNDGGQVEMRSTADGRLATSRDLNGVIVPEEQLIIDGTRPYQPSVAVAGDHAYVLGPSAVAALSITDGSLTWLTSVPRPFPVSAVSCGHLLCVTGSGGTTALDTATGEVRWSGAEWASYTADDLATSAGGRVARLDPATGRVVTELGRGVATGGLMLRAVTGGTRVTDLRTGRLHGELAGVLPFGCTVAGPFLACPTTGSARSVWRVG

SEQ ID NO: 9471 - protein, 415 aa, Actinoplanes utahensis
MQRILSTELAAHPHEKVLVEGWVHRIRRLKSVTFLIVRDAAGLAQVVVDDPGDLREETVVAIVAVVTPNEQAPGGVELTAPAIRVHSAVDVPLPFDLHRPALTAGLPAQLDHAAVALRHPARRTALRVAAAATAGFRAALEAQRFVEIHTPKIVESATESGANVFQLDYFGRPAFLAQSPQFYKQMMVGVLERVFEVGPVFRAENSDTARHLTQYTSLDAEMGFVADHRDVMAALTRTLGGMLGEVTARTGVVTPEVPAEIPAVHFTEALRIAGAPAGEPDLAPAHERALGEWARREHGSEFVYVTGYPMRKRPFYTHPDPADTTYSNGFDLLFRGLEIVTGGQRLHRHADCVAALRAAGEPLAAYAGYLEAFRYGMPPHGGWAIGLERLVARLTGAANVREVAAFPRDPHRVAP

SEQ ID NO: 9472 - protein, 307 aa, Actinoplanes utahensis
MTIAPEGRRMLRIEARNAETPIERKPPWIKVKAKMGPEYTQMRGLVQKEGLHTVCQEAGCPNIYECWEDREATFLIGGDQCTRRCDFCQIDTGKPAEFDADEPRRVGESVATMGLRYATVTGVARDDLPDGGAWLYAETVRQIHALQPGCGVELLIPDFNADPAQLAEVFGAQPEVLAHNVETVPRIFKRIRPGFRYERSLDVITQARAANLVTKSNLILGMGEERAEISAALRDLHAAGCELITITQYLRPTPRHHPVERWVKPEEFVELREEAEAIGFAGVMSGPLVRSSYRAGRLYRQALDARG

SEQ ID NO: 9473 - protein, 89 aa, Actinoplanes utahensis
MDSAVDMAYRVVEALFGPDSGIPWWAWLAPIAILFARLLYPMMFPEAAAAEAETDRRLAEFRREREGQARDRGAEKGKGKEKKGKKGKK

SEQ ID NO: 9474 - protein, 1262 aa, Actinoplanes utahensis
MTGRLADAAALSGTIGRLADAAAPSRTIGPDFLSDPRGMLDPMMTASEILVGRDADLAALRDTFRRVRGGEPAAVLLGGEAGVGKTRLVEEFTRSLAGEPVRVLTGQCLELGEEGLPFAPFAAALRELVRDEGVAVLEGRESGLARLLPELGPAPEFGDTHRGLLFELVAALFARLAVERPLLLVLEDLHWADRSTRDLIAFLVRSARAPRMLLLATYRTDELHRGHPLRPFVAELERVRGVQRLEIHRLDRDGTAELLTHLLGGEPRPQTVDAVDRRAQGVPFFIEQLAATADPACADIPETLRDLLLSRVDQLTEAAQRMLRVAAVGGTRLGHELITRVAGVDEVTLDSALRVVVAARLIVFDPERGYEFRHALVREAVHDDLLPGEHLRLHARYAEAIEADPHLVPPGRAPAETAHHWHAAGNHPRALVSAKLAADEAGRQFAYAEQARLLDRVLELWEQVPAAGSLLGVCHLDLLEETALVAIDSGELTRALKLTQAALAELDSEAEPLRAARLLVCRARLLRNMGKSDGFAETKEAYRLLTAVPVTSAAPAVASAPAAPAVSGASAGSSAVVSASAAPSASAPTSVSDSTSVSDAASASLSASDSASASAFAEPGRAELLGEVAYLFAGMDGDEVSRIWDQVRASVDELGDTTAQVYAEITKGQVCAGRVTAQEGLPTLLGALAQARRLDDEQALCHGLVNVSDALFELGRYQESAAAAAEGVPHAARYGVARTTGVHLLANHAEALLALGRWDEADARLAEAARQDPPGLMALPWLRLRARLRLARGHAGAGPLLSRAIGMLGKPYVPAEKKLWMHELRVLAALHERDVPAAVAVARVALQDPALLDRPRYTWQLLATAARAVSAARDATPAHDPAPARDPASARDSVSAPDSSSARDSARVRKSALARDPAVARDPALARDSALARDSSQDRDITSAGAASSPVAGRSAPSPRAAVSSAASLAAALRDAPSWEPGSRDAASLRMPIRDATSSWALSQDAVPIEAVSPDVASFGAVSGDAVSFGAASGDAVSFGAASREVASARAVSRSVASSGDGVRNGASTAGAPGDDLSVEAARLAARIWWAAEQLPRHYPAELAGAAQVAAELDGGAERWGAAVAAWRADGQPYELACALLRAAEANAADRTAAATALAEVTAIADGLRVTPLVEAAETLARRLGVRPAATAAGTLEEVLTAREREVLRLVAEGQSNGQIAQRLFISPKTASVHVSRIIAKLAVTNRIEAAAVAHRLNLLAD

SEQ ID NO: 9475 - protein, 230 aa, Actinoplanes utahensis
MAKPQEKVSFVERLKQIGQVFSFTAKQDKWFVPLVLAAVLIPIALTVVAVLLGWGVLFIPVGILVTVLAVLIVLNLRSNTAMMNVAEGQPGAAASLMENMRGDWRVRPAASSTTQFDMVHVVIGRPGVILLAEGHPQRVKALLGQEKKRLSKVIGNAPLYDYVIGSEEGQLPVRKLRTTMLKLPRNLTGKDVNALDTRLSALMARPQMPKGAIPKNMRPSKGAFRQQRPR

SEQ ID NO: 9476 - protein, 509 aa, Actinoplanes utahensis
MPTAGPYRLQRQLSSCEVGDVWSGVDAQGRPVTVAQLNELASADDRWRGAFAAASEALGQSDTDRLPIDGSDHLGERPWVACPEGEGQGDAAEIFTVLGQKLRPVTAGPPVETPPPASGDAVVEQHSDSVRREQDPPTAPFPPVPSPFPAAAGHPVSAQPFAAQPVSAQPMSAQPMSAQPWPATPGPAQPMSAQPGPERPIPAFPVATQPVSAQPVSAQPVSAHPVSDHPVSGHPVSAQPVSSHPVSGHPTSGLPAFSHPISAVPVSGSGQAYQQIGRPPRPDRLLLLIVGLVCLLLGGAAGAAVVSLQRDGKPRPAASDAPVTYTDAQLLLPATPPVAPGLTPEPDGEWPKSWPTFGSKATVKRVTDLDGVGFDFKVPDGWTCELAEKAAAAVHYRCGAFQGPTLTAGGDLYVRTCAAVCDDKARQALRQREEAWGLRWTSGTSLRSWAETDTIDGKPQYGLVYVGFWRTTPEDVLNREVVLRMTAPPAAKKDVKRVADNIRDRTYTQ

SEQ ID NO: 9477 - protein, 552 aa, Actinoplanes utahensis
MASTLAVPGTYPTIRDALEVAPDGAVITIGPGTYRERIELTGRRLTLRGSGEEGTVVVDAAALEGPALAVLSGEVTVEGLDLTSGDYPAIAVTAARVVVRKCRLRSGYAAGLQATDMATVEASEVRVLKGQNGLVFSDAGGTVESCEVRGVNDDGIIVRLGADPVIRNTTVAECGYRGVYVYQSGRPVIERCDISGTGDAGIVIANSSAPAIRETWVHQTAGSGIVVGAGCSAVVEQCRVEGTAEPKVAVDPRAQATVTLSEGGPAPRAGITEAGAGQDAAEVDRLLGELDAMIGLAGVKNEVRALIDEIQVNEWRRSAGLSVGAASHHLIFTGAPGTGKTTVARIYGQLLKALGVLPNGRFREVSRRDLVGQYIGHTAEKTTSVFEEAMGGVLFIDEAYTLSRAGGASADFGQEAIDTLVKLMEDHRDQVAVIVAGYTREMLDFLDANSGLASRFAKTLEFENYGPDELVMIATRIAQNDDYTFAPGLSEALHEHFSQIERDRNFGNAREARKLLEGMRKAQSGRLRSLGRMPSRDDLTTLVLDDLLTAIR

SEQ ID NO: 9478 - protein, 373 aa, Actinoplanes utahensis
MVAEVAVLATIAAALQGPIPALVTGVAGLILIIVFFARQQGRWWLEHRQIARHHARRRAAAPETGAGPVLAALRTIAPGLAVRDMTAQDGARAGVAKDEAGWFSVVALTPAAPVHHDAAPIPLDALVSVLAATEQPGVVLELVTHTVPAPSPDVHASSPAVSSYRQLVESLSPEPVPAHRESTISVRVDARVLAEALHDHTADLETAAALVAGLGRKVATSLRRIGIACRVLDADELLAALARSCDVEAGSLAEGAQVDEDWTHWSSARLIHRTYWVKTWPTSAGEIGSLFAWAATAPAAQTSVALVLNAAADGEDVAVRAFIRLATRPDADLGALDRVLLEGVKRVGAELQPLDGEHGPAAYATAPTGGGAG

SEQ ID NO: 9479 - protein, 502 aa, Actinoplanes utahensis
MTDPNRDGSWRPYPPQTPDQPAADADAPDAAGREQQLPPPPAIFPPGSVARAQVRPPQGQLPPPPAHLPQAPTGPGQGQYQQGPYSPGSYSPGGAQPGFGPHPAGAAAPSGQFAPGQAAPAPLAPGQAAPAPLAPGQPAPAPLAPGQPAPASLAPGQPAPAPLAPGQPAPASLAPGQPAPAPLAPGQAVPAQGLFAPGQAFPTSGLQGTSGSQGLQQGAGDASGRRLAAPQLTSAPLAGPQGRLPAAAQAAQTWENDSPPDDSPDEDDDARTGPSGKTSPLHIGWHAISRKTLRRVTVAPSAGAGLVLGRDRQHAPVPLHLFAPEPVRIALVGGVWAAQLLIFRAFALGARVVVVTTEPRAWAGFGERATGQYNRLTVHSSDQGVALAGSAQMPTLAVYDLGMSGPATTPPLGPWRTQLTILRQLDRPGLAALQDAQLTLLQRLGGDEAAMAASALKLRPHSSQFLQFMADDMLALIGAGTDRYLFLSQTPTEQQFVGLPRR

SEQ ID NO: 9480 - protein, 350 aa, Actinoplanes utahensis
MLHERRSRHHRVAAALAGRSDGELAAWLQTASPMGVGVGGDASSIHVDGVPVFVKRIPITHRELAHPYSTANLFDLPARWQYGMYRLAGPGFGAWRELAANQIVTEGVLAGETPSFALLHHWRVLPGRPPTAAEHLDVDAVVAQFGGHRAVRARFEALASATASLVLFLEHLPDALPGWLSDPVGRAATVERQLFEMVAFLRSHEVLHLDGHFGNIRADEDRLYLVDFGLATSPRFDLSGTERDFAADNAGHDADYASMRLVNWLITATCSVPAGGGPVARNRLVRRCATGDIPPEVPAPVAEIIARHAPAAARMNEFCRRLFDGDLRAAYPGHADAIRTPPDDATPVTA

SEQ ID NO: 9481 - protein, 1319 aa, Actinoplanes utahensis
MTVTIVKRPPRRPAPVMPSGEVLLDPPPEIPPPGGKGWTRMLMVLPMGAGAAGMGLMMSAQRGGPLTYVAGAMYGVSILGMIAMMATNTSGPGKREMIESRRQYLRHLSQLRAQLRATIRQQREAYYYRNPDPATLWTFADSGRLWERRRNDADFTVVRIAVGAQEVATRLVPPQTRPVDELEPLCAMALRKFVNTYSVVPDLPVSVALRDFSHIYLRGAEEAVLGFCRALTAQLVTFHAPDDLRIGVCVPDHQRPRWEWVKWLPHGQHPDKIDAAGSVRLVSPSVPALEASLDDVLASRSRFELTGPPPPGPHVVVIIDGGSTAGSDHLMTEGGVAGVTILDLSGPPPRLLDDSSVILEIAADGTITGVTMDGSTQVGRADTLGLPEIEVLARELAPLRLSAAASGDQPAISQDMGLAELLEVDDPYQLELADLWANRPNRDRLRVPIGIGLDGRPIEIDLKESAQDGMGPHGLLIGATGSGKSELLRTLVVALALTHDPEILNFVLVDYKGGATFASLDRLPHTAAMITNLKDEQPLVDRMLGAIQGELTRRQELLRKTGNYASQRDYERARAAGVPLAPLPSLVLIVDEFSELLADRPDFIDMFVQIGRVGRSLGIHLLLASQRLDEGRLRGLETHLSYRIGLRTFSSMESRAVLGVPDAYELPSHPGHGYLRAGTDGLIRLKAAYVSGAVRREGAVAAGGTRAGSPIREFTTYYAMPLQEEQPRAAEPAGQEVEEKVQGDTLMDVLARQMEGRGTPAHEVWLPPLDKAPTLGQMLPPVISMPDRGLQVDAAERFGALHALTGIIDKPFDQRRDPMWLDLSGAAGNLLVVGGAQSGKSNFLRTLITSLSLTHTPREVQFYCLDFGGGPLTALADLPHVGGVAGRRDSDRVRRTIAEVHLLMRGREDFFAQRNVEGMAAYRRVKAQGRYAEDPFGDVFLVIDGWSTLRTEFEDLEPTVNELANRGLGFGIHVIGATSRWMDVRPQIRDVFGTRIELRLGEPGDSLINRREAVNVPDKSPGHGLTPDGHHFLAALPRIDREQRADDLAEAVAEMVKHATEHWSGPPAPRVRLLPAELAFEALPAARGPVVPIGIAESDLEPVWLDFDAEPHALLFGDIESGKSSFLRSLAKSIVAGNSPSEARILTVDLRRSLLGIIPAENTIGYGTSHQVTADLINQVVVAMRERLPGPDVTPEMLANRSWWKGPQLYVLVDDYDLVAAAAQNPLLPLLEFLPQARDIGLHLVITRRIGGAARAMFDPVIGRIRELASPGIMMSGPRDEGPLFGTIKPQFLPPGRAWMITRKHGARLVQLAWTPPAH

SEQ ID NO: 9482 - protein, 467 aa, Actinoplanes utahensis
MTAPGGPSLARVTIAAPTRRMDVALPDNMLVGELLPHLLRHAEGALGEPAERHGGWVLRRATGAALEPQRNLAAQGVRDGELLHLKPAREDWPELAYDDVVEVIASGARRAGRSWGAAATRRAGLAVFAAALLIGLFGLAAGGPARPTAAIVALVVAVALAVVGILLSRAFADAGAGAVVAASGLPYAFLGGAWLIADSGARFLGVGAPALLLGSAVLLVLSVLGHTGVAGLPRLFVGGIAVALTGLLAALLTLAGVSAAGAAAVALTAAIGLLPGYPVLASWIGRLPFPELPSRAEEILKDKPMPRRADVFAAVVRADEVLTGFLLATAFSSIVAIVYLAWSHPGTPAVLLIVAAVTALLLRSRLLATPRQRGPLLVAGVAGLAVLGVGAVVTGAVPGLLVLAGAVLAGAVALPAAVVYSQRQPSPYLGRAADLLDVIAIMALIPLACAVMGVFDDIRGLLSSIGG

SEQ ID NO: 9483 - protein, 452 aa, Actinoplanes utahensis
MASRRDQLQSYQFLNQRVISAFVMRETDPAQSPLRRGIGALFGGLMIAVLIAAGFGIYGILTKVGGDQWRTEGSVVVEKESGASFVFLHDRLNPALNFTSAKLAAGKPNPQVYRVAAKALTGVPRGVTIGIPGAPASLPAADQQSGLPWAMCLVPGENPAATLLVGTAGPAGADLGDKGLLVTDGAGNVQLISHGWKHRIQDAQTNLPALFGAVDPMRVSTAWLNSLPAGADIAAIPVQNRGVPSRRVTGLNNGQVLATEVGVNGTQFYLVLDNGVLPITALQKAVLNAAFPAEPKNVPVTVVTGAPQLKPAGNADAQPPADPPKLATVAAGTTACAVTRSAAKAPSIVVGGSPAGLSAAVPTTGAAGGRALADQVGVPAGHFALVHVPGSGGYQVITDLGVRHAVPDADALARLGYTAASATEVPTALVTSIPAGVTLDPVAALKPVTGTD

SEQ ID NO: 9484 - protein, 406 aa, Actinoplanes utahensis
MALLRGLPAVFLLLIAVVVTPAAAMAADCARPARLTGSTAWPRTMLSIDSATSFSRGGGVVVAVLSTGVRAGQRQLAGRVLAGRDAVRNQGAADTDCTGIGTQVAGVIAADRADGSPVLGLAGKATILPVRVTGDDGTVQPAALSRGISFAVQAGADVIVVAEPAYQDSAALRDAVAAAVAADVPVIAAAGDLGAAQDANPTPFPATYPGVIGVGAIDQNGAIFPKSQHGPYVDLVAPGVAVPTLQGGDGASAGLVEADGTALAAGYVGATAALVRARFGRLPVAEVTRQLTASASPTVTGDAFGAGVVNPSAAVTGRVSDRRPRALPALSPAAAGRSGVENRRRAAAFTGATIAGVAVLAVLMVTAAIRRSRRQHWRPALAPPPPSYAEPIEPGPPVMLLDQPDR

SEQ ID NO: 9485 - protein, 167 aa, Actinoplanes utahensis
MLPVARTRDEAHLYMDLHGCPDCGSVDVTWAEALVDRSGVLARRYHGRCGGCGRDREFVFALPDRPTPPRAGEYVTFGSEPSQLFDAGEWVDLADMLSLAAEIDDDPGSLLIAVACLDEALRFLPADAAEVPAEAFWSDAGRAARARSPERFRRADLLARRAALAAR

SEQ ID NO: 9486 - protein, 263 aa, Actinoplanes utahensis
MKKRIISYAVAALLTAVVVADLLSGGRLVRLPQRADAAREQAAQIGARLRAAGTAKVTFEASMNPGGSWAGTSTVRFGDTPVWDTAYTRATAGSRRIPLRRLHLQRRDFYSSPALTTADARPWIPPDRIGFGRLSSPGNNISDLTTWLPFLTGAGEQVAPHEYEFRCDGTSAGCPPPLHSDLDSYFNAVPDGPVMRARLDDEGRLVRLQVTAVLDNIRGDGSRGILVPSDVTATFTLADFGTPVQVVAPAEADITTTFVSLPG

SEQ ID NO: 9487 - protein, 279 aa, Actinoplanes utahensis
MTAPAWEPGNGVEETLLGAAIQDDRQTFFQVVASSDLYLPRMSGDGPQRFLTIHALGQVMLPVFTSVRALAAQVGHAVDGYTVTNFAELSRKWPDPDWRLAINPGTPIDAYLSIETLMQAALGDIRVPTLGELAESAEREAIADAEARHRRRDPAEYPDDDRAALRAALEVGDVYGYLDRLLDANVLIPVSRPAEPEEILGDGFPWLPGYDQMIEVFTSPEAFDRRHPHEPPERVEVSLAFALALWPEGHGLSVDPESDSAFQLPEDQVLALLAFTPED

SEQ ID NO: 9488 - protein, 344 aa, Actinoplanes utahensis
MTVLVAQTYAEAYLYLDLTPCECGETAFTPSVVAEADCVRWFGVCPRCGRERSFRFRFGDRPDSTGFSHREAPSELIDAGQWLWVAERYLSGVPQSIPGIRALPRDQQKTVQALLDVADAALDEAAKFWTTMEDDEDLPESALWTGWSRQARAAAPERFRRRWLSDQRSRWALLDGGIPPMTDEEFAGGPDSDYLKVVRLRAEVRAMWVARHGLSDLTDRRATPAQRLELQRAERAATGLDVATGYSTHATQSALAAYDSLVSTIQREFATDPGQRDGRLAEAAAVRAVWLAETGLPAWSPDDDVYEFPADRMPPAGQAWEMVRAARAAAGVDPDLGDIREWRP

SEQ ID NO: 9489 - protein, 254 aa, Actinoplanes utahensis
MPVPRARSEHEAHLHMDLHPCVCGESRFPREPEKTLLPDGLAEVRFAGPCDNCGRPREFVYRMSTEPEIEEPGWPRFGGPEPSELIDADQWVAAAARYAAPPADPMRMRTAMACINEAEKLGAEGLSPLWESYNRSSGVWEPRPWPGPPSYEKDPATGFPTDTGRTALSGYNRLPYQIRARFQDDPAERDRRLAAVAAVRSAWCVRQGYPEWDEDADEYDMPADRLPPAEPAWELVRAARAAAGQDPATGEFVR

SEQ ID NO: 9490 - protein, 119 aa, Actinoplanes utahensis
MRDPDDDRDPARHLLSRVRYRRLPDGTQQRVPITLDQAAAEFGELIDAGRPAEVRLDPDEGRDEVAAFSRQRAKVIASLLDELSRRVRPGLAVGPIQSDGKLADLAAESAAHLRSGTGY

SEQ ID NO: 9491 - protein, 110 aa, Actinoplanes utahensis
MTPDPARHWLSYPVHRGDPEGFRPKPLDEFAADARPALDAGDAFDHRTTRGSRDIVSISVQRAGVIAALLDELALRLRPGVEAGPIQADGELSLLARELADDMYRWASPE

SEQ ID NO: 9492 - protein, 334 aa, Actinoplanes utahensis
MTHPLARTRQEAHLFIDLTPCACGDRRLATAGEPVTLPDGNPGRRYAGRCPTCGRDREFVFAMPAVPEDSTSTRQIVYGYGTRPSRLLGPGQWLWAAEQYAEAVPRDPEHLTGEARATARTWLMAAVAAVREAAKFLPDGADRLPPGDVPAGRDPDDFTRQRLIDRRLGYERRLRALPGDPPPPRDPEQVRRQLARNRAVEAWAARHGLADPVIGAGTAEQNREIDRELRRMDGLDPETGLDRDSAAAGFAAFRQFIDDLEIALAADVPARDLRIGTALAAYQAWLDRLRISDGPWRDALWAGDIWQTPDTDLPPAAAVWEMVEAARSAVRSLG

SEQ ID NO: 9493 - protein, 162 aa, Actinoplanes utahensis
MTELPPAADQPSLEGLFRTLRDTEWSWDRAGFPALAERFGWTVTYQDDNGVIADVPWPAPRRPVQLAWSRGAVDEVSITLASVAGLPEAPPDFLPGVFDLAVRTGTAILGEPGDGRPADHPQVRWPGERATIVLDQLPVAVLLTWADNEWLAIADWSDEDDG

SEQ ID NO: 9494 - protein, 175 aa, Actinoplanes utahensis
MAWPGVTVPRSVVTVPRSVVTVPGSVVTGLPWIVLLWIVLPWGTTVRRSVASGGRREGIVPPLVASAGRLAETGRLPDGTGLLEAMWRRAGRRAEGGIPGMAILVGFRKAREDPTTVECRYGHPSRDRALVIDKDTPAGTPLDGAATPAFAAVAAKAVRTSRTVGTWPAAGTYAA

SEQ ID NO: 9495 - protein, 547 aa, Actinoplanes utahensis
MLDYFSAFEEWLPGWADWLSHLVIGEIPLAHANNVYDLADQWERLADELNRTYQDIVRAADPIVENWSGDASASAFVEQWYAYLDSLRQTAEGAGEMRQGVQNFGLEVELMKFAVAMNLFMLAVQIWMMIAGAGPTGGATLTGAPPAFWGFRALLGKAASATIGRIAGIVMKFAIKPLAFVFGKLPARALTAGVRFAVPLVTRITLGHMIPAGVVRGLVAQGARNLAEKIAGKWLTDMAIKGATNLAARGISKTVANRLAAQALRDMANTEVRGLLAQQSARAVQKQLVKEIQQQLMKNWVGRKVAEDVGENALTKLAVKEAATVGLGKEFGHYVGSRVAFGAGFMGGGDLAGQLVQMGEGNRDSLDWGHVKDSAIQGGVFGASMFGGITGHVAGGALAGGGLDIMSQLEQGTGIKDLNWTEAGHGAVQGAEAGVIFGGQTHLEMSTLGAGKLQIGKDLHILSHEDGSFSAVSFRDNPKLGIREHLVLTDNGYAAYQGANHGGDGALRVVPAEVSARPEVAQHIADNWGPEPATVRTESPSPGVTAS

SEQ ID NO: 9496 - protein, 128 aa, Actinoplanes utahensis
MGNYVSIKSSPSELINVADRLRDHGISLTANVRAIKLDIVEHENRGDTFPSDKFTDGFVPKNYKKPVPGPVPGQDIPANEALMQGAEAVAARLQEVGEYVGKAMVNYDVTDLENAGDIVKHTATAKRV

SEQ ID NO: 9497 - protein, 133 aa, Actinoplanes utahensis
MADVPGRPDWGVLRDMLSDLRKATSDLPNVQRRMLQVTGTGYSPDGLIKAVVGPRGHLLELDIDPRVLRQPNSKALSASIVQTVRAAIEDAGRKSTAVMTDSLPADLRRMAPDDVRSYVGSHDADVLIRAEDD

SEQ ID NO: 9498 - protein, 94 aa, Actinoplanes utahensis
MSITYNFGQINDVATAIGTFEGQMDHQLTELYTAFTTLFAADWQGSAGEACDQARQKWNQGANEIKAALASVGVKLGASAERMQQIDQQIAAGM

SEQ ID NO: 9499 - protein, 113 aa, Actinoplanes utahensis
MGQVHATQEQLNRMAQRCEETGENISRGMAGLRERIEGLSGGGFQGSANNALQDVTGQLTEGLAKIVNALDELAGKMSSASKQYGTHDEDAAHDIRAAAASTGDGSVVSILRG

SEQ ID NO: 9500 - protein, 357 aa, Actinoplanes utahensis
MGDDNLYPDTTKQNTHQPWLDEHTPVDVNLDGLREYAKLMGKQQTQLQDDLGRLTHLYDSPFKAWDGHVLGEAANIRQQLTNNAGELQAYMGYLAQAFYNIGSAAQTIADIYSDGDATGAASLNDVLFAFGDKSIPRPHGLPRNIGRTYLDAVTEQAKSDPVAIPGETSPEWGNPTVTTLSPYQSKEVSVGPGGQHMEKVITSVPGSGVTIETVTIFNAKGQQLSTKSTRTTTSFDASTHSIVTSTESSQDGRATGSSVNTKTYAGTRLADETTVNKGANGQETTTTETKTATDGSKVETTTKPVKDKHGHIVPDQRTTTDEVHTGTATTSSGTSAPTTKISTAYDPIAQRMAADHG

SEQ ID NO: 9501 - protein, 517 aa, Actinoplanes utahensis
MADGDYFGAKADPNYGYSPYSGQLHYGNHSIDFEFTPDAGEGNPLTIETVEWMINNSHPEEIAVLGDHWQNMITRLNQYKTFLRDESKQLEAESWKSPKAREMFLQKGPGEALAYLDVWIDAATTNLTAIRALEKVAADSRAKIAQLMNEYRAALHNAQHVDLKGQLSEWFDTSRALNTTWGDAKKYQIQQQVGEVEKHFNGRAQELAALTAKAYSDWSKTLFSGVGPPYKPMDAVLNQPGHPPLLAPPNLPGGGAPPPPPPLPPAVPPPPPPSGANPKPPTAPGGDLPPDPSQGTQGNPPPAPGALPAPPGQLPGGMPGGVPGGLPLFPGGLSNRGLTPPSLRPGLGAQRPALPQSPGTSLPNPGQLTRNAFNRPGQPPGLGQPPGRTLRRGGQSTGKPGSLPPGRPGDRRRGEQDREHGTRLPGGTEEAFGHPPNSMPPVLKNPSTDRQRRRPGSTEELRPTAHTSGDAYRPEGTAPPVLNRPMQPGIPPAQPSRRRQTPGQRQTTGPAWGDFFG

SEQ ID NO: 9502 - protein, 94 aa, Actinoplanes utahensis
MSGLEEVPEALRSRAAARAAAAQQGRPGTVAPELSKRRVTGEPAPAQRDEDEDLSGVVTDEQAFEVQTPGGGVVTSQRDQPVYEPEIKRVLGSS

SEQ ID NO: 9503 - protein, 133 aa, Actinoplanes utahensis
MAASANDVPQATARPEPAGGGRRLLALLIDWLLCLLVAGLYASPYRTSWPPVVLLILVNTVFIGLFGQTPGMRLTRIACRSLIDGGAIGLGRGLLRAVLLALLVPALIADGDGRGLHDRAAGSMVVKRSPAPA

SEQ ID NO: 9504 - protein, 474 aa, Actinoplanes utahensis
MFANPEELLRYLKDEDVKFVDVRFCDLPGVMQHFNIPVESFDDSVATDGLAFDGSSIRGFQAIHESDMMLLPDVATAFVDPFRIQKTLALNFFIHDPFTREAYSRDPRNVAKKAEAYLASSGIADTAYFGAEAEFYIFDSIRHETSAHQAFYYIDSIEGAWNSGREEEGGNRGYKTAFKGGYFPVSPVDHYADLRDAMVRRLVDTGFTVERSHHEVGTAGQGEINYKFSTLLHAGDQMQLFKYIIKNTAWEHGKTATFMPKPLFGDNGSGMHTHQSLWLGGEPLFYDETGYAGLSDMARWYIGGLLHHAPSLLAFTNPTVNSYRRLVPGYEAPVNLVYSQRNRSACTRIPVTGSNPKAKRVEFRVPDPSSNPYLAFSAQMMAGLDGIKNKIEPPAPIDKDLYDLPPEEWGSVKQVPGSLDAVLNSLEADHEFLTAGGVFTDDLISTWIDYKRTNEIDPVRLRPTPHEFEMYYNV

SEQ ID NO: 9505 - protein, 771 aa, Actinoplanes utahensis
MDIENSASFEVALQAGIHLMLGAGFSVLAKDKQGRSLPVGGKLGDELRQEFGVDPGCKLTLPQLYTILAAKDRDAADEYLRNRFTVGWFDPRYTSVARLNVSMIFTTNIDDLPWKIYEGSQTKYLNDVVMRGPQFKDGSAVDYAPLHGSVLDDTRAFRFTSIEVASSFSSDPTLWQTFRRRLSAGPTLFWGYSLQDAAALESLQTTGQGGRAVGNNWITVRPSDRDDPLVEYLRALRFQIIFAETEEMIEYFDGLVPAAPSEGADDIIDSLRQYLVPRPSRVPQRPVVEFYSGAAPAWSDIFRPDVPKLEQYRVAENALNSKKDVIVTGIPASGKTTLLMQLAAANVGPGVTFMPGSMTREAADRLQRVLQGNEATVVLDRFCDDVEAWNLLRAAPNITLLAADRDYNIGTVIHRIDRSGVEFVSLSEISELDQGTIRAAIPAAVRTPKMVRPPVTAGEVSILDFNLANTTSKSLESRLVEAIKQFQEDDPVSAEMLILIAYVHACGTVLSMDMALAYWRDKSAQYRDILTLIEKVGKLLNEYEGDLAEDDGQDYFAARSIVVAEAALNAARTSILRKVLTTFHSNLATTRICRFDIFRRRGYSHRIIGRAFQRTQDAIQFYDLLLDKDANPYLLQQKALLLSERSLYTESFVAIDQALAMSPKKNWRIEATHAELLFDANINLAAESSDARRQADRAMDMLRRCYLSDRRRSLHAFSYSRRALKYFGQFGDEQARTYLEQAEEWLRVVQVNEPYMTSTKYLLGDVRRELS

SEQ ID NO: 9506 - protein, 1155 aa, Actinoplanes utahensis
MDIGVLGPLELRADDGAPVPIGGVRLRTLLILLARDAGRSVSTGRLVDGLWGAAPPAGAGNAVQALVSRLRRAAPGLRIEATATGYRLVLDPGRVDALRFLACADRDPGAALRMWRGELEVPDVHLEEVRLRAQKAWLAAEMAHRDVVAELEALVAAHPLDEPLAALLIRALRRAGSPGRALDAFERIRVRLREQLGTDPSAELTALHRELLRQERPGPRGNLPAELSTFVGRETDVRRVVALIGTHRLVTLTGPGGSGKTRLSVEVGGRLPGASWLVELAPVRDAAELPQAVLTALGLREQPGRDPLTRLRDAVAGRELLLIVDNCEHLIEAAAEVAAALLRAAPGLRLLATSREPLGIPGEGIHPVEPLPLPPAGSDATTAAGFPSVRLLLDRATGFALTDGNVASVVRICRALDGMPLAIELAAARLRTLPPAMLADRLTDRFRLLTGGNRAALPRHRTLRAVVDWSWELLSEPERRLWRRVAALPGGADLAGVERVCGADLDVVSALVDKSLLILEPDGRYRMLETIREYGLERLAEAGETESSRRSIADHLLALARAAEPHLRRAEQLVWMARLRAEHDNLHASLRAALAAGDRATAVALVANLGWYWWLCGHRTEGSTLCLAALALDGPADRQELALAYTLAALNGVEGPMAFAEVKASFNRALELADPHPGSHPGLRMLGLVAALYGTRRADAEQAAATIVDDPDPWLRAVARMIVGQVRLNFGEPAEVAEADLRASLAGFRAVGDRWGIGFTLSALADLTAARGDFAQAVGWQREAVELLREVGIREDVPQMGAKLAYQLWLHGQREQAYRALDEAREYAADLGIPEVMASVHHVSATLAREEGRLDEAREQVDRTVALIAGSTLAPQFRAMTHSTRGLIEATAGRLAEARAEHETALRIAVRTRDSPMIAQVLAGWADLALREADPERAAFLLGAADAVRGSVDRTVNAGVIVAGEARAALGDAGYAAAFGRATAVTMDTALAAAGLDPAAEGLDGEGGEDREERGGPDQRTGDRAGHRATGEQAAAGVGQERGRVHPREAAQPARHAVGADERAAHERDREDQHEAEDLHPGRFADQHREQHGHPGDGHREAEQQGEEAEHRQRAGGDPETQQHAETQQQRERPRLFDHVGHDPAGQRREPGDRQ

SEQ ID NO: 9507 - protein, 313 aa, Actinoplanes utahensis
MGHDTTTAVYAEGLVKRYGDTTALAGVDLAVRTGTVLGLLGPNGAGKTTAVRVLATLVRPDAGHATVGGFDVVRQGHQVRRLIGLTGQYASVDEQLTGFENLLMIGRLLGLTRPAARARAGQLLDRFDLADAAGRAAGKYSGGMRRRLDLAASLVGEPRLLYLDEPTTGLDPHSRNEVWDIVRGLVADGTTVLLTTQYLEEADRLADEIVVVGHGRVLATGTPEQLKARTGAQTVTVRPADPDDLEKLSGEVGRVAAGPVEVRGDAVVAPVSGPGALTALVRSLDDAGLPVSELALRGPSLDEVFLSLTGAAA

SEQ ID NO: 9508 - protein, 390 aa, Actinoplanes utahensis
MKRIVSLVGSALLAVVLIFTAVHRNQFFDSKVYYGAVKYWFRDGGMVYDWLKPGTPYGFTYPPFAGLVMSPMSVLPFAAVVVLASIGTVLTTALLVWWLAGSVLRRTGHPLWFVFGLACCAGLAFEPVRETFSFGQVNLLLLTVVTGDMLFGVARGRWWGGIGIGLATAIKLTPGVFILYLLVTRRWKEAGTAIGAAAGASVLAGALFPDQSREFWTSALWDTNRVGSLQFLSNQSERGMIARLPYDQIGSKIWLVCVLITLVWWGLRVARNPGDVVGGLALTGVLGCLVSPVTWIHHCVWLIPALIRCLERGWSGVGRGPAWLATAAYVLMTSHLAWLWENRPWPPMAILGSNLYVLFSLALLIWTPIGAGVPAPDPAPEKVLTGADGR

SEQ ID NO: 9509 - protein, 464 aa, Actinoplanes utahensis
MPRPPLIRYAGLAGSTLLSGAARLGGAHRPWEPTVTPWTIVTGQNGILLPVFWLIGITLLIGAWLAGRRVVPSARWAFVTAGLWAFPLVLFLPLGSYDTYSYACQGWQHAAGLNPYAGGVDLLGCPWSDAVAPIWRATPAPYGPVFLTLAAMAAREGGSLAGTVALLRLIAVAGVALLGACLPVLARRAGVPAARAVWLVLACPLLLIHLVSGAHNDAVMVALLVAGLAVASTGRGWPAGVLIGLAVGVKVTAIVVLPFLIFLVPKPRWRAAGELAGGAAGALLVASLGSGLGLGWIGALVDSGVSVQWTSPPTAAGMTLELFGVPHGVPVTRILGMLALVAVLIALFRRTARGGDPLLYAGLALAATVLLAPVFHPWYATWPLAVLAATLPRDTRWLAVPCAVAAALCLPDGYNLALATKALGAVGMTVLAGSLAWKVLHEANRVPGRVGVAGGGSDIHRGAP

SEQ ID NO: 9510 - protein, 81 aa, Actinoplanes utahensis
MARQLDEECVVATFQDRFARWFHETFDDMWFRSLIGPAQTKGAVQGCDAFAREGWKADLERRKQYTRDQRELKRARRAGAR

SEQ ID NO: 9511 - protein, 148 aa, Actinoplanes utahensis
MTDDAPVDDDPLALERQVCFALSVAARSVVALYRPLLEPMGLTHPQYLVMLALWGESPLTVRRLSELLALDPGTLSPLLKRLEAIGYLRRERDRADERSLAITLTERGEALRAEALRIPPAVVARLGMPIDDLHRLHASLTRVIAAAV

SEQ ID NO: 9512 - protein, 1003 aa, Actinoplanes utahensis
MPGCRRPCRCWGSEVTRPTRLARYGFADSGADLLGPRGLRLWDAEGPAGADAAELIHALSRAADPDLALRQFHRLVDAVSRAAERAAGARPTGPTGEITANDATREVFGELFRDHGLRRRLVAVLGASSTLGDHLVANEQEWRALATTKSGLPPDPEGHLELDEPTVPALRRAYRIALLRIAAADLTGGRGLEPTMAALSTLADETLSAAYAIAVAALPAGTPEPRLAVVAMGKCGGNELNYISDVDVIFVAAGDEDLPAGTTVAARLMEICGQVAWPVDAALRPEGSRGPLVRTLASHQAYYRRWARTWEFQALLKARPAAGDLALAGEWLADLAPLVWHAAERPEAVADVRDMRRRIIDNVPARELDREIKRGPGGLRDIEFAVQLLQLVHGRVDESLRLPGTLPALRALVSGGYVGRQDGETLLRGYRFLRAVEHRLQLQHLKRTHTVPDDPAGLRWLAAALGYTALPGQGAVEAFRSDWIGHAANVRRLHVKLLYQPLLEAVARVPADALRMTPESARKRLEILGFADPAGALRHLEALTGGVTRTSAIQRTLLPMLLQDFADAPEPDRGLLNYRQVSDKLGGTPWYLRLLRDGGPVARRLARVIGLSRYATDLLTRDPEALRLLADDAELQPRSREKLLDGFAAAADRHAGDPVKAIAAVRALRRRELFRLACADILSQAGDLAPAHPVDVHEIGAALSAVTDATLNAALLIARRARPGPPGMRFAIIGMGRLGGYEMSYPSDADVLFVFDGTDDGAAAHAVAEETRRLLNAPAPDPALGVDADLRPEGRQGPLVRSLQAYQQYYDRWSKVWEAQALLRARFVCGDHDLGVAFEALADRKRYPDGGLSRDQVVEIRRIKARVETERLPRGADPNTHTKLGRGGLADVEWAVQLLQLRHAHEVPDLRRTATLEALAAAREAGLVEAADAAAMADGWTLAAQVRNALTLVRGRPTDQLPQHGVELAGTVLLLGGGDPGEFVDRYLRLTRRSRAAMERVFS

SEQ ID NO: 9513 - protein, 256 aa, Actinoplanes utahensis
MRTALVIENDPTDDLRRLGEWLTEAGLELTVLRPHAGDDLPETLDDFAALIVLGGDQSAYPDAAGAPGAPWFPALEGLFRKAVRNRVPTLGVCLGGQLLASAHGGLVERSPAGPEIGPGLVGKRDAADTDPLFQWVPLLPDVIQWHRDEITELPLSATLLAASSRYPHQAFRIGDRAWGLQFHIECDAAMMADWVRLGAADLDELGYDGEAVVHAVAGILPDVEEVWQPFAARFAALALGQLPDAGMPKTLPLLGQ

SEQ ID NO: 9514 - protein, 36 aa, Actinoplanes utahensis
MPTSIQPMVFISFSFVGVDRTLAGRPDSVLSVFAGE

SEQ ID NO: 9515 - protein, 479 aa, Actinoplanes utahensis
MRPVQAVTAGAARLGVDRGAGLLQGADVTLDGADAHLEALGEPAGAAWPGCDRPQFLDKGVEPVGTVHAQHARAGVRQSPGTAPAPRSHRRPPKVCSMTQESPEPRVSTLELFFDLVFVFTVTQLADSLAHHPTWSGLVDVLLVLVVVWWMYSGYAWLTNAVAPTTTTRRTLLLAGMAGFLVMALAIPDAFGHNGWLFGVAYVVVNVTHSVLFLQAGPDARRVMRTLGPMNLLAALLVLTGGVLPEPWRHLCWLAAPVVQVLASYSHPIGLHHIAAGHFVERHSLVMIIAIGESVIAIGVGVGGQGHLGGDLILAAVLGLAIAYYLWWTYFADGDRRSEHVLAAVDDPARRGRLALNAWGYAHIPMLLGIVITAVGIKKTLGHTFEALHWPEALMLGGGVAVYLLGHAVFLRLLAQPGPGYRVIVATCCLATVPLGHLLAVAQLAAVAVILAAGAIAEDIPRVRRAGLQAAIGDFGRTG

SEQ ID NO: 9516 - protein, 141 aa, Actinoplanes utahensis
MLQDLLEGAGRSIVFGLIGIGLMAVGYVLIDLLTPGKLRDLIWTRRNPNASLLLAANQLGIAAIVFTAIFTTYDSFGQGLASTVLFGLIGIAIMGLAFLVLDWMTPGRLGEVICTDDFHGGALVSAASHFGAALIVCACIA

SEQ ID NO: 9517 - protein, 450 aa, Actinoplanes utahensis
MDRQQEFVLRTLEERDIRFVRLWFTDVLGTLKSVSVAPAELESAFEEGIGIDGSAIEGFARVFESDMVAMPDPTTFQVFPFEGGGSGESARMFCDILLPDGNPAWADPRHVLRRALARAAEKGFTFYTHPEVEFFLIQDQDNDGSVPIPVDTGGYFDHTTHAVARDFRRQAVLALERIGISVEFSHHEVAPGQQEIDLRYADALTTADNIMTFRHVVKEVALSQGVKATFMPKPYTDQPGSGMHTHLSLFEGERNAFYDSEDPQKLSKTARAFIAGLLVHAREYTAVTNQWVNSYKRLFPMQLPDRITESPAFVSWGHLNRSALVRVPAFGKPNSARVEVRSLDSATNPYLAFAVMLGAGLKGIEEGYELPAGAEDDVWSLSPAERRAAGYEALPENLSEAIDVMAGSELVAEVLGEHVFDFFLRNKRAEWEQFRREVTPYERQRYLGAL

SEQ ID NO: 9518 - protein, 593 aa, Actinoplanes utahensis
MPTLRIALAQVNSTVGDLAGNAAAVRRWSRAAAEAGAHLVAFPEMMLTGYPIEDLVFRNSFVEASRRALGELAAELAADGLGELAVVVGYVDADGPARISSDATPGTGRRDASALLHRGEVVATYFKHHLPNYGVFDEDRYFEPGDTLTVVRLNRIDIALTVCEDIWQAGGPFTAARRAGVGLVVTINASPYELNKDDVRLPLVQRRAAEAGATVAYVNLVGGQDELVFDGDSMIVGPDGELLARAGQFSEELLVHDLDLPEADAEPNPEGSTDAAKPRVETEVSDTMAVSRTTITGEPAMLRDRRTAPAKDRLEDSAEIWSALVLGLRDYVDKNGFRSVILGLSGGIDSAVVAAIAVDALGPDRVTGVSLPSGYSSEHSKDDAADLAGRTGLKYRVEPIQPMVDAFLANMSLSGVAVENLQARVRGVILMALSNSDGHLVLTTGNKSELAVGYSTLYGDSVGGFNPLKDVPKTMVWQLARWRNTQADAPIPENSISKPPSAELRPDQKDSDSLPDYEVLDPIIKGYVDHDLGRAELIAAGNDPALVDRVLRMVDLAEYKRRQAAPGTKISGKAFGRDRRLPITNRFREGQVL

SEQ ID NO: 9519 - protein, 276 aa, Actinoplanes utahensis
MSEIPTLYGGPATRRVRTRDLLNAKVRGDRWPMLTSYDMYTASIFDQSGVPVLLVGDSAANNVFGYETTVPITVDELLPLVRAVVRATRTALIVGDLPFGSYEESPTQALRTAVRFMKEGGCHAVKLEGGRRMAPQIEAITGAGIPVMAHIGFTPQREHAIGGYRVQGRENEGAEVISDARAVADAGAFAVVLEMVPGEVAKQVTKELSIPTVGIGAGPDTDAQVLVWQDMAGLRTGKAPRFVKRYADLAGALTEATRQFADEVRSGEFPAPEHTF

SEQ ID NO: 9520 - protein, 474 aa, Actinoplanes utahensis
MPIKRVWAPQIDFSVLRRELKLPGEFPAEVIAEAERVAGEMPELADRTDVPFVTIDPAGSQDLDQAMFLERRESGGYRVRYAIADVASYARPGGAIEAESWVRGQTVYLPDGRIPLHPPVLSEGAVSLFPDVDRAAVVWTIDLDADGATTGVALERARVRSRAKLDYPGVQRELDGGSPSEQVTLLAEIGARLARRAADRGAVNLPLPAQEVERDGDGWRLVLRAPLPVEEHNAQISLLTGMAAARIMLDGGIGLLRTMPAPKPEAVAGLRVAAASLGVPWPDGASVGAVVASVDPGSPRGAAFLDQAAELLRGAGYTAFGGDAGPPPSDVGHGGVGAAYAHVTAPLRRLADRYVTEACLALHGGRPVPGWVREALPRLPKQMSATDRVAGAADRGAIDLAEAVLLQGRVGETFDVAVLDREDASGKRPAGGMVALDEPAVRARCLGDLPLGSRIQARLTEADPSTRTVRFEKA

SEQ ID NO: 9521 - protein, 412 aa, Actinoplanes utahensis
MATGARAAGATKTAAKATTTKTGTKATATKATAAKATAAKAAATKAAGTRATPAKAAGTKATAAKATAAKATATKATATKATTTKATAAKATATKATATKATATKATVAKGTGAKAAATKGTATRATGGRATAVKSAGARAAGGRAAGKVAGRKVSGARAGAAAEAVVAEAAAVEAAAADFAAVKAEEAMESANQAVASVMAAKSAAAKAVKVAASNRAAAAKAARTSKAAAAKAAQAVADDEPAARSGRSRTTAATSTTGRAGTKAASGRAAAKTAAGSKRTVPAASARTETAVSSARRAPAKSASVKSASARNDSAKNGPVKTASAKGASAKNAPAKNAPAKKAANKSVAAGAGRATGNAAKGTKATRTSGTNGSAGGGATGGGRNAAKAASASRASAVRKPAGAVRRSR

SEQ ID NO: 9522 - protein, 864 aa, Actinoplanes utahensis
MPAAKKAPTRPATSGAATKTIPGTAKRTTAAGQPEAATGRTGAGTPRPGGTRAAAASARPSTGTGRSARAVTGAGTAKAGAVGRAAAKVGSGVAVAAKTKSSASVTARVSGKGAEAKPGSSRAAKAAVAKPVGVKAGVVKAGAVKTVAAKTASAKTASAKTASTKAAVVKASPAKVASTKVAAVKVAPAKAASTKVAVTKAAPVKTVAGKAGAAAKATTSVRSAAVKGAAGKGTPAGAAAAKSAGAKTVAAKPAAKATAGKSARGVAVVPTARSGAKSAAVGRTGAAKAAPVSKAAGAKVSGRDATAGKKVPAARAATTPKSSVKGAAPAKRGTAAVPAARVAGGSARAAGGSARAATKRGDKPVTKPVSAAKAVVASKPAVKGVAGSKVAVNPVAGGKTTVKAVAAARSAGRSGVAKPVTGRVADSAVAKAAAGRKAVTPSKAAKSAAVKVPAARSGAASTGGVKVGPAKAGAAEAGPVKVGAAKANTVKVGAAKASAAKTGAAKVGAAGTGAAKGGAVKSGAAKVGVGKAGKDAGVATARRASGGRRVAAASSNVPNKTQVTVSTEDAESKEWRRAGDETEISPSELTDRPFLGGWFAPSRDDTEPARDSDQWGADRPDLEALAEPDKVAGGTGGTGTTDLVSAQMEAFAKSARARGQLFLSPEDEGAVEDGGVIRSTPVRKRGATAGPQEAERAGEPGGGGAGSEVAAVRAAQAEMAATRAAQAGTLAVGRVGPDQPEPPATQVAVGGGTVPGGPAGKRAGGRLIAVPDDPGVAYGGGSVAAGPFAAEHSGDVSRTSVEPGAADEATASAEVAPSRMTRREAAARRAAARAAMSGSAGTAGSSGAVRSGGVGSASSGSAAG

SEQ ID NO: 9523 - protein, 73 aa, Actinoplanes utahensis
MQSDGMNDSGLGGAGYFWCLRHHRVETGDDVCPAQFRLGPFATADEATRALETVEKRNAEWDAEDARWTGENS

SEQ ID NO: 9524 - protein, 341 aa, Actinoplanes utahensis
MRIGIIGATGQVGGVMRRILAERAFPVSELRLFASARSAGRTLPWGGGEVTVEDAATADYRGLDIVLFSAGKGGSKEYGPRVVDAGAVVVDNSSAWRMDPDVPLVVAEVNPDAARIRPKGIIANPNCTTMAVMPVIRPLHDEAGLVSFVATTYQAVGGSGLAGVAELDEQVKKVADRATELTHDGSAVEFPETRVFPRPIAFNVIPQAGSFVDDGSFETDEEQKLRNESRKILGLPELLVSGTCVRVPVFTGHSIQVNARFARPLSPARAQELLATAPGVELSTVPTPLQAAGRDPSYVGRFRVDPTAENGLAFFVSNDNLRKGAALNAVQIAELVAAELG

SEQ ID NO: 9525 - protein, 265 aa, Actinoplanes utahensis
MGMATYTHGHHESVLRSHRWRTAENSAAYLLPHLSSGFTLLDVGCGPGTITADLATRVTRVTALERTEDALNAARAEITRRGLPNVDFALGDVHALDFPDDSFDVVHAHQVLQHVTDPVAALREMRRVTRPGGLVAARDSDYAGFTWFPLLPELDEWLALYQRVARGNGGEPDAGRRMLSWARAAGFTDLTATASVWGFADDADRQWWGTMWADRILKSEMATTALATGAATADDLQRLSDAWRRWAASPDGFFTIPHGEILCRA

SEQ ID NO: 9526 - protein, 196 aa, Actinoplanes utahensis
MNSRIADIQSRILALQTQQAATITTNRTTASGSSSASTFAGHLQGAMVAQGAAGAGRTYKLNAKGIPEDLAAYGNGRIPPEALEQVGDTRHKLWAPAAEKLTQLIADAKRDGVTIGITDSYRPYTEQVDLARRKGLYSQGGLAAKPGTSEHGWGMATDLDLNPEALSWMRKNGGRYGFVENVSRESWHWAFRPNMV

SEQ ID NO: 9527 - protein, 425 aa, Actinoplanes utahensis
MADEIQSVHQFRRFALIVCAIGVVIQLGLTAYYLSMGHRAAPHHLPVGLVAGAEQRAQVIGMLEAGGRFRVGDFPSAAALTAAIKRREVYGGADLTGDTPHLYVAGAAGPAAATLLRGTYTAVLQQRTAEQVAALAKTTDRVGIATVRTLITPPPVTDVVPLPKDDVNGVSLGFLTQALSLGGTIASMGLGRLIPRTRRSWRRGVAHLSTLIVYAVGSAAAVLWSMSWFGVGVDANRAEMLGIFSLISLAVTGSTAGAVALIGPAGAAVGAFYFTIGTVISGASILPEFLPSFGRRLGENLPTGAGVQAVRENLYFPQAPIAAHLWVLAAYAIIGCLLVLVTNVLPNRRDSTSEVDLDLTVRLEGSAVESFSRSNSDFPGDAEPVERGNRGSELAHRGHPEPDPGPADAAGGHDHHEPDDGVRKQ

SEQ ID NO: 9528 - protein, 295 aa, Actinoplanes utahensis
MITLADVEAADRRIDGRIRRTPLLQAGPDRWFKLEYLQHAGSFKTRGMLNKILGSDVPPAGIVAASGGNAGLAAAYAARELGVPAEVFVPVTAPAVKVAKLGKLGAKVVQVGNEYAEAYAAARERTGALFCHAYDDPALIAGNGTIAHEISEVSDTVLVAVGGGGLIAGLIAGNVGNMRIVAVEPATSCALHAALEKGHPVDVPVSGVAADALGARRVGDIAFDLATTAKIDAILVDDDAIVRARRALWDDYRIVVEHGTAAAYAALTSGAYRPAPGERVTTLLCGANTDPSDLT

SEQ ID NO: 9529 - protein, 374 aa, Actinoplanes utahensis
MRNGGVLDGRGTHNSNGVGERSMTVAIGINGLGRIGRSLTRIVAASPNPGISIAAVNDIAPTEKLAYGLRRDSLRGSFPGTVTARGDHLVVNDHAIRTYHQERPDRIPWADQGVDVVIEATGRFRAGGSARTHITHGGARKVVISASADDPDAFLIFGANHLSYNPGVHDVVSPASCGVNALTVMAKVLLDRFGLHAVKTSVMLATQGWGRVQDSLIGASRDDPRLGRATGESIIPHNHVVGDLVRVALPEIGEMRYSYYCVPTPIGSLAELAGETDRPVSVEEVNRAMAEAAAGPLRGILAYDPDPTVSIDVKNNPASCLFDPSGTQTTAGGGVSVRGWFDNEWGFSHRLLDLTRLIGERLPVPSSQVSWSVV

SEQ ID NO: 9530 - protein, 140 aa, Actinoplanes utahensis
MWNALRHAGHVPVLLSYAPADAHWAQWITGSLQAAGHAVTMHPAGVDFAHRMTVALSGSDRVLILVSAEHPASESDWARVATTAGWTVLALDAVPLPAALDAANCKSLHDLDEEEALEILLGAVGGPRDSFSRTPQSRPV

SEQ ID NO: 9531 - protein, 254 aa, Actinoplanes utahensis
MDLSHILLLVVAGVAAGGVNAIAGGGSLITFPSLIAAGLPSVDANVTNSVSVFPGYVSSVAGSRADLAGQERRVRSVLPAAVLGSVGGCALLLSTPGRVFEVIVPFLVLGAAATLAFQERLRGLVGHPRGMPARRAAVILQAVVFVGAVYGGYFGAALGVMYVAALALVLDEPLKRINALKNVLSATVGLVTVLVFAFFADVHWAAVATLAPATVVGGYAGARLARRLPATVLKYLIVTFGTTIGLILLYRAFR

SEQ ID NO: 9532 - protein, 221 aa, Actinoplanes utahensis
MPLHQDRPGDDVSDDPSGRSAVAVDHLTSKPVRTFKIKRPMAGFVPVMIAVVAAGPLHAHAGARPEANAPAIAPIPGDPGWQGVVVADVHCGDADPCRRVPTDPALADKSAFWGPDNDTRQLISQVEAALAKDLDKRTACGLDDKACAAKPPSPAGVRQALTAAGISHFEVRTGGLEAGVPEGTVLVGIPHGPGCVIVTVTGYTHDIYKNFAQPDGTCLHA

SEQ ID NO: 9533 - protein, 290 aa, Actinoplanes utahensis
MRRVPVGARRARRLIADLAVRCEPCPCSTDSPVASGLFSEGSSCLQGVALPAQMTLTQQFATEYAKGAVPGMLRAIRTIKRANNGILAGALAASYLHQGHYLVSLDAGLFAWIVPAVFDLAMLSMLTISQTAGMAADAKRAALKVLVLVVTISAAVNFAAPGPLGLRIIFSLVVGLVAGVEWVAAKIRPDFAAIEAREVEATADVRPARRLDPEVARRRAAKAAVTRRANQAAKAAEDVARSRAAKAAERARERAAKDVLEQAELAGFFAAQPYQQGSYPEVTQQVRARR

SEQ ID NO: 9534 - protein, 547 aa, Actinoplanes utahensis
MSGHVTEIVIFTVLFLLVSGIGFVAARWRAPQDMAHLDEWGLGGRSFGGWITWFLVGGDLYTAYTFVAVPALIFGAGAAGFFAVPYTVVIYPLFFLVLVRLWSVAHRHGFVTPADFVRRRYDSPTLALLIAITGIVATMPYIALQLVGIESVLKTMGVTGDSAVARHLPIIIAFAILAAYTYQSGLRAPALIAFVKDTLIYLVIIVAVLYLPYKLGGWGAIFDAADRKFQATPAPGDGILLNANNQVQYFTLALGSALALFLYPHSITGVLASRNRDVIKRNMSALPAYSFLLGLIALLGYMAIAAGVKPLPGAKAGSLDSNTVVPLLFDTKFPSWFAGVAFAAIGIGALVPAAIMSIAAANLFTRNIYKEYLKRDATPAQEANVAKITSLVVKIGAVAFIVFLDPQFSIDLQLIGGVIILQTAPSVILGLYTRWLHRGALIAGWAAGMLLAFWMLWQIPNAATGRKHFGGSAFALSEFGLDTKKTIYVGFVAVLVNLAVAVLVTFALRAAKTPEGVDGTAPGDYFADEGDPRVGQEPTPVETVSST

SEQ ID NO: 9535 - protein, 73 aa, Actinoplanes utahensis
MAELKSSPRTDSSVWNWLLLVPIVVPLLTPLFNHDSPRFAGFPLFYWLQFAFILLGVATTTLVYRMTRKRSRP

SEQ ID NO: 9536 - protein, 428 aa, Actinoplanes utahensis
MNGFIRRFVAAAAAATVVLGAAQTPAEAQASKGFVKVGYFTQWGIYGRDFQLAKVQKSGAAARLTHLNYAFGPVTADGVCASADPWADWQTPFSDATSVDGVGDVAGQPIAGNLNQLAELKKANPRLRVLISLGGWSGSAYFSDAALTDASRRKLVSSCVDLWLKGNLPDHAAGAAAGIFDGVDLDWEWPGSDGNTGNVVRPEDKRNFTLLAAEFRAQLDRLGRTNHKHYDLTAFLPAAPAKIGAGFEADKIFRYLDFGTLQGYDFHGTWESRTNQQSALRVPAGAPDNPDFSVDNALHAWVAGGAPKNRIALGLPYYSQGWTGVTGGGTGRFQPATGPAAGTFGAGTEDYKVVKTLPAKGYTVHRDLRSGDAWLFDGTTYWTYDDPAVLLQKTLYIRSRGLAGAMMWSLDGDDDNATLTKTISLGLF

SEQ ID NO: 9537 - protein, 366 aa, Actinoplanes utahensis
MSAGLRVVVEADGGSRGNPGPAGYGAVVKDAATGEVLLERYAALGTATNNVAEYSGLIAGLRAAAELNAARVDIRMDSKLVIEQMSGRWQIKNPGLRPLAAEAAQLVARFQTVSFDWIPRERNREADALANRAMDEAAGKAVPDVPAAAPQPRSWAPPELDNATRLILVRHGATAMTAQGRYSGRGDVPLTDEGEAQAMAAAGRVAGLSRDVAVVLTSPLARCGRTAELIAAEVGGVPVTVLDDLIECDFGLWEGKTFAEVQEGWPDEMTAWLSSTSVAPPGGESFQAVAKRVRGALAKIQQAYEGQVVVVVSHVTPIKLILRDALAAGDAFLHRLFLDAAGVSTMDIWPDGNIAVRSVNETAHLR

SEQ ID NO: 9538 - protein, 244 aa, Actinoplanes utahensis
MKAAPEAQRRLLDLQAVDTALAQLAHRRKNLPEIAEIEAVAREISALEDERVRAQVAVDDLDRDIARFEKDIDQVRQRKAKDQQQLDAGGSLKQVEGLQHELATLNRRQSELEDAELELMEQREAATAALADVQGRIAAAGQRRSDAERRRDEAYADIAKEQEFKAASRGPLAGDLPADLVTLYDKIRTETGMGAALVYAGRCGACRIELYGADLNRVKSAPADEVVRCEECRRIMVRTAESGL

SEQ ID NO: 9539 - protein, 108 aa, Actinoplanes utahensis
MRAAGDPERVIRTMAVCGGAGDSFLADAARAGVDAYLCADLRHHPAGEHLANDGPALLDTAHWATERPWLDDVAAWLRAQFPVEVVVSDLDTDPWTVHSASAHKEIHS

SEQ ID NO: 9540 - protein, 114 aa, Actinoplanes utahensis
MVDALDGRYPRSWAESWDRVGPVLGEYEHAVTRILCVVDCVPETVDQALAVGADLIVAHHPLLLKPVSSLAPDTFKGRIAHRLIRAEVALYTAHTNADVANPGVSDALAARLGL

SEQ ID NO: 9541 - protein, 194 aa, Actinoplanes utahensis
MTGNPSPGVLYVLVCGSPMARDVGILVGLAQRDGWEVCVITTPDGRKFVDVPALQAQTGHPVRTFYKSPGDPDVLPPADAMIVAPATVNTVNKWAAGITDTLVLGLLVEGYGYGVPTAVVPYTNKVMALHPALHESLAKLRDWGVHVLYGEDVCRLGGPGQTDRFRGQFPWRRALQAVSGPITAASRVEPGAVS

SEQ ID NO: 9542 - protein, 424 aa, Actinoplanes utahensis
MAHRRRVRRVSGGGTVDELPIGRRVAYWRGRRKMSQQVFADRLGKSKSWVDKVERGVRRLDKFSVVYDIADVLQVDVQLLLGKEVERKPETQACIDQVEVEEIRAALERYDQMSAFFQAVPQSPPLAEMHKAVSHAWLTYQHAKYGALARALPKLLRDAQAADTAHANSDQAPKAAHLLGQVYQIASSALRKVGEHELSWLAADRSIAVSQRAGDQLLAGLASYRVGSALLALGRVRPSLEVNVNIANRLACGLERADGDQLSVYGMLLLNGAMAASRIGDSATVRDLLDGADQASRQLGGDFNHYWTSFGPTNVLLHRCATAVELGDGRQAVETHEKALDMAGFNALLPERRAHHYLDIARGYTQIGDVDKAGEMLLEGDRLAPSEIRCRPLAHEILSDVLRRTRGTPPAPIAELAEQMGVGV

SEQ ID NO: 9543 - protein, 214 aa, Actinoplanes utahensis
MQWSSRQPFVPPSFLDRLDRVRLRRAAQTFAGHGWAVAPGAVLTGPRFDCGRPGCPITGCHPAVDSLAEAATTDPGRVAAWWRRRPHNVLLTTGERFDVLEVPALLGRPVADRAAGPVAVTAGGRWMFLVRPGCPLRAELDLRQDVVRHGHGSWIPAPPSRMVEGPVRWVIPPSQVDWAPGDPGRIQEMLAASAARTGWAHRVPRQLSTLRRAA

SEQ ID NO: 9544 - protein, 306 aa, Actinoplanes utahensis
MTAAGGSGRFPLGGSGPPGCRHDGGGAVNTELYIGADAEKVVVAGRPVRTRTGRARSRRTGSMVEAVPCPPSGRSREVRVTNTARLALPLLFVAAVLAAAGLTWWLPAAGGTALVVWLWRRQARAAQPVAFRRPGEGEGRVLWTEPERAAFTRAVAVAHRVRRTWPALGAMIDTRLADRSLTRALDELATLLARRQELRRVRAGLAATEDADIPADSPARIAADLQRERADELWRETGAAANRIIRAIDAAARTGESFIREQQVAATARHAERTLARVGGVPVAESGPELADRTAAVITAYRELGV

SEQ ID NO: 9545 - protein, 176 aa, Actinoplanes utahensis
MDSVDLVLRKYDGRPHRRVTGRLLGEDEHGTWIGTPRGTRVSYSYGLRRLSWTRSDSVRLIPRDTWWMAMFSAAPSRSEIYCDVITPARRTRPHEFTVIDLDIDVIRLRPDGRVVIDDEDEFAAHRIRFGYPAQVVAEATAAAATLQAALSGGAEPFATHYREWLTRAAALPRPLR

SEQ ID NO: 9546 - protein, 204 aa, Actinoplanes utahensis
MTDTALRDSPITLDRRLLLGATDYEVTVFPTDDQRLELCIVSSDGDGRVLSELSGSLTPADLPTLTEVLTSTLSGLRAMTTPPPATPPPTPPEPPAQRSRPANHGARWTTADDDRLRARYREGPTQSALAREFGRTPGGIRSRLEHLGELPPGAPWRPPRPTAPTDPLATTGISKPTPPQAQPPPAPHSGEPDPRLPTRPPTAG

SEQ ID NO: 9547 - protein, 154 aa, Actinoplanes utahensis
MPIEVGAPAPDFLLKDQNNQEVRLSAFRGRKAVLLVFYPLAFTRRCHGELTEIQAHLDDYVNERVQVLTVSVDSVYSHKVWADREGFDFPLLADFWPHGEVARRYGVLNEETGVANRGTFLIDPTGTIRFAEMTTPGETRDQHAWRTALATLGT

SEQ ID NO: 9548 - protein, 143 aa, Actinoplanes utahensis
MSATAGQADGVRSLADRFGFEPNMVVMEMGYDDDVDEELRDALTERVGDLVDEDTDEVVDAVLLWYRDGDGDLFELLTDALGPLADNGVVWLLTPKAGRDGHVEPSEISESAPTAGLQQTSTLNAGKDWTGARLVSPRGAKKK

SEQ ID NO: 9549 - protein, 467 aa, Actinoplanes utahensis
MRRERRPAVLHLGTVRLLGRPGDPDPGPDLDRDPLAGTARLLVETGLLTVDEVITRYDEIGWQVRKAAEEVLGEPKLATVGEIVASLAPRRPLRVAHAIADAAERALGPAGANRSRVFGGRLPEQAGPMTLAQAINATLTDALAARPGLLVFGPGTTRGGRHGVTAGLRDRGGDRVFDTPPDTTSVVGLALGAGLAGLLPVPELPGLGSLHSGEDQVRVEAATMSFLSSGAYRNPLVLRVPALADPYGLGGPLDNDNSLAVLRDVPGLVVAVPARAQDAAPMLRTCLAAADLDGSVCVFLEPAALYQTRDLYQQGDNEWLSPYPGPAQWAAEHAPIGRARIYTLGTAQDLTIVTYGGGVRMSLRVAARLAADGYGTRVVDLRWLSPLPVADLVRESLATGRVLIVDETRRSGGVGEGVLAALVDGSFVGSARRVAAADAPVPLGPAAQHVLVGEDAITQGAHALLAR

SEQ ID NO: 9550 - protein, 216 aa, Actinoplanes utahensis
MIGFRRVAALAPVRDADFVTTPQSLDERFRDAVSALRPPEHPHAPGDPVRDGSTLTGARALEIFDAQLTSRHLDLAARWLRSFNEGFHTVASSGHEGNAAVAAALRGDDPALPHDRAAAFYCMRAAASAPGDRTHRLEDAARDILRGVVASVRDPISGGRDKVFGNAGLHLVPVVSTPAGHLPRAVGLAYGLSRSPDPRWPADAIVAATFGDDGAS

SEQ ID NO: 9551 - protein, 134 aa, Actinoplanes utahensis
MRSEVITVRTGNAPVVVDITARAEDFVRPQGDGLLHVFVPHATAGLAIIETGAGSDDDLLTAIDELLPAEDRWRHRHGSRGHGRDHVLPAWIPPYATLPVVGGRIMLGTWQSICLVDPNGDNPERQVRFSFLAG

SEQ ID NO: 9552 - protein, 955 aa, Actinoplanes utahensis
MCRASLRRPLGVTMPTVKRQDGDLRAIRHLDRTGSDTQPRGLPVATERKRPVISDGLPSQLPDIDPSETNEWIESLDGVIDERGAKRARYVMLRLLERARERQVGVPPLTSTDYINTITPEQEPWFPGDEFVERRIRAYVRWNAAMLVHRAQRPEIGVGGHISSYASSASLYEVGMNHFFRGKDHPGGGDQIFFQGHASPGMYARAYLEGRLTTDQLDGFRQELSHPGGGLPSYPHPRLMPNFWEFPTVSMGLGPMNAIYQARYNRYLHNRGIKDTSQQHVWAFLGDGEMDEVESLGAIGLAAREELDNLTFVVNCNLQRLDGPVRGNGKVIQELESFFRGAGWNVIKVVWGREWDALLAADTDGALVNLMNVTPDGDYQTYKGESGAYVREHFFGRDPRTRKLVEHMTDDEVWNLKRGGHDYRKLYAAYKAATEHTGQPTVILAKTIKGWTLGSHFEARNATHQMKKLTLEDLKGFRDRLYLDISDKQLEENPYLPPYYHPGEKSDEYQYMQQRRRDLGGYVPSRRTRAKSLAIPDSKAFSDIKRGSGKQKVATTMAFVRLLKDLMKDKEFGARWVPIIPDEARTFGMDSLFPTKKIYSPHGQTYTSVDRELFLSYKEATNGQILHEGINEAGSTASFIAAGTSYATHDEPMIPLYIFYSMFGFQRTADELWAAADQMARGFLLGATAGRTTLNGEGLQHEDGHSLLIAATNPAVVAYDPAFAFEIAHIVENGLHRMYGEKQENIFYYLTIYNEPAIQPAEPANVDAEGILKGIYRYAEGPSTNGPKAQLLASGTGMRWALKAQELLAQDWGVSADVWSVTSWGELRRDAIAAEEHNLMHPSDQPRKPYIQQKLEGTEGPSVAVSDWMRAVPDLIARWVPNGYTSLGTDGFGMSDTRHALRRHFHVDGESVAVATLRELALRGKVPAHVPGEAAKKYAIDDVNAAPVGETGGDS

SEQ ID NO: 9553 - protein, 470 aa, Actinoplanes utahensis
MTVRVRFAPSPTGMFHVGGARSALQNWIYAQQHGGVFVLRIEDTDAARNKPEWTEGIISALDWIGIERGTYEGPYYQSSYAADHTAAATRLYGEGKAYYCDCKREDVIARTGNTHTGYDGFCRDRALGPGEGRALRFRTPDEGETVVVDLVRGKPTFENKLIEDFVIARSDGSAVFLLANVVDDMSMGITHVFRAEEHLPNTPKQQLLWEALGRTPPVWGHVPVIVNEKRQKLSKRRDKVALESYRDEGYLAAAMRNYLMLLGWSPTGDREIVPWSVVEEEYRIEDVNHAPAFFDVKKLRAFNGEYIRALTPSEFTQCCAPWLTGTETIPAPPWSPEKFDAEVFTTIAPLAQTRIAVLSEIVENVDFLFLDEPVADEASWAKAMKDGAADILDGAAEAFTALPEWTAESLKAALERVGEARGLKLGKTQAPVRVAVTGRTVGLPLFESIELLGRERTLARITAARARLSA

SEQ ID NO: 9554 - protein, 238 aa, Actinoplanes utahensis
MVVRQAMKRVAAGAGGLAIAAAVTLGVTPGVAFATPRAQAGTATTVVTGSSSKPAPQPDSLLITGDQVPSEGIKVLQSEDPKLFRMMLSEVSWLSSATPTATEPQKGKLGPKYTVKVFIKEDASELYDLYPLATGGPRAHRPTGAPNGKKADGWFYGRQSMSESLRLSGVPLKAKPDVVNGGIGGGIGENLNSSELDPVSGAGHLFGQMRRLLLLNGAVLLVILTGLAGMAFVIRRRI

SEQ ID NO: 9555 - protein, 189 aa, Actinoplanes utahensis
MDDKRRLILDQALALVDERGLAAMSMRAVAERVGLTSMALYPYVGGKDALLDGLVDLLHLELGTTLGDDLAEIGWQARLRALGRAVRSLAHAHPSAFPLLLNRSAAGASASWLTAALRGLLHDAGVPAAEVPRLARMICAFLLGYTTGEVTGGLPTVTPDPGAGEFDADLEDLVALIERVADHHAGDRR

SEQ ID NO: 9556 - protein, 402 aa, Actinoplanes utahensis
MAESRIAEPAPEAPANPLQPATLRRIERHAGALASSAVARMEETLPWFRALPADQRSWVMLVAQAGVRSLVEWLRSGATVAASTQEISDEVFAAAPRALARAITLTQTVQLIKVTIDVAEAEVPGFAAKGEGDLLLQAILRFSREIAFSAARVYARAAESRGAWDARLQAMLVDALLRGDSSDVLASRAAALGWVDSPPVAVVVGRSPGGDITAVLHALYRAARRSRLEVIGGLHGDRLVAVVGGATDPVLTAASLRSGFGDGPIVAGPGVPTLEQATESARAALAGFRAAPAWPGAPSPVAADALLPERALAGDLDARRKLRNDVYGPLSRAGSGLLETLDAFFAAGGVLESAARELYVHPNTVRYRLRRVAEVTTLSPLDGRDAFALRMALSIGRLDPAT

SEQ ID NO: 9557 - protein, 309 aa, Actinoplanes utahensis
MLAVLSPGQGSQKPGFLAPWLDLPGARDSLTTWSALAGVDLVHLGTEAGAEEIKDTARTQPLLVAAALLATAQLPLEQVAVVAGHSVGELGAAAAAGVLTPADAVTLAGVRGREMAAACALEPTGMSAVLGGDPDEVLATIEKHGLHAANRNGAGQVVAAGAQEALAEFAAAPPAKARVIALAVAGAFHTPYMAPAETALAEVASGTAVTDPARTLLSNLDGTAVASGREMLDRLVRQITAGVRWDLCMRTLRDLGVTAVLELPPAGTLAGLVKRELKGDGAPEIVTLNTPDDLPAARDLIARHATPQH

SEQ ID NO: 9558 - protein, 316 aa, Actinoplanes utahensis
MTAGSRIVAMGHYQPSRVVTNDDLTKTLDTNDEWIRDRVGIAERRIADTETVADMAGFAAEKALAASGLSAADIDLVVVATCSSIDRCPNVATRVANRLGIAAPAAYDLNTACSGFSYALGSADHAIRAGAARNAIVIGAEKLSDVTDWSDRKTAVLFGDAAGAAVVTGVPDGEEPGVGPVLWGSAPDKGDVLRIEGWRPYIEQEGQIVFRWATTALAPFAIEACRRAGVDPSELAAFVPHQANTRIIDGIVKRLGLSDTAIVAKDLVESGNTSAASVPLALSKLIERREIPSGAPVLLFGFGGGLTYAGQVVRCP

SEQ ID NO: 9559 - protein, 80 aa, Actinoplanes utahensis
MATREEITSGLAEILEEVAGVNPDDVAEGKSFTDDLDVDSLSMVEVVVAAEEKFGVKIPDNEVQNLKTVGDAVSYIEANA

SEQ ID NO: 9560 - protein, 408 aa, Actinoplanes utahensis
MSTVDVVVTGLGATTPLGGDVASTWDAMLAGRSGVGPLTQEWAGQLPVRIGAQLAVDPSEVIERVRMRRLDRSEAIAIIAAKQAWADSGLDGSGLDPERLAVSFGSGIGGAVSLLDQDDILEQSGPRRVSPHTVPMLMPNGPAAYVGLELGARAGVRAMASACATGAEAVALGLDLIRAGRADVVVAGSTEAVVHPLPIAGFASMRAMSTRNDDPQRASRPWDKGRDGFVLGEGAGALILERADHAVARGARIYARLAGAGITSDGYDIVQPDPECAGGIRAMSMAVRDAGLTGADIVHVNAHATSTPVGDMGEIKGIKAALGTHPVITSTKSMTGHLLGAAGALESIATILAIRDSVVPPTINLDDPDDRLDLDVAAHKARPLDIPAAMNNSFGFGGHNVALIFTRP

SEQ ID NO: 9561 - protein, 426 aa, Actinoplanes utahensis
MDRDPESRLRALFDHHTLRPLAVPDDSGVLPARGTVDGTPAIAFATDPGRMGGAIGVHGSRRIVEAIDLAVRERVPVIGVWHSGGARLDEGMVALDAAGQVVAATVRAAGRIPRISLLLGPALGSTAYVPALTDVVIAGPEADGSPAGNRLTGGSAVAGAAAFGRVAHVISDDDEAAVGAARRTVRMLGHPGRLSPADVKPGSTLGRSLDSLLPAGIRGYDVRPLIRALLDEPGLELQETWAPNVVTALGRFAGRTIGVVATNPGHLDGRLDEAAADKTARFVRMCDARALPLLVVVDTPGHLPGPELVISGARLLHAFAGAVVPRVTLLTRRAYGGAYLALNSRALGATAVFAWPDTELAVHDPVEAVPIRHHRRLAATAPEERGALQERLAREQAETAAATVDAVITPAETRRRIAEAFAAAPL

SEQ ID NO: 9562 - protein, 580 aa, Actinoplanes utahensis
MAVVRKLSCVAFVAPLLLLIGACGDDAKPPPAAPPTTDPVGSVLSVPLSESASAPPGDPAVRAAATVARLSDEDLAGQVLMPYAYGGSANRVDAGAVAGNRKLAGVDTPAEMIAKYRLGGLILVSFTQQDPTGRTNPTSNVENPQQVRALTDGLQVAARQLPAAAPLMIGTDQEYGVVTRITDGVTVLPSALAAGAAGQPALTEAAWHAAGEELAAMGVTVDFAPVADTLGPAGSAVIGSRSFGTDPAANAAQVAAAVRGLQGAGVAAALKHFPGHGHTSGDSHEELPVIRQSLAAWQAQDLPPFQAGVQAGAGVVMSGHLDLQAVDKGVPATFSHKIMTDVLRGRLQFTGVAITDAMNMAPARKWAPGEAAVRALNAGNDMLLMPPDIGAARDGILAGLRSGTLPRQRLTEAVTRILTLKFRTAATAPPALAAIGTPAHQQAVAALDAAAVTVLRGRCSGPLVTGPVTVTAPASRETARVNLVHALQDAGVVVQAAGGAEIRLVGYGDQPVDLSPDAALTVITDLPGLLAYAKSPTLLATYSSSRLSMVALAAVIAGKTTAPGRSPIAVAGLPRSACGR

SEQ ID NO: 9563 - protein, 163 aa, Actinoplanes utahensis
MPTCGVVYVHSTPLAVCQHVEWAIARVLTAPVNLHWTVQPVDPSMRRAECSWTGRAGTGAELAAALRQWPMIRFEVTEEPSPGLDGERFMHVPGRGLFHGTMGASGDIQVGEDRLRAIMASARAPEALAHALEKALGSAWDAELEPFRYAGDGAPVTLLTRVG

SEQ ID NO: 9564 - protein, 108 aa, Actinoplanes utahensis
MASNTSKTARASVRAGQGTGGALSVLGEYKYLIPLANGRFAYVRNLTNGKTSHLKTDSDAFVEEIRVLSAAGHGAKIRAELNALHTSSPADGWDATEKRLADAGVFEG

SEQ ID NO: 9565 - protein, 200 aa, Actinoplanes utahensis
MTATLPAPVTPAAALDELLAGNKRFVSGTPLAGHDVAQAVALAGGQQPHSIVLGCIDSRVPLEAVFDQAFGSILVARSGAHVLDRSVAGSVEFSVGALGASLVLVLGHTNCGAVQATLDAERSGDRPAGDVGYLVSEIAAATEGIDLAAPDAAGLVLRAHVRRTVERLRTADSLAPAIAEGRVDVVGGVYDLATGTVIIL

SEQ ID NO: 9566 - protein, 329 aa, Actinoplanes utahensis
MITTRGYDGAVRHAEVPMSERIEVRLADGVRLHAEVSGPERAPVTVVLLHGWCLDRRTWRHQVDALSGLGRRAPRVIAYDTRGHGRSSATHRRSATLDQLGDDLAEVLRRLAPRGPVVLAGHSMGGMTIMEFAHRHPAEFAGRVAGLLLVSTTAEGHTHTRYGLPGSVAGVLRVGETLGAGVLARSGAWRPHRAVLPALAPALRWLLFGDRCADEDLGLTLRGVGRASLCSIGGFRASVGAQQRLDTLHAFAGVPAAVLVGDRDRLTPPACAESIAAALPAAEFTVCPGAGHMLPLERPEEVSAALLKVVRRAGRATRRTAAGHLGRAA

SEQ ID NO: 9567 - protein, 714 aa, Actinoplanes utahensis
MKGRTTDLSDATVLQLQIAVEQQHVDRVYARLAELRRDASRAEKEGYQLAGVGTFGALVERDAMVFHAARRRHALDTEYEGLVFGRLDQKDGATHYVGRMGIRDEDSKPLVVDWRAPAAAAFYRATPAEPLGVIRRRMIQSSRERVTGIEDDLLDPESAPPGMTVVGDGALLASLAKATGRGMRDIVATIQREQDEAIRSPASGVTIVTGGPGTGKTAVALHRAAYLLYSDRSRFAGGGILVIGPSGVFVEYIATVLPSLGEDTATLRSLGSLVPGWDATRVDSGPVAAIKGSLRMRRVLERASHDAVPGGPAELRLLYRGTLLRLGAAELDQIRRRVLQRGARRNEVRGQGFDRVFDALWAQAREQRVTGLPEKREFEAELADRTDFREFLKAWWPRFTPMRVLRWLADPARLRSYANNLLSREEIAVLQGSFDGLAEFGPTIADVALLDELDELLGRPRQPQKKTKNPFHVRDGIQEVSTFADRQAAARAQQVQREEDYRDYAHVVVDESQDVSPMQWRMIGRRGQYASWTIVGDPAQTAWAGDPDELDRSREKALGSRKRNSYALTTNYRNSSEIFAVAAGVIRAILPDLPLPSAVRSTGVDPVDVVTAPAGLPGAVRELAEKQLADVDGTIGVIAPVPRRDEVAGWVTGLPERVQVVTALEAKGMEYDAVVLVEPGQIAIDRAGVRTLYVALSRATQRLTTVGTDPAWHP

SEQ ID NO: 9568 - protein, 363 aa, Actinoplanes utahensis
MAGASRGAAARPARVGPRGRGTHRTRPGSLKRHFCSFCDPPRRMRKKMRMRIMSDGRVMVFAPAPQLTVTIEQHHDEPELHVHPGGQGIWQTRMITSLGAQVTLCTAAGGEVGRVLAPLMAELPGVTMRLVGREHGTGWYVHDRRSGSRQEIAERPGVPLSRHELDELYNLTLAEGLRAGIAILSGPAHPSVIKPEVYGRLAADLRSNGCRVIADLCGRYLEEVLAAGLNVVKISHEELIKDGLAADGSTRELMNALMKINTDGAEAVLVSRADEGALALIDDEIYAVTLPRLTAAEHRGAGDSMTAGVAATLASGGTLTDAVRTGAAAGALNVTRHGLGTGHVDAVRVLTERVRLTPIKKAS

SEQ ID NO: 9569 - protein, 283 aa, Actinoplanes utahensis
MTLRQPRILITNDDGIEAPGIRWLARAVAHAGYEAVVAAPLSESSGSSASMTAVVQDGKIVSEPRELVGGKNIPAYGVAASPAYIVLLALREAFGPAPELVLSGINRGANAGAAVVHSGTVGATLTASHAGLRGLAVSLDVLTPAQATAASGGAAIDAIHKADEEQHHWASGAELAVRMLPALLHTPPGTVFNLNVPDLHVDGIRGLKQAALARFGQVQMSIAEAGDGFVRTAVQAAEEELDAGTDLAALADNFAVVTPLRAPHEDTTIRINVDGIRIQTPAI

SEQ ID NO: 9570 - protein, 116 aa, Actinoplanes utahensis
MTLSITTSTLADGAVEVSPRGEIDVENAYEIREAVAAQLADGSPARIELNMQHVTFIDSVGISALVAAFQLAGVGGVKVVVTHPSRFAHRQLWVTGLLGLFGNPAPHEDDAALSGA

SEQ ID NO: 9571 - protein, 136 aa, Actinoplanes utahensis
MFATRKNRAERTAGQAWEYLSAAVASAGETAKDQAGEARKAARQGRKAAAGKAAKVNKQGHRVADEARSRATAAANALAGRKPGRPWGLLAAIGLLGLAAGWAAATTTRAALEREAENEQLELAETAVVVTPTADK

SEQ ID NO: 9572 - protein, 136 aa, Actinoplanes utahensis
MAEPQFFPDAAALRGWFEEHHEAAPEVFVGYWQKGAGESGVSHRVRCQPPRDDRAGPHRRLLIRADRPGGVRRHPDPLIQATPAAGEWFRAQSAAYGRSATRRVLGARRADTRERRLAQLIEDAAAGRRVPPLASR

SEQ ID NO: 9573 - protein, 466 aa, Actinoplanes utahensis
MLSAGHILDNRYRLDERIATGGMGDVWRGTDKVLGRVVAVKVLRTAMLDDPEFAARFYGEARMMAAFRHPGVVEVYDYAEAGDSGGSETVAYLVMAFVEGEPLSVRVKQGPIPVAETLSIVAQAADALHAAHEVGIVHRDIKPGNLIVKPTGAVILIDFGVARSNAMTSMTGLNAIVGTALYMAPEQVAKGNLTPGTDVYALGAVAYHCIAGRPPFDGDNALQVALRHLEDEPDPLPDHVPFEVRELIARAMAKQPADRFATAAEFAEAAYAAVGTPQDWKRLTGTAMIAPRSPIPVSPPPAAPTYAMTRPRMSPAPPPMPAPEPVASGWHTQRGLMVAVIALFVLAGGLGVAFALSGNGEKADANTGGKKDQKPGISQTVEQPFDQVTNGPSAAEPTHKPSARHTKAPVSSTSVSAPASSAPASAGPTSAPPSSKPPVSSPPPDDPTTTTPTATTTTTGPAAGSQ

SEQ ID NO: 9574 - protein, 285 aa, Actinoplanes utahensis
MLSIGDFAGLGRVSVRMLRHYDAIGLLPPARVDPHSGYRFYTAEQLLRLNRILALKDLGFSLQQVQSMIEEKVDVGELRGMLRLRRAELAAQLERDNARLALVDARLRMVESEGHMDTTDVILKQVPALRVAALSATALGYDHPSSISENLSPLYPRLLQLMEQAGVAMTGSPIAYYRPAPTGPEDETITVHAAFPIGDAEVGAAGFDVVTLPPVRVAAAVHRGPMAEAFRTGGRIAAWIEDNGFRPVPPGYAREVYLHCPPELAEWLTEMQVPLDGTGNATEGN

SEQ ID NO: 9575 - protein, 210 aa, Actinoplanes utahensis
MTIQTSHHDHLVSPPWANENAVEAAETVEFVVPPFGGTVPPYGSPENKHGALLVRFPHAVLGEARPEAPSWRPVVAWTFLLSVLGVVSAMRRAGRARAYGRPRAPYWIAFLLTAAAGAAFWSVLVADVAVPAYRHHVEDRATAAVQAKVLGDGRVEAAVGTTVKSGGCVPDGDRGADSLRVYVCSFQLTDGRSASMRITADIRGNWTFRK

SEQ ID NO: 9576 - protein, 601 aa, Actinoplanes utahensis
MTLPNGVSRRGVLAVSAAAAAAPLALTGPAQAHGKGHDPKPPKAPETFHLTVLGTSDLHGNVYNWDYYKDAEYDDAAHNDVGIAKAAALINKLRAEAAGATLVLDAGDTIQGTPLATYYAKQEPITETGERHPMAKSMNVLHYDAVTLGNHEFNYGLPLLNLWIRQLGFPALAANAVSAKTGRPAFTPYIIKKVSLGKHAPTLRVGILGLTNPGVAIWDKGNVEGKLKFLGMVETAAKWVPIIRHRGADIVIVVAHGGDSGTSSYGPELPNENPVQLIAQQVPGIDAILFGHAHLEIAQRFVTNTATGAQVLTSEPSKWGQRLTRMDFELVREHGCWKITSKASATLNTNTVEADPKVLAVVKSQHAKTVAYVNQIVAASTAELSAATSRYEDTAILDYINKVQTDEVTKALAGTSYANLPVLSIAAPFSRTAVFPKGDVKIKDLAGLYIYDNTLEAVVLTGAEVKAYLEYSAKFFKTLAVGAPVDPATISDSTIPDYNYDILSGVDYDIDISKPIGSRITRLQIAGVDVAADAQFVVAVNNYRRSGGGNFPGIVKTQVYNEQKEIRQLLIDWAQAKGKIDPADFFVKNWQLVREGVPVTF

SEQ ID NO: 9577 - protein, 547 aa, Actinoplanes utahensis
MNLESLLHDRLAPALAAVAGHPVDPAVRASPHADFQSGAPLALARELGRAPRDIAADVAARADLDGVARIAVSGPGFLNLTVSDSLLTDALQTVGADARLGVPPAAAPVRVVVDYSGPNVAKEMHVGHLRSTIIGDALARMLQWLGHDVVRVNHLGDWGTPFGMLVEHLVDRGGAADHSIGDLTAFYQSARVKFDTDDDFRTRARRRVVALQTGDPLSRDLWRTLVAQSERYFLDVYARLGITLGPDDFAGESRYQGDLDDVVAELEVKGLLAESDGALCAFPAGFTGRDGDPLPLIVRKADGGYGYAATDLAAIRYRAGKLGARRMLYVVGAPQRTHFEMVFAVATAAGWLPAGVTAEHIGFGSILGPDGKMLKTRVGDTVKLAALLDEAESRASTPAVGIGAIKYADLSGDRRGDYVLDFDRMLAITGNTGPYLQMAYARVCSIFRKTTGTPGPVAVTEPAERALAMALLGFAPAVTAAAEQAEPHRLAVYLHDLAAAFSVFYERCPVLRAPDGLRAGRLGLADLTARTLRTGLFLLGIETPEEI

SEQ ID NO: 9578 - protein, 224 aa, Actinoplanes utahensis
MQERFEIQGQHPISSYGRSGSTGEPLRNRRDRPAGGRHKSAAAVETAASRADGAEHAATITRRGRLGRPGSVPAMSGTTGWDQDAAGVLRLPSGRLVRGRGLRRAMPTGHPPQFGVYLLGSPPPEFGWTTRWIRWPDFWLPSDRSEARATLREALDRAAGERVEVACFGGVGRTGTALACLAVLDGVPATEAVAYVRAHYHHQAVETPWQRRFVARFATVAPRP

SEQ ID NO: 9579 - protein, 135 aa, Actinoplanes utahensis
MTTGGLQAWLVPVFVTAAIVLIVLIDAGVSWYTHRDKPPAEPVSPPTADRRLQTVGLGLLVLLAIAVVVMAGLGPNRADQFASVIAALLGAVSAVLAFFSYRDNLEFLRANRDREAAATGTPDPAPPQPDGSSPD

SEQ ID NO: 9580 - protein, 412 aa, Actinoplanes utahensis
MPRTPGTPRWRTSSNLNHMTDLYSRRSFIAGVLTAGMLSTAAGYLFTRRVPVTLTLVTGTDDTGGRTLLIKLWNTFHPDVTVEVVPVGNSTQDQYEKFVSTKADIYNLDIIHIPRFSGSGRITPIDAPDGITLLPPVRRTCEIEGSTRLWAVPFNTDVGMLYRRIAAKGARDLEPGLDAVIAGTRLFTGQLSTEGTFTDEAFVVNVLEQALAQDPTILDDRGTVSFNLGQWQKALAPLAAAIYSRRVVVTAGETQTNEAFQRQGLRYMRNWPVYFPAIDRAEREKPGTAAIRLGALPIGILGGQALAVAEDTRHRAEAEAVIQFLTGMPAQKLLATYGFAPTSVEAYNDPELAATVPHLGKVRSAVERAHPRPMSAGYAAFSGIVRQHVYNYLYNRIQLGENFVQSMQEALR

SEQ ID NO: 9581 - protein, 414 aa, Actinoplanes utahensis
MSDYYFFLSYARGDDWESVKQFFNDLSAEVRSYAGLPTSRNVGFLDVEMQVGEAWARTLVTALGNCRSFVALITPRYLQSEPCGREWTVFTERLTLLELDVPVLDPPPLIPLLWLPPPKLPPAIAARQYLNHRLPEAYAALGLRQIIRLQRYRDDYIEMVARLAQQIVAAYDVDPALPKNPATVPFEEIPSAFHTAGMTPPATGGPAHQVEFVIAAPSRADLSDHHHPDLPGVARDPRFYGEAPESWAPYRPALESSLADRARSVALNHRFQALVTDLDKLRRLGRDDDAVRLVVLLVDLWVTGLARHREALARFAAGGRDTTAAAVLVPAGQDDEQTLTHLHQLKATLSRVFGRRMNTRMDPPEFRSEIPSPAVFDAELGGILERSRNRMFRTDPVHRRPPGPSGQRPILRGP

SEQ ID NO: 9582 - protein, 1309 aa, Actinoplanes utahensis
MTSSSHGREPGQIVTFYSFKGGTGRTMAVANVAWILAANGLRVLAVDWDLESPGLHHYFRPFLADKKLRHSRGVIDMIRDFAAAAVDPTADPAEPEWYRRYADVEREAVSLTWRFPGAGRIDMLPAGQQNPAYSGTVSTFDWAAFYDRLGGEAFLHALRENMAQMYDYVLIDSRTGLSDSAGMCTVNLPDTVVNCFTLNEQSIDGAAAVAESIVRLSTRRPVRILPVPMRVEDAELFKLETGRDHARQRFEPYLRLDPDAATSYWGDVEIPYKPFFAYEEILATFGERARQEHSLLSSFERLTSIITAGAVTELPPMEERERRRWLAGFERQKPSINPNTVISYVSVDRTWADWIAGELEQIGQSVTLQEVELTDPAAGPGHDPRPAARLLVLLSHDYLLTPQSAALWQQAADRDLAAGDLVRIRIDNSRLPVSFARPQVREVDLFGLTEEQARPALLGAFDQPHLEPGAAGVRAGAQSGSRFPADTPPVWNPPQRNPTFTGRTRLLEELRDRLPISVTATAPQALYGLGGAGKTQIALEFVHRFAANYDIVWWIPAEQPALVRASLAELAEALDLPTASSTAEAVDAVLDALRRGEPYRRWLLVLDNADQPEEIRRYLPAGPGHILITTRNVAWGRYVSATEVPVFSRVESVGLIRRLVPAMSEADAEMIAAKLGDLPLVIEQAAAWLAATGMPAGAYSALLDTELPRMLRENPPPGYEHTPAGTWRLSLERIRADLPAAARLLEVCAFFAPEPIPMRLLYSGRFIELLQPLDPTLQDPLLIGRLVQEIGRYALARFDAGRNTIAMHRLVQTFIRSEMSPEDREQTGRDVHRILAATNPKEPDDPETWPDYRLIRPHMEATGVLSSPVAPVRQLVIDMVRYLWRIGDLQESQELGERALAAWRAAGGEDDLTTLWLRLHLANPIRSQARLAEALAIDEDVHRSLLSTVGPEHPYLVMSLSGRAADLKGLGRYPESLALDREALALATRTLGENAARTIFAMNNLGLSLRFNGDFRESAKMAERSYVLARQLGESRPYTLAMAANLGRSYRDLGQFAEAQRVLTRVLIKSTEVHGAGHAQTLAIVRILAVTLRKLGDLDQAEALTRDVRPKLERRLGRSHPETLACLNDLANLQSALGDDRTALLTAETALRHYESRLGVDHPSTLACRNNVAIFQRRLGDHAGAREISERVIARFRALLGPDHPYTLACLVNRGNELFDGGDLDGARDNDQDVCDRLTEALGEEHPDTIAARSNLAITLAARGDQETARELTRRVLAQSVRVLGAEHPNTTAIREGRRLNCDIDPPQM

SEQ ID NO: 9583 - protein, 387 aa, Actinoplanes utahensis
MVAAGPVRPFRQVLLKLHSRCNLACDYCYVYEHADQSWRTRPRVMSPEVIAAAAARVAEHARAWGIDSLAVVLHGGEPLLAGAAAIGTVTGAIREALGSTAAARFTVQTNGILLDEPMLEALLRHDVRVGVSVDGGRAAHDRHRRYAHGAGSHDDVVAGLDRLRGERYRHLYRGLLCTIDVRNDPVEVYEALLALGPPTMDLLLPHGNWTSPPPFRVPGDPATPYGDWLVAVFDRWYSAAPETDIRLFSSIITLLLGGASGYEATGLDPVDYVTIETDGAIEQSDALKTTADRAAATGLNVFDHTLDEALAHPGVRARQSGLASLAETCRRCPAVAVCGGGHYAHRFRAPADFANPTVYCADQRRLIDHIRDRVFADLRRALPAEVG

SEQ ID NO: 9584 - protein, 56 aa, Actinoplanes utahensis
MAMKPAVQPDDDPYVITNSTRKLVDRSKVDSRVLLALLDRADDPEPTTTYFTNFVS

SEQ ID NO: 9585 - protein, 1331 aa, Actinoplanes utahensis
MADVRSRGKPCGPAQRAHELAVIMEFSGRHGQIITFYSFKGGVGRTMSLANVAWILASTGRRVLTVDWDLESPGLHRYYSPFLPDRDLRQSPGVIDAVVRFEERAGEAQANGEELGPGEIRRLARIQEYATSLERYEFPRGGSIDFVPSGRQTPEYSHVVSNFDWETFYTRLNGERFLFDLADDMRANYDVVLIDSRTGLSDNAGICTVTLPDTVVNCFAYNNQSIEGAVAVANTIRRLRPDDIRIFPVPSRVEDGEAAKLNRRRALAQQQFREFVAALGHADPGKYWGQVEQPYKPFYAYEETLATFGDRPYQENDLLAAYERLAGELVGERCKLDEISEAIRLGWLAEFEQRGTINPGPALICYTPRDRIWAEWIAYQLRLAGQRSVLQDVNAAVDATEVLARSDCAIVLLSQESVRVPQLETWWRLTVRRDIPGHGRFLVPVRVDGFRPPEPFADREPVDMFNVPERAARDSLLARLDLRDTGSGHIGGLAGGPTPRFPFEPARVWRAPARNPGFTGRDATLEALREQLNASNAQTGPVVLQGIGGVGKTQIAVEYVHRFNADYDIVWWISADQPALVVTALADLARELGLPIAGSGRADEEVAAVLEALRVGNPSANWIVIFDNTEDPEQIRRFLPTGSGDVVVTTPGQEWSRTAWTLDINVFDRSESRALLTRRVAGLSDAQADEIAAKLGDLPLAVEQAATWLATTGMSAERYLALLDEQLPRILNEPPPPGYRHPAAETWRLSQGRLQQANPAAAFLVELLAVMAPEPIPTTLLDSPGMADALARYDPIFRDQLMRNSLVREVSRFGLARVDSAVHALRMHRLVQSVIISDLAVEEQRRRREQIHVILAKAQRGEPDDQASWPTYQGILTHLEPSGALDSDDAEVHQLAVDMVRYLRYRGDLAGGRRLAERAIGIWQDRLGADHLSLLRMRSELGNILEAHGEYRAALDIQQDTADRMIAQRGHTYPHALIALSGVAAAYVGLGQYQQAVDLAEQVLLHWQTTVGDSHRRTVIARNNYAFFLMLAGDFARSREISEQAVVASEDVLGPSARWTLLIRRNLGRCLRADGDLGRSENVLRETLAGCQNALDEADEYTLLTRKELAVTLRRLGHLAEARELAERAVAGFGATVGAEHPHTLACRLEVANIRAAQSEHAEARAEAAEVLAGYSRIRGESHPATLTVANTFGVLECLDGEVADARTRLEQTFTALEATLPESHPYVWIGRMNLASALFQAGEVQAAREADTVSLARLRERLHSRSHPAILTAGVNLVASRLAAGDRTGGEAQREEVLRIAGELFDEKHPLMVALRSGGRAFFDLEPLST

SEQ ID NO: 9586 - protein, 390 aa, Actinoplanes utahensis
MLYFFLSYASDEDDIFVRRLYRDLSAEIARRIGAEPQQVIGYLDDSGNGRWPADARSALGTCQTFIALCSSRYLASDRCGRYWGTFVDRIRKDDSAAASGALIPVLWSADGVSGDVFHEPGLDVQPHRTPHGDDLRVMMRLRSHRAGYAAFVASLAHRVVETAHAHRLPDGPAGVDLDAAVNPFDERRHRPGAGPPSTKVYVVVAAGTREQMRAVRDDLRFYGRRREDWSPYQPMTPQSLAARACGVVSDRRLQSEVVPIESVPERLRKGLQRDILVLLVDAWATRVEDLHRALREIGERDDEAVAVLVPASPGDGETSARRGELRGEVLRSFPGRASWHDSLFRVGVDSPDEFDADLATAIAAAQRRAYRRERPGGSRPGPRRPVLEGP

SEQ ID NO: 9587 - protein, 392 aa, Actinoplanes utahensis
MSRPAGFAPAPVRQVLLKIHSRCNLACDYCYVYQHVDQSWRDRPRVMSRADIDLAVARIAEHAGKHDLPYLAVILHGGEPLLAGPDVIDYIVRAVRGAITSHTKVAFGVQTNGLLLDDAYLELFATHRIRVGVSLDGPATANDRHRRFPNGRGSHAGVARALRRLNEARHRPLFGGILCTVDVTNDPLDVYHHLLAFDPPELDFLLPHGNWDRPPPERGPDPGRTPYADWLIPIFDRWYESPAPQTRVRLFESLVSLLLGGPGGIEGLGLGRVDLVTVETDGTLEQGDALKTAAPGAPATGLHVRWHSFDDYLEHPGARARQSGVDGLSATCRRCPLVEVCGGGLYAHRYSSLTGFDNPSVYCADLATLIRHAADRLATDLPPAAGGPGVRS

SEQ ID NO: 9588 - protein, 59 aa, Actinoplanes utahensis
MARESETSIALLRSAAPDQARLALLLRRRPALRHSLDESRHAGVFGNFIGGHCSDEAPR

SEQ ID NO: 9589 - protein, 277 aa, Actinoplanes utahensis
MDFADRGSLAEDLRGLGLRAGESVLLHSSLRSVGWVCGGAVTVVQAFLDVLGPAGTLVTPAFASENRDPARWAGPEIPAAWWPRIRETMPAYDAQRTPCRALGIVAETLRCWPGAVRSPHPQTSFAAVGARAAALMRRHDLVSELGEESPLAALEAAGARVVLLGVGFDRCTAFHLAEYRLPWRTPRDNACVMSTPAGRAWVPYRGVLLDAGDFAALGADFERTGAVTTGPAGAAVARLFPLPAAVAFARDWLAAHRVPPAGPPEPGDSVRSRRHCT

SEQ ID NO: 9590 - protein, 418 aa, Actinoplanes utahensis
MCAACGQTAHVPDTPRRFAALRNPDCRPYLFGAALAMMADNIEHVITYWVLWEKFHSSALAGFQVISHWVPFLFLSVWFGSLADRYDCRRVIQVAQTLFMLVSAAWGVLFLTGTLQVWHACVLLVLHGVAGALWGPGEQLMLHDFVGDDELPSAVRLNATFRSLGVLFGPAVGSALLLGLGPTWGIFANIAFYLPLTLFLFRTRFTGHSRDGGVPAGRKRVGIMDSVRVLRHVRADRTLVSMIILGGLGSFFVGASLQSAMPLFAQDLGSGSAGTAYGVLLFANGAGGVLGGLVLETTGWIRPTVFAAVLSTGLYGLFTFCFAITPNYPLAVVLLVAGGVANLASMSVGQTVVQLMAPPADRGRVIGVYGMSANGLRFGSGITVGLFGAVVGIHWSLGLSAATLCVGTLIAASYARRT

SEQ ID NO: 9591 - protein, 290 aa, Actinoplanes utahensis
MNGGHVQRRWHLVVLAVLGVLALACEGGAGSDPAPKPTATRKPRPGGGPASMAALGDSITAGVGSCVTYLACSHNSWSTGDNDGVDSHYRRILAKNPGIKGNEHNFAEPGAEADALVTQARRAVDAKAQYVTILIGANDACAGSVADMTPVATFRNEVDRGLAELKKGLPRADLLMVSIPDLYRLWQVGRNDDDAVRVWRTGGVCPSMLADPTSTASADERRRRAVRDRIDAYDEVLHRSCAGYGSRCRWDGGRVHGLRFSLDLVNRFDYFHPNLKGQNELADVTFAARN

SEQ ID NO: 9592 - protein, 445 aa, Actinoplanes utahensis
MDLDEMTTELGRLKPRRPSAHLAITLIWAAQRADRDEPRQSRWSDARSTLQDAVAKVSGHAAADQAASPVVALRGSPLWSMDVDAGAPPLANRDAAGWLDRADPLVGLSPAAYSTLRGGGFEEFALAAVGKLDTGTAHSVLSYFNVERLPFQGFGDVPGIDVGATFKDRADLFAHRVHRELQAGIAGSASRGAESIVLSGGYTDRDFGDVIIYTGHGGRDPRTKRQIADQDPKARGNAALIVSHLTNAPVRVIRGAHRGSPHAPAVGLRYDGLFLVESFWQEPDDNGFRLCRYRLVGFRPSAVVATAETHTTPSTPLPSGSTNPGRRATTSERIIRNVALANATKALHNHTCQVCDTRLLIQGRGYAEGAHIRPLGEPHNGNDTPDNMLCLCPNCHVLFDNGAITIDADLTIRSDQPHRGILRRAEGHDINPAFLAYHREIYPGN

SEQ ID NO: 9593 - protein, 271 aa, Actinoplanes utahensis
MWKDGTIARRTTLPATDAEIVDMTRDGTGVATGYLQNHQASFGYADGRFTRLRGSGVGAIAINEAGVIVGGRGGSPGGVPVRWASASAAPVRLPLPAGATEGSASNIAEDGTILGSVGRAGKSATAYLWFPGGTGRYLPLSTVDGGRRATSFAPSAISNGWVTGNAVVETEQSTASTPMRYRITTGEFQRLPADLWSAEKIAADGWVAAEGLDLSVTGDAGRRSSAPAGVGGDRPDLGQAGGAGGGRRDGKPHAAHPLRREPHGQRGAAGR

SEQ ID NO: 9594 - protein, 40 aa, Actinoplanes utahensis
MTAPASAATTPQQLGGLDIGAYCRSIGYTAPAGSGRGVSL

SEQ ID NO: 9595 - protein, 442 aa, Actinoplanes utahensis
MTDLSEYTGRMAAIDRSQAVIEFGVDGNVLTANANFLAATGYTLAEITGRHHRIFCDPQYAGSDAYAAFWQRLAAGEFEAGEYRRFGRDGRELWLQATYNPILDEQGRAYKVVKFAIDVTAAKLRNTEFAAKVDALNRSNAVIEFDLDGTVLQANENFLRTMGYTLREIVGSHHSRFCTEDYRRSDEYRDFWLRLGKGEFISGRFERVGNYGRQVWIRATYNPIMDVDGKPIRVVKYASDITAQVEREQRIDALIAGTAEVTTSVQSLSESIAEIAGTSQTAAELAARTQTAATGGAQALQASMEAIGLIEKSSKAIADEVRVMSEIANQTNLLAFNASIEAARAGEHGIGFAVVADEVRKLAERSFEAAQHVGRLVEEAAERVHEGSRVSAEAGAAFQHIVDSVERTHEAIGSISGSTRVQQAAAQEVDRLVSRLVAEHAR

SEQ ID NO: 9596 - protein, 443 aa, Actinoplanes utahensis
MPADRITYGAARLGPLTLALPLTALHEAVACPPALDPAPFPGGGVAGSLNLRGLVLPVLDLRPHLGVGDAAPDEQVVLVVADGEHRFGLLADGVLGMLRPEPGAVRPVTTGAGPSLVSHLFTEPAGAGPVAVLDTAAVRRLPGLPAVQVRDTQTAATAGGATRTVVVVRCGELTLGVDTSLVHTITPGTAAGRFLSYDGRKLPVLDPLPLFGTDRPGPATVTAHLVLRVAGGHVALPVTALVGLHRLAEADVLAVPAVVLPRPGLIAGLVETPAAGRFLVLDPAAVDADPDLGALAAASRLGARPESRAVAARAGGSFLTYAAGGDFATPLDQITEIIPMPAGVGGDGPVLGMIQHRRAAIPLVCLAGLLGRRPEPVNPCVLVAQVDGVPVGFRIDRLGSIDTAEWAGRAGGAGRVIRAVAAARMISELDLHETGRRVLCGRP

SEQ ID NO: 9597 - protein, 422 aa, Actinoplanes utahensis
MAYRQLPALTATVTLTLTLTSAFVPSAAQAAPRGPNAVVTWNLNAQNEIYEVAKQSPATAARSFAMVQGAVYDAVNAVSGVPFEPYLTAPRAHRGYAVDAAVAAAASGVLTSLFPDQADTVQAQYDAALAAIPDGWAENGGVRVGRQAADAMIKARAGDGAFDTSDSYHVGTAPGQWRPTPPTNVQDGAWFADLKPFVLPDAAMFRTAGPPALTGATYAKDLNEVKAIGGVTSTVRTADQTRSAIWWHDRRLTEWDMKRQLAITRHLSPLQTARMFAMVDITNVDALIACYNEKKYWNFWRPITAVREADNDGNPDTTGDPSWTPLLVTPPFPDYTSGHTCSFSAITLTWQRFFGRDDLPISAYSADSGTTRAFPSFSSALAEVIEARIWGGVHFRSADEQGVRIGTSTARYVLAREFRPRR

SEQ ID NO: 9598 - protein, 195 aa, Actinoplanes utahensis
MLTVSILAGCSRVDVPDINSPLSSPGVTLPPSLFPSVDSRRSVPPATHHWKTDGLACPSVTRPAAVAAGIAGVGKVVDADHLSALGDTISCQWGPADGTAPSAIMNLTTTTQQAAADRVWAIGDSTLKQPLNGVGEQAFMSEDVGFDETRIAVRSGNATVRIQLLAKRNDAGSRKALRGAAADIANDLLTCLVPA

SEQ ID NO: 9599 - protein, 275 aa, Actinoplanes utahensis
MTEPDGSFAPALLGTFQDAVDLLEKQVSGIRTAWDEFTRTAEEFLAAIRAKLQDDHWWNRIAEWFTDDIADTLEAIEAGIESARVKLDDILGRMDAALSGTPPILSLFRSGIDWSTTINTRLSAIQPDVEQSGSIDVWHGPAHDTYRTRETEQGEAVGLASAQVKSLSVWLADVAEANTHFVTELVDQATTIVEELVTVTLDIGTAIGAEDPLSAQEAVNNLDEMMGKYAAAIIDFLTSLANRFTEVIRLVTEVAAEHSDNSAFPGGNWPKAVDL

SEQ ID NO: 9600 - protein, 267 aa, Actinoplanes utahensis
MACSQGLRFLNFLVQVLRGHGLNLVADGGVLPDAHIDARCATPESLAREVAATMSQSDDYRLRDARRFVQNLEDALARTPHGRPVPGLAAIEGTDPTGTVHCRVGLRGDLRVAIVDGWWHSVGPDRIADAVLEAYRFACEKAGFARLVLRHHGRAGRAKSPPVDPGRRCSYPSGHADHQDLAELRRRLEQASIGLDRAARLSELLSGRTSREVTGPRRLFTVVMRGAVIQGARVAVHGLRRADGAVLAADAQDALLTSRLGITPGER

SEQ ID NO: 9601 - protein, 824 aa, Actinoplanes utahensis
MKKQILTLAAAAVALLTVTATTATPAAVAAGEPTWHAGIPPLATPWTGQVGPDNALPDYPRPQLTRARWQSLNGVWQFAGATVGQAVPTGQNLGERVLVPYPIESALSGIQRHEDRMWYRRTFTVPDGWDVGGGNRLKLNFGAVDYDAKVFVNGRQVATHRGGYDKFDVDVTDALTGSGEQELIVWAEDLTDATGQPIGKQRRTGDHGIFYQGSSGIWQTVWMEPVPTDSITGLRFTPDPEAGVLRLTVDVAGRQNLQVKAVARGSGAVAGKIQGGSGTELALPVTAAHLWSPDDPYLYDLDVSLIDGRTTVDRVGSYVGMRAVGTAKGADGRLRITLNNRILFTMANLDQGFWPDGLYTAPTDAALKWDLKKDKEMGFNAVRKHIKVEPDRWYYWADKLGLMVWQDMPAANTGPIPPEWRGQFEAELHEMVREHQSWTSIVAWIPFNEGWGEWDRAATGRIADDVKAQDPSRLVNAHSGVNCCNSHGDSGRGDVIDYHQYLGPASPRPTADRVAIDGEHGGFGLKVSNHMWFGDGNAYQMTPDKATLTARYVQNQQDVLTSAQRCGISAAIYTQLSDVEGELNGFFTYDRRVTKMDLAQVKAINQKIIAGADGTTAGIPQPDPGTPGLSGIAFWPLDGSYGDLTPVNAPAFADGHTGQGVAFNGGKQYLDAGRPVLNTASDYSVAAWVRLDKADGAFQTVISQDGPANSDFFLQYSGADQRFAMSFAGVRALAPIRPEAGRWYHLTGVRDTVKGQLRLYVDGELAGTADACLPQGAPTGNTVIGRGKFGGNPVDYLDGTADQVHLYDRALSADEIRQLYASGR

SEQ ID NO: 9602 - protein, 230 aa, Actinoplanes utahensis
MVFRLPVRAESRRSQRKGTPPMTTPYLVPCLVTLRSEFNRLSPRRDKDSDGWIGDAAHSSRVSDHNPDRAGRVLALDIDSTGPWPQPFGDLVETLRGDSRLEYIIWNRRIASRARGWTWRAYAGSADPHTGHAHFSARHDHAGNNSTAPWPLEDVVTPDDIEKIANAVYLKLKPQLDQAVSAWDDTFGRGDAATTAGLILVETRNNTRALLSRLPEENGSGTGTPAAGAV

SEQ ID NO: 9603 - protein, 497 aa, Actinoplanes utahensis
MQVDDTSTGAFIVSHLFNPGPTPIPAREIPAMPLKRTPLLAVGTAALVAGTLGVLGITDASAASAGTLASALNGKCLDVTDGSTANGTLPQLWDCVAGSANQLWTLADNGSVQGRGKCLDVANNATTDGAAVHLWDCFDSVTSQKWTLNAAGDLVNKASGKCLDVRDRNTANGAKLQLWTCTGTSNQKWTFGGGSVPTTPPATGGPGAKAVAPYYYTGWGNPPSLSAVTAATGVRWFTMAFMLNSGTCDPKWDGSRPLTGGQDQTAITTIRADGGDVIVSFGGASGPWLEHYCGSASALAAAYQKVIDAYGLKAIDIDIEGTPYDSATDQQKTVDALKTIKANNPGITTYITLGSGTGGPDDSLIKRAAAAGLVVDGWGIMTFDWGNTGGNQGQLTIQAADGLKNKLKSAYGWSDAEAYHHVGISSMNGITDEHATVTLADMQTITAYAQQHTIARLTFWSLNRDRQCPGAYPNDDTCSGVAQSAYQFTKIIGAYRG

SEQ ID NO: 9604 - protein, 153 aa, Actinoplanes utahensis
MGVLFDYFRAPEVEEVRRKLDENEGYSPVPEFFDGVMLKTIDPGVILAQMIAMAADREWSADLVSERLIWPMSADRDLEYQGPWVTGIGDPARDALAGIEAGRAPELAERWAGIEEFFGDVDTEYLAEVIIELGELAARARAHGESLYCWSSL

SEQ ID NO: 9605 - protein, 204 aa, Actinoplanes utahensis
MMARVDRRDVMSYEHLPPAEGNLETFGLATRRVIRFSVGYLLVSALTTVLVLAGVAALRSGAADPLSVGTQATFAITNLILGSATLICLIGLLISTIVWAVSADRVAPGGPGAPGYGGLTLAVLLIALSELLTAPALLLGALQLAAWAALLAGVLITRTRLRRHTGDVSLGGRRKPVVTSDDWDASRWDPEVAHDIERRGRPTG

SEQ ID NO: 9606 - protein, 445 aa, Actinoplanes utahensis
MEDDTHASIAPSVRRLRQRAIGDRLRESLLFLPMLLLAAGILAETAAREIDRSREPAGLGLFAMSSDAAVTLLSTIAGATITTAGVVFSLLVVSLQLASGQFSPRVLRTFWRDRIGQVLIGLLLATFAFCVLALGHIDSQDQAPRLTMTLAVGLSLASVLAIVVFLNRITRQQYVGRIMERIQHEAIELIDDLPYGSRMGIQVGAPIAAPRAGEPGDALAVRSPADGWVQQISHPAILAAVPPGSTVRLETRVGAYLIRDEPLVRIWPRPAKAQAHRIAQLIAEAVVIGATRTMQQDIDFALRQLNDIGLRALSPAVNDPTTAVESILRVSSVMRPLLQADLPAQAHRDDRGRSLLTPWDLDHAEYVRHAYGQIRLFAGGHPQVALTLIRVLRMLRDVVAAREDRAATLVEIDRQLDAVIDDARRAGLPDSELAPIRESARRRQE

SEQ ID NO: 9607 - protein, 120 aa, Actinoplanes utahensis
MRIGDLAERTRVSVRALRYYEEQGLLASTRSGSGQRLYADAAVNRVRLIQQLYGAGLSSRTIAELLPCVDAKVSTPESRARLVAERDRINAQIAELTLARDRLEDIIEVTSGPNPACDYR

SEQ ID NO: 9608 - protein, 236 aa, Actinoplanes utahensis
MQINGTKALVTGANRGLGKAFAEALLARGATTVYATARRPDSIDIPGVVPLQLDVTDPASIAAAAAGVGDLDILINNAGISTDAPLLGPSTDNIRREFDTNFWGTLNVTRAFAPRLAGGAILTVISALSWYAFAPSSNGYAASKAAEWSLTNGIRLELAGQKTQVTALALAIADTDMMAGYDIPKLPPHEVIAKALDGLEAGALEVIADTPTANVKASLSRDPALFYADIPGALFG

SEQ ID NO: 9609 - protein, 85 aa, Actinoplanes utahensis
MGVRRSNHRGRRGTRPADQDVRHRIGVQISEVAPDRVAVAVLDACQSDCRGEFAYSGATYYLVPVRLHKPLGARLVDDTNGLPVF

SEQ ID NO: 9610 - protein, 97 aa, Actinoplanes utahensis
MPQAGVHRRTDPFEDFRAGDFDVQAASAAPTAMNGAAGWPMMIVVNPMALTIPSLATVMKLGRPARGRSVWRLSIPSSAMDGLLLMAIPLAAVLLWG

SEQ ID NO: 9611 - protein, 133 aa, Actinoplanes utahensis
MAITLGIHALADVALVWLGSLVWNAYRQGTLAATEAASVSILAVSAGVGAVITVVLQIGLLRGTNGRHLVQAAMALNLARLLGLLLALMITAARLGITALAGMMETFAAVIAVAEALGALYVTTVVSRRTSDG

SEQ ID NO: 9612 - protein, 36 aa, Actinoplanes utahensis
MMGERIAVAAGLLCLVMIALVTVVTVAQRRGARREP

SEQ ID NO: 9613 - protein, 85 aa, Actinoplanes utahensis
MTSAISASEARKSLFPLIERVNLDHTPIEIVSKRGNAVLVSKEDWDSIMETNYLLRSPANAKRLTESVEQWRAGRATEREFGPEE

SEQ ID NO: 9614 - protein, 101 aa, Actinoplanes utahensis
MASGTSHGARVRPRGVKLSWTDHAWDDYLYRQTQDRRTLKRINALIADIKRDPDGQGIGKPEILRNNLAGLRSRRIDDEHRMVYAVETNEITIISCRYHHE

SEQ ID NO: 9615 - protein, 245 aa, Actinoplanes utahensis
MSMVDAALLRRAGDLKGELVAFSQQPRYDRAMSSFLAEYGNGLESADEQRWMLLWDGFTLEHRLADGQTVVEQFVEARPDLPEVEREMVLGLDGYYTYCRDSVLGPDPKVSPSMVSMSLPPDLTGAETVALIYDETDGLGFYAEFGLVEEAFVNPDVLRRRRWRERTLSYLEDDSVEPMVLRRLAARHPEKASVVFRRLLKRPRFDWVRDGEALMREFKPLYFHRLPRPRVSPLSERLAEFARRR

SEQ ID NO: 9616 - protein, 409 aa, Actinoplanes utahensis
MPKSRGRPAGRGKPRRPQRPVSELRLSDRLMRDAMSIVSEDSVLKVERWASGWLGAAWSAAGLGERDPEKVLYLEVVGRASTRPSLYGLAAVAALRRVAAPGEWPMLDDTLEILSESQPVPDWFAIPGFEPVRAWRAVDVWDSEHVLFVEFAGQTPHTVMAQISLPGGVLVDKLAVLQPGAAEAWDRLREPGEVPMPAVECPVEVALAELADALRTTDMTWPRHDDEEFLDLRALAWSRCRSYLPDFRDWQPMSDEERQRLLDGFAPADDTVARSLADLFLDYGDGYMTSGPLCWSPGQVGLFLADWLPRKAALDAEQRAALPDVLRRWVRYALERRAVDLEWIGPVVEAVDTFLPSFEEAFDDTAAWGPAKQIAAELTARGVDFTDSEAVEDAMRGLNAERLARYLID

SEQ ID NO: 9617 - protein, 717 aa, Actinoplanes utahensis
MPAGGSAIGRALREREHAAELMRRYRRAQAVAARYAAAAIGEQQVAAALIVLTGAGWTLLVDRRWPGSAVANVDMILVGPGGVFVIDVKNWRSPPTALDGRLHAGSDDRHQEIIKLRAITSRVHDELAVLDMAPAVVASVMVFANQSVEQRVGTVFLRGVKEIAPWLAALPRRLTTPQVGRVAVHLAGKFPAYDIPDIVERPVQVDRSDPPQKAPSLFDVDAIARAEQQSVLARPIESWMTYLHPDQLAIVRRRWNGPARISGAAGTGKTVVGLHRAVWLAQRTVGKILYVTFVKNLPRVQAQLLARLSPAVVDRVEFCSLHGWARSLLDQRGVHLRVDLAATGNCFSRAWLHVGRSSVLAELEPNPMYWQDEITYVIKGRGFTELGQYLTATRPGRRTALRRVHREAAWQLYLEYERLRAERGVHDFTDVLTEAIAVLRDPAARPRYAAVIADEVQDLTLVGVSLLHQLVGDAPNGLLLIGDGQQAVYPGGFRLSDAGIDIRGGRAEVLKVNYRNAADILTAALQTLDGQPFDDIDGTVVTTGPAVETTYHDGRVIRVDAATADEHDQAFLAAVRELAGDSSDDTRLGDAAVLCARKKDVIHYQRLLTRAGIPNSNLEDYDGQATGELKVGTFLRSKGLEFKHVFLPHHDREVRKAQTSSLTETDRLALVKRQLFVGMTRARDMLWIGAVPDAKLPRPRTGHDSAAVPGSPPLGSR

SEQ ID NO: 9618 - protein, 57 aa, Actinoplanes utahensis
MSDFNPENFAEFTTQDGPESPGVGEDNLPAIADLQPPDMVSDPRYQIVLLPQTLVER

SEQ ID NO: 9619 - protein, 420 aa, Actinoplanes utahensis
MSQPVEVDVVIVGGGLAGLSAARRLDRAGVEWLLIEGSDRLGGRVATENVDGWRMDRGFQVLNTAYPRLSALVDIDALEMRYFTAGVLVRRGGTLHRLENPLREPLATPQTLLSGVGSLTDRLKFAALATRCATTPAAKLLEAPETTTQEMLRKAGLSHRIIEEVLRPFFSGVFADRSLDTSSHVTAMVLRSFTRGRIGVPAAGMAALPAAVAGPLPFPQLLIGARTLSIGPGLVVTEGGEIRCRAVIVATDPLSAADLLPQLPRPDMHGLTTFYFGASLAPIDEPILLLDGERREIVANTVVISNAAPEYAPGGHSLIAASVVGVSAPSSASEAVIRVELARMYGTSTDDWDLLNVISIPNALPAARVPQNTLRKSVALGDGLFVAGDHRDSPSIQGAMAGGWRTAGQVLASLGVQVGV

SEQ ID NO: 9620 - protein, 107 aa, Actinoplanes utahensis
MRGKLMFLTGLAAGFVLGSRAGREKYEEIRANAQKVWEHPTVQEAAGVAQAQANKLYTEGKDKLQSSKLGEKLGATSQSSTSGTTSTDELLAPSDSLSGTKGSGSTY

SEQ ID NO: 9621 - protein, 345 aa, Actinoplanes utahensis
MRLRHPSGRTVHLIAGVDLTGARTAADAFAMIDAVAARLRSGRTADPRLAVAGVTDNADRAAVGWTGRAAGLTENADLSRTDAVIGGDADPAHHRLGIALRLPYPLAAALVDDGRARTRLRADLDARGLDVVTVNGGPEAEVGGLPPLPDWSETARLQHTLDLARILVDLLPADEVRGAVGTCGLAHRDGWDEAREMAVSRHLRRLSGRLADLAWRVGRAVRVGFEPGPGWVLDTPEETVAGLARVDKDRLGICLDLARAAREWPDPAAGVDRLTDAGLSVITVRITDPRAAWQPILRHLLAADTARTEYVEVEGSGAAAADLTYTMGELTALGLVPEHEPCPTS

SEQ ID NO: 9622 - protein, 439 aa, Actinoplanes utahensis
MRLQNRPHGRHDPEDDKQSGSVAAVPAASGSHGRPDPGDGEGSAVQRTDGSGADHATAAGSADASDAGRTGAEHAAASDAGRGDDAGQARRRGAEDFDLAAASTTDVGRTPDPKDLSAPGPDAGPDRPSQLHARGIFAAVRRTFKQFSEDNVSDWAAALTYYGVLSIFPGALVIVSLLGLLGDAGQRTVTDAVTQITPNSQLRDLVNTVLDQVQGTGNAGLAAILGLVAAFWSASGYIAAFMRASNAIYDVPEGRPIWKTLPIRVGVTAIVGTMLIASAAIVVFTGDLARIVGEKLHLGGVAVTTWNIAKWPVLVILVSLMFAILYWASPNAKTGGFRWISPGGIFAVLLWVAASAGFAIYLANFANYNKTYGTLGGVVAFLVWLWISNMAIMLGAELDAELERGRAIAAGHPADEEPFLELRDTRALKKGSEHGLSQG

SEQ ID NO: 9623 - protein, 269 aa, Actinoplanes utahensis
MLTMLLPRLVSFEGSAGRSVRVTERNVNALKSAYWVVMAGGLLEPLLYLFSIGVGVGALIGDIALPDGRLVSYPAFVAPAMLASSAMSGALSETTFNFFGKMKYMRLYDGILATPIRPFEIAIGELIWAMARGTLYSLAFLIIMVAMDLTTPLRALAAFPAAILVGFAFGALGMSVATLIRSWQDFDLIAAGQFALFLFSGTFVPAGSYPPVLRWLVEISPLSRAVDLIRGITLGSAGWLALVDILYLLTLLTIGLSISGRRMSTLLCK

SEQ ID NO: 9624 - protein, 252 aa, Actinoplanes utahensis
MTAAGYVLEYHLVNYRRTWRSSALSTLVLPLLTMLGFGLGVGGYVKAGVDGFAYIDWIVPGLIASTAVQTALGEASWPVLSALTWMKVYFAQAASPLRVGDIVGGHLAFMIFRVLLSVTAFLLIAAAFGTLHTVAALAVLPLSALIGFAIAAPVMAYTASIRSDSYLAILFRFAVLPMSLFSGVFFPIGSLPPLLRWVAYALPLWHGVDLTRAATLGLNPGWAGLWHALYLLTWCVAGWFLARWRFRSRLVM

SEQ ID NO: 9625 - protein, 307 aa, Actinoplanes utahensis
MTALIHARGLIKRFGDFTAVDGIDVDVQRGEAFGFLGPNGAGKSSTMRMIGCVSPPTDGILEILGMDPRRDGPAIRARLGVCPQLDNLDVELTVRENLTTYARFFGIPRATARRRADELLDFVQLTERAGSKVEPLSGGMKRRLTIARALVNEPDLVLLDEPTTGLDPQARHLVWERLFRLKQQGVTLVLTTHYMDEAEQLCDRLVVMDGGRIVAEGSPRALIEQHSTREVVELRFATDDQGAYAGKLAGIADRIEVLPDRVLLYVADGDEALAEVGRRSLSPASALVRRSSLEDVFLQLTGRTLVD

SEQ ID NO: 9626 - protein, 171 aa, Actinoplanes utahensis
MFRRRPALPAESRPPLEAEERVLAWSAGEQGVVVATNRGLWLPGGADRLGWHEIHKAAWSGRELRITPAEVAEERDGYTVLVDGPVITVLLLAPGELPDQVRSRVTRSVAYTTHHELSHGAVRVVGRRVSGRDGLSWAVRYDSGTPVDRESVIAETAELVGAAQNSVAPPP

SEQ ID NO: 9627 - protein, 617 aa, Actinoplanes utahensis
MYAVAGRVKDEDIALVRDRTSIADVIGETVTLRSAGGGNLKGLCPFHDEKSPSFNVSPARGVYFCFGCGQGGDAIKFLMDAEHLSFIESVERLAGKAGIQLRYDTDGAAPAGPRPQTGQRQRLIAAHASAVDFYRDQLGSAGARKAREFLAERGFGRDTAERYGCGFAPDSWDALSKHLLMRGFTTDELITAGLAKTARSGSLIDRFRRRLLWPIRDLTGDTIGFGARKLFDDDDGPKYLNTPETPIYKKSHVLYGIDHAKREIAKRGRAVIVEGYTDVMACHEAGEPTAVATCGTAFGVDHIGVLRRLLMDSDSFTGEIIYTFDGDAAGQKAALRAFEEDQRFVGRTFIAVSPDNMDPCELRLARGDLAVRDMIAGREPLVDFALRHTIGRFDLDTVEGRVEAMRRAAPLVAKIKDREKRPEYARKLAGDLGMDLEPVQRAVNHALRGEQVQPVPQQATHAPQRLVERDALKLALQEPVLAGPMFDAVGPENYNDPVLRAVREAIAAAGGTSSAVSGVVWIEKVRDACADIGSQAAAGQLAVEPLLLDGAPDPHYVQVLLAKLQLPRVIQVIRDLKSRLQRLNPVTHKDQYLAQAGELFSLEQQKRALSEQAAGDL

SEQ ID NO: 9628 - protein, 969 aa, Actinoplanes utahensis
MGLPGRSGGQRVLRAERPPWGRSVAEFVDQGADLPGRAADQLRGVAGGVRPLRGVRAGRADVRHRAADLGRRRGHRPDVAGQLIGGRRLLLDGGRDGPLPVVDPGDHRGDRLDRLGGPGGHLLDRQDLRGDVRGRLRGLLGQVLDLGGDHREALAGVPGPGRLDAGVQRQQVGLLGDVRDHLHDRAHLPARLAEPGHRVRGPVGAGGRLVRGGRRGQRLLGDLPDRGGQLLGGGHHRRHRAGDVAGRAVRAARLRRGLLRRPVQGAGQLLQLGAGLGQHPHPAGGRRHGLLQGAGRLVQRHRHRTQLVPVDHRGPHGQVPAGQRTQRVQHPAQRPADRPHGQHARRRGDQGGQQRGDHDEPVARPRRLGAAGRGGLDLGVHPGVEIAELLLEVGVDLEEVGQAGGRGGVVGLGGRHHALRGLGVRHHGRPDRHIVGLEGGRGGFRGIVVHLQHGGAVVGHLVDRERLPHARGRRVHRRHHVGPQRVVLHVGVPLIAHRLTDRGDLLVRRRLVGGVAHRERGHQADREQSGGTHDHETGDDRDAAAPGNGLHGIPIGILDIRLRLGIMTAADAQRWAAEPAKDSGYGRTPYQRDRARVLHSAGFRRLAAKTQVHTAGVDDFLRTRLTHSLEVAQISREMGARLGCDPDVVDVAGLAHDIGHPPFGHNGEAALDVAASACGGFEGNAQTLRVLTRLEAKVPGAGLNLTRATLDACSKYPWFRRPGTRKFGVYADDEPVFTWLRDGRDDDRRCLEAQVMDWADDVAYSVHDVEDGVHGGYLDLGPLLRDPAERAELCADVAATYSDETADQLGESLEHLLADPAVAAVEGYDSSYAAQVTLKRMTSVLTGRFVSSAVGATHSQYGTDPMRRYDADLVVPRTVRNQCALLKGMAFRYVMRMRSAERWYEQQRTIVVELVEALGRAPDRLDPLFRPLHAAAGSDAEALRVIVDQVASLTDHAAVAWHRDLTGTR

SEQ ID NO: 9629 - protein, 122 aa, Actinoplanes utahensis
MPSHWEQVVVDAADPGRLGRWWAEALGYVIVDEHADGAYLEIRRGADELPALFFLRCDQPRRGKNRLHLDLRPDDQESEVERLVNMGARPVDIGQGDVPWVCLADPEGNEFCVLSAPRGAVQ

SEQ ID NO: 9630 - protein, 126 aa, Actinoplanes utahensis
MPGVDHCLQEAMTIPGAVGASIVDYTTGFPVATTGAAPNADHEAAAAGTAEVVQAANSRSLFVSAIPHDLLEDLIITTAGGYHLLRIVQTDFDSRLVLYVWLDRVRGNLAVARRQMQRLTDELVSD

SEQ ID NO: 9631 - protein, 328 aa, Actinoplanes utahensis
MSATKTAAPADLLSQVAGERQTGALVMGGHPGGAVYVFEGRVIYAESPAAPGVGELLTSSGRLAGRTWQNALDLGTSTARVGRLLVEQGHLTQGELELCVLGATYDAAYFALAAPSGPVEFLPAATHWLGPVVHIDAAAVLREVGRRVKLLDDIHPSARIDTAPVSPVTRPPRERVTITAAQWELLIHADGQRTPADLALLLGRAGYATIQELRRLAALGLIEVPLEVRAESPEFVRLPQHRAEVAPVARPAPPPAPPPPVVPVISSQPPPAPPPGEGNTGANRLPRLARRKPGAKLPKELAVENPPVHQGTDEVLLKRIRTALRALR

SEQ ID NO: 9632 - protein, 165 aa, Actinoplanes utahensis
MTVDPAVLDELGRLRSRVPELSGSVLATADGLVVAHDSHGIEPDTLAALAAAHLALARRFAHAVNHGELRESVVECDGGYITSYTAGPNALLTVVTSGDANLAMVHLEARRCVRRIVKLLALDSAQQKHLRPEIPQQTGPSSIPLARRTPMATLSNASRRRTAAG

SEQ ID NO: 9633 - protein, 123 aa, Actinoplanes utahensis
MADMDTALKEVMEIDGCIGVALVDHTSGMALGTLGGGKDLDLTVAAAGNTDVVRAKLRAMEMLNLTEKIEDILITLDTQYHMIRPLTSRQGKGLFLYVALRRDRSNLAMARHQLRRIENDLDV

SEQ ID NO: 9634 - protein, 359 aa, Actinoplanes utahensis
MPAREIVERVRAGELDHETALDMLTGAPAAETDAALAEALGAEFDRLFRTGWQPIELHRTIARRGDPIQGRLVAEAAAAFLVGKAPVDEAWRAQVVQLQRGAGRKKDDRIAVLDASLGLLDELRRLPGIEILIPPPGTPATTVHQHADRRLLDRVRALLAKAEATDFPAEAESYSAKAQELITRYRIEEVTAPAVDVVPFARRIGVDHPYENEKASLLDAVSRTNGCRTVWSPELGFSTIFGFDTDIDGVELLYTSLLVQANRAMTRDEPAKGKARVKAFRRSFLVAYAIRIGERLREVTEQQFAGHGDLLPVLRNRDVQVRAAMEKVFPRTVRTRGSRVDSLEGWESGRAAADEAKLR

SEQ ID NO: 9635 - protein, 372 aa, Actinoplanes utahensis
MLGNHAVNPPVVLAPMAGITNVAFRRLCREQGGGVYVCEMITTRALVERIPKTLKMIAFAEDEGFRSLQLYGVDPDVTAAAVRMVGERNLADHVDLNFGCPVPKVTRRGGGSALPWRRKLFGRIVRQAVEAASEFGIPLTIKMRKGIDEDHLTYVEAGLTAQDAGVAAVALHARTAEQRYSGQADWDAIATLKQALDVPVLGNGDIWEGSDALRMVAHTGVDGVVVGRGCLGRPWLFADLEAAFTRGANYQPVLPTLGEVAKIMSRHAQLLVEALEDERHGCADFRKHVAWYLKGFPVGGDLRRSLAMISSLTELDDLLGRLDPAIPFPVESLGQPRGRVNAPGKVSLPYGWLESRDDDTVPEGAETDESGG

SEQ ID NO: 9636 - protein, 156 aa, Actinoplanes utahensis
MGPRRLVVVFESPVAEALQRFAVDLGFHSVLVEPDPTRLGGTPRPHGDRVVGDLAAAEPDEHTDVVLSDHHRPEIGPLLQEILAGPSRWIGIVGNPRHEGPHTAALRDLGVPEAEIARVHRPIGLNIGSRTGPEIALAILAGLIADRNGRPGGFSF

SEQ ID NO: 9637 - protein, 414 aa, Actinoplanes utahensis
MPKVSRRRRLLAVVAAMLVGAVTMGAGPGRAEAAAAFAPIDPAPFMLDPSDSFQRYGSLVSRIEASGKVTATPQLGSALDGPQDFKPTWGLCHPTAGIPAGLGATGFCWDPRDDGWGLTWTPQGISGSWDAQPDGLWEGRKIALASWHGPNNGFARLTFVDYTNTAALKFRDVLLVVPYSSNGVDNFRVLSAHADGVVWYGNTLLVANGGRMHVFSLKHLWAMDRSEEETGFGADGSKAPSARWHRYALPEIGEYYPESTPTGTYVGCTSATGVRPCLNAISLDRRGGNPDSIVSAEYLDANAAGGRAFRWPLSPTSGLVVSADGKVHAEAAYTSPVWRMQGIASDGVNWYIAGNCASGASNSGCIHKAVPGQAPHQQAEVGGVENLSYQPGTSPRLWGLTEGKNPITFTIKVP

SEQ ID NO: 9638 - protein, 459 aa, Actinoplanes utahensis
MPADRIDSVVSLAKRRGFVFPSSEIYGGTRSAWDYGPLGVELKENVRRQWWRTMVQQRDDIVGLDSAVILSKDVWAASGHLDAFVDPLTECQSCHKRFRADHLEEAYEAKHGSLPASLSELNCPNCGNKGTFTEPKMFNGLMKTYLGPTESTEGLHYLRPETAQGIFVNYANVATAARKKPPFGIAQVGKSFRNEITPGNFIFRTREFEQMEMEFFVAPGDDEQWHEYWLQERWNWYRGLGLSESNLRFYEHPREKLSHYSKRTVDIEYRFQFGGTEFAELEGIANRTDFDLTTHSKHSGVDLSYFDQEKQERWTPYVIEPAAGLTRAVLAFLLEAYDEDEAPNTKGGVDKRTVMRFDPRLAPVKVAVLPLSRNPELSPKAKGLAADLRKRWIVEFDDSQAIGRRYRRQDEIGTPFCVTVDFDTLTDDAVTVRDRDTMKQERVSLSQIEDYLIKRLPGC

SEQ ID NO: 9639 - protein, 175 aa, Actinoplanes utahensis
MTYGQPYPALPETPTFVAPPPPPGPGVHPPFPAPPVEGRGRRIGLGFGIGGGIVALVCAGGLAAVVGLGLAMTSAFTEQAHVVVGKYLDAVKAGDYTKAYAQLCPEARARESITEYRARVTQDERIDSYSIGDLDLVTGEVPVDLTYADGGTDHVEAQLGQNSSTGAFEVCSVGE

SEQ ID NO: 9640 - protein, 232 aa, Actinoplanes utahensis
MSRRRIMAPTVVDNDNDCQKRMGQRALPSTATISRVSSTTRTSRVIGGWTGQVVKVSVASPAASTASSSAPTTPGRNRPASSRASAAKNAEVGFTLASRRRKWSGVVTAAPSRRAYPRHMLVLNRFLVPPDTQDDFREQAHAALAALAGCPGYLSGRLARALEDTAAWTLVTEWESVGAYRRALGNFDVKVHATPLLARSLDEPSAFETLAAAGPGEPVTETASDRAAESWR

SEQ ID NO: 9641 - protein, 283 aa, Actinoplanes utahensis
MRRLLTPLLLLAVLAGCGARAAADGRMPIVAAFYPLQFVSERIGGDLVRVVNLTKPGAEPHDVELSPRQVAQIVDAKVAVHVAGFQPAVDEAIEQNAAIAGYDVSAAAAPEHHDPHVWLDPVRLAAIADRLAVRFGQADPPHAATYTANAAALHRQLDDLDAEFRTRLASCPRRELVTSHTAFHYLAERYHLTQIGITGVDPEAEPSPRRLAEVAADARAHGTTTIFFETLVSPKVADTIAREVGAKTAVLDPLEGLIDPSADYFSVMRANLASLTTALGCPS

SEQ ID NO: 9642 - protein, 32 aa, Actinoplanes utahensis
MPVMTGGTGRHRRNLTIGAAGEGHEGMTRRAQ

SEQ ID NO: 9643 - protein, 260 aa, Actinoplanes utahensis
MSVIAVRHVAAGYDGREILRDVDLSVAAGDVVAVLGANGSGKSTLIRTILGLVPVRRGEIDLFGTAQRRFRDWARIGYVPQRLGAGSGVPATVGEVVASGRLARRGLFRLPGAADREAVRQALTAVGLLDRIGDPVSTLSGGQQQRTLIARALAGRPDLLVLDEPTAGVDAASQEAFAGALTEFAANGGTILLVLHELGPLRPLIGRAVVVHEGRIAHEGVPPEPAGHHAEPGHDHVHPHADEAKAGICEWAPTDGMKAY

SEQ ID NO: 9644 - protein, 286 aa, Actinoplanes utahensis
MDLLTYPFMLRALAGALIIGLAAPALGVYLVQRRLSLIGDGIGHVALTGVGVGLLTHRSPVLTAVLVSVIGAVAVELVRERGRTSGDLALALLFYGGIAGGVVLVGLSDDASNASLMQYLFGSLITTSPQDIVVIAGLGAAVLIAMLVFRPALFALCNDEEYARVSGLPVRTLNLLLAVTTAVTVTIAMRTVGLLLVSALMVVPVAAAQQLTRGFRSTMAVAMLIGVGAAGAGVVLSGQIDTAPGATTVLLALAAFLVTAAAGALWHRRRRPAPAHAEPPDVVLHG

SEQ ID NO: 9645 - protein, 101 aa, Actinoplanes utahensis
MAEQGAGHGSYEAAGALLRALSAPIRIAIVVRLGGGACCVHDLVAELGAAQPLISQHLRVLRGAGVVRGVRRGREIAYSLVDDHVAHIVADAVSHARENRW

SEQ ID NO: 9646 - protein, 134 aa, Actinoplanes utahensis
MVSPDSAQRNTKQRSAVSAVLAETEGFHSAQDLHAMLRDRGERVGLTTVYRTLQGLADAGEVDVMRPPGGEHLYRRCSQGHHHHLVCRSCGRTVEVLGPAVESWAEKMAGEHGFVDVSHTMEIFGTCPECAHRG

SEQ ID NO: 9647 - protein, 203 aa, Actinoplanes utahensis
MKLYADRMPIAVRQLVTDILVVIWVYLWIRAALWVHDLVQQLAVPGQKLESAGGGIADNLADAGGKVGRVPIVGDQLTKPFAGAANAARSIAEAGQQQQDLVGKLALILPLMAVAVPLAVILFLWLPRRLRWVRRATTASAVRDLPAGRDLLALRALASRPLSELARLGPDIAQSWRAGDAAAVDALADLELRRLGLRRAGRS

SEQ ID NO: 9648 - protein, 183 aa, Actinoplanes utahensis
MAATPSKETQKQRWDRNFADLLQELRVAQTGVQILFAFLLTLPFSSGFPKATEFQRDTYVVALISAAFATALIISPVAFHRALFRQGRKPELVRYAHRMASAGLACMLVSMVSSVLLVTDYVLHARWAVVLTVLSAGWFLTFWAILPVTHKRWATDDDKDGFVLDDAPADSATSGLLDADRGA

SEQ ID NO: 9649 - protein, 271 aa, Actinoplanes utahensis
MEVKARGLTFEVAVGGPEDGRPVLLLHGFPQDHREFDPLLPRLHEAGLRTYAMDQRGYSPGARPSGVPAYRIGEPVADVLGVLDALGLESVHLVGHDWGAQVGWLVAGRHPDRVRTLTAISVPHPRALLLALRVRPSQQARLAYFQVFRSAVAEKLLLGGGALVMRRMLGAIGPRADLYVKAMREPGRLTTALHWYRAFRSSDVADLGEITVPTTYVWSDRDGVVGLTAALRTADWVPADYQLVAMRGVSHWVPEQAPRELGDAILARIGV

SEQ ID NO: 9650 - protein, 576 aa, Actinoplanes utahensis
MGRHRDHPGCGPGPRRRAGLRPVPLPGLHPARRAALRRPGRPGRRGLRLVRLDLRLRPVELPDPVRADHRRQRHRDRRRRRLAAGPRARADRRPGPVRGRPPAGIDLIAVSEVQLRGFGWRHAGRRAWAVRGLDLHIRHGERVLLLGPSGAGKSTLLAALAGLLPEDSGEAAGGIEIDGLEPPKARDRVGILFQDPQTQLVMARSGDDVAFGLENRGVPAGEIWPRVTETLDRVGFRYPLDRSTAALSGGEAQRLALAGVLALRPGLLLLDEPTANLDPAGAALIRDAIAQAVGPDTTLIIVEHRVADALPLVDRVVVIEAGGGVRADGTPEAIFAAYGDELAEQGVWVPGHAVESRIAPVTVPSDLVRAEQTGVPGRLPAVRLTAGAGEVLAVTGPNGAGKSTLALLLGGLLAPGTGRVSAFGDRKPPHRWRARTLTQRIGSVFQNPEHQFVTTRVADELSLGPRRLGRGAAEIRATVDELLHRLRLERLAEANPYTLSGGEARRLSVATALATAPRLLVLDEPTFGQDRRTWTELVTLLGELRDEGHGVVAVTHDEEFVRTIADRTVTIGGPRP

SEQ ID NO: 9651 - protein, 306 aa, Actinoplanes utahensis
MDRVGDVAGRAARRGARRGGGHARRGIRPYHRRSDRHHRRTATVNLLLEPIADPGAPLARRNPVAKLGAALLFALPMIATLDPVTPAVALGVELIALPFFGVRARVLARRIWPLLLTAFSTLVAMVLFAADRGGELLFSVGRVDVTTGVLASATGLILRIFAVALPGIAVFTTTDPTDLADALVQNAKAPARFAIGALAAFRLLPLLGQEWRMLTLARRARGVETGKNPVAFASTAFALLVGALRRGVRLAVAMDARGFDSGVPRTYARTQRFTAADAVLLVTAVVLSALILAVSVVSGVFRPIIG

SEQ ID NO: 9652 - protein, 167 aa, Actinoplanes utahensis
MRRAVVPRGTATPAIDLPAPPRRDDHGWVSQYFEVGDLVLWNPSNGVARLYARTGEAVAPLVELPTGIGPMIADEYEIDLDVFVAFVDALTGYYLGAQHPILRSLMEGFLATSIVMVQRAGRELPALREQQRPHWWNVSVTTRGVAPTADRDELLDLVAEHAMSMAR

SEQ ID NO: 9653 - protein, 305 aa, Actinoplanes utahensis
MTRARLPQLLADARSGVLLFSITPPKRSTPEERIKEIAEVTLERLGRLDLDGLILYDIDDESDRNPVERPFPFLASHDPAQYYETHLGAWKQPVIIYRCVGKYAEEELRDWMRGVDPEQVLGVFVGASSGGKAVRTGLRRAQELRAEVRPELPLGAVVIGERPEEHRRMLTKQDRGASFFISQVVYHVNETKNLISDYFYECRARDIPPRTMIFTLSLCGSLKTLEFLRWLGVDVPRWLENSLRHTADPLAESYKHCLDIARDLRDFCEHLGVPYGFNIESVSIRREEIEATTRLAADIATLLGR

SEQ ID NO: 9654 - protein, 98 aa, Actinoplanes utahensis
MLVAFSVTPIGVGDSVGDAVAEAVRVVRASGLPNRTDAMFTTIEGEWDEVMAVVKQAVEAVAAVAPRVSLSLKADVRPGVTGALTAKVDHIERVLGES

SEQ ID NO: 9655 - protein, 224 aa, Actinoplanes utahensis
MRRLVMWDVDYTLLRGGGVAARAWKAAFTEVTGVAWRDTPIFGGRTDLDICGGVFEAHGVTDCTPERFFARYVEIVDTVRHEFAEQGALMPGVREILAHLAERPDVVQTLVTGNVPEVAAAKVAAFGLSGSFDAEVGGYGTDDSVRATLVRRSLERARAKYGEPFRPVVIGDTVNDVTAALANDAVAIAVATGATPAADLAAAGAHVVLPDLTDLETAVKAMTD

SEQ ID NO: 9656 - protein, 171 aa, Actinoplanes utahensis
MRHLWIARHAFANEDETGLTGDGEQQAALLGKRLADVPLTAVHHSPLARAVQTATIVAAHLPPEVPLHPADELDDQFPTPANSAGMIARFTGAAPVETHELVITHAFQVAWFVRDALEAPEDRWRGLNSCNAGLTLIRYFPGQKPRVIMFNDVSHLPASLQWTGFPPELRP

SEQ ID NO: 9657 - protein, 260 aa, Actinoplanes utahensis
MSPRPPTPHISGARPPQLPSAAIPRHVAIVMDGNGRWAKERGLSRTKGHEQGEHSLFDAIEGAIELGIPYLSAYAFSTENWKRSPEEVRFLMGFNRDVIRRRRDQLVDLGVRVVWSGRSGRLWKSVIAELQTAEEMSRHNKTLTLQFCVNYGGQAEIADAAAAIARDVAAGKLRADKVTEKTIAKYLYHPEVPEVDLFLRPSGEQRTSNFLLWQSAYAEMVYLDTLWPDFDRRHLWYACELYAQRDRRFGGALPNPVSPS

SEQ ID NO: 9658 - protein, 258 aa, Actinoplanes utahensis
MPAGYRRHLYRDDAVVLRVQKLGESDRIVTLLTRRHGRLRAVARGVRRTTSRFGARLEPFGHIDLQLAGSPEGVGSALHSVSQVEALSLFGKSFLADYPRYTAASAICETAERLTPVEREPALRLFQLTLGALKALAAGEHAGSLVLDAYLLRAMAFAGWAPALTECAVCGDPGRHAAFAVPAGGAVCPDCRPPGAAHPSPDTIGLMAALTSGDWPVADASAPSVRRECSGLVAAHLQWHMERSLRSLPLVDRRELKP

SEQ ID NO: 9659 - protein, 254 aa, Actinoplanes utahensis
MTRRVALLLAAASVAALAGCDGVVGAKMTFDDTEKTKVTDIVLSGGSGDVTVTTGAVGETHIKRIVRGGNGSGPSYQLSGTTLTLPTDCGFNCSVSYEVDAPAGVAVHGSMRSGSTSLTGVGAVDLKLTSGDVVIDHATAPVKVKATSGSVTVTGAPAVTLEATSGDLAAREIAGPIDARVTSGDVDLELSRPASVTAVVTSGDLMLRVPVGSYQLKEHATTGDEHIEGITDDPRSPNVLDLRARSGDLTVGTL

SEQ ID NO: 9660 - protein, 350 aa, Actinoplanes utahensis
MAMRNRYLDLLRAIATVRVVVYHLTGWAALTIVFPAMSVMFALAGSLMAASLDRFGVWAVERRLRRLLPSLWVLTLLIAVPAMLISGTPFDVHLLLWGFPLVDPEATGWWMASLSHAWYLRDFLWFVLLSPLALPVFRRIPLIAVLLPYAGLLVLELTGARVVNVVHDLALYGGAWLLGFAHHDGHLARIPRKRLIALAAALAVPGMAWVLTHSGPRGLDLNDIPIGNALWSAAFVLVAMGCSPRVGEHRVLTVLNARALSIYLWHIPILLGVTEFGERHGLPVRGAYGIGWRLIVVTLLIAVALALVGWVEDVAAGRRPALLPGRPVPVPVSPAPALEGADGEIAAARA

SEQ ID NO: 9661 - protein, 291 aa, Actinoplanes utahensis
MYRAGFACFVGRPNAGKSTLTNAIVGQKIAITSSKPQTTRHVIRGILHRPDAQLVLVDTPGLHRPRTLLGERLNDLVRETWSEVDVIGVCFPADEPVGRGDRFISAEVGELKAKVIAVVTKVDLVDPQTLAQRLLAVAELYDFAEIVPVSAVSGHQVETLTDVMVRYLPESPQLYPDDVLTDEPEQVLIAELIREAALEGVRDELPHSIAVLVEEMQVEGRTTKIYADLYVERDSQKSIVIGTRGERLKTVGTRARGEIEQLLGRKVYLDLHVRVAKEWQRDPKQLRKLGF

SEQ ID NO: 9662 - protein, 40 aa, Actinoplanes utahensis
MADENERRLTAGERNELRRQERRAARKAADGQGQVQGRGH

SEQ ID NO: 9663 - protein, 126 aa, Actinoplanes utahensis
MPEQSFAAVPVPGADGSALSAEDAKLVTLARSSRARAGAAEGAAVRDQDGRTYAAASVALPSLSLTALQLAVAQAAASGATKIEAAAVVTEASTLDGAGHAAVRDLAADAPVHVAGPSGTLLGTVS

SEQ ID NO: 9664 - protein, 523 aa, Actinoplanes utahensis
MSRPCSATSCWPRRWPPSRRSPPGTPPPTSCICSPCTARCTCSGTTTPSRRRSGRCSPCRTSSCRAGAPVVKPADVNSASTLPELQLIIIAVGLVLLAGLASMTDAALATVSAARSSELAREGQRGAGALTAVASDVVRYVNLLLLIRLLCELSATTLVALVAVDNWGIGWSAALVTAGAMTLVSFVVVGVAPRTVGRQHAYAVGRAAAPLVRWLGRVLNPLASLLILIGNAVTPGRGFPEGPFGSQVELRELVDLAEQRGVVEHGEREMIHSVFALGDTIAREVMVPRTEMVWIEAPKTLQQALYLFLRSGFSRIPVIGESVDDVLGVLYLKDVIRRTQNGDPAAAAQAVADAMRAATFVPESKPVDDLLSEMQAARNHLVIVVDEYGGTAGLVTIEDILEEIVGEITDEYDVERPPIEHLDDGAVRVAARLPIEDLGDVFGVELPTDEVETVGGLLAQTLGRVPIPGAQADVGGLHLIAEGTAGRRNRIDSVLVRRVPPVTPTDDNDENVTENEERLPADA

SEQ ID NO: 9665 - protein, 358 aa, Actinoplanes utahensis
MTGTPNPSSTGSSSPVRAQTKISVSDPKIMVNLLGAKDEILRLIERTLSSDVHVRGNEITITGEPADNATAERLFSELIELIEKGETLSVDAVRRTLRILEDTTSERPAEVLTLNILSRRGRTIRPKTLGQKHYVDAIDENTIVFGIGPAGTGKTYLAMAKAVQALQAKQISRIILTRPAVEAGERLGFLPGTLTEKIDPYLRPLYDALHDMLDPESIPRLMAAGTIEVAPLAYMRGRTLNDAFIILDEAQNTTPEQMKMFLTRLGFGAKIVVTGDVTQVDLPGGTTSGLKVVREILRNVEDVHFAELSSSDVVRHRLVAEIVDAYARFDAEQEQQQAANSVHAVPGRAANGRAPRRR

SEQ ID NO: 9666 - protein, 454 aa, Actinoplanes utahensis
MTGHHPRYERAVRRAQADGRIPALSVALVRADRDPWVCTVGESGTPGRPLGPDSRFRIGSVTKTFTAVLVMQARDDGLLDLDQPVSRYLDVPAHGDATIRRLLSHTAGYQREPHGDVWDTLISPDAARMLAELDRVERVLPNARRYHYSNLGLAVLGQLVAKLRGGTWAEILAERVLAPLGLTRTTVDRPAEAVVGYLVDAYSDAARPEPAIDLGGVAPAAQLWSTATDMARWAAFLADPHDDRVLAAATVEEMRWPVTTTDEALWAQGFGLGLILAPEGRRVTHVGHDGAMPGFLAGVYGRRGGEGNPGGLGCAVLGSSGTAGQTIDLAHELLRLAVETDPAEIRPWRMAAPAPAAYRSILGRWWSEGSDFVFGWHDGRLQARLAEAPADRPPAIFQPLPDRPDVLRTVSGREAGELLRLTRDDSGAVVRMHWATYRFTRDQQTFDGGLASDG

SEQ ID NO: 9667 - protein, 851 aa, Actinoplanes utahensis
MGRRLRVDVPEGDRGLGAVHDGRGDLAGDDAAEQAGVVHPSDLMRPPGRLEWVPEYPTPARERSHMTDVDHLLDRLTLDEKVSLLTGQDFWSLPAMPRIGLRSVVMSDGPVGVRGTGWAPENPSIALPSPTALAASWDPELAVEAGRLLGQEARAKGVHVVLGPTVNLHRTPLGGRHFECYSEDPLLTGEIAAGFVRGVQEHGVGTTVKHLVGNDFETERMTVDVRIPERALRELYLAPFERVVEAGGWGVMSAYNGVNGASMAQNGRLQDEVLKREWGFDGVVVSDWRAARDTVGAALGGLDIAMPAMDNPWGPRLAAAVRSGQVPVEVVDDKVRRLLRLAARVGALGAPPVVTAAAVDGGEVAHRVAARSFVLTRNRGVLPLPPERTGGIAVIGALAQDARVLGGGSAQVAPPHVISPLDGIRRVFGDVAYAVGADPRPFLPAAQGPGWSAFTIDLGAYRFEVPTAAVRWLGDPPGGLAVPDVTTLELTTTYTPEIGGEHVFAVSGFGTFQLTVGGQELYRGSLHPPGTGRADLLLHPREQRFPVRLAAGEPVRLTLRQSFAPGTAHSAGTTLGHRPPGPDADGLIAEAVDLARHCDVAVVVVGTTEQVESEGFDRTSLALPGRQDELVARVAAANPSTVVVVNAGAPVLLPWADEVAAVLLTWFPGQEAGAALAAVLSGAEEPGGRLPTTWPRHETDCPVLTVQPRDGVVTYDEGIFIGYRGWRAAPLYAFGSGSGYTTWEYSGLTATATEVAVTVTNSGQRAGREVVQIYLSARDDGAVERPERWLAGFASVTADAGERVTVRIPLPERAFQVWTDGWRTLPGRYTVIAAHALDDPRLTAEIEKPQA

SEQ ID NO: 9668 - protein, 479 aa, Actinoplanes utahensis
MNHRTPLLRLAVPNYVALLSGVLTGIVDVAWVARLGPSPVAAVAVATGVENALLGIVLLISGGVTVRLAAALGAGDTHTGRDRPGGATAGGATAGGEAGALAVIRAGWRLYLVITPVVVLAGTALRGTLAGAFLADPGAARLAGAYLAVLFPGVAIFYAQQVVDAIFAGRGDTRTPMRLALTANALILVLDPLLIYGAGLGVTGAALATAAGRAVALTGGLVRLHRGRPGGRLRPDAALPVRAVARTGAPIAGDFLVRMAGALVLLAVVGRHGVAAVAAYGIGLKVLYFATMGFYAIRNAATIHTPRTLSARPGQRAAIGRQVLTLALVAGIGASALFAGFAPLIMRLFTADRAVAAAGVLFLRCVGGYLVPIAAVIGLAGFLMAAGRGARLFAVTVAGTALQTLLALWLPARLGLPGVWLAMALAAVFQLLLVLASANLRDHPAAAAEGGGPVGTEAVKPAVSRSRRSAGDRPERAPR

SEQ ID NO: 9669 - protein, 174 aa, Actinoplanes utahensis
MLALAILGFLHDEPLHGYELKDRIRSLTGHVRAVSDGALYPAINRLTAAGLLERRTEPGTSAAPRQMLSLTGAGRAELLSRLRSPSEVEITDRNRYFTILAFLRHLPDPADQAEVLRRRLAFLAAPATFFSQGGTRLRAADVSDPFRRGMFEIARATSQAERAWLERTLATLTP

SEQ ID NO: 9670 - protein, 256 aa, Actinoplanes utahensis
MVRGGAGGSVRGVSAPLFLVENLPSGSFFTLDGAEGHHAATVQRLRAGETLILADGRGGTAFAEVVAVGKGSVDVAVGERGQEPAAAPRLTVAQGIAKGDRGELAVQAMTEVGVDEILPWAASRSVAQWRGDRGHRARDKWASTAREAAKQARRSWLPLVGGDPDCSTKQIGARIGEASAAFVLHEEATERLSTVGLPDAGDIVLVVGPEGGISDAEVTAFRDAGALPVRLGSTVLRTSTAGVAALAVLATRLGRW

SEQ ID NO: 9671 - protein, 425 aa, Actinoplanes utahensis
MGSACWGRPGWTTPAPSLLFVQWHATLATCWHRIDGSAQTLRTPNPVAKDYYGILGVSREATDDEIKRAYRKLARQYHPDVNPDPEAHEKFKDINAAYEVLSDDQKRQIVDLGGDPLAPGGGMPGGGPGGAGPFVGFQDIMDAFFGTAAGGGSRGPRPRTRPGADAILRLELDLVETAFGVEAPITVDTAVLCTQCSGAGTAPGTHLATCEVCGGRGEVQSVQRTFLGQVVSSRPCQNCSGHGTVIPTPCPTCAGDGRIRTRRSLTVKIPAGVEDGMRIRLAQQGEVGPGGGTAGDLYVEIHERPHDVYSRKGDDLHCRVTLPMTAAALGTRMTIKTLDGEENIEVKAGTQPASTLRIRGKGVPHLRGQGRGDLFVHLDVKTPTKLTADQERMLRDFAKTRGEDIAELSKQGGFFSRMRDAFNGH

SEQ ID NO: 9672 - protein, 340 aa, Actinoplanes utahensis
MSLDDRKLEVLRAIVEDYVKTREPVGSKALVERHQLGVSSATVRNDMAVLEEEGYIRQPHTSAGRVPTDAGYRLFVDRLTRIKPLSPAERRAIERFMVGAVDLDDVVHRTVRLLATLTRQVAVVQYPSLSRSSVRHLELVPISTTRLMLVMITDTGRVEQRLVEMPAPVPEGDVWDLRRRVNEKLAGQRLADTPPLVQKLVEECAPERRGDMACLATVLLETLVDRSEERLALAGTANLTRGGVLDFQGTLRPVLEALEEEVILLKLIGDLEPSTTRVRIGDENEIDNLRSASVVSTGYGPGATIVGGLGVLGPTRMDYPGTIATVRAVARYVGDLLAQN

SEQ ID NO: 9673 - protein, 127 aa, Actinoplanes utahensis
MAEPKQYGRQPRPGYSLERNWVMTAHVGGAAGALLGGVAGWVAPLLALLNQGGRSPTVRAAAVQALNFQILWTIVALVGWATRWLAVGTVIVPVAAAVAVIFGLIAGTRALGGEPYDYPATARFIRE

SEQ ID NO: 9674 - protein, 400 aa, Actinoplanes utahensis
MAGALPDGEPVPDDGSLPDDATRDVGGRGFAVYVHVPFCASRCGYCDFNTYTASELGGGASRDEYAGTVLRELELAARVIRPARVDTVFVGGGTPTLLSPADLGRILEGVDRTWGLAAGAEVTTEANPESVDPAGLRALRAAGFTRISLGMQSSAEHVLRVLDRRHTAGRAPAAAEEARRAGFEHVNLDLIYGTPGETPEDFDRSLRTVIDAGVDHVSAYALIVEDGTRMAGRMRRGELPYPSDDVAADRYLAAEQALTAAGFGWYEVSNWARPGGNCRHNELYWTGADWWGLGPGAHSHVGGVRWWNVKHPSAYAGRLQEGLSPGHGREVLTAEDRHVEDVMLRVRLREGITLAKVDAKAAKQALDDGLLDPEAYAAGRLVLTLNGRLLADAVIRDVIP

SEQ ID NO: 9675 - protein, 258 aa, Actinoplanes utahensis
MELVRTVTDAGVTTLTLDSPANRNALSRALITQLLAALGAAAAAPGTRVVVLSHTGPVFCSGADLKETAATRPGERLPVELMADLLAALWEFPKPVVARIAGPARAGGLGLIGAADIAVCAESATFAFTEVRLGVIPAVISATVLPRLSARAAAELYLTGDVFDGRRAAEIGLVSAAVPAEALDDAVAGYCASLIRGGPLALAGTKQLLRRARSESIRAELADLSDRSAGYFTSPEGREGVAARQERREPNWVPTQQE

SEQ ID NO: 9676 - protein, 282 aa, Actinoplanes utahensis
MKAVIGVVGALVLIAVVSVVIVLHQAPGVIKLPRLGPECTVSADGEVTLDSVQMANAATIAAVGVRKQMPEQAVVVALATALQESKLENLDEGDRDSVGLFQQRPSQGWGTIEQIKDPRYAAGRFYTALKKVKGYEQMRVTDAAQKVQRSAYPNAYEKWADESRVLTRALLGRATGAVACTVPGTPVLRGAAAAAALMAGLKLDWGRTLDAASEEAAGLTLSVSNPKSGWRYAHWLVSHASATGLERVRFGDLEWHAPDGKWQQVTTAAARDDGRVVAEVFN

SEQ ID NO: 9677 - protein, 557 aa, Actinoplanes utahensis
MFWGALEWILLGAGGVGAIIHGVRRHRPARKAPWWLLAGSVAVLAAGDVCYSYRQMGTADIFYLVMFGLTALCLLQFTRGGALLGDRARLIDLLALACSTLLVAWVFMIGVDGRLDTVSAPDVIGDLLLTGVAGRLVGADRRNAAAWLLLAGAAGMLAGDIGYPLARGPLTESAYVVLYLCWGLAALHPSMVRLTEPAPPRHSPWRFRWSVLLTLSACTPPAVLLIEALHGEVKDGLVIAITGALTLLLTITRLADSIRQNSQALSREHALRTATAALVAAADRPAVDAAVRAAVIQLLPPAAIRRVSLADELGPTELPIGGAEPATGPSGRAEPTAGPADRGWWLPAADPDDRTLVCPLRLEPLDVARPSGGALVLTGRREDLIAGRDALEVLAGQAALALDRITLVEAVGRRDSDLYLRAVIRNTADLMAVIDADQRIRYASPALRHLLGQDELPPLATLDELIHPCDRARVRGELRSQGDGTIHCALQRDDQSQVLVELTYRDLRDDRLVQGLVLTLRDITGNHDPVERHPYAEPGGDLPAWVNRRSARQRFRY

SEQ ID NO: 9678 - protein, 91 aa, Actinoplanes utahensis
MTVTGIITALIVGLIIGALGRLVVPGKQNIPIWLTMVIGVVAALLGTVLARAFGVADTKGFDWIEFFFQVVLAAVGVALTVGITGRRGLTR

SEQ ID NO: 9679 - protein, 625 aa, Actinoplanes utahensis
MPGPLDPGVNVIGSTDPSRIRNFCIIAHIDHGKSTLADRMLQITGVVDPRQMRAQYLDRMDIERERGITIKSQAVRMPWTVRAGDKQGETAVLNMIDTPGHVDFTYEVSRSLAACEGAVLLVDAAQGIEAQTLANLYLAMENDLHIIPVLNKIDLPAAQPEKYAEELAKLIGVEPGDVLRVSGKTGVGVDHLLDEIVRQFQAPVGDATAPARAMIFDSVYDVYRGVVTYVRVIDGRIEARDRIKMMSTGAVHELLEIGVVSPEMEKAGALGVGEVGYLITGVKDVRQSRVGDTVTGNNRPAKDALGGYKDPKPMVYSGLYPIDGSDYPALRDALDKLKLNDAALTYEPETSAALGFGFRVGYLGLLHLEIIGERLEREFGLDLISTAPNVVYQVVTEDAKEQTVTNPSEFPAGKIAEIHEPVVRATVLVPNEYVGAVMELCQSRRGALLGMEYLSSERVELRYTLPLAEIIFDFFDQLKSKTKGYASLDYEPSGEQVADLVKVDILLHGEPVDAFSAIVHKDKAYSYGTTIAAKLQKLIPRQQFEVPIQAAIGSRIIARETIRAIRKDVLAKCYGGDISRKRKLLEKQKEGKKRMKMVGRVEVPQEAFIAALSTTEAADPKGTKK

SEQ ID NO: 9680 - protein, 92 aa, Actinoplanes utahensis
MEAVAAALRRDREHDGADPRAAIVVAGLRNPCAQIDRFRSGLLKQVLGRDDAGNVVRRAGVMAVVLRGGVIRPGDPVVAEPPPGVTGPLERV

SEQ ID NO: 9681 - protein, 123 aa, Actinoplanes utahensis
MISQTQGMSGDSATVAAVSRNDAYTFTKPNRDEIVLVEGWGVEGDIHAGVNVRHRSRVAADPSQPNLRQVHLIQAELFDEVAGKGFDVPAGGIGENVTTRGIDLLALPRGTILRFGPAPAGAP

SEQ ID NO: 9682 - protein, 177 aa, Actinoplanes utahensis
MRTDDFWAVIDRATTDRPASPAVVAERAVAELATHDPEEIVAWGRHLDKVMAASGTEDLWAAAYLINSGADEAGFDAFRGWLIAHGRKAVAAAVQRPDVLANVEVIKAAADSGAVFEAEEVLGIAARAYEQATGEPLPAEERPRIRPAVDDLWDFDNEDEMRRRLPKLSALFLEPPD

SEQ ID NO: 9683 - protein, 343 aa, Actinoplanes utahensis
MRPITLPDVPYSATAVRPQWHELPETVREAITERLGSPIVAARSAGGGFTRAFAAVLDTEAGTGAFVKAAPLSEPTSQWYAREAAVTSALPPEVTAARPIAMLTVSDWFVLCLEAVDGRIPELPWTRPDLDAALRTWSAAATALAYPSPALLAVGLPRLPDILRDEMSWWSLIAKRREPMPEPARDTIAPARLADLARLERALPDLAAGDHLLHGDLRLDNVLIDRDGRAWLCDWTWPCLGAPWFDTVTLLVSAYASGADTDAVLRAWGAPDDGVDGALAALAGYWLVRAGGGPSSASPHSRQHQRFSGRAALAWLAERRGWSATPPSTPGRPAPEKRGWLRR

SEQ ID NO: 9684 - protein, 88 aa, Actinoplanes utahensis
MANIKSQIKRNRQNEKARLRNKSVKSSLKTVIRKLHEASDAGNVETATTLLRDASRQLDKAVSKGVIHKNQAANRKSAIAKKIASLSA

SEQ ID NO: 9685 - protein, 326 aa, Actinoplanes utahensis
MTRTVRSRRTGAAHQPLYARMLGLRHLSPGGLLCFVFLEGAIALGVLLALAELVSWWGVLVLPMVVAAMVKFNDVVAGWLSPPASAAEPVAARAAVQRAERHTHRPQTAGHAPEWPPVRVRTPVAPPPVDARPTGVVWFPPENGYGRRPVGAPPAGPGVNSGGGPGSAPWNGPGGGSGSAPWNGPGGGSGPGSWNGPDGGSDAGRWNGPSADPGAGSSSGRNASSAGAPHAGRHGPAGPFAPRGQGGPGEPVLAPGSGRPGAVGSAISDGGAAGYGAGVPDGRFAEGGHGRHGGPAVNTAPVRRARTDDVGVRQQMARQSAVRRYE

SEQ ID NO: 9686 - protein, 327 aa, Actinoplanes utahensis
MSDVNAAPPPSLLLVQGDEELLAARAVAAAVAEARVAEPGADVREYEAGQLSPGEIAEMLSPSLFGGRRVLVLRNGQDARKELAAALLAYAKNPDPDVTLIVTHPGAAKGKAFADGLQKAGATVVPAMKLKNDRERIAFVRDEFRRAGGRCDEAAASALLASVGNDLREIAAACSQLLADTDGKVTEAVVARYYKGRAEVSGFTVADAAMIGDLPGALEALRWALHVGVDPVPIADALADGVRTVARVASAGKGNPYQLASTLGMPAWKIQRAQERSRGWTPDGLVDAMRAAADCNAAVKGGAEDRGYALEQAIFAVAAARRGEAVR

SEQ ID NO: 9687 - protein, 888 aa, Actinoplanes utahensis
MTAPPADGSPPTPDGPLPRSGSPQSRSGGSLPPFSGTRPSPGSAHPPSGRPRPAVHPSRSPGRLSPHSADGAGSAGAAVPAGGAASTGGKAVGGRRGRGVPDLRLGGFMAGVWLAALGALHLPARGGLLVGGVALLVAGTCALAGAIWWTEAGGRAPGRGRAEIGPALGWIVIALALGAGCGAVATAARLSVREARPLAGLIASGEPVEVRAVVRDDPRALRGAAGPPTYLLAVDLETVRVVGSGMTMRLSARALVLGSDPGWRGLLPGQEVTAAGKLLPPRPGDLRAAVVAVRRAPRLIGEPSWAQRAAGVLRAGLQRACAPLPADSGGLLPGLVVGDTSRLDPGLETDFQTAGMTHLTAVSGANVAMILGVVLFAVRRTRAGPVLCAAVCGVALAGFVILARPSPSVVRAAAMGAIGLLGLASGRPRVAVPALAAAVAVLLLADPELAADPGFTLSVLATGGLLLLAPAWREALRARGWPAGAAEALAVPAAAQVACGPVIAGLSGTVSLVAVPANLMVVPAIAPATLLGVAAALLSPVWPAGAGFAAWLAHWPAEWLVLVARTGARVPAGALPWPAGVPGALLLAGLTVAFLIAARRAVVRRLAAVVAACAVLGALPVRLLAPGWPPPHWLVVACSVGQGDAVVLPAGTGRAVVVDAGPDPDPVDRCLRRLGVRQVALFVVSHYHADHVGGVDGVFRGRAVAAVVAPDWPEPAGGRRQVAEAARAGGTPVLTVGPGWAYEVGGVRLVALGPVEPLRGTNSDPNNNSLVLRATLGGRTVLLPGDAETEEQNDLVARVGAAGLRADVLKVAHHGSALQSPELLTAVDPAVALVSVGVGNDYGHPNLSLLARLARDGARVMRTDESGDLAVVTQVGGLAVTARGVNDR

SEQ ID NO: 9688 - protein, 293 aa, Actinoplanes utahensis
MGAPSSSVPPFMSAPPAEAPFDERYSWTAEEPPVAAEPGLPGAGAFGADESGPRRWLNAFDPGRPGVRALFAVAVMVLLIAGFLAWRARPRVDPVGAGSGGPGTGVAGTTGSGRSSGSGVSGSGSGGARPDSGAGSGAAVGPGGMTGAAAEVVVAVGGKVRRPGLVRLAPGSRVADALAAAGGAEPGVDVAALNLARKVTDGELIMVGVSPPPGAAATAGTGPAASGTAGGLINLNTATLADLDTLPGVGPVLAQRILDARTAQGGFRAVSDLRKVDGIGDARYDQLKELVTV

SEQ ID NO: 9689 - protein, 258 aa, Actinoplanes utahensis
MTRNEAISLLRAAGCVFAEEEAAVLFEAAPDDATRRALVGRRCGGEPLEQVVGYADFCGVRVHLRPGVFVPRVRSELLVRTAASEATTRAGDDHPGPLVVDLCCGSGALGLALRTVVPRIDLHAADLDPVAVACARHNLGQNVHQGDLFTALPARLRGRIEILIANVPYVATPHLPFLPAEARDHEPRTALDGGDDGLAVFRAVVAGARSWLAPGGLLLSEITEAQTAPAAAVVAGYGLTPDVITDDDLDARVITARR

SEQ ID NO: 9690 - protein, 344 aa, Actinoplanes utahensis
MGLFRRVARARLARRVIRRLRRAGVRGARYHRAGFEVRFTLPGEPEPTILPLAALAGRKRREVRDHVAGILRTADLPLRWADAAPLLRPVLRGGAPGAPLHRPALPFLSEFVVVDHPDTMTYVSPAQLAAWEVTAEAVFATARANLPGASLHGAPSGRPVVVRFVDDGNAYWTSHLLLPGWLSRLSGQVGGVPVAFAPERGTLLVTADGTELLPALFAQAEEIFARSSRSLTPMAYVSDPDGCTVPYPAPPGHPLHAVVARAERILAVEEYSRQAAGLPGAAEIELAGERTRALWPRNTPVLLPTADEVRLGDRVVPWADLALTPVEGLSPARWRAEGWPEGAG

SEQ ID NO: 9691 - protein, 282 aa, Actinoplanes utahensis
MTIAVVTDSTAYLPAELNGRYDLTIVPLTVVINGWDGLEGLEISPAEVARALGGRRSSVSTSRPAPSQFAEVYRELLAGGADGVVSVHLSAKLSGTYEAAQLAAAEVGSRVMVVDSGTAAMGLGFPALAATTAAAQGHDLETVHRITVEHAARVSTLFYVDTLEFLRRGGRIGAASALLGTALSVKPILHVVDGAVVVRDKVRTAGRALSRLVDLAVEAAGPGEADIAVHHLQTPERASALVDAITMRLGDRLRDCYLTEVGAVVAAHTGPGLAGVVVHRRD

SEQ ID NO: 9692 - protein, 137 aa, Actinoplanes utahensis
MATPGVQRGRALAEPSAVRRRPIGMIRRNLLPATLLLAIAGCAQPAQTGQPGAGTPSSPAPVPGNTAAGTTISGTVAVGTEPGCLLLQNHLLIISDPEQRKQLTEGSRVRVTGVPQPGLMTTCQQGEPFAVSSVTPG

SEQ ID NO: 9693 - protein, 225 aa, Actinoplanes utahensis
MEGLPDHSVRRPGHGRRGRGRHRHPVTRLIVWRHGNTDWNAERRVQGQADVPLNDLGRRQAAEAAAVLAERQPAAIVASDLTRAASTAAALSAVTGLSVSHDERLRERFFGEWQGLTTAEVASRRPAEFARWKAGADVVGGGVETLDDLGKRVSDALHDAAALAPGETVVVATHGAAARQGVGQLLGWPREQVRTLRGLHNCHWFELTHEEGPGWQLLAYNVGVR

SEQ ID NO: 9694 - protein, 134 aa, Actinoplanes utahensis
MPVTERALELAMTAAQAAADKKAQDISVIDVADQLYITDAFVIASAANERQVIAIVDAIEEALVNLPEKAKPARREGERQGRWVLLDYVDIVVHVQHAEEREFYALDKLWKDCPTIPFVDRDMVDAGAAGTDTP

SEQ ID NO: 9695 - protein, 201 aa, Actinoplanes utahensis
MSARRIGIMGGTFDPIHHGHLVAASEVQARFELDEVTFVPTGQPYEKGRVSPAEDRYLMTVIATASNPRFHVSRADMDRDGPTYTVDTLRDMRAVYGQSAELYFITGADALARIMSWRDALTMLGLAHFIGVTRPGFELSAANLPADRVTLVEVPAMAISSSDCRQRVASGSPVWYLVPDGVVQYINKRGLYLDSGNVGPA

SEQ ID NO: 9696 - protein, 500 aa, Actinoplanes utahensis
MEWSAELSSGLLQAAPDAILVFDGLRIALVNDRAGQLYGWPTTELVGQSLEVLLTEESRALVRRRQQVIDTSPPGSIGTVTTTARRRDGTEFPVESSTTIVETPQGRLAVAVVRDLTERIRVDQEKARLRAEAHAHRSQRLESLGQLAGGIAHDFNNMLGVILNYANFVIEEAESPQPDLKAIAADAQQVVRAGTRGTDLTHQLLAFARREVVRPQPLDLNTVLTEVEDLLRRTLGEHVTLIVRPGPDLPSITFDPGQIEQILVNLAVNARDAMPSGGNLVIDTHRLGDRVRLRVCDSGRGMTPDVLDRAFDPFFTTKPKGEASGLGLATVYGVVAQAGGEVSLTSEPGLGTTVTVLLPAGEENAPAAETAEPAVTRGNGETVLVADDEDGLRDVAGRILTAAGYRVLTADCGRQALDLAAEHTGEIDLLLSDVVMPGMLGKELAERLTDARPSTRVLYMSGYAQPVLASQGTLDPGVELLEKPFTSNDLLAAVRKRLDG

SEQ ID NO: 9697 - protein, 834 aa, Actinoplanes utahensis
MIVVMPTLTRAEAADRASLVDVESYHVDLDLTGDGETFRAVTVVRFRARAGAATFLEFEPVAIASITLNGAPVPIAAAGGGRLALTGLAEENVLVTDATMGYSNSGEGLHRYTDPADGSVYLYQHLFINNGGRVLPCFDQPDLKASFRVSVTAPAAWTVATNGRLVSRDGGRWEFASTERIATYLASLIAGPWHARTDEHDGIPLALYVRATLADQLDAQAPEIFEVTKRCLDRYHEMFEIRYPFGHYQQAFAPEFNFGAMEYPGLVVFRDEYIPRSAMTESEREYRASVIAHEMAHQWFGDLVTMAWWDDLWLNESFAEYLGSRVAAEATRFTGTWTTFAMHRKAWGLRADQRPSTHPVAPSEVTDTDQALMNFDGISYAKGASVLKQLVAWLGDEAFLAGLNAHFEAHRFGNATLADLLGALSKGSGRDLSGWAELWLRRAQVNTLRVEVTRDGAAYREVAVLQTAPDDFPTLRPHRIGIGLYDHAPDGTVTRRELIEVELEATGRTVLPALAGVRAADLLLLNDGDLAYAKIRLDDASAAAVPLLLPLITDSLARAVIWAGTLDAVVDGERPVAELVTLVLAALPVETETVIVEDVLRATRGLVDRYATAETRPAACEMIAQAADRLLAGSAPGSSRQLVAARGLIGAGIDTARLRGWLTGAGVPAGLVVDADLRWLIVYRLAVLGAAGPDVIEAELAADRTVGGEQWAARCRAALPDPAAKRAAWSAVVGDAGLSNRMAELTALGFWQPEQRELLEPYVERYFTDMPEMMRIRSGMAAEKAAIAAYPAVMVAERTRRLAAGLLARPDLHPLLRRVVQDHDDDMRRALQAC

SEQ ID NO: 9698 - protein, 329 aa, Actinoplanes utahensis
MTTTVTAAPASTRRLSGFQPTGHLHLGNLLGALRPLIAAQGAAESIALIADLHAMTVDHDPGEVRRFTLEQVSVLLAAGVDPERTPIVLQSQVREHTELHYLLECAAAYGEAARMIQFREKSAAGGPVRLSLLTYPVLMAADILLYDVTQVPVGEDQNQHLELARTLATRFNSRYGATFTVPEGVRPDATARVMDLAEPTTKMGKTTGTGRIGLLDSPDVIRRTIARAATDTLGVVRRDREAQPGVTNLIDILAGITGARPSDATSYAALKREVTEAVIALLAPLQARHRELQAHPDFVRGVLTAGAERVRPIAAATVSRARQAIGLLD

SEQ ID NO: 9699 - protein, 149 aa, Actinoplanes utahensis
MLIESRPALDPELAALVTAQQRELAGSATGAGKMFEPHDDVAYLIGVVNSRAVACAAWRALEDGVAELMRMYVRPAHRGRGLAREMIVAVEEETLAAGRPVIRLETGVHLPAAIALYQSSGYRQIPAFGHYAGNPGSVCFEKKLPALVQ

SEQ ID NO: 9700 - protein, 498 aa, Actinoplanes utahensis
MTTFVDRVVLHLQAGDGGHGCVSVLREKFKPLGGPDGGNGGHGGSIRLVVDPQQHTLLDFHFHPHVKASNGGGGAGANRDGANGKDLVLKVPDGTVVQTADGEVLADLVGAGTEFEVARGGRGGRGNRALANTRRKVPGFAELGEPGDQLDVVLELKSVADVGLVGFPSAGKSSLIAVLSAAKPKIADYPFTTLVPNLGVVQAGEETFVIADVPGLIPGAATGKGLGMQFLRHIERTSVLVHVLDSATPEIERDPLADLDAIEAELAAYGGLEDRPRLVVLNKIDIPDGRDLADITRPDLEARGYQVYEVSAVTREGLRELTYALAKAVAEFRAAKPVVEATRLVLRPRAVDDTGFTVERDDDGVYVVRGAQVERWIKQTNFDNDEAVGYLADRLERLGVEDKLGKLGAQAGDPVRIGAREFDWQPNAGEFVSGPRGTDARLEEQDVRPSAAQRLAARKARRIRNEDEVLHMASDGTVTAVANPQVPVLITDEDDTDE

SEQ ID NO: 9701 - protein, 85 aa, Actinoplanes utahensis
MAHKKGASSSRNGRDSAAQRLGVKRFGGQLVKAGEILIRQRGTKFHPGDLVGRGGDDTLFALAAGNVLFGTARGRKTVSIVPVAE

SEQ ID NO: 9702 - protein, 104 aa, Actinoplanes utahensis
MYAIVKTGGKQYKVAEGDVIEVEKLVGEPGDALTLAAVLLVDGDNLVTDAAKLANVTVSGEIAEHTKGPKIRIHKFKNKTGYHKRQGHRQPLTRVKVTGIKSGK

SEQ ID NO: 9703 - protein, 60 aa, Actinoplanes utahensis
MDSFSYALRDMAKLTSDPKVKKALDAMGRQVTALKGDVAKIDDKKLADLHAELDAACGRG

SEQ ID NO: 9704 - protein, 625 aa, Actinoplanes utahensis
MAAAAEQPVLDEIDESDESADDAEDGVEDDGDDDEAGGRRRRRRGRRGRGRGKGPSDEADDADLDAEESEGEAEAAHDEEAEDEESEDGEGGVTRRRRRRRRKGSSGDGETGGIEDGVHTVVRVREPRRSDEVQGVSGSTRLEAKRQRRRDGREQRRTRPPILSESEFLARREAVDRVMVVRQKPDRIQIAVLEDGVLVEHYVARATSGTMVGNVYLGKVQNVLPSMEAAFVDVGRGRNAVLYAGEVNWDATGLEGRARSIEQALRSGDSVLVQVTKDPIGHKGARLTSHIALSGRHLVYVPNGNASGISRKLPDNERKRLRDILKKLVPDGAGVIVRTAAEGASEDELARDVKRLQAQWEDIQARAAEGNAPRALSEEPDLVIRVVRDLFNEDFRELIVQGEQAYAEVENYLHSVSPDLVERLHRHVGVGDVFAENRIDEQILKGLDRKVFLPSGGHLVIDRTEAMTVVDVNTGKYTGAGGNLEETVTRNNLEAAEEIVRQLRLRDLGGIVVIDFIDMVLESNRELVLRRLTECLGRDRTKHQVTEITSLGLVQMTRKRIGAGLLEAFSETCDHCKGRGVIIHHEPVPERRSNGGGAAPAATQVKAVAAAARTEAPPAQPALAS

SEQ ID NO: 9705 - protein, 221 aa, Actinoplanes utahensis
MLDNEPPVTLGEQGGERDGAATPPVDAATGTTPARRTRAPRRKAAAPGAEEVAETAAAAPAEVVEPTPAPVKKATRSRRKVAEPAPEAAPAAAAEEAAAEAVAETAEKPAPVKKATRSRRKVAAPPAEQLEIPPAAEPSPAPVAPVAPPESPEVPIVGILPLDDDFLEPAEEEPAEEQPAEEQAAAEAEPAGQRPARARKAPLPPPVLFMPPEATEVAPAS

SEQ ID NO: 9706 - protein, 251 aa, Actinoplanes utahensis
MGGQAPVVQRIRLRYAKRGPLRFTSHRDFARAFERALRRAGVPIAFSQGFTPHPKISYASAAPTGVGSEAEYLEIGLQSEVDPEQLRLALDAALSPGLDVLEAVRAGEGSLADRIDASQWRLELFEVDPAAARDAVEAFLSAGEVLVERMTKQGRRTFDARAAVTRCMVVAEPDLPSGAGGVPCAIIDLVVRQVTPAVRPDDVLSGLRVVAGLEPPVPPRVTRLAQGTLTAQGEIVDPLEADREGVGIGGH

SEQ ID NO: 9707 - protein, 647 aa, Actinoplanes utahensis
MSVSSVFPQLEQLLPRVSKPIQYVGGELGAVVKDWDATVVRWALMYPDAYEVGLPNQGVQILYEVLNEQPDVLAERTYAVWPDLEALMKEHGVPQFTVDAHRPVKAFDMFGVSFATELGYTNLLSALELAGIPLSSADRTEDDPVVLAGGHAAFNPEPIADFIDAAVLGDGEEAVLEITGIIREWKAEGRPGGRDELLLRLARTESIYVPRFYDVDYLPDGRIQRVVPNRPDVPFRVAKRTTMDLDAWPYPKKPLVPLAETVHERYAVEIFRGCTRGCRFCQAGMITRPVRERSITTVAQMVKEGLEFSGYSEVGLLSLSSADHTEIGDMCSGLAEQYKDTNVSLSLPSTRVDAFNIDLAQELSRNGRRTGLTFAPEGGSERIRKVINKMVTKEDLIRTVVTAYSNGWRQVKLYFMCGLPTETDEDVLEIAGMAHEVIRAGREAAGTKDIRCTVSIGGFVPKPHTPFQWASMERPEVIDARLKMLKQAINSDRSLGRAIGFRYHDGEPSLIEGLLSRGDRRVGQVIRRVWEKGGRFDGWSEHFSYARWVEACAEVLPDLGVDLDWYTTREREETEVLPWDHLDSGLDKDWLWQDWQDSVSEFEQDDCRWTPCFDCGVCPAMDTEIQIGPTGKKLLPLTPVNGLRVPV

SEQ ID NO: 9708 - protein, 114 aa, Actinoplanes utahensis
MTDQWVSFSKRGVAETVHLRGEIDLANAHDIGRAVVARTTLAEAVLIDLTAVSFLDSAGVRLLDLIVGDLDERGKPIRLVVGERGAARMTLQLCAFRNDLFAIDLDHAADELGG

SEQ ID NO: 9709 - protein, 832 aa, Actinoplanes utahensis
MSESGGPDVTQELRLPWDDDPEDLYEHAPCGYLTTLPDGTVVRVNETFLSWTGYTRAELIGHRRFRDLLAPGCRIYHETHYAPLLTMQSEVHEIALDVLCADGSRVPVLVNSVLERGVGGAPRVIRTMVFNATERRSYETELLLARDVAESSEQRIKALQRIVADLAAAPTEAEVAEAVVRAPEGAFQATSSSIYLVDQDRDQLVAVASTDPTTGNWNDMPRSSQRAVAEVARRGDLHVVHTLAEAAEHFPDLAESMVRSGRSTVVLLPLTTGPAEDHAGVTVLGLLAFSFAEERRLSDGELRVIRLLGQQAGQALDRARLYDDARRREERADFLAVTTRALDEEHRLMQRSRRLVERVVPAIADWATVRLHVGPVGLREDAGGPAPDEARLGARILEATRSVKPIFATEGDPLDCAVLPLTARGRVLGTLALRMAETRHAPETDQAFLIDLADRAGLALENARLYEQERAVARTLQRSLLAADVPSGDPRFALETHYRAAGHDLEVGGDWFDAFLITPHKLAVVVGDVVGRGLEAASTMGQLRSAIRALATAENGPARLLEGLDRFCQRVETARMATVVYGEIDLDACELVYACAGHLPPLLHQPAGPAEFLLQARSGPIGTRAGDRRRTETRIRLAPGSRLLLYTDGLIERRDRPIDHGFEVLNREFSRLRGAPMKGLTMALTDTLAGREHGDDVCLLCLTLGVEERLERTLGADPLQISLLRSDLRSWLASHGVDRECLNAVLLACSEAVGNAIEHGYRDDPFGTVEVSVTITDDAVEIRVADRGTWRGPGHSRGRGLQLIEECMDEMLFDQGEGGTTVTMRRYRGDAA

SEQ ID NO: 9710 - protein, 410 aa, Actinoplanes utahensis
MLGGPGRSVLAGPRVDGGHRRPVLRFRLGSAADPVDQPVPQRPARPGHRHRRGAAPPGRQHAGRFVGKAVRPGVSHGFPSPPLPAAARAFTQVKDGVPDVQRSLIRAPDTNGGQPGRCAERCGVVWLPGPDMRPTSQSSGEGADRMSSTQRNAVTISGRESGQPMLFAHGYGCDQNMWRLVTPAFADTHRVVLFDHVGNGRSDLTAYDDEKYSTLDGYASDVLDILHEHDLRDVIFVGHSVSSMIGLLAAVREPERFAGVVMVGPSPRYIDDEADGYVGGFTRTDIEQMLVSLDSNFLGWSSAMAPVIMGNPDRPELGEELTNSFCRTDPAIAKKFARVTFLSDNRADLARMRVPSLVLQCSEDVIAPAVVGEYVHKHTPHSTLIALNATGHCPNVSAPQETVDAIKSWL

SEQ ID NO: 9711 - protein, 401 aa, Actinoplanes utahensis
MADTRPDGFSDEPTGVLPPRWSGAAPVPVPGPRRSLWDRLVDRVGGAPEPEPENWATMPAVDPWAGQDTPAWTTEHLAPLPEMPPTRLEAPAAPIGTAGPGVPAVPTGIVDRGAPAVPTGIVGQGAPAVPTGIVGQGAPAGKQEKIKALLDALAAKAAETAEARNAKPARGGPAHDVPLNRPQAAAKPPSRGWFRKPPPSAAPPRLPEKPRPRRRLRRLRRLALVLAVLAAAWFAAPLAYERWPVLAQFPVSAALPDRVGDLRLRADPASTKAVDRLADQLRSAGVDGSAFAGVYGDGNGKRVTVYGVTGWRFTPQSDALGQLARIAGDAELSDVADYPLDEPGAFESCGTGRLGGTSTVICTWADHGSMATVLLTRRSPEESAALVARLRGAVLSPKFGA

SEQ ID NO: 9712 - protein, 222 aa, Actinoplanes utahensis
MPLIYTIGKLTVGNTLMVGWKPRIEGLEHIPKTGGAIFAGNHLSVADELFLGAAVPRHLAFWAKSDYFVGKGVKGFLSRKLMEGLGAIRVERAGGRAALTAFDAAIPALKGGDLVAVYPEGTRSPDGKLYRGRTGVARLATAAGVPIIPVGMIGTDVVQPIGRLAPKLMRGTVTVKFGKPIETIGRSSDRTSLRELTDQVMGEIQKLTGQEYVPRYAPKREE

SEQ ID NO: 9713 - protein, 1036 aa, Actinoplanes utahensis
MYPKHTDAQGVPASPDLPAVERAVLEHWAADKTFEASVEQRPAGENGANEYVFYDGPPFANGLPHYGHLFTGYVKDVVPRYRTMRGQRVERRFGWDTHGMPAEIEAEKQLGITSKAQIVELGIDKFNEACRTSVLAYTKDWQGYVTRQARWVDFGNDYKTLDPDYMESVMWAFKTLHDKGLVYEGFRVLAYCYRCETPLSNTETRMDDVYRDRTDPALTVKFRLSTGEDIAVWTTTPWTLPSNLALAVGPDIEYAVLADGAGQKLIVGAGRVAAYAKELDGYEQVGTVRGSELVGRRYTPLFDYLVEPAGENAFQVLGADFVTTEDGTGVVHMAPAFGEDDQNACLAAGIPTVVTVDEQTRFTSLVPDFQGLQVFDANKPVIATLKERGVVVRHDGYTHSYPHCWRCDTPLVYKAVSSWFVAVTRFRDRMVELNQEITWTPAHIKDGSFGKWLSNARDWSISRNRFWGSPIPVWKSDDPQYPRVDVYGSFEELSRDFGVAVTDLHRPGVDELTRPNPDDPTGRSTMRRVPEVLDCWFESGSMPFAQVHYPFENKEWFEHHYPGDFIVEYIGQTRGWFYTMHVLATALFDRPAFRNCLSHGILLGEDGRKMSKSLRNYPDVYRVFDSYGSDAMRWMLMSSPVLRGGDMPVTETAIRDSVRQVLLPLWNVWYFFSLYANAASHEAKFRTDSTHLLDRYILAKTGELVEDVAKKMDEYDISGAAAGVRSYLDALTNWYVRRSRDRFWAGDADAFDTLATVLEALCRVVAPLAPLTAEEVWRGLTGGRSVHLTDWPSADAFPADHELVASMDAIRDVASAALSLRKAKALRVRLPLATLTVAAAHGRSLESLGDLLKDEVNVKDVVFTDDVAAYCQQVLTVVPRALGPRVGKQVQQVIKAVKAGDWELIDGAPVAAGITLAEGEYELKLVAADAENSAPLPAGGGVVVLDAAVTPELAAEGLARDVIRVVQQARRDAGLDVSDRISLIVSASAAVRAAVETHREFVAGETLATSLTFDGVEGFDGEVGDGEQITVGVTAV

SEQ ID NO: 9714 - protein, 138 aa, Actinoplanes utahensis
MSTSTERSLILIKPDAVRRGLLGEILSRFERKGLVIEALEVRTMSPELADQHYAEHVDKAFYPPLKDFMTSGPLAAVVLSGDEVIEVVRAMIGATDGRKAAAGTIRGDLALSNRENLVHASDSPDSAKRELALWFPHL

SEQ ID NO: 9715 - protein, 441 aa, Actinoplanes utahensis
MANQTGRPIAPARKLVAAVMGTLAGFVIVYGLGMKSWPVSIFGLVVLAIAVTLAVVTPGRRGGRATVAGTAEIMDITAPPLAGAYGRAEIRAIVVAPGLGTFDKVIRDGRVPVAKWPVAGSTVPITVDVDDTRRVRVNWKDAPDLGPAGDPPPPVTGSAHSEFHEDPLLPEEEDDDVLGAVAPKPWETRDDDWAAQEPAYEEERATTPVVVRDTPNGPILEGQLVGGEEQVAPLPRRAGSGPRRSGGSFDSAATDPVGFDPLPTDPATPDDPANGEDPATREDPAAPASPAAPTGPVAPTGPAAPASPAALEDPAVPAGPAAPASPAAPHRPGAIRRRVVDRCRRGIAGLRHRGGAGGRRDRPAALFGNGIRPVRVRRRSGPGPDRRRQRLQPVRVGRLLRGLAVGQLPAPARTRGRRPPARRRRLVRLPAPAPAGRHPGR

SEQ ID NO: 9716 - protein, 366 aa, Actinoplanes utahensis
MPATPTGAAAIPVHTASGPAAGTDSDDPGLDGYPPAAFPVSAYAPTDPEPPVPPAPVSTARAEPTPLTAPPTAPEPDRPFPTAPPPATPRPAAPTPVADEIDIPLDDVPESTPEAAPAVAAGIVAPPADPGDIVTPWTDPGDIATPWADPADIVTSPAAEPPAEQSAAAFPATAEPDDAPSAETTAWPVTADSPTAAAGAEGRKGNPWADFAGRPVPDDRTAEVITAYPSARPGPAGAIHGVGITILVTDLARSIVFYRDTLGFFEIDTGDGSSVLASGDTRVVLRTVPNLSAEAGRLIYLNLEVGDIEAVHDELRAKGVKFVHSPRAVNRGDKLELWSATFRDPDNHNIAITQWRAVRPDPTPEA

SEQ ID NO: 9717 - protein, 131 aa, Actinoplanes utahensis
MTGPEENAAPVGDEAGAGPRRSGLRNPEAAVRGLGAGTLALEAIVLLLAIQPIRILGGHLSGWGIGLVIGLAVVAALLAGCMRQRWGWGAGTALQVLLLASGLVHWSLAALGVIFGLAWAYATYVRRSILG

SEQ ID NO: 9718 - protein, 451 aa, Actinoplanes utahensis
MSPAEHSSEHASAYAAVEAALNERGFTRMVFDMQKIRDLMDVLGSPQRAYPAIHLTGTNGKTSTARMIDGLLRACGLHTGRYTSPHLETVRERISLDGEPVSEERLVDTYREIAPLAELIDARNSEPLTYFDMTTAMAYAAFADAPVDIAVVEVGLGGEEDATNVIDAGVCVLTPIGLDHTEWLGDTIEDIAWAKAGIIHKDATVITAVQTEEAMRPILERCAEMGATLAREGSEFGVVQRTQAVGGQVLVLQGLGGVYEEIFLPLFGAHQAQNAALALAAVEAFLGAGPGKQIDIELIREGFAQVDSPGRLERVRSAPAILLDGAHNPHGMAATVAALEEEFSFRHLVAVLAVFADKDVTGLLDLLEPVVARIVVTQNSSPRSMPVQELAQLAANVFGEDRVSIAETMPDAIEEAVVLAEEDASGELSGVGVLITGSVVTVADARKLLKR

SEQ ID NO: 9719 - protein, 879 aa, Actinoplanes utahensis
MTDTTDTRTPDSRPTGGLSAQYQPGEVEQRRYERWVSEGYFTADPKSDKPPFTIVIPPPNVTGSLHVGHALDHTIQDTLVRLKRMQGFEVLWLPGMDHAGIATQNVVERKLAERQLSRHDLGREAFVAKVWEWKAESGGAILGQMRRLGDSVDWSRERFTMDEGLSRAVQTIFKRLYDDDLIYRANRIINWCPRCLTALSDIEVEHTNDEGELVSIRYGEGANAIVVATTRAETMLGDTAVAVHPDDERYRHLVGTEVELPLTGRRIPIVADEHVDPAFGTGAVKVTPAHDPNDFEIGQRHGLPSLTVMDERAVITVPGPFEGLDRYEARPAVVAALREQGRIVAEKRPYEHSVGHCSRCKTTVEPRLSLQWFVNTTPLAKAAGDAVRDGRVRIEPEELSKRYFAWVDNMHDWCISRQLWWGHRIPVWYGPAGEVVCVGPDEQPPTGEGWTQDTDVLDTWFSSGLWPFSTLGWPERTPELAKFYPTSVLVTGYDILFFWVARMMMFGLYAMDGVQPFNVVNLHGIVRDQFGKKMSKSFGNVVDPLDWIDRYGADATRFTLMRGANPGSDVATSEEWCQGSRNFCNKLWNATRFAMMNGATVEGDLPAPSELSAIDKWILSRLQHTIAEVNEQFDSYEYAKVCDTLYHFAWDDVCDWYVELSKPVLAQDTPEAARSRRVLGHVLDQLLRLLHPVIPFVTEELWIALTGRETVTFATWPMVDHALVDDAAEEELAALQKVVTEVRRFRSDQGLKPSQRVSAALTGLGNVGIDTHEPLIRSLARLDAPADGFTATATLAVTGGITVDLDTRGAIDVAAERARLDKDRAAAEKEAAQCRAKLGNEAFIGKAPEAVVAKIKDRLATAEADLVRIATALEALPAA

SEQ ID NO: 9720 - protein, 265 aa, Actinoplanes utahensis
MSDRGHAPPPPAGDAPEPDPAEPDLSRDIEISAVPAAAGPEPADTDAEPLDLTEGEPIELQAGPFSLVPVEDGDDAPLSPRRRRTRTILTGSLLAVGLLGVAGLGWYYWQIHVQRDVTLSLPPSVADMTLDDSPNAKDTADYLQTALNTEIDMDKTVGGVYSGTGEKDVLIFGGTTLIWSPGKDLATSFGLISDKQGTVTGLHDVDPGPLGGSMKCGITRTEGGNMPVCGWADHGSLALAMFPNRSESEAAPLMLQLRKAIQTRN

SEQ ID NO: 9721 - protein, 71 aa, Actinoplanes utahensis
MNPSEASASDGLLDLIVPLWQLVIGVLVLVTVVVSTRKLLLRGPSRMSGALLLVGSAVVGLAVISYLLQTL

SEQ ID NO: 9722 - protein, 264 aa, Actinoplanes utahensis
MRVAVCQLNSREDRAHNLDVARGLLERAAAGGAELAVLPEYVDFLGRAKDAPPPEPVDGEFAAFFATAARELDIWVHAGSFHETGPDEQRTFNTTLVFRPDGSLAATYRKIHLYDVEIAGRVSYQESRTVAPGAETVVAAIGSVPTGLSICYDLRFPELYRQLAIAGAKILVVPAAFMLHTGRDHWEVLLRARAIENQCYVVAAGQIGDHEPGRTCFGRSMIIDPWGTVLAQVADGVGIATADLDLGRLDTIREELPSLANRRL

SEQ ID NO: 9723 - protein, 195 aa, Actinoplanes utahensis
MPDPWLEIVPPPSSDRAAVVSFPGHVVVAAAVEPVWAEKLAGEDFAAPTGPRFLTALEDRFGLHAGAFDVSLLATPLAGDPPLPLTPLNASGHPRALRAHRYRTDVRLWTSQHGLLVVGRGLGGRWEVAFEVDPAARGRGHGRLLAAAARHLIPQDRPIWAQCAPGNAASLRVLLAAGFQPVGSEILLMPPTAGW

SEQ ID NO: 9724 - protein, 429 aa, Actinoplanes utahensis
MARIGDGGDLLKCSFCGKSQKQVKKLIAGPGVYICDECIDLCNEIIEEELAETGEVKWEELPKPMEICQFLDNYVVGQEQAKKALAVAVYNHYKRIQAESNGAPGGSSDVEVAKSNIMLIGPTGCGKTHLAQTLARMLNVPFAIADATALTEAGYVGEDVENILLKLIQAADYDVKRAEQGIIYIDEVDKIARKSENPSITRDVSGEGVQQALLKILEGTVANVPPQGGRKHPHQEFIQIDTTNVLFIVGGAFAGLDRIIEQRVGQGGVGFGARLRSISERNTDDIFSKVMPEDMLKFGLIPEFIGRLPVITTVRNLDREALIKILTEPRNAYVKQYQRLFELDGVELEFDEGALEAIADQAMLRGTGARGLRAIMEEVLLSVMYEVPSNPDAARVLITREVVLENVNPTIVPREFVGRRRHAREEKSA

SEQ ID NO: 9725 - protein, 220 aa, Actinoplanes utahensis
MTDLSMPPGFAPVHNRYVLPSFTERTSYGLKESNPYNKMFEDRIIFLGVQVDDASANDVMAQLLTLESTDPDRDILMYINSPGGSFTAMTAIYDTMQYVRPDISTVCLGQAASAAAVLLAGGTPGKRMALPHSRIIIHQPATEGGYGQGSDIEIQAREIMRMRTQLEDMISQHSGQSIEKVRKDIDRDKIMTAAEAKEYGLVDVVLATRKKSLQTVGASS

SEQ ID NO: 9726 - protein, 211 aa, Actinoplanes utahensis
MTELHIPAGPVSRRGGDSLSGNLDDSVFNRLLRERIIFLGSEVTDAVANRICAQLLLLSAEDPERDIHLWINSPGGSVYSGMAIYDTMQFIDNDVSTVGMGMAASMGQFLLCAGTPGKRYALPHARIMMHQPSGGMGGTAADIAIQAEQMLYTKRMFQERIAFHTGQTQEQIAADFDRDRWFTAAEAQDYGFIDKVITGAVQVPDGAGTLN

SEQ ID NO: 9727 - protein, 449 aa, Actinoplanes utahensis
MKSTVETLSPTRVKLAIEVPFDELKPSLQKAYREIGAQVQVPGFRKGKVPSAVIDQRVGRGAVLNEAVQEAIPQQILAAVQEHDVKTLGRPEVEITEFADNAPLKFTAEVDVRPEIVVPDLSTISVEVPAVEIGDNEIDEQINGLRERFATLKTVERAAAEGDYVQLDLNATVDGEEVPGGSATNISHEVGSKQLLPGLDEVLVGLSAGDETTFTTQLVGGDFAGRDADVKVVVRTVKDKQLPEIDDDFAQLASEFDTLEELRGDLRERLTKVKKVEQIYAARDEALKQLVEAANIPAPEGVVKDEVEGRKQAMTDQLERIGATLADYLASEEKTEEQIDQELTEAAQEGVRIQLLLDTVADAEDVQVTDDEFGHEIVHRAQRAQMQPQQYYDQLVRSGAAAAVFGDVRRGKALASVMEQVTMKDSEGNTLTLDDLRAASEDEHAGHNH

SEQ ID NO: 9728 - protein, 172 aa, Actinoplanes utahensis
MGTRTRVLLRCRYLPSVTSPNEPPDVSRPQVAAGVLFFDEAGCVLLVQPSYKTGWEIPGGYVEAGESPKAACIREVAEELGLSPAIGDHLIVDWAPATGEGDKLLFIFDGGILPERDRARIDFVDGELADWRFVAITDLETYVPARLARRITTAAAARQGARPVYAEHGVAK

SEQ ID NO: 9729 - protein, 351 aa, Actinoplanes utahensis
MTHNDEGGPEDRSSGEFTLRRPLFVLTSETVRPAGRHRPSEKPGVSSSWAGFIAPTGIAPHCTGRAGSAAAADGGGTGGHAPARSLRRPVAVAAGVATAVAVGLIILVPDHDRGAPSATGDGRNGIVVDGPSAMVSTPPGAGTELPGAGSEPATTPASPQPHATQLRKVSSSAAARTPEASRFVAVAGESCPQSADRGYHVSGQASDWYFPSRGGWTSDGCGGRVAAVPMSGSPTRDDRDNVIVWWFRTGTVRTGSCAVGVYVPGTGNPKDAAGEPAHYLLRADDDIDADVVAEFDVDQSANQGRWVDAGRYSVTSGEISVQLVTRGVDWGSGREGDHLGVSALRADCRAE

SEQ ID NO: 9730 - protein, 429 aa, Actinoplanes utahensis
MTPADFLPKATTRKEPPLFENPAVPRIRQRGSTLLVVDGDAEQDLPELPQLPGETHVTTVVVHTTVVPDIPVLRSLLNRGLAPECAAVRLVLPGAGAPGPDGWCAARHLAESLNLPVIAPDGPVIVLPDALFAFGGAWRTFRPGAEPVVDGPRHPAPRWQRTLTPPPQAEAPLRATPIPAGLWLHTADRVVAPDDPVFAVPVDPASVSLVIGRPGDPVLPAAEVAEYIRRLAPTIGDEPLLIPYGSGGHLVDELAVRLPGDAVASVRVDAGMPAVEADDVAVRTVVDAAGRAVWRPPAQQLRFQPGRAPRLLHWRPPLPHASTVGTGLQRLADGWLVEVVRCGLWIRPDREDDDAVRRIPADPDRLLLLVGAPGAPPATEVWPAVRRLLDALPADQRERVQPVLPAGTAQPSGFPAAWRLSPDADAQAR

SEQ ID NO: 9731 - protein, 75 aa, Actinoplanes utahensis
MELRRSGVARGRRLTSWPSVRTDLRNAGAEVVDEPVVTDGNITTSRSPDDLPAFCERILHEFAKAPQPVGAAGRA

SEQ ID NO: 9732 - protein, 129 aa, Actinoplanes utahensis
MAGELNGRRIAILAADGVERVELEQPRQALDGAGARTVVVSIAGGEIQARDHDLEAAGAFTVDQLVGEASVDDDEALLLPGGTVNPDKLRMEPAAARFVRDFVRSGKPVASICHGPWNFVEAASPAGDG

SEQ ID NO: 9733 - protein, 386 aa, Actinoplanes utahensis
MKAVVYEGPRQVSVKEVPDARIERPTDVLVRVTSANICGSDLHMYEGRTDFEPGRWFGHENLGQVVEVGDGVDKVQVGEYVVLPFNISCGHCKNCERQLTNYCLTAQPEPKMAGAAYGFADMGPWAGGQAELLRVPWGDFNCLRLGADAEERQTDYVMLADIFPTGYHATEMAGVQPGDQTVIYGAGPVGLMAALSATIRGASKVMVVDRHPDRLRLAESIGAIAIDDSKVDPVQAVLDQTMGLGADNGCECVGYQAHEPDGREQANLTMNRLVASVRFTGRIGNVGVFVPQDPGAGDELAKQGRLAFDYGMFWFKGQHIGSGQAPVKKYNRQLRDLIAAGKAEPSFIVSHELPLDQAPEAYEHFDKRDDGWTKVVLHPAMAGAGA

SEQ ID NO: 9734 - protein, 391 aa, Actinoplanes utahensis
MRANTWAGRNKVEVRDVPDPKILNGRDAIVRITSTAICGSDLHLVDGYVPTMQDGDIMGHEFMGEVVEVGSGVSADRLRVGDRVVVPFPIACGACAACVAELYSCCENTNPNAGIAEKMFGHPVAGIFGYSHLTGGFAGGQAQYARVPFADVGPLKIESDLTDEQVLFLSDILPTGYMGAEMCDIQPSDVVAVWGAGPVGQFAMDSARVLGAAKVIAIDKEPYRLRMAEQAGHIPVNFDEVDVRSRLLELTGGRGPDKCIDAVGLEATHGSAHIAAYDRIKQAVRSETDRPHALRQAIMSCRSGGVVSVIGVYGGLLDKFPAGAWMNRSLTLRTGQCHVHRYMRPLLERIERGEIDPTRIITHTLPLDEADRGFEMFKNKQDDCEKVVLKP

SEQ ID NO: 9735 - protein, 240 aa, Actinoplanes utahensis
MPGLGDSPRVSARREAVRQAGCRLDESRSGSGATGGSAQATRIERIGPTPVARANHKGGPMELTATTTVRKPAAEVYGFWRDLENLPTFMAHLEQVRTTGDRTSRWTADAPFGKDVTWDAEIVEEIPGERIAWRSTGNADVPNAGTVRFLPAPDGVSTEVHVALTYDIPGGAVGKAVAKYFGEEPHQQLDDDLRRLKQVLETGEVVRSDGAPWGKRARKEFPQRPAQPLSDEELAKGADA

SEQ ID NO: 9736 - protein, 182 aa, Actinoplanes utahensis
MEFLCYHRDRPGSLALRHELTEAHWAYMDRFEKEMIARGPTLSPDRTAPTGSLHIADLSGAAAARAFAFDEPNHQAGVYRDLVLRRWRNALGRTMWDFPGGPVDDNGYLVLGFGAGPAVDLEVPAGRHDLIAYGPLLSDDGATWLGTASLLVASDPEAACALLTRDRYDSVEVHRWAPGGRR

SEQ ID NO: 9737 - protein, 1141 aa, Actinoplanes utahensis
MPRSARGVLTASLVSLGVLTAAAYPAAAFAAPPVVKLPATAGQPARGVIVMLRDQHKDLKVTRSSNSPRALADRKDQAPLLSRARSAGFRDLHGFSNVNAFAGTATAAQIAALTADPSVAAVFPDLPITKTPVAGRPEAAAATRTSPATSKAAQICPTDPSKPLLEPEALQTTNTAFGNPATPQAQSLATGAGVKVAWLADGIDINNPDFVRADGSHVFVDYKDFSEEGPDAPSSSAEAFGDASSIAAQGRQVYDLSTYVNPAHPLPAGCTITVRGIAPGASLVGLKVFGAAPTAPTSRFIEALDYAVNVAGVDVINESFGSNPFPDLGNDPISLADDAAVDAGVTVVASTGDAGLTGTVGSPASSAKVISVAASTTFRSYLQEGYSGARDFSNGTWASGNISQISSGGVTQRNRVPDLAAPGDLGWALCTPNPDVYVDCTDDKGDPASLQNFGGTSQASPFTAGAAALVIEAYKRTHGGDRPTPDLVKRLLTSTATDLGYPASQQGAGQLDTLGAVRAALSFKDGNGAPQAQGTSLVVDRSQLSVAGQPGHTVTSKLGITNVSRNTQTVRLSTRTLGKATSTTNGTVTLNSATAPTFVDSTGIVRSYVIQKFTVGVGADRLDFALTGASAPGALKASLIDPHGTFTSYTFAQGAGNWGHTDVHYPAFGTWTAIIFITKAVGFNGPVHYQVSTSNFARFGTVSPSTVTLAPGASKKVTVSTKLPSNPGDTSASVQLSTPLGVTVSVPLTARTLIPAGRDSNSFSGVLQGGNGRAGAGGNAQSNFYYIDVPAGKKDLGVSVSVADPAVQFSGVLTSPDGQVYSYQSNRYVTAAGEATNDKSLQLYRRNPRAGRWTLALDFTNPQSGAEVSQPFTGKLTFNTVKVSAALPSKATLTAGKPVTVPVTVTNTGAAPLAYFVDGRLTTTGDLPLAEISGAPGTIDLPVPAGIVPQWIVPSESTGVTFQASATLPVNLDVFYNSGEPEVYSAAQGNSAVVKVQAPLVSPGVWAADIGESGPFDGPAPIGTVQVAAVAHTRLFDPAVTSSTGDFWQTALSGAPDSALSSAVRANAKAGRFVTAAGSRAAAAPAPIVVAPGRSATILVTITPSAPRGTTVRGHLYVDTFSQITVSGDELIDLPYSYQVG

SEQ ID NO: 9738 - protein, 416 aa, Actinoplanes utahensis
MASTGARRVSLLAFATLFVVGTDTFLVAPLLPTLSQAFGVGTGVSGWMVSAYALGYAGLALFAGPFSDGRDRRAVLLGGLLAFAVTTALCGFAQGFWSMLLFRFLAGVSAAFVTPQIWASIPVLVAPEVVLRTMGFATAGLSIAQVVGVPVGSWLAAVSWHTPFWVVAGASVLLWLALARLFPSVGSPSAGGIRQTYAAVLRDRTLVLYLLAYLVFQTGNFEAFSFIGSWLTRDFRLGVAEVGTAMIALGLGNTAGALFGSRLVRRIGQRTALLTAYAILMLCYAMLPFAPGLGIAVTLLTVIFLVGGFIFPVFMTMLQSRATAARGTVSSLSNAAMYAGSTVGGVAGGVLLAGVAGFHGVAAFTVVAYAVSLGVFAAAGALKRQPSPGSAARETAAPAPRCGPSRNDACRTAGSA

SEQ ID NO: 9739 - protein, 207 aa, Actinoplanes utahensis
MVERGTSRRAEHLTPVAQPETEAPPVLADELLRAVGRGDEQAFGRLYDLVAPRVYGLIRRVLRDPAQAEEVAQEVLVEVWRTAARFDPARGSATAWVFTIAHRRAVDRVRAEQSASDRTIRAGAAALDTPYDAVADEVSGRLERQQVRRCLDVLTELQRQAVTLAYYQGHSYPQVAELLKTPLPTVKTRMRDGLIRLRDCLGVEVTA

SEQ ID NO: 9740 - protein, 250 aa, Actinoplanes utahensis
MIADIHSLVGAYALDSVDDLERAAFERHIGDCEACRIEVAELRETTARLADSTWSAPPPRLRENVLAAIATTRQAPPLTAATPSRERAATRARMSRRQLFSAAAAVVVAAAGAGTAVYTIQDQRVRDERAAAEADRDLQARVRAILGSPDVVLRGEQLRDGGRVTVAYSRLRDAGVVTLAADGPPSGGRVYQLWTVRSRVPVDEGALPVGQSSVVKIVERMSSAEVVGVSEEPPGGSARPTDMVAGVKTI

SEQ ID NO: 9741 - protein, 214 aa, Actinoplanes utahensis
MRATKLTALAAATVFAISLAACGSDSDSNSGSGTAAAPATTAAMPSAAPSMATDPTVNFGPGCAAVPADPSNAGSFQAMAKVPVATAASGNPLLSTLVSAVKQAGLVDSLNSADGITVFAPTNDAFAKIPEATLKKVLADKKTLTSILTYHVAKGKLTPADLAGSHETLQGGKLTVTGSGEDFKVDGTASVICGNVQTANANVYIIDSVLMPKK

SEQ ID NO: 9742 - protein, 42 aa, Actinoplanes utahensis
MSLPGRGCEEFRGRDPVVAATIPLIVAAGLPPVTSSASGRSR

SEQ ID NO: 9743 - protein, 123 aa, Actinoplanes utahensis
MIDAAPVAVKDFAVRGWGVPDKPALLAATALADPARGGDRADGEAVAPARDRGRNRSPGGRGGGDADPAAQFRAAIRLPAPARPVPDGGAPRPLTTTGHLYRVDTALTVPRIAAASAGCASTA

SEQ ID NO: 9744 - protein, 63 aa, Actinoplanes utahensis
MRAGADRILARSADGMTVGTSLSTALDGRDTMPAVGMNGEPLPLDPAYPSGSRRPAPHRSRTG

SEQ ID NO: 9745 - protein, 106 aa, Actinoplanes utahensis
MTDDDRVFKALADPSRRFLLDLLFVRDGRTLTELETELEMTRFGVAKHLRVLEEAGLVVTRRSGREKLHFLNPVPIRQIHDRWIDKYTEHQITTLIDLKRTLEEES

SEQ ID NO: 9746 - protein, 168 aa, Actinoplanes utahensis
MSETKVFRIWIKATPERIWQAITDPEWNAKYGYATPQYFELTKGGRYHSTANQGMLDYAAAQGFELPDPILDGEVLEAEAPRRLVQTWRMLMDPGTAAEGFTTLTYEIEDSAPGVCRVTITHDVTDAPAVGAMVSGNPDPAAEGGGGWAWVLSDLKSLLETGKVLADA

SEQ ID NO: 9747 - protein, 32 aa, Actinoplanes utahensis
MTVFWFILLGLGTAMSGTAIWLAARDRRRGRG

SEQ ID NO: 9748 - protein, 298 aa, Actinoplanes utahensis
MRDPRVGVVVITWQRREEALACVERLLALPEQPPVVLVDNGSTDGTAGAVRAAFPQVDVIAAGRNLGAVGRNLGVRRLTTPYVAFCDDDTWWRPGSLARAADLLDAHPRLAVVNARIVVEPSGAEDPIVAELRDSPVPAPDWLPGPALGSFLAGASVLRRDAFQQAGGFSARLWLGGEEELLATDLVSAGWELCYREDLTVHHHASKLRDATHRRRVGLRNTLWFTWLRRPLAPAVRRTLFLARTVPRDRTSLLAACDAARGLGWLLAERRARPHRVEVRLASLDEAQRRSAARRYVG

SEQ ID NO: 9749 - protein, 203 aa, Actinoplanes utahensis
MPEQPQWSERTLDMPPQDPWADQPTSPVHEFDATQPTPVSPHPPASPQSPFSQGRAQVNPRVHREPEPTATHEPTGTGWPGAQPPRPRHSLRWHVDQLRRGGEWSTAAALFVFVCWGIWALSGSGSLSLPLTALLLTLLVGVGVFALARLVGRLVLERYLNRTRHTARGAHLVSGLFLVVAGFAFLHQTEWVMTAFDWVKHVF

SEQ ID NO: 9750 - protein, 403 aa, Actinoplanes utahensis
MDGIDIRRGSSADIPAVCDLIGIVFHEDLTDEGRQDEAEVFEPDRSLIADDRGVVAGHTLTHSRHLTVPGGVLPAAHISSVGVLPTHRRRGILTALMRRQLTEIAAGPEPIAVLWASETSIYPRFGYGLAAHRFKLSIENREVRLPDRPAGRLRMGDPGDLRDDLVKMYDAIRPQRVGWSDRDDRWWRHVLRDMESHRGGATRRRAVVHDGADGSPTGYALWRVKPRSTAHGPACEVQVREVVAADPQTYLALWRFLLSIDLSRTVTFDLAAVDEPLQYLVDEPRRLGPEFSDSLFVRLTDLPAALAGRRYAAPVDVVLEVDDPVLPANAGRWRLTGGPDSATCVRTGDPADTVCSVTDLGAAYLGGTSLSALAAAGRVRQLTANDPGVAFGWHRAPSVTETF

SEQ ID NO: 9751 - protein, 73 aa, Actinoplanes utahensis
MAKRPAAPAAAEDREAERGLRGLVGSGSSQVGVGAALRARDASRPTEADLAAADRDLVIVRRNWLPREDLPRR

SEQ ID NO: 9752 - protein, 233 aa, Actinoplanes utahensis
MQWKNRPNGLTWSGVIKNEEAKREAAARLAAELQDGQTVGIGSGSTSFLTLQALAARAAAEGIAFTAIPTSIEVANACAALGLRTATLNEARPDWCFDGADEVDPKKRLIKGRGGALYREKLMMAAAPKAFIVVDQSKIVERLGQNFAAPVEIDPDALSLIFEQLADFPGLDEVTLRPAGGKDGPVITERGNLTLDLRFSEIADDAHTRLKQMSGVVETGLFFGYDYELILAG

SEQ ID NO: 9753 - protein, 305 aa, Actinoplanes utahensis
MLHPQVTAAARLRRRPSAEESAGSPHERLRYTRAAMEESNEAETGPALPLPVVADLDADGVPCRLYATRAGAPLLVYLHGGGWCYGSIETVDRFCRRVADRSGLAVLSVGYRLAPEHVHPAALDDVATVLDHVRKNAAELGVDASRLAIGGDSAGGQLATVTARRQRDAGTPLDFQALIYPALDPLTSAESYDELGEYGLDRASMRLAWETFVPQPALRLTPDVAPLAVADLSGMPATLIITAEYDVLRDEGADYADALIAAGVPVVHTRYMGMNHGFARKIATIDAARAAADQVAFALRAALIF

SEQ ID NO: 9754 - protein, 398 aa, Actinoplanes utahensis
MTVVHPISRAWITTGGTGAQNYDEFADDAEITDIITANPHSALAVEMPHLAPETLGKTFADSLPDAVVRLERDKSEGHYRHAEHVVVLYRITGKDEPAAYGLWSMVDTDQISTSADEPGLVIRNEDVFIAKVRERVALAGALQTLLSPVLLLQTGKGEELHAALAQACDAAGEPEATDTDQSGRTHAIWVVGAGPLQDRLTGLAGGGELVVADGNHRSLAAQTGGLPRFLAVITTPASVAIQPYNRLVGDISVTPDELAERLREAGATVTELPRPAELPAKGTIELYAAGRTFAVGLPAAASATAVENLDHALVERVLLGDVLGLEPGDKRISYIGGDYPVAWLRGEVDAGRSALAVLIAPVTVDDFVEVNLARLKLPRKSTWFTPKARGGLVLAQLG

SEQ ID NO: 9755 - protein, 78 aa, Actinoplanes utahensis
MPSLDGVMYTSSSDAGGVTVGVQRAVWPDLSPELAELVAPPIIVTTGPVKRPVNAHRRAQLSRSRGNMPVGRHRHTAG

SEQ ID NO: 9756 - protein, 1109 aa, Actinoplanes utahensis
MRCTSPHPTTAPVNRWRTSQKELVENRADLAAALDLVEAGCAGHQQDAVPEPAGRLALGRRRDHRAEERDRLAVDRAGRVDDRRADIRADRLHAGVVAGPQRLVTLVGERGRGQFRIEADLGQRLAEQLLVQLVLLQVDPGAEGRVEVTQHLRAGGLGRGDADPHRAPALRHQFSVLLGKVAALVEHGQAHHVESDVEGAHLLHLEQPAGGDPGPRAQRVEPHVDGGAFSHTSILPPPGRARPHRLREKQSARRRVHVAGVHNLTQVEAAERSRLLEVTGYDITLDLTDGNGNPGSGVFRSTTVVTFGCTEPGAETFIEAAAVKLHRATLNGEPLDLDSWSAEKGLPLPGLAAENTLVVEGDFAYSASGQGLQRSEDPVDKEIYLYSQFETADAQRVYAAFDQPDLKSEFTWHATAPNHWKVVSNMPVEREEPVGAGARTVHFAKSPRMSTYITAICAGPYHEVRDAHDGIELGVFCRASMARYLDADDLFLITKQGFDFFHEQFGVRYPLPKYDQLWVPDFNAGAMENFGCVTHAEAHYIFRSQVTDYEYEQRANTILHELAHMWFGDLVTMRWWNDLWLNESFAEWASHWCNTHATRFTDAWSTFLAMRKAWGYRQDQLSSTHPVYCEMPDLEAVEVNFDGITYAKGASVIKQLVAYVGLDAFRTGLRAYFGKHAWGNATFDDLLTELETASGRELRKFAAQWLETAQVNTLRPVVELDDEQRYTRVTVLQEAPADYPTLRTHRIGIGLYDLDGDRLVRRELLEVDVAGERTEITALAGVKAPDVLLLNDDDLTYAKLRLDERSMGVLVGHIAGFESSLPRALCWAAAWDMLRDAELAARDYVQLVCSGLPAESDINLTTATLRQAGSALVSFADPEWAPQGWAMLAELAQSRLAVAEPGSGWQLTWARAFITAARTEEQAAVLRGWLNDGRAPAGLVVDTELRWSLLQALAAIGAATAQEIDEELGGDRTASGEREAAIARALLPTAENKARVWAELTGPQALPNWLNRSLLQGFQSTRQVALTAPYAEKFFAAVGDVWARSDSEPAQEFATLAYPSLQISEDTVALTDAWLAQDGHPASLRRLVAEGRDGILRALKARAKDRSAG

SEQ ID NO: 9757 - protein, 181 aa, Actinoplanes utahensis
MLSQGSPARWNAPVGRWTEPDLHLFPQDGHRYEIVDGSLHVTPPPRDASHDAVVEAIVTTLRAAAPPDWWVCVRLGVEIAESSLVPDVTVLRPRSSGAVWVDPADVALVVEVESAETRLYDRLLKPAVYASAGIPAYWRVAPGLLTVYTLDDGEYLHVAEGAEHLRLDAPYPVRVTPKGWF

SEQ ID NO: 9758 - protein, 129 aa, Actinoplanes utahensis
MTSGELADADRETPFTTSQLLRLDEALRLADQATGLTFSIYLGELAEPVRESAEKLHAEIRNPQRAVLLAVSPDQRRLEIVTGDEARRRITDRDAKLAAFGMAGSFSGGDLLGGLLIGLDQLASHAGRA

SEQ ID NO: 9759 - protein, 95 aa, Actinoplanes utahensis
MSVTTTVLVYVIIPAAVIGTVAVIVFAGSGKGKPSRRYRPGRPYEFAPMWFLAAPERAAAGHGHATPAIERGLVIEDSSGAPVRPGPTGGASDKW

SEQ ID NO: 9760 - protein, 164 aa, Actinoplanes utahensis
MRLAVALVFPVLAAVLLLPPPAARAAAVVYVELNPSTVRAGDTVSVRASCDDNLKAAAVSAAPIGSVTVEPQYGFLTATATVPVGHRAGDYPVTLHCPDGRTATATLHVVARVEPSRGPATGGRRHRPGADRAAAGRRRPGGHGRGRRAGPGVDPPPAGGLRPR

SEQ ID NO: 9761 - protein, 268 aa, Actinoplanes utahensis
MTDPTGKPPHVPESVRRKRPAQVITAPPPGTVTGPLPAPRPQGGRPAFRVPLPRRTPTPRPAPGRRRRWPIGWIALILFFLGLFAVGMGLGVATGFDLGMFRGPDAPPPRSFPVLEPSRPERLSIPELKVDAPILQVGLAGDGSVDVPPLNRHNEVGWFDGGPTPGQFGPALFVGHADTRTGPSVFHDLGRLKPKQRIEVRRADGTVAVFEVNAVEHYDKDQLPVGKVYGDYSRPSLRLMTCGGRWLGGEQGYSDNVVVYASLIDSRK

SEQ ID NO: 9762 - protein, 185 aa, Actinoplanes utahensis
MPDIRPTVGSSALVLNATYEPLCVVSVRRATILVLTDKAECVSDGDGILHSAHEQLPVPSVVRLTRYVKVPYRTHVGLSRRAIFARDGGRCAYCRGSAETIDHVFPRSRGGLHAWDNVVAACAKCNHSKGDKTPAELGWRLHAIPQAPRGVAWRVLGHRTPDPRWMDWLDLPDNHAAPALEAEAA

SEQ ID NO: 9763 - protein, 358 aa, Actinoplanes utahensis
MFLAPSTPDPSLPTVNLTKSCTEDSVCNWMTHHDVPGWIAQSGYVIVVKPVRIIAIIAIAMLIRWLLHRMITRLTASTSRAAMPALLKPLKERSDVTAEDAQFIPERRRQRAEAIGSVLRSFVSAVVFTMAALLVMGEFGFNLGPLLASAGIVGVALGFGAQSLVKDLIAGLFMLLEDQYGVGDTVDLGEATGVVESVGLRITTVRDSRGVLWYIRNGEIVRVGNKSQGWAMVVIDIPIGFVNSEEAVAVLSTAAAAVAEHPEHQTEFIEPPSVVGVEQLTVDGATIRTIAKTTADSQASVQRELRRALAEALESSGMSERIAASRLAPRSAVPPPAWYTTPGNSSSSIGDQRPGGTA

SEQ ID NO: 9764 - protein, 452 aa, Actinoplanes utahensis
MANDPEGPQHAAKVTEGDHPVTFRSLLALREFRAIYASQVISVLGDFLTRAAVTVLVYQQTHSVLLSAFSFAVVYLPNILVGPLLATLGDRYPHRRVMIASDLFRMALTALLLIPGLPTALILLVVLVASLGTPAGQAARSALYPLAVGRDRLTLALVTSNSTVQMAQVVGYLTGAALAVGLGPRVALGVDVATFAASVLLVAAGVQTRPGAISPERRRHLLTETAEGFRLVFGHPVLRPIAVVVLTTVAFSVVPEGLAASWAAEATPKGIPQGIEQGLIMAAAPLGFVAGGLLFSHLVPVERRWRLLPILAVLVPLSLVPVLPGPQGTTVAVLTALCGMAAGAALPALNAAFVLVLPLSHRARAFGVMSSGVQASQFLAVLVTGVLADHVRIPLVVASWSAVGAVAVALIGLRWPSRERFAAAEREAAAEQATAPVPQQPSRPAGQAEPAT

SEQ ID NO: 9765 - protein, 130 aa, Actinoplanes utahensis
MSSFYDEVGGEPTFRRLVDKFYEGVAEDPLLRPMYPEEDLGPAADRLTLFLMQYWGGPNTYSAGRGHPRLRMRHAPFPVGPAARDAWLTHMRTAVDSLDLDDAHRTTLWNYLEHAANFMVNTMDPVEPPR

SEQ ID NO: 9766 - protein, 420 aa, Actinoplanes utahensis
MRRRLLAVATVFLAALGGSPPPAVADITQSGIVSANPVDWTPHVLDGTVWALAVVGDTVIVGGAFTRVADAGRHTTLARKNIFAFDLNDGTIRSFAPEVDGAIYSLAPGADGTVYAGGAFKTVNGASSRGLTRLWLGSGNRDTGFRAHVNWGDVRALATRGDDLYAGGTFSAINGTERVGLARMNAESGAVDRGFDARLSGPGLSRVRVEHFDVTADGRKLVAVGAFLRAGSADRTQIALFDVGGSAAQLSGWYTDDYKPQCMKGFDTYLRQVKFSPDGSYFVVAATGRASSAQKLCDSAARFETNRTGGQHPTWVQRTGGDSLYAVAITGPAVYLGGHQRWFDNPYGTDGNGPGPGAVSRPGIGAVSPITGRALSWNPTRARGVGVRAFLTVPRGLLVGSDTDQLGKEYHGRIGMFPLD

SEQ ID NO: 9767 - protein, 235 aa, Actinoplanes utahensis
MPWWSWRPGSSAANEPDTGGEVAVQSTVRVGVPAQREPGRTGVPSDNDLSRGADREPGRGAAPDRVPECELSRTPDRELGRGATPSDLSAVSGSAEVVEPVTLARIGKALDLLDIRFLADGGGSLLAMWERHAVLFTLEGPEDEILVMRARPHATVPPDWADRAYRVVNEWNHTRRFCKAYVGDATERGQLPIYAELQVPLAAGAHDTLLVELLDCGAAVATSFVDWLHDEGALL

SEQ ID NO: 9768 - protein, 219 aa, Actinoplanes utahensis
MSGHGLLGVPDAGAFLARLTRLDPGAPVRLRSTAGRTALWAHLPWDVLVTREVAGPGPGDATVSAAELLAVLAAGGAELPERRDTRWRWPLPPAASTAVESVAGAELTRLAAAAAGTLREVTAGGVAGRAVGQRAVRDALLDHVALVVTPEGAGPVEVSQRLVQAVARMGFLGPRGAEPADARVRTAGSWVGISAPYGVAWRQSAHKLTVMPMSSHPKG

SEQ ID NO: 9769 - protein, 136 aa, Actinoplanes utahensis
MSRRFTYDVPVRWSDMDAYGHVNNARFLTLYEEARVAMFFVGARNHGLGSFEEGIVIARHEIDYLRPVDFGEPVRVEMWISELRAAAFTVSYELFDDGVLASRAKSVCVPYHLAAGHPRRLTDAERDFLKPYVEVA

SEQ ID NO: 9770 - protein, 558 aa, Actinoplanes utahensis
MAQYIYVLEKARKAHGDKVVLDNVTLSFLPGAKIGVVGPNGAGKSSLLKIMAGLDKTSNGEARLMPGYTVGMLAQEPPLNDAKTVLGNIEEAVAETKAKLDRFNKIAEQMATDYSDELMDEMGKLQEELDHLDAWDVDSKLELAMDALRCPPPDADVTQLSGGERRRVALCKLLLEAPDLLLLDEPTNHLDAESVSWLEQHLAKYAGTVLAITHDRYFLDNVAGWILELDRGRAIGYEGNYSTYLEKKAARLAVEGRKDAKMKKRLTEELEWVRSNAKARQTKSKSRLDRYEEMAAEAEKTRKLDFEEIQIPPGPRLGNTVIEVNGLTKGFEGRTLINNLSFSLPRNGIVGIIGPNGVGKTTLFKTIVGLEQPDEGSVRIGETVKLSYVDQSRAGLDPTKTLWEVVSDGLDHMMVGKVEMPSRAYVAAFGFKGPDQQKPTKVLSGGERNRLNLAMTLKIGGNVILLDEPTNDLDVETLSSLENALLEFPGCAVVISHDRMFLDRVATHMLAWEGTDEEPDKWFWFEGNFEAYEKNKIDRLGADAARPHRVTYRKLTRD

SEQ ID NO: 9771 - protein, 160 aa, Actinoplanes utahensis
MIATVLLTIIGMIGGYLLSERRDARGTARPSASATTDASDGPSLLPTEGLCPDQTQEMGHRNGATGDLLQVFRVTTERKTVIWICQDDRGRLFYHANRGGTAAPWKEGVTALFLAGVTRQDDGSFQAVAPQDGNTFSINRERLLVTKSDGTEAEQRVVGD

SEQ ID NO: 9772 - protein, 500 aa, Actinoplanes utahensis
MASKSRPREQSGYVPWWLRTVGSLGEQKPPGGVLSVAQRSSFVVVANRLPVDEVTLPSGEKQWRSSPGGLVTALHPVLTEHRGTWIGWAGGDGPAPEPFDLEGIHIHPVPLSADELERYYEGQSNATIWPLYHDAVETPAYKRRWRDSYRTVNQRFAEAAADVAAEGATVWVQDYQLQLVPAMLREMRPDLRIGFFLHIPFPPIELFMQMPFRAEILRGLLGADLVGFQQRLAAQNFVRLARHLLGLRYEGQSILVDGRRVKAGAFPISIDTRDMERLAADPAVQARAKQIRAELGDPKTVILGVDRLDYTKGIELRLKAFRELLADEKLQVGDAVMVQVATPSRERVEHYQTLRVKVEREVGRINGEFGKVGTPAVHYLHQSVDKQELAAMYAAADVMMVTPLRDGMNLVAKEYIACRGDTGGALVLSEFAGAATELRQSFLCNPHDPDGVKDALLRAINAEPAELKRRMRVMQRHLRTHDVARWARTFLDELTVDDES

SEQ ID NO: 9773 - protein, 402 aa, Actinoplanes utahensis
MSLYPLALRLEGRRVLVVGGGSVATRRVPALIAAGARVDIVSPVLTPALQAYVDAGRARWTPRRFEPADVAGAWLVHVAVDDPEAAAQVSDAAEEHRIFCVRADDRDAATAWTPAVTRHGQVTVAVTDGGDRRRAMAVRDLVAHALEAAPPVAPELKGVALVGAGPGDPELITVKGRRLLAAADVVVADRLVPGMLLGELRPEVELIDAAKIPYGPSAAQEEINRILVDRALQGRFVVRLKGGDNFVFGRGGEEALACAEAGVPVLVVPGVTSSIAAPALAGVPVTHRGVAHEFTVISGHIPPEHADSLVDWAALARLRGTLVVLMGLKNLAKIAGRLIAEGRDAATPVAVIQEGSTAHQRSLRSTLGAVAQDVAAAGIRPPAVVVIGEVVSATAGFTPAAG

SEQ ID NO: 9774 - protein, 350 aa, Actinoplanes utahensis
MTLETTLAAIRPADERAMAAARELQSRLTKPAGSLGALEELSVRLAGLAGVCPPPLPAPATVAVFAGDHGVHAQGVTPWPQEVTAQMVANFVAGGAVVNAFARQAGADVMVVDAGVKIPLHGGPNLLDANIRRGTRDMTVEPALTREEARAAVELGAAVAAQLVAAGARCLLTGDMGIANTTPAAALIAVFTGSAPAVVTGRGTGIDDATLARKTEVIAAALARHTPDPADPLGALATVGGLEHAALTGFILGAAAARVPVIVDGVIAASAALAAAAFAPDAVAAMVAGHRSAEPGATVALSHLGLEPLIDLGMRLGEGSGAVLALPIVAAAVRVLHEVATFDSAGVSEK

SEQ ID NO: 9775 - protein, 360 aa, Actinoplanes utahensis
MRHAVPVTHDLDHHGDAEVGDGLIDLAVNVRHQAMPDWLADPIREALTRLSAYPDATAATAAIAARHRRDPAEVLLTAGAAQGFVLLAQALRGARRPVVVHPQFTEPEAALRNAGHTVERVLLREADGFCLDPGLVPDDADLVFVGNPTNPTSVLHPAADVARLARPGRVLVVDEAFADTTYRDDRPGEPESLTERRDLPGLVVLRSLTKTWGLAGLRIGYLLGPAALLPRLAAAQPLWAVSTPALAAASACASPIAVAAEREIAAALAAERAHLVERLREVPKVTVAGHPASAFVAVRLPGADRIRTHLRERGYAVRRGDTFPGLGPDWLRIAVRDTATTDRFVQTLREVIGDVSEERP

SEQ ID NO: 9776 - protein, 719 aa, Actinoplanes utahensis
MSYLRRVTDRRPTVAGRVALLIRAGLIAGLVIAGLSYPFTALAGMGVKAGTDALDNMPEQLTEVPAAQTTYVYAKDGKTLLTMFYEEYRRQVPLKDMSPYITQAIVASEDTRFYEHHGVDAKGVARAFVANQQAGGVSQGASTLTMQYVRMALRDSAKTPKEALEATEQTAARKLREMRLAVEVEQRLSKQEILQRYLNAAYFGHRAYGIYAASEVFFSKPAKDLTLNEAALLAGLVKAPSAYDPATRDQDAALQRRNYVVDQMLKMGSITEAQATAAKKAKIKLRLSTPPNDCVSVSDEHNDWGFFCDYFKNWWREQPAFGRNVLEREENLRRGGYRVVTTIDPAVQGYAIRHVLDKEGRNSPFAHGEVVIEPGTGRVVSMAVNRRYSLQQDNNGKHSDRNQRDVRGNYPNTVNPLLGGGDMAGYQAGSTFKIFTLLAALDAGLPLSTSYYAPERFVSKYITAPGPATCGTHWCPKNSSKSMTGEQTMWSGFGKSVNTYFVQLEQRVGAEKAVAMAEKLGLKWRTAVDRTLATPEHAAGWGAFTLGVSDATPVEIANVFATVAAEGNYCEPLPVISIRTPDGRDVTSRGRKVADPRCHRVFSRDVARAATDAARCPTGYGAARGSCGGWGTSEMVYATMGRPVAGKSGTTDNNKTAWFSGFTPQLAASAFVADPDNPEHYVGSGRSTISKYTVAETLRDALKGRPELDFTPPSDKLVW

SEQ ID NO: 9777 - protein, 218 aa, Actinoplanes utahensis
MAARLPLDLDPPVRRLKALLLGVDDRELAAATPCPGWSVATLLDHLMRLAEAFTDAAHKGADASGTGPPPAPSAEHLSPHWRSRLPVLLEELATAWHDPSAWRGTARAGGVTMPAAELGTVAANELVMHGWDLARATGQDFAADPRVLATLITFLSAGPPEGTPGFLGPRVPIDPSDDDDLPRALALAGRDPSWRPPRMRDVPTARLRHDQPPAARPA

SEQ ID NO: 9778 - protein, 930 aa, Actinoplanes utahensis
MTRTLIGAVLRREATVRLLDPIDRFRGLPRGGPQVGLLDPVAGAVLARAASVGDVDAVAGAVLARAALVGVVDAVAGAVLLRAAGLDLRDAVPGAGRGGRHRFAGRLGAFAGRGVDAVRLPARLIAPQGKGHDREQPPLDGVATVLPGVLVIDRDRREGRIVGRRLGGQQHIRPVHGKWQLVREPGHVDPAGVPPAVTSLDRGRSTFRQVNLSDNGHLAGGCGRRLRGSERSGGRRRHPAAVDQHGRAVGQHQRGDDLEPHVAVDRATPGLDLVRRVVAAGDGNLCPGHSLAGGGARGALHGGCGELRRHRHGRRRVRRVDPGVDLAALVIPAELPVAEHHHDHRGDHGEDGGGQPAGCQQEPVHPPRLPGEAVASAAAGYCANFRRPIARDRRSAKPSGETLITAQPRLVVSAPSSGHGKTAIAVGLLAAMAARGLPTAGFKVGPDHTDAAYLGLAAGRPGRNLDPRLVGAQRIAPLFGHGAAGAQLSVIEGAMGLFDSLTGQPEIDGTAAVAAALRAPVALVVDVAAMGHSLAAMVHGFRMFDEMVHLGGVILNRVASPRHEQMLRSALDDIGMPVLGALRRGDLPNVLPSRAHGLVPVAHRTVEAGRAVRRLGEAVAQSLDLDRLMALANAAPPVPGPLWTPAEAAGEPADMRPVIALAGGPGAPYTYVETAELLTAAGADVIVVDPLRDESLPPGTRALIVGSGLPEGYAEELSANRHLCADVAQFARDGWPVIAEGVALPWLGRDLDGRPMCGVLDITGTTGEQTVAGYREATAPASSVLAPAGARITGYKQHRAVVAPRAGATPAWTWSGGNPEGFVWRQIHASQLGLHWAAAPEIAKRLVAAAIAGPVKPGGPGHQPSGHGPQSGSPMPQPAGHASSGHGPSSGHASSSHGPSSSHAPAVGHGAPSAGPGPQQPGGHGSPLAS

SEQ ID NO: 9779 - protein, 156 aa, Actinoplanes utahensis
MTFPPDDPWGTPTPAPAGPPPTPPVPRPQPASPYEPPRQSGPVIVQIAEIEVTSSTIRTPAGDFPLAGSRWQVNEFWVTLRRTPLWAKIVGFAGMCFTFGLSLLLLLVKETAPQGTVQVTVTSGPQQYVARIAVNDEQDVITINQQVNYVRSLSAL

SEQ ID NO: 9780 - protein, 515 aa, Actinoplanes utahensis
MGIVRFLDIAATSAAVAATGGRKAKIELLAHALRRLEPDEIAAGSAYLAGELRQRQTGVGYAGLRERPAPALEPTLTVAGVDASIAEIATVAGAGSQARRRQLLGALFGAATADEQRLLTGLFSGELRQGAQAGLLTEAIAVAAAVPVTGVRRALLLSGDLKQVAAAALTGGAAALAAISLRVGTPLTPMLAQSAPDIAAALLATGTPAVVDTKLDGIRIQVHRSGDEVAVFTRSLDDITERLPGVVAAARALPLREVVLDGEAMALDEQGRPRPFQETSSRAATRAKTGGTDAAAVLVPYFFDLLHLDGTDLLDEPGRVRWAALADALPAGLIVGRQTVETQEQGAAAFAAALAAGQEGVVVKAPDAPYDVGRRGSAWVKVKPRHTLDLVVLAVEWGHGRRRGWLSNLHLGARDPETGGFVMLGKTFKGLTDELLRWQTERFKELAVDDNGWVVRVRPEQVVEIAFDGVQTSPRYPGGVALRFARVLRYRDDKPAAEADTIDAVRAIGGGAVTS

SEQ ID NO: 9781 - protein, 97 aa, Actinoplanes utahensis
MRSIGAVPNGSVTRPKPAGPRATLDRLRTRDRIESIARLRAAVRALGDVDVSGWDDATLTEHLDELSQALCGIDTELTRVAEAVRARGFRIDEQRAA

SEQ ID NO: 9782 - protein, 492 aa, Actinoplanes utahensis
MTELSCEVLVVGAGPTGLMLANWLTRLGVQVLVVDGKDGPTRESRALVVQARSLEIYDQLGIGDQILDAANRAEAISPGSGSRVFGRVPLGALGRGTTPYPFLEVLEQSRNEEILYDHLRKLGGDVIWETPVTAVTQVERGLEAKVGNHTVQARFCVGCDGANSAVRKARRIAFEGSTNAHRFYVLDAAAAAGLVGGAVNVRPGGRDFLLAFPMPGRDNWRLIGIVRDVDGDSALDEDDVRGRLRELFAVTYTEARWFATYRVHHRVAAAFRDGPFLLAGDAGHVHSPIGAQGMNTGLQDAHNLAFKLADVLRGRRRDTWLDRYEAERRPVAKTLVATTDRLFQAITSQRTLSRVVRTAMIPLIAPMAARALPRTSGGSRLFQYVSQTRIHYPIGPQARTPDGKRDPVVGRRLPWTGANFAVLRTADWQIHGYGGVEGTEAPDLGLPVHVFPAAPATPLQPGLFYLVRPDGFVAGRATPAEAEVTFRHALAV

SEQ ID NO: 9783 - protein, 450 aa, Actinoplanes utahensis
MSLTESELRATIAQQMPGVRADLERLVRIPGVAFEGFDHSHVERSAEAVADLLRGCGLDTQIVRHGGQPAVIGRKPAPPGAPTVLLYAHHDVQPAGDPELWTSDPFEPVERDGRLYGRGAADDKAGVMAHVAALRAFGDRLPVGVVVFVEGEEEYGSDSLDAIIQAHRDELRSDVIVIADSGNWDIGQPALTTSLRGLVNLFVEVEVLRGAVHSGMFGGAVPDALITLSRLLSSLHDDDGEVAVDGLVGREGASVDYPQDRFRHEAGMLDGVTLIGRGTITDRIWTKPSISVLGIDAPRTLEAANALQASAKAKVSVRVAPGDDPKSVYAAVKSHLEKHVPWGAHVEVTLESDGDPCVIDATGPGFDAARSAFRSAWDGTEPVDMGVGGSIPFIATFQELFPDATILVTGVEDPHSAAHGPNESLHLGEFERVCLAEVLLLKNVAENLTK

SEQ ID NO: 9784 - protein, 359 aa, Actinoplanes utahensis
MTTDEENRPVRRRVTLTGISSRAWEHPADRGALSALRELRGFDDVVKTFFGMWNERGFRLSYLAGSIRVDHRQYPRVYQRFTEAASTLDIAELPELYVTQSPMINGSAIGLDRPFIVITTGAVEKLDDDELRAVLGHELGHVRSGHAVYKTIMMILTNWAANISWVPVGAIALRAIIAGMLEWWRKAELSADRAGLLAGQDPSASLRLLMKLAGGGDLSQIDTTAFLEQAAEYEGGGDIRDSIHKLGMTAWSTHPFPVARAAELRKWIDSGAYAQILSGDYPHRDSDGDSSFSADAKAAAQSYREDFANSQDPLVGLLRRVGDGATDMAGAAAGRAMNWASDARRRARGDGNGGDGEAS

SEQ ID NO: 9785 - protein, 526 aa, Actinoplanes utahensis
MSDPVVAVGAGAGPQRGRQANTLLIAGTTSDAGKSILTAGICRWLHRNGVRVAPFKAQNMSNNSVVVVAPDGRGGEIGRAQAMQAEACGLPPDLRFNPVLLKPGSDRSSQVILLGEAIDTVTAGNYRSLRPKLAETAYATLTDLRADFDAVICEGAGSPAEINLRDGDFVNMGLARRFGMPALVVGDIDRGGVFAAFFGTLALLSPEDQALVSGFVINKFRGDLGLLQPGIDMITAVTGRPVHGVLPFHRDVWLDAEDSLAYGTVLGRPGPPHGREWLRVAVIRLPRISNATDAEALAAEPGVRVHLTVEPGDVADADLVMLPGSKATVSDLAWLRETGLADAVTAHAAAGKPLVGVCGGFQMLAGTIDDEVESGRGVTPGLGLLPVEVTFAARKTLARSAGSALGAPVGGYEIHHGQVTREAPEAFLRYADGRPEGAVRANVYGTHWHGTFESDEFRRRFLTAAAAQAGRHGFTVAPDTRYAAIRARALDVLGDLVAEHLDTAALWRLLENGPPPGMPFVPPGAP

SEQ ID NO: 9786 - protein, 328 aa, Actinoplanes utahensis
MLNRWTADAAGLIAGYLLDAALGDPRRFHPVAGYGTAAAALERRVYRPDRRAGVLFTTVAVGVPVLAGLAAGRATRHLPAARFALTTAATWTVLGGRTLRRESRTMARHLTAGDLVAARGRLGHLCGRDPSALDETELARATVESVAENTSDAVVAPLLWGAALGPAGLLGYRAANTLDAMVGHRSARYARFGTAAARLDDVLNLGPSRLTGLLTIAMAPIGGGTPRETARVWRRDRGDHPSPNAGQCESAMAGALGVRLGGRNVYFGRSETRPFLGDGPRPSAVHLRRAARVSAAVGAAAMLLAAGGALVRGGFGAALRRAGRDGSR

SEQ ID NO: 9787 - protein, 218 aa, Actinoplanes utahensis
MWRPAARPERGPRPGRRCGKPARDDLVDKTRFPRSGWADRSASPGRQAERPDWSQDNHNRQTEVVMLKDIRAVAEETMVLTPEDQDAEYVNTTWFGAPPHERMGMSPDEVVTAFEETAAALREQVAGSGHRGTATFFVWHDPEAGQLRCSVSTRKPGDLVFPVTYQVTDDLHAIVVEFLVDRAPGSIQWGALEPVPYPEEAGPAALAVWAFDLTPFGR

SEQ ID NO: 9788 - protein, 264 aa, Actinoplanes utahensis
MSTPRRAISDPPRRRLLSTLPRRPQADPRRGAAPASLITSAAIDVKETTMNDTYTTIVGNVLTAPEWRRTNTSGQLVANFRVAATSRRYDRDNNRWVDGDTLRIRVSAWRRLAEGVAASIRVGDPVIVYGRIYTRDWTDDESNPRVAYELEALAVGLDLSRGRARFYRTRALAALAVVEDTEAETMVGGEPADPVTDGQVPVRFGEGLPEPLPGETEPDFLEVVAGLTDPTDEPTEEPGEEPPADPVTTEVRRTRRVRREPVPA

SEQ ID NO: 9789 - protein, 361 aa, Actinoplanes utahensis
MVVEIDVLGRPYERHTIELGADDEGPVVATLVRRRAEQPTRRAVLHVHGFVDYFFQTHLADFFVERGWDFYALDLRKYGRSLLPHQTPNFARSMTDYFPELDEAVRIIREQDGHDQLLVSAHSTGGLITSLWAHTRRGRGLVDGLFLNSPFFEFNLPWVMRRPALSLVVAISGRTPYRILPTAGLGLYGQSIHQDHHGEWSYDLAWKPILGFPIRFGWLAAIRRGQRRLQAGLDIDVPVLVACSDRTYRGREWHDDVHVTDSVLDVDHIVRFAPGLGPRVTIAQFNGGKHDLTLSGKEVRAEVFTELARWSEAFLAAPGTAEVTIPPAPEDQGGRAILLEAAEAAVEKAADEADDKSGTTA

SEQ ID NO: 9790 - protein, 110 aa, Actinoplanes utahensis
MPDPDCWVRRADAVPIATIGARLSVWKSADVLLVVEVSDETVLQDLNVKTRLYGAAGYPVYWVVTQERIFEHTGPTASGYRTRIEYRPGDRIPVGYASLDLPVSSLLSDD

SEQ ID NO: 9791 - protein, 332 aa, Actinoplanes utahensis
MYRSSEIGKSRRWQIVAVTGVAVVLAGIGLGVASAAESTPTVNCPQVKVNVAIPAQAQNEVKSNLALLQTQIDEANKRIVDTKGQGGPNFIQNAILGPLKDKRFATISRIETAIGRNAPKPNLNAAGLSACTLNGAAAPAATTAAANQAPGSNLGILANNCDKSRLARHDGFQKGDRCVTTEFGEVGSAANNPSLLITQAPRVVNRNTAFTLKVSTRNLIRDRFLAAGQGGYYVESSVLQNGIVRGHFHTACRMLAGTNVAPAPDPVPAFFVATEDSKGGRTPDTVTIQVPGLPTAGTAQCASWAGDGSHRIPMMERANQTPAFDTVRIQVR

SEQ ID NO: 9792 - protein, 46 aa, Actinoplanes utahensis
MGREMLAALLFAVAAVALAAGVLLGYRLGRAQCRAAGHRHSGTGTQ

SEQ ID NO: 9793 - protein, 41 aa, Actinoplanes utahensis
MTGSGVAPISSPEESDSASRWPAPSPATPPARPPLTETLSY

SEQ ID NO: 9794 - protein, 48 aa, Actinoplanes utahensis
MTTAHRATTESPAPDWMPEMLERAARRRAELAERAARRQATAQRRAHG

SEQ ID NO: 9795 - protein, 405 aa, Actinoplanes utahensis
MMIDQAKVRVLLLESIHPDAVSRLEADGFAVESVPNALDEAELVERISGVHLLGIRSKTKVTAKVLEAADKLVAIGAFCIGTDQIDLTTASSTGVAVFNAPFSNTRSVVELAIAEIISLTRRLTEKNSLMHAGIWDKSADGAHEIRGRRLGIVGYGNIGTQLSVLAENLGMSVSFYDTADKLALSNAHRCASLDELLESSDVVTLHVDGRPGNAGFFGAEQFAKMRPGSLFLNLSRGIVVDHLALRDALRSGHLGGAAVDVFPKEPKGRGDEFLSELRGLPNVILTPHIGGSTEEAQSDIGGFVANKLAKFLSEGNTTLSVNLPGVVLPEQPGLHRIVHVHVNTPGVLAQVNRILAEHNVNVEGQLLSTRGEYGYLITDIGKGYSEEVLEQLRGMEQTVRLRVLS

SEQ ID NO: 9796 - protein, 474 aa, Actinoplanes utahensis
MAPSSSVAASSSSAAASSSSAATNRVRETPAAPEYGPASPAGPGRASFGFSAGPISGNRPLGGSGDTADSDGTTAAPVQGAWASSPSSSSTASWPAAEQSSWPAAEQSSWPAAEQSSWPAAEQSSWPAAEQSSWPAAVDAGGRSGGPVDPGGLPIVRRNAAETDPTSPAAAGWAAPEAAATRPSIPDSNFGSWESMVRSDNPGVPRTPSRSAAAAAALRPPRRRSPVVTAGMTVLGIVAVLIIALTGVVFYSGPDSRITRILHLSAATTSPGGSRMVTAPLGGRSTASFEMLAASDRTRLSVADIGDDLFRISTPDDSPLLPSPQVDGDAVRLQVTRSGAGADGEVDVVLSARVRWSLRFSGYAAERDVDLGQGQVTGIEVVGGTRRAVLDLSAVSGTVPVKITGGVEELTLRSPAGTPIRVKVGGGAATVTAGTRTLRNVAPGSTLTPKDWNAVGRYDVNAVAPVTLLSVEAG

SEQ ID NO: 9797 - protein, 218 aa, Actinoplanes utahensis
MGNDEAIRVLVVDGHQTFAELLGHALAGQPDLQWVGHARTGQEALHLASELSPDVILLDPELSDADGIAIAQLIRVRQPDVRVVILTAREDQGLISRATTFGAAGYISKNGALAEVLNALRTAHGGGMTVSTDIMARLLRSTPPVSVTREGGLTAREDEVLQLMATGLDARAVARRLGISVHTCRGYQKSVLAKLGAHSQLEAVAIATRRGLVRPDHR

SEQ ID NO: 9798 - protein, 173 aa, Actinoplanes utahensis
MGLADRRRGSPRFCIMYDIQLFGRIEVRTRGIRLAGDDFGGDRPRQLLALLALHGEQSLVELSDLLGAPPATVKADLRVLRDRLEPGASGRDSVVVGRHGSYHLDTERVRVDVATFEKLLAAAEGRTPERAARPLTAASYVAARPLLEDEDAAWAAELRAKYDAKRRLTATAA

SEQ ID NO: 9799 - protein, 199 aa, Actinoplanes utahensis
MLDAPTALLPVPLAPEISLHLVDAPLGLFDLTGGEFHSDTPPPFWAFVWAGGQALARYLLDHPAEAAGRRVLDLATGSGVAAIAAARCGAAEVAASDIDPAAVAAAHRNAAANALTLASAVSSPDLVLAGDVYYSPTVAPLITAQLRAFRREGATVLVGDPGRGYFPERLFTLVTDYVVPVPESLEETGELRTGVWRMR

SEQ ID NO: 9800 - protein, 161 aa, Actinoplanes utahensis
MQEQQSISSTARLSDEIIRFIRMGQRFRGMLKTEDLGAEFSALMLLLPLRAMGPMRVTDLAELKQADPSTISRQVAQLVKAGLARREADPADGRASRLAVTETGQDACARLGAARTALLERALNDWPADRVDTFVQLFEEFNTSVEALLRTDLGAPPRENA

SEQ ID NO: 9801 - protein, 565 aa, Actinoplanes utahensis
MSHPTPTAARPAAEFTHRQILTILAGLMMGMFLAALDQTIMATATRTIADDLNGFDLQAWATTAFLITSTISTPLYGKLSDIYGRRPFFLFAIGIFIVGSMLCGLSQNMYELAAFRAIQGIGAGGLMSLALAIIGDIVPPRERAKYQGFFLAVFGTASVLGPILGGFFAGADQLLWVDGWRWVFYLNVPIGIAAMAVVAKVLHLPHTRVNHRIDWPGAVALIVGLVPLLTVAEQGRTWGWDSGRSILCYVIGVVGLISFVIAERAYKDEALLPLRLFGNRTIAVGTGASTILGIAMFGGLMTVPLYLQIVKGSSATMAGLQMIPFVFGIMSGSIIAGQLIARTGRYRIFPILGSTFMVIALFLFSLVGADTPLWRTMLIMVLMGLGLGGNMQPMITAVQNAVSPREIGVATGAVTFFRSMGGTMGTAVFLSVLFNVLPGNIRDAYADAAKNPEFLKAAADPTQQQLLKQAQGGGGLSDTSFINKLTDVVAHPFKVGFSDSVHVVYLLAFAIMLVGLVIVFFLPEIPLAMRSAQQQRADDAAAQGDASGADQGTAGVKAGTEGFAH

SEQ ID NO: 9802 - protein, 102 aa, Actinoplanes utahensis
MAVVKINAIEVPEGAGPELEKRFAARHGAVENEPGFLAFELLRPVAGDNRYFVYTKWESEEAFQNWSQGSAKAAHAGERAKPVASGASLLEFEVIQHVTKQD

SEQ ID NO: 9803 - protein, 113 aa, Actinoplanes utahensis
MAVASVPLDVRRHAVGALTVGLGAPGPVAPEVLLTVMAVAGQAEVLIGELHRREALTEGAAVDRAVGVIIAQRGCGVQEAYRILHDSAQRLGLDRVTVAERLVAAAARDRDQS

SEQ ID NO: 9804 - protein, 68 aa, Actinoplanes utahensis
MTESEENLRLAAFLDGAYRAEERMSSGDLQRRAIAEDLPASLLTRVDALPEGEYLQDEAAEALSAPAI

SEQ ID NO: 9805 - protein, 171 aa, Actinoplanes utahensis
MSSLQARVAEVARAYAPHDHRPLGGYLVAMGAFGTLAASLAAAAKLTGKPVPERPAMTDVVLLSIATHKISRLIAKDSVTSPLRAPFTRYTEPAGAAELNEEVRDEGSPVRHGIGELITCPFCLAAWIATGLTGGLVLAPRLTRLVATAFTATAVSDFLQMAYSIAKERAE

SEQ ID NO: 9806 - protein, 79 aa, Actinoplanes utahensis
MTTARPETGTDTGIDPAGLADDDLFRELTSLYRTRLQTLRHGPDAALDNHFRRTAELETEYMARFPGREVDPERLTQAF

SEQ ID NO: 9807 - protein, 168 aa, Actinoplanes utahensis
MVHLQRCGRTGTTGGLPARVRAKPAGRLGGMKGLWSPAWIARHLLALILTAGCLGLGWWQYSRATGGNSLSWGYMFEWPVFAGFVVFIWVREIQLFRKPRDTGAEAEPAEPERVPGAPVAVGRPVRVAVRPAEAVAADPELDAYNDYLTWLAEHPGARPADYPGRIIK

SEQ ID NO: 9808 - protein, 106 aa, Actinoplanes utahensis
MRGALTRYRIIAWIVGVFLVVLVLVGMPLKYFGDNDTVVAVIGPLHGFLYMIYLLFSFDLSRRARWPFGRMILVMLAGTIPFFSFWAERQVTRHWMTEVAWEPAVK

SEQ ID NO: 9809 - protein, 326 aa, Actinoplanes utahensis
MPLPRTRLRALVVALTALAITTSGATAAHAAPSKDELKKQIEAASNKLDDVTEAYNKTRIDLKATQTDAAKLTASLKPAEAAKNQAVTKVNAIAASSYMTGRVGPMTLILGGNQHDLLERLSYLDQLSKSNQAQIDNYTEVSRTYTSRQAELKATEQKQALQLKELDAQKAKYTKDLQKLTATQKELYGKPTQSSGSWTGPIPKGSGDAGVAVAFAYKQIGKPYGFGDEGPNSYDCSGLTKAAWAAAGHSLPHSASEQRYASGVTYIKAGTAGFVPKQGDLVFYRDGGHVALYVGSGMVIDAPHGGADVTRRTINIMPVQGYGRIS

SEQ ID NO: 9810 - protein, 333 aa, Actinoplanes utahensis
MDAGNARNRVSDGNEGTVGNVEKNTVMRTDQVAEERDLVGVYLHEISRTPLLDAAREVELSKAIEAGLYAEHLLEQGEERRGISREELERLVTEGSRAKDLFIRANLRLVVSIARRYVRSGMPMLDLIQEGNTGLVRAVEKFDYERGYKFSTYATWWVRQAISRAIAQQERTVRLPVHLVEDVNRMRNVTRQLVRELGGDPEPEQIAAALGVTVERVNELTRWAQDTVSLDTPVGDDGDTNLGDLVADSDAPSPEEIVLSALERQRIEGLLNHLDDRSAGIMRARYGLEDGREHSLTEVASRFSLSRERIRQLEIQALGRLRELARAEGLQAA

SEQ ID NO: 9811 - protein, 45 aa, Actinoplanes utahensis
MGEVSNTTPGKIFPMTNTALVTGGTGGLGAATVAAFLAAGWRLAS

SEQ ID NO: 9812 - protein, 166 aa, Actinoplanes utahensis
MAAATAEPGAPLTAVVNLVGGYAGSGLIADTPVDEFEAMFTANLRPTYLVTAAALPHLVAAGGGAVVSVSSRAAVAPFAGAAGYVVSKAAVLAFAETVAVEYRRQNVRSNTVLPSVIDTPANRAAMPDADHSRWVDPESIAATILFLASDASAPTSGARIPVYGQA

SEQ ID NO: 9813 - protein, 237 aa, Actinoplanes utahensis
MTARPRTIALVGIDGSGKTTQARMLAAAMTRAGTPARYRQNAGGRARLGRLAVRLGREDAVGLLGRRGLLLMESVLRWLAIARTLLRRAVRREVTVMDRYAVCQYASVRAHRGTAAAERRARLAYRVFPRPDVTLFLAVDPGVARARIELRGRDSESLEYLTAADMAYRQLPEFAEFTVIDANGSPDQVFDAVQRALGRPAAPVQRPLRVRSLVLAGASAVTGAAVSAWQLAESFPA

SEQ ID NO: 9814 - protein, 191 aa, Actinoplanes utahensis
MPHRVDEGLAGTMKRVAATLKTAEIPFALGGSFAVYAHGGHSSDHDVDFLIREQDKERALQELSEVGFETLEPPEDWLVKVFEDGRMVDLIFRPVETPVTDETLADTERISVEAIYMPVLSATQLMIHKLLSYSQHHCDFAQGLPLARSLREQIDWARVRRETAKSPYAEAFLVLLDRLDVVPNKSDEGED

SEQ ID NO: 9815 - protein, 82 aa, Actinoplanes utahensis
MTKQIDLEAEIQRLLAEHDRIAEQGVTVHRRENLLMLGGEVESAQRRDEICRQISARYPDLEIACDIGITRTQAPAEVEEIS

SEQ ID NO: 9816 - protein, 250 aa, Actinoplanes utahensis
MIRIAAVGDVHVDKDVVGRYRPALEELPGRADVLLVAGDLTRHGTPEEARCFAAEFGDLAVPVVVVLGNHDHQSDQQDEVTRVLTGSGITVLEGAATVLEIRGHRLGIAGTKGFGGGFAGACASNFGEREMKDFVGTTERYAAALRDALLSVECDALVAMTHYAPVPETLTGEPLEIYAFLGCYQLGQAIDDAPTALALHGHAHHGSERGRTPGGVPVRNVAHPVIKQAYNVYQLLTDTVDTRNEELVNV

SEQ ID NO: 9817 - protein, 47 aa, Actinoplanes utahensis
MDLLLWILAVILVVAGILALFRRQILWGVVLIIVGLLVGPGGVSIFT

SEQ ID NO: 9818 - protein, 291 aa, Actinoplanes utahensis
MAAHIHHFTYGAFNPIAAALLAYLGSFLGLLCTERARGAHSRGRRNRWLAIAAFAIGGGAIWLMHFSAMLGFDVPDSPVRYDLPTTLLSMVFAVVTVGIGLMVVGHGAPSPAKTVAAGFLTGGGVLAMHYTGMEGMRMSAVVHYDPVLVAASALIALAACTTALWFAVSVRGLTRIAGAAAVMAVAVCGMHYTGMAAMSVRLDPSIVPAAGGIRPLTMIVPITLITAATIVGVALSALQAMTEEEFTDGAGTPKRGMHAEPHQPWTLRQASQFGTGVRLSPAARAVAAGPS

SEQ ID NO: 9819 - protein, 298 aa, Actinoplanes utahensis
MPRRSSRSRPNRPSRWRHHPRRSRRCRSRTRRAARWRVRPHPAREVFPVAADDPVYLIRMAPRMLLSMPLHAITEVYGEEGLRQRFGLELESFPAADRERLTEALDLAATLHADDRRVREPYLNHLLRVAIRIIRYYQVRDVDVLVAALLHDAVEDHPAELAGLPADTAYPKATEAALAVLAHRFGARVSELVRSVTNPAYDPGRDRHEQYREHVTASLDRDPWARIIKISDFTDNGVGVIHTTLDKAYRSATKYRPLVPKLRELIGRPDTPLSTQAKEHILDQLDLAEERFAAILDD

SEQ ID NO: 9820 - protein, 534 aa, Actinoplanes utahensis
MPSHDSWWRDAVIYQIYPRSFADGNGDGMGDLPGITARLPRLRELGVDAVWLSPFYVSPQHDAGYDVADYRDVDPRFGTLGDADKLIAAAHDLGLKVIVDLVPNHTSSEHPWFRAALAAPPGSPERDRYIFRDTPPNNWQSVFGGPAWRQVADGQWYLHLFDVSQPDLNWDHPEVRAEFVAILRFWLDRGVDGFRVDVAHGLIKDAELTDWTAPATVLGGLEPAGPPPPMWDQEGVHEIYREWRAVLDGYDGGRILVAEAWVQPEERLARYVRPDEMHQAFNFPYLEAPWQPAELRAVIDSSLAATGAVGATTTWVLSNHDVVRHASRLGFPPGGKRKPGIGIGDPQPDTGLGLRRARAATLLMLGLPGSAYLYQGEELGLPEHTTLADEFRQDPAWERSGHAERGRDGCRVPIPWEADAPSYGFGPGDDSWLPQPALWAEYALDRQVDVPGSTYELYRSALAARRAHRLGGGTLAWSATEGAVLAFRNGPVLVLTNFGAEPVTLPPGARVLLSSEPLDADGRIPSDVTVWALA

SEQ ID NO: 9821 - protein, 487 aa, Actinoplanes utahensis
MKARGGAAHRAYSVVVFVILASLDNVAIGIVPPLYGSIGAAFGVGEGRIALATTVMFGISAVAAIGWAYAGDRTDRKPVLIAGTLIWIGGTAWSGLAGGYGAFLSAQVLAAVGLGAVASVSFSVVSDLISPRRRGLVMSFWGLSQGVGTLAGTLAGGILGHADWRRPFLVTAVAGGIATALYLFTYNVPRGDSQPELAGIDYDERIHHDHLPIILGRRTNIWLILQGGTAQIAFGSLVWLPVLFRARAEDQGYSTPTAVLVGSVFATVFQLGAALSILGGLAGDRLQRRTPRGRALVAAVGILAAVPFYVVLFLVPMTIRVPDRASTGAVIRGVLTNVVTEPTVAACLATAVFALMLTSANSPNWFAMISDVNPPEHRGTVYSLGNLVNGAGRAGGNALVGVAFQRLAGAFPPPLNYAVGLASFQFFFIPTGIMYWLASRTVAVDMAATHAALLAKRSGQRPDRDIAGDPPVGVEGLAAQQDPGAGR

SEQ ID NO: 9822 - protein, 466 aa, Actinoplanes utahensis
MALVAGIDSSTQSCKVVVRDAETGKLVRQGRAAHPDGTEVHPDAWWAALRQAIDEAGGLDDVAAASVAGQQHGMVVLDENGDVVRPALLWNDTRSAGAAADLIAELGGGAAWAEAVGIVPVASFTLTKLRWLARHEPALADRVAAVCLPHDWLTWKLSGSTDLADLRTDRSDASGTLYWSASTDRYRHDLLELGFGRDLRVPEVLGPTGIAGHLPNGAPLGPGAGDNAAAALGTGALPGDVIVSIGTSGTVFVSSDAAPADPSGTVAGFADTTGRFLPIVVTLNAARVLDAAAKLLGVSHDELSRLALSAPAGADGLVLVPYLEGERTPNRPDATGAIHGLTLKTSDPAHLARAAVEGMLCALADGLDALVGQGAAANRIVLVGGGARSEAVRRIAPALFGKPVLVPPPGEYVADGAARQAAWVVAGGDTPPAWSAEPPEVFQDDAVPLIREQYAAAQDRVVDRSR

SEQ ID NO: 9823 - protein, 394 aa, Actinoplanes utahensis
MSLQPTREDKFSFGLWTVGWRARDPFGEATRPALDPVEALYKLAEIGAYGVTFHDDDLVPFGSDAQTRDGIVAGFKKALDETGLTVPMITTDLFFHPVFKDGGFTSNDRSVRRYALRKVMRQMELGAELGAKTLVLWGGREGAEYDSAKDVKAALDRYREALNLLAQYSEDRGWGLRFAIEPKPNEPRGDILLPTAGHAIAFTQELERPELFGINPEVGHEQMAGLNFTQGIAQALWHGKLFHIDLNGQHGPKFDQDLVFGHGDLLSAFSLVDLLENGADGSQAYDGPRHFDYKPSRTEDVTGVWESAKANIRMYLLLKERAKAFRADPEVQEALAASKVAELAAPTLNPGETYADLLADHSAFEDFDADAAGARGYGFVRLNQLAIEHLLGAR

SEQ ID NO: 9824 - protein, 90 aa, Actinoplanes utahensis
MTARLTSRSSTPVRQSSVRAHNLALVLDTVANSADPPSRASVAALTGLTRATVSALTDDLIAGGLLVERDPPPRTGAGRPAAGLALTAAS

SEQ ID NO: 9825 - protein, 242 aa, Actinoplanes utahensis
MIAGAALAVPGLVSTGLIPAGPGAAGPSGPGAAGLVRVAPNLGWQDVDAPALLRGVPELADLSIAVDNEANLAALGELRVTGGNPDFLYVSGEVGIGAGLVIDGELYRGARGWSGEIGHVTVYPDGRPCRCGANGCLEQYAGQEALAADEPLAAAALGIALAAVVNLLDVPVIVLGGAYAPLFDRLRDGIEAELRRRVLTSGLAPVTLRAARLGAEAAVRGAADAVIREVRDDPARWLRRTA

SEQ ID NO: 9826 - protein, 591 aa, Actinoplanes utahensis
MERVSGRHRRNFNLKGASVVGGTMAIVLAVAGGWFAYSRLVDSSCSGSVSLSVAAAPEIAPAVTDAANAWAKDGGNVNGVCVAVAVTSVNPADVASAIAAQHGVVLAGLGQASGATQVPDVWIPDSSTWQLRLRNEASGFQPTKVTSVAQSPLVVAMPQPIAVARKLEGQKVPLTALLSAGLKSADGPKFGIVNPARDASGLTALMAVTQNVGTGDAAVKAQVQALTLLAKNRSELRDELLEQFPKATDQDTLEESLGAAPLSEEDVISYNAKRPPVELTAVYLDGPSVPLDYPYSVLPQVVDGQKISAAQGLLTQLTSGSFKSRLAGQGLRAPDGTYGAGFVAPVGAPKASPAINTAGGGDTGGTAASGVDAASVSKVVGTWNATTQAGRVLAVFDVSGSMNDPVPQAGNRSKAVVTQAAARTGLQLFSDDWAVGVWEFSTDMDGTRPWKQLIPITPLSTGRQDVQATIPLLNPKKGGNTGLYDTIRDAYDTSKKNWKAGKANSVILFTDGVNENDDGIDQDTLLAYLKKAQDPTKPVRLVLIGIGDGVDRTELEKISNVVKGSGVFLAKDPTQITGIFLQAIGSRTGVE

SEQ ID NO: 9827 - protein, 352 aa, Actinoplanes utahensis
MGANAEYVFVGCYTGDKGGEGDGITLLRRDPAGGELTRLGLAARTPSPSFLTRHPTLPVLYAVNELDEGTVSAFSVAPDCSLIPLAVRATGGADPCHLAVTADGRHLVVANYTSGSVAVHPLDADGVPGERSDLLTLSGSGPDAERQASPHAHMVVPAPAGPDVLISDLGSDTVWRSRLDPVSGRLGAPEPAVEAKPGTGPRHLTRSADGALLLAGELAGTLSWYRAAGGPVWELRGTAAASAVTGGVFPSEVIAGRDGRFVYLANRGPDTVTTFAWDGESAAVVAETSTGGVWPRHMIVIGDHLYVANERSHTVTVFRIDSDSGIPVPQGEPTGEPSPTCLLRWSPPMIRP

SEQ ID NO: 9828 - protein, 485 aa, Actinoplanes utahensis
MPGEKGRGRRAGSQAQPGQLAAGRITPQQRDAVALTPLVTGVTADEDVLSVRAHTPIPSQRADETWQAPHLDRYRRRAYCTGIEDAPRRSPWNFPPPTCADSPRPTASCTARCRTPRSSRTGHAAAFCAGPCAAYRLLVPRVTLQTIADRVGVSRMTVSNAFSRPDQLSPTLRRKILDAAQELGYAGPDPTARALAKGTTGAVGILLTDSLRYAFTDLVAGGFLGAIAEELAPTGLAITLLTSAGAGDLIPARDVAMDGALIYSCDPASPAVAWLQRRRLPMVFVDQTPLDGYASVNVADREGARATARHLLDLGHRRIAYAIAGIHGAHGVITDPSTLTEGHASVQRRLGWDDVLHAAGLRPTIIREPFEQVGAIRRDARELLSGPDRPTAFLCFSDVTAAGVHQAAGDLGLRIPQDVSITGFDDGPTATQLRPALTTVRQDVEEKGRVAAALLTAALRGEPAPAPVMLAATLVIRESTGPAPA

SEQ ID NO: 9829 - protein, 207 aa, Actinoplanes utahensis
MTSTYSRRLSMDSVRSDRTGGSRIPVALKILIAGGFGVGKTTMVGSVSEIRPLQTEEILTGAEGADDVSGVEGKTTTTVTMDFGRITITEDLQLYLFGTPGQDRFWFLWDELSQGALGAVVLADTRRLADCFPSIDYFEQRGTPFVVAVNTFDAEHRFGPEAVARALDLDPGVPVVMFDARDQVAARNVLIELVEYVARRQYATAAP

SEQ ID NO: 9830 - protein, 128 aa, Actinoplanes utahensis
MASDGQRVSHDWMDQDAGPVVRPYAMTQGRVAPSGGDFDLVAFVVATVPDLAPGIQLQPEHHAIVAAAWEPISVVELASQLDLSIGVVRVLLGDLRSAGLISLYEPPAASQPHDVDVLKAVVNGLRAL

SEQ ID NO: 9831 - protein, 139 aa, Actinoplanes utahensis
MAQTTKQSANLTWLLDDLVERVPTAQQAVVLSADGLMLGASAAMSREDAEHLSAMAAGFQSLAKGASRHFQAGAVRQTVVEMEEAFLFVTAAGQGACLAVLASADADLGLIAYEMAMLVTRVGQTMSAPERTLSAPDGL

SEQ ID NO: 9832 - protein, 876 aa, Actinoplanes utahensis
MRSRNWSIRSKIIAMVAVPLAALLALWVFATAATAGPAMDLLNARDAVHRLGDPGLQLIAQLQRERHFSAVYLSARKTPLTDLRTQRAATDQAIDRFRTAVRDLRMSDDLSARTGTMLADLSALTGVRGRVDTRDIDVLNMMTAYGDTVDAGFEVSTSAAVFFHEKVDREVRGLIAGYRGQEYLSRVDAVLAGANAAGRIDQKSRGRLIEFVATSRYLLSSGVQDMPEQARGDYARLITGSSFVQLDIMQNQLIDQSYTGGTPPVSGAEWQATYDQVSADLRAFELRTVDEVASDATPLAITVFLWLGLSALVGLGAFLLAIWVSVRVGRSIVGRLIKLRREALEMATHRLPTVVRRLQHGEAVDVEVETPPLEYGKDEIGQLGQAFNDVQRTAVQSAVDEANVRRGINEVFLNIARRSQTLLHRQLSLLDRMERRETEPQELEDLYRVDHLATRMRRHAEDLVILAGAAPGRGWRNPVPVIDVIRGAISEVEDYKRVDIRSVASAAMLGRSVGDVIHLLAELIENAGSYSPPHTRVQVSGQLLPNGYVIEVEDRGLGMTADAIEVANRRLAEPPDFDPADSARLGLFVVAQLADRHHIRVSLQASPYGGITAVVLVPAELITEAPQPAGTRGRGEVTGDLTAPLAAATTRPALPAPRVNGESLPAAKVESLNGRHRTEPEAGGPTPSSVASGLTPDGLVQRKRVRRAPETTAGLPPEATPSRLGDVAGALGVGSRAVPRNSGPVLPTSAAPLFTTPEPPLPVAPTSAAPMFAAPVSAPPADVDGGGEEVTAQFGLDGLPKRVRQASLAPQLRNPVVEPPRSTAPERTPEQVRTLMSALQRGTTRGRIQASRDAEEANNGGESAGGNDVYRPEKDA

SEQ ID NO: 9833 - protein, 210 aa, Actinoplanes utahensis
MSPTATIVLIVVILLVLAAIVFGVRAARRRRLQQTFGPEYDRVVADTGSRTEAERELLERKKRHAQLELKPLSAQSRAKYSAAWEEVQIRFVDSPKEAVATADELVTRLIAERGYPTGDYDERLADLSVEHAATLEHYRSAHEISLRSKNDEAETEDLRQALVHYRALFADLLGADPVAAGTAVPAPRPATEDTTATDRTAPTEPDATSR

SEQ ID NO: 9834 - protein, 255 aa, Actinoplanes utahensis
MRFFTNEDKDDTDREDRADRAAAFPQQRAGSPWTDAPADETAAPGAHRDPAEDDTTRIDTLRPDHEDRVADTHAADATQEIHDHRDDDEDPVDVALDDRGTFDDPVVVEEPVVEEPAAEAVRDERAGDENRATLTETDPVVAVAEPIEAEPVAEPVVAVAGVPGQTPTAAGPSPFFPESETQPLRDRWREVQLRFVDDPKATTGEAAALVDETIEKLTSSLRAHRGSLATGADDTEALRVEFRAYRDILDRLLGL

SEQ ID NO: 9835 - protein, 95 aa, Actinoplanes utahensis
MSAYSAASTVSGDGEPDTAPDPAEGDAEAEADAEAGGAEADADGEADETATDGEAEADAEVTTAAGDARWRAGRIDGGRLHRSAGSSVPDTSPAP

SEQ ID NO: 9836 - protein, 656 aa, Actinoplanes utahensis
MSNDARAATRSAVALTGFLIVAGLQLAAVLGVLWAVLTLLPAAFAVRAGVPLSIATFGALGYATWRALYTRHRVPAGVPISRADAPQLWALVDAAAAAAGVTPPAGLTVVADATAVVGERTRALGLLGGRRDLYLGLPLLLAWDPARLRAAVAHELAHGSSRLGRWAPTAYRGRIAVGRIAPRWNRGRNPAAAVFRAYARVYREWDAPFSRAQELAADRVAAGHAGVAATVGALRDLPVLAGMQRLFHAEYVAPGWTAGHVPEDVFGGFLRVLAARGEDVAILRARGAEPGGPWDTHPPLAERLAALIPAAGDASAEAAAGSPAAAGSPAAADSPAAVEAPAAADVPAESGQPAPEDLVPDLPGLGRALQAVAFPPHGRTEMAWDDFLSVARTAEMEREAEAAMAAVARAVGAEVPDAEGILRLAADGRLRTAAATIFPGLPPEETAERIVDLLALTLALAALRSGVARWRHNWTGTAELVAADGAHLNLTDVAAAAADPEQAEAVRAYLTRLGVRLAAPDGARPAARAQVLGGLINLSADGGRTDVLVTDLGFLLVPGLPRGRGPEARRRLHEIAAAGVTATAGGGDRRFLPFIEVAAVTTMPGRRRGWVIELHDGGRVTLRASLDTDELPGGWAAWEDAVAFLTKTRVSSATNQ

SEQ ID NO: 9837 - protein, 485 aa, Actinoplanes utahensis
MIAIAKQFRVFRVRSQTKRLGDVIPAPALVVPEPAVTFTITPVTTVSAPPAAAAVAAHLGPLADDGPIRLELTDTDGLGAEGYRLAITATGVSLRAAEPAGLFWGVQTLRQLAADDGVLPGGVIEDRPRFAYRGAMLDLARHFFTADEIRAHLDLLVQFKINHLHLHLTDDQGWRLEIPGWPRLTEVGGGPGTGCDGTGPGFLTLAEYADVVAYAAERFVTVIPEIDMPGHVNAALVAYPELTADGRPVAPRTDAEVGYSSLVAGKDETYAFVETVLKTVADVTPGPFLHIGGDECLSTSAEDYHAFLSRALPLAGKYGKRAIGWHEIAATDLPEGTVVQYWRPEPEDAQVLAAVAAGHQVIMSPADRTYLDMKYAADTPLGLDWAGLVPVRRSYEWDPATRLAGVGEQALLGVAAPLWSETLRTVADVQYLTFPRLPAVAEVGWTPQAGRDWAAFRERLAAFGPRWDAAGVNYHRSPEIDWPSA

SEQ ID NO: 9838 - protein, 177 aa, Actinoplanes utahensis
MAITVRHATAGDEQPLHALATLTFGLACPPEARQTDIDEFIATHLSVERFAGHLADPARILLMALDDGSPLGYSMLVRGPITDPDVAAVVDAATSVELSKFYLLADRHGSGAAHTLMTATLAAAAGTGAASCWLGVNQRNVRAAKFYAKHGFGVVGVKRFLVGEQWHDDHIRELRFR

SEQ ID NO: 9839 - protein, 318 aa, Actinoplanes utahensis
MANTSARMLRLLSLLQTHRYWPGAELADRLEVSPRTLRRDVDRLRELGYPVDASRGVAGGYQLQAGAAVPPLLLDDDEAVAIAVGLRSAAAGAVAGFEETSVRALAKVIQLLPPRLRRRIDALQAVTSPGANGFGPVLDAAVLTTIALATRGEERLRFDYDPREGTAARRHVEPHRLVPLGRRWYLLAWDLDRGDWRSFRVDRITGPELTGARFRPREIPGGDPVAWLRARIRAIPSRYDVAVLLETDPETARGVTGHWATFEPAGDGRCRMRMNVDDLGWPTLVLGVLAVPFTIEAPAELHDRVRAAGEALLRGSRT

SEQ ID NO: 9840 - protein, 366 aa, Actinoplanes utahensis
MLGRALQRPFRQLLERLTGPPGARPALRHGNPDAVVDCAVYAGGLRRAEPGQPRQMAYAEAARMARRRRNAFVWLGLHEPDRPTMDQIAEVFGLHELLVERATGGGHRPGVQTVGEVTRLVLRTARYVEHDRLTATSEVVETGDITVLVGAWFVITVRHGPVGPLWQVRQELESRPEVLRHGPWAVAYAVGSRLVDNYLDVAGHVERDLERLEEETFSVSRGAGIAHIYQLKREMVEFKRAVLPLADPLAKLLETRELPAALRPYLVDVRGRLSRAVDRVAGFDDLVNSILQARLAQISIDQNDDMRKIAAWAAIAAVPTVIAGIYGMNFEVIPGLDSPYGFSGAMTAMAVLAGGLYWRLKRTGWL

SEQ ID NO: 9841 - protein, 90 aa, Actinoplanes utahensis
MALRGPRPVTTRLPSIRAAVAGWVDIAWRTDHPVCDAQVQVRGERVRVDYPGNRRAAFFATGRTLGPRRPEVTRVRVTPDFRLAGDVARL

SEQ ID NO: 9842 - protein, 34 aa, Actinoplanes utahensis
MHLSRRIAATFALATTAAGLATAVAAAPVTALAS

SEQ ID NO: 9843 - protein, 109 aa, Actinoplanes utahensis
MTEKAEDLGEPVAYLVLKEGVPVYAPSGDRIGTVEHVLSDEPADVFHGLLISTPDGRRFASGDQVAGLYEHGAVLTEPAEQLARSGADLPGERSGGTLKRAWDWLVQPH

SEQ ID NO: 9844 - protein, 302 aa, Actinoplanes utahensis
MHRGGTRRERERGTMAEIHHFDHGWVTPAFSYLLSVLGSLLGLTGAVRLRSARTRAERGWWLVLAALAIGTTGIWTMHFVAMLGFEVVGTPIRYDVNLTVASVVMSFVAVGAGLAIALLGTSARQLRILAGGVLAGLGVAAMHYTGMAAMRLYGDIHYSGSRVILSVVIAVVAATVALWLTLVVSRPLIIFISALVMGVAVNGMHFTGMSAMSVTPEGHSGVIEGATAQSMLIPIGITVVFGLLGMAYALASAPNEEDRAATEYLNARIEARMAQQAAQARNATGRGTLGNGAWTYRDRASK

SEQ ID NO: 9845 - protein, 292 aa, Actinoplanes utahensis
MASIVIAEDDRDIAELLATVLSNADHSVRTVPTGAAALEAIGAETPDLVILDHHMPGMSGLEVADRLRAEAATAGLPLIMLSAATPAAARHLCDLTISKPVRPRMLLEAVGELLAARVDGGPPADIHPDAATQLADVPRLLAVSDLLTRPAHAAGLDAFAERLAGLTGVPTAAITLMLNDTVVVAGSFGLPRWVREAGGVPAEWSPDTIVVAEDVPVLIGDSRENEEYADTPLFSVSGVRSYASVPLHSPEGHIVGTLCVMDERPGSCTEDTVQTLHSQRAAALGLLLPAGA

SEQ ID NO: 9846 - protein, 586 aa, Actinoplanes utahensis
MSVDPAGRASCSLVSRSARADSRATARSAGSAPRQATASAKSTEATGVSRSPDSTRARKSAAPRSVSSYTVRGGRLPTRPGSRAATRPARCRNLSSVVTVLRVGVSCACRSRRRVPRSYACAGRSPRSSRIGSTRLFREASSGMKLRYGRIHLETTQYCPGSVENAAVRRSGSFRRVARVEPLTNWAGNITFGARRVLRPQTVDEVRELVAAAAELRVLGSGHSFNRLADTTGDLLSLAGLPRIVEISPDRRTVRVDGGIRYGELATRLHAEGLALHNMASLPHISVAGAVATATHGSGVRHGNLATAVAGVEIVRADGELIRLRRGDADFPGAVAALGALGPVVALTLDVQPTFELRQYVFDHLPVAAVRADLADILADGYSVSLFTRWTGTDIDQVWLKREDPITGDTFHGARLADGPRHPVPGMPAENCTRQGGVPGPWHERLPHFRMEFTPSSGEELQSEWHLPREAADDALRAVAEIRERVADVLQICEVRTIAADQLWLSPHYQRDSVALHFTWIADPEAVLTVVADLEKLLGLLGARPHLGKIFTSAPEPPRVADFAALAGRFDPTGKFRNEFLRRLLP

SEQ ID NO: 9847 - protein, 275 aa, Actinoplanes utahensis
MTAPDGGAGFPGRVDASPSSTPRSDPAQPAAAAPPAADTPLAAAAPPAVIAPPALTVPVEPTAAAASVVISAFRAEADALGHVASRWTGEDWTRPTRCTPWNVRELFAHIRIVLAWLPGMLDAPAPGAADTSAAAYYRPDHRFSADTDATRIRLAQQHAPGLDVRAFRGFTADLADRCGTEPPGRVVRTRHGDAMLLTDFLITRVVELAVHGLDLADALARPAWLTPPAADVVLGLLFGRPASELPGPADGLLRQATGRAPAGLDLTGLRPLTLG

SEQ ID NO: 9848 - protein, 266 aa, Actinoplanes utahensis
MTEASPDQPPTPASAPRPPDAVPAAQPPSASASRPSAGRAGSGGQAPVTEEPSLAASAGEPPAAHPGSQPTDGMDHQPTDGADGQPTAGSGGQAVVRRRRPIVTALWVAALAVIGLVAWVQSRPSSPDAERDAALDGLLTFGGPAGWQLSQDPGVPAAGGFAWTQRDGRPVLLGDNGFTVVWSVSPATPDACTALSTWTTSRIGDEAATQVATACPAALARKDGAERVFTSYRTDPGKHGRYLFAARVGGGALFAGLTYERPGAAQ

SEQ ID NO: 9849 - protein, 325 aa, Actinoplanes utahensis
MPRRRGPSVTVLAFDGMSMFELGIVTEVFGLPRPEFDRPWYELTICAETPGPVRVIGGAALHTDHGLDTFAGGETVIVPGVPDVRADPSPALIGALRTAHARGARIMSICSGAFALAGAGLLDGRRATTHWRYAEALRTRHPSVQVDADVLYLDDDDVLTSAGSAAGLDLCLHVVRRDHGPAIANAVARRLVVQPHRDGGQAQFIEAPVPDDPADDRLARSMQWALTHLAEPISVDVLARRAHMSTRTYLRHFTRATGTTPIRWLIAQRIHASLALLETTTIPIETLAATVGFDAAVTFRHHFAHLMRTSPSAYRKAFARTPPVT

SEQ ID NO: 9850 - protein, 180 aa, Actinoplanes utahensis
MVKTPVGRRPGAEAWRDLSGGWHQRHWGRRGGDGTINGMTNTDAIAHFSRRLAFETDVSDVHADLRDGIAGLVVVDSRSDEAWRQGHIPAAVHLPTGRIAALAAELVPAGSTVVTYCWGPGCNGATRAALEFARLGYAVKEMIGGYEYWVREGFPVRDEKGEWSRPADELAAPAGATCGC

SEQ ID NO: 9851 - protein, 760 aa, Actinoplanes utahensis
MSARKLQAGLLAAGLAVGILVAPAAPATAAPAAPAAAAASVTDPTNLATDEDKVKAAGAIGVNPGVDLLVLNDQGFVFALYQRAEAGPYVKAEALRSYLSSDPRAAYTFIVTGIFVAANDDAQAKIAETAAQARRRSVAVTVGLDSSDTALIEKNDRDFIFAVWQRVTAGTHVWTTAQAAIADGTTQTDWDTFLNTGAAAAADQDMRDAIAKADEQLAAQLRAKQLADAKKSLLQLLLLQVTDELVNAPNRQFVLFVHNNAKGSEVSLASQVALNAPDDQLDKALSDFIFTGGAAANKRDEDAAAVIERDGYHARVIPIRDAAEHDGFSPNLLAAAQAALAANTLVALQTFLLKGQDEARAKDRRLDFTSGFETTDPRPNWQDTVDTNGGGATNIGGVIAGLTKAELGVRSFSDGTKFLLYSGKDNSATSSYSYNALYSLSNVKVRPTTKLSYQIYPLSSAGDPNVSGINSTCVAVDIIFADHPDLRDSGAKDQRGNSIHPGGQCGKLKLDAWNTVVVDLGAVAAGRTILRVNVGYDQAANTGGYRGYIDNLKLTDLESAPKFVTSAEPTDTHPTWVNSLDTVKPGGNTWNVGPVVSSVTGPEFKEGTDYGRTGTGVVLYSGKDNGTDASYAYLKAYALNDTYVSSTTQLSYWIYPQSSKKWSTVVGNNSTCVAIDLILQDRIDGSTISLRDTDVKDNRGNIFHPAKQCAKLPLDTWTQVTVPIGSVANGKRIVQIDFGYDQAPGTGAYRGFLDDIRITQ

SEQ ID NO: 9852 - protein, 369 aa, Actinoplanes utahensis
MHRNLRPLALVTASALLIGLPVTAQPASAAPLGAGPLLAAGPSNPTDRYRTLVRRLADNDPRWEVQSAAWSALVSDVPTAVTDFLSSGGGYEKARARATTDASRNNLVISRAIATTTDKTSPIVHLTAQRASYGTLAEKDRYVRTGLKEAQDLDAKHSPVEQAKLQAQQDRDYVTDIAAHGSGAWVRAAAQRAIQKGTDNDIAEFFKYSWASAANCDLQAYRMDLVEQDLTYRHRLDQLIAAAQAAQQAYEAASDAAKAKAAEEAKLAWNTAADTAAATQASWLANSAAAAAQAQAWAAVHDFAVTASTQQDWPTIAGNAANTDASWTDEVAWAQNQAQEWTALYESAKASAEAIPAAPANGPSASPAV

SEQ ID NO: 9853 - protein, 210 aa, Actinoplanes utahensis
MTSAGQAAAFAGVIALAAISPGPDFAVVVRRSVVAGRRHGVVAGLGVATGVFVWSVAAAMGVAAVLEASAVAFTVVKLAGAAYLLWLGVTALLAARRGGAAPEITTDRDTDVRLWVSYRNGVLCNVFNPKCGVFFMAVLPQFVPIDGRPADVLLLSSVAVIVTISWFTVVATLVAALRRVLARPRVRRAVDAATGAVLVALGLRLATAGA

SEQ ID NO: 9854 - protein, 138 aa, Actinoplanes utahensis
MGDNEDTGRVGKQIGGTVAVAVLSALSWLAWMGWDHEYQTDPATGVTSGPYEAWQVIGCALTLLAVFAGAMAAGVRPVLVSVALPLAFTAAWTVTAAADDTTGLYAAGALLLLLGLGAATVVASAITAAIRHWRAAPH

SEQ ID NO: 9855 - protein, 195 aa, Actinoplanes utahensis
MLIKVIDQITDGEMLEAAWGLYLEAFEDLNSLAVQRHLMYRSEFDEVMRDPRVDKYLALQEDGTLAGLSCYTNNLDAIPLIAPAYFERHYPEHYHAKRIWYIVFVAVKPEAQGQDAFAQMSEQMYLVAATQNGLVGLDVCSYNDDVRHMSRVFRLLIGRLCNFNMTFQQIDQQSFWLYNFPAVASENTVDIPRAA

SEQ ID NO: 9856 - protein, 204 aa, Actinoplanes utahensis
MTYAIQELVIRDVTPVDTDEITDLVAEAMRDGPVAKWLHGDPEVRRREAPRYFEIFVEHATRYGEVYATADSETGRLDGVALWFPLTSLIPPPVDYERRLKEAAGDAFDRACQLDVTLDEHHPLEPHHYLAFLAVRPDSQNRGIGSALLERHHARLDQAGLPAYLEANDPRNRDLYLRHGYQIRSVINLPGGPPLWTMWRAPMA

SEQ ID NO: 9857 - protein, 534 aa, Actinoplanes utahensis
MSVGRHQLRHNNTDQWAGRLLTQRKSAAEPDIISRALAQNRLGTASVVFFGVAGAAPLTVIIGSISAIYAIQGSTAVPVAYLVVAGILSLFTVGFVAMSRHIVNSGAFYSYISHGLGRVVGVGAAFVALPAYSLMQIGLFGLFGTAASGIFAEFGLQVSWYACAIGAWVLVTVLGMLWVDLSGKVLAALLVAEITIVLLYDLVMVSHPAGGHVSFATLSPAPMLTPVVGSLLVLAIAGFVGFEATVVLSEEAKDPKRTIARATHIAVLLAGLLCGVSAWAMSVTTGPDRITAVAAEHQTDLVFRLVSPHLPVALVDVGYVLFMTSVFAALLAFHAAVARYQFALGREGVLPSAWGYTHPRTGAPLVGAITQSVLALGVISIYAVVGLEPLLYLFAWLTTIGGLGVLILMWSASAAVIAFFQRGRRGESVWRAYLAPFIAFLLLSIVLAATIIGFGQLLQVSSGSIFNWIVPVAYAVVALIGFSWALIMRRTRPDVYAAIGRGAETRVAFPALETDFSPHVLPPAPVGSRGYPSW

SEQ ID NO: 9858 - protein, 213 aa, Actinoplanes utahensis
MLADQYYLIAHEDRTGRSRLHPRATGLGLAAALLSELVLEGRIGVTDGDLFVLDRHPPADALEHDILDLLVAQPQHRDVRTWLAFLSQDAGLRVGERLMRIGAVEPIVRRRMLGSPSVTYMPNSAQQRNAAAWASTRLANLLVRGMELSIVDQMLVSLVSATGLTRHVLYGFEQYPHAFQYVPNVAFGLPSDLREIVEYTEASIGSVLTVGRR

SEQ ID NO: 9859 - protein, 282 aa, Actinoplanes utahensis
MSDIEGPTLRRRRLGVELKRCREAAHLTQQDVSRHFEWHSAKVTRIETARVAVTPRDVRDLLTLYRVEDDTYREALVELARSSRERSWWTDYKDIMRPGNFVGMEAAATSMRCWEPIIIPGLLQTEAYMRALISTGRSADPPQRIDRRISLRLTRQSRLHGDHPLELAAIVDESVVRRVIGGEDVMRAQLDHLIEIAKLPNVSLQILPFGSGEHPFLGGAVTLLEYRDTTHLDVVYLEGIAGDYYEEQPTEVARYRQEFERLSTRALDHRTTIKMIESLLVA

SEQ ID NO: 9860 - protein, 72 aa, Actinoplanes utahensis
MLAHQLNGAVWKKGSRSNGNGGNNCVEVAFLDEGGIAVRDSKNRTGPALLFTPAEWTAFVDSAKDGEFDIAP

SEQ ID NO: 9861 - protein, 274 aa, Actinoplanes utahensis
MRLRRAVAVMAAAVAATTAVLAGPTPARAVTAVTLANTIKLSNCSASLVRYPTSVSSDRAMMLTNGHCYEGGLIPSGTVLQNRTSSRSGTLLNSSGRAVATVRADRVLYATMTGTDVTLYRLTSTYATLSSRYGATALTISANHPAAGSSIVIPSSYWKRIWNCTINGFVPTLREDEWTWHDSLRYDSACQTIHGTSGSPIVDATSGQIVGINNTGNDDGEMCTLNNPCEVDANGTTHAYLGQSYGEETYWFTTCLTGTRTIDLTISGCLLTKP

SEQ ID NO: 9862 - protein, 453 aa, Actinoplanes utahensis
MTMLAEMLLHEPAPVAIWAALWLATIPAMVVLASPTGVRNPVQALIDAGAFLIGRPLRHPRRREPPTNDFFPGDPIPFLTSGDPSLATPAGPAPFADSADSTPSATASGAPSLSSADSATASAAPSLSSADSATASAAPSLGSADSATASAAPSLSSAGSAPSVPVGLASTFSSADPAREVPADVTPGFPAVSAPAAQEGTSFAARGSSAGRHHAAGLAGHAGEGDAGLASRASGRRPLLRRLFHRAAARREERLRRETEAVRSVRYAEEVRVAAEQAGYAADRWQEHWEATAARVDAAFRAWQAADARLQRSRTAIAYGTPATEQSPAEYVDRERFLHLAVRAAAERGELPTSAVADALTGRGGWDARLHPVDQELVIQRAAATHLEAVWKRAAAAEKLAWRDAQTARRNWQSLCQETILAAAHATAVHHLLPTEPIIIPATTHPAPVARVA

SEQ ID NO: 9863 - protein, 85 aa, Actinoplanes utahensis
MPATGWVLAAKKARTSANSAGNDRSTELRCAVVVMTVKVSARFGRPGEAARRTAGFTRRWRGRESEAHKVGESRKWGDREWGDRE

SEQ ID NO: 9864 - protein, 606 aa, Actinoplanes utahensis
MRIRAGAADPVLVGLLVLGVLLFPLFLTGLGGDRASWTVQTAIDLADVLFAWRLARHPDVPPVGRRFWRALVVACAACTAGDSFQTMLAYAGSGAQISMVQTILVVAGMAIVVVAMLRHPLGGEGRQRLRLWLDAATVLTGVAVFLWYYLLADEWSGPQEMHRWGAAATAGVMLLIAFGVLKMLFSGTAPFSRTAGLLGCVGLAGTGPGAALAGVLAGGEMDPGVMYLVQLLPCLIMAVALRLQLVQSRPVDPARARRVAQRPSVLPYVAVIATQVLVVSALRGGRPGLGTWGVAIGAVVITALVLARQLSAVRDNERLLIELDQQREWFRALVQHTSDLTLVVKRDGTVQYASQAADRVLGLSPAELVGTSLHDRTHPDDRAAVDRLDEHQSAHPGESVAFQVRWRHADGTYRWLDLISTDLYHNPHVGAVVLNARDATETRALHDELQRQATHDALTGLANRVLLQRRIDEAAGDDPYETSMLLIDLDGFKAINDRHGHHAGDRVLVLVAERLTALLGPGEVAARLGGDEFAVLLPGTGAAEAAALAERITAVAAEPMLINGRWLSVGASVGVASGRAGEGDRLLREADAEMYRRKHDRRAAIG

SEQ ID NO: 9865 - protein, 187 aa, Actinoplanes utahensis
MGNGFIEAALSFPTVLLTPLLILVIGYWIVVIVGGAGPDAGHDHGGLLGVPLPVSVSLLVALAWFGTLAGSQWPGPVPPGVIPPVALVAAALVTRLIAIPLRRLLPDGPDASRADFVGRTCVIRTGRVTGTFGQAEVHAEDGSSAIIQVRQTGVDALPAGTVALIYDVDPEGEFFWVVPADIARKGL

SEQ ID NO: 9866 - protein, 640 aa, Actinoplanes utahensis
MDVVSTGFGVLLAVVVLIAIGVLFFLSRMFRKVEQGKALIVSKVRRVDVTFTGAVVLPVLHKAEVMDISVKTIEISRTGREGLICRDNIRADIRITFFVRVNKTTEDVIKVAQAIGTSRASNEATLQELFNAKFSEALKTVGKQLDFVDLYTKRNDFRDQIIEVIGTDLNGYSLEDAAIDFLEQTPLGSLDPKNILDAQGIRKITELTAIEAVLTNDFRRNEEKEITRQDVDAREAILELERRKADAEIKQRREIETIRAREEAEIALARAEETLRSEAARLKTEQQLGVQAENKNREIAVAEKNRERVIAIETERIEKDRMLEVIGRQRETELSTIAKDSEVETEKRAMAEVIRERIAVERTVAEQEENIKRLRVVEEAERTRQAVVINAEAEAQEALVKDIKAAEAAEAAARFKAREQLLLAEAKQQAAELEAQAAIRLAEGKQAEAAAFGLAEVRVRERNAEAIEKTGRAEAIVEREKALVAAEAIKEKLKGEAEGLEQKASAMATLDEVTRAHEEYRLRLEMEKEIRLAGIHVHREIAEAQARVVAAGLEKADIDIVGGDSVFFDKLIGSITLGKSIDGFVEHSSVAQAVGARYLNGDGDLAEDLRKVVGAVSTADVANLSVAAAVANSVTKDKSE

SEQ ID NO: 9867 - protein, 501 aa, Actinoplanes utahensis
MTIDAGTYEVLRGRLDAKARELAGRAETLNARRIEAFGAQQTELLGTERIRTGNNAVPADVAPAGEVLLFGANAFLGMKAETAVDDVFTVVDRKFQPAAAPGLLDDPGFRRDFAELYRYYRGTRLRQLRRVEGQLLAIFQTGARAGDLKVLRWQIGVDGTVAYQDARGERDHVLPPTHDFEWTVTSREQHVLGRHPHVSIEDEVFVETVGGDLTVKVEDNTEDGAGVYSEPVDQPLQSLADAEIAYARVGPLILLRVLPYQETAYRYLVFNTRTRDVRRLDGIGQACRRLPEDQGVIFPGGYYLVTGAAKTFDRDTAGLAFERVVRSVNGEDVLHVFHDADSGRYLLLPYNVIGKQVATPITGHGYAIFDDGTLVVLRSPGDEPARVHPVQVWRTPYVSDAHAAAQPAGTGPLARIGNADLVRGIADALTVSRMVGEMSAAGPVFEAIIAACTRTFDTYHWLADPELENLAEPLAEVRAAATRVLDEFAAVQALTAQAEPS

SEQ ID NO: 9868 - protein, 1089 aa, Actinoplanes utahensis
MRYADGARLDAIDASLVTATDDTARRAVEFLRHPDAFADYQASVEELAGQAAAIGTVAEGEPVAGRITEQSDGLQVVTEVVGGLEIADATVRVSILDRIGAVLGGLNRARATVDARRRELAAVEGRAAFAAEFALFGQSVSAALAAADTPEHCDEHLARLMAQVETLESRFGEVDDFGERLATRRAEVYEAIAGRRQSLLDERARRADRLAGSARRILDAIHRRIATLGDPDEVNTYFATDPMVAKVRSVADRLRADGDPVRAEELDGRLTAARQEAGRALRDRRELFGDGGIRLGRHTFAVNGQAIDLTLVPHDGGLAYAITGTDYRAPVTDEAFQQTRDFWDQPLISEYRRLYRAEHLAAAILAEEPRAAATAQAEGRLRELVHRIADSRYDEGYERGVHDADATVILDALLRMHTTAGLLRYPPRIRVAAQLFWAYGATAGQRQAWQLRAASLIRVRAMFGSAGRALDDLRAELTDAATDHLGTAGLSAAGVATGDAEIGEYLVDELAGTPAGFVTGAGARAFLDRFHRELGGAESAPARQYAEDLRALAGEPAVRHQLVYAWLEAFHRARPDSGDLNDMLEAVGIEVVGTGLTRYDVAATVRETVTGLLGVHPRIKDGQLTVRLDALLSRARHFREKRMPAYRDYQSRRAALAKAERARLRLDEFKPRVMTTFVRNRLLDDVYLPLIGDNLARQLGTAGAERRTDRSGLLMLISPPGYGKTTLMEYVADRLGLVFVKVNGPALGHGVTSLDPADAPDATARQEVEKISLALEMGTNVLLHLDDIQHTSPELLQKFISLCDAQRRMEGVWNGRTRTYDLRGKRFAVCMAGNPYTESGRRFRVPDMLANRADVWNLGDVLAGREDLFALSYLENALTANTVLAPLAARDGADLPLLLRLAEGDETARADRLAYPYSAAELEQILAVLRMMRRAQRVVLRVNQAYLASASQAEAGRTEPPFRLQGSYRNMNKLAERIVPAMNDDELEQVIDDYYLGEAQTLTGGAEANLLKLAELRGRLAPARAARWAEVKAAYRREQTLGGAEADPVTRAAGAVALVADRVAGVEEAIRLRTRAAAWTAERPDRPAR

SEQ ID NO: 9869 - protein, 206 aa, Actinoplanes utahensis
MMSRVSDMYEPRPSAPDWQTRVLPTVPTIDEREAVARRRRLIVLGSAGAFLALAIGYWALSGPGDDKSAPAAAPATSAQVLQTTSIEPLIESSTGPSPKPSSARPSSRPPAVSAAQLTRVLQQMRGEVFVLFRSRQLERDDARALNTRLRKIAEELRKDDREGAGKQLKSFAKKLADLHDDGKISDAGFTALAGQAAQLSTQLPVS

SEQ ID NO: 9870 - protein, 325 aa, Actinoplanes utahensis
MAPGVAAAISQHMLAVDPPDHTRLRRLVSAAFTARRIEALRPRIERITADLLDALSGRDEADLIDAFAFPLPIQVICELLGLPAEDRDEFREWSDTVVAGSQAGPRLAPALEAMVGYIRDLLAVRRRTPGDDLLSGLIQVRDADDRLTEDELCSMVFLLLIAGHETTVNLIGNGTYVLLRDRAGWERLRADRSLLPSAIEEFLRFEGPLQTATFRIAVADVEIGGVTIPAGDPVIVGLLSANRDGERFPAAAELHLDRVQSPAHLAFGHGIHYCLGAPLARLEAQVAFTALLDRLPGLRLAVPAEALRWRPGLLIRGLETLPVRW

SEQ ID NO: 9871 - protein, 94 aa, Actinoplanes utahensis
MERCHPRVEIGVDPTYGRAMTQEIADLGDAVFQADPHPVYERWRTSGPVRQVRMPSGLTVWLITRYEDARRALADPRLSKRATPMPAGQAALAS

SEQ ID NO: 9872 - protein, 167 aa, Actinoplanes utahensis
MEILTPLLVIAALAYAMVRRYLGEPLTARRLVVLPLALTVYGGFMVAQAGLTHVRADVVALAVGGVLAVAGGALRGATVRVMVRDGHLWYRYTWVTLTVWIGLIVLRLVQATVAGTLGADRPVLAASLVLALGLSFLGEAAVVGPRAMAVGAPFAPRRSRRRVAAGR

SEQ ID NO: 9873 - protein, 362 aa, Actinoplanes utahensis
MNTADRTRLPELWRRARNLLVLIAVTVVMVQDHAPWPLVVIGGLGWALLTLRVLPPRPHLVAVCVTLASGLALTALGARGVAPVYLVVALAGSAAVLDLITTGVLAGIGLLALAATLATHHADLSSIAVWCGVLIAVTLLVLLRRQREASAEQERLLADEQALAAMLAERARLAREIHDVLAHSLSALSVQLETAAALLERDRTTEAAALIDRAGTLARDGLTETRRAVSALRGDPLPVPELVAELTAGYARDLGAPATFTVGGEPRELDPETGLALFRAAQEALSNVRKHAPGSAVDAHLAFEAGAVALRVRNHGPAGPPVTGLSSGYGLIGLRERAEMAGGSVTVGPDSDGWLVDVRMPG

SEQ ID NO: 9874 - protein, 221 aa, Actinoplanes utahensis
MSIRVVVADDQTAVREGLSLMLSLLDDIEVVGEAADGEQALELVGRERPDVALMDLRMPRRDGVSTTAMIREQFPETRVVVLTTFADDEHILGALRAGAVGYLTKDAGRVQIAQAVRAAAIGQGVLDPQVQQRLLAAATGGAAAAGGTAARAERELPDGLTAREAEVLRLIAAGLSNKEIAKRLFVTEVTVKSHVNRLFAKAGVRDRAQAVRYAYQHGLSA

SEQ ID NO: 9875 - protein, 207 aa, Actinoplanes utahensis
MACVLLISGSTREGSVHTAALRTAARFAPAEIDARLYSGLAALPAFLPGDPAPPASVVDLRRQVAAADAVMISTPEYAGALPGSLKNLFDWLVDGGDLTGKPAAWLSVVAPGQDEGARAGLESVLEHGGARLLRAGCVRVPLDVRAVDERGLVDDPLLHRAVQDVVQALIRSLAGPRPQPSWQVHSSVYPVITRNDAPSFVRRPDFR

SEQ ID NO: 9876 - protein, 607 aa, Actinoplanes utahensis
MGIVRRRPYHLPLILLVLVTTSCSVPHPAPRPAPRPGLPAAQIRVDQAGWATGESKVATLLAPADAAGARATVVDAAGRTVLTVAAGRSRGHWNDHFAATNPLDLTALRTPGTYRIRLDDHYHAESPPFRIGAAADLYTPLVADTVRYFQAHRDGADQVPGPWQRTPAHLDDRNATVYATPEPDDSVLASTGATLDVSGGWYDAGDYLKFAHTTAYALILMQLVQRDGPAPAALPDEIRHGLDWLTRMYRDGVLYTQVGVAGNDHYLGDHDIWRLPQADDDLSVQPGDRAYYQRYRPVFRAAAPGEPISPNLAGRVTAAFALAAQLSAANDPARARFYLDLAATLFGQAATAPTGDLVTTVPRDFYPEESYEDDLALGATELALAGKALGDPRTAGWTGQARHWADATGGGDDGLTVYDVDALADAELYRLAPAAPLVADLRDRLAGAVKAAGRDPMDATTGAGGADYAARQLGWAATAALYQRATGDTRYAAFGTAQRDVALGANGWGVSMVIGAGARYPQCPHDQIGTITHAALTGAVVNGPNVAGRVESLESEDDSMCTAGSYSAFNRDDAQYADDMRVSATNEPSLDFTATGMLAFALTARPR

SEQ ID NO: 9877 - protein, 74 aa, Actinoplanes utahensis
MVLSERTAGYDDPGEPGRMIEYTAAMCGETLTGAARPGAGPDDFCSRVAVTCGPAPATEEGPSRGGPFPVLCAA

SEQ ID NO: 9878 - protein, 423 aa, Actinoplanes utahensis
MRQDGCAENSRTGTEMVDLRRCVATLLALSVTVPLAACGKGDKPAPAAAASVAPGAAAIPESATTAAPVTLTVSPAAGQKDLPTSTEIGLKVGNGTVTSVRLTDAEGGTVAGALRPDGSSWVPARTLKNRQAYTAEVTATGTDGTTTTAKTSFTTMAAGGRHTGTGLYLFDKQTYGVAMPVVVEFSPGIRKADRAAVQNRMFVETTPSQPGTWSWTSSGTAAYYRAPQYWQTGTRLKVRIAVGGLPTGKGLHGDRDRSATSTIGRKLEMKVENASKKMTVLQDGKVVRTMPVSLGKKSTPSSSGHMVIMDKMAQTVFDTTDTDPTGGYRVNIQYAQRLTWSGQYIHSAPWSTYAQGHQNVSHGCVNVSPSNARWLFDKTLIGDPVTVQGTGDRLDYGNGWTPWDVSWEKFAAGSALPVPAGLG

SEQ ID NO: 9879 - protein, 411 aa, Actinoplanes utahensis
MTPVRSAGSGRRQMRVTLVALLAGSLLFTAACSGGKSPSWQGGSSGGGTTESGTAPSAQPTLSTVAVTSPQSAATGVEAWSDVKYTSEDPENTTVKVTDADGSEVKGTVDKDAKVWHPAESMDWGKQYTVTVSTPAAQGKGNQTTSNFTIMKQPANLVRVTSFLGDHQTVGVGMPLIVKFGRAIPQSYRATVERNMKVTATPAQEGTWRWISPTEVHFRPQTYWKANSKVFYKVALKGVKMGDGWYGRSDMTVDINIGRSLIMTVSNKTKKMTVTQDGKVIKTLPVSLGKAATPSSSGTMVVIEKKEHTVFDTTDTDPTGGYKTNIDFAQRITWSGQFIHAAPWSEGVQGKRNVSHGCVNVSEAMGAWLFKQTMMGDVITVSGTEEKLKNGNGWTDWNMSYAEYKKGSALS

SEQ ID NO: 9880 - protein, 195 aa, Actinoplanes utahensis
MAAYAVKRPAARGPAPPGRRVTPGDRVPRTPCGDGRNVLGMHIRPIHQGDAPRLAVLLEQLGYPSTEKDVRHRLGYWLDDRASHLLGADDDGVLAGVAALHVTPIIEVTGKFARLVAIVVDADSRHRGAGRALMAAAEQRARAAGCLFMEVTSDRERLPAHRFYESLGYTDTHESSRRFIRRLTPADPARSTTLD

SEQ ID NO: 9881 - protein, 175 aa, Actinoplanes utahensis
MVALIVTCEIGFWIFLLAGLAVRYLLRRRRTGAALLLGAPLLDVVLLGAAAVDLRRGGVPDFAHGLAAIYLGITVVFGHEMVRWADTRFAHRFAGGPAPVPPPRTGRAHAARERRQWLRHLLAYAISAALLAAFTPLAGGFDRAAPLWQAMGPWTLILLIDMVISLSYTLAPRRP

SEQ ID NO: 9882 - protein, 123 aa, Actinoplanes utahensis
MLLILVAGVAGCSDQRQPGAPGSPAAASPSVADDPPGRLTCQNLAAAVRSASLMDPGVVDRIVAASGSADAPVADAATALGEAYRNARASHGTPNEPDAIAAVSAAAADMSQVCADSGLDSAD

SEQ ID NO: 9883 - protein, 260 aa, Actinoplanes utahensis
MADLAEILRREADRHVPDGDAMFDRIDRGRFAPEPVRAPRPFLRRFAGLRPVAAAASVVATLVAGFTGIKLLTAEEPDRAPAATTTTTTASPASSPSPSPAVPGTSSPAAKAKSPAGRGQVTSAPPSFQPVNGFLTSRGVIDVYSTDDWAQSDVTVASTKVITALDLAISVARTDGVISTGSWSTIPAAMITMSVTEEKAAVIYRFILKPGGTLAAGSYVFAAQYQHAAGKRQPGADLYGGIVAAGDRKAEVTGGFPAGG

SEQ ID NO: 9884 - protein, 221 aa, Actinoplanes utahensis
MARQDQVSVQRAGRNRGVHRLGAARHQRVLGEDQLTRSACGPSTVRKSRVPETDDEGAFRRFFDEHHADLSRLAYLVTGETQVADDLASDAFVEVWRHWARVCAADSPIAYARGIVTNLARQWIRKQTRDRAGLLRLGLLRRDRGETDTPAILDVRAALRRLPLRRRECVILRYAFDVPEKEVAAILGISLGAVKSHTSRGAAQLSEFLREMPLTTGGHHG

SEQ ID NO: 9885 - protein, 403 aa, Actinoplanes utahensis
MLVKRFVVPLAVVAVGAGAAVVGVLNADAAVTAGCAVTYTVGSRWNSGFTGDVEIRNTGGSAIDGWTLRFAFPSGQRLASGWSGTWTQTGATVTVTDAGWNRSIAAGATVSLGFNGTLGGPNAIPDAFVVNGMTCGTTPAATKTATAATTKTATATAAKTPTVTTTRTPTATAPPVKNCTDYAALVRGRYWVNNNTWGRADGAGSQCVWVNGRTGDNLSWGTDWTWSGDTTKVKSYAGAVLGWHWGWKTTGTGLPVRLSAGRSVRSSWNFTVTPKTSNIMNVSYDLWLHAMGNADWQDQPTDEVMVWLYRSGGAGPIGTRQATVMVGGTTWDLYKGNIGWNVYSFVRTSNTTSADLSLTDFTTDLAGRGWLDKTKYLSSVQAGTEVFTGSGRLDTSAYSVKIS

SEQ ID NO: 9886 - protein, 37 aa, Actinoplanes utahensis
MAHVPTVDNTNGGTKLSRFYRDMRVWDNDPFFVQVVD

SEQ ID NO: 9887 - protein, 179 aa, Actinoplanes utahensis
MTDEDTSPTLRLAGNGEVSASNGFYELLDYEGFDDIPPDANVDNGLVSVGSTGAIILTGTMVGPVALRVEIHHAAPRLDVAGWERVVEVEQYTASGIVSVNSPLIGDPGLPSLETTGNSWYRIRIHARGIEEARAYPATVDSPVEHHLLQLWPAVPETSTEDHEFPNPALREYRVLHPG

SEQ ID NO: 9888 - protein, 37 aa, Actinoplanes utahensis
MDIAAHAFLAAATTVSSETPDGLIAVTVTNSAVCSTP

SEQ ID NO: 9889 - protein, 109 aa, Actinoplanes utahensis
MRMEPSLSLPRPPCSRRCRSRTAGRSLNTPATTARVACRTSSVVPAGTTHWSVRTCGTFVTARLGHLDGVLLVDETGDLKKGTQTVGVQRQYSGTAGRIENCQLAVHLS

SEQ ID NO: 9890 - protein, 191 aa, Actinoplanes utahensis
MWIDCEMTGLDLGKDKLIEVAALVTDPDLNVLGDGVDLVIHADDAALDAMPPVVRDMHAKSGLTEEVRRSVLTMAEAEEQILAYVKEHVPNPRTAPLCGNSIATDRGFLARDMPALDAHLHYRMIDVSSIKELCRRWFPRVYFGQPAKGLSHRALADIRESIRELEYYRRTVFVPPPGPDVETAKAVAADL

SEQ ID NO: 9891 - protein, 1508 aa, Actinoplanes utahensis
MRLIRPVLGMLLLTIGLPALLAGGCLWAVLRHRDAGGAFSAELQRLDAPGYAIVVPDVDRLLRDDASFARIGGTELRVTALTAGGPAFIGLAPAADVDDYLRDVPHTEVSGVQVGTGELPITATRVDGSTGLPSAPGHQSFWTSTGGGALRWTPETASGDYSLVIMNATGARGLRLDGTVEARPGWLDPAAWALLTLGAILLMAGVVVLATPGRRRDIVYVVEPSQVPDLMKAIGAPLPMRALEGGTTDGLNPAGALALMRRGLVGFGHGDDAGHAGLLQRAFGQRLPGSHRDSDTLTGVFGGPDGAHRPRTLADSQPARPPALPQFAWPPKKAGGTEGEHLPVTSGLRGTSSAASASHTATSIRPNALTPVVPGALPVPSPASATESASAGSAPAAGRAVPSGSSAAPGSEPIADSAASGPAVMDGSAAPWGSMADPASVDVAGAAVFGAGRSAQSAAAAVFAAGRGAESAAAPVSMTGQDAESASGPVKAPGGAPGNRQRAEAPAAGPNATGLAGAAAPALTPGRPLGLLGETPAPAGLPAALPGTRPDRQSRRRNAAAADLPEFHATAVGAWVAQTAPERARQTEAQAAAALREAARHRAAPATGVTPAKQADTAFRAAPSDAEPAEAVPAQPVEATSVEAGKPEAVTGGATSAAVVQGAAMTGGLASTDGMNADVAPIEGAKTQAATTEVSQPEGATVEVSQPEGATVDGTSTSVEPADVQSGEVESAEATRRGEGKPGHGRGAWPAPAPRRVALLTGPSATDWSATGLTRMGSSRPSPKSAAHPSTAGSPSHAGFEPGRQSSAARSTDTVDAAADAADTFDTADTAVAAAKPQAMPSRAAMGAAKIAVASGAVKVAAPKDALDTKDALDTKDALDTKDALDTKDALDTKDALDTKDALDTKDTEIADAGDSRAALTGTAPKAVPAQAPATEPTAKEAVTTGTAAPDEAATATAVTSPADAGPAANQTPTTDPAAGDTAATEVSASGTAVSPASAAGAVVEDEPESVDTAAVDGETAVEATAAVTGDAPAIEGVVSGTEQRNASGEPAPETEKRDEPKTPIVPFPTRHPSTPARPVPSARVGERRLSIHEAEAAPVPDTEAVPAEPARPETEKLVEAGGSAAVELVETDSSQTVELVEAGGSAAVNVVGTDSSQAGELVEAGGSAAVAKAEAGDSAGANPVSSASQTVKAGGSEGVPSSAAERPSLHAAEAGIDGEASEVPGSAAESDRPGGEAGPRADALEKAGKPAVKRAEPKRTAEPDHPLSRAQDRLSGAAGRQSGSAVARKVPAAWLKAAETVAARAASQTSADEPAAPESAGSTETPAASGEPSAAGTASVGSGAGSVAPAVAQAAEVSPVARKPRPRTARPAAEKPAVVRQSAGTSDSGQPAARGAAGRTDGVPQSGRTGEEARGAEQAVGARQVSGAGQVGGAGQADGDAKAAGAGEAGGAADTGAVEVAKPAPRMPNYREEAAELLAGTGEPKRRRAAGGRGSARNRGKGTPEQG

SEQ ID NO: 9892 - protein, 553 aa, Actinoplanes utahensis
MAVMTVDRRRGATVLLGLLIGLIGVLLSAGPASAHAALVSSDPGTGTIVPDAPNKVTLTFSESVQLISGKIRVVAPDGSRADQGDPAVDGSRVTIPLRSGGARGTYLVTFRVISADSHPVGGTFSYSVGAPSTPPSADDSANVKVDPVVRTLIPVGKYLGYAGLVLLVGPVLVLALLWPQRLSRRGPGRLIWTGIGLVTGSTVLAIWLQAPYTLGTSLFDVRVGDLRDVLGSTFGAVMLVRLAVVVAAAFLLRPLLVGAGGESRLDLALLGVLGVAALATWPLTGHPTASPVAGVSVVLDALHLAAMSVWLGGLVMLFAFLLPRANARELTAILPIWSRWAFTAVGALIFAGVVQALIEISTLSGLFTSTYGRLILVKAGLAALVVGIAAYSRKLVRDRTAEESPRVLRRMVLAELAVTAVVLGVTSALVQIAPPRTAEASENTTTDTTVSQTLTEKTMTLQMDIYPATVGNNSMHVYAYTPDNKPQTVLEWKATAALPSAGIEPIEVPLLRITDFHAIGDFALPQAGDWTFKFTARTSDIDQTTFTATVKIR

SEQ ID NO: 9893 - protein, 200 aa, Actinoplanes utahensis
MRNTRPVRVPDDARTMRLVTDGEHETDETTALALAARAGDPVAQAAFVRATQTEVWRFTAALVDPGAADDLTQETFLRAFRALDSFQGRSTVRTWLLGIARRACADHLRAVVRRRRLDVRLAAQAATEAPAPDPAHRMTSADLLSRLSDERRTAFVLTQVIGLSYAEAAEVEGVPVGTIRSRVARARDELITAVARAQAS

SEQ ID NO: 9894 - protein, 161 aa, Actinoplanes utahensis
METTTRASAWPWVSTLARLGLAAVWLIAGATKIGDLAESARAVYAYHLMSYDVAKVVGGVQPFLEIALGLLLLAGLSTRLVAGISAVLLAVFIFGIAWAWAKGLRIDCGCFSTGGDLAAGRATEYGLDILRDLGFLALSGILLWRPRTRFSIDGVLMGDAS

SEQ ID NO: 9895 - protein, 264 aa, Actinoplanes utahensis
MAATDPVLNRWRADGGCVVSKGSRDRAVKARQIVERQRAQEKRRKVTLWTSVAVVAVLVIAGFIGYSQLSGTDDGKLVTPSVAVDEGTAFAVGSGPVTVDLYEDFMCPNCKNFEGSSGATLRQMATANKITLRYHVVSILDRSSNGTRYSTRAAGAGAAAAEDGRFPEFHDVLYANQPQEGSDGLSNAKLIELGKSVGLTSDKFANAVNAGTYEAWATQNTETFSKRGFNGTPTVVVNGTQLKGPNDTVPQLDQITQAVTKAAG

SEQ ID NO: 9896 - protein, 376 aa, Actinoplanes utahensis
MGDAEHRDVLQAWLQRHADRRGQRHPAQGSERHRAAARPDHPGRHEGGRVRRITLILAVAGAMIAPATPAFAHGGEGANVTSYRTTVSGISDPMRGLSVRTVEGGARLELTNDTGRSIEVLGYSGEPYLELRPDGVYQNLGSPAAYVNRTLAGDTPVPPVADPTAPPSWQKVSAGHTIRWHDQRTHWLGTVRPPQAVTDPGHAHRLRDWTVPLRDQVRLFAIRGALDYEPPPATWAWWAGVLLLTAALTALIRLRPRVIPPLAVVSALSILAYAVTRGLDGAGWSGVLLLTAALALGAAWKHPPFYLALSGFVIAAFAGFASSDVYLAAVVPATGPGWLARACVTATLTTGATLALTGLLQMRAAVPDPAPATRVS

SEQ ID NO: 9897 - protein, 439 aa, Actinoplanes utahensis
MYLHRLRISDVRGFHGSHEVDLGFELSADGEPTDRYPGLVVIAGRNGSGKTTLLRAAATALAGPEVTNSLTEGVRDWVTHEAATAVVHADIRLAGDEIFPPERFLEARLRWPRTEGARARPESGLDSRSEQHARISLWRSNPESWFAAGYGPFRRLAGSSSEVARLTAGDWTVARFATLFREEASLAETVHWLQQVNYRARSGQQRYADMEGFLLALLNDGLFPDGHAVDRVDPDGLWIARQSGPPMLIEEMSDGYRSVTALITDIVRQISDCFRLGVPWTGEYPPRVLTSGIVLIDEVDAHLHVSWQKRIAPWLREHFPNIQFIVTTHSPYICQSASPGGLIQLPGPDDDFAPRVVDDELYRRVVNGSADDAVLTELFGLESPYSQRVDELRAELTRLERLAIRGHAQAGDLEKLAELSEELSPSPSSRARDVLGGEA

SEQ ID NO: 9898 - protein, 243 aa, Actinoplanes utahensis
MIPFARRPLPGSLSTSLAARTRQLSGSTSPYQDARKAWKTATTTRRGLKTHLCVSCARPAFCMYCHESRGTDVDHYEPIRRAPLRTFVWDNHLLACAYCNQQAKQEVFPLDGNGQPLLLDPSVDDSADHMTLLSTGVFEGLTTRGAETIEVLGLNKRPELVRARTVSWRGVVRVFDQAALHGGVLTPNDLEDLRFLPVVDAFHHFAHDVVAGRLGFKGVRPHVVTSADANLAVIRGLFPACRL

SEQ ID NO: 9899 - protein, 187 aa, Actinoplanes utahensis
MRIPFRQAVPARLSLVKTRWTVRFPMCSRGHGNAGLASRHGSSVRSPAESRVALPCRERSTQAMTEPTGGTTANGNTTVSGEVVEKIAAAAARTVPGVADLGGDVARFFNSVLDRVGLDTVGDASRGVRADVKEGTATINVVVVLAAGTVVAEVVTAVQQKVTEAVQSYGLRVLAVNVNVDDIALQA

SEQ ID NO: 9900 - protein, 141 aa, Actinoplanes utahensis
MDNDHYGDELTLRLSGIADISALDDDEVLTRFMRDLVTRIGMTVIAGPLVATEGGPPEKAGKSAVVILAESHAAIHTYPHLREIFVNVFSCKPFRETDVLAAFHRLVGDYSVTEYTLRRRGEQWPRDLTAAERLWSARRAA

SEQ ID NO: 9901 - protein, 158 aa, Actinoplanes utahensis
MTDNVRLSAGDAAPDFTLTTDTGESLSLKDLRGRKVVLYAYPAAMTPGCTKQACDFRDSLASLQAAGYEVVGISPDKPAKLAKFRDQDAITFPLVSDEDKSVLTAYGAFGEKQLYGKTVTGVIRSTFVIDENGAIERALYNVKATGHVAKLRRDLGLD

SEQ ID NO: 9902 - protein, 309 aa, Actinoplanes utahensis
MSAHRRPFPTRWLAAGGAAGLAGIIGVALVLQSGGSACAAPPSTTTKTGKATFYDLGGTSGNCSFEVPADDLYVALGPDEYSGGASCGAYLDVTGPKGTVRVKVFDSCPECDTGHLDLSHTAFKKIGAEVAGIIPIKYKLVANPRVPGPITVRIKEGASRYWFAARIDNHANLLSSVKVAGPGGTFRSAQRTDYNYWLIDGGAGSGPYRLKITDVYGITTTVSGIAMKPGVVQKTGVSVSGRSAIVENGTVAKKNASAKPAVSPSGSVAPKAATPSASSVAPLPASAVAVPGTTEDALLAAADATTSCG

SEQ ID NO: 9903 - protein, 270 aa, Actinoplanes utahensis
MRIRDLHTYPVKGCHRLDHAEAEVQPWGLAGDRRWMMVDPDGVGLTQRDEPRLTQLAVHPRPGGLRLSAPGLPDLEIDEPAAGAKISVRVFRNKPEVPARVAESQWSSAFLGRDARLTWQADPTGRTIADRALPSDRVSFADSYPLLLASTASLDAVNDWLAEAGEDPVPMHRFRPNLVVTGAPAWAEDGWLGGRLRIGEVTFRVAKHCARCLVVTIDQETGETGRQPLHVLGRHRRIDGGLMFGVKLIPDLAAGRSGVVRPGDAVTPLE

SEQ ID NO: 9904 - protein, 277 aa, Actinoplanes utahensis
MVRTAERVLDLFQGARLTPTQRRIAHSLVEHAAKAAYLSAAEVAEIAGVSQPSVTRFAMALGYSGYPALRRELRALASDAPSEPGGENAMQRAVLAETEHLRRLAEELQRPGDVRRAAELLAASRPLPVLGLRAAAPLAAYFGYFAAKAFPDVRVLDSGGTGLYDRLDQARAAGAGAMLAIVLPRYPRESVEAVHEAKAAGFAVVAITDSAVSPVSEAADVVLPAAVGTQLVFDLHTGPMAMAMVLLEAMCDAAPEPVQRRLEEFEASATRRNIFVA

SEQ ID NO: 9905 - protein, 547 aa, Actinoplanes utahensis
MTRMDEIRAPRGTSYTAMGWPQEAAKRMLLNNLDPEVAERPEDLVVYGGTGRAARNWPSFHAIVRELDTLKGDETLLVQSGKPVGVLRTHEWAPRVLIANSNLVGDWATWPEFRRLEQLGLTMYGQMTAGSWIYIGTQGILQGTYETFAAVAAKRFGGDLGGTLTLTGGCGGMGGAQPLAVTMNGGVCLIVDVDRTRLQRRVDHRYLDVIADSLDDAINRALDAKSRKAAVSIGIVGNAAEVFPELLRRGVAIDIVTDQTSAHDPLSYVPIGVDVADALDYARTKPEEFTERSRASMAQHVQAMVGFQDAGAEVFDYGNSIRGEAQLHGYGRAFDFPGFVPAYIRPLFAEGKGPFRWAALSGDPADIAATDRAVLDLFPENEPLARWIRMAGERVAFQGLPARICWLGYGERDRAGVRFNDMVARGEVSAPLVIGRDHLDSGSVASPYRETEAMLDGSDAIADWPLLNALVNTASGASWVSIHHGGGVGIGRSIHAGQVCVADGTALAGQKIERVLTNDPAMGVLRHVDAGYESACAGDVRIPMRDE

SEQ ID NO: 9906 - protein, 384 aa, Actinoplanes utahensis
MSDFARLWGEIAGIGRASSGGYLRYALTPPEMRLREWFRGQAGSRGMTVTEDGNGNLFAWCGEPWAPGTVLTGSHFDSVPHGGGYDGPLGIVGAFLALDQVGHSRNIAIGAFVDEEGGRFGVPCLGSRLLTGAITPSQAAALTDRDGVSFGEALGSVPTGKITSISDISAFVELHIEQGRALEVPVGVGSAIWPHGRWRLEFAGAGDHAGTTRMTDRRDPMLTFAYTVLAANKEARLLGAHATMGRVQAEPNATNAIPSLVHGWLDARAADTATLDRLLESVIKKATERAGRDGTDLTVVAESVTGEVAFDTELAGRLSALLGDVPILPTGAGHDAGVLSAHVPTAMLFVRNPTGVSHAPAEGASDEDCEAGIDALARVLEALT

SEQ ID NO: 9907 - protein, 429 aa, Actinoplanes utahensis
MTAYVAQYAWIGDEVRENVGIEIADGRISRVSTGISGERLSGLVLPGMANAHSHAFHRALRGRTHGDRGSFWTWRDLMYRVAGRLDPDNYFALARAAYGEMALAGITCVGEFHYLHHGPDGTRYADPNAMGHALTAAAAEAGIRITLLDAVYLTAGVDGKPLDGVQRRFGDGDYDGWYSRFDALRGGGHVRIGAALHSVRAAPADGMAAFAARTDGLPVHVHLSEQPAENEQCRAVHGCSPTELLDAMGVWQPMTTAVHATHLTDADRALVEGSHACFCPTTERDLADGIGPARALADGGTTLTLGSDSHAVIDLFEEARGLELDERLATRQRGHFTAAELITAATRAGHASLGWSDAGEIAVGQRADLVAVSLDSPRTAGIDPAGTVFAATAADVTDVIVDGRPVVRDGRHLGMDVPAALRSAIAAVL

SEQ ID NO: 9908 - protein, 393 aa, Actinoplanes utahensis
MSLLITNIGELFTNAERDLIPDAAVVVDGERIAWVGPAAEAPAADQRIDAEGAAVLPGFVDSHAHLMFAGDRAAEFGARMAGEPYTGGGIRTTVRATRAATDEQLRANARRLVREAMRQGTTTIEIKSGYGLNVADEARSLRIATEFTSETTFLGAHVVPVEYQDRPDDYVGLLCGPMLAMAAPHARWVDAFVERGAFDADQARAILESGKELGLGVRVHGNQLGPGPGVRLAVELDAASVDHCTHLTDADVDALAGTRMDCMCACGGMTTTVATLLPGAEFSTRSPYPDARRLLDAGVTVALATDCNPGSSYTSSMSFCIALAVREMRMTPAEAVRAATLGSAQALRRSDIGVIRPGARADLLILDAPSHLHLAYRPGVPLIRTVIHNGVVQ

SEQ ID NO: 9909 - protein, 511 aa, Actinoplanes utahensis
MTVIVQPTGIDPADVIAVARHDAKVELSPAAVEAMAASRAIVDGIEASGRPVYGVSTGFGALANTSIAPERRAELQHALIRSHAAGVGAPMPREVVRAMMLLRIRSLAMGRSGVRPVLAQGLADLLNHDITPWVPEHGSLGASGDLAPLAHCAIVLLGEGWVIGKDGARASAAEALHTAGLRPLELAAKEGLALINGTDGMLGMLLLAIADAAHLFTMADVTAALATEAMLGSERPFLPELHSIRPHPGQAASAANIHRLLQDSAIMDSHRDDLAHAVQDAYSIRCAPQVAGAARDTLDFVRVTASRELVSVVDNPVVLPDGRVESTGNFHGAPLGFAADFLAIAAAEVGAIAERRVDRLLDVTRSRELPPFLSPDAGVNSGLMIAQYTAAGIVAENRRLAGPASVDSLPTSGMQEDHVSMGWAATKKLRTVLDNLTSLLAVELLSAVRGLQLRAPITPSPAGRAAIAAVEPFAGRPGPDVFLAPVLEQTRAVIAARDLRTAIETATGPLG

SEQ ID NO: 9910 - protein, 204 aa, Actinoplanes utahensis
MSARLLLATANKKKLIELQRILDAALGMSQIELVGLGDFPGYPDVPETGLTFGENALIKAREGAKRTGLPTVADDSGLAVNALNGMPGVFSARWSGGHGDDAANLDLVLAQIGDVGDEHRGASFVCAAALVLPSGREHLVEGRQSGRLLRARRGEGGFGYDPIFLGDGQDRTNAELAPAEKDAISHRGKAFRELAKVVAKELPR

SEQ ID NO: 9911 - protein, 242 aa, Actinoplanes utahensis
MARPDGRAADQLRPVTLTRHWSIHPEGSVLVEFGNTRVLCTASVTEGVPRWRKGSGLGWLTAEYAMLPRATNTRGDRESVKGKVGGRTQEISRLIGRSLRACIDLKALGENSIVLDCDVLQADGGTRTAAITGAYVALHDAVTWLAGRKSLAGKVDKVLHTSIQAVSVGIIDGEARLDLPYVEDVAAEVDMNVVCTGAGDFVEVQGTGENGVFKRAQLDAMLDLGLAGCAELAVAQQKALAA

SEQ ID NO: 9912 - protein, 402 aa, Actinoplanes utahensis
MRIVRLANFVTVHTGGLRTTLRELGKGYQDAGHEAVLIIPGRQFRDQETAQGRVITLPSAPVPRTGGYRVLAGRRELIKLLDSLEPDRIEVSDRTTLRWTGTWAKQRGVRSMMVSHESLAGLLGVWGMPKRDALADRFNRRTAEAFDTIVCTTAFAAAEFRRLGVPNLVEVPLGVDLELFHPSRMDVSVRSRYARPEELLVVYASRLSAAKRPELAVDTVAVLRNNKVPAVLVVAGDGTRRAALAYRAARLPVRFAGHIADRKAVAALLASADVVVAPGPVETFGLSALEALACGTPAVVDEQSALPEVIGEAGIAVPGTPEAFADGISRLLERPRDRWRATARARAERFGWPRAVEGFLRAHAVDPGPGPSLIRPAAPESRASIPWTREPGADEAGTPRYA

SEQ ID NO: 9913 - protein, 248 aa, Actinoplanes utahensis
MRLTVLGCAGSFPGPESACSAYLVEAEGFRLLIDFGSGALSALQRYSDMRAIDAILLTHLHCDHMLDACTYVVVRRYDPAGPLPALPVYAPLGAAERIAAAYSADGEPVDDVYTFYGLQPGTFPIGPLTVTVDRVNHPVETYGVRIEHNGRVLAYSSDTAPCEALLRLAAGADLFLCEASYMDGVENPPDLHLTGGEAGEAATKADVARLLLTHLVPAWASEATIVEAAGAAYAGPVEVVRPGARYDL

SEQ ID NO: 9914 - protein, 133 aa, Actinoplanes utahensis
MTAVEPAGITRTAVPEILPFESSWEPVPWDPDGPIFRFPAEDDPAPDPHRVLAMAGYCAMLGLTGVGAGLYALIAVFRGAPGWYLPALALLTMVSVGLVVGAFLAVHQRTLPWILLLAAAPPMFAALLLAVAY

SEQ ID NO: 9915 - protein, 321 aa, Actinoplanes utahensis
MARYESLLDACGGTPLVGLPRLSPAVPEGAPPVRLWAKLEDRNPTGSIKDRAALYMVREAEESGHLRPGDTILEPTSGNTGIALAMVAKLRGYRLVCVMPENVSAERTQLLRMYGAEIIFSPAAGGSNQAVATAKQIAAEHPDWKMLFQYGNPANARAHYETTGPELLHDLPTITHFVAGLGTTGTLMGTGRFLKEKVDGIQIIAAEPRYGELVYGLRNIDEGYVPELYDATVLDRRFSVGTRDAVLRTRQLVEVEGIFAGFSSGAVLHGALAVAHEAVKAGKRADVAFVIPDGGWKYLSTGAYGGTLNDAEEALEGQLWA

SEQ ID NO: 9916 - protein, 104 aa, Actinoplanes utahensis
MAIEVRVPTILRSYTGGSKIVEGAGDNLSALIDDLDAKHSGIKGRLITAEGGLHRFVNIYVNDEDVRFLGALDAKLNDGDSITILPAVAGGALGFAAAAAFFGR

SEQ ID NO: 9917 - protein, 157 aa, Actinoplanes utahensis
MCLATRGVAKPFGNVNAVLTIDSAIVRAIVAHARRDHPDEACGVVAGAIGSDVPARHIPMDNAARSMTFYEFDSMEHFRVWREMDDNDEEPVVIYHSHTATEAYPSRTDISFAGEPNAHYLLVSTREPDSEEIRSFRIVDGVVTEEEVNIVDATVKS

SEQ ID NO: 9918 - protein, 166 aa, Actinoplanes utahensis
MFRRSGGQCVATFAHDEVRVLRKVAAEVVGLLTDGMDHTDPVVGRLFPDIYPERPEDSREFRLYTESDLKSAKIDQAGAILAALPDEGEGEVRLDGEAAEAWLRAINDARLAMGTRLDIQADTDLAEELDDAVLEDPGSSRVFQLSVYAYLGYLQESLLNALPEIK

SEQ ID NO: 9919 - protein, 425 aa, Actinoplanes utahensis
MGPALLTDHYELTMISAALKDGTAERQCVFEVFARRLPTGRRYGVVAGTDRLIEMVAGFRFDPAEIEFLRSSGVVDEATATWLANYRFTGDIDGYAEGELFFPGSPILTVSGRFAECVVLETLILSVLNHDCAIAAAAARMVTAARGRPIIEMGSRRTHEQAAVAASRAAYLAGFASTSNLAAGRAYGIPTTGTSAHAFTLLHDDEPTAFGSQVAALGKNTTLLVDTYDISQGIRNAIAVAGPDLRAVRIDSGDLSVLAQHSRELLDSLGATETKIIVSGDMDEYSIATLAAEPVDMYGAGTAVVTGSGAPTAGLVYKLVEVAGRPVVKRSENKATVGGRKTAVRRHKPTGTATEEIIVSQGVPDHQANDRLLQRPYITGGEAQTRPTLQESRDHLRRNLISIPWEGLKLSAGDPAIPVILIPTA

SEQ ID NO: 9920 - protein, 193 aa, Actinoplanes utahensis
MTRALIIVDVQNDFCEGGSLPVAGGAAVAKGISLVLDRAGDRWDHVVATKDYHIDPGAHFSASPDFVDSWPAHCVAGSSGADFHPELITDRIEAIFHKGAHQAAYSGFEGHTDQGETLAGWLRARAVTDVEVVGIATDHCVRATALDAATEGFATTVVLELTAGVAAATTEAALADFRAAAVSMTGAPIVDPM

SEQ ID NO: 9921 - protein, 257 aa, Actinoplanes utahensis
MTRVPDETPPPSATTAPPSSSVAAAPLSPSAPSSSPSPAAPASVAPVSAAPVSAAPSGLARPSRGVLAARPAAVIRPVADGDWGQVWPIVREVVRAADTYPFDPAMTEPEARAIWLEQPPGLTVVSTEPARGGADHDVPANGSPPEKITGTAKMGPNRGGPGAHIATASFMVAAGSRGRGIGAALCRYVIDWARTEGYAGIQFNAVVATNTAAVTVYRRLGFQILGTVPRAFDHPTQGRVGLHLMYLEFPRHGGHTG

SEQ ID NO: 9922 - protein, 355 aa, Actinoplanes utahensis
MEFGLGLPINDPALLPAWARLAEQHDFATLALLDRLTFDNPEPLIALAVLAGGTDRIRLQTEVLLGPLRSTALLAKQVATLDRMSGGRFVLGIGIGGREDDHEAAGVPLAGRGRLLDAQLADLRRIWRGEPYRAATTPDPRDRSVAPDGAGHPLRHRRAEHPGGTETAGPGGPDGAGRPGGSGVVSRSGGSGVAPSTEDDWGLGRRVAAGVAGIGPRPVAGDGPPILIGGFAPAALRRVARFADGFICAAPLGWAGGLVRTVNEQWEEAGRAGRPRLVCQINVSVGDAATVERGRRAVADYYAFTGRPGFGVPLSDPGEIAEAVAAYREFGADELVFYCYADDPRQIDILAGILR

SEQ ID NO: 9923 - protein, 459 aa, Actinoplanes utahensis
MLLKPYRETLALPKVMSVLAIATLARIPIAAGAVVLTLHVVTDLGRGYGAAGLVGAAATLGGSLGAPMMGRLVDRRGLRPVLVLTTVAEVIYWIVAQALPYWALLPVAVIGGFLALPAFSVARQSIAALTPESHRLPAFALDSMTTELSFMAGPALGVLISTADHAGPRVAMLALAGGILLAGLGLWLVNPPTRADHEAPVSAGERVARREWLKPRFIAILAVTMAATLVLSGTDVSVVAVLRASGELSWSGLVMTLWALFSLIGGFAYGTVRRGLPVLALFIPMAVFTVPVGLGGSHWWLLAVLLIPAGALCAPTITASSSAVSQMIPAAARGEAMGLHNSALTVGVALGGPLAGLAIDSWGPGWGFTAVGTVGVLVALVVIPAELRRRRDNPPAQPTSTGAPPAASAPVASTAVASVPPASVPPASVQAASAPIASVRAASAEAIPAPVAPVEATSV

SEQ ID NO: 9924 - protein, 415 aa, Actinoplanes utahensis
MTNRRMFIRAGGAAAMGVAATAVGSGPAAAAGDEPAYAEGHLGFSVKEFGAKGDGTTDDTAAIQAALDYAAAPGRTGSIVYLPRGTYRTSKALRVHPATTLQGTHGNHIDEGDKTWVQTESRIKPLDTFSGPACIEIVDRDTGGYPAGSAEQRLFHLTLNGSALAAGTGVDGIRFTGKIHGVVVRDVAIFDFPNHAITTAYRTPSDGGPQALYSARFERIAAKGNGGITYSFNNTTDSQFTDLESIEGGSHGFFIAGCGNSCFTNCRSEWSRHNGFDLRGGNGIVELLGCSTDRNGFNGVSIDQNSTGEGVIVLNGLRLNRDGKSDNGGYAGLKINGTAAAPVATAVLVSALAVETGTNDDKTGPTTPQYGVSVDNATTVVLESGIVRGRVAGYRAGGTNTTLKVGATFLSRTAS

SEQ ID NO: 9925 - protein, 583 aa, Actinoplanes utahensis
MTTVAPSPIATRPYPVRRQVKGSAFARILRTTDAKQIGIMYMVTAFVFFLLGGLMALLMRAELARPGMQLLSPEQFNQLFTMHGTIMLLFFATPIVFAFGNYVVPIQIGAPDVSFPRLNAFAYWLYLFGGLITIGGFLTPGGAADFGWFAYTPLSDSLHSPGVGGNMWVVGLAISGLGTILGSVNLITTILTLRAPGMTMFRMPIMTWNMLVTALLAVMVFPFLAAALFALAADRVLGAHVFDVATGGPMLWQHLFWFFGHPEVYIIALPFFGIITEVIPVFSRKPLFGYKGLVAATLLIGALSMSVWAHHMFVTGQVLLPFFSFLSFLIAVPTGMKFFVWIGTMWRGQISFEPPMLFAIGFMVTFLFGGLSGVLLAAPPIDFHVSDSYFVIAHFHYVLFGTIVFAVFSGIYFWFPKMFGRYLDERLAKVHFWLTFVGFHTTFLVQHWLGTKGMPRRYADYLPTDGFTTLNTISTIGSFILGLATLPFLYNIWKSYKVGRVATADDPWGHGNSLEWATSSPPPLRNFDRMPRIRSERPAFDLKFPELAAGEYGALAGPPEGGARPLTHESDGGASYAEDIQHD

SEQ ID NO: 9926 - protein, 368 aa, Actinoplanes utahensis
MTLRILVVGAGIAGLAAARGLRVAGFRPDVVEALPATMSPGAGIYLPGNASRALRLLGLDVPLRPLGDLIFRQVFLDARGRDLFEMDVAGLWAGVGESRALSRADLQQVLLTGVGGEVRYDTEVRDVEIVDGAAKVAFSTGAMAEYDLVIGADGRRSQIRERIGLGGPAVPTGQIVYRAVVSGGPPLTDWTAVLGRRAQFVAMPMGGRRIYCYADETAPDTPDPADPIERLREVFGQFGGPVPAILDRIEKVSVARTDEVVLPSWSRGPVVLVGDAAHATAPTLAQGAAMSFEDGFVLGRELRRAEGDIPVALRAYEDRRRPRCAEVRDRTRERDRTRDVPPSLRDPMLRRRGLRIFTDHYRGLVPAV

SEQ ID NO: 9927 - protein, 433 aa, Actinoplanes utahensis
MDTRRSQNTTARNGHGKPTINIDTPPRRPPAGCFSGGEGATGAGRRDRPADPDRLAGRTRLNSHATPDHRGTTIPCGRAGRQNRTMPDRLDEYRRKRDPARTPEPVPQSPPAPREPGRRFVIQQHHARSLHWDVRLERDGVLVSFAVPRGLPRDQARNHLAKHTEDHPLEYLDFAGEIPAGEYGGGRMTIFDAGTYETGKWRSDEISVTFHGDRTKGRYVFFQTDGADWMVRRMDPPEPGWEPMPADLSPMLATRAGTLPPDDADWGYELAWGGQRVLTYLSGGRVRLSGPGGKELISLFPEVRALGPALAPVEAIFDGELVAFDGTRPAADQTARTARTRNPRPVQLLLYDLLWLDGHRTTELLRYAERRELLDDLAPAGPHWQTPPYFPGGGRFALDAARSQGLSGVVAKRLDSPYLPGRTTRLWLDIEVS

SEQ ID NO: 9928 - protein, 471 aa, Actinoplanes utahensis
MAGVAGDRSGKGLDFTMHPSPSSSPVADPSAELWQSAVRVLDTNWSGDHTVPSRRLYPHQWSWDAAFIAVGLAYVNPTRAWRDLRSLFEAQWPDGRVPHIVFDPATAEDDYFPGPGFWNVPVYAGRPARRSTGLVQPPLHALAAWEVYRHAAAHGAACVSAARTELAWLYPRLVAQQEYLTERRDAGGTGLASIVHPWESGLDNSPAWDQALAAVPADHTLLARYQRRDLAVSDAAHRPTDEDYARYVGLVLSYRDSGYSDSELIERHPFVAECPAYNSILAVAELALAQIAGVLGRPADAGRHRDRAREITTALSRRLWDPASASFRVRDARTGRLSPAHCVSGLLPLMLPDLPAEQVQAIMADVRSERFRLPVPSVDRTSPAFDPHRYWRGPVWVNVNWLLRRGMLVHGFRGAAEELRRALLRLVHEHGHYEYFHPETGEGLGAPTFGWTAALCLDLLADRSAPAYSRT

SEQ ID NO: 9929 - protein, 361 aa, Actinoplanes utahensis
MSQRVRGVIARAKGKPVEVTTIVVPDPGPGEAVVQVKTCGVCHTDLHYREGGINDDFPFLLGHEAAGVVEAVGAGVTDVAPGDFVILNWRAVCGTCRACAKGKPWYCFATHNATRRMTLEDGTELAPALGIGAFAEKTLVHAGQCTKVDPQARAAAVGLLGCGVMAGLGAAINTGGVTRGDSVAVIGCGGVGDGAVAGAALAGATTIIAIDTDDRKLEWARGFGATHTINARDHDVVERVRELTGGFGADVVVEAVGRPETYRQAFYARDLAGTVVLVGVPTPDMTIELPLLDVFGRGGALKSSWYGDCLPSRDFPMLTELYRQGRLDLDAFVTEEIPLDGVEQAFAKMHTGEVLRSVVVF

SEQ ID NO: 9930 - protein, 149 aa, Actinoplanes utahensis
MDEPRWLTDEQQAVWRSLVEVLVKVPAALEAQLQRDAGLTHMGYLVMMTLSEDPDRRLPMSHLAKRASASLSRLSHVVARLEERGWVRRERHAGDGRVQLAVLTDEGFAKVAATAPGHAAAVQHLVFDRLTPAQARQLGKLAEALLKRP

SEQ ID NO: 9931 - protein, 552 aa, Actinoplanes utahensis
MTVPEERERWAPPTASLPEPRPPVEDRAAWFSYTAASDQIVWSAPLSAMLGRVPADRERTRELLTRYVHRDDLATALGAITEAWTTRTPVRATVRLMRADGGWFDVDCRLEPMMSPDGTVRGIRGTIRDVTDRERARREDVRLTRRGETVQSSLVDPDPVTGLLTRARFADEIDRALRRAAGALLVLRVQGEGTGEELLRGAARLLECRVGPDRLLGRVGTAEIAVLLAGTPWSAARKQAAALVDTMRAESGALVWGGLVRFRPDAEAGSHDLLIDAEQAWRQSREAERPLTLIAHPVPARDRQGSYRTRVADALGTDRFTLYSQPILELQSNRVTRHELLLRVLDEAEGPQSPIHVLDTAERLDAVFDIDLWVVERAMRLAAEQPGMGLQINLSGRSVGDPRLTDEVERLLAQYRVNPEQLTFEITETALIGNLSEARRFADRIRDLGCSLALDDFGSGYASFRYLRLFPIDLVKIDGEYVVDLVGNPQDQVLVRALVQVCQAYGIHTVAEFVQDDATLRMLRELGVDYVQGYLIGRPSPVIPGELPDAAL

SEQ ID NO: 9932 - protein, 222 aa, Actinoplanes utahensis
MRPDVLVGPSDWLVEQFGDKIADELWTRVPEALSTAIDREVHAHPAMTQTVERVLGNPRWPLPYEELVLFLGTLPGAEIISVPRSVYQLVLINGHIVVPWCYGQSARLSMADAEVGRSFGRLARELLGRFGPPWRRSPIESPLPLDAVDEREVAKICAAIAQIDPKPEVVIAGYAGAPNLGLLRACLGEVKSTDNGTLNWSHLDDLPLPPPVIPRPRRMQFP

SEQ ID NO: 9933 - protein, 88 aa, Actinoplanes utahensis
MNDAYDMDDVRFLIGEWRSEAAQRARSARELSARIHRPAGTARSPDGLVSVTVGPRDELLGWELGTRSDDGRRRTPPRSSRRPCGRRG

SEQ ID NO: 9934 - protein, 122 aa, Actinoplanes utahensis
MDHREWHWPAPKLAALRLGRRLAMLVPASQPHRWSFVHIVPSGRSADEDALRAGAARSDTGRSFLVTQWEYEADRLEGYDPPGAVRLRCAQAADESELLTVLREWRLPPDGFDYSWDTVDPG

SEQ ID NO: 9935 - protein, 581 aa, Actinoplanes utahensis
MTARSVPRKGFDNACRPAAGRIDTLSRDPGRGVPRRPADHSGARSAVRSRAAEDVRRTAISAAPRADAVSVWPNVRPPRETNRSRVHPHRPRHRLPQGPPASPRSAQRRPSAQAAADATGPAGVGTDGRQPAERCPHPGFSVGRSRYRARVSYISPAEEAATVIAAVLRDLRSHRHRGVVVDSPPGAGKSTLVVRAAGELAATGEPLMIVAQTNEQVDDLIERLGARSPDITVGRLSAVDYERSDRVKEHPHCRVAAKVADLAGPAVTIGTAAKWATVAEGSWPWAIVDEAYQMRSDALLRVAPRFERALFVGDPGQLDPFSTVEVERWTGLSWDPMQSAVAVLLRHNPELPVHRLPVSWRLPASAAPVVAEAFYPFTGFRSGTGPGDRTLHFEAPGETPLDQVLDTAAKSGWGLHELPARFTLRTDAEAAAACAQLAARALARGGVTESEAGSGPLTPGRIAIGAAHRDQAAAIRALLPPEAAGITVDTANRLQGREYDLTVVLHPLSGRRDATAFHLESGRLCVLTSRHRHACVVVARAGIPELLDAHPSTEPVHLNVPVKFPDGWEANQSMLAHLYRR

SEQ ID NO: 9936 - protein, 336 aa, Actinoplanes utahensis
MTPNGAYRPILRPRRGEFTALAHLSADEAARITPIVELDPEVSIIPLLRELRPRTGELALDFGHVPEPTATAEQPLALAERLFRLGVATVPVLRPYESGRRLVSHGLAARMHRRRAVLRIQPHVDAGNPARADAIADRVLAITALDPNEVDLLIDLAETPCLAHADEVEERARRVLRWARLMPWRSVSVGSGAMPPNLDDLPTDRPVAVGRLDARVWERLGDPGVGYADYGVTSPVRRLGVQHHRQLPTLRYTTESDWWIYRWARRGGRSDDRCHDLCRTLVTSPQWPSAGARFSWGDAEIARRARTARGAGSSASWIAWSTSHHISHVLRTLPTG

SEQ ID NO: 9937 - protein, 595 aa, Actinoplanes utahensis
MVLQWDVIGDTEQSVLADPVRLRSVRRLGEPGPDEAFDRVAMLVRKLVDAPLGVVSLVGAERQHLAGQVGMPEPFASGRSMPLTHSFSRHVVVNGRLVVIPDVRVDLRTRGNPSIEQLGAIAFAGAPITDPDGLVVGALCAADHEPRNWTQSEITLLTELAAVCSSEVCLRIARAAAEDARRAAESAHHQLELLTDLTESLAATMDLDEAMHRLGSLVTARLADWCVITYGDQPRVVAAHRDPTRNADMSRLAELTARSRTDLRTLATAARRPPRRAEGTDLLRGKVSDTEIAELATVAGLGSSVVAPIISPVRRRVVGSVLLVNGPDQAPFTAADERVAAEIGRRAGLAVENSRLYREQRHVAEVLQRSLLTELPDLPGVELHARYLPAQDGAAVGGDWYDAFAQPDGSVMVAVGDVSGHDIEAAATMGQLRNLVRGDAYGRPDEPGALLTQLDQALHGLRVPAAATAVLARVRQSWSGYAISFANAGHPPPLLLLPDGRVQVWWVPPEPLLGLPVPSDRTTTIRYVPPGSTLVLYTDGLVEDRDQLLDDGVARLAERLRESSAFPGDELCARLLEVAPRRTDDIALLLVRLTG

SEQ ID NO: 9938 - protein, 43 aa, Actinoplanes utahensis
MAILQLILKGVAFRMIGRSVDRSGDRKRMIGSGARRRRRASRR

SEQ ID NO: 9939 - protein, 541 aa, Actinoplanes utahensis
MPVHLRTLRLLSARGERDDGGARPAGARGARRGRDHRRGAGARLRRAGAHRGAGGGGRPPAGRPPAPRRSPFLSTLTALARAQAVAAGRAQPIATVRHLHVHEHPLVLIPLAMAGEANAPLAALVGTDPATPELLVVSQPRDRDERFRFADRLGQIIAAYVDSFADVTEDVPVDRGKDVRTRYADAPQIWVPNPAGVDFLRLFGRSTRFRTVDGEHPVPATVPLLGRWLTFFANSAEVPGSALLVNAVQALGLHWATGQSGTEDAQLAVLMAWIEEGAAAARAVENGPIAGPATDPDFDNRVLAPLIERRAPEMSDVLRDLMTPTWERMWRVPNLLRRLPVGERVGLRWDADKDAYTAFAQHLAEGGAPQPRRDGAVAAAARLQRLETAASRYAVQRAFDDPLVLAEYRLAGAAFAGVVTLAAPDRIDDSGKRPVLRPRIMVRTGEPVRVAAGTSLTSPARPSQKARVISVTAVGPEFDVLLELSGGMGRKLVAEPGSVPVVGERLILTTLSEEFRRGGALPDPSETPWTHGGPPTVEVPI

SEQ ID NO: 9940 - protein, 94 aa, Actinoplanes utahensis
MPKAIWNDEVIAESDDTVVLEGNYYFPLTSVREDVLIPSDTHTVCPWKGKASYYSLRADGRTAADAAWYYPDPKPDAAAVRDRVAFRKDVQVEI

SEQ ID NO: 9941 - protein, 130 aa, Actinoplanes utahensis
MHAEPSPRLPRRGPAPAVDQMDNAELARMVEAEHPYRGKALFELCDRLAGDDDAVAKVAMLTRLTSLRRARLFDRVSLAWSAIIALLAAETENARAEAYAAFRALDPAEQRDMLDYLEVSAIEEAHPRIA

SEQ ID NO: 9942 - protein, 157 aa, Actinoplanes utahensis
MLGGELGVGDGASRSGGAAAALADRVATLRASAAGAGGAVRVTVASSGNVTGLELDERSLGLGAPGLAAEILLTIHRAQAALAGRVAEAVASTVGAETETGRAVLDGFASRFPAPDEVPPAPVMPSAPPFPSFSAVPTLPHQSPGNGYEGGRDSRAR

SEQ ID NO: 9943 - protein, 557 aa, Actinoplanes utahensis
MALRDDRRLRILPGRARRPRRFRPGPLPAPAGRHPIRAERTDRRLQLGALTTRIPLRQFRLADAALADLGAGRPSPATLGLLRRAQLSRNLLLLRQLRRSVTEKPIWYARLAALSPQDARTRIVDPMTGLWAAHALTTPPHGLDAPLEPVGHLLTVTCAGRELTVRLDDRSPLRHLLGLPPADPLTAAEVTHWQECLEAAWRILVTRHPAAADTLAAVLRVIVPARPDPLAEGVSATSAEAFGAVAMSTPITGTGMALALLHETQHSVLNAVNGLFDLVEPGGAPGYSPWREDPRPASGILHGVYAFLAVTRFWRTAIRAGGAPAGSEAEFEFARWRTAVHETAGRLLRAGEPTTGIARQAAGEPTTGTAPQAAGEPITGEARPAAGEPTAVGTRPAAGELTAAGRRLVGALRDEVEPWLAEPLDPEVTRLADLARTDHHARWRLRNLAIPAEGLKALVSAWAAERPAPAVESTVAERPRREEPHHRLRLIRARLRGDHRFPAEARETTTAAADDACLDGRWQDALTAYATILGQDRDDAAAWSGLALVSPLPALRR

SEQ ID NO: 9944 - protein, 559 aa, Actinoplanes utahensis
MARKALLDRTRRVVDDGVVLASLLLLVWPAADATDVTLTGRLVPLAAALCLGLAMLLVAPDRPVLRFAPTAAALAVSGIRHVQGELAPGAVWLLLGMAVAVLFRRWAVAGSDNALIREMTSQRALLARQAYRDPLTGVGNRKMFLERADHELSAASRTMTAVIVVDLDGFRELNDEFGHEVGDGLLRAAADRLAANVRANDVVARLDGDEFVVLLPGVEDEQAAVAVAERVLTELHRPLEVDGIKLTVRASAGVAITAGGETIDHVLREADQALHRAKLDGGGAARRFDPALFALEEQRRKAEGDIIRALDLGEFEVHYQPIVDLDGEHTVGVEALIRWQHPEKGLVPPGLFLELAEQLGLLPRLGGWVLEEACRQAVNWQRQFPGFEMNVNLSASQLSNPNLVGEVRAVLERTGLEPEHLVLELTESVALVDLVESARILTELKELGVRIALDDFGTGFSSLSHLSALPVDVVKIDRSFVQAMPESGGASVAEAVLHIARTFNLAPVAEGVEDAAQAEWLRDLACGRAQGYHFARPMPALGVTELLDKQADKDVPLAS

SEQ ID NO: 9945 - protein, 806 aa, Actinoplanes utahensis
MPIRGGLPPRNPRFVGREELLTRVRGLLGNGPVVLLPSPDHQLGGTGRTQLAIEYAYRHADSYELVWWIPAEQGAGMRAALAGLARKLGLPETRDLNRTLGAVRDALSRGEPFRHWLVVFENANRPEDIMPYLPSGAGHVLVTSRNPRWTAEVAQALPVPVLDRADATDLLRGRAPELSPEDADRLAARLGDVPIALDLAAAVRTATGWPVAEYLERYERRAAELAFPTPIRVTWGLAADALGEASPADRVLLELCTFLASAPISWQLLWAARTCPLDPEVARTVRVERRLRAAMRRIARFGLAGLDPSGERLTVHPLIRGMFGQELSSERHAELLRTVRAMLSAADPGDPDNPAGWYRYAELAPHLIHSDLLGGDAEEVRQLVINCIRFHYARGDYDSSRELAGSAVARWRDALGESAEQTLLASFHLANALRAVGRPADARALNLQTLRTQREVFGADDEATLATANSVGGDLRMQGHFGQARQLDADNLVRYRRLFGESFPTALRCANNLAIDLRLLGDFRGARALDEQTLRHRHAIFVDGHPETLASRAALAYDLFGLGDYAGVGTVLAGQAEQVAEDHPFALWAGRLTAMAAHRRGVAAAREMATENLAACRRRFGDLNVDTLATAVSLANCVRAAGDLAGAHELLERAVIRFHAVLGDEHPFTLAASAGLAGVVRAAGRYAEARTIDEEVLGGLRRSVGADHPFTLSCANGLAGDLFAAGEAQQARELAADTLRRSRVVRGADHPDTVACAWNLALADADETAQQQALTGLAKAYGDGHPIFRVTAAGQRLETDIDLPPL

SEQ ID NO: 9946 - protein, 100 aa, Actinoplanes utahensis
MTSLDADGNTTTVSLRGEIDVLTVEQVRVALGEAVTGRPRQIVVDMAAVAFIDSTGLGALISGFQRARDQGIAFQLAHPSPNVRQILVLSGFLEVVQVTP

SEQ ID NO: 9947 - protein, 427 aa, Actinoplanes utahensis
MKARLHPAWSVAAVAFIALIGAAGFRSTPSVMLQPLHAEFGWSLGTISAAVSVNLMLYGLTAPFAAALMARFGIRRVAAAALGLVALGSGLTVLMHHSWQLMLCWGVLVGLGTGSLALGFVATITGRWFVRHRGLVTGILTAGGATGNLIFLPVLSRLVESHGWRTAALTVSAIALLVVPLILGRLRDHPQDLGTTALGGITEPPAPPAGNAVRTALTALRDAGRTRAFWLLAGGFAICGATTNGLVGTHFIPAAHDHGMPNTTAASLLALVGVFDVVGTIASGWLTDRVDSRVLLGAYYALRGLSLLVLPSILAATAHPGMLVFILFYGLDWVATVPPTVTLCREYFGAAGPVVFGWVFASHQIGAAIAATTAGLVRDQLGAYTWAWYGAGALALLASLLSLMLFAGKHLKPLAPGLGLAVPAAKA

SEQ ID NO: 9948 - protein, 323 aa, Actinoplanes utahensis
MRKNRAMPHVIAVLVLDGVVPFDLGVPAQVFGAARDGARNRFYELLFCGEGPVRAEAGFTVTPDHDLSVVARADTVLIPGIHLGGPVTDGSLPDAVREVLLAAARRGARIVSICTGASVLAAAGLLDGRPAATHWAWASRIGGLYPRVDWDFDVLFVDDGDVLTSAGVGAGVDLCLHIVRSDHGAEVANRAARRCVVPPWRDGGQAQYIERPVPAAANSGTEPTRTWVLDRLADPVTLEEMAAHARMSVRTFTRRFRDETGSSPRRWLLRQRVEHARLLLESTDLGVDVVARRAGLGSATALRQHLHATIGVAPSAYRRTFRH

SEQ ID NO: 9949 - protein, 568 aa, Actinoplanes utahensis
MEGCIPCAAPEDSMDQTFRPLLDALKQIGVDPHAVDSAAEEAQRSGRPVRAVLINDQVVTEEQLTQAAAAAFGINTLDLVGFTPDPTALKRIPLPVVLRHRVLGLAINDGELVVGVTDPADVVALDDVRAATGMTVRPVVVARSEVRRIIEKLQRDDSDLGDLAGAGMDDSAGMAAQQTSTEDAPIVRYVNSLIEQAVMNRASDLHLEPTEDEMRVRYRIDGVLHEVDIVPRGVMAALTSRIKIMSGVDITEKRVPQNGRITALIRDRTVDLRTATLPTVWGEKIVLRVLDTGGIDLDLRKLGFTEHNLSRFEASFTKPHGMVLVTGPTGSGKSTTLYATLGRISKPEVNVITIEDPVEYRLRGINQVQVNVKAGLTFAAVLPAILRSDPDVVLIGEIRDGTTAQIAVEAALTGHLLLSTLHTNDAPGAVTRLTEMGIEPFLVGSSLDCVLAQRLARRLCDWCKEAYAPTEEEVLGARWPLEDLAFPQVLYRPVGCRNCANTGYKGRIALHEVMPVSPEIESLTIRRAPAGELREVALAQGMYDLRSDGLAKAAGGLTSIREVSRVAV

SEQ ID NO: 9950 - protein, 373 aa, Actinoplanes utahensis
MNTIEHGTRQPETAVNPDDLAVLDQMLITLVESRGSDLHLTVGSPPMMRVDGSLRAVPGYGKLNAADTELLARAAVTPAQWQTFQAEQEMDFAHSIVGVSRFRGNLYRQRTSCGAVFRAIPHKIKPLDELGMPESVARFAHLPRGLVLVTGPTGSGKTTTLASLLDLANRSRADHIITIEDPIEFLHPHKRSIVNQREVGADTDTFASALKHALRQDPDIILVGELRDLTTTATALTAAETGHLVMATLHTQSATQTIDRVIDIFPPHQQLQIRAQLAASLQGVITQALAPRADGKGRAVICEILSATPAIRSLIREGKSHQIPSFMQAGSNEGMLAFDQHLAEKVREGIITMQTATEISHSPEELKRLVGRS

SEQ ID NO: 9951 - protein, 411 aa, Actinoplanes utahensis
MSGTNKTFAYSTIDASGKKSKGTIEAPNEAAATHMLQQRGEVPLGLVEAGQGLQRELKIPGLGNRVKLKDLAVFARQFATMTSSGMSLLRSLSIMEEQTSSPPLKKAIGEVRSDVAAGGGLSASMAKHDRVFPRLMVAMIRAGETGGMIDRALEQIADSLEKDTALRGKIKSALTYPAIVLGFTFLLIAAMLIFIVPIFEAMFKNLGGELPAITQFLVTTSHNMWWIGPLVLGIGIGAAAAYKHQHRTSAEFRLKVDKLKLRMPVFGSLFQKLAMSRFSRNLGLLLNVGVPVMQALAVVGETTGNEVINIAMQDIQATVRDGQPMSGAMRNHKVFPEMVNQMIEVGEESGQISQMLDKVADFYDREVDAAAESLAASIEPIMVLVMGAVVGGMVVCLYLPMFTIYQNIQSS

SEQ ID NO: 9952 - protein, 168 aa, Actinoplanes utahensis
MQNVIDRMIAKQAEIRAKKDDEGFTLIELLVVVVIIGVLVAIAVPVYLNYRQGAADKSAQSDVRGAISAVEQYYTGNGNTYPTNAATSIVANSTPASSITLPAQTGGTAGTITVSDKTELTYVPPSGTSSYKICAKNTGGSGKVYLYDASVGGSVKTASGITPTATGC

SEQ ID NO: 9953 - protein, 261 aa, Actinoplanes utahensis
MPLSPLLLVVGLLGLAVGSFLNVVIHRVPRDESLVHPGSHCPNCGHAVRNRHNVPVLGWLMLRGRCADCATPISARYPLVEAGTAALFVAVAARFGWSWALPGYLYLAAVAIALALIDLDVMRLPDKIVLPSYAVAAALLIPPALLAGDPTALLRGAAAAGLLYVLYRVLATFGMGRGDVKLAPLLGFHLGWLGWGAVAVGAFAAFLLGGVVGAILLATRVAGRKSRIPFGPYMLAGAFLAVFAAAPIAEWYAQLLIPASF

SEQ ID NO: 9954 - protein, 340 aa, Actinoplanes utahensis
MAGATPIGLDIGSSSIRAVEVRRTKDGHTLTNFGQIPLDPGAVHGGVVQDPLGVTTALKQLWAASRFGTKRVSLGVTNPQLVVREMSIANLPASQMRQALPFQVKDALPLAVERSLLDFYPLEQPGDNPTVRGLLIAMPKEAVVGMVQAVEKAGLHVTGVDLASFALLRAASRLDAQVEAIVDIGADITSVVVHADGEPLFVRTLPRGGSEITDSIATRLGLPADQAEEIKCRYGLHGDGNPDTVTAVADAVRPLASELRSSFTYLASGERQKQVTRLSLCGGGALMPGLAEHLQNQLGIAVMYADSAARLRDTRRARERGFDSFVPSAAVSIGLTLGGA

SEQ ID NO: 9955 - protein, 227 aa, Actinoplanes utahensis
MTTTALMPVDPSVTPQQAARVLSIRANLLPQDISDGRRARRTRTAVLVAVVLVLNGLGYWYWQAAAERKDADAEYAAITKQVADVQRGQNKYQEVVKIRNRNTLVEGQLAKLMADDLSWQAMLDLVRTTGTASKTTVTQISGSLNAAALKSDGVGLLSVSGTAPDKKAVADYVKALAALGKKGLADPFVSNVATAAGGGVNFNLTVSITDPALCGKYSVKKCPSGGN

SEQ ID NO: 9956 - protein, 193 aa, Actinoplanes utahensis
MNLLRSDRVWLFGGIGLIALLVAAAWFLPIKSQYTDAATARDQVGDATAQLAKLRKTLADLNVEQAKMDTYKANEARYKLALPTGDAIPAFLTQLQTMGLDLNVAVDAYSASGHDKSQVVPTVEELPITISATGSIANLSTFVNQLQYTQPRAVLIQTANLQVSTKPDKSTLDLTMSAFRNIAPASTAAVNTN

SEQ ID NO: 9957 - protein, 402 aa, Actinoplanes utahensis
MSRTDGVLRASWHSSIPFMAGIRTSVIMPIGLATVRIRAAVCPSLAPTARKPAASRLTDSRSRTSASSSAIRIRFSFMRLLLVDPPDRPRSGRGQESRGCRPGAVCRRQKNAASGPGGGQNPAMATFSLQAQPADAADWLDLARRAEAAGFHALYAADHPGSGASPFVALAAAAAVTSRIELGPYVVNAGIREPLLIASDVATLDVVSGGRAILGIGAGHTPAEWTAVGRVRPDVAGRVRHCIAVAEATVRMLAGDGLDRPRPVRERVPVLFGGGNTELLRWAATNADVIGLSGLGRTLADGHTHTARFHPDQVDAQVELAGGTPVEALVHYFAIGDDAGRRYATWAADAGISPAAAAESPYLLAGTAAEIRAKLQRCERRWGLTRYVVRRPAFESMAPLLR

SEQ ID NO: 9958 - protein, 268 aa, Actinoplanes utahensis
MNPSPPFAEIGVIGGSGLYALLDGAIEHEVETPYGPPSDKITVAEVGGRRVAFLPRHGRDHRFPPHKIPYRANLWALRSLGVRQIVAPCAVGGLRPELGPGTFVVPDQLIDRTSGRVQTFFDEGAAHVSFADPYCPAGRAVVLNSAARVNAVDGGTMVVVEGPRFSTRAESRWFTSIGGTIVNMTGHPEAVLARELALCYTAIALVTDLDAGVEGDHGVTHEEVFAVFAQNTDRLRGVLLDAVAKLPTERECPCGDALQGIKLPFALP

SEQ ID NO: 9959 - protein, 185 aa, Actinoplanes utahensis
MESMTGQLLVATPTLKDPNFDRTVVLLVAHEPGGALGVVLNRATEVPVAEVLGNWGELAGDPAVLFEGGPVQPESAICLARTRPEVKKRLTGFHPVAGALGTLDLSADPEHLKENVAGIRVFAGYSGWSAGQLEEEITAGSWFVFDALPGDPFVERPDDLWAMVLRRQGDILAAVAHFPPDVSLN

SEQ ID NO: 9960 - protein, 113 aa, Actinoplanes utahensis
MDDARIVFSRGGREFLHGRITVIGSVDHAQQTWLWSWANDSLPQAVLGDIAGVRDFGERHGFPLLVRPGFHAEQKPVAQAKTVAADVLDAEGLWFQPGDEIDLHFAIHGLRPV

SEQ ID NO: 9961 - protein, 135 aa, Actinoplanes utahensis
MVRLYSLFGLIDLVLIVVALIDCLSVDEYAVRALPRGLWVLLILLFSPIGPIAWFVAGRPARPIHLSNGTVWRPGAGFPENERPTRRAPAAPDDDPEFLRGLAASRREDENLMRRWEADLRRREEELRRRESGEA

SEQ ID NO: 9962 - protein, 472 aa, Actinoplanes utahensis
MTLATSAQAAYLVAALLFILALAGLSRHESAKRGNAFGVAGMALALVATIALAVEGDLSGTGLALLLVATAIGAAIGLYRAAKVEMTGMPELIALLHSFVGLAAVLVGWNGYLHVEGDPDGGESAALSAQGLLGIHHAEVFIGVFIGAVTFTGSIVAFLKLSARINSRPLVLPGKNLLNVGALVAFVALTVWFVIDPRLWLLIAVTAVALLLGWHLVASIGGGDMPVVVSMLNSYSGWAAAASGFLLSNDLLIVTGALVGSSGAYLSYIMCKAMNRSFFSVIAGGFGIEAGPSGDVDYGEHREIQADAVAKMLTSAESVIITPGYGMAVAQAQYGVAELTRKLREKGVDVKFGIHPVAGRLPGHMNVLLAEAKVPYDVVLEMDEINDDFARTSVVLVIGANDTVNPAATEDPSSPIAGMPVLKVWEAAEVIIFKRSMASGYAGVQNPLFFRENSAMLFGDAKDRVNDILKAF

SEQ ID NO: 9963 - protein, 505 aa, Actinoplanes utahensis
MIIGVLGESSPGEKRVAATPATVAQLLKLGYEVVVEPGAGRRASFADEAYAEAGATVGDPYAADVVFTINAPEPARLDRLKPGATLVGVFSPRLNEALVAEFAGRPITVLSMDAVPRISRAQSLDVLSSMANIAGYRAVVEAAHAFGRFFTGQVTAAGKVPPAKVLVAGVGVAGLAAIGAAGSLGAIVRATDPRPEVADQVKSLGGEYLAVQAADVEVSSTGYAKEMSDDYNERAARLYAEQCAEVDIVITTALIPGRPAPRLITERMVASMKPGSVIVDMAAANGGNVEGTVAGEVVTTANGVTIIGYTDLAGRLPAQASQLYGTNLVNLMKLMTPERDGHLVLDFEDVVQRSITVVRQGELTWPPPAVSVSAAPAPETKEVAAPKAATATRNRTLPLAGVGAAALFLLTALAPTTLRGHLTVFALAIVIGYYVIGHVHHALHTPLMSVTNAISGIIVVGALLQLGHGGAVVTVLSFAAILLASINVFGGFAVTRRMLAMFTRS

SEQ ID NO: 9964 - protein, 144 aa, Actinoplanes utahensis
MAGGPPPSAAALHCSLALPDDPVEVRIRVLDGGASTALIDATAAHLRERRFTVLNGATGSPLEGAASVSYGPAGIGSAALVRAYLQDGATMLFDPGIRDDIIAVTLGPAFTRLATPTEANRNLVAVGEPTAPPQCATVGAPAKR

SEQ ID NO: 9965 - protein, 63 aa, Actinoplanes utahensis
MSRPVPDRLRELAAEVGDLPVPPAAEVRARGRQRSRRRLAVVTAAGLALVATAGVTVIWPLAS

SEQ ID NO: 9966 - protein, 190 aa, Actinoplanes utahensis
MAGCGVYSSVRAPTEAGTMAGDDSADFDTFYAATVRRVLLYAYASCGDRAEAQDVAHEAFARAWQHWSRVSRYDDPEGWVRVVASRLLINRWRGLRRWVAARARLGPPDDVAGGPSPDRVAVAAALQRLPKAQREVVTLYYLLDMPVRDIAESLGVPEGTVKVRLSRARAALAQLLGDNDQEISDVTSRS

SEQ ID NO: 9967 - protein, 427 aa, Actinoplanes utahensis
MQSSVGERIRRLRTERGLTQRELAEPRFSRALLAAVESGTRQPSPSFIGYAASRLGVDADELRHGRPPGTAEDLAARLTAARRDLSQGRIDAAVAAFDQVRADAVRYALPAPAAWAAYWRGEAALQSGELSAAEDAFAPALDCPGPVEPRAAAIARWAYCRFAGGDTSGAVDVLEKHLAVLQESPQSPADALVRLGTALIYAYIELDWRERARNLEDESRALLPRVRTTEWVAQFLVTAGQARRTAAELPGAQRMFTEAGRIYAELGLTREIGLCHWAHGYVLRRAGSLEPAAGEFTAACTVLDSVGARQDSAGAALELAEVRRLQGRLDEADALADGAARVCAEFGHQECSAEADRVRGLVAAGQGRPEAARELLARAADRYARMGLAAELATTCRELGDVLLAGGEPAQAALVFRRGLRAAETIR

SEQ ID NO: 9968 - protein, 401 aa, Actinoplanes utahensis
MTAAFGGRLRELRKARGFSQRELAAPRYTAAFVSSVESGRRAPSTDAVAYFAERLGVTPRALTTGEDPDHRVRARLALADADAQDGAADAAYRKLASEGIFEPQCRLGLGRLALRRGEIADAAREFAAAARLLAGEPAHVRAHAVAGQAACLRAQGDPRYAAHLLHRVLTEMDLAALPDPAALVAIHAQLALCHADLEDETAAAASASAALSLAGPREAGSLADLHLTVARTLLSTNDLAGADLALHRAGQARQQATLAPELAACRLIRGRARRTAGDLPGALRDLSPVDGPVSAEAAVELAAVYADLGLRDQAHDLLPERLPAADRLRARLAEEVGDHEAAEHHLRVAADGYRTRGPRRELATTILALADLLDRRNRPEDALTALRDGLTDVLGPGIGKA

SEQ ID NO: 9969 - protein, 779 aa, Actinoplanes utahensis
MRSRTVLAGTVAFATGAALAVGITSAHAASPPQPAAASGTPVTEQVRLAAADKAAASGFDALGKGPDDAFLRRQAITGLGGYSYLTYDRTYRGLPVVGGDATVVVDAAGHVRDTFAADHGRVSLGNLRPAIPAKQAVGTARRQLDSVATAGQAQLVVYALGAKPLLAYQVLVSGVRHDAPSRLHVWVDAGTGKVLFTREDVVSEAARGYVNGAVQIDTNGGVLQDPARPGLSCGNYSTRQTYRNGGTGTGTDLQTACVDAYYGVEQEWNMLRDWLGRSGISGNGSAFPLYVGLNDVNAYWGGSSGTFGHNSSNTAQATSMDVVGHEMGHAIDQYTGAGTAAENGLGEGTGDIFGALTEHYADNPSDPPDYTVGEEINLVGSGPIRYMYNPSTNGDPNCYSSSIPGTEVHSAAGPLNHWFYLLAEGSRPANGNPASPTCDGSTVNGVSIQKAGQIFMSAMNMKTSGWSYAKYRGATVKAAVNLFGASSAECASTKAAWSAVSVGPQSGEPSCTTVPAGDFSLAVNPSSGSLQQGGSTTTTVSTQVTGGTAQSVTLTASGLPSGVTATFSPATVTAGQSATLTLRASATATTGSKAITITGTAPSGSHTATYTTTVTTGQPPANDFSVSVNPASATVAPGNSVTASVVTATAGGSAQTVNLAVSGAPTGVTAAISPASVTSGGSATLTVSVSSTAAAGTFPLTVTGTGTAATRTATYTLTVSGGTPPQGCGGVAAWSATRPYVPGDKASYNGHLWNSTWYSTGAEPGAPGSWAVWTDAGPC

SEQ ID NO: 9970 - protein, 79 aa, Actinoplanes utahensis
MASRSAEHLGRHRRSAATLELPARYSTRSRWQRSQHFAHAGHGYHDAAGMAGAGSMRSSSFCGSAAWTADPTRTSTDGY

SEQ ID NO: 9971 - protein, 157 aa, Actinoplanes utahensis
MTFRGRTQMVTLWLAPSVLILSACSGAGVDKQSESDVNAVVQQHAEQIATAVGMPLFNPKLSSGGCTDRAGESSDRIFTVQGVYNVNPPQKDQHLASLARIKAGWQAKSYRITDDRTVGPDDGLVAAETPDGYRLEVDRAIPDGLVVLIHSPCYAKP

SEQ ID NO: 9972 - protein, 30 aa, Actinoplanes utahensis
MAVAAAYLDLGDQVRHLEDAVSNRGPTDKP

SEQ ID NO: 9973 - protein, 329 aa, Actinoplanes utahensis
MDGVPATDRDKANRIGLAQQKQYLQDRLHNPDMTLEAHDTYDELQRLETIEKGLDKLGPRGLLLGFDTAAFDGDGKVIMAMGNPDTARHTGVWVPGMGTTLGGSTLDNLDRIMKMNDVADSITRDRSGDISTIYWLGYDAPEFPPANLSVVANFRSIAGRDPYIDFMQGLRATHESGDGHLVAMGHSYGTTVLGEAAKTHRLPVDDIVTAGSPGMHVGSANDLMADPRHLWAGASDSDPVARLEAYTVSGDSTVDSSPLTELANKIADDDHGLAPSDPSFGGNVWKADTSGHTHYWDDNSESLNNQSRVLAGAYDQVTYNSGSIPENWR

SEQ ID NO: 9974 - protein, 159 aa, Actinoplanes utahensis
MTRNGTVRTVVASAAAALSLTLFACSGAHVETKSEKDVNSAVQQHADNITKVAAKPLEDPKMRSGPCTDPMGRDSDTVYTVQGVYNLAPPATGTHLDILAKVRTDWTSKGYTITDDRTVAADRGVLAAKTKDGYNLDIETATPDGFAIIIHSPCFERPD

SEQ ID NO: 9975 - protein, 158 aa, Actinoplanes utahensis
MTGRSTVTAVTALLAAVAFTLSACSGDQVETKPEADVNAAVQKHANAIAAVAGQALQNPKVRAGGCTDPNENVSDSVYTVQGVYTLPAPAAGEKHLDVIAKVRDDWKAKGYTITDDRTVAADRGVAAARTPDGYKLDIETGDPRGFAVFVDSPCYARP

SEQ ID NO: 9976 - protein, 114 aa, Actinoplanes utahensis
MQPNVEIDVEGLVRTGTQVQDSSGSVRDAITKESGWLTVAGAAAPWAAVATMADRAHGWATYLQDLAERIRLSGAGMVGAAIDYQTTDHDSGTDIAGTYPAPGPHHGPHMGYAE

SEQ ID NO: 9977 - protein, 144 aa, Actinoplanes utahensis
MSTITLQDVAETNVAAFSSASDAWDRVAANLDAGLEKFIAAGQLLPHVWQTGYAAQDRVSALQAELSGTYDPCKMISRALRTHADTVLSLQSMLSDIQRECAAAGLTVNLTTATVSSKGHLTDTSQVLRWPDWCRATPGSWASC

SEQ ID NO: 9978 - protein, 157 aa, Actinoplanes utahensis
MTSSGRTQRVALWLAPSVLILSACSGADVDKKSEADVNAVVQQHAEQIATAVGMPLFNPKLSSGECTGRAGESSEKIFTIQGVYNLNPPQKDQHLASLGKIKAEWKAKNFRITDDRTVGPDDGLVAAETPDGYKLEVDRAIPDGFVILIHSPCYEKP

SEQ ID NO: 9979 - protein, 270 aa, Actinoplanes utahensis
MLAGTPLQRRDVMKQPLSRALRATGLDAVDVAARLSVDPKTVERWLTGRLPYPRHRAALAGLTGWAEPDLWPGIDAREQAPPDTGDILMTYAQRCSVPPDAWRRLFAGAEQEIGVLAYSGLFLAEDAGAVAILRDKARAGVRVRIALGDVNGVQVAQRGVEEQIGAIMPARINNALALLRPLIEEAGVAVRTHDTVLYTSIYRADDQLMVNTHAYGCAASRSPVLHLRRATDDGIAATYLDSFERVWAVAQDLQAQPTTRSKRSAGLASG

SEQ ID NO: 9980 - protein, 184 aa, Actinoplanes utahensis
MGDVSWARELAEKLLVDTLPRRWAHSQGVGRKAESIAHLLGDDADTVVCAAWLHDIGYAPDLVHSGSHALDGARYLRDVAEADETICRLVAHHSYAIVEAGRRGLATELAEEFPAVNGLMADALVYCDMTTSPDGDPVDVEKRLKEIASRYAPGSIVADSILEVSPRIVQSVRVITGMPGFQAD

SEQ ID NO: 9981 - protein, 154 aa, Actinoplanes utahensis
MADGGWIGDAADSFSAVGTVGAFLVGFLLLRKEQRREAGRSDDERRAQAAKISAWVELHRKADGTRELAFHIHNASDMPIYEVELPLPSPDGPEVTEFVGLVPPGQTIRRPAPADWLRSYVEPEPIQIEFQDSAGRRWTRDEQGTLAQADKPAG

SEQ ID NO: 9982 - protein, 158 aa, Actinoplanes utahensis
MSRRIDYFDDPEAPAANSIVPSVNVVVTDDRGRLLLIHRTDNDNWALPGGAMDFGESLPEAAIRETVEETGIKVEITGLVGIYTDPRHIILYTSDNEARQEFSVVFTARAVSGEPTTSSESREVEWVEPDAIPGLTMHRSMRMRIDRYLAQEEQPYLG

SEQ ID NO: 9983 - protein, 244 aa, Actinoplanes utahensis
MPNDRLRTALLERGVTPADLAEELKVDPKSVERWISGRTPYRRHRYAVAAKLGVDEAYLWPDALSRSQVADASESEIVNIYPHRWAVPSEMWRNFFDTAEAEIGVLAYGGLFLSEDAGVRKVFREKADAGVLVRILLGDPNSESVAQRGADEGVDDAMAAKIRNALVLYRPLRNLDGIEFRLHDTVLYNSIYRADDQVLVNTHIYGFPAAEAPVLHLRKVAGGTMVSSYLDSFERVWDGATPLE

SEQ ID NO: 9984 - protein, 61 aa, Actinoplanes utahensis
MPTPANEPTCTCGAQLDADHPNQCCKCSARSRWQRRHANLARRTGPGRKASGRGKDGRRPA

SEQ ID NO: 9985 - protein, 64 aa, Actinoplanes utahensis
MTVTVSAVLLLAVFVYLLWRFAGLPLWQAAICAVFGYLLAASSIGPNIGDALHSLVRIIAKAQL

SEQ ID NO: 9986 - protein, 577 aa, Actinoplanes utahensis
MRAYGRRHRRWRRHGQPLLLVSDESWLSAILAGIGRLAHRYRSELAPATVAVVFDLVAVWLHSAQPGACWWVLAGTGAATLRAALRGAPWGATRAEERAYAAITTAVAGVWLAAATALGPGHAHLQSVLLVAMFACGTPWWRHRRRRARVKVDRTIQAWPNLAEQIGLAGSRVLSAAVDVWGWRARMTLRGGQTVADVIAQVPAIESGLGTRPGAVRVEADPAHAGRFVMRVLAEDPHANAVPWRGPAARSVADPIPLGVFEDATDVAVPMLRRHVLVGGIAGAGKSGVLNVIIGNLVACPDVVLWGIDLKGGMELQPWAPCLARLATTPAAAETMLRDAVRVLDARARAMAESASRLWIPTERKPALVIVVDEYAELAEQSPAAVEYADSIARRGRAVAETLLAATQRPTQQAMGKGAIRSQMDVRVCLRVRERRDTDLILGQGMVTAGWHAHDLDAPGKFLVSAEGFNHPRRARAYLVTDDDVRATVERYAADRPVLDHLSADALHDEADALHDEVDEADPEKVLWAALSEAPEHGLSVPDLMRMTGMRRTWIYDRLQANATQVSRGRWRLPNGG

SEQ ID NO: 9987 - protein, 599 aa, Actinoplanes utahensis
MAQIPRQHDRPASTHKRAFSYLRVSSAGQVNTDYDPEGISLPAQRSAIQRRAAELGAEIVAEFVEPGRSATTVDGRPVFREMMARLKAEKSVDYVLVYARSRLHRNSIDAAITKRDLRSAGVTLISVMDYTEDSAIGDLVATVLDGVNEYQSRASGADIAYKMGQKIIRGGSVGRAPIGYLNVRETFEGREVRTVAVDPVRGPLVRMAFELYATGTYGFHALIAALSDAGLRTRPTKRFPIGTSISLNSLGNLLRDRYYLGLVSLRGVEYQGRHEPLVSPEVFDRVQQMLESRRAGGVRERTHNHYLKGVVWCHRCKRRLMVMRGKSHTGDLHFYYFCRGRQQHACDLPYLPIARVEAAVIDNYATIALPADLRDNLTSRVGELLAESAGMSAELRTQVKDQLATLDRQEDRFLDLVGDPDWPQDKIAARLRKVRDERDRLARQLNDSDAPRLDEAAETMLYLLGLLADPQELYRRAGQQGRRALDQAFFAKIYFDSDDDGPYVAADELSDLVFPLVNEVRNDSGGAMGAAAAGEPSPALAGSSKPPLVEVPGIEPGSFVVLSGLLRAQLTMSLLGPPTHVSKFGRRAQSLINLAARSP

SEQ ID NO: 9988 - protein, 219 aa, Actinoplanes utahensis
MSTNPPHRDRQFFIARGVFGLAGAILISLVAWIALRAGGSSASAADTPLLVQPSTGLRAAESTVVPSATGTAPVSSGPAVAATSPSASPSPSRTSASPKPSKTSASPKPSVTRTTTPPVSRDLSLSCGINAWNGGFVANATVTNNGSQAHSFRVTFTFSGSVRVLNNPWNSRATSTSGQTITLVGSSALAPHSNVMVGFSGSADDPRRLRVGCSVAVTG

SEQ ID NO: 9989 - protein, 158 aa, Actinoplanes utahensis
MPREQGRKLVASNRKAHHDYTILDTYEAGMVLTGTEVKSLRLGRASLVDAFGHENNGEIFLHGLHIPEYTQGTWTNHEPRRVRKLLLKRDEIHKVMGKLRDDGVTLVPLSVYFQNGYAKVEIGVAKGKKSYDKRQDMAERDAKREINRAVGRRAKGMA

SEQ ID NO: 9990 - protein, 294 aa, Actinoplanes utahensis
MAGARERVAQIARNSYMGSPITRLNLLVSAHGPVDLMDRMSMVDEMVRQENDDVRRLIGARREARAAQDRAGAAKRAAEVAEAEAAAKLQEAQTAQVDAVRAKRDVYQLVLARRAALSAANAQRATVLAQYRAAVAEERKIRSSMAGWEVRSGYSGQYHGRLLMPVHGWKSSDYGNRYDPYYRVWQLHAGTDFAAGSGTPIRAAAAGRVIQAGWHGGYGNYTCVNHGRVMGIGFSTCYGHQSRIYVHVGEYVRQGEIIGLVGSTGASTGSHLHFETRFGGAPRNPLNYLPPCLC

SEQ ID NO: 9991 - protein, 56 aa, Actinoplanes utahensis
MRYRRLDPLLTACLCLLAAVGLTLAVPAPASADQNDAAEAAQSVRRAEALLENAAS

SEQ ID NO: 9992 - protein, 293 aa, Actinoplanes utahensis
MRVKYVLNEVLVGLWRNVTMTVAMIITMSVSLTMLGASVLMYLQVDRMKNFYYGEIEVSIFLADNVSDGQIQALQAKLSGDPLVKKAELETKAQALERFKVLYADSPDFVAAVNEDSLPQSFRVKLKNPEDYNKFTQALGDQASQGIQRVIDQRELLQKVFNIFNSVQLMSLVVAAVMAFAALLLVGNTIQVAAYSKRREVAVMKLVGASNWFIQAPFVLEAVVAGLIGSILGFVALFIGKIVLLDNKLQALTAILTPVPAGNVWLMLPLLAGVGAVVSAGTAWVTLRFYLKV

SEQ ID NO: 9993 - protein, 226 aa, Actinoplanes utahensis
MIQLENVTKTYPKASRPSLDNVSVGIEKGEFVFFIGPSGSGKSTIIKLLLKEVQATRGKVVVNAKDVTSLRSWKIPHFRRSIGCVFQDFRLLPNRTAYENVAFALEVIGKTKAVARRVVPEVLELVGLGGKEHRYPHELSGGEQQRVAVARAFVNRPLILLADEPTGNLDPDTSIEIMRLLDRINRTGTTVVMVTHDSNIVNQMRRRVIEIESGRIVRDQARGVYG

SEQ ID NO: 9994 - protein, 381 aa, Actinoplanes utahensis
MIWPDGVFLSVVTAADFPEQLKALDATLRNIENVLDVDKLRRNKAELEEQASAPDLWDDQARAQDVNSRLSYVSGEISKLERLRTRLDDAGLLLEMAEAEGDAGSVAEVGDEITALTKAIEEMEVRTLLSGEYDSREALVAIRAGAGGVDAADFAEMLMRMYLRWAERHGYPTEVYDTSYAEEAGLKSATFTVKVPYAYGTLSVESGTHRLVRISPFDNQGRRQTSFAGVEVMPVVEQTDHIDIPDNELRTDVYRSSGPGGQSVNTTDSAVRLTHIPTGIVVTCQNEKSQLQNKASALRVLQARLLERKRQEEEAKMAGLKQDTTGSWGDQMRSYVLHPYQMVKDLRTEFETGNPMSVFDGDVDGFIEAGIRWRKQNQSAA

SEQ ID NO: 9995 - protein, 253 aa, Actinoplanes utahensis
MGRLSECARQFRTDLGLSCPARPVWPIQCAILPGQPPIDGRNARSARSLSDCLCGTVVCGGANWTDRAKSWTADRQSGSLEGMPDFQINPTAAALLGLLHEGPMTGGQLMAAAERRLGPYWSMTRSQVYRELPVLAEMGYVRLGKPGPRSSQPYAITASGKRAFGRWLTETPGRDALRNPVALRVAFGQQHSTEQLQTLYTNANQYHAEALAMAKEQAKEAKKNDDSYGAAALEFAVAYHKAALSWLKTVPSE

SEQ ID NO: 9996 - protein, 433 aa, Actinoplanes utahensis
MERSVTAGRAPPGRPITLTPMTDAQATTAAPETIEESRLTVALLTAASLAWTVAMLYSARASITGRADVAMEVTSTAYAMPGAVAAAMVTGAAVALLVLTLINGRRALGATARFAVATVSGLVTGVLCALPIITINIDGTMYAAVGGTVAAAATIGGALAGFRIPPVIAAAGAATVGVFLIGFVLNNKHVQNPVLDLLGSGSTESAVKANQYFSYGQSAISGLAAGLIAFRVLRRHRQRAGGADLRWPFYLIAGAGAGVLSVLSEILTRTAGAQVLELAGKVSELEKSVQQILSTNRLNSGLIVLFVGAFTAMVAIGRTLSPADDEDDYEDHPGATDTAPGATAPAPDAAARTPEAAAPQTAPTAPEAPASVAATGSAPAATTAGGKSDIVGTTAVAKSDVADAATRPQQAEPIEASSAPGASATDAAVGDRN

SEQ ID NO: 9997 - protein, 177 aa, Actinoplanes utahensis
MAKLEENVPITELVRVYVPATLPMLAALRKAGRLGDGATVAHAVTPALREWYAEGDEEELEYVAFTRAAQDALRLLRQDAGAARRRVVVSADVPASALVREDAELGSSTVRLPEALRLEQIASIHVDGAEASEAVAAAAVVVEEALAGDPDAQFTVDEAEDHELEWYAVTELDEIGE

SEQ ID NO: 9998 - protein, 345 aa, Actinoplanes utahensis
MRSAVDSAPAGTRAVRLRPVPRYEPPFDDELAPQLWSPEQQLALTWPRPVVTGAAGRAGPPPIAAPERERGPGSSPECGGGGSRVGRAVVSGDQRKAGSSRDRPAGGGEHRGADQGGGDQCGGEQCGGEHGGGEHGGGVHSGSDHSGGVHSGSDHSGGVHSGKDQGGSVPGGSDQGGWASGGGNGEPAGGGRTGLLGCHPWREGTPWVDPGRIAALAAVPVVAGPSGEAKLAVKRFVHLCVEVLNGYRPATHLRRLSLPAEAAEVVAQGLAGARRVSAMRRARRPGDRRPQRPSPVAVIKVNLCQPRGGAVEAAIALVTGERTWAMALRLELHQDTWFATALRLI

SEQ ID NO: 9999 - protein, 970 aa, Actinoplanes utahensis
MSILEKILRAGEGRMVRRLKAIADAVNSIEDDYVDLTDDELRECTEQFKQRYQDGESLDSLLPEAFAVAREGAKRVLGQRAYDVQLMGGAALHFGNIPEMKTGEGKTLTGVFPAYLNALSGDGVHIITVNDYLAQRDAEWVGRVHVFLGLTVGVILPNRPAAEHRAAYQCDITYGTNNEFGFDYLRDNMAWSRDELVQRGHNFAIVDEVDSILIDEARTPLIISGPAEHSQRWYAEFAAIVKRLEKGKDGAGDYEVDEAKRTVAITERGVSRVEDRIGIDNLYESVNTPLVGYLNNAIKAKELYKRDKDYIVSPEGEVLIVDEFTGRILHGRRYNEGMHQAIEAKEGVEVKQENQTLATVTLQNYFRLYNKLGGMTGTAQTEAGEFNSVYKVGVVSIPTHRPMIRVDHPDVIYKTEKAKFSAVIEDIAERHATGQPVLVGTVSVENSEILSTLLRRRGIPHSVLNAKFHAQEATIIAQAGRKGAVTVATNMAGRGTDILLGGNADFLAAQELAQRGLDPAENPEEYAKALEEVLPQVKEACEAEQAEVQAAGGLYVLGTERHDSRRIDNQLRGRSGRQGDPGESRFYLSLQDDLMKRFRAGAVEAVMERFNIPEDVPIESKMVTRQIRSAQTQIEAQNAEIRKNVLKYDEVMNKQRQVVYAERKRVLDGEDMHEQVTHMIDDVITDVVHAATSDGYAEDWDLEQLWTNLRRLFPVTLTIEDLIEESGGERNAIDQEFLVEQLKQDAQAAYAAREEELGSEAVRELERQVLLAVIDRKWREHLYEMDYLQEGISLRAYAQRDPVVEYQREGFDMFNQMMEGIKEEAVGFVFNLEVQVEEQPTVNVDPSQAFELPKVGEVPDDAPVDEPHEHVEVRAKGLGGGNRPQNLQYTAPAIDGEAGGGSPVIQPQAEPPVAFGPGGAPSPVPANPAHTTAGRHAAKEADSNGPSRNAPCYCGSGKKYKRCHGAPGAV

SEQ ID NO: 10000 - protein, 363 aa, Actinoplanes utahensis
MDHDDGVLLRARGPQDEAAVTAAREDRHGRRFLPRGGSSTSDFSYAVIRLSTGFPVGGIDLDRQRADPGAARVTFWIGSPARGLGLGTAALRTLGDHIFGDTPEITGLHRLELLIHQDNPIAQRVALAAGFTREGERRGALPNDTGGYDDVLVYARLAGDPGTPAERLLPDLPGGDLTDGVVTLRPLGEDDIAFYADLHSRPDVVATSVPPIPPEPDEVRRRCLWAPAHWLAGSRADMVIVDTATGAPAGEVSLYYQEPRTGQAMIGYSMLPEFRGRGMTTRAAKLVALWAFAETGIARLIAGTLPDNRGSQRVLEKAGFQREAYLRSRLPGPAGTRHDDVQFVLFAEDLLAQVSGGELTQPG

SEQ ID NO: 10001 - protein, 205 aa, Actinoplanes utahensis
MDIVVKGRNVEVPDHYREHVADKLSKVERYDQKLMRVDVELFHERNPRQSDTCQRVEITVMTKGPVVRAEAQAQDFYAALDCAINKLDARLRRSADRRRVHRGRHAPVSVAAATANLPTDLTRGGAATLTAEPEVDELTEHDDGQPWRIVREKEHSGEPMTVDDALFQMELVGHDFYLFHDKESGRPSVVYRRRGYDYGILSLAV

SEQ ID NO: 10002 - protein, 129 aa, Actinoplanes utahensis
MPSTRAARRDRYGDHMARLAGHAANRLRAAGWTVAVVQPLTALPRPDSTSLGPAARSTAAVNSLRINPARIGVLRRGDAMRGTLVVADDIVTTGATLAAAVRRLEEAGMQVTGAAVLAATQLRRSCPGI

SEQ ID NO: 10003 - protein, 70 aa, Actinoplanes utahensis
MSPVLADLADLVLPGSCAGCGVERTRLRRGACPACVTELEALAPYACAPSPPPPGFPPCVAVGPYAGTLR

SEQ ID NO: 10004 - protein, 609 aa, Actinoplanes utahensis
MSRRLIALPLAGLLAVLVTGSCGIPDDSGVTVVGPGPSAGINPGDYGGSTQVTRGSESTDHAAFVENYLKAASGDLDTATDRLRAFMSRDAATAFKPNTTGLKVIRLVQPPLPTPGSEVVEVKYQTVGTLDKFGLLTPEAESRTDVYRFRVGPVGGQDGLFVKDAPPNLLISTDALSVYYREHAIYFWNTDYTALVPDVRYMPNAVPVEQRPTTILNWMANGPASWLSVSDLADGFGLIGKVVPAINGTRLQITLNEKSLPATDTALALDRLRKQLQWSLRPLLPDGGELDIKISFKDVGSYTGGDYLASNPAYRLVPDNPDKFVVYDGRIHRVTGAANTPDQVPVLRPEDNKDIRAAAMSSSGSHVFAAVVAGKGDTLQVASAETGAQAALQPISGMPGPLGQPAWAITYRDDVAEGAIGLIPAGGRLYSFSAVKGEAQLIPWTGQGTRITAVAVAPDGRRVVLVVDGKLYRASLTTGGDTPALGSPQQIRPVGLDAVTAVGFSSEGWLSVAGPRASDKRATIIDMSIDGAFSSSAGPDLGEQPVDAISVYPANPTILSRSRWVSYTAGGKAWELLSKATLIGVDRLSGLPSSGAAPDKTPTAPFYLE

SEQ ID NO: 10005 - protein, 549 aa, Actinoplanes utahensis
MRAPAWLPQPVRRPLRVMRRSWRVVAHRLERYTAPVRRSWRRSLQVRVVTLTLVASSLLVGTFGWFIADRSAKILLNRAQDEVSASLQRKVRYASEQLTVHPQPYDPELPATISETVTELYDGDQAGDSGTVVSIRAESYPEIVPQTVPPATDTRSLITPKLITEVATNGRVAQQIRTVDVKGRPTKFLVYGSPVTSKFGHVELYYAVPLTTEDRAANQIRNTVLVTGLALVILLGVVAGLVTRLVVTPVRVAARTAQRLSAGLLDQRMKVDGEDDLALLAAAFNQMAANLQRQIVRLEEMSRLQRRFTSDVSHELRTPLTTVRMAADLIFSEREDFDPAVARSAELLQAELDRFEGLLTDLLEISRFDAGFAALDAEHTDLVPIVERVTERLAGLAERVGVELELHLPDGPVIAEVDPRRVERVLRNLVGNAVEHGEAKPVQITMATDDAAVAITVRDHGIGLKAGEERLVFNRFWRADPSRARQTGGTGLGLSISAEDARLHGGWLEAWGAPGEGAQFRLTLPVRGGDRLVAAPLPLIPRDRTAEVS

SEQ ID NO: 10006 - protein, 232 aa, Actinoplanes utahensis
MDRMRARVLVVDDDPALAEMLGIVLRSEGFLPSFVADGERALAAFRENRPDIVLLDLMLPGMSGIDVARAIRAESGIPIVMLTAKSDTVDVVLGLESGADDYVVKPFKPKELVARMRARLRRGEDAAPEMLTIGPPGNQITIDVPAHTVSRDGEEVKLTPLEFDLLVALARKPRQVFTREVLLEQVWGYRHAADTRLVNVHVQRLRAKIEPDPERPEIILTVRGVGYKAGTG

SEQ ID NO: 10007 - protein, 67 aa, Actinoplanes utahensis
MQDATITWRKSSRSGAAGHCVEVANTAAAVLVRDSKDATGPVLTFDAQDWTGFLAGVRAGQFDRPGA

SEQ ID NO: 10008 - protein, 282 aa, Actinoplanes utahensis
MARPTSTARRELGGELRRLRGERRAVDVATALGWSESKLSRIETAHTGISEPDLDRLLTLYGLRVEDRGRLRDLSRRGRARVWWTSYRSFVTDPYDEYLALEGEAISISQWEAQVMPGLLQTEEYAQAVIETGAGIEDGEVIERRVAVRMDRQRVFTREPPATLRVVLDEGVLLREVGGRDVLARQLTRLYEATEQPGVEVLILPFEAGAHAGLTESFLVLEFPDGTRNPVVHSEGLTGGHFRVKPEELLVYRDAFDDLHERALSKEASRTVIAETRDRLAR

SEQ ID NO: 10009 - protein, 392 aa, Actinoplanes utahensis
MYPLTGVIRPYAWGSKTAIAELQGRPTPTEGPEAELWLGAHPGDPSTVPGPDGPVTLTALIDTDPAGQLGAGVAERFGHRLPYLMKVLAAGAPLSLQAHPDLKYAAEAFARQEADPSLPKNYTDANHKPEILVALTPFDALCGFRPAVVSAQVLAGLQMPRLEPVVAALRAGDLSEAVRLLLSWPGEDRGALIDAVVAAAAARGDTEPYAESYRLAIDLAAHYPGDPGVLVALLLNQVHLAPGEAIWMPAGNLHAYLHGLGVELMAASDNVLRGGLTPKRVDVTELLKVLRFDTLEDPLLHGAEVAPGVTSWRVPVRDFEMYRVELTGNRPPVKLPGAGPRILLGVAGDVHVGEDHGIPVSLGPGAAAYAPAGAGQLTAAGLGTLFIAAVPD

SEQ ID NO: 10010 - protein, 320 aa, Actinoplanes utahensis
MSAEGGTKAIIAALSANLGIAVTKFGAWLLTGSSSMLAEAIHSVADSGNQLLLLIGGKRSEKKATPEHPFGYGRERYIYAFIVSIVLFSVGGLFALYEAWHKIQHPQKIDSWQWVPIVVLVVAIGLEGYSFWTAITESNRTRGTTSWIDYIRRAKAPELPVVLLEDAGALVGLVLALFGVGMTLITGNGRWDGIGTGAIGVLLVVIAGVLAVETKSLLLGEGANPEAIRRIERAVLAGDGVERIIHMKTLHLGPEELLVALKIAVPRSETAAEVARHIDETEVRIREAVPIARVIYIEPDIYRPREIADDAVTSAPPVTA

SEQ ID NO: 10011 - protein, 407 aa, Actinoplanes utahensis
MVNPLEGSAGVNGHRVADESLLNDEKSMLDNDPGGMLRATASAGAQVRETAALAAEVDLTMLADEGRPRAVVVAGIGTAGLTGNILSTVAGPRCPVPIIGHRSAGIPGWVGAADVVIAVSASGRSPEALAAAEAAARRGARLVAIGNPDSELEAMAERARAPFIGVPRRAPARATLWGLAVPVLLAGRALGLVKVTEADIAETATRLDADAERCRPGADSFVNPAKALALGLAGSVPIVWGSSPLATVAARRFADTLAANARYPVMAGALGEAGRGRVGLLDGVFGGLAEGSRDIFADPEDADEAVTRLRLVVLRDGGLNPEDDADEPVAVEERRADAIQTLADRRGVRCDVLTAEGGSTLERLASLVAVPDFASLYLALAHGLDPMAVPAISEMKELSNPMPEGLS

SEQ ID NO: 10012 - protein, 61 aa, Actinoplanes utahensis
MALDPQLLDILACPDTHHAPLDYDAGGQTLTCTECGRIFDIKDDIPILLLDEARVVEKGDQ

SEQ ID NO: 10013 - protein, 459 aa, Actinoplanes utahensis
MLDLSQIIKAYDVRGVVPDQFNEPVARAIGTAFVEMLRESGDEPERIVVAHDMRESGPGLAAAFARGVNAAGAGVLNIGLASTDQLYYASGSLGLPGAMFTASHNPAQYNGIKLCRAGARPVGQDSGLVVVRVRAQELLADLNAEADGPARVEHRDLLGDYAAHLRSLVDLSGIRPLKVIVDAGNGMGGYTVPAVLGDQVLSPLPLTIVPLFFELDGSFPNHEANPLDPKNLVDLQAAVREQGADIGLAFDGDADRCFVVDENGDPVSPSAITGLVAARELAKFPNSTIIHNLITSAAVPEIILENGGKPVRSRVGHSFIKAEMAQSNAVFGGEHSAHYYFRDFWFADTGMLAAMHVLAALGGQDLPLSEFAAEYERYVASGEINSTVADAAAKSAEVRAAFPDAQVDDLDGLTFGFEDGSWFNLRASNTEPLLRLNVEAPDASTMASLRDRVLAIVRG

SEQ ID NO: 10014 - protein, 215 aa, Actinoplanes utahensis
MHPWPRTEEEALAVQDLLRARVVAAPGPASPETVAGLDVAYDGDRLGAAVVVLGTADLAVRDVALIKGQTTFPYVPGLFAFREVPALMAALEKLTVRPDVLICDGPGLAHPRRFGLASHLGVLTDLPSFGVGKTRLVGEWAPLGESRGSRSALVDAGETVGAVLRTQSGVKPVFVSAGHRIDLDNACSLTLRLAARYRLPETTRAADRACRDLVR

SEQ ID NO: 10015 - protein, 420 aa, Actinoplanes utahensis
MLPVNPWLALTPGDDPAERIRQVGRAHERFLAGQRRPELMRAVVAESWARSAAWVGADSTPPVELCDDELQAYRAAHPLARVMPIFRDLLGGLAEDGDHILAVCDAHGRLLWVEGNAGTLRGVASMNFVPGARWDEAHAGTNAPGTALAVDHALQIFATEHFNRSVQRWTCTAAPIHDPGTGRLLGAIDVTGGDHLANPHSLALVRATALAAEAYLYEPPRATSGPAVTALGRDEAVLVSGNSRTKLSRRHSELLILLAAHPEGRTGDQLTLDLYGDDLNPVTVRAEMSRLRRILGPELLRSRPYRLQKPMKTDLGEMSEALAGGNLAEALRNYPGPLLPGSDAPGIVRLRRLLDDRLRTALLHSADPHLLREWLSTPHGADDLALWEAYAVLTPGDPLTSRRITELSREYACNVSATYS

SEQ ID NO: 10016 - protein, 507 aa, Actinoplanes utahensis
MTTYVPPGSEGAIVSYQSRYDHYIGGEYVPPAKGQYFENPTPVTGSAFTEVARGTADDVERALDAAHGAADAWGRTSVAERATILNRIADRIEQNLEKLAVAESWENGKPVRETLAADLPLAVDHFRYFAGAIRAQEGTAGQIDEDTVAYHFHEPLGVVGQIIPWNFPILMAVWKLAPALAAGNTVVLKPAEQTPASIHYLFSLIGDLLPAGVVNIVNGFGVEAGKPLASSNRVAKVAFTGETTTGRLIMQYASENLIPVTLELGGKSPNIFFDDVSGADDDFFDKALEGFAMFALNQGEVCTCPSRALIQQGHYADFLSAGVKRVENLRQGNPLDTDTMVGAQASNDQFEKILSYLDIGRKEGAKALVGGAKADLGGDLSGGFYIQPTIFEGRNAMRIFQEEIFGPVVSVTPFADFDDAIKIANDTLYGLGAGVWTRDINRAYRAGRAIKAGRVWTNCYHLYPAHAAFGGYKQSGIGRENHKMMLDHYQQTKNLLVSYSPKAMGFF

SEQ ID NO: 10017 - protein, 125 aa, Actinoplanes utahensis
MATRVDVTPAAAAMMRRLREQHGPLMFHQSGGCCDGSSPMCFPEGEFRTGGSDVLLQSLAIEGVPEPITFWMSAAQFELWKHTHLTVDVVPGRGAGFSLEAPEGVRFLIRSRLLTDAEQEELKTR

SEQ ID NO: 10018 - protein, 279 aa, Actinoplanes utahensis
MRLSSTRRALLISMSLILAGLLGQAAAAESTHSSASAAAPAVSASPVSTPTVATPPVVKPTKPRTESTRIPERPKGHSGPAGSLLTTGSRGVALTFDDGPDPANTPALLRILAKNHVKATFCVVGENVKNHPDMIRKIVAGGHALCNHTWDHDLKLGKKSPAAIRADMQRTNDAIRAAVPQAQIKYFRAPGGNFTPQIVKIAKELGMASIYWKVDPRDWEHGREESDGAHTNRVITTVKSHTGPGAIVLSHDYAQPDTIRAYATLIPWLRSRFRLIALP

SEQ ID NO: 10019 - protein, 121 aa, Actinoplanes utahensis
MRSPRRCSRNGCPRQAVATLTYVYSDSTAVVGPLAAFAEPHTYDLCEPHARSLTAPRGWELVRHDGDFAPPPPTTDDLVALAEAVREAARPAPPPRPDVPEQPPGHQTGRRGHLRVIPPSH

SEQ ID NO: 10020 - protein, 158 aa, Actinoplanes utahensis
MTTSPERRRTDPKAARSTGPGHPARRDRHGRGLRGRLVPATVPLARTKAEIFDDLVLDTVESLERRYAKELAGVEFAVEDVPPELNVYDSDVLEDGEVPLARLLPGRPGRHELPPRIVLYRRPLEFRAMDREDLADLVHDVIIEQVANLLGVDPDELA

SEQ ID NO: 10021 - protein, 85 aa, Actinoplanes utahensis
MEAQVEGVDLLGDAPEWQERALCSQTDPEAFFPEKGGSTREAKRICGRCEVKAECLEYALGHDERFGIWGGLSERERRKLKRRVA

SEQ ID NO: 10022 - protein, 915 aa, Actinoplanes utahensis
MAEVNEGVSSAVAAAGSSATAGSGAAAVFLPAPVFLPALGSGAEPGSVAVPGSVAVAGSGSAPGAVAAADVAAPTEASIRRALRRAADGKAIDVDEATALLAATGEQFDELLTIAGGIRDAGLREAGRPGVVTYSKKVFIPLTRLCQDRCHYCTFATVPHRLPAAFLERDEVLEIARQGAAQGCKEALFTLGDRPEERWPAARQWLDERGYDSTLDYVRACAIAVLEETGLLPHLNPGVMSWAELQRLKPVAPSMGMMLETTATRLWSEPGGPHYGSPDKEPAVRLRVLDDAGRVGVPFTTGILIGIGETPAERAESLFAIRRTAREFGHIQEIIIQNFRAKPDTAMRGMPDAELRELAATVAVGRIIMGPRARVQAPPNLIDDEFALLLRAGIDDWGGVSPVTPDHVNPERPWPQISLLAEKSAASGFTLRERLTIYPEYVRRGAEGWLDPRLAAHVTALADPAGLAREDAFPAGLPWQEPDEAFGTGRTDLHAAIDTEGRSGDRRSDFDSVYGDWDEVAAHLRTPQSAPAGSDPRSVPAGDVPRTVPADLLAGLKLASTDPAALLLPQHEDAAMALFTADGPALDEIARIADDLRRDVNGDDITYVVNRNINFSNVCYVGCRFCAFAQREKDADAYRLSVEQVADRAEQAWRDGASEVCMQGGIDPKMPVTAYADLVRAVKQRVPGMHVHAYSPMEIVTAAAKAGVSLREWLTDLRDAGLGTIPGTAAEILDDDVRWVLTKGKLPTATWVDVVTTAHQVGIRSSSTMMYGHVDHPRQWLGHFRVLAGIQDVTGGFTEFVALPFIHTNAPIYLAGIARPGPTWRENRVVHAMARILLHGRIPNIQCSWVKLGDEGTRIMLNSGCNDLGGTLMEETISRMAGSEHGSARTVAELKELAAAAGRPAVERTTVYARR

SEQ ID NO: 10023 - protein, 286 aa, Actinoplanes utahensis
MTSAPPEGKPIGQYLTPLRDLAAYVLVGAPAVFLLATVLNLFGDGFGARAAASFGGFISLETIGMPLAAVLLALGIKPVHPRARLITLAAVIEYAVMAFFGVIFGLLFGVINIASYDAGAAFSALLARVAWLAVFGVAGYAVLQIWRGVYMVPKPQMPPGVYGQPQSYGQPYGQPAAYPASGIYGQAPSYPPGTYGQPPQPQPPHAQPVPPPAPPVVSRTQPPVASQAQPPAWNQPPVVAPPVAPPPLAEPTQVVPRGEPEPIDRTSVLPEERPGFGPADADPPRQ

SEQ ID NO: 10024 - protein, 316 aa, Actinoplanes utahensis
MRIVVLTGGIGGARFLVGVRQHARAIGAEVTAVVNVGDDVRMHGLQICPDLDSVMYTLGGAADPERGWGRVGESWVVKEELAKYGVEPSWFGLGDKDTATHLVRTTMLTAGYPLSQVTAALCERWQPGITMLPATDDRLETHVVVDVDGERKAIHFQEWWVRYRGAVPTHRFIFVGAEKARPAAGVLDAIGAADVILIAPSNPVVSIAPILAVPELREAVIGAAAPVVGVSPIIGGSPVRGMADRCLATLEVEVSAAGVGRMYGPRAEGGLLDGWLVDTSDAGVEIPGVVTRAVPLWMKDETLTAQMVADALELAR

SEQ ID NO: 10025 - protein, 184 aa, Actinoplanes utahensis
MSLYEDAVRVLTGWPATSDVAEVNRKRTLGLLADGPVAMTRAHRAGHVTASALIVDDAGRVLLCLHGRLGLWMQLGGHCEDGDATLAAAALREATEESGIDGLLLDPEPIDIDIHEVRCGATDGAPAEASIHYDVRFLLRAPAGAVERISAESSDLAWFAPDALPSPLASGVVQQIGPAQARLG

SEQ ID NO: 10026 - protein, 219 aa, Actinoplanes utahensis
MRDLRTRALCAAAAALLVLGSVTGCSGTAEPAAPTAGTTASSAGGTTGNAATAGTGRTTAAHPVTAKKPAACHDADLAITITAQPDDPGTGATLRAMVTLTNKSRHTCTLNGWPSVAPYDMAGEVIKVATVRKVAQPGPVAPFTVDPGVSAFAGLKWATCGDDENCGWGNALRASVQGPATQGQWAELEGFGDAEHNNIRIKSLQIGTLQPSHQGVVAW

SEQ ID NO: 10027 - protein, 373 aa, Actinoplanes utahensis
MSDEQSALYGVVLAGGTGTRLWPLSRAGHPKFLHPLTGTEASLLQATVDRLDTLTTPDKVFVVTGVAHAAAVSRQLTAMPDENVLVEPSPRDSCAAIALAAAVIARREPEAIMGSFASDHLIADKAEFTSVIRKAMVGARDGLLMTLGITPTRPETGYGYLQCGGELHEDGPVLQVEEFKEKPSYDVAESYVKSGNYLWNAGMFVWRVDVFLAELARQQPQLAAGVSRIAQAWGTAEQEEVLGEVWPTLPRISVDYAVMEGAATVGRVATVPGDFGWNDVGDFHTLGEVLTADPAGNVVVGHERDGERPTVLLRDTENLVVVPGSGRLVAAMGVRDLVIVDTADAVLICPRERAQEVKHLVDQLKELGQHGYI

SEQ ID NO: 10028 - protein, 397 aa, Actinoplanes utahensis
MPHRSIGTSKPPRRCLVTPGRPPRVLVDATSVPADRGGVGRYVDGLLGALGQLGPERVDLAVVAQRSDAERYRRMLPEAQVLPGPAAIAHRPARLAWEQTGLPLLAQQVGAHVLHSPFYTCPLRTGAPVTVTVHDATFFTEPEHYDNTKRTFFRSAIKTSLRRAARVIVPSKATRDELIRLLDADPTKIDVAYHGVDQAAFHMPTEEEKARVRARLGLGDAGYVAFLGAKEPRKNVPNLIRGWARAVADWPRPPALVIAGGQGHDDDIDRAVAEVPSHLRLLRPGYLRYADLPGFLGGALVACYPSFGEGFGLPILEAMACGAPVLTTPRLSLPEVGGDAVAYTTEAPERIAEDLADLMHDEQRRQALAKAGFDRAKEFTWASSAEVHVTTWNRVAN

SEQ ID NO: 10029 - protein, 245 aa, Actinoplanes utahensis
MNTTIPQAFAEAVRRDPAAPLLTWYDDATGDRAELSGATLDNWVSKTANLLVDGVGLGHGDSVALLLPPHWQTAAILLGVSAAGLAADLADLGGDPQPVEALFTTPDRVERAATWSTADRYATGLLPLAMPLREVPAGYADFVTEVRNHGDHFRGQPVAPADRAFAGPIELSHADVLAAAEDRATQLGFGAGDRVLIDVTIHPDPVDWLLAPLVAGASAVLCANLDESRLDARATAEKVSLVLAV

SEQ ID NO: 10030 - protein, 180 aa, Actinoplanes utahensis
MEDQLPGRPVELSRVTLSRIMTAVDVNLYGTVHGGVLMKFVDDVAGAAAARHSGGTAVTAAIDEIVFLEPVRVGDLVHAYAQVNWTGKSSMEVGVKVTAERWDVVGATPLPVATAYLVFVAVDVAGKPRAVPPVLSEDPDDRRRFREAEIRRDHRLARRTAIQKARLTESQDPVTPPGRD

SEQ ID NO: 10031 - protein, 414 aa, Actinoplanes utahensis
MRHLRSIVYALVLAPAAWILAGVGFTHDLTSRGRDFFTAESLSGLLLLIFAGVLYGIMILSPISPAGPTLAGAAYMGTTWWAWTAPKSYAGIWPAAVVKDGFDLSRPAYGLAALLAVPLLCTALSARRWARYEPPVLPIIGEIGRFRGSARVAGDNVAAIETTVLRTSGPAPSRHPAPPAAATQIIPPPAAVSARPAAPQTAAPQTAIPKIVPSPRTVAPQDDKTRLLGTPSATPQLPTPAGEPAVPATAGDPTTPSVGSVRAASDDATVTFAAATTAPKSNKSGITTNSAITAGAEKSDARPPVSDLSDEKTVTLTAAAKPAATPAAAAKPAAAATPAAAANPSTTPAAAMVKPLPAATPNSATTPGGTTAPSSSAAKSEPDSDDRTVLFSAKNVEDEETEVLSSTGLAPAKD

SEQ ID NO: 10032 - protein, 211 aa, Actinoplanes utahensis
MTETPLWLQGRAAVIEAADPSEFRHGTPDYHLSAVVMPGQRTTEHAPGSLEAIVETIVQVFEMEVSHKKDPKTWVSMVSEHFRTNVNGGGWASSQDIADQGSYNILIGDSVFYKPESFDGQHDVFHGAFPNGFYWEVLEVLSPPPVVTFKWRHWGSFDGEYNGHQPNGKTIEMFGMSVAKVNDDLKLLEVEHYYDPNAFLGKLTGGCPVVH

SEQ ID NO: 10033 - protein, 387 aa, Actinoplanes utahensis
MHPETRLIHLKAPVPQGSTPLAVPIYQTSSFAFDDPELIADGLHHPDRAYAYSRFANPTVRALENAITDLEGGAAAIATSSGMGAITLLLHGLLSAGDHVIVQRDVYGGTHAQLGDLAARFGIEVTRIGGHDPAELRAALTPRTRVLYLETIANPTGHVSDLPTLAPIARDAGVLTVVDNTFASPIFCRPIEHGADVVVHSVTKFLGGHSDVTGGLAVFADRALYERVWEQSVEFGATADPFAAWLTLRGLHTLGLRMDRHAANTARVATWLAAHPAVEAVRWTGDPSHPSHAVASRFVQGFTGAFCFDLDGGHDAGVRLMSRLTVIRAAASLGSTQSLILHPASTTHRQLTPDQLRESHLSPGTVRIAIGIEHPDDLVADLEQALG

SEQ ID NO: 10034 - protein, 487 aa, Actinoplanes utahensis
MSPIVPAELAARLGRWSAGRGPLYLLLAGRLRALIDDGDLPPGAALPTDRALATALSAGRTTVVAAYDLLRQEGRLVRRQGSGTWVAGAGAEPPNTTEPTVNPVFLHLLDPPDHVAQFACAGPLAAPPEVIAAYRGALEALGGPDLGYHPAGHPRLRAALAERYTARGVPTSPGRILITTGGQQGLALLARALVAPGAEVLVQAPTYPGALEIFRESAAALVPIRNTIEGYAAALARKPALAYLIPANHNPTGHTLPESNRRAIVAAALAHGVPLIVDDVTADLTFPDRRARTAPDARAAPDAAAAPDADELITVGSLSKVVWGGLRIGWVRAQPALIGRLARLKAVIDLGSGVLDQLAAVELLENLDDLAGQRIRTLAARHDHLCAELRRHLPEWQFEPARGGQTIWVRLPHGDAASYAQAALREGVAVLPGGSLDPSGASTDHLRIPFVAEPAALTAGVRAMAAAWRGFTGRAAISPPPLPAIAV

SEQ ID NO: 10035 - protein, 716 aa, Actinoplanes utahensis
MLLKMAMAVVVAATPAVPCPRPAVTGTYSVGAAHWQPAHVAQTGQSAATVVIDPSRTEQRYEGVGFSIDETAVANLWKLTPDRREQAIKLLVDPRTGAGLDRFRLTIGSPDLIEHLPFWSYDDLPAGVTEDPELKYFSVQRDLDLHIVDTIKLIQKYNPRATFFASAWSAPAWMKTNNRFLGEVALKPGSTTDYYQAGKLRDDRIDVFARYYVRYLQEYARLGIRVDAITLLNEPGMDVVYPAMDISVEQQQRLAVAIKREFRRAGLRTSLYVHDFNFWDWRDPNSTATKNYYRILNDPQAARAADAIAFHPYWGDPQVMRDAYRQTGKPVQMTETSDLSPSTVLSYFRLDASSYILWAQTTDQDGGTLHWTGERNNNVDWDEVARTSRWPDRLVKVNTITKDYSVRDELYQLGQFARYLTPAHVRVESSTTGHGISNVVYRDGRDYVAVLGNANATDTAVRVVAGDDSFVTTVPAGAYATYRWTGSRTDSRHNRAPLLPGVPPVTADQYATTRIALHATDPDHDRLHYYAVDLPAGASVDPDTGVLTLDPAVPGEQQVTVAVTDGKAYAETTVHVTVVPHGAPVGAIVEAEAYTAQHGWTEGGADFVESNGAASGGKDVGWTAPGNWLAYRFDVPAGPHRLELRVANGTGAVATGAISIRDASGAVLAGVSVPDTGGWAAYQTVDVPVSLADGDQTLTVYCESGGFNLDYLRLAV

SEQ ID NO: 10036 - protein, 615 aa, Actinoplanes utahensis
MRKTLFAAAILGGSLLYAPAAQAAGETVSVYLTTTSDSAGRTVTRGLQQQTNIAFGPAGGSAGTTINVDEGTTYQTFEGGGASITDTTAYLLRGGAVSAATRDAVMTKLFSPTGGIGLSFVRNPIGASDLSRPGNVSLDDTCCDLADFGANGYDTNVRLLTQQAKQLNPSLRVMAVPWSAPGWMKDNGRMDQMGWLKAGYYPMYAQYLVKYLQSYQAAGVPVDYLSVQNEPNCCQASNPTAMTYPGMSWNPSGLVEFTKNNVYPALHAAGLNTRVLVHDWNYGDYASFGSGILGDAGIRTDPAFGGIAWHGYSGSASTGSDVHATYPAVKQFETEHSGGTWIGDQHNEDLNNIIDYTRNWGASVVKWSLGVDQNMGPHNGGCGTCTGFITVQNGGSRAGQVDYTVEYYTMGHLTRFVKPGAVRIDSNDGSAVRNVAWRNPDGSKALIAHNGGTSSQSVRVNWGGQSFIYTLPARTTATFTWSGTAAPDPSGTITGLAGKCVDVAGAATANGTAVQLYTCNSSAAQRWTRASDGTLRALGKCLDIVGPSTADGTLAHLWDCHTGASQKWTYDGAGQHLINSYSGKCLDVKDNSSADATRLQVWTCTSGANQKWVLN

SEQ ID NO: 10037 - protein, 375 aa, Actinoplanes utahensis
MAENVNPWREVTRSTGGLPGHCPVCTAARSIYDSPMKHGDETRVTVRDLAARTGLSIATVSRVLNDRANVAPDTRDRVLRAMGTLGERAPRRRGVRARAAGVFVRCPYVLTDYFGLIVSAVAEACEPHGLHVILNAGTSAQQTRVLPTLPERRDVAGAVLILPPEPGAELVRLRDRGFPFVLVDPRISPPRDVAAVSAAHFAGARALTAHLIGLGHRRIGIIGGPRDWLASDNRFHGYLAPLADAGVLADPALTRFVAEPNTGLGYRAAVELLDLPERPTALLAFNDKMAIGALRAAAERGLKVPHDLSVAGFDDIDLGSACDPMLTTVRQPLGEMGRMAVHLLLRMLGGHRLDALHLELGTELVVRGSTGPVPA

SEQ ID NO: 10038 - protein, 339 aa, Actinoplanes utahensis
MTRWWIVAVALLLVPALGLFGPTSATAEQPDRIADWRADARHLPDPASTAPDRIAAFFAGLPAAAADDLAREYPTVVGNLDGAPPGLRYAANRTPGYAGRQILALDRRGDGRIAEVFGDLDTVDRVVILIPGVDNTLADFDTGLGGVRRRSPSWQAHQLYQRIGTGERVAVIAWLGYDPPEGIRRAALREDRAASGALALERFVGGLVARHPGQRITVVGHSYGSIVAGWAVAHLPAQVGDVVVIGSPGMGVSGRDQLGGTARIWAGSAPDDWTRKLPGIRIFGLGHGRLPIDPGFGALPLPAGNVCGHDGYFVAGSAALDAMAEISVGDIRLTPLPVA

SEQ ID NO: 10039 - protein, 274 aa, Actinoplanes utahensis
MSDNELGAFLRARRAEVTPAEVGLPPGSRRRTPGLRRAEVAMLAGVSVEYLIRLEQGRDRRPSPQVLAALAGPLRLTAAERARLYRLTKSASGFTCGAGERAPSRTVRPGLRAVLDQLEPAAAALLNQVGDVLAHTAGFARLAAPIGLLDGAEPNLTRYVFTDPRARTAYPDWAQVADERVAALKNGPPRPDFTDEMLLLAGAEFAERAERVPGVPRPHGVLRLEHPAAGPLRLAYEILELPGDEGLRLLIQLPADEATAEALRALAPLRLVAG

SEQ ID NO: 10040 - protein, 359 aa, Actinoplanes utahensis
MKPEVIVVGGGYAGIVAAAALDDVADVTLVEPTETFVHHVAALRAAVDPDWTDRIFIRYDGLLPRGRVIRSRAIRVTPETVELASGERLHADYLVLATGSSSPFPSRMDSPDTAVARERLGAVRDALSRASHVLLVGAGPIGLEFAGEIAAAWPTTRITVLDRAPDLVGGRFPDAFRAELRRQLDALGVRLLLGTALTAPPAVEPGTVRPFTVTTAAGEIIAADLWFPCHGTGVRSEYADGSLAGARRADGRLAVTEHLRVAGHDRVFAVGDLAGTDELKMARAAARHGEVVAANIRALIGGGPLTAYEPAPDGIVLPLGPHGGVTYDADAGLLGPETTARIKATFHIERFLDVLGAQV

SEQ ID NO: 10041 - protein, 690 aa, Actinoplanes utahensis
MPTTASSSGDSSSLPPSSCISSPETANRAASVRSRTSRLHRDRRRASSSRTACTGQPWSTASVIGRTPCTTNSPARCRLVRLVSSACHCWKVAFRVETRIVLDIPTIQAVRSWPLRVGYGPDRDAFRGAASQPPRRGLIRRPAPRRGGCSCFAGRCPFPGKPVLEPRHDHLESAAAQPDAVPPLPPRPRAGRRADHRPHLAHPAADRRPLWVPVDLRDGNQALAEPMDADRKLRAFTMMVAMGFKEIEVGYPSASGLDFDFVRLLAERDDLVPDDVTVVVFTAARDDLIRRTVASIDGLARAVVHMYTATAPTWRDVVLRASRAGLRTRILHAAGVVLSETDRLAHTYTRFEFSPEVFNLTEPEFVLDVCNAVTGRWDAAPDRPVIHNLPATVECATPNVYADQIEWMSRHLDRRNDVILSVHPHNDRGTGVACAELAVLAGAQRVEGCLFGNGERTGNVDLVTLAMNLYTQGIDPKLDFSDIDAVRRTVEHYNRMPVPDRHPYAGDLVYTAFSGTHQDAIDKGMIFHAKRAAALGVPESEAPWEVPYLPVDPADVGRSYEAVIRVNSQSGKGGVAYLLRTGHGLDLPPGLRVEVGALAQAASEGRAGGGELTPAELWSLFRDEYLVHPGFPVDLDGVEVIEEVTGNFREAIISYVRCRIAEVERWGAGVGSTPEAARHAAMSSAARRAV

SEQ ID NO: 10042 - protein, 399 aa, Actinoplanes utahensis
MQRAGDEGVGMSAEQARWPELSLDVAALRRAGHRAVPFRDVVLKVHQRCNLACDYCYVYTMADQSWQDRPRVMDRATWRLAARRMAEHADTHDLPEMRLVLHGGEPMLAGTALLDELIGDFRAVFPAGRRLEVLIQTNGTLLDEAAVAMFRRHRVRVGVSLDGAAESNDLRRRRPDGLGSSAAVDRGLRLLTGDVFGGLLCTIDPATDPVAGYEALLRYRPPAIDLLLPHANWETPPPASCAGWLIAVFDRWYDAPRQETSIRLFEDVMALLLGGSGRSEQIGLSPVAVVVIESDGAIELTDSLKSAYPGACATGRTIAADPLDAVLDHPGVVARQIGADALSDACRACDLHRVCGAGHYAHRYRAPGGFRNPSVYCADLAALIRHVRRRLTADLAQRV

SEQ ID NO: 10043 - protein, 356 aa, Actinoplanes utahensis
MNEDLRQSLSGIADDVHFVDLHARALGRSRQIRRNRITAVTASALAVLGLAGFGVANLDAFRTRPGPPAVVAASVSPSPGATVRKPAPSGPATVTMAVPASKSLTALTGELFYRSKSGTVVRFTGDGTRTTVLDRANQAVAISPDGRQVAYVSAGKLRLAGAAQPLLSGTVDIAKQLPSWSPDGTRLLVAAPSPAVLTVATGKLGPIPGGLKGQNFHWSGDGSKLFYTAGQRIRVGAATVPVFGDPDVGRNPEQLSGDLVLSVDRTGARFALRLSNSFDVDQRPDTVADASTGALDPIPVPGTVESALFDTDGNLMVRATDGDRRVLSLFSATGTLLVQATEPASLRDLDLIAYTR

SEQ ID NO: 10044 - protein, 171 aa, Actinoplanes utahensis
MDQADADFAEFVRSRTHSLLRAAFLLTGDQHLAEDLVQEALARTHRSWNRLDRAGNAEAYARKIMYHTQVSFWRRGRVAEVMPGELPDRAGGDGSDESDATTRRLVLRNALLQLSAKQRAVIVLRFFEDHSESEAAELLGVSVNTVKTQCARGLAKLRTLLPDMRALEAQA

SEQ ID NO: 10045 - protein, 342 aa, Actinoplanes utahensis
MRAIKTGLVATATVAALLISGCTGGGKEGTAGTVAPPVVAPSSTPAAVPSSPPAESTRAATIDGTLLYANLDKVYGVRDGKPSVLHRSPGRMLTLPSVSPDGRHLAYVEDELTVSGVDGKNRRTYKFDIDISDGSTNLGPAWTADSAGLLVRRIDAQTKNRITKVTEGIFRIADGSFQALPKSLQGFENYLMSGDGKRIFFIDKGVICSTAVDGSDLRKVPVIGAESSAQNPSRLQANVLGTVNADGSRITAILFRMTDGNDEAGGTPDRLIDTATGKVVPTVVKDGPGSLLILRDGSVLAGTGDVAGTQTLTLFSAAGRVLTSRSFSMKLDFDARLSGYAE

SEQ ID NO: 10046 - protein, 1058 aa, Actinoplanes utahensis
MRLPLSAGQMGIWLGHELDPTGHAYNIAEYTEVDGDLDQDAFEQAWARVLEEAPTFKATAIRRDDSGELYQIIDEAPARITRVDLRTEPDPDAAAQRWIRADLDRRIDLEVGGLFTFALLRVGDARFVYYGRGHHIACDGYAAALLFRKIGAYYTEIVTGAPLADAPPPAESLAATLTADAEYRAGEEFQADLRFWREHASSASPVKLSDHWATRGPDTPDPGAVHIRRSTSVPAGRTAAIAEVARELRTRWPVLLMAATAAFLHRCTGRTDVVLGVPVTGRTTRQLRATPNHSSNVVPLRIEVRPGDTLRDLVPRVSGALRLALRHQRCRFEDWQPAHAGAAGTGWGTVVNVMAFDYQVTLAGLPTVTRNLTLGPVDDLSLGFYDRGDGSGWRLDVDGNPDRWARADLAVIENLYLRFLEEVSTLPDTPLGEFELTSATERELLLHDWNGTPAPAPRGDLADAFAARAARTPGAVAVTEGAREITYAELDAAADALAAELLDQGLRAEEPVAILAERSALVVLATLAIIKAGGAYLPLRPTDPAARQRAMLADAGVRLLLTDVPADHPVEALLLSAADLSAAAPATAPHRGGDPDRLAYVMYTSGSTGRPKGVAVTHGNVLAFAAHHRWSDGDHERVLMHSSHAFDASTYEIWAPLLTGGRIVVAPPGQVTADELAAVIAAHGVTAAFLTTSLFNLIAGTRPAAFAGLRTVSCGGEAASGEAIRLVRAACPGIRVMNGYGPTETTTFATTMEVEESGGTPPIGVPLDATRVYVLGPDLRPVPIGVSGELYVAGWQNARGYLNRPALTAERFVAAPFGPPGSRMYRTGDVVRWREDGVLEYVGRGDQQVKIRGFRIELGEVEAALLRLPEIAQAYATAQETAPGARRLVAYVVGAAGETPEPTRIRESLRESMPDFMVPAVVTVLPALPLNANGKVDRAALPDPEVTVTAGREASGAVESALAVAFAEALSVSRVGASDSFFDLGGDSIRAIQVVTRVRNAGWLIGVGDVLTLHTVEKIAERAVPATPAPAEPAPDDLLSLDDDDLAALVSALAEDAG

SEQ ID NO: 10047 - protein, 91 aa, Actinoplanes utahensis
MVSALGSNGDDVVSLLAAAGIFVVLIVIVWQLAATWRARLATAREAQYRELAERCAQLLAENAELQKRTVAELTHVREATAAMEKMMREVG

SEQ ID NO: 10048 - protein, 105 aa, Actinoplanes utahensis
MDVTGDDLLKMLTALSNPHRLRIVGVLSAERDYVSRLAVRLGMSRPLLHMHLARLEAAGLIEGSLELSADGKAMKFFEVTPFALQLTPQTVAEAVKTLTDAATEK

SEQ ID NO: 10049 - protein, 812 aa, Actinoplanes utahensis
MVVETPAGLDDATLAAALRDVVGHHPVLAARLTADGDLEIPAAAAVELLTFEGAAFEAAEFAARRLDPTAGINVLAVRVDHRRLVLVAHHLVVDAVSWQVLLPDLATAAEARGRGVAPVLEPVPVSYRTWARGLPEVARQPRRTYGFARDARHTEVTVPAEVVTRLGTVAEKFHGRLDDLLITAYSRALTQEAVIDIEGHGRDSDADLSRTVGWLTAVRPVRVTGIGADPRAAVLRVKEQLRAPAADDLDPAPFLFNYLGGTAGAVAGAWPLLAGEPLPSGVDPGMPLGYHLEVHVAGRPDGTLRALWITADGFEAPAERWRDALVALAELADPAVPGGRTPADLPLAALGQAEVTALESLVPDLSDVLPASPLQEGFLFHAAEARDGGTDVYTTQVRLDLSGRVDPTRIRAAGQRLIDRHSALRTGFHQLESGAAVQVVRSGGVALWRDVDFTVLPASEREAAAERLTEAERDDFDLDRPPLLRLALMRLADREWRLAVTAHHIAVDGWSLPILVQELRAMWSDRAALTDDTAPSHRDHVAWLVGRDPAAAVRAWAENLRDLDGPLLVAPETPGAAVTAQRQISRELPGATVRRLLDAARPLGVTLNTAVEFAWALVLARITGRDDVVFGTTVSGRPADLPGADRMVGLFVNTVPVRVRLHAGTTLGEALTVLQGEQTDLLDHQHLGLGRIHRLTGCTQLFDTTTMLVNYPFDVEVLAEPDGAGYRVTGLGLDDATHYPLRLVAVPGPDDRLTVRLGFRPDLVAPADAEAHLDRMMLALESLAGDLDVGVREIDLITAAERETIVAQWGGY

SEQ ID NO: 10050 - protein, 1040 aa, Actinoplanes utahensis
MSGARLPEGIEAAWPLTPLQEGFLLHALQEQVDVYATQLRLDLDGEIDAARLRTAADALLARHGSLRAAFHHAGLKRPVQLIHRDVPAAWSEHDLTGLAGPESEAEAARIAGVERAAGFVPHRPPLLRFALLRLRPGRQRLVLTVHHLLWDGWSVPVALGELFALYAAGPADVLPPAPQFRDFLAWLRRHPTAPSEQAWAAALSGLDSPTLYAPQAADLPATLQHEVRAVLPAEVTDRLADLGRRHGVTLGTVVQFGWGVLLSRLLDSADVVFGTTVSGRPPLLPGADRIVGLLLNTVPVRLRLRAGESAAACLVRLQAEQAAMIEHHHAPLAAVQRATGHPALFDTTTVFQNFPLDHEAVTAPLTAAGVRVAGVHIEDSTHYPLRLAVTAGDGLEMRLGHRPDVVDADQAGILLDRLVRVLTAVAADPGIAVDDLDPLSPAERADVLHRWNDTAAGVPGGTLVSAFEEQAGRTPEAVALRHDGAALTYRELDERANRLARRLLAEGAGPGRLVGVALPRSFDLVVALYAVLKTGAAYLPIDPEYPAARIAAMIEDGRPACVLTDGPGVPGPALRLDTLDLDAVPAHPLSAAERRPVTADDTAYVIFTSGSTGRPKGVAVPHRGIVNRLRWMQDRYGLRPGERVLQKTPAGFDVSVWEFFWPLQVGATLVVARPEGHRDPAYLAELIRQERITTLHFVPSMLGEFLREPAAAGCTGLHRVICSGEALPVDLEHRFLGLLPGVELHNLYGPTEASVDVTAWQCRAEPGAVTVPIGAPITNIQVYVLDRLLRPVAPGATGELYLAGVGLALGYVGRAGLTAERFVACPYGAPGERMYRTGDLVRWRADGVLEYLGRSDHQVKLHGQRIEPGEIEAAFAACPGVSQSLVLVREDRPGVQRLVAYVIADPGRTLVADDLLTAVSGTLPAHMVPSAVLLLDAFPVTPNGKVDRAALPAPEVPVTAGAAGGEPRTAAETAFADAFAVVLGHDRVGVTDSFFDLGGDSILAMRVVSLARQAGWVATAKDVFRLRTAAALAAVARLAS

SEQ ID NO: 10051 - protein, 63 aa, Actinoplanes utahensis
MSNPFDDEEARFLVLVNDRGQHSLWPAAVTTPAGWSVALAPSDRADCVRYVEQHWTDLRVGSK

SEQ ID NO: 10052 - protein, 258 aa, Actinoplanes utahensis
MTVAKHIAARDCFRVIAPRPAARLTLFCFPHAGGAASSFHQLAALLPDDLELVAVQYPGRQDRYGEPLPRTMAELVDEITGAMLDRLDRPAAFLGHSMGATVAYEVARRLRARRPNALRRFFASARRAPHRTNQSLRFPDDASVLRYVDSLGGTGAGMLADPDLRELAMPVLRGDFRLIADYQYATGAPLTCPITVIAGDSDASFTTDHAGEWARHTVAGCSTRTIPGGHFYTETAPAQLARLIVAELSAELTAGGTR

SEQ ID NO: 10053 - protein, 210 aa, Actinoplanes utahensis
MRNIKVAAGLLAIATGALFAAGCDPKASGSDQSADNTYDISDKVSTLSLSGRGGNVTLTASDGASVKVSEELKYDDAKPKTSHSVDGGTLNLVDSGCGKDNCHVDYRIELPAGTVVKIKTDGGDITGSGLGADATVNTNGGNIDLSYATPAPLVDVTSSGGDVKVKVPAGPYEVDASTDGGNKTVSVQAVAGSAHKIKAKSGGGDVSVVS

SEQ ID NO: 10054 - protein, 746 aa, Actinoplanes utahensis
MLLLERMVGWSARHPKKVIVGWILLVAVAVLVGGSAGSGAKTTDAGEAGQAQSMIRAQKVTSSYTENVLIEAQGRDKSFLGTPDLESAATDLSARIKALPGATSSVVTPLDNEQTRAALVSKDGKSGLVSFTIPGPGKDADKHFADIKKEITAVQGAHPGVRLAMAGDISLTSAVNKAADEDLSRAEQLSLPVTLIILIVVFGALVAATVPVFLAATAVLAGLGVLDLVGTIIPANSTVSSVVLLIGMAVGTDYSLFYLRREREERAAGKSATEALKISARTSGHAVVVSGLTVILSLAGLFLAQVDTFNGMAIGTIIVVGLAVLGSVTVLPALLSVLGRRVDSLRVPFLGRSRTTATNSRGWSAIAGGVSRHPLIYGGLALIALVALALPAFGMKLSEPGQLDSLPRSIPAVDAGVRLQQAFPGGADPAQVVVWGTGATSGAADQAVAELRREAAASDLLGDQISATPVGSVLSIKVPLAGSGTDDTSVKALETLRTDVLPKAFANTPGLKYAVGGRTAGLHDFADVLQQRTAWVVAFVLVLAFIVLVVAFRAPLVAAVSMVLNLLAIGAAMGIVVLGFQKGGFAGLLGFSSFGGVVNWLPLFMFVILFGLSMDYHVFILSRVRERWARGESAKDSVVHGVGSSAGVVTSAAVVMIAVFAMFATLSGIEYKMLGVGMAVAILIDATIVRGVLLPATLSLLGDRAWSLRGRPAVVTGSDPVAESAHAEPTEEAVLVSHAAATARGE

SEQ ID NO: 10055 - protein, 87 aa, Actinoplanes utahensis
MTYGNDLTSLLAVAGIILVLVLIVTQAAATWRARIVAQRGDEHYRELNHKYAELLLEHEDMRERVASELTGVRQSVTSMERMMRELS

SEQ ID NO: 10056 - protein, 409 aa, Actinoplanes utahensis
MTALSEKPTTPLRRNRDFRMLWTGAGASLLGTRVATAAFPLLIIWGGGSPADASLVAFATLLPQLLFVLPAGALVDRWDRRRTMLTCDVIGLAAMGSLVAAMLLGRVWLPHVMAAAFLDGSAVIVYRLAERASVRHVVEPEHLGAALSQNEARGQSTGLVGQPLGTALYSALRWLPFAFATLTHAVAFVTLLAVRRNLQDDRPQARRMLTTEIAEGFAWVWRHRFMRSAILLVGGSNLAFQVINLTLVLIVKHGGSPPYMVGLIGLLGGAGGLIGALGAARVMRRLPIPAILIGVLALWAVLIALVAVITLPAGLGALMGGMAALGALLNVAAATYQVRVTPDHMQGRVTSVFALIGSGLNSVGALLGGVLLSAVSTSDAALVTAAGMGLLALLAVCLPAIRQAPVSSL

SEQ ID NO: 10057 - protein, 377 aa, Actinoplanes utahensis
MIKAVAAAQRRGLPLTLFAMYQHRTLAAVAEEVDAQLAATAATKAAPPVTAPGLVSRQDWQDAMERHHVPGLSVAVLAGGELVEVETFGQAAAGVPVTGRTPFQAGSLSKHLTALAVLRLVDEGLLDLDRDVNRYLAGWRVPAGDRPVTLRHLLAHRSGLSSTPGGGFVPGEPAPSLTGLLDGAAGAVSRIAEAGASFRKANVHYVVIEQVLRDVTGEPFDALMGRLVLEPLNMADSSFDQDYPARAASPVAHGHDTAGEPIAGGWRIRPDAAAAGLWSTPADLARVAIELRRSALGRPLALLRRQTAELMLTPYPDSLYGLGTVVDSTEFGHAGTPVGYHSLSVISLNSGDGLCVMTNGEAGEQVVKAVVARLRRH

SEQ ID NO: 10058 - protein, 1885 aa, Actinoplanes utahensis
MTAVETAVAEAWERALNTAPIRRDDRFFERGGDSIRAVAVVGALRGRGYDLTVRDVFAQRTVADLAAVLETRGITAEAPAPGVAPFALISAADRALLPAGTADAYPLGEVQLGMVAEHYASGDKRVYHNVAARRIRDDRPFDEAAFRRAVEVITARHENVRTSVHLTGYSTPLQIVHAAATVPVRVVDARGVARAEGERLLTAEVEAERADVLDFRAAPLMRLAALVESDTSWWLLITYSHVITDGWSSATFEMELANAYREIRDSGAPAGYEPPAVRYADVIAGELASLRDPADAAFWRRVVDRHARFDLPVGWAGTAGADAEPYSVGVPIDDLATDLRARAAEAGVPFKTLLLAAHLEVLSRITDAPAFHTGVVFHGRPEAVGADRVLGMHLNSLPFPHRAGAGTWRELLTAVFEQETEVWAHRQYPLSRIQRDAATGGRLIDVLFNYIDFHQVDGEVVDQGVAVNQRANDFGLSVHAHGDRRLGIATDSGLLAPRYAEQLAAMYRSVLTAIAAGLDEETTVPVAAEEPDQGTLAHELFEARVAAQPDTVAVVAGDIELSYDEVNTRANRLAWRLRDAGAGPEDLIGVHLERDVDLVPTLLGVLKSGAGYLPLDPANPRERLGYVLADAGARIVVTSAELAPGLAEVYQGRVILVDEAGEGRTDNPPRVSTPDNVIYTIYTSGSTGRPKGVVLTHRNVTRLLDTAQEHYAFDDADVWSMAHSYAFDVSVFEMWGALAFGGRLVVVPRDVSRSPEDFLNLLVDQQVTVLSQTPTAFRSVITAAAAKDRRIKLLSLRAVVFAGERLEVAELKPWVEQVGLGRVALVNMYGITETTVHTTYHRLTKRDLAAGAGNPIGRPLSDLVIHLLDEDGRPVPAGVTGEIHVAGPGVARGYLGRAALTAQRFVPDPLGAPGSRMYRSGDLAQQRPDGTYDFVGRADDQVKIRGFRIELGEISAAAAACDGVREAVTVVATDGRLVGYLVPDGEAAPDVRVVRETLARTLPEYMVPAAFVAIAAIPLTTNGKLDKRALPEPAAEQWRGAAEYVAPRSPLEASVSQMWQAVLGIDRAGVTDGFFDIGGDSIRAVVLVGTLRDHGFAVEVKDLMRYPVLGDLCALLSRRAGGPTPPPPVRPFALLGEADRALLPAGLDDAYPLLMAQTGMQVEMLVGGEHPPYHVVTSVRIRDDRPFDAERFRAAAARLAQRHDVLRSSVSLDRYSVPMQLVHTEVPVHVPVEDLTALTEAQAAAAIERFVTEAGRLPLDPDGPPLLKLAVHHCADGWQLTAINSHVVLDGWSRRTLFVELFELYHGRDDWAPPSVRFADTVAAELAALASPQEQEFWRSQVADCPRFALPANWGAPAEEPGGTIVLDIPFADLTDGLRAVAARAGAPMKSTLLAAHLTVLGGLTPERSFLSGLTHHVRPESADADRVHGMFLNVLPLRHDRGARTWRELVAATFAREREVWAHRHFPMPQIERSYGEGGRMIEAYFSFHDFTGMGSSLDGGVAVGDSLGHSSNEFGLSISTGPGLLHLRCNLGLVSREHASRLASMYRAVLEAMAADAEGDATGVFLPVGEAEVVAGWERPAEEAVTARPVPVLLAEQARRTPGALAVRGEGFELSFRELVGRAGAVAVALRAQGVGRGDRVGVRVERGPWLHAALLGVWFTGAAYIPIDPGFPDSRVESMLAGAKALLTDESVASLEEASFTPAEIDPDELAYVIFTSGSTGKPKGVAVTHRGLANHVGWAVRDLAVAGSLVGGGRGGAVFSSVAFDLVVPNVWAPLLAGQPVEMLPPDLDLSELGGRLHSAGPFAFLKLTPGHLEVLSQQLTPEQVSDLAGVMVVAGEALPGSLAGRYSPAGRLVNEYGPTEASVGTCVHRVPAEPGTGLAS

SEQ ID NO: 10059 - protein, 3936 aa, Actinoplanes utahensis
MSEQSTLSTSELRAELLRKRLAGQSGGVRRDGIPRADRSATLPLSHGQQQMWFLSRLDPNSTEYLVPLMMRLLGPLDVDVLRQAWQHVCARHEVLRTRIELRGVEPVQVIDDPRPVGLPEIDLRDVPDGLRDDEAMALIRRDLQAPFDLAAEWPVRGALLRLGEDHHVLAVVFHHVACDAWSTRMFGAELSAAYNGLLRGDGLFLPDVPVQYADYAQWQSGQIAGDRGERDLAYWRSRLSGLEPITLPTDRPRPPVRTHDGADVVFDVPAALGDRVRERAREFDTTPFTVLLSAYQVMLAKFSGSDDVAVGTVVSGRAHADLQRVFGYCINTLVMRAECDGESSFADLLRRGRATVLDAFDHHAVPFARLVDELQPDRDQSRTPIFQTAFTLHEYRLDVLQFAGLTAEPFGAEDGIAKYDLTLQMQERPDGTIHGRLQYATALFDPATAARLATAFQRVLSAAVTDPSVPVAHIEVMSPAERATVVVPPVASPEVDVLAHELFETFAERTPDAVAVVAGDSRLSYAEVNARANRLAWLLRDAGVGAEDLVGVHLERGADLVPVLLGVLKSGAGYLPLDPANPMERLGYVVNDAGAHIVVTSAELAPGLAEVFHGRLIILDELAEDGRVDNPPVVATPANLIYTIYTSGSTGRPKGCMLTHANVVRLMRVCESELDITADDVWSMVHSYAFDFSVFELWGALMFGGTVVLVEKEVARSPEDLLRLLVDEQVTVLSQTPTAFRGLTQAPRPADLALRSVVFGGEKLEVGEITSWAGQVALVNMYGITETTVHVTVHELTAADLATPAISPAGVALPDLAVYLLDRSGQPVPAGVPGEIHVAGPGVARGYLGRAALTAQRFVPDPFGAPGTRMYRSGDLARWNSQGRLEFLGRADDQVKIRGFRIELGEISAALSACAGVHDAVAVLRAERIVGYLVTEDAVDRAAIRAELGRTLPDYMIPAALVEIDAIPLTANGKLDKRALPAPDGAQLRSAGEYVAPRTATEQDVAGVWKAVLGVDTVGVTDSFFELGGDSMRAVALVGALREAGYQVSVRDVFEHRTVARLIEFAGEAGADAVDRPVRPFELIDEADRALLPEGVVDAYPLGQNQLGMVIEMLADDGQNNYHNVSAYWIHDERPFSPEAFTEAGRIVVARHEALRTSIELTAYSRPMQLVHAHAEMTTDVWATTGTTAEQVREEVAAFGARERTHPFDLSVPGLMRFHAHPTDLGGWWISLVECHPILEGWSYHSLLMEFVTTYLTLSAGEVPETPEAPRVRFADAIAGELAALESAGDREYWRGVVRAHAPLTLPVSWGDPEAVAGSPYKTGFSWRDLESGLRALAAATDTSLKAIMLATHLKVMSQLTEEESFHSGLVCDVRPEVTGADRVYGMFLNTLPFPHTRGARTWGDLVRGVFAAEVDLWGHRRFPLPAVLREWPGSGRLMDVYFNYQDFRQVDTEVVDAASGMDDSPTEFPLTVASRGGYVILTANRRHLTPAAADNLAAMYRAVLQSMAAEGERGDALKAYLSPTERAAVTAPPAPRDSADLLAHELFEARVAANPGAIAVVAGDVELSYAAVNARANRLAWRLRDAGVGPEDLVGIHLERGPDLLPTILGVLKSGAGYLPLDPANPLERLGYVLADAGARLVVTSEALASGLADVYPGDVILAGEIDGTRVDNPPRASTPDNVIYTIYTSGSTGRPKGVVLTHRNVTRLLDTAQDHYRFTDADVWSMAHSYAFDVSVFEMWGALAFGGRLVVVPRSVARSPEDFLQLLLDQRVTVLSQTPTAFRSVVTAAAEGDPRIDRLALRAVVFAGEKLEVAELKPWVDRVGLQRVALVNMYGITETTVHTTYHRLDAQDIADPGMNRVGDPLADLAVYLLDAAGHPAPSGVTGEIHVAGPGVARGYLGRPALTAQRFVPDPFGPAGSRMYRSGDLARRRPDGTLEFLGRADDQVKIRGFRIELGEISAVLAGCDGVREAVTVVAADGRLAGYLVPAEGATLDTRAIREAISRTLPEYMVPSAFVEIDAIPLTTNGKLDRRALPAPGEQTYDQDRYVAPRTPDEERMAAVWAHALKLERVGVEDDFFELGGDSIRAVSLVGALRSAGFAVGVLDVFEHTTVAALCASATGAPVPVTPVRSVAPFALIDAVDRARLPEGLDDAYPLLQSQTGMLVETLASGAQANYHDFTSFLVRDDAPFDAGLFRQAVELVGRRHDILRTSVDLTGYRVPMQLVHHEVTIPVAVHDLRDVAPADLHERLVAFAASERANPFDLASPLPLLRITVHLQTDRAWRLSFTKSHALLEGWSYHQLLKELVEVVRALRDGAEIRYDAPPVRFADTVAAEVASLASDADRDFWHGLVGEYEPLALPEDWHGDLGAPAERIDAGFSFADLEPGLRDLAAATGVPFKAVLLGAHLKVLSQLTGAERFFTGLVGHVRPEVTGAERLIGMYITTLPHPFARDAATWGDLVRRVFADETAAWPHRAYPMPAIASAGSRLIDTFFSYLDFHLLDDGDVVDEGNGINRTAMEFGLAVTAIGGVLGLRSNTHLLSRENIDRIAAMYRAVLESMAADGDRGDARATYLSAAERATVVIPPVPGPGAEALAHELFEARVAETPDAIAVVAGASRLSYAEVNARANRLAWLLRDAGTGPEDLVGVHLERGADLVPALLGVLKSGAGYLPLDPANPMERLGYVVNDAGADIVVTTAELAPALAEVFDGRLIILDEIAGDDRVDNPPTVATPDNVIYTIYTSGSTGRPKGCVLTHANVVRLMRVCESELDITADDVWSMMHSYAFDFSVFELWGALMFGGTVVVVPRGVARSPEDFLRLLADERVTVLSQTPTAFRALTQAPRPADLALRSVVFGGEKLEVGEVASWAGQVALVNMYGITETTVHVTVHEVDSGDLANPSVSPAGVALADLAVYLLDPAGQPVPVGVPGEIHVAGPGVARGYLGRAALTAQRFVPDPFGAPGTRMYRSGDLARWTSEGRLEFVGRADDQVKIRGFRIELGEISAALSACDGVAQAVTVLREDTPGDKRLVGYLVPAAGQRTDPRAIRAELARTLPDYMVPAALVEIDAIPLTTNGKLDKRVLPAPDSTSAAIATVAPRTPLEQQLGLIWGQVLGLDQVGVEDSFFDLGGDSIRAVSLVGAVRAAGHDVSVTDVFERRTVAGLAELIGSRTAPARPHRAVEPFALIGAADRALVPAGVSDAYPMLQAQAGMLFELEAGEVAHYHSTGGYKVIDDAPFDPEALQAAVRVVCGRHEALRTSFDLSTFSIPLQLVHERAEPPVGVVDLRGLDAEALDAALREHVAGEQARPIDPAAVPQLRLGALVADDGWWLALSRSHMITEGWSQHEMLMELVECYRAVRDGRAPARPESVEVRFADTVAAELAALESPADRAFWQGVVDDRAPFRLPATWGDADGPDEAYQLTVPAMDLEVPLRALATQARASVKSVLFAAHLKVLSQLTNEPAFHAGLVCDTRLEVLGADRVHGMFLNTLPVPYDRSAATWSGLVRAVFDAEVALWPHRRFPMAGVSRLAGGSGRLVDVIFNYQDFHNLDAEKIDLSAGFGSGSNEFGLTVTTSNGGLTLKTRTSLLSRANAERLGAMYRAVLEAMAADPAGDATGVFLPAGDDERITAWEPATDGTVTDVPVPVLLAEQAARTPHAPAVRGDGFELTFAELVGRAGAVAAALRADGVGRGDRVGVRVERGPWLHAALLGVWFTGAAYIPIDPGFPDSRVESMLAGARALLTDESVAALGEAAVTPAEIDPDELAYVIFTSGSTGKPKGVAVSHRGLANHVGWAVRDLASAGDGGGAVFSSVAFDLVVPNVWAPLLAGQPILLLPPDLDLSELGARLQAAGPFSFLKLTPGHLEVLSHQLSPEQVRDLTGRMVVAGEALPGALAGRYSGSGRLINEYGPTEASVGTCIYPVPADPGTGLAS

SEQ ID NO: 10060 - protein, 1651 aa, Actinoplanes utahensis
MHQNSPTSTQATTALTPELIGSQAVLTPDAVAVVDGVRRLTYRELDTRSAQFAHHLRERGAGPGTHVGVLLGRGLDLIAGLLGIWRAGAAYLPLDPTHPQGRLTGILTASGCGLVLCDPADAVRVTTAGAEPVHLSAAAGHPATAPAVDRGADDIAYVEHTSGSTGVPKGVVVTHGGLANLLGWATGDVGIGAGDRVLQRTSLVYDAHAFEIFAPLTRGGTLVLAPAGDTAPATLLRVIAEHAVTVLQVVPSILHTLVEEDGWAGCGTLRTVVSGGEQLHAEPVERLRRLVPGVVVWNVYGPTETTINSIATRVDPAQTTGPVPIGRPLPRTRVQVVDEHGRVVGVGVPGELLIGGAGLARGYLGRPGLTAERFLPDPLAKDGGRVYRTGDGVRWRADGQLEYLGRLDDQVKVNGVRLEPAEIEAALATHPEVVAAAVTTYRLADGAARLVAYVVPRGAAGRELDAALRTHLLDLLPPSHVPGRFVHLAALPQVASGKVDRRALPHPDAAGADDRRTGAVPATPSELLVKNAWQHLLGSTVEGRELTLEDDFFRLGGTSLQLTKLLSDLRGQTGADLSLRSLLYAPTLLAQARLLDDARVGAALPRVPRGGGVPLSSGQQRLWFMDRLNPASPEWMAGLLFRLPAGADRTLAEQALNVLVARHESLRTRYAEVAGEPRQFIRPEVLIEVAEQQVSPAGLADALADLLGRGIALGGDEPLLRAVVLDVADGRRLLAVAMHHITTDGWSAAVLEREFAQVIGALVAGRSPALPALPVQYADFAAWQRDRLTDEVVEAELSYWSTVLDGLQPLTLATDRPRPRVRDGRGSIVPITVAPALVRSLDALAAEAGTTRFTTILALYATVLARFSGQWDIPIGTVVAGRGRAELDGVVGFFLNNLVLRCRLDPAAGVAESVARLGTVTRDAFAHQELPFDVLVDRLVPEPDLSRTPLYQAAFDLHGADFNETVDDDLGAIREMWRVTHTDLTLLLRPTADGGLVGGLEYATSLFDEETADRIAATLEHALTEAAAAPGTPLGLLDTLTDQDAYDLRLWSRGEPAIDGGLVPAGVVEQAGRTPDAVAVRGDGFALTFAELLDRAGAVAGSLRSAGVGRGDLVGVLVERGPWLHAALLGVWLAGAAYVPVDPDFPVTRAQSMLAGAAALVTDASRAGVFDGPVTVLEELVPAAVAPAAIDPDELAYVIYTSGSTGRPKGVAVTHRGLANHVNWAVRDLARAGDGGGAVFSSVAFDLVVPNVWAPLLAGRPVHLLPQDLDLAELGSRLTAAGPFSFLKLTPGHLEVLSHQLSPGEVRDLAGRIVVAGEALQGTLAARYSPSGRLINEYGPTEASVGTCIHPVPADPGTGVVPIGSPLPGMVMRVLDDRLLQVPVGGLGELCVGGTGVARGYVDRPALTAARFVPDPYGPAGSRLYRSGDVVRWRGDGAVEFLGRFDDQVKIRGYRVEIGEIEAVLREHAGVADARILVDDQGGVKRLVACWVPVGPEPVGDDELREHCAGLLPDFMLPAAFLSIAAIPLNANGKVDRAALPDPAPRPESRDAEPLSPVAEFVQQLWRERCGIVAGPRENFFHAGGNSIIAIRLIAAIQDEFGVTLPVRAVFEGPTVVEMAQLIENLIRDEIEQMSDSEVVADLTLSEEPQA

SEQ ID NO: 10061 - protein, 68 aa, Actinoplanes utahensis
MSEQNTHLVVLNDEEQYSIWWADRDLPAGWTAEGFAGSQEQCLEHIDAVWTDMRPASLRRRMAEASAA

SEQ ID NO: 10062 - protein, 313 aa, Actinoplanes utahensis
MAGHSWKPLDITAEDIGTAATPEALAGHLDSLGTALDDLLVQEKALVFRGFGVTPAELDGVFDRLLPRRLAYVNGNSPRTKVGSNLYTSTEYPAEFTISMHNEMSYATSWPSRLAFYCQIAAATGGATPLVDAQLWLESLDPGVREAFAGGVRYTQNLHGGRGLGKSWQQTFETEDRAAVDEYLTAAGAEWTWRNDGSLHVEQPRPATTRHPVTGAEVWFNQSDQWHPAALGDETAKALAQILPPEELPQYVTFADGSTIPDEYVIQVRDRGLENAVDVDWRVGDVMVFDNLLVAHGRRSFTGQRRVLVAMTD

SEQ ID NO: 10063 - protein, 594 aa, Actinoplanes utahensis
MNDLEFRVLGPVEVWRRDRRVMLPGSKITTVLAALLLARGKVVPHAELSALLWGWDPPATVDAQIYTYVSRLRKRLDFAVRIVREHAGYTLDIGDSFVDLFAFEELAARGAERLAQGHRAAAADDLRGALALWRGPALANVTEPLGERHLPWLDEAYALACERRAEAELELGGSLELVPELTELVARYPLREQFRAQLVLALHRAGRRSEALVAYDRARRTLADQLGVGPGEALTLAYQEVLISDTAEPEPAPVRAAEPVLVTLPPDEQYFVGRADELAGLERLLTADRPAANGPRQVLLTGAVGTGKTALAVRAAHRCAGAFGGRIAYASLTDQNGAPLPAAAVLKRLLYGLGEPVEPGCGADELGLLFRAATARRPVLVILDDVPAGADLAALTPNHPAATLLLISRATLTVAGRRDTVLLEPMRPAEGIVLLAAVAGEERILADLDAARAVVGFCDALPAALRICGARLAARPLWSVRRLAHRLTDPARRLDELALGDESLRGRLLSAFRSLPDAARRGLPMLRDVGPDAFTVTSLHLPGGISEAEKEQVVDMLVQARLVEEVVADDLGGSQFRMPGLMRLLTLDVTRAAS

SEQ ID NO: 10064 - protein, 230 aa, Actinoplanes utahensis
MRTRAPRLRLLLRHLRPHRRGLLTGAGLMFLGGLAGLAAPLAVKRLLDSLAGGAPAGGAVALLAALLAAGALLGAVGMYLLEATAEGVVLGARRGLIDRLLRLRAGVLDRAAPGDLLARVTGDTTQLRAAATTNLVDLATGIFQVTGAVVLMARLDPVLLGVVAAVLVLVLAVTAVLAGRIRQAGERTQAAVGDLGALLERALGALRTIQANGAERAQAAAAHRAATRAS

SEQ ID NO: 10065 - protein, 84 aa, Actinoplanes utahensis
MAGGPGPAGGSGGLRGQPEHLVDPAGRGQPALQPGDPAGQLGHRPGQIEQVEQEGDQRRHGQPAGRHRGAADAEHHHEGHLLAS

SEQ ID NO: 10066 - protein, 250 aa, Actinoplanes utahensis
MAFHGVSLRHRPDGPEVLRDVTLRLPPAGLTALVGPSGAGKSTLLALVERFREPTAGRVEAGGRDVRHWPLRDLRARIGYVEQEAPVLAGTLRDNLLLGAPDASDERIAEVLAQTALTALVRRLPHGLDTVLGHRGSTLSGGERQRVATARALLRRPGLLLLDEPTSHLDAVNEQALRDLVTRVARTTTVLMAAHRLSTVTRADRVVLLEQGRIRAVGTHDELLARDGLYRRLAATQLLVSSGYRAGPDA

SEQ ID NO: 10067 - protein, 43 aa, Actinoplanes utahensis
MAPTTYQRPTLTKGGSFARKTAGSLFTSCRESFVTQKPKAVCN

SEQ ID NO: 10068 - protein, 612 aa, Actinoplanes utahensis
MALLPDLASQVSWFVAVPDNDAGHRMAGPLLRTPTGVPGPRPRTPTGVPGMVAHASGRPWLVGRWQPGEAVTAAIGPNRLAALGEHRLTADDLRRLARGARTAEQLCESLRGQPGSFHVIAAGPDGLAVQGSLSGFRRVYHHGPLAGDRADVLAAVIGAGVDDEALAVRLLSPFAPWPLFWNPVFHRIAAVRPDERLVVAPDGTPRLRRRWQPPAPTVDPGEAATWLRDALAAAVAVRGAPGDVLASDLSGMDSTSLCALAVRDGRHVIGLTCVSPDPLDDDLPWAETAARELGKVTHEVIAGDASPLPYTDLHRPADGFDEPTAAVMYRAGFLGASRRAAGHGARVRLTGFGGDELLTADPALQLSLLRTDPRAAIRNLRLLRSAYRWGRTATLRAAFDRRPYGTWLASLTGDGDAGAGPMLGWGPPAALAPWVSPDARATVRRILREQAASATPLLDDRGLHGRLAGLHAGAAAARHLAQASRRTGVTVALPYLDDAVVEAALSVRLAGVASPRQYKPLLALAMRDVLPEPVRHRSTKADTSIAALRGADEHRGTLLDLADRSQLADRGLIDAAALRAALTAPGDRTFYDLDQTLAAEAWLRVPGNGDAR

SEQ ID NO: 10069 - protein, 84 aa, Actinoplanes utahensis
MNWTLPAHVAWTPTEYGGVLLDSAIGEYWTLNATAATMLDCLLAGPSPATDRLAADLGADPATIAADLAEFLGELRGAGLVVAR

SEQ ID NO: 10070 - protein, 140 aa, Actinoplanes utahensis
MTTEQVLAHRPSRLGRRLTVLAVVAFARVLAHRSPDLICRVLRRISRGARPATRQEAAAARRDTVANSAFCAGPVGCLPRSIATALLCRQRGAWPDWVAGVRRHPPFGAHAWVEVDGVAVDEPYPDGFHIPMLTVRSPSR

SEQ ID NO: 10071 - protein, 82 aa, Actinoplanes utahensis
MTTTLLYLSWTGRGALAMVFAASVLAKTHRVAAFTRFRQATATLTGQSGRRAGVLAVLTVAAETAVAAGSVVARTAPWAAAS

SEQ ID NO: 10072 - protein, 167 aa, Actinoplanes utahensis
MSALIAAVVVLALVVAFHTALIVALIRRLRYHAELLVDIEERGVPARALPRGAVLAAGLGLLAPDTDTLVAFFSPTCDRCRRDRAAFGRVAAGWDRAVAVVSGPDASAGFLAGAVPAARVVVDADGSLRHAFGIRHFPALFVVSPDGRLAWTGMHASAIPPSSSEKK

SEQ ID NO: 10073 - protein, 333 aa, Actinoplanes utahensis
MTSESIRFLNRADVAACLSKMDAAEVVAQTLRDHTSGRTELPPEGYLSWSNSAGAYSRAIAMLGAVPDGAAMAYGMKLINASVGNPGRGLERAGGLSFAFDPETARPAVVAEAGLLSAVRTATYTVVSLRELGPESFDTVSLIGTGTLARVHLEAIADAFPAVRRAVVFDLDPARAAAFRDDFAARRPELTVTVADSARHAAGAAPVLITVTTSNDPYIPASWLAGGSFVAHVSLDDLTGEAFRGAEAVFVDDLELIRDNPRRIMGRLLQEGVLTGGDGSLGEVLTGRRPARRPGSGYVISNPFGMAVLDVALIHAVAQVARETGAGQLLDLL

SEQ ID NO: 10074 - protein, 330 aa, Actinoplanes utahensis
MIIESALDLRFPDVFLELSGFLPDSRLYLKIEAMNLAGSIKFKPALAMIDDLEQRGLLRPGSRVIESSSGNLGIALSIVCNARGYQFTCVTDKNTAPATIELMRAYGARVVVIDKRDPNGGYLSMRLAYLQDRIRADPMLVWPNQYANPINTMAHYHTTAAEILQQFPEVDAVFVGAGTTGTLTGCAQYFARHRPQTRVFAVDIIGSTTFGTPPGRRHIPGLGTSRTPAIASLQHVTDLVMVSEHETVKTCRRLRDRHHVLVGGSTGAVLTGVADRAALLRPGSVVVAISPDLGDRYAGSLYNPAWVAERELDRPPAPVEPLDIPVPDLV

SEQ ID NO: 10075 - protein, 321 aa, Actinoplanes utahensis
MSTSEAFTGLPPRREPGGLLTLADLTPDRLAGLARRSVELYRDRTAHHDPLQGLLIGIVFTRTSTRTRTAFTAGVERLGGRAIGYGPGDLQTNTGESLADTARMFGLMLDGIVTRTAGPLADMRLLSAESGLPVINAMAAEEHPTQGICDLATILLHRGSLDGARVLYVGEGNNTATALAQGLSAFAGTELHLLTPDGYGLPEDALKAATARAAGNGGHVTESHDPRDVPAGAEFVYTTRWQTTGTSKPDAAWRETFRPFHIDDQFLGRTPDALFLHDLPAHRGEEVSGAVLDGPRSVAWSQARMKLCSAMAVLEYAFGRD

SEQ ID NO: 10076 - protein, 55 aa, Actinoplanes utahensis
MTDDLATRIAGLLRRAHPLRMGSAIRQADELLTDIGPAGRAAVLERAIHLALHGE

SEQ ID NO: 10077 - protein, 465 aa, Actinoplanes utahensis
MRDGGVDVPTGPIVTGDPHVVRALDLRGGRLELHARRRVRGPGRAVPVVGGEGEVRPGRREGPLVVERGGGVDRPAVRLDRRSRQFGPHGAGPLEGLELGGALEADGGLRQGVDQRGVRAERPDLRGDDLAVGADRHRDGRPGGRRGGRRLDGERETGGDQRAGGHEGGCTTNQDGGSSTRGDWAPSLRRTSIAALYRIRPVPLPTGKRCRAGSPVRGASVRSGHVHCREGARLLTAAEAAMIESILPSAVTAVDTFQDPPEAGLFPEEELLVSTAVAKRRAEFATGRWCARQAMLRLGHRPAAILPGPRGEPQWPTGLVGSITHCAGYRAAVVAPAPQVTTVGIDAEPHEAMPAGVLEAVSQAAERDHLAALTRYQPGVHWDRLLFSAKESVYKAWYPLTARWLDFDDATVTFDPAAGTFNARLSVTGARLHGRELTGFSGRWVVGNGILVTAIAVLAPVPALL

SEQ ID NO: 10078 - protein, 923 aa, Actinoplanes utahensis
MELVERDGVMAVLDSLLAAAVAGKGRVAMVTGSVATGKTELLNTFAERVVDLNGLAITAVGARSERDLPLGVFGQLLMDAPLVAEDSRRAMDLLHEGAQSIPAGPDGAARLDPQIVHALCTILLDLSQRYPLVVVVDDIDQADPASLLCLSYLARRVRFAPMLAVFSLSSYARPDEPAVELEALSRPPQGAHLSVAALSPEGVRRMAAEVLDPEQADRIAPRWHQLTGGNPLLVTGLVADHRQVLAEGGAADGEPVTAGHYARAVVSCLHRIDPQLAEVARGAAILPETGLLDQLLGVDAAHIGQALRALTTAGVLHNGEYRHPVAREAVLAEIPDTERREMHRRAAVLAHYGGAATRVVADQLLGAGRADDPWAVPVLEEAARQGLREGRVDTAIGYLRLAWQTCADGPHRAKIMTTMLRAAWRINPGTSTAYLPELTAALQRGFLLGGDALALTKALLWDGQFSSARTVFDHLNAVTDDLDQEGMTELAIARPLLRCTYPPFFALLRQPSERPPAVSTVAASHRLEAATALATVLTRGPSEKIATAVQRILHNSRLDEMSLDTVESALLTLTYGGWCDQAASWCDLFVEEAVTRRAPSRLARLSAIRAEVSLRLGDLPAAVRHARFALDTMPPASWGVAIGAAVAPMMLAATAMGRYDLVREQLDQPVPEEMFHTRYGLHYLQARGRYSMAIGQLQLALRDFELCGELAGKWHLDVPGLVPWRVDMAEALLLAGLPDRAHELIEDQLNRCAKNNPRVQGMAMRLYAATSQPRHRPMFLRQSVDLQAGDEYEQARALVDLTGAYEAVGESRRAGMIARRARALADKTEAEPLLATLSPELGGDEAETATALNLAAGAVTLSDAERRVAILAADGYTNREIATKLYITVSTVEQHLTRVYRKLDVHRRTDLPAHLLRDHATAN

SEQ ID NO: 10079 - protein, 561 aa, Actinoplanes utahensis
MGNKYVRPFTPTFPERTWPGRTITSAPRWLSTDLRDGNQSLVNPMGPDRKLTMFRLLTAMGYKEIEVGFPVASRDDHDFLRLLIEEDLIPDDVRISVLVQARDELIRRTVDSLAGAPRATIHIYNATSPQFRRVVFGMDRAECKELAVQSTRLMLKYADRTLAGCDLGFQYSPELFNDTELDFSLEVCEAVMDVWQPAADRPIILNFPTTVERATPNVFADQIEWLDRNLSRRDHVCLSVHPHNDRGTGVATAEMALLAGAQRIEGCLLGNGERAGNVDLVTLGLNMFSQGVDPGIDFSDINEVRRVVEYCTEIPVHPRHPYAGDLVYTAFSGSHQDAIKKGFDERKRTGDQRWEIPYLPIDPDDVGRTYESVVRINSQSGKGGVAYVISSCLGLHLPRDLQREFAALVQARADAEGGPIDSDRIVELFTREYVSRPLLSVPLPLREAVPVTLHVDGHAFEVGAVRADAVERVKQSLAAWRIDLRAVHRTGTGLADGTATGVYAELRAGERTLWGVAADDDVESAILAAVRSAAARLGRPAERPRGAYRIDETPYPMARAS

SEQ ID NO: 10080 - protein, 118 aa, Actinoplanes utahensis
MSISAQAVDVVYGRPAAGVQVRLQRKISDLGHELDDWVTVDHAETDHEGYVRAWTEKRLGRGPYQLVFDSNAYFATLGLSTAYKEVSVVVRLTGESDSCQVQVRLAPYSYSMYFGFRD

SEQ ID NO: 10081 - protein, 64 aa, Actinoplanes utahensis
MRKFTRRSARFVVAAVAAAVLAVLGAATADSNDTTPAQPGTPAGTSVATGADDTTISGTWPWEG

SEQ ID NO: 10082 - protein, 1018 aa, Actinoplanes utahensis
MTVEFRVLGPLDALIDGQRIDVGGNRQQIVLASLVLEAGSVISIDRLMRAVYGESLPSSARVQVQICVSALRRLFGQHGHPKAIVTRNQGYVLAPTEIDVDLQRYESLVMQARAAGNAGRKEESTARYREALALWRGPALEGLDSEPLRMVADRLAERRLTVTEDCIEYDLELGRHREVIAELVGLVGTYPLRERLRGQLMLALYRSGRQAEALDAYRAARRTLIDELGLEPSEWLQQLERSILASDADLSAPEATTAAVPLSLLPVVEPEVPPPDLLVLEPEAARAVADPAPAARGGQPVPSMLPTDIADFTGRTEQIEAIQAHLTAAAGDPAQLAVPIIVVAGKPGIGKTALGIHVSHRLAPRYPDGQLFADLHGRSSDRVSPMQILERFLRTLGVPGASIPDGLEERAEMYRGLLSDRRMLVVLDNAGSEAQVLPLLPGNPRTAVLITTRSRLGALPGAVHVDIDVLDPSHCVALLSRIAGDDRVLAETDAVAALTELCGRLPLALRIAGARLSARPHWSVEQLADRLENESRRLDELNHGAMGVRVSISLTYDNISDAARRLFRLLAVVDSPAFSAWVCAALLDEALPDAYDLLDDLVDAQLVEIDSTEPGPHRQYRFHDLIRVFARERLAAEEPLADRNAALQRVFGGLLFLSEEAHRKFYGEGNKEVHSAAPRWRIPQRSVDRMLSDPLGWFERERQSIVAAVRQAAEVGAVEYCWDLAVTAVTLFETRVYLNDWRTTHEIALAAVRRAGDRLGHGMVLYSMGALTIAERRFAEGRRRLEDALEMFEVLGEESGHAMVNRHLAYLERMDGNLDEAARRYEQVLPVVRRGGNPAALAYVLHSMAQIEMERGNAGDAKAMLEQSLELSRRVGGRRIEAQVLHRLGQAHLQAGEPESAVTVFGEALTAAHGLGDPIGEAYATLGLGAAYLSAGDLTEAGAALARARELASINGERLIEARVEFCMGELSLAADLPDAATTHLERALVMFREIHAPLFEERVLAMLQRTKNQCRVA

SEQ ID NO: 10083 - protein, 427 aa, Actinoplanes utahensis
MQVPLLAVREFRSNWRRNAIFGAILFVSISVQLFTAIAATASRTAVESYATAVFGYAETYSLTIPDERTGAALHTLNDRLADITRSHPWLRPATAVNVTAYVRASATSDPSALVPVTLRSVTRDWQLLTPALADDDLWRTVIDDRRLGPAVLLDRDTAGRLGVAAPMAVTLLLDAPVADHPGAGASPGPEQARQQAAGDAPAQVAAGASVRPRIALGGVPVFGTYTELNKSLAADGFVTQNVIDLAHLGPQTVQVYWRCVRIRCGDAAALVRTAVGGHVTAVESRIDDIDQFRPVLDQQREEGQRFSVIVLVLGALAVGIVSTAFVEVRAPQFATLRALGASRPAVGVLALLENLLTAAVVGVLAVLAGAAASRLDPNRFNQISQVRLDHLGVPIAIYAQTIAITLAIGLLTGLAPAIRAYRAVRTS

SEQ ID NO: 10084 - protein, 238 aa, Actinoplanes utahensis
MTDSRPVVEARGAGKTLQLPTGDRLQVLRDVHLTIMAGEAVAIRGRSGSGKTTLLRALGLFIPFDTGEHRVLGTDVRRAGDRRCSRLRARSIGFVFQDFRLLPNLTATQNVEYAGILAGLRGRRRRAAAREALDRVGLGARLQSRPAQLSGGEQQRVGIARALVKQPALVLADEPTGALDAETADAVMTLLLDAVRDLNAALVVVTHDDAVAERCDRRVLIAGGAVHEPGAADVVEAP

SEQ ID NO: 10085 - protein, 315 aa, Actinoplanes utahensis
MLRSRVVARAAVFAGATVLLAACTTTGDAGPGSGAGAGDLVVASATAAPATVRVEKREIYQTVRLEGLVEPYDAVPVKAAVDGRFIPAAGVRNGRTVPRGFRLGAVRQCPDEQNAGTVNPAPSASASAGGTAATHCAYRYTAVRAPAAGQLSDVGEQNVAPGAVIANIRPPGFHIRLPVEDKSVLFNFAHPPSSGKAQIVGGPSGLTVRFERRTFDQSSGTVNVFVSAPSHVDLFAGLHAVVVFVTNALKDVDTLPLSAVRGRAEQGEVVVLDQAGHTRTVDVVIGAADDAYVQVSGLDPDADVLVYPLDSNFDR

SEQ ID NO: 10086 - protein, 183 aa, Actinoplanes utahensis
MASRSRLLASVLLLGLLAAGCSSGSGDKSTDQSGSAPGQGGKPGVNNPADAAKKPAGAATGTKKDDFMPTLQQAYAKVSWPPKRKMTTDKLWGFMAAGAADTQYQASDATNMVTIWNACAWTMQLVDDTKANKPVSADESALSGLGNSDLKGLIDKIVSDAKLGEISTARQFIDANDCQKGFA

SEQ ID NO: 10087 - protein, 132 aa, Actinoplanes utahensis
MIKRTAGLAVVAVVAIATLLGITAAPALASSYNTGGTTTSITNFTTGSTTYTQDHAGDDIAFDVTSGPAIDMRWVKCSDSSVHGSINYNIGTDGYRVLGTDFKATTCLHLQFRGFTSTGAFRGVTYWDYNFA

SEQ ID NO: 10088 - protein, 593 aa, Actinoplanes utahensis
MVDESARNAVAQRWLSAIAAAGFVPGRRARVLRELQRLLRRLESTVAGEPFDPAAGWRIGARLVELRMAGPKVIGATIRLLRTELTELLAGDVAALGVRVDLVLEQVNNGFAAALRDTAMAIAEDINRSMRVTWEADRSVLHHRWQHARLHDPVTGLPNRAHLRDVLRRVTADGSGRIGVCLLRVDDFADLSDALGHAHGDDLLAAISWRLRDLVRSWSATARDQAARPEADDRYLLAHLGGEEFALLVIGTTGAHQMVKVAKLAGLALRTVVLPSVDGYAPRMTASAGIVEAPIAARPDPEEWLRDARRALAWARGDDAGGVMVFEPGRARQDSRRNRLAAAMPVALDRGEFEPHFQPILRLADRSVVGVEALARWRHPREGLLSPAAFITLAEQTGLIRRLGQSILEQACRQGAAWRAEGRHLTINANLAPAQLADPGLVAGVADVLYRTRMPAGCLQLEITESAVVDRCGRQLDDLAALGVRLALDDYGTGYASLRSLARLPVTTVKLAAELVADLADPGDAAAAAIVKHTVRLCHSLGLTVIAEGIEAETQHARLRDLGCDLGQGFLYAKPVDPRHVDPFSRRMEPPSE

SEQ ID NO: 10089 - protein, 341 aa, Actinoplanes utahensis
MPGLQVRCWGRPRPRPVGCPAGGRTPPIAPGRSRKARVPHWGDIDRCEPFPSTPRRYIGCGNDRAAGVAVEPNTWVPEGADITVPNASRVYDYALGGMHNFAVDREFWHHVQDSFPEAHLVAQANRAYLGRAVRWLVEERGVTQFLDIGSGIPTLGNVHEVAQEADPDARVVYVDIDPIAVEQSRSLLRDNPNAHAIRGDLCDPDTIVWHDQVISFLDFSRPIAVLMVAVLHFVPDEADPRSLISRIGAALMPGSFLVLSHAGPEVTEDGLRRQEIARKLYEKTPTPLVIRDREQLLGLLDESFEVLEPGVVAADQWRPDPEQAAQIPPQPTALVVVARRR

SEQ ID NO: 10090 - protein, 223 aa, Actinoplanes utahensis
MHSGVDPGFDRQFFAQMLGAINRFDDRDFIAYGLEADQVAAMPELFRTWQADTQASPPLTKLGCLSFRRLAAQRRCVRGPDKFEERELLVEGPVQGVQYYIEKMSDMDRILLTAPLIEAFKNLTTLKLDERIGILDGLEGHPLEVTRVVPSEVADAYQVRGEIAREAGKTLSGHADFVAVLQNATSNVYIGSVDSGRFIVFAILDEESRRPLAMMLMEHEPRR

SEQ ID NO: 10091 - protein, 238 aa, Actinoplanes utahensis
MLEGRANNDGAWTGASAALGRINDVRVEMAGWEGAFQSNFIDRFLTPLEAVVPNQRELIRYSRNAIEGAKIIHIRFRKSVLNMLDNAIKATQQLSNSACTGADAMKWGTIAMCALSTIGGALTAGAGVFVTAVVIDVAGTIGGGLVPNGKEATKLDLAADTATEVAANIMSAQSALDNDTYTAEEDVVQSLRDLYRGLAAERLKALSSNVSGPFGVAVPALADATPSQVTGGMFRPRH

SEQ ID NO: 10092 - protein, 144 aa, Actinoplanes utahensis
MAGEVTGGDLFHLWRVSEVHLPRIADVFYDANRLLGGSTGGGDSFRVNGPAYPGSSVMISGIGAAWEDLRSEMQLMMEQVGTTVLDAAQGVRNATQAYIDVDNENANLLRDYLNDPDNVDRADAASNPPVPGSDEDPGKPYPAA

SEQ ID NO: 10093 - protein, 378 aa, Actinoplanes utahensis
MPLWYTSDVTRKSVAALAVLAMSAAAMPAPALAQPDGATPTLVAGAGAPGFSGDGGPAAEAKLNRPLGAAVAADGSVYIADTLNRRVRVVGKDGIIRTVAGNGRQTVPASVPAGTKGTGIALSSPNAVAAGSDGTVFIADSAASRVYALAADGSITVRVDADVLGGSIATINAIAVAPSGTLYLADRENNRVVEIAPGAGSRPLSTPVNLPTGLAADAAGDLWITSASSVLSRLHDGKLATIIDTAGGGWRADENRAALSPFNASTVSAGTDGVYLVDNQQRTVRRLGTDASAATVAGLPADPFGTRDPIGLAAGTASAGPLYVVDTVGSRIFSMPVTVSAGDSADGDPKPVWPWALGGAAVLVLGAVFFLVSRRRRA

SEQ ID NO: 10094 - protein, 193 aa, Actinoplanes utahensis
MWYGDVDLGEQLRTMTVTATSPDGAIRATVTGENRLELRFQPRTYQWYDDHGLARELTALGTTTWVAWTRQRAEVTRLSLGQSRGEAEQSQRRDGDPRHDRFIEALRRLECDGVSRDRSIHLRLAGATRWQVEIADGTARNTPERTFVEQAVSAVDSVIQDRSMKMALLRAEHFDIGVPSSWLDRVRSLRFRY

SEQ ID NO: 10095 - protein, 383 aa, Actinoplanes utahensis
MTDFDVYRLPEDHETIRAAVREVCDARVAPNAAEADETAEFPKASYDALRSSDFHAPHIPVEYGGAGADALATAIVIEEVARACAASSLIPAVNKLGSLPVILAGSEDLKRRYLTKVAAGEGMFSYCLSEPEAGSDAASMTTRAVRDGDHWVLNGVKRWITNAGVSEFYTVFAVTDPAARSRGISAFVVEKSDQGVSFGAPEKKLGIKGSPTREVYFDNVRIPADRMIGAEGTGFATAMKTLDHTRVTIAAQAIGIAQGALDFALAYAKERKQFGKAIAEFQGLQFMLADMGMKLEAARQLTYTAAGKSERGDADLTYFGAAAKCFASDVAMEITTDAVQILGGYGYTRDYPVERMMRDAKITQIYEGTNQVQRIVMARQLLK

SEQ ID NO: 10096 - protein, 79 aa, Actinoplanes utahensis
MAKAEEPDYGEQLSRIDASIAALKQQDMEAASTRTKIASKIQAAQFQRDILAHAQKQKTARPRGRRPAEEFPPPPPLAS

SEQ ID NO: 10097 - protein, 1520 aa, Actinoplanes utahensis
MAPMEHGPEASTQSVQNILLGLGALLIGGAAVVFAGVAFSNPVARAVILALFTAIALSVAPGVARRTLTSTAETIAAIGLIVLPMTLYALHGSALGGGPAVATPLYLGITFAITAIAGFLYAGATKLAIPRYATVIATQPVAPLLAYPWIHSPAGWGLALTAVAVLDLLLLTRVLRRGRLVPRWPLGRPTAADRAAESEPEWPEPRPESQPEEPDLIIPGLRPRRSRWIPTRIFPGPRPEGAPPAGSVPLAPPATPPSAEWLRELTFFLLCVACAGALLYSSVALLQAQVVPDALRSGLILVAAALTAVAAAQLLDQPLARHIAGGVLTLAVIGAAARVAAVVDPRWTLVVAAATVAITGALVGMLPAQVRTGPQYASTAALALIGARVAIDAIRAAIAPVAAARPVWHADTAAYARTLSDAVGSAGWLLVFSALLVTVAAALALPGGIRHEGAVIGVAVTALALPASLALNWSEAPWPLVLAAIALGGAGLWSSTRRVAITHIAAAGVVGLFGAGAALAATWLTAAVLTALAGAGVMVTIAARQIPVRLFAWMVGDWASGAAALAIPGAAVTAVLAITDTGQGPPPTAAATVPALAAGFLTVAGTLTYAAVFQVARREISFPLTAGTGLGALALAAAALFAPGRAPADIAVGALLMAAALLLFFAKSIDERGRTDRMMDGPDWAAAAATVAICGALARVAALAFPAAPLAVAGVVILLVGMGVTILQEDWKRGPSRGLGLAALVVAGLAGFQAMGGSLRILTAPGPLWAADVTHLAAAPPAGAWQAPFALVMVAITAAIALPRPWSHHASGVCAALATMGAPWALGLPWWSPLLIGAAVATAYALAALATAEPAAARARAAVAAMVLLHASVVGLARPWSTGMALLTVVLLGSLVAVAARVAAGEADVLPAHRAQVGGAATGSVLLALPGTFAAFAADQGGSAQVVLTAALAGSSLGLALLALLGRRVPQYLPWATIGLVLGAMVTALVSVPSSYPTALYAAAAALLGVLAEMLRGAVPAPLRPSVVEEFPAGDIRYQRARRMRGGGGLFQRWLADPATGAVMLALLPTVLALFSLAPALRAALVDPLKQLGSVWKGPVPALITPAAGTIDATSALAAVLLTGAAALAALSFGGRPAETVPVILPGVALTLLITPIALHAGFPAATGAALVVFTISMLGLALTLPPVASRAPLLRGTRTVVFVVGLLAGGAGLAGSLARSPLTLLTLGCAVFVGVAAAVAGRTPSARLLGWLFAALMGQMFVLAGAIALGLSRHWAAFGVLAVGAGLLALESLLPRLGLAQYRAEAVTVEWSGYASAAIAGALAFDSPAHLAALLAAWGAVLGLTASRPDRTPGQRRTMFWLAVGFEIVGWWLFIALAQVALPEAYTLPFAALALAVGIVEAHHRPELSSWAAYGPALLAAFVPSIALVLAGGSHNDLREVLLLLGGVVTLIIGSRSRQQAPVVIGTIATVVAALKFVFSLGGPWLMLVPVGVILIFLGATSESRRRTTELRNRVSQMR

SEQ ID NO: 10098 - protein, 165 aa, Actinoplanes utahensis
MAPVVGIIMGSDSDWPTMEAAAEALAEFEVPFEVGVVSAHRTVRKMVDYAESAAGRGIKAIIAGAGGAAHLPGMVAALTPLPVIGVPVPLKHLDGMDSLLSIVQMPAGVPVATVSIGGARNAGLLAVRILGSSDAGLRQRMSDFQAGLEKLVGEKDAALREKLLG

SEQ ID NO: 10099 - protein, 380 aa, Actinoplanes utahensis
MDTRTGLPVVGMVGGGQLARMTHQAAISLGQSLRVLSARPDDSAALVAADVPIGTHTDLAALREFAKGCDAVTFDHEHVPTEHVEALEAEGVKIFPGSKALVFAQDKGMMRERLAALGAPVPRWSRVSTADEIEAFAGGAWPVVAKSTRGGYDGRGVWMVGSREAAEDLVSTGIPLIVEEKVPLRRELAALVARSPFGQVAAYPVVETVQRDGICVEVVAPAPGLSEERALAAQQLAIDLATELGVVGLLAVELFETGDGIVVNELAMRPHNSGHWTIEGARTSQFEQHLRAVLDYPMGSTALAAPVVVMANVLGGEDGGISIDERLHHLFAEDPGARVHLYGKQVRPGRKIGHVTVLGDDLASVRARAARAAQWLQEGK

SEQ ID NO: 10100 - protein, 663 aa, Actinoplanes utahensis
MANRLANATSPYLQQHRDNPVDWWEWSAEAFAEARRREVPVLISVGYAACHWCHVMAHESFEDDAVAAQLNADFVAIKVDREERPDVDAVYMTATQAMTGQGGWPMTVFATPDGDPFYCGTYFPKQQFTRLLTSVTAAWRDERDGVLKQGAAVVQAVGGAQAVGGPVAAVTAEMLAAAAAGLAQEHDQTYGGFGGAPKFPPHMNLLFLLRHLERTGSAEALELVRHTAERMARGGIYDQLAGGFARYAVDEHWTVPHFEKMLYDNALLLRVYTQLWRLTGDVPARRVADETAEFLLRDLATPAGGLASALDADTDGVEGLTYAWTPAELTEVLGPDDGAWAADLFRVTPDGTFEHGRSVLVLARDIDAADPALVDRWRDVRARLLDARGKRPQPARDDKVVASWNGLAITALAEHGALTGSTASREAAVALAGVLADRHLIDGRLRRVSRDGVVGDPAGVLEDYGCVAEAFLAVHQITADPRWSRLAGRLLDVALARFGTGSGGFYDTADDAEKLVTRPADPTDNATPSGLAAVCAALVTYAALTGETRYRDAADAALATAGPLIGEHPRFAGYSAMVAEAALTGPYEIAVATDDLDDPLVIEAVREAPAGSVVVAGPPDLAGVPLLADRPMIDGRPTAYICRGFVCDRPVTTPKDLLARLRS

SEQ ID NO: 10101 - protein, 312 aa, Actinoplanes utahensis
MRTGHVPGRFLAALTAATGGLGAGLLAVGPAQAAPLPDLKVTVAITPGKAAYSVGDTITAVYTIRNVSAVAATGIRSGGTYDGLTWIGDMPWSAAFDLAPGASRTFTWAAKVSDAGSRGGYAAGRFEFEAAAGDADPADDLGTFRLPVPGGKGTMRLKVFVDAKGDSSSEQPGLAGAEVVLSQPKPGGARVAGGRTDAKGWVSFTGLATQDYRVSVPGRKLAGDNPDSTSVEVMADQTATAFVGLLPGAAASGSPGASSDVAAPAGASPSGTPALAVTGSNSGTVAVVGGIVVLAGAGLFLMARHRRRRFVA

SEQ ID NO: 10102 - protein, 842 aa, Actinoplanes utahensis
MTGRSAAHRRAWTRLAGRSRPVRVLTVTVVVAALAAVLLGALQPAHLRADSPLTPFDGGCVAAVLAAIAQLAGLRFRLGPDAVSVSWAEAAVVVGLVVCPAGWLPAATLVGIGAAWLLLAWLTGLRNVAEVVHLVASMTLGVSAAALVTSLLAGDAGVRSGRLVPALAAGAATYLLITFGLVVLTLTLQRDAAPAQLATRVLYAKVPMSTGNVIVGVCAVYALVREPLWLLAFGPVLWLLHRTYRFHLRAAEERRMWEAFAAATARLPGTTEAEVARAGLRGALDVFGARRAELELRSEQGSRRYAEDGPGQNPDVARSGPAVTRGMAVAGRPVGELTVWLGEPTLPAARDEAAITAYGEALAGALHDAAAHQRITELDALVAHDRVHDPLTGLSNRPALTADGDTVLRSGERGRPVALLLLDVVGFREVNSTLGHRGGDEVLRVIAERLTGQARAGELVARIGDDEFALLMPALTALAGPDGWARGAPHILSQALRRARELVEQLRLPMQVAGVRLAVEVTVGAVVAQAGHVEVTELLRRASLAAGRAKEQGLTVGTYDSGQDASSTDQLALLAELQDAFAADDQIVLHLQPAVDLITGAPTGCEALVRWRHPRRGQLSPAEFLPAVERSELLIPFTRRVLDLALAAAADWTAAGIDVPVSVNVSARSLTDPTFPAQVTEALRRHRTPASRLVLEITESVAVSERDIVDEVLARLRATGVQMSLDDFGTGFSSLASVTRVPVDEIKIDRSFVDEMIDSVAAGAVVRGAVELGARLGVRVVAEGIETIEQRAALIALGCPSAQGYHFCKPMPADKIVQALTQLRRSSTGEATITPLRADGAS

SEQ ID NO: 10103 - protein, 316 aa, Actinoplanes utahensis
MAESIFAAGPGPPTAGLVERVINVAEQLRLMTVHAHPDDESSKGAATMAKYVAEGAQVLVATCTGGERGSVLNPKMDRPEVLADITNIRRREMDRAREILGVDQAWLGFVDSGLPEGDPLPPLPDGCFGLQDPHEAAKPLIKLIREFRPHVMTTYDENGGYPHPDHIMCHKVAVIAFDQAGDPELYPELGEPWQPLKLYYNSGWTRARMLALHEGMLAAGLDSPYAEWLEKWSDRQDRGDKITTRVECGEYFAVRDDALRAHATQVDPDGFWFHIPLEMQQKVWPTEDFELARSLVDSPVPESDLFAGIREKVDAA

SEQ ID NO: 10104 - protein, 159 aa, Actinoplanes utahensis
MDSAILADPPDNKRMRGRQVSETRATTPVFPPGRYGRRREPGRRRPLGLVVAAVVCGVLALGLTWAYYQKFGRTDYSPEIVGWNEPTDTEMVIKFRVRVPAGESAACMLRARDYQGYELGTRTVTVPARPGGGEIVVTGSVPTTARGSVGDVMSCRPAG

SEQ ID NO: 10105 - protein, 164 aa, Actinoplanes utahensis
MSSSEAPKTWLSQDAYDRLQAELDELIAGRPAIAAEINARREEGDLRENGGYHAAREEQSRQEGRILYLKEFLRNSEVGEVQAADSVVPGSVVTIYFDDDQADTETFLLGSREISSTTDLTVYSPESALGKAILGARPGQTVTYTAPSGADIKVTVVKFGAFEG

SEQ ID NO: 10106 - protein, 444 aa, Actinoplanes utahensis
MSVVSIGAGCPKCGTETISRRSAEPWCPACEWNLDCFDPGQRSPEMGWRWLDRRLFRAAYRLTESQYAELREAPALARAATSARIATIALAVPLLAVVAALLVIGVGLLVHDFFEPLNLIGALLILIAVVLRPRLGRLSGLIRDGWQLDRDTAPTLFAVIERVAAAAGTPMPHVVVFTPEFNASTTTVGLRRRRVLRLGAPLWAVLDPQERVALLGHELGHFVNGDVRRGLLTQAVESTLGQVAYLLRPDLQRTRLRPDARRGMVRPARGSAGTSNLIGMIAESVVDVVAGILAELIGLLHLLLVSISRRDSQRAEYLADELAAKVAGSAAVIRMIDVFLLADGIDTVTRREARAGNGAAAWRAAADQARVNQATGLAAYRQLSRRAGVSVFATHPPDGLRAGLLAARPAQPAAVVMTEPEQARMDDELAASYESVRRELVATW

SEQ ID NO: 10107 - protein, 411 aa, Actinoplanes utahensis
MTDLLSLADVEAARDLLAGVVKTTPLVTSRPLTEITGVPVWLKCENQQRAGSYKVRGAYTRISRLSEADRARGVVAASAGNHAQGVALAAGLLGIKATVFMPEGAPLPKVSATKGYGAAVEYAGTSVDDALAAAGDFARRTGAVLIHPFDHPDVIAGQGTLALEILEQCPEASTIITAVGGGGLISGLAVAAKALRPDLRVIGVQASGAAAFPPSLAAGAPRKLESCATIADGIAVLRPGDLTFAHVAKLVDEVVTVTDEDLSAALLVLLERHKMVVEPAGAAAVAALLTGAYTPPRGGGPVVAILSGGNIDPMLLLKVIEHGLASAGRYLRLAVRCTDRPGQLARMLREIAEQRANIVDVVHSRQSPRLSFGEVEVALSVETRGPAHSAALISALRDAGYRVALLADATP

SEQ ID NO: 10108 - protein, 453 aa, Actinoplanes utahensis
MDTTTWVGATAKQIARAVRRGDTNATQVVADHLEQIAISDPALGAFRVVRGGEAITEAEKVDDQEDLANLPLAGVPVAVKENTAVAGLPTWHGSAAARTGEVAEVDHEVVRRLRGAGAVVVGVTKMPEMGLWAVTDDAEGPTRNPWDLDRTPGGSSGGSAAAVAAGLVPIAQGNDGLGSIRIPAACCGLVGLKPGRGVVPVDFGANDWFGLVENGVLTTTVADAALGFSVLAGQAPAKLVEPARLRIGVSLRSPVAGVKPDEPNVSAVTKASKLLVDAGHDTVHADPRYPTGVALGVLATWFAGAYKNSEGLDLKSLQPRTQRHIRLGRAVTRAGLVRASQRAAWRERSIRFFADRNVDLLLTPALAATPPRALSFSSLSWVQNMQANARYAPYQAPWNFAGLPAIVVPVGFRPDDGLPLAVQLVGPPDSELLLLSVAGQFELQNPWQRHALV

SEQ ID NO: 10109 - protein, 429 aa, Actinoplanes utahensis
MPLEHRPGVEKRHPGRLVGDLECRDIARHDPTEHAVGHGLRLALRYMTTDHYGFDTLAIHAGQDPDPRTGAVVPPIYQTSTYAQDAVGAPRLGYEYSRSGNPTRDALQECLAAIEGGRRGLAFASGLAAEDTLLRAVCRPGDHVVIPNDAYGGTYRLFSKVAERWGLDWTAVPLDDFDAVRAAFRPGHTRLIWAETPTNPLLNIADVTTLATLAHEYDAMLAVDNTFASPYLQQPLALGADVVIHSTTKYLGGHSDVVGGALVVADPGLGDELAFHQNAMGAVNGPFDAWLTLRGIKTLGVRMDRHCDNAERIVGFLSEHEKVASVLYPGLESHPGHETAAKQMSRFGGMVSFRAAGGPEQAVEICNRTKLFVLAESLGGVESLIEHPGQMTHLSAAGSALEVPADLVRLSVGIETVDDLLADLEQALG

SEQ ID NO: 10110 - protein, 220 aa, Actinoplanes utahensis
MFLRHKKLDLPTAETALPGRLISMPVADRHEVLGTPLEGPWPAGYEVAVFGLGCFWGAERIFWRLPGVHSTSAGYAGGFTANPTYEEVCSGTTGHAEVVQVVYDPSKISYAELLKTFWENHDPTQGMRQGNDVGTQYRSTIYTTTDAQAEAARASLAAFQPVVTKAGLGEITTEIKPLGDYYYAEDYHQQYLAPTKNPNGYCNHGPNGLSCPIGVAKTEG

SEQ ID NO: 10111 - protein, 124 aa, Actinoplanes utahensis
MSPSSANEARYSGYRDAGERFRNPDEHDAWAQAEVMMEQARAMMREAEDALETWKTGKEMNRLRCERRGISQTDAEIRWSATTTAKNAITNNNFYVSLASMYYGAASANYSRALYLRSHGSARF

SEQ ID NO: 10112 - protein, 65 aa, Actinoplanes utahensis
MGVRREPLAALSRFPAGAEPLAALSRFPAGAEPLAMLSRFPVCTGSWAARRARAVQNRALPWLRR

SEQ ID NO: 10113 - protein, 523 aa, Actinoplanes utahensis
MSRRPASDTGRRSDFSMNKLLTTGYRPPPCHRNLRDRCVKTVRTGTIDRVETATETERKYDVPETFELPDLTGAAGIARVGGAETHDLDATYFDTEDLRLMKNRRTLRRRSGGHDAGWHLKTPGDGDGRREHRMPGDGDQVPDELRALVRTLVRRRALEPVARLRTHRVETPLRDAEGRTLALIAQDRVRADSGDEHSAWQEVEVELVDGDERILDVVEKALLKAGATHAAGPSKVTRALSGRLSGKPRPGKINPISRYVAEQRDAILEHDPAARRGDQDAVHRMRVATRRLRSTLKSFRRWFPDRETAGLSDELRWLAAALGAVRDPQVLEGRLLAGLDDDAAFIPAAQRIRTALDERVATGREQLAAALDSDRYLDLLDRIDALADHPPARAGNPAKQVRKVLGRADDRLDTALADGVDEELHEARKKYKQARYAVELIAADSGRPAKRLVKTLTALQDGLGAHQDSSIARETLREIGPDSFHFGVLYGRQEAVGKETLIAVPALVRASRRKKVRRWLVKA

SEQ ID NO: 10114 - protein, 317 aa, Actinoplanes utahensis
MSTEVDSQFDEAVTHPYQGPIAELNGYRVVDDEDDDPRLLNADGSPVDTWCEDYPYDERLARAEYDHHKRLLQIELLKLQNWCKDTGERLVILFEGRDAAGKGGTIKRFMEHLNPRGASVVALEKPNQRESTQWYYQRYIKHLPSAGEIVLFDRSWYNRAGVERVMGFCTRQEYLEFLRQTPELERMLVNSGINLVKFWFSVTQKEQHTRFAIRQVDPVRQWKLSPMDLESLDKWDDYTEAKEAMFFYTDTADAPWTVVKSNDKKRARLEAMRHVLHRFDYAGKDLDVVARPDPLIVGPASLVVESAESGPRVFPRL

SEQ ID NO: 10115 - protein, 311 aa, Actinoplanes utahensis
MRELVVLGTASQVPTRHRNHNGYLLRFDDEVILFDPGEGTQRQLLLAGLAVTPLRRICVTHFHGDHSLGLPGILQRISLDRVPHPVAVHYPAGGQEFYDRLRHATSYWDNAEIVASPVGAGFAVETSAGRLTALPLRHSVESYGYRLTESDSRRMVPALLAAHGVTGPAVGELQRAGRLGDVTLDQVSVVRPGQSMAFVMDTGLCDSVYELARGVDLLVIESTFLAEDAAMAAQVGHLTAGQAGAVARECGVRHLVLTHFSQRYPDPSRFLDEARDEFAGPITIAEDLMRVPFPARRDAPVADTGLSPGGR

SEQ ID NO: 10116 - protein, 167 aa, Actinoplanes utahensis
MKLQLRAAGADDQFRVGALHQRSRVAAYAGFIPVEVLTARSAESFGEWWAERWKWEQDTHRMTLAEVDGELAGFSYIGPSETPRAAELYAIHVDPARVGTGVGRELMVRALADLPAIGEARAVLWVLTENHPARRFYERGGWTTDGATRTEPVNDVPVPQVRYEHPL

SEQ ID NO: 10117 - protein, 98 aa, Actinoplanes utahensis
MVDVDEAAPADIVDRLLWRDAQQMLGRHMAAGRDGNCVWCGWHWPCSARRLAERADAVSRRPWREAWTLRHDLNSLPAAMTDRGRADRGNHNHRRYAD

SEQ ID NO: 10118 - protein, 309 aa, Actinoplanes utahensis
MDTEESEALDAYSRIVTGVASRLLPSVAALTIRSPRGGAGSAVTFTDDGFLLTNAHVVAGPTTGSAAFAEGVETPFDVVGADPLSDLAVVRVHHPGAPAAPLGDADTLRIGQLVVAVGNPMGLAGSVTAGVVSGLGRSLPARDGHRMRVIDNVIQTDAALNPGNSGGALADSASRVVGVNTAVAGYGLGLAVPINDTTRSIIGELVATGRVRRAWLGVAGLPAPLPPHLAGRLGQKQGLRVVEVVPGSPAGVAGVYLGDILVSAGGHPVDSVQALQRLMLGPAIGVDLPITLLRRNALVDVVAAPAELR

SEQ ID NO: 10119 - protein, 453 aa, Actinoplanes utahensis
MRYYDNVVEIIGNTPLVRLNSVTDGISATVLAKVEYMNPGGSVKDRIALRMVQDAEEAGLLKPGGTIVEPTSGNTGVGLALVAQQRGYKCVFVCPDKVSEDKQNVLRAYGAEVVVCPTAVAPEDPRSYYNVSDKLTRDIPGAWKPDQYSNPANPRSHYEQTGPELWKQTEGKITHFVAGVGTGGTITGVGRYLKEQNPGVRVIGADPEGSVYSGGTGRPYLVEGVGEDFWPTAYDREITDEVIEVSDSDSFEMTRRLAREEGLLVGGSCGMAVVAALDVARKAGPDDVIVVLLPDGGRGYLSKIFNDRWMARYGFLRTPGDAPTVADALAAKGAEIPPLVHVHPTETVRDAIDYMREYAVSQLPVLKAEPPVVTGEVAGSISEKALLDALFTGQAHLHDTIERHMGDPLPMIGGGESVSDAVALLEKSDAAMVLVDGKPAGVLTRQDLLAHLS

SEQ ID NO: 10120 - protein, 129 aa, Actinoplanes utahensis
MAYPSHAGVAERGTEMAKTLKRAAAFSALGRALMSGARGGPSLSKRISALPRMVKATTRGEYDGGMRLALMAAATAYVVSPIDAVPEAFLWVFGLIDDAVMVTWLAGTVLSETERFLEWERLAKPVVVR

SEQ ID NO: 10121 - protein, 371 aa, Actinoplanes utahensis
MAAPGGDSGPVGSLRTTARDTVNSTVIHFRGLTAEDRQRIRTAGRIAGQVTGALAGVTAISAGLLLRQAADARRIIPLAEAPPPRGDGIYGAKFHGRPISLAVLGDSSAAGYGVHRPRETPGALFATGISRRLQRPVQLHRFAVVGCVSSGLPWQVDAALEHHPDLAIILIGGNDVTHVSARAEAVRHLGDAVRRLREAGCKVVVGTCPDIGAIQPIKPPLRWLARRWSRQLAAAQTVAVVGAGGRTVSLGNLIGPMFEADPARMFGSDRFHPSAEGYARAAAVMMPTVMAALGEDDRPAVPLAESVRTLPEAAVEAVRAPGTEVSPVRSGKRWAQLRRHPWFGEQRHWFGSLSARSVPQPQAPGPIRAAS

SEQ ID NO: 10122 - protein, 262 aa, Actinoplanes utahensis
MAGLPERLTRAAATSLLAGALGGAALLAGEMLAAKARRYAKPTMGLALRTSMGPVTAPPLRLVLLGDSAAVGVGVEWLSDTVGGQLARLVADGTPETGPRHVLLSSVGVAGSRSADLSTQVARALLGVKPDVAVVLIGSNDATSGRAPEEAAGHLGQAVRRLRAAGVQVVVGTCPDLGALRSMAPPLRQIAGVFGRRMAKAQAKAVADAGGVVVDLAGETGAVFRADAGTLCYDGFHPSADGYRVWAHALYPAVAKAALSGV

SEQ ID NO: 10123 - protein, 414 aa, Actinoplanes utahensis
MPEAVIVATARSPIGRAHKGSLKELRPDDLTATIVDAALNKVPQLDRALIEDLYLGCGLPGGEQGFNMARVVATKLGLDGLPGATITRYCSSSLQTTRMAFHAIKAGEGDIFVSAGVETVSRFARGSSDGLPSAAQALVGGGWENPAFADAQARTKATAESGGTWHDPREDGLLPDIYIGMGYTAENLAQIKNVSREEMDEFGVRSQNLAEKAIADGFWEREITPITLPDGTVVSKDDGPRAGVTLEAVSGLKPVFRPDGRVTAGNCCPLNDGAAAVVIMSDTKARELGITPLARIISTGVTALSPEIMGLGPVEASKQALRRAGMTIDDVDLVEINEAFAAQVIPSYKDLNIPLDKLNVNGGAIAVGHPFGMTGARITGTLINSLNWHDKSIGLETMCVGGGQGMALLIERLS

SEQ ID NO: 10124 - protein, 109 aa, Actinoplanes utahensis
MSDFATSIERLLTQVRHWEESRWSARAGAESAAGGDSASKADQAFALVQRLADLDAEAAGRAPREVPRLHDLVLPDQLRVVSDDLLAASPGPELLTIATAAVDEFRRIV

SEQ ID NO: 10125 - protein, 284 aa, Actinoplanes utahensis
MKTSNPVLSRLGQAAERERTAGYGPAGHAGYGQPGYGYGQPGYGYGQQPYPTAEGYAAPPAVQPMTIDDVVVKTVTLLGITGISAVVAWSVVPISMTMVAWIGAAMVGFVLGMVLSFMRMANPALVVAYAVVEGVFVGMISKAYQSFLGYDGIVLQAVVATFGVFFLMAMLYRARVIRATPKFQRIMYAVLGGLFMVMLINLVLYLFGVNTGLRDNGPLGYLFSLVCIVVASLSFILNFNEIEEGVRQGLPKRYSWTAAFGILVGLVWLYVEILRLLSYLQGDD

SEQ ID NO: 10126 - protein, 481 aa, Actinoplanes utahensis
MCPSTLDFQGCDGHRTTHERPVARENRGVNPPRIVVVGAGHVGLYTALRLSKKLNRNHAEVVVIDPVPHMTYQPFLPEAAAGSISPRHAVVPLRRELKKCRIVSGEVTKVEHARKTVIIQPIDGPSYEMAYDHIIVAPGSVSRTLPIPGLSEIGIGLKTIGEAIYLRNHILDRLDVAAVTPDPEVRKASLNFVFVGGGFAGIEALAEMQDLVADGLKYYPELDPKEVHFILVEATNRILPEVGPEMGAYAARQLAARGVDLRLEVFLNSCVDGQIELSDGDSFRAETLVWTAGVKPSPMLQQTDLPLGPRGHVNCLPTLQVATLEGEVLEGAWAAGDCAQVPDLTNPGGWCSPSAQHAVRQAKVLADNIAQVILGGAPKEYRHKHVGGVAGLGINKGVAHVYGIKVKGYPAWLMHRFYHVSRIPSFNRKVRVLADWVLAFILKRETVALGQLHAPREEFLEVTPPVAPKPKAEEKVASGAR

SEQ ID NO: 10127 - protein, 187 aa, Actinoplanes utahensis
MLTGLLRRISRIPGMVRRATVIPMLVRAGIALCGLFAIAVAWPIELVASQFVVPLVLVALWPAFAPRGRAATFAALVVVAGWIVDTSGYDSRIALWRVLSLATLLYLGHTLTALAAVLPYDAVVNLEVPGLWLGRAGIVVLISAVLTVLALGLTADLDGDAFQLATLVGLAAATGVTMLLVRLTRRS

SEQ ID NO: 10128 - protein, 265 aa, Actinoplanes utahensis
MTEPFKATEAMPAAAGLVGAHRSRRLGEGGELAGVRQFAPGDRLRRIDWRVSLRTRDLHVASTLSDRDAEVLLLLDLLGEVGRSGGVAGGASVLDTTVRAAAAVAEHYLHRGDRVSLLEYGATARRLRAASGRRQYLTVLEWLLDVRADPVDEEYEPALGSHQISTSALVVVLTPLIDPRAADMLAQLTQAGRFVVAVDTLPEDAAPPVRNQWSQLATRLWRIERENVLGRLREHGVPVVTWAGAGSLDLVLRDVARMAAAPRGR

SEQ ID NO: 10129 - protein, 150 aa, Actinoplanes utahensis
MTEPAAPSWAPTRALGRSVLLTGLLLLLGVALGRVDLVLLAAPFAIGVALNLRNRPQAMPEVTITADEAHLVEGGAVQAALTVANPDVLGYDLVVVRTRTSPWLRLEHADRPFAITVPSDGWAAVDLPGEALRWGRQDVGPAAARAALAS

SEQ ID NO: 10130 - protein, 333 aa, Actinoplanes utahensis
MTQQGGQALPPYEVGRLAGAVLDAVNSVVVGKREALELVLAGILAGGHVLLEDLPGLGKTLTARSFAQALGLDFRRLQFTPDLLPADVTGSFLYDQRKGDFAFRAGPVFTNMLLADEINRTPPKTQSALLEAMQEKQVSVEGVTYRLDPPFHVLATANPIEYEGTYPLPEAQLDRFLLRVSFGYPTAEEEWEVMRRRMSRRQEEAQLTPVVDARTLQVMQAALESVAVEDSIGRYIVSLAAATREHTAVLVGSSPRGSLALLLLARARAAMAGRDYVVPEDVKDVAVPALAHRITLRPEMWLRQVNPAFVVQEVLSAVPAPASGALPTYARHD

SEQ ID NO: 10131 - protein, 85 aa, Actinoplanes utahensis
MRRWEWTLDKAHADPDTYARTVVLPVLGELADERLRLRHGITRATDPARARELLGGDAWAVLSDPGRRGLKAKDLETYVQAMERL

SEQ ID NO: 10132 - protein, 41 aa, Actinoplanes utahensis
MSDGGLDELFGMTAAPAAPEPAPAPARRRSPALRVAGNVLL

SEQ ID NO: 10133 - protein, 229 aa, Actinoplanes utahensis
MDLGLLRRWWPLAAVIGLLFVISLAATRSAPQLDRITPESTTPTTQAPLLPPTPHPTVEQSESPVEAARGLPGWVGSAAVAVIVVLVIVMVVILIWALLRDVARRRRNRTGRRDPRRAGNTAEDLVAALDAGLEELSDTDRDPRRAVIACWVRLEQAAAAAGTVRHPGDSPTDLVGRLLAEQQVDAAVLAALMEVYREARYATHTVDDRMRQQARYALERLRADLGALA

SEQ ID NO: 10134 - protein, 250 aa, Actinoplanes utahensis
MQPSESSPRTPQSVVDQAAGAASLTVLDARVADCFACPRLVAWRTEVATVKRAAFRDQHYWGRPVPGWGPADAAIGILGLAPAAHGGNRTGRIFTGDRSGDVLFAALHRAGLANQPTSVAADDGLTLRHTRIFAAVRCAPPDNKPTPAERDTCAPWFQRELRLLTPTLKVVVTLGAFAWAAWWPAMRSAYAVTPPVPRPRFGHGAEVHLPGVPPLLGCFHVSQQNTFTGRLTPDMLDAVFARAKDLAGLA

SEQ ID NO: 10135 - protein, 208 aa, Actinoplanes utahensis
MSNPVEPNPYGAPAEQPGTAFPPPNAGAPGAYPPPNPGAPAAYPPPNAGAPGAYPPPNAGAPGESAYPPPGAAAFPAPQPAPKKSFGKKLLGVLGTIVVLIVIAAVKFGIGFGVSKALSGDPTKDAKVGNCISVDDKLSDKETETKADIVDCSKSDAKFIVVGRVDGVNDVNSTACDKYFTEKDKDPAILSSPSDSKNKYLLCVKANG

SEQ ID NO: 10136 - protein, 303 aa, Actinoplanes utahensis
MRVAAIDCGTNAIRLLIADVDGDRLTDVTRRMEIVRLGEGVDRTGMLSPAAIERTRVALAGYAADIEKSEAVAVRMCATSASRDASNAGDFRAMVRGVLGIDPEVITGEEEATLSFLGAVKGLAAPGPYLVVDLGGGSTEFVTGTDTVERAISMDIGCVRMTERHLHGDPPAAEELAAAQREVTVAVDTALAAVGGRAARTLVGLAGTVATVAALAHDLPEYDSARIHHSAVSRAAVTRVTGELLGMTVERRLALPVMHPGRADVIGGGALIMRTIMERSGHDTVIASEHDILDGIAFGLAAG

SEQ ID NO: 10137 - protein, 164 aa, Actinoplanes utahensis
MLIRRARTGDVRAIRHLVDTYTTDRRLLSKATVTLYESVQEFWVAVDEDGTVSGCGALHVMWEDLAEIRTVAVHPDKRGRRIGHRIVGVLLDQARELGVRRVFCLTFETRFFGSFGFTEIDGAPVPHAVYEQLLRSYDEGVAEFLDLERVKPNTLGNTRMLLHL

SEQ ID NO: 10138 - protein, 166 aa, Actinoplanes utahensis
MDAPTPADLDIVAAQLGRPPRGTRAVAHRCPCGNPDVVETSPRLDDGTPFPTMYYLTCPHATAACSRLESAGVMRDMQERLSTDPELAAHYAAAHRDYLDRRQAIDDVPEIHGVSAGGMPDRVKCLHVHLGHALAAGRGVNPFGDEVRDAVEPWWVDGPCVKRDEC

SEQ ID NO: 10139 - protein, 199 aa, Actinoplanes utahensis
MTQRRMPSGQGPSRRSGGASGRPGASRTRGAGPVRVEARPTVRVPTSRSARPAGARRTSQSGGPAATRTAAPRPRALTSRATVLLAVLVVLALAYTYPIRVYLQQEAQIAQMERAQAEQRDQIAATATELAKWNDNEYIRIQARKQLYYVRPGEAPLLVIEDRAGAAHDAGQKAPAAAPDRWYDTLWNSVRAADAEPAN

SEQ ID NO: 10140 - protein, 427 aa, Actinoplanes utahensis
MATIEAIVAREILDSRGNPTVEVEVGLDDGTVGRAAVPSGASTGAFEALELRDGDKGRYLGKGVEKAVANIEDKIADELIGYEASEQRLIDQKMLDLDGTDTKSELGANAILGVSLAVAKAAALSAELPLFRYIGGPNAAVLPVPMMNIVNGGAHADSNVDVQEFMIAPIGAPTFREALRTGAEVYHALKSVLKKKGLSTGLGDEGGFAPNLPANAAALDLIAEAVQAAGFSLGSDIVLAMDVAATEFYKDGSYVFEGSPKSTDEMIAYYAKLAADYPIVSIEDPLAEDDWAGWSAMSEQLGNKIQIVGDDLFVTNPQRIARGIAESAGNAVLVKVNQIGSLTETLDAVDLAHRAGFKTMMSHRSGETEDTTIADLAVAVGSGQIKTGAPARSDRVAKYNQLLRIEEQLESAARYAGAGAFPRYRVA

SEQ ID NO: 10141 - protein, 209 aa, Actinoplanes utahensis
MSISVFPEDGSRVEMESGGDIHPGVRVVAGSAAGVTVSLPQAGVPRAGATVILRWPATPRGRYVVSATVAAAGENRVELRLAGEPEIVQNRLYVRGGGGEPVVMTRPGHPDAIGWVHDISERSIRAHFTDVEVRPGHEVALRVQLGADVVEMPATVWKASAMRQQVPVRGPLSVEMVALYDPPESQAKIIRRYVLRHQLLMRAKTAESA

SEQ ID NO: 10142 - protein, 216 aa, Actinoplanes utahensis
MVIVARRRFVNGILAVGVLLAGTACTDLDQASAAGVGPADAVAQLAAQLADSADATYTATYSLTGGDTATVSRAQDPPRTAYRWPGGRLILTATGTTRCAKATCAISDPGGPAPEPPPAAGLISPEGVMAMLRSAEADPALRITQRDTTLAERHASCLQIVGSFEVCVAGDGTLAAFKGNLGGLRVEMTLTDLTSTTAVADFRPPPGATVTDQRPK

SEQ ID NO: 10143 - protein, 538 aa, Actinoplanes utahensis
MPEFVPLAERIADSLLESDPVTALYAGDHRFDDRLPDLSATAVDGRVAMLRDAADALSAIDADALDPEEQVDHAILTAQVDRGLFELTEVREHEWNPLEHNPGPLLHGLLSRPFAPPAERLTSLRGRLAALPDALATARAVLDDVPRIHAETAAGQFAGTAGLIRDELPALLAQEPGLRGTVEPVAAAAVAALTEFDGWLRKRLESGESGRDPRLGRRLWEARLWHTLDTELSAAEVLSRARANLDRVGAELRVLAAEMVGGEPTDDTVRRALDTIADQHPDNTTILGLAKSTMDEATEFVRAHDVVSLVDDPCVIEEMPEFARGVAVAYCDPPGPLETADVPTFYCIAPAPAGWSPERIRSFYREYNNEMIRNLTVHEAMPGHFLQLAHARRFRGSSPVRALGWSGPFVEGWAVYAEEMMVGLGFGGPAVKLQQLKMQLRMSLNAIIDQLVHCEDLAEGEAMALMTGRGFQEEGEAAGKWRRALLTSTQLSTYFVGYTEVAGLAALRPFGATPKAWHDAMLAHGSPPPRHLRALLGV

SEQ ID NO: 10144 - protein, 319 aa, Actinoplanes utahensis
MSARIVLLVTSPRLPAGLLTAEAWDTVRSGPVFAAAESPQAEALRAAGVPVTVLDIDAQGLLDAIGAAPLAVWLAGPHGDQPFARQLGLRLAREPGLAELELMYGSWDPPGARLLDAVTVMDRLASPGGDPWKRAQTHRTLAPYLLEESYEAYDAIEREDYHELREELGDVLLQVVLHARLAEDLPDGRAWNIDDVAGILVEKMVRRNPHVFAGETVEDLEEITANWERIKREEKARESVLDGVALSQPALALAAKVLQRAARGGVDVPLPAGDELGAGLLRLVAEARAAGHDPEAELRAAVLTYAEAVRAAEKVGPPE

SEQ ID NO: 10145 - protein, 236 aa, Actinoplanes utahensis
MLRTRRFASMAVIASLAVAGLSACRSEPSVAAYVGDTRITEKQVERIADEAQRARAGAGATPIPRSEVVRLLVARPLLDQLAARHQVTLPANLPYDQYAKLIGLPADNELLHLIVDNGTLQQAVSQKITGPATLSDDDLRDVYQRPEVQKALPPGTSLEQFRSVLSNADLKAGVQAGIGLRNELAEVAAPLHVTINPRYQPLELVTYTFQPSQTTNIGMVGAPLGDPAHLPVSDVS

SEQ ID NO: 10146 - protein, 1203 aa, Actinoplanes utahensis
MQLAGLIPAALRDRGLARARDLARKGFVDSDSMDLTAPVSLRPFVVATVAGPADAGGAQRPVLAVTATSREADDLADALGCLIEPGRVAVYPSWETLPHERLSPRSDTVGRRLAVLRRLAHPGDQPLQVVVAPVRSLLQPQLKGLGDLEPVELVTGREAELEGVARRLSDMAYARVDLVTKRGEFAVRGGILDVFPPTDEHPSRVEFWGDEVEEIRTFAVADQRTIEQVERLWAPPCRELLLTPAVREKAALLATRHPELAEILDRLAEGIPVEGMESLAPALLDGTDSMELLIDCMPAGTHVLLCDPERIRTRAHDLTRTSDEFLEASWAAAAVGGEAPIDVGAVAFKTLADVRAHAAVLHQPWWTLSPFGLATADEPAAALPWEDAGTVEVSPDTGDAVALAAQPVPLYHGDTERLAADLAGWSAAGWAVALVFEGKGTAQRATELLRDAGLGVTPVDSIATPIADGQLLVTCGGLNHGFVDEASRLAVITGNDISGGRGASTKDMRKMPARRRNTIDPLELKMGDFVVHEQHGIGRYIELVQRTVNGADREYLVIEYAASKRGQPGDRLYVPTDQLDQLSRYVGGEQPTLHKMGGADWQKSKARAKKAVKEIAAQLIQLYAARQASKGHSFGPDTPWQRELEDAFPYTETPDQMAAIIEVKHDMELQTPMDRLICGDVGYGKTEIAVRAAFKAVQDGKQVAVLVPTTLLAQQHYNTFTERMSQFPVQIRQLSRFQTPKEAALTLENAADGTADIVIGTHRLLSKSTRFKNLGLIIVDEEQRFGVEHKEQLKALRASVDVLTMSATPIPRTLEMAITGIREMSTIATPPEERHPVLTYVGAYDDKQVAAAIHRELLRDGQVFYLHNRVESIDRAARRLRELVPEARVAVAHGQMSEEQLEKVMVGFWEKEFDVLVCTTIVESGIDIPNANTLILERADLLGLAQLHQIRGRVGRGRERAYAYFLYPREKPLTEHAHERLATIAQHTELGAGMYVAMKDLEIRGAGNLLGGEQSGHIEGVGFDLYVRMVGEAVSAFKGERPEEEPEVKIDLPIDAHLPTDYIAVERLRLEMYRKLAEARDDARLDEVVAEMTDRYGEPPAAVVNLIAVARFRQLARAYGLTDVSMQGRHLRFAPLALPDSKQMRLKRYHPDSVYKPANDQVSVPRPQTRRVGGEPLRDQDLLQWCAQLLKDVLGDAPAPARV

SEQ ID NO: 10147 - protein, 551 aa, Actinoplanes utahensis
MRILLLVSAFNGLSQRVWCALRDAGHQVGVLLAGSEQQIADGVRAADPELILCPFLKDRVPAEVWQRRPTVILHPGPVGDRGPSSLDWAISEGARTWGVTALQAVEELDAGPIWASRTFDVPAAPPRKSALYTGPVSDAALECALEVVTKAADPSFSPVPASVAAPRPMMRQSDRSFDWGDATDAILRRIRAADGSPGVLTEVGGLPAYAYDAHRGAARGARPGALLSRRQGAVLVATGDGSLWIGHLRPAGPGGIKVPATTALGERLRGVPNSPLEAHAQPEAPAAYRQVRYRRTGAIGWLHFDFYNGAMAPGHCRRLLAALRHAAAQDTRVLVLRGGTEAFSNGIHLNVIEAAPDPAAAAWANIRAINQVCREIIGCTRQLVVAAYAGSAGAGGVMLGLGADVVAARDGIVLNPYYDIGLYGSELHTYTLPRRVGADRAQRLIDEKLPLSTAQAVRIGLIDEVGPRHPEAYSQWLTLLAERHSDARSARKRRAAKARRLAGERIPLDVYETRELAEMSRDIYTDRSGFAAARQAFVRKARPDGTPRRPS

SEQ ID NO: 10148 - protein, 40 aa, Actinoplanes utahensis
MLLAGNAGPALPGRQRTGNSGPAGERRAPITVRPAVPVSA

SEQ ID NO: 10149 - protein, 932 aa, Actinoplanes utahensis
MTELPAHLDEREGPDAELRADIRRIGTLLGQTLARQEGRPLLDLVEEIRALVRQDVPAAAERLAAMDITTGTKLARAFSTYFHLANITEQVHRARDLRRRRAKDGGWLDQAAKRIAERGVPADEIASAARRLAVRPVFTAHPTEASRRSILSKLRQVADSLDAESAAAALYGDTDTTQSTKRFAELIDLLWQTDELRLDRPDPTDEARNAVYYLKDLYAEAAPQVLDDLAETLRRLGVETAPTSRPLTFGSWIGGDRDGNPFVTPAVTAAVLLIQHEHGIQATEKVMDKLIEELSVSRRLRGVSLDLSASLAQDLDNLPEVADRFRRVNAEEPYRLKVRAIKAKLANTRSRLQHGTPHVAGRDYLGSDELIADLELMRASLARNSGQLPAVGVVATAIRQASAFGLQLATLDVREHAEKHHEVLQQMYTQVGEVEDYAALDRTERTKLLAAELTGRRPLSSADTPLTDSARKTFDVFNTIRESQERFGADVIETYIISMTLGVDDVLAAAVLAREAGLVDIHTGRARVNIVPLLETPAELDAGGDLLDEMLSLPAYRAIVRARGDVQEVMLGYSDSNKEAGITTSQWRIHKAQRSLRDVAARHGVRLRLFHGRGGTVGRGGGPTHEAILAQPYGTLDGAIKVTEQGEVISDKYTVPALARENLELTTAAVLQATLLHTTLSVDPVRLEVWDATMDTTSEAAFAAYRRLVENPDLPAYFWAATPTELLGALNIGSRPAKRPNADAGLGGLRAIPWVFGWTQTRQIVPGWFGVGTGLAAARKAGLGDVLTEMHDNWQFFRTFLSNVAMMLAKTDLSIARRYVETLVPEELHPIFATIEAEYDRTVQEVLAITGEPRILAAQPELSRTLGVRDTYLEPLHHLQVALLRQYRDLSDAARQMPTAPGARRGPSDSTALERALLTTVNGIAAGMRNTG

SEQ ID NO: 10150 - protein, 216 aa, Actinoplanes utahensis
MSQDPRLQRAAELFHAATFNGDPDAVPAATEQLDSLEAALALARGRVLHAAFLRDRREDPRELVAFERAAELYASLGDDHALAEAEFWLGCFLQVVRQDGDAAHPHLQRSAALARATDNRLTLSYAVRHLGFAAGMAGDHATARLLLEESVALRRELDFPAGVAAGLVALADLAYRDGRSDEAERLLDEATAVAAKCGAIGVLGWADNTREENTRP

SEQ ID NO: 10151 - protein, 275 aa, Actinoplanes utahensis
MAVHPGPRSLRNRVELGPGVTCPRLGDRVVALTNEGGLAEVATADAALTASVPAGLNLADAVIAPGVLTTAVLLHDHLARVRAADVVLVHSAAGAIGRAFADVVRATSGARLIGVVGAPSRIEAAHRAGYPDVLVRGDTFAAQVHAELSDRGVDVVLDPQGTAFLDQDLELLAPSGRIILFGNASGAQLGALPATASLYARNASIGGFSLAALSARAPHMVTSALRVALDLLTAGQASTEVTVLHGLEAAANAQQALAEGTGTGKYIVGLLELQR

SEQ ID NO: 10152 - protein, 114 aa, Actinoplanes utahensis
MTVEREVMPVTPRPPLVHPDIDDVELVAVLHALADPTRLTIVRTLRGERERACGTFPVRVAPSTLSHHFRVLREAGVIRQREDGNRRWAMLRLAELDARFPSLIDIVLASATRG

SEQ ID NO: 10153 - protein, 236 aa, Actinoplanes utahensis
MSTVALITARGLFGRRRALLLLPLPLLLIGLAALCRANDLDVTNWGSPVVIGLGFGVVLPVIALIVGTGVLGSEVDDGTLVHILTKPLARREIILAKFVVAVLATAVTSAIPLYLTGLLANSAKLGAALALAAVVGSFAYTALFLLLSLLTRRPVLLGLVYILIWENLLGKFLSGTRVLSIQQYVITIAHKMQPATFLDPKVSVTTAAVMSAIFVVVCTVLAINRLGSFSLAGETS

SEQ ID NO: 10154 - protein, 321 aa, Actinoplanes utahensis
MTLETQPTAPAAPAAAATPGVVDLQGVSRWYGNVVAVNDITMSLGSGVTGLLGPNGAGKTTILHMMAGFLAPSKGTVTIDGTPTWRNPGVYRDLGLVTEREAVHSFLTAEQFVLACAKMQKLRDPAGAARRALELVEMTDAANRRIGTFSKGMRQRTRVAAALVHEPRVLLLDEPFNGMDPRQRMHMMQLLHSLGDTGHTILFSSHILEEVEQVAGLVQVIVAGRLAASGDYRKIRRLMTNRPHVFAVRSSDDRRLAVALIAEKSVAGIEIENGGLTVRASDYGDFTRNLPRIALDEGIRLHQLVPSDESLESVFSYLLEA

SEQ ID NO: 10155 - protein, 286 aa, Actinoplanes utahensis
MSETGVIHDIGYQRYSGPRLGRSAGIGALYVHGLRAAFGFGRSAKAKIFPWMVAGVALLFAIIIAAVKSQVTEFSFGYADLDDQLSWMIIFFVAILAPALVSRDIRSGTLPLYFSRPLRAADYVLAKFLAMVTAVWLLLGVPQLIMFLGSAFTTKKGMSGVWHEVLKLLPGWGYSLLWALLFTSIGLLIASFTGKQAFAAGGIVAVFLMTTPVVGVLANLPSSNARQLAFLASPNTLIAGVGHWLFDTSIDFDLGRFGPIYGIEALCLIAACLLLLLARYRKVAAL

SEQ ID NO: 10156 - protein, 304 aa, Actinoplanes utahensis
MNIIATQALTKTYGGGVTALSDLTVSVEPGVIGLVGANGAGKSTFIKIMLGLITPSAGSVRVFDIDPVVDTDKVRARVGYMPENDCLPPDVSAAEFVTHLGRMSGLPRTAARERASEALRHVGLYEERYRQIGGYSTGMKQRVKLAQALVHDPDLLLLDEPTNGLDPAGRDAMLALIHRIGTEFGISVVVCSHLLGEVERICDSLIAIQGGRLLRADRISSMTAASDVLAVEVTEGTDQLAARLTEAGLRVTRENRMLLVPMDSDEAYDRILRAVTDLELNLHRLDQRRHRVAELFTAKETADV

SEQ ID NO: 10157 - protein, 408 aa, Actinoplanes utahensis
MRQTLRSAAFGTAFTMAVAVTLAWAWTGGVEQLGRLPAGDPVVSAAPAGPHPGTTAGTAADPAPPGSARLRQAVLSGADSPLTGSFPARAAVHRTCTTGRLLVPTCGILWGVAPGARTDDHGAEALAEFERKTGRQQAIFHAYHHGIRQLFPTPQEIAIARQPGKKRILLLNWKPESASWAAIARGDRRTDAFLDQLAVHLHRDFREPFFFAIHHEAEDQVRERPGSGYTAKDYAAMFRHVVRRLRAHGATNVVTVLVHMAYVPHTTKSWFTDMYPGDSVVDWIGFDTYSYSDPGYGHGDFAELLNRRSALKPRWPGFYNWVRAAHPRKPLMVAEWGVWFSKRHPGHMAAFYREVGQQIGHFPAIKAMVHFETPANQKGQDSSVDCTPAALREYRKLGRLPVFQVAVR

SEQ ID NO: 10158 - protein, 506 aa, Actinoplanes utahensis
MSGSVLPEDVLRDAPSFAPRPYELADLELLLSGAYAPLTGFLVRADLVALARTGRLADGTPWPVAVTLEIPLDLAERLNPADPARRTVVLTDLEGAPIAAIEARDVWRIADNRYGVGGPVQRMGDGGHGPFQRLRRSPAEVKALLPPGRVLGVIADRPLHRPQLAQIAHAARTLAAHLLIMIPVSGHGPDGLPPEALVRAVFAARDRMPPATVVAVPLMPHGDEMRDALLRSRVAAAYGVTHVLSTGESLSGAGLRVLVPRELAYDNRDGQWRWRDDIPPRNRRLAMTPDEIDDLLDRGFPLPEWHTPPAVAKELARVRPPRRHRGLVLFFTGLSGSGKSTIARNLADALRETGERTVTLLDGDVVRRELTAGLGFSKADRDRNVRRIGWVAAEVGRHRGMAVACPIAPYEAARTAVRRMAAEAGAGFLLVHVATPLEVCERRDRKGLYARARAGQLRGMTGIDDPYEEPLDAELTIDTSTMSVAEAVEMVLGYLVENGWVEPKLS

SEQ ID NO: 10159 - protein, 615 aa, Actinoplanes utahensis
MRGGFTNPARHGVELTHHSRLGVGVSPWGETPKILLERPRKPMEASRPPSSDVAHYLGAVRRHWWIALVATAAGLGVGAAVTHSLPRVYESSSSVLVQSVDQDVNAQGGRTKGAVNLDTEAQLVGSGAVAAKAAALMRTTVSPLELAHSVSVQVPANTTVLVITFQADTPMKAQAGSHAFAEAYLRNREETARGLLDKQIASLNLKVKQLTTALTGINAKLADARPGSSAESNLQSLRSNSQNQLNSLTGRLNELTTTTVGAGAIISDARLPDTPSSPNTLLDIATGGMIGLLLGLALAYLRERFDRRLVTAADVRDRGRVAVLATLDERTTPHFDDVLQPYGPGGRVFNRLRNEVLASLDPHDRVIVVTGTSRGSASTLVAANLAAALARTGSDVVLIGAHLPDSVVDAAPLARMLGVAPVPGLSEMLAGRVSLSRVLQHTARIPALRVITTGGAATAAGLIQSQRLRDTLEALRRQGGYVVIEAPSTSSSADAQSLASLADAAILAVELRRTRRPALVDATEQLQRVGTRLLGAVVLPRLNVKHTAEPAAAPAVTLPPTGTEPVVEEATQQLSALKDRGEPVSATVRQRPADGDTGEQTSVVEGSGATDGDEK

SEQ ID NO: 10160 - protein, 457 aa, Actinoplanes utahensis
MITVVPAAPPAGPAQHRAGKDLSLPAWPVTGILLLYPLWWALGLGVLIFPLVAAPMLFLLIRRRAAGRPLRLPPGFTWWVVFLVAVVVSIAALGADPAQTVVERAVGRLPAVLYKLAMYLSLTVLLVYAGNLTERELPRRRMVRLLAGMFVLTVLGGLLGMVAGHFEFTSPVEWLLPQGVRSKGFVRSLVHPYAAQIMDIVGGDAPRPAAPWGYTNTWGNNFCLLVPWLLVAAAAARSRGRRAVLWVFLLVSIVPAVVSLNRGLWIGLGIIGGYAAVRYVLAGKLWVLGVLLVAGGALAVALAATPLGTTVQARLDNGKSNGVRSFLIERAMAGFTGSPVIGYGGTRNTLGGRNSITVGESSECERCGNFTIGGNGQLWQLLYSHGAVGTAGYLGFFAYGLWRFRRDRTPIGVAGSAALVSSFSAMLWYNSLVTPLAFMVLAYALLWRNWIEGNDDN

SEQ ID NO: 10161 - protein, 412 aa, Actinoplanes utahensis
MSPVKTAPAELTAGDAALRTQYLTEVMALLYPPPCRPAREDDGAGNTIVEYLVVPNAHRPRLLVPNTSAAVAAAAVRRYAEPQSRMARFKRDAVVAAVRTRTDRLVFRDRIRVSGPVSASIDGYLSDALRRDLSVSVHIGPARANRKPVLQLLTPDGETFAFGKIGAGPLTQRLVKAETAALNAIGSSGLTKLTIPRVMHAGQWRGMQVLVQSALPVWLPRAPLTPRRLTAAMLDIAGCCGYTTGPLTQSSYWHELRARLAAVSDRAEGAALSAAVDLLAAHSGEHTLRYGAWHGDWAPWNMANLTDALLVWDWERFATGVPLGFDAVHHELQRRIQTSGDARGAVEATVRRADELLAPFGVAAVARETTALLYLVDLAVRYLTDRQAEAGARLGVLGTWLLPVLIRRVEEL

SEQ ID NO: 10162 - protein, 292 aa, Actinoplanes utahensis
MNVRNLPAPMKAVVHLGSRSYGRLTADHRMLPSFLICGGQRCGTTSLYRALAAHPVVLKAVLHKGVHYFDTSYHRGLDWYRAHFPARRAAEKIAERFGVPAQTFESSPYYMYHPQAVARIARDLPYARIVVLVRDPVERAYSQHHHEVARGFETERDFGAAMALEPARLHRQEERLADDPAYYSFAHQHHAYRGRGEYARYLSVMAQHVGRERIHVVESERFFSDPEPVYDEVCHFLGLPPHLERPAFERHNARPRQADMDPQLRRELGAYYQSHDEALAGWLGHTPIWRRG

SEQ ID NO: 10163 - protein, 518 aa, Actinoplanes utahensis
MTAGPLTDPAPPRADPGRGTRGAARGGLANMAGSALAGGAGVIVTWVVARRLGTDEAGAFFSATAAFVLAGGLAKLGTNTGLVYWPARLRATGRAHLLGTCLRTGLVPVFVFSLILAVAVWAGAPQIARVTAHDSAGAYLTGLRVLAVFIPLQALTDVLLTITRGYRSMRPTVLLDRTLRSALQLLGVGAAGLLAAASLPVFALAWAAPYLPVTLFAAYAVRRLYLTGRPAAAASRRAERRQLHREFWRFTAPRALAAVAQLALQRVDVLLVAALGGLGPAAVYAVAGRFVILIQFANQGISQSVQPRLAEALSIGDRDAANRLYQVATGWLVLITWPVSLLVILFAPYYLRVFGAGYTAGTPVVRLLAAAMLVATGCGMVDMVLSMAGRTSLNLGNVLIALVVTIGLDVVLIPRYGAMGAAVGLAGAIVANNLLPLIQVFRGARLHPFGPGTRAAALLSTGCFGLLPRAVTALLGDGPAGLAPAVAAAVPAFAAGAWLLRGRLELGAFTRRKTQEAS

SEQ ID NO: 10164 - protein, 245 aa, Actinoplanes utahensis
MTSDYTEVFQDTEAVEKYESITYAPDSYASRINDRQRDYLRALVRREFEGQHPPVQHDFACGTGRAIRTLHGLVREAHGYDTSAEMMTKAAEVGSRAYWHRVSIDGPVPAPVAAGFPAIVTIFRLLLNVDDTVRDRALAFAAKALPHRGSGLLVVENHGNAGSVRHLRARRHQGERWFAELSHEEVAALLDRHGFEIVERRGFSMLTPSLHDNRLARLADAAARRLPGTDGYAVNVLYTARRVHA

SEQ ID NO: 10165 - protein, 335 aa, Actinoplanes utahensis
MRRAGLGGVLVGVLLILSACSGSHRGNPAPPPSPDLTARPPAIAVQDGPFAAGPFTPPATGAYVGAWIKPDQLTHIGRLEAVDTLEASLGRRLDILNTYRRFDQMVGTESDQEFLAQGQSLMISWATGDNRSILDGEHDRLIRQQAEAIRRIGRPVLLRMRWEMDRPNLRATMWSGADYIAAWKYVRAIFQREHADNVSWVWCPTAEGFQRGDAQQFYPGDDQVDWTCVDVYAGADFQPIGQLMGPFLQWAAQRPKPIIIGEFGVAKAWGSANRAAWLRDAERTFKANRQIKAVAYFESDPTGNGPNQQFQLSGDKAAFKAFHALAKDPYFNVGR

SEQ ID NO: 10166 - protein, 124 aa, Actinoplanes utahensis
MTFRIDDLHHVQLLIPPGGEPVARAFYSGVLGMAEIVKPPVLAARGGCWFRAGGWEVHLSPVPDFAPATKAHPGVLVRDLDALAEVLTSAGHPVERDPHFPGHHRLYSADGHGNRLEFLEPIRS

SEQ ID NO: 10167 - protein, 179 aa, Actinoplanes utahensis
MSDFFREQTEIIQQFGWAVVHVVPTDEEAADDVAPFAYTVGLTADSHPELIIAGLPPDLAHQLLNELAGRVHEEGARFRHGRRVTDLIVEQDVVLLNGSPTAELWPGAALARYGRRVRLQQLVWPDPGNRFPWQAGYSDADHAQPLIDAPPATMVRCGSPRGLAGPRGRRSVTRRGPIP

SEQ ID NO: 10168 - protein, 407 aa, Actinoplanes utahensis
MVIEAFDRVHLGGTGIDRITEDEVVAVVRDALSHGRGGRIITPNVDILRRAAEDPAARRHLDDADLIVADGMPLIWASRLGGVPLPERVAGSSLIWTLSEGLGRDTRSIFILGGTPTPRTLHALPGPASSSPDRALAALRDPASFTTPDRASAAPGDRSFSATPDRASSTAPGRPFAVLCDRAPSGAPDRDFSAPGTAAAPATETLVWNSLSGETWTANVPVAESVTRRPPAAPTSGDIVPADPAAEAPIVGGRGSAPATGVTVRDVRASGAVRAAVRLATANPGLRIAGALSPPFGFDDDENTYAEVCARVTAAQPDLVFVGLGFPRQEQVIERLRRDLPATWFVGCGAAINFVAGDIHRAPRWMQRTGLEWAHRLTTEPRRLARRYLRHDAPYALRLLARARLAS

SEQ ID NO: 10169 - protein, 310 aa, Actinoplanes utahensis
MAQVLFLGGLGRSGTTLVERLLGELPGVCALGEVVHLWQRDLRDDERCGCGERFSGCDFWKRVGKHAFDGWNNVDVDRVHALRDAVERTRHIPRLAATTHPGAAVREYAGYYAKVYAAAAEVSGADLVVDSSKHSALAHVLRAAGQVDLRVLHVVRDARGVAYSWTKRVARPETDGAQEMTRYSPGRSALLWNAHNAAFGLLARRGVPVRRIRYEEFLADPRAALIRLADFAGLTLHPEDLDFLRPGHADLRAGHSAAGNPMRFTVGRLPLRHDDAWVRALPTVQRRLVGAVCAPMLRAYGYPLNPQESR

SEQ ID NO: 10170 - protein, 304 aa, Actinoplanes utahensis
MNWPSVGVVIPTRNRPELVRRSIAAVRAQKYPGELRVVVVYDQTEPDYLLAQTDGVPVLVLTNWRAAGLAGARNTGVLALDTELVAFCDDDDRWLPDKLRRQVAALLAEPDAEFATCAIEVEFEGHTTPRLAGRSRVTVDDLARSRMAMLHSSSFLIRREALAEDAVGLVAEDAPGSQNEDWDLLLRAARRSPIVHLDEPLVQVLWGRSSHYAYEYATKISSLRWMMQRHPEISGCRPGAARVYGQLACWSAATGNRSQAWQFSKEAVRANWKEPRTAIALAAMTGAVKVENVLSALHKRGRGI

SEQ ID NO: 10171 - protein, 258 aa, Actinoplanes utahensis
MLAQQRQAAILDRVRATGGVRVSELATEYGVSDMTIRRDLEALADRGLLAKVHGGATTVSPGSAHEPGFAAKSVRQRDEKAAIAARGAALVSPGDAIALSAGTTTAVLAQRLVDVPSLTVVTNSIPVADVFYRAGRPDQTVVLTGGTRTPSDALVGPVAVAAIGTLHLDMLFLGVHGMSERAGYTTPNLMEADVNRALVEAAERLVVLADSTKWGTVGISSIVPLERADVLITDDGLDTATRTLLTETVPELVVVNPQ

SEQ ID NO: 10172 - protein, 364 aa, Actinoplanes utahensis
MTFFRSTVALSDGRELIYFDEKADSSRSAFPDTRELPPPPPASQLRYDPLVDEWVAVAAHRQTRTFLPPSDACPLCPSSSRFASEVPAPDYDVVVFENQFPSFSYREVPGGDITELTDMVPVKPGLGRCEVVCFTSDHNSSFGALPPARVRTVIDALADRTTEMSALPGVAQVFPFENRGVEIGVTLHHPHGQIYAYPMVPPRTAAMLRAAAKHAERTGGRNLYADVLAAEQEAKVRVVAANELWTAYVPAAARWPFEVQIAPHRQVPDLPALTDEERDALAPLYLDVLRRFDGLFGKPMPYISAWHQAVVGEGRDLGYLHLQIFSIRRAADKLKFLAGSESAMGAFVSDVVPEKAAQLLRDAG

SEQ ID NO: 10173 - protein, 404 aa, Actinoplanes utahensis
MAKIKVKNPVVEIDGDEMTRIIWKQIREQLIQPYLDVNLEYYDLGIQYRDETDDQVTIDAANAIKRHGVGVKCATITPDEARVQEFGLKKMWRSPNGTIRNILGGVVFREPIIMKNVPRLVPGWTKPIVIGRHAHGDQYKASDFVAPSKGKMTVTFTPEDGSAPIEMHVADFPAGGVGMAMYNFDESIRDFARASLRYGLARNYPVYLSTKNTILKAYDGRFKDLFAEIFETEFADQFKEAGITYEHRLIDDMVAAALKWEGGYVWACKNYDGDVQSDTVAQGFGSLGLMTSVLMTPDGQTVEAEAAHGTVTRHYRQWQKGEKTSTNPIASIFAWTGGLKHRGKLDGTPEVTQFAEALEQVCIETVEGGQMTKDLALLISKDAPWLSTDEFMNALDENLARKLA

SEQ ID NO: 10174 - protein, 199 aa, Actinoplanes utahensis
MNEARHVAGERFSGADWALDERERVHFEDCVFHDVDWSESTFTACTFERCEFGNCRFNAAVFERTALLQSTLRRCSFFGTTFDDCKLTGSTFDDCGLRPLTVHGGDWGFVSLQGQNLSGVRFGAVRLREADLSGADLTRTDLRGADLSNVRLAGAVLKGADLRGADLDGAPLRGVDVTGAKLNLAQAVHFTRAYGAIVS

SEQ ID NO: 10175 - protein, 227 aa, Actinoplanes utahensis
MVSDAELIEKRDFSRVKSIGSHRTLAGFHLVRCEFDGSSLAQFDDPGLNLVVRDARLTRCVCRQSSIQGVRLEDVLVDGVTMSGSLNLHGCALRHVTLRGRVGRWFIMPPNPSLPAEVREAFMIAIQRFYRDVDWALDISAAEFTSAQLHYVPGELVRRDPETQFLLRRHVVEAVDPAELPSFGSIAVSRFETTPLDCIVAAAPKRSSNFAEILDHLQQMRNRGLAE

SEQ ID NO: 10176 - protein, 519 aa, Actinoplanes utahensis
MSTDEGRRPIKRALLSVWDKAGIVELAQALHAAGVEIVSTGSTASTVEKSGVPVTRVEDLTGFPEILSDRVKTLHPKVHAGLLADLRLESHAAELAEHGIEPFDLLVSSLYPFSETVASGAGEEECIAKIDIGGPAMVRAAAKNHASVAVVVSTAGYPSILSALRDGGFTLNQRKALASTAFINIAEYDIAVANWTASTLAPADWPDFAGIALRKQDTLRYGENPHQQAALYLDPAAPAGLAQAEQLHGKEMSYNNYVDADAAWRSANDFTEPAVAIIKHANPCGVAIGADVAEAHRKAHECDPVSAFGGVIAVNQEVSAELARQVAEIFTEVIVAPAFAPEALEILREKKNLRILVAPAWNPPPAEVKQVGGGMLVQAADRIDATGDDPSGWTLATGAPASPEVLRDLVFAWRAIRGVKSNAILLAKDGAAVGIGMGQVNRVDSAKLSVARAGAERAAGSVASSDAYFPFPDGLEVLIEAGVKAVVQPGGSIRDNLVIEAAEKAGLTVYFTGTRHFFH

SEQ ID NO: 10177 - protein, 205 aa, Actinoplanes utahensis
MTAPAPARLVVLISGSGSNLQALLEATRDPAYGAEVVAVGADRDGIAGLDHAAAAGVPTFVDAVKAYPTRDDWDAALTAHVAAHRPDLVISAGFLKLVGKQFLDAFGDRYINTHNALLPSFPGIHGPRDALAYGVKLAGATLFFVDAGVDTGPIIAQVSVPVLDDDTEETLTERIKVAERAQLVDFVGRLVREGWTIENRKVRIP

SEQ ID NO: 10178 - protein, 479 aa, Actinoplanes utahensis
MPSTTDRPGGSEDPFAVAEALQSVVRDTEAPPIDADQRDEPTPGTRDTVVVDEAMLGRRETVRVPVQRRPPDRAGRAPLPVAVAFATIWAALLSYLPVAAALGLARTLEGQGGLAGAAKAGAAAWLLGHGVPIGTSIGSLGLAPLLLTVLVLWRLGRAGLHVTRAIGARHSGGVGAALLVAACVGGTYAAIGALTAHLIDGRGTDVSTARAASDFLALGVAGALIGALRGSDAVTTLARRVPVVVRHGVRTGLVAAFLMVGAGAAVGGLSVALGGGDAAKIISAYHTGVAGQAGITLVSVAYAGNAAIWSTAYLLGPGFALGTGSVIRLTQLTVHDLPTLPLLAGLPNGPVGGAGALLLALPVIAGAVAGWVLTQRLRYGRAHAWRPGPGSGADAPEPAWSLLLGAGLLAGPVAGVVLGVLAALSGGPVGDGRLAQIGPAAWSVGLVAAIVAAISVILGASAARIFREPRPKRRPNGRR

SEQ ID NO: 10179 - protein, 293 aa, Actinoplanes utahensis
MAIWLTKDSKVIVQGITGSEGSKHTRRMLAAGTNVVGGVNPRKAGTKVDFDGTELPVFATVAEAIKETGADVSVIFVPPAFTKAAVVEAIDAEIPLAVVITEGVPVQDSAAFWAYNVSKGEKTRIIGPNCPGIASPGASNAGIIPADITPQGRIGLVSKSGTLTYQLMYELRDFGFSTAVGIGGDPVIGTTHIDALKAFQDDPDTDAIVMIGEIGGDAEERAAEFIKANVTKPVVGYIAGFTAPPGKTMGHAGAIISGSAGTADAKKAALEAAGVKVGKTPSETARLMREIMS

SEQ ID NO: 10180 - protein, 430 aa, Actinoplanes utahensis
MADDSSRWRRHCDAPRIQQVGTQRCGLPALGVASERRHVDLFEYQGRDLFERHGLPVLGGGVAETPQEARAIAERLGGKVVVKAQVKVGGRGKAGGVKLADGADEAEARATDILGMDIKGHTVHKVMLAETADIKEEYYFSYLLDRANRTFLCIASVAGGMEIETVAEEDPERVAKVAIDASKGVDEAKAREIVTAAKFPADVADQVVDIAVKLWQAFVAEDALLVEVNPLAKVGDGRVLALDAKVTLDENAGFRHPDHEALEDKSAVDPIEQAAKAKNLNYVKLDGEVGIIGNGAGLVMSTLDVVAYAGEKHGNVKPANFLDIGGGASAQVMANGLEIVLGDPAVKSVFVNVFGGITACDAVANGIIQALALLAERGETVTKPLVVRLDGNNAEAGRAILDGANNPLVERVDTMDGAAARAAELAAAGK

SEQ ID NO: 10181 - protein, 137 aa, Actinoplanes utahensis
MQARIRVVVAKPGLDGHDRGAKVVARALRDAGMEVVYTGLHQTPEQIVETAIQEDADAVGLSVLSGAHMTLFRRVVELLAERDAADIVVFGGGIIPEDDITELESLGVAKVFTPGATTASIIEWVRANVGTQPAGQL

SEQ ID NO: 10182 - protein, 250 aa, Actinoplanes utahensis
MRQRLSSEPDRYRGRRRVPTPPRSRYAAVGAAAFVGAGIVAIGAASNLPDSKTVNPDVLSSLDQAQTQVAADALQNRAGTHASRSENRDAAAKATTKLSDDEVADAYLLPLDDYEFTAPFGVRFGKLHAGIDLAAPDGTPYKAIHAGEVTAAGYNGGYGYSITVKQSDGTEVIYAHSRRLLVKKGDTVKAGQVIGEVGNTGYSYGTHLHLEIHVGGTPVDPISFLKPHGVDIQLQLESVYAAQAASLAAS

SEQ ID NO: 10183 - protein, 265 aa, Actinoplanes utahensis
MGQTATPGSTGRHRQERLHRHRAPAFPALFATRGRSAVSLTALTATLATGIGVAGAAASAAPVHQHATSGGHTAAHPYAALPIVPPPGDDAPAKTHPELQHTGDEVSVGRPAPDPVKRAEKPVAVAAATGTWVDPNPTARVTSCFGERWGRLHAGVDLAAPDGTPIVAAGAGVVVRAGVAEGYGNAVLIDHGNGWLTHYGHLSRITVAVGQVVRAGEQIGNEGSTGHSTGPHLHFEVHEGYYKNPVEPTAWMHRHGVDIAGCDTF

SEQ ID NO: 10184 - protein, 757 aa, Actinoplanes utahensis
MTHAGGPLLIVAGAGSGKTRVLTHRIAYLLAARDVHPGEIIAITFTNKAAGEMKERVAHLIGPRARLMWVSTFHSACVRILRAEHEHAGLKSTFSIYDADDSRRLMQMVARELDLDPKRYTARGLAAQVSNLKNELVDPEEFKAKAKGPNERAVAEAYELYQRRLKEAHALDFDDIIMATVHLFQSHPLVAEAYRRRFRHVLVDEYQDTNVAQYMLIRELVGRDDQDPSELCVVGDADQSIYAFRGATIRNILEFERDYPSARTILLEQNYRSTQTILSAANAVIDRNTSRKPKRLWSDQGAGEQIVGYVADTEHAEADWVAREIDRLSDRHEVRPGDVAVFYRTNNQSRVFEEVFIRVGLPYKVVGGVRFYERKEVRDALAYLRAIVNEDDTVSIRRVLNTPKRGIGDRAEACVEALSNRDRISFGQALRHARTAPGISTRAANSIADFVQILDDLREMSLTEAPEAVLEAVLQRSGLLTELEESLDPQDQGRVENLQELVSVAREYTERVETQAGEDDPEAPVASLAGFLEQVALVADADQIPSDDPDHQGVVTLMTLHTAKGLEFPVVFLTGLEDGVFPHMRAMSDNSELEEERRLAYVGITRARQRLYLSRAVTRSAWGQPQYNPPSRFTDELPAELVRWERTGGSYTSWSGTGGGVGGRGGGDRQRGGGFAGGTPKAQRIAERLGIDASRLSTASELKQAPKVEAGDRVNHQRYGLGRVVAVEGHGPGARAQIDFGDQVMWLILRHAPIEKI

SEQ ID NO: 10185 - protein, 613 aa, Actinoplanes utahensis
MTSPLRRRVAVPAVALAVVGALSTAPAQSAAAAPPAEFVPVSASYGASPGTPVVKGRILSYNDFHGAIDPPTGGGAVVNAGGTSTPAGGVEHLATYLKRLRAEAAAQGRQTITAGAGDLIGASPLVSAAFHDEPTIELMNTVGLQVSSVGNHEFDEGVAELIRMQRGGCHPVDGCQDGDGFGGAKFHYLAANTIDNRTGLPILPPIDIKYVGGVPVGFIGLTLEGTAGIVNPAGIKNVHFTDEIVTANRWSNILKLFGVKAQVLLLHEGGAQATVTPTAGVSDCTGFTGAVVPIVAGLNPDISIVVSGHTHRFYSCKLPNKAGTDTVVTSAGTNGQLITDIDYSLDKRTGKFTEITAKNVIVENGVPDGNGGWKKDATGVYLKNPDTVDPAAKKVADKYRVAVAPLANKVIGTISGDIPRSNNAAGESPLGDVIADAQLTYTTAATAQIALMNPGGIRADLDADQSSGGEAYGQVTYGEAFTVQPFNNLVTTEPLTGAQLKEALEQQFAGYAKQTTTKILQVSAGFTYTWSASAPLGSKVSNLALNGTPIDPAATYRVTMNNFLANGGDGFTNLVVDPAKVVTAPGFDIDALTAYLATGTVQPGPANRITTTP

SEQ ID NO: 10186 - protein, 145 aa, Actinoplanes utahensis
MTADVMNPSTDAARPTTPPSTDAARPTTPPTPDAAPPASTPAAATDKAAAAAIALDASTGAGRPLAADEIRALRERIDEIDQAIIDLWQERSRLSQEVGKTRMASGGTRLVLAREREIVDRFRAALGPDGTQVALLLLRSGRGPL

SEQ ID NO: 10187 - protein, 335 aa, Actinoplanes utahensis
MSDVVLEAKGLVKHFPITQGIVFKSKVGAVRAVDGVDLHLRRGETLGVVGESGCGKSTLAKLLVGLETPTAGSINVRGEDMVRLKGAALRRARRNIQMVLQDPYTSLNPRMTVGDIIGEPFEIHPDVVPKGGRQRAVQDLLDTVGLNPDHINRYPHQFSGGQRQRIGIARALALKPEIIVCDEPVSALDVSIQAQVINLLERLQNEFGLSYIFIAHDLSVVRHISDRVAVMYLGKVIETGHDQAIYEQPTHPYTQALLSAVPVPDPRLRGHRDQIVLEGDVPSPANPPSGCRFRTRCWKAQDICAQQEPLLQIRERSPHPSACHFAEIRDVVRGR

SEQ ID NO: 10188 - protein, 345 aa, Actinoplanes utahensis
MTDIKAQMDVLPGVDPRAPLLEVNDLHVEFRTNYGVAKAVNGANFWLSPGETLAILGESGCGKSVTAQAIMGILDTPPGYVTQGQIKYRGVDLQKLPEDQRRKVRANRIAMIFQDALSALNPVYTVGFQLGELFRKHRGISRAEAKRRSIDLLDQVKIPGARTRVDDYPHQFSGGMRQRVMIAMALALDPEVLIADEPTTALDVTVQAQIMGLLADLQRQRNMGLILITHDMGVVADVADRISVMYAGKVVEEAPVYDIYARPAHPYTKALLESIPRLDMKGQQLSVIRGLPPALTDVPKGCAFNPRCAYARDACRQDPPPPPYQVSVQPHRTARCHFFREVIGE

SEQ ID NO: 10189 - protein, 312 aa, Actinoplanes utahensis
MSDLNTVTAAEAPGGQPNVPHGPVKKDKPRSLAADAWDDLRKRKIFWVAVVLVVAILVMAAFPTLFTSADPRYCVLPNQFKGPRSGAPFGFDFQGCNVYAKTVYGARNSIIVGVLSTLLAGVIGLVFGLATGYYGGWVDAILSRFVDIMLGVPFLLAGIVLSRRLSAGAGSDGIMAVTLTLGLLAWTSGARVMRSAVISSKNQDYVAAARMLGATPGRLVFRHILPNSIASYIVLLTLLLGINISSEATLSFLGVGLKGSAISWGIMISDASGFARIEPWPLVWPAAFLGVTVLAFIMLGDAVRDAFDPKLR

SEQ ID NO: 10190 - protein, 308 aa, Actinoplanes utahensis
MFRYIVRRLLQMVLTFFGSTFLLFALVFANQTDPIQALVGERPITASQRLALTQRYHLDEGFFGQYWYYIKGLLTGDLGMSLTGRKISQMMADAWPVTLRLAVIAIVMAAVFSITAGVYSAIKRGGIFDNSSLLLTLILLAMPIVVIAPLFQLVFAMQLHWFTATATRDATFTQLLLPAIVLACIVVAPEMRVTRTSVVENLRADYVRTARAKGLTRMRVIWVHVLRNSLIPVITLIGVDLGTLMAGAIVTEHVFNIPGVGFNLARAIRTEDGPLVVGFVSILVILFLFINLLVDLLYAALDPRIRYE

SEQ ID NO: 10191 - protein, 544 aa, Actinoplanes utahensis
MPGKSPWKMAVGATAIALLAAGCGGGGSDDQSTTSNTVVIGISEPEHLIPSNTTDSSGSEVLQSLFTPLVKFDDKNEPTLVAAESITPDKTNTTWTVKLKSGYTFSNGEPVTSDNYINAWNYGAYGPNGQNASSFFQHIAGYGDLQSVDPDGAGPKKAPDPKAKTLTGLKKVDDSTFTITLDAPFAGWETVMAYDCFLPLPKAAWASEGKLADGFEDALIGNGPFKLKGKWEHDSQLVVEKVADYKGAVPKIDGITWKVYQDLNAEYADLTDGHVDVQTTIPIESLAKASADLGDRFKKSPMSGFGYIGFPTFEKEFSDVRVRQALSMAINRQEISDQIFLGSRVPATSFVSPVVPGYRDNTCGENCTYNPTKAKELYTAANGPKDIKITYNADGGHKPWIDALCNQIKASLGVNCTGVGEPKFADLLKKAEAKTPIGLIRLGWVMDYPLMEDYLGPLYSTGGSSNYYGYSNPTFDNLVKEGSAAPTTDDAVKKWQAAEDILGKDLPVMPIYTQQNVFGHSEKVSNVNVDLYSRVDLSKIEVVK

SEQ ID NO: 10192 - protein, 221 aa, Actinoplanes utahensis
MTEPVTQSAGRLTVFLVDDHAMFRAGVRAELGRHVEVVGEASTVAEAISRIGQIQPDVVLLDVHMPDGGGRAVLESVRRTHPQVKFLALSVSDAAEDVIGLIRAGARGYVTKTISPDELAAAVRRVADGDAVFSPRLAGFVLDAFASRPDVPVADPELDQLTNREREVLRLLARGYAYKEIAKELFISIKTVETHVSNVLRKLQMSNRYELSRWAADRRLV

SEQ ID NO: 10193 - protein, 432 aa, Actinoplanes utahensis
MARACRTCDDRGVTATAAPPPIRRLYRPREHRIVAGVAAGLARHLGVPVLAVRISLVVLLGFNALGLLLYAAYWAVLPQEARLDEKPARRDLGALLPFAAIGLGVVLLQTLVFGDQVGTTVGWMIAVVAVGAGVIWHQSDPSRREQWADANAPSGWMAAIIGETDRRSFMLRFVGGGVLVAVGVIGVVAIYSPADSLSSVFNGMIFALVGLLGVGVVVAPLVWRTFGQLRAEREGRIREQERAEVAAMIHDQVLHTLALIQRNSADIKEVQRLARGQERSLRNWLYKPTASPTERFSAALEQAAAEVEDTYAISVETVVVGDTQCDEKVAALVAAAREALVNAARHAGVQTVSLYAEVEPDELSVFVRDRGAGFDLGGVAETRHGVRGSIIGRMQRHGGRAEIRSAPGNGTEVRLTLPVSRESVTAGKESSR

SEQ ID NO: 10194 - protein, 457 aa, Actinoplanes utahensis
MNDEAAEPRTPGTGPEGGPAPSATTPPQANVPPWLTAAQAAFARQQLVRPREGRYIAGVCGALARRTGTDPVLWRVLLAVLGVLGGAGVLFYLIGWLVIPSEGDTASPVESLLGKGHSGMSPLSVVVLGGAALLTFSFVVSDGARASMLAAAVLVGAFLLIKRGAPAGTFAAPPAPAGPPASPGAEEPTMAFTSPTPAAPAGEPVTPPAPAAYEPPRWTPPTESGYRPPFAPHGPFASAGAYPPPAPATPPPPKPPKPPKQRSILGRLTFFAIIVVMGLLAVLDMAGVNVAVSAYFAAALTTIGLGLLVGTWFGRARGLIFLAFLTTIGLLISTGTERWGSEFRDSVYRPANLAEVADSYEFTLGNVTLDLRGVDFTGADQATTVRMSVGQLRVLLPDRVDTTAQVHVGGRTVLFGQEYSGDDASSRSVTDLGRDGAGGGKLALDLHLETGNLEVIR

SEQ ID NO: 10195 - protein, 110 aa, Actinoplanes utahensis
MKPHRMDGVSLTFGLISLVIAAWWAVSQVVTLHLPALGWTVAGGLILFGVIGLLGAITSGRREPVAPVLAEAVPASVPGDLPPEVHASIVQELMDDPAARFPREERETDK

SEQ ID NO: 10196 - protein, 414 aa, Actinoplanes utahensis
MTQFPAVSATPVPAVGARAARALTAEFARQNAATTALLIGADHASAVVAAAVEALLPGDTLVLVAGEHSSADLLRGHITGLGSWVADRVRILESLDEAQPADVVIVGEPLTGTADDTRGLIDKLAKYLTDGAVLSVATPAGPGRTMGAAAELFRQGSLFGVGSDLVVRNQPPLRVHKLRFTPAEVGAAATVAPAYRTASVPLTRTMHIDSNGVAAAGIALGLAALARRTRPKSKLWLIPALAAAPVAAFFRDPERDVPSDPASVVAAADGKILSVERMHDDRFGPGEFLRIAVFLSVFDVHVNRSPVAGRVADYFVEEGGFANAATAAAEHNVAAYTVLDTEHGTVVVAQRTGLIARRIVQRTPVGTLVAKGERFGLIRFGSRTDVYLPADRAEALVSVDERVVGGATVIARWK

SEQ ID NO: 10197 - protein, 322 aa, Actinoplanes utahensis
MPRTPWRRRRTTDSPRPAGRRWAGRLRRGGTLARQALLVRVGRRAAETSRAATATRAEVLYTSPEPGLSRTIPAPGVPLDTPAAFPVDESVPATIPLLPGEPTMARRARFALVNACTLSSLGLGLLAIFLAMADQPRWAAGCLVACVAFDGLDGALARKLGVASPFGAQMDSLADMCSFGLAAPVVVYASLLGTVPQPAAALACALVAGCAAVRLARFNVSPKDGRFFCGVPTTMAAAVLALAVLIGLPLPGMALLAGVALLAFAMVSSFPYAKLARIVKLPPWLWLLPVVGALVEPKMTFVLVVATYLVSGPVLWVRAKRA

SEQ ID NO: 10198 - protein, 297 aa, Actinoplanes utahensis
MKIRRTAAYGVCRAADGGVLLTRGSDLSAFPGVWSLPGGGVDHGEAPADAVVREFAEETGLTVAVTGVRGVVADVVAFPFDDLVEHTDRILYDVAVTGGDLRPETGGTSDLAEWVPPAEVAARPLLPFTAGALGVSFDAPAVVPLDDEPVHRGDRVQRFGAYGLVTDPAGRILLARITQGYPGGGSWHLPGGGTDYGETPEEGLLRELYEETSQRGRIDGLLTVGHRYDPAALGPEGVPLDWHVIRVVYRVRVEEPVTPVVSEAAGGSTDRASWFTPGEVAGLPLTELAREALAEAG

SEQ ID NO: 10199 - protein, 315 aa, Actinoplanes utahensis
MTPALEPLRRIAAYAVATDDEGRVLLVRASAKSGTPGIWSLPGGAVDHGEDPNHTVVRETAAETGLSVAVTGLRDVLADMRSLPHRGVTIHTDRLIYTVSVRGGTLIDRVGHPTDLARWHTLEEAARLKLRPFAAEALGLPAASADLRPDVPPTFPSFYAYQGPDGLHRAQRFAAYAIATDPYDNLLLTRIAPGYPGAGCWHLPGGGTDYGEQPGPALIRELVEETGQQGRLIELLGVASHRDAASLGPEGYPIDWHGVRAFYRVVVDAPTEVVIHDVGGSTSEAGWMPLREVAALAADQLTEVTADALRAAGLI

SEQ ID NO: 10200 - protein, 515 aa, Actinoplanes utahensis
MSTPRPVLVVDFGAQYAQLIARRVREARVYSEIVPSSMPVAEMLAKNPAAIILSGGPSSVYEPGAPTLDAGLFDSDVPVFGICYGFQAMAQALGGTVAHTGSREYGRTLLTAQGGSLLRDLPADLPVWMSHGDSVSVAPSGFMVTASTPGAPVAAFEDLTARRAGVQFHPEVAHTEQGQEMLKRFLYDIAGIEPTWTPGNIIEDQVALIRQHVGDKQVICGLSGGVDSAVAAALVHKAIGDQLTCVFVDHGLLRAGEREQVEKDYVAATGIRLVVVDAEEQFLGHLKDVTDPEQKRKIIGREFIRTFEAAARDLDAERHIEFLVQGTLYPDVVESGGGTGTANIKSHHNVGGLPDDLQFALIEPLRTLFKDEVRALGAELGLPEAMVQRHPFPGPGLAIRIIGAVDRERLDLLRQADLIAREELTAAGLDRDVWQFPVVLLADVRSVGVQGDGRTYGHPVVLRPVSSEDAMTADWSRLPYDLIAKISNRITNEVREVNRVVLDVTSKPPGTIEWE

SEQ ID NO: 10201 - protein, 354 aa, Actinoplanes utahensis
MRTGRIARAVVVAVLGMTVAACRHSGAAAPAASTAPIPESTPSAAPAPSPGADLTGPLDLVLAGVDTRITEPGWEPHSDAIMLLHVDAGLKSAYLYSLPRDLLVQVPAYPKAGFPGGRHKLTEAMAFGSRIPGRTAKNVANGYDLLTRTISAYTGIRTFQAGAILNFGGLDRLVDELGGIDMTIDQKVKSRHRRPDGTLRKLSGHDYTGPQAVYLPGKRHLVGWQAIDYARQRYGLPNGDYDRQRHQRQMVEAILDKALGEGLSDPAKLQPVITALGKTLVTVGGRQPIDYAYALRDLTPSSVTMVQLDGGGVGSGSGYLGEALNAEARGFLSAVAAGTIAAYLKAHPGMVDKG

SEQ ID NO: 10202 - protein, 461 aa, Actinoplanes utahensis
MRRRGPVAVLAVLLIAGGCRSSGAAAFTAGAIGAGDPYFPTYGNGGYDVAGYDLDLRYDPGSGQLGGRATITATATQSLSRFDFDLAHLTASKITVDGAAATAETAGNELVVTPATGIPSGRRFTVVVEYSGEPDQLENKALGNGGWIRTADGGIALGQPESASTWYPVNDHPSDKATFRLAMTVPDGLQVISNGVPGTTDRHGGWTTWHWAESAPMASYLSTVVIGHYRVTTGTHDGKPMIVAVPESVPATSPGARALARTGEIADFLAGLFGPYPFDAYGGVIVTDSRIGYALETQSRPVYGGDFFTKDENAGVVAHELAHQWFGDSVSLRRWQDIWLNEGFATYAEWLWAEHDGGRTAQQEFIIAYSSTDWTQPTGDPGPAHLFGSAVYQRGAMTVYALRRTIGDDAFLKLLTAWPAAHRDGNGTTEQFIALAEQTSGKDLKDFFHAWLYGTGKPPAP

SEQ ID NO: 10203 - protein, 373 aa, Actinoplanes utahensis
MRDVVEIGLGKTAQRGYHLDDIAIVPSRRTRDVDDVSTEWKLDAYPFKIPCVAHPSDATQSPDSVIALGRLGGLGVLNAEGLWTRYEDPSKILEELASLDEEADATKRLQEVYAEPIKPELIGERVRQIREGGVTVAVRVSPQHTLALAPVILDAGVDLLVIQGTLVSAEHVSTTDEPLNLKEFIADLDLPVIVGGCTDYKTALHLMRTGAAGVIVGVGADEWSTTDTVLGIRVPMATAIADAAAARRDYLDETGGRYVHLIADGGIATSGDIAKAIGCGADAVMLGEPLSLAEGAPAGGAWWHSAASHPALPRGGFCIAGEPDGSLEQLLYGPADRADGQLNLFGGLRRAMAKCGYRDVKEFQKVALVLDRQ

SEQ ID NO: 10204 - protein, 495 aa, Actinoplanes utahensis
METDSARTVPLGLTFDDVLLQPGESDVVPSRVNTVTRLTRNVELSIPLLSAGMDTVTEARMAIAMARQGGIGVLHRNLSVEDQAAQVDLVKRSESGMITNPITCGPDDTLRQVDALCGRYRISGAPVVDGQGVLVGIVTNRDMRFVSDLDAKVRDVMTKAPLITAPVGVGKDQALELLARHKVEKLPLVDENGHLRGLITVKDFTKSEQFPNAAKDPQGRLRVAAAVGVGDDSYKRARALVDAGVDVVIVDTAHGHQRAVLEMVARLKKDVAVDIVGGNVATYAGAKALVEAGADAVKVGVGPGAICTTRIVAGVGVPQITAIMEAARACAPAGVPVIGDGGIQYSGDIAKAIVAGASTVMLGSLLAGSEESPGELIFMNGKQFKSYRGMGSLGAMQSRGQAKSYSKDRYFQQDVNEDKLVPEGVEGQVPYRGPLSRVAHQLIGGLRAAMGYVGAETIPDLQERGQLIRITAAGLKESHPHDIQMTVEAPNYHSR

SEQ ID NO: 10205 - protein, 133 aa, Actinoplanes utahensis
MGVQEEPIDPFNGDPADPAAELDDLQEEAESEPLSEDERQDVLEDLSDLEIYQALLSPTGIRGLVIECEDCHEPHYFDWDLLRGNLRHLLSSGRPRVHEPAYDPDPDHYVTWEYARGYADGVHDTLTEGNDEN

SEQ ID NO: 10206 - protein, 37 aa, Actinoplanes utahensis
MVTGRPDHPTSSVVQVTPRRSSSLKIEFVFATVRADH

SEQ ID NO: 10207 - protein, 279 aa, Actinoplanes utahensis
MRTVLVCVRTPLAAQTVASTAARLGMTGVVRTAVSETEAMIRLAERPAEVVLADTAVTRPDSVGFTRRVLARAPQAQVVLFGAEDPRVAAAAVAAGARGVIRGVEHDLVSVVAKALLLLLLPVRPQGMPINGNAQPATVAGGMRNNNSPAARGAYQNGGIGMGAPNAAAVPAMLPNSPMVPVQRGDAPIDPATGRPMVAWPGNEAMADGAPAGRRLTLTERELQVLRGMADGKSNAEIGRELFVSEDTVKTHARRLFRKLGARDRAHAVAAGFRAGLVA

SEQ ID NO: 10208 - protein, 128 aa, Actinoplanes utahensis
MSNVRRLPGPIADLWDWQRLGLCRGRDSAQFFHPDGERGSSRNRREAKAKTMCGACPVRAECAAHALAVREPYGVWGGFSESERLRLLAVGWEDLADRHGRVDLARLEARLGRPHKSAVPAQRQAPAA

SEQ ID NO: 10209 - protein, 497 aa, Actinoplanes utahensis
MRHSIRAGLAGVAAAAAALGVAELLAVLAGPRSAPLVAVGGVVVDHVPAPVKDFGIAVFGTHDKIALLTGTAILLGLYAFGVGVLARRSWPLAAAGIALFAVIGAAAAVTRPGAGPGAALPSLLGAGLSFLVLRHLLRVGALPEAAGRRQFLKQAGIVVAVAAGGGLAGRWLTSRGVATQARDELRLPAAGEPTPVVPPGAQVEGAVPYVTPNPDFYRIDTALVTPQVDPATWRLRIHGMVRNPITITWADLLKRPMIERYVTLACVSNEVGGDLIGNALWLGTPIKALIDEADPLPGADQAVQRSTDGWTCGTPTAVLRDGRDALLAIGMNGEPLPVDHGFPVRMVVPGLYGYVSACKWITEIELTQFADFDAYWVPRGWAAQAPIKTQSRIDTPRDGASRKPGPVVVAGVAWAQHRGIAKVEVQVDDGPWEVAALAPAVSDDTWRQWTHTWTATSGRHVLRVRATDLDGATQTSERADPAPDGATGWHRVTVSVN

SEQ ID NO: 10210 - protein, 579 aa, Actinoplanes utahensis
MDHHAGPGADPAAATPAAPPAPRGAPLPAPETALMITEREIGGIPALLAPATGPMHAGLVFRVGHADEPLAKRGITHLIEHLALFSFGVADYHYNGATGVEYTYFHMQGAEADIVTFLNGVCAGLRELPMSRLPVEKEILRTEENGRGESPAGPLGLWRHGARDYGMPAFPEWGLTGLTPDDLRDWVARWFTAENAALWIAGPGVPDGLDLRLPHGERRPAPAPSNALPCRPAYFAGPENVVAWNAAVPRQPAAAVLAGVLERALFRSLRQESGLSYTVQADFESRGDGAMVITAAADALPEKQEAVLRGFVEVLEVARDGGFAPAEITAVVNQRCEDLARAEEAGARLPAQVFNLLAGRRVRQLDEALAELREVTPADVAVAGRLAVADGLLMTPGRTTAEWAGYTAAPECSTEAVTGAEYRLLDPERPGDRLIAGTHGISLVGDASTVTVRYDGLAGVLSWPDGARRFIGHDGIQVHVEPTLVDGGPALVAALDTGVRPEQRVTMAARDPARIPHPPAPPAPPPRDPRRTERIWRLSFAAVGLIGLVTLRLLAPPVAAAFFAIALIVVFAVYRILGR

SEQ ID NO: 10211 - protein, 300 aa, Actinoplanes utahensis
MLPRMPPHHPVLDPAVAYPKINELRAALDARDWTACRALLDAAEPVERGFLIDAAAEAAEVAGFLRGVRTADPADSTAAALLGRHLTVVAGSAERWRAAEIELIDAAARAPDDPAVWAARLGTARLLGLGQSEARRRYDRLAAIDPHFLPGQSGFARQLCPQWGGDWDRAHEFARSAAEAAPPGSLSHVLIAEVHIEHWLALRDTAARRTYLAADAVRSGLYDAAKSSVWHADFRRTHGWVHVMNVFAVAFALLDDMPAVASLFTALDGLATGWPWSCLGDPVTVISQYAERALPDGGAA

SEQ ID NO: 10212 - protein, 392 aa, Actinoplanes utahensis
MRAGPSQEEVRRHNLGTLLRYVHMHGATSRAELTTRLGLNRSTIGALTAELISAGLVSEAVPKETGRAGRPSLVVRPESDTVFAYSLSIEVDRLRAARVGLGGQILEQYETVRPPGMSADEAVEPLARFVRAMHDQVSDDARCVGSGLAVAGMVRREDGMVRLAPTIGWVEEPVGAALRSELGAPGRLSIGNHADVCALAEHARGAAVGCDNVIYLYGDVGVGAGIVAGGRRVTGHGGYGGEVGHMVVNPYGRPCDCGSRGCWETEIGEHALLRLSGRADRTGRDVVLEVVDAAVRGDSQAQHALRHVGDWIGFGVGNLVNIFNPEVVIFGGTLRDVYLVAAAQIRSRLNSVGLPACREHVRLRTPELGADAALIGAAELAFEHLLDDPLIS

SEQ ID NO: 10213 - protein, 419 aa, Actinoplanes utahensis
MTTTTTTTAGGIQAVKPTVSSHIRDYWARVRGGDLGTLPAVLGLIVLSLVFGVARSDTFLSGRNFANLFNQGAGVIFIAMGLVFVLLLGEIDLSAGYTSGVCGAIMAIMLTEHGQPAYLAIPAAMLTGVVIGLLLGSLVAKVKIPSFVVTLAAFLAFQGVLLKLLGEGKNISTRDEFVNSLNNDNLSIGLSWGFAVLAVVVFAAVQLNRVRARAKRGLITEPIGIVLLRVGGLAAIVLIATAVLTQERAINPALNSLKGVPIVVPIIVAFLVIWTFVLGRTTYGRHVYAVGGNTEAARRAGIPVDGIRISVFVICSFMASIGGIMLVSRATSVDPNTGGSNILLYAVGAAVIGGTSLFGGKGRVINAVIGGAVIAVIDNGMGLMGYQPGTKYIFTGLILLLAASVDALARRRAAASGNR

SEQ ID NO: 10214 - protein, 267 aa, Actinoplanes utahensis
MAATPLLELRGINKSFGPVQVLHDVGLNVYPGEVTALVGDNGAGKSTLVKCISGIYNIDSGTAVFDGKEVAIHSPRDASALGIEVVYQDLALCDNLDIVQNMFLGREKKRGVVLDEATMEEMAGETLRSLSVRTVKSLRQLVASLSGGQRQTVAIAKAVLWNSKVVILDEPTAALGVAQTAQVLELVRRLADNGLGVVLISHNMNDVFAVSDRIAALYLGRMAAQVKSSDVTHSQVVELITAGRSGNLGLPPEKPSDFVDITPGEEQ

SEQ ID NO: 10215 - protein, 369 aa, Actinoplanes utahensis
MRKGLFALAAVGLLATGSMAACGDKKDDTTPSSGGSNAASAGKVGVILPDTKSSARWATADLKYLTDAFKAAGVDADIQNAQGDKTQFASIADGMISKGVKVLVIVNLDSGSGAAVLKKAKDAGIATIDYDRLTLNGGADFYVSFDNTKVGQLQGQGLVDCLTAAKVTKPVIAELNGSPTDNNATLFKQGYDSVLKPKYDSGDYVKGPDQSVPDWDNAQGGTIFEQMLTSNKNIKGVLAANDGLGNAAISVLKKNKLNGQVPVTGQDATVQGLQNILAGDQCMTVYKAIKKEADAASALAISLAKGQAPTTATGSVTDPESKKDVKSVLLDPQSITKANVKDVVADGFVTKEELCTADFAKACTDAGIS

SEQ ID NO: 10216 - protein, 160 aa, Actinoplanes utahensis
MPKRAAGTPATVLLTAQRVAHTLHPYQVSPDAPNYGALVAAALGVAPERVFKTLVAEVDGALVVGVVPVTGELDLKALAHAAGGKRAALADRATAERSTGYVRGGISPLGQRRRLPTVIDDSAFGAEPMYVSAGRRGLQVSLAPADLVRLTSATVAAIRA

SEQ ID NO: 10217 - protein, 389 aa, Actinoplanes utahensis
MTPELLALLQTPEGEQALAVATGMGDGEPLAAASALRARGFGAELAAAALTQASLRRRAAMKFGPDAAGMFFTRHGLEQATRAVVADRRAARLVAAGVTSLADLGCGLGADALAAARHGITVYAVDADPATAALAAANAHAAGLADRITVTCADATTVTVERFDAVFADPARRQSGRGRVFDPKSYSPPWDFVAGLAGRVPRTVLKLAPGIDHGLLPPGAEGEWVSVGGDLVEAAFWCGPLAAVPRRATLAGVGELTGTGDRRAPVGPVGAWFYDPDPAVVRSHLVAEFAERIGGRLGDPEIAYVYTDDPVDTPFARRLAVTDVLPFSLKRLRALLRDRGVGTLEIRKRGSALVPDQLRKDLKLSGPQAAGLVLTRVDGAPTVLLTEHS

SEQ ID NO: 10218 - protein, 102 aa, Actinoplanes utahensis
MTTATKVAIKPLEDRIVVQANEAETTTASGIVIPDTAKEKPQEGTVLAVGPGRIDDKGNRVPLDVKVGDVVLYSKYGGTEVKYAGEEYLVLSARDVLAVIEK

SEQ ID NO: 10219 - protein, 548 aa, Actinoplanes utahensis
MAKILSFSDDARHLLEHGVNTLADTVKVTLGPRGRNVVLDKKFGAPTITNDGVTIAKEIELTDPYENLGAQLVKEVATKTNDVAGDGTTTATVLAQALVREGLRNVTAGANPIGLKRGMDLAAEVVSKALLAKAVEVADHKAIANVATISAQDATIGELIAEAMDRVGRDGVITVEEGSALHTELDVTEGLQFDKGFISPNFVTDAESQEAVLEDAHILLTTQKISSIEELLPLLEKVLQTGKPLLIVAEDVEGQALSTLVVNSLRKTIKVAAVKAPGFGDRRKAILQDLAIATGGELIAPELGYKLDQVGVEQLGSARRIVVDKENTTIVDGGGNSADIADRVAQIRKEIEASDSDWDREKLSERLAKLSGGIAVIKVGAATEVEMKERKHRIEDAIAATKAAVEEGTVPGGGAALAQVATELDGGLGLTGEEAIGVSIVRKALVEPLRWIAQNAGHDGYVVVAKVAELGWGHGLNAATDQYVDLAAAGIIDPVKVTRNAVSNAVSIAALLLTTESLVVEKPAEPAPAAAGGHSHGHGHGHQHGPGF

SEQ ID NO: 10220 - protein, 600 aa, Actinoplanes utahensis
MSRPLPVAGRAQAWRYARSLFRSHPGMFRATVGLHLLAACAGLAGPRLLGELVQGVQRGVHEAELNRLAATLAGFVLVQAVLVRYAYLASARLGEQVLARLREEFIARALSLPLGTVESAGTGDLLTRTTRDVDALSKCVRLAVPETTIALLTGGLVVVALVAVSPVLALPLLIGVPITVAGTRWYVRRAPAGYLRQNAAYSDVTDGLAETVEGARTVEALGRQGQRIARTDRDLHRSWRAERYTLFLRTVWWPVIEVSYVLPMVLTLLTGGWLYLRGTVGLGQLTAAVVYVQQLIHPLDRLLSWLDELQVGAASLARLLGVTATAEPPRPAAPVPDGPRIEVRGLRFGYVAGREVLHGVDLTLRPGERLAVVGPSGAGKSTLGRLLAGLHQPTAGSVTVGGVPLGALAPDRLRTEVALVSQEHHIFIGTLRDNVAMARPDAPEPDVRTALAAVHALEWVDALPHGLDTEVGDGGQVLTAAQAQQVALARLVLAGPHTLVLDEATALLDPGAARDLERSLAAVVHGRTVVAIAHRLFSAHDADRVAVVEDGRITELGSHADLVAANGSYAALWRSWQGGGEAPEKPPDMARARPRQDAPF

SEQ ID NO: 10221 - protein, 629 aa, Actinoplanes utahensis
MCRVTSIRPRIIASSSSPNGETPRRACPARRRSWWHALRTSGISPPSIAERSQHGRSRPYRRGLMRRLPVADPGLPDARSATRYLSWLIRRSRMTMLTAIALAIAWMGCQSLVPAIVGEAIDAAAERRGRALLGWGLVLFAAGVAQAVAGISRHRFSVVNWLGAGFRTVQVTVRQANRLGSSLPRRLEAGEVVAIGTSDINHIGGAVDVAARGAGALVAVGTVTVLLLRTSVPLGLVVLIGVPALMIVVGGLIGPLHARQQTYRERQGRLTGQAADLVTGLRVLRGVGGEAVMVARYRQRSQALRVAGVRTAEVESLLEAAQVLLPGTLLVLITWLGARFAAEHRISIGQLVSFYAYAAFLVSPLRQLTDSIDKLTRGHVSARRVADMLGLRRDLPDPPAKPPVTVPPPGGELADPLSGVLVMPGRLTAIVAEDPADTARIADRLGRYAPGATWDGTPLTAIPLEVVRERILVVENEARLFSGRLRADLDPHRTPRLAEALAAASAQDIVDGLPGGLDSVVAERGRSFSGGQQQRLRLARALVADPEFLILVEPTNAVDAHTEARIAERLRAVRAGRTTVVCTSSPLVLAHTDRVFFVECGRVTAAGAHPELLAAEPGYARVVLREELS

SEQ ID NO: 10222 - protein, 350 aa, Actinoplanes utahensis
MRDEPLVLGIETSCDETGVGIVRGHTLLADALASSVDQHARFGGVVPEVASRAHLEALVPTMRRALDEAGVTLADVDAIAVTSGPGLAGALLVGVAAAKGYALAAEKPIYGVNHLAAHVAVDTLEHGPLPEPAIAMLVSGGHSSLLLVDDLTAGVTPLGATIDDAAGEAFDKVARLLGLGFPGGPIIDRSARDGDAGAIAFPRGLTAAKDLAAHRFDFSFSGLKTAVARWVEARERAGEPVPVADVAASFQEAVCDVLTAKAIDACREHGVGTLVIGGGVAANSRLRVLAEQRAARHGIAVRVPRPQLCTDNGAMVAALGSHLVAAGVAPSRLDLPADSAMGLTAVSVAG

SEQ ID NO: 10223 - protein, 145 aa, Actinoplanes utahensis
MRIERLRWWHIEAILPLEEDLFGPEKWSAAMFWNELAQRNYYIVALENDDIAGYAGLSVVDREESWVQNIAVRRDAQRGGIGRALLEDLLAEAARRGVGRTLLEVAVDNHPAQKLYATYDFEPVGIRRGYYQPSNTDALVMMRDA

SEQ ID NO: 10224 - protein, 218 aa, Actinoplanes utahensis
MLVLALDTATPASTAALVEVTADGLFGVAESRTVDPRAHGEKLAPEIAAVLATAGVRPSDLTAIVAGLGPGPFTGLRVGLATAAAMGQALGIPTYGVCSLDALGRAAGPGRVLIATDARRREVYFASYVDGVRNGGPDVSKPADVTVNADRAAGEGALKYGDVFGLPVEEHLLYPPGAALVALAADRVRAGAASEILTPLYLRRPDAVEPAGRKPVLT

SEQ ID NO: 10225 - protein, 227 aa, Actinoplanes utahensis
MNLTEHLPAEWRAELAPFLDAQATAELGEFVAAEYAEHTVYPPAEDLFAAYRLCSPEQTRVLILGQDPYHGAGQAHGLSFSVREGVRVPPSLRNVFKELAEDVNIAPPKSGDLTGWARQGVLLLNAVLTVRAGKAASHANKGWETFTDATIRALNERNERVVFLLWGNYAKKKAALVTNPVHAVIEAGHPSPMNPAGFLGSRPFSAANKALADGGRPVVNWDPRATV

SEQ ID NO: 10226 - protein, 149 aa, Actinoplanes utahensis
MKLTTVEQTRAFGRRLAAVLRPGDLVLLTGPLGAGKTALAQGIGTGLGVQGPITSPTFVIARVHRGPVPMVHADAYRLGDRPDPRAEIDDLDLDASADEAVTVVEWGAGLVEQLNDEHLLVRLERLDDDTRVIELTPHGGDWAHRLEQM

SEQ ID NO: 10227 - protein, 368 aa, Actinoplanes utahensis
MSRSRAAKTAGIAGAVVGVAAAGLATAFAVERVLVRRSVNKPGDPYVDEPFGDQPYDEERTVTAADGTELHVEIVDPRAEEPRGWTGRPGRGRKEKPTIVFVHGFALDMGTFYFQRKALAERGDHRLVFYDQPGHGRSSRLQSGAYDIAALGRSLAAVLDATVPDGHIILVGHSMGGMTIMAFAEQFPEWFGNRVTGVVLMSTSAGLFDKATLGLTNVVARASAPFFPLWDRAAKLGGGTIDRARVASSDLAWLLTRRYGFGEARPSPSLVTFVESMNSRTSVETLTKYLNTLYRHSRLPALSALRGVPVLVVVGDRDYLTPVTHSEQIIRELPQAELLKIENSGHVVMLEKADEVNAALIPFLEKIS

SEQ ID NO: 10228 - protein, 372 aa, Actinoplanes utahensis
MWQAEVRVNLDAIRDNVAMLRAGTSAEVLVAVKADGYGHGMVPAARAAVAGGATWLGVATLDEALELRRGGIEARVLAWLFAPGQPLHEGITAGVDLSAATPELLDELVTAARRAGRPARVHLKLDTGLSRGGAVPAEWPALFEAAAKAQAGGDVEVTGVWSHFACADEPGHESVDRQLAAFTDGLAVAERFGLTPRYRHIANSAATLTRPDTHFDLVRVGIAAYGLSPIAGETYGLRPAMTARARVTMTKRVPGGQGVSYGLTYHTERETTLAVVPLGYGDGVPRHASSAGPVRIGTTTARIAGRVCMDQFVVDLGDAPVAPGDVATLFGAGDDGGPTADDWAAAAGTINYEIVTRFGSGRVPRVYTGEVA

SEQ ID NO: 10229 - protein, 483 aa, Actinoplanes utahensis
MRQAWRVADVRAAEKTLMATLPEGALMQRAAAGLARRCALLLEDSGGVYGARVLLLVGSGDNGGDTLYAGALLARRGAQVRALLLSPDRVHLAGLAALRQAGGFTTADLPTRVDLVLDGIVGIGASGGLRPPAAALVGALGELRGRTGDRPLIVAVDVPSGVRVDTGDVPGDAVDADVTVTFGCLKPAHLVGPAAPRCGHVELVDIGLGPALVADPAVRVAEAADIAAWWPRPGAASDKYTRGVVGLATGSAGYPGAALLSTAGALAGPTGMVRYAGSAHREVVHAHPSVVAAPKVADAGRVQAWVCGSGLGTGDEARTELRSVLATSLPVLLDADAITLLVGGEHAEHLRRDAPLVLTPHDGEFKRLAGEAPGADRMAAAARLAAWTNAVVLLKGDRTIVATPGGEIWANPTGSPALATAGSGDVLAGLLGSLLAAGLPPVRAAVAAAYVHGLAGRHAAADGPVTSPDVAAAIRPVLAHLLG

SEQ ID NO: 10230 - protein, 122 aa, Actinoplanes utahensis
MIVSVGIDVVLVDRFARALDRTPLLGDRLFTEAERLTGSGNPRSPESLAARFAAKEAVAKALGAPVGLRWHDCEIVTDPDGRPWLTVSGTVAAAASERGINRWHLSLSHDGGIASAMVVAEQ

SEQ ID NO: 10231 - protein, 95 aa, Actinoplanes utahensis
MNPDLDVDTETLHRIADATEGTASRVREAASSAPHPVAGPQWATTGAATITSDTAARTLRQLGADLSDTASRIKTTITAYAAADTRAATRLRSTR

SEQ ID NO: 10232 - protein, 135 aa, Actinoplanes utahensis
MSVHPVTVGPTLTVTYDRLRVTDPARWAAAALTWRRWAALAGVLCAEFGPLIEGLRTAWSGAAAEAAVLRLATLRRRLVVFRLLCWRADQILSEFAAALTRARALLDRARAAAAAAASSGGLGQGGTGPGAGGTS

SEQ ID NO: 10233 - protein, 378 aa, Actinoplanes utahensis
MDLVPGVPGPGAAELGNALRLAASADASAAARLAELTAIPVAPASDDRPSCTATPAQVRLWWAALSPGERMWLLGTEPTAFGGLNGIPAADRDLANRLLLADRRDELLRHGGTAGTVQGLDRLADRLADDRGPRAYLMGLDVSGDGRAVVAFGDPDRAANVLTHVPGMTSDLASLNGELTRAERVAGRATDLGPAEATSAVLWLDYDAPDFLPEASSARQARDGAGALRLFQDGLRATHEGAAARQTVLGHSYGSLVVGEAATGGLDADRVVFVGSPGVGVESAAQLHLPADRVFASTSISDPIQYLAVSPAGAARELVPGLGLAPTEHLWFGHDPSDPAFGAQVFHTQADGGHLGYWDPGKPALDALATITLGGHPK

SEQ ID NO: 10234 - protein, 639 aa, Actinoplanes utahensis
MTFARKSATLPGMCGIVGYVGNRPALSIVLDGLRRLEYRGYDSAGIAVIDAGEVHTEKRAGKLANLEKALAERAAGGIAAGHTGIGHTRWATHGGPTDRNAHPHLSADGRVAVIHNGIIENFSRLRAELEADGVEFRSDTDTECAAHLLAAEMRALRAAGGQDGPALLAEGMRRVVRRLEGAFTLLAVDVEVPDAVIAARRNSPLVVGRGAGEYFLASDVSAFIEHTREAVELGQDQVVLITPAGIEITDFDGAPATGQEFHVDWDASAAEKGGYDYFMLKEIAEQPQAIADTLLGRLSERGEIILDEVRLTDQDLRDVDKVFIVACGTSYHAGMVAKYAIEHWVRIPCEVELASEFRYRDPILDRSTLVIAISQSGESMDTLMALRHAKEQKARVLAICNTNGSTIPRESDAVLYTHGGPEIAVASTKAFLTQLVACYLIGLHLAQIRGVMYADEVAAVVSRLRRTPDNLRELLDKMEDVRALARDLKSASTILFIGRHVGFPVALEGALKLKELAYMHAEGFAAGELKHGPIALIDQGTPVVCVVPSPAGRGVMRDKVVSNIQEVRARGARTIVIAEEGDESVKAYADHLIEVPHTPTLLAPLMTTVPLQILACEIAAARGHDVDQPRNLAKSVTVE

SEQ ID NO: 10235 - protein, 188 aa, Actinoplanes utahensis
MSDQRDPARDYPPTAQFAPVGYPPPDYRQHRRSNAPLIALILAITLLLCGGVITTVVLVARRTSDKAKETVQKIPTALPTPSRLPKLPAGGDDDHTKLTVRYEVSGDGPATIIYSEKLGLPKTVNEAKLPWKIAVRMDGLSFVSVSALRLSLQDGSITCKAIIDGKTVDEHTATGVGATATCNKLTFN

SEQ ID NO: 10236 - protein, 385 aa, Actinoplanes utahensis
MSTDPLVERMRPFGTTIFAEMSALAARTGAVNLGQGFPDTDGPPEMLAAAAQALASGANQYPPLPGIPALRHAITGHERRFWGLTRDPDTEVAVTAGATEAIAAAVLALCEPGDEVVCFEPYYDSYAASITLAGAVRRPVTLRPGPDGRYEFDEAQLRAAFGPRTRLALLNSPHNPTGKVFTPAELALVAELCQAHDAVAVTDEVYEHLVFDGVHVPLATLPGMGERTLRVSSAGKTFSCTGWKVGWVTGPARLVSAVLRVKQFLTFVNASPLQPAVAVALGLPDAYFQDFTAGLRANRDRLTAGLTAAGFEVLPSQGTYFVTADIRPLGGTDGVEFCRGLPARSGVVAVPTQVFYDHREAGRHLIRFAFCKRPEVIEEAVARLK

SEQ ID NO: 10237 - protein, 451 aa, Actinoplanes utahensis
MGRLFGTDGVRGLANGDLLTPELALSVAVAAARVLVEADSSHQPLAIVGRDPRASGEMLEAAVVAGLTSAGANVVRVGVLPTPAVAYLVGQTGADLGVMLSASHNPMADNGIKLFAAGGQKLPDELEERIEKAVADGHGLVGRPTGAGIGRVHDLLDGAEHYIKHLVESIPHRLEGIKVVVDCANGAASDVGPVAYREAGAEVIAIHAEPDGLNINEECGSTHLDKVRDAVLAEGADLGLAHDGDADRCLAVTAAGDVVDGDQIMAILAVAMRDAGTLTEDTLVATVMSNLGLRIAMKQSGIKLLETKVGDRYVLEELQGGGLALGGEQSGHIVMPAFATTGDGVLTGLHLMAQLASSGKSLADLAAVVHKLPQKLINVKVGDREAGAAAPTVQAAVALAEAELGETGRVLLRPSGTEPLVRVMVEAATEEQAGAVAARIADEVRAASPVA

SEQ ID NO: 10238 - protein, 168 aa, Actinoplanes utahensis
MTDIIEPEVVETVETVEEPAETVVVVETPAPAPVRAPRPGDRPVQTVGRRKEAIVRVRLVPGTGKITCNGRELENYFPSKVHQQLIREPLVTVERAEQFDVIANLRGGGITGQAGALRLGIARALIADEADDRPALKKAGFLTRDARVKESKKYGLKKARKAPQYSKR

SEQ ID NO: 10239 - protein, 169 aa, Actinoplanes utahensis
MSTSSSTRPARAPRPTTRQGNSVRTYSPKPGEIERQWHIIDASDVVLGRLATHTATLLRGKHKPTFAPHVDTGDFVVIINAGKVALTGNKRQTKVAYRHSGYPGGLKQVGYEELLSKRPEKAIELAVKGMLPHNKLARQIIKKLKVYPGAEHPHAAQQPKPFEITQIAQ

SEQ ID NO: 10240 - protein, 404 aa, Actinoplanes utahensis
MPFGGPPGHAATSHFPIPGRCGPSPAVRRRMTERIPAARRSALDEPAAVLAGYTVGVTSDRRRDELAALLEGRGARVVLAPALRIVPIADDAELRAATRACLDSPPDIVLVSTGIGMRGWLEAAESWGLAEPLRAVLDRSYLVARGPKARAAVRTAGLRECWTPEGESSAEVVEHLTTRGLGGLTVALQLHGESQPEYTEVLRAAGARVIELPVYRWAPPTDTAPLHRLVDLIAGRLVDAVTFTSAAAVHALLRAAGPAVDPLLDALRSDVLAACVGPVTAEPLRRLEIPVTTPARARLSALVRTLTDELPQRAVSLQVNGHAITLRGHAAVIDGRLRQLAPAPMAVLRALATSPGRVLSRAALLQTLPRHADEHAVEMAVARLRAAIPGIVQTVVKRGYRIAG

SEQ ID NO: 10241 - protein, 203 aa, Actinoplanes utahensis
MDFASSEWAGASPSEITSAKIVIAGGFGVGKTTLVGAVSEIEPLTTEAVMTAAGAGIDDASKVPEKGTTTVAMDFGRITMADDLILYLFGTPGQTRFWFMWDELIRGAVGAAVLVDTRRLTDAFAPLDYFENRHLPYLVAVNCFDGAPRYEPEEVREALAIPARVPLIMCDARHRESVKAVLIGVVEHAMTTLVAEHEQGVTV

SEQ ID NO: 10242 - protein, 120 aa, Actinoplanes utahensis
MSEPHDPRGNLVRPYAVTRGRTEPIRDIPIEAVLVASPAAVQESRFAGHDKYRIAALCEPKALSLAELAALTRLPLGVARVLVADMVADGLLALHSAAPKRGFTERMDLLGRVLSGLRKL

SEQ ID NO: 10243 - protein, 137 aa, Actinoplanes utahensis
MTRPPTMQDMGWLLNNFADSIAGIAHVVAVSADGLLLACSRDLPPDRADQLAAITSGVVSLTDGASRMFSAGKVQQTIIEMDSGYLFLMSISDGSSMAVLAARSCDVGQVGYEMALLVERVGAALSPVAREAVGHAR

SEQ ID NO: 10244 - protein, 855 aa, Actinoplanes utahensis
MSTGSSGLPVRRGPLSWSRDAGIRTKLAGLMVIPLVAALALASVRLIDVRGTASDAGRVADLTRIGTDLSGLSRLLHQERMAAAAFLADTGAAPDRFRTATEAVDTQIRTFRAHRTALGDVPARVADRLRLIQEQLGTLTDIRGAVEARKDLPIVTMAQRYDQALDQIFDFDDVVVQIAEPGTVADGLRGLAAFGRIQEAVADQEATGYVVQATRQLGAAQQQELIGAQVARQAALDDFRQIADRDQIGLVESTLSNPVVAQADGLVTRLAGGGSVDADELTTTYGQVLDLLQDTGGRLDGQVAEDARYDRDAAARRATVEFIVVLLVLTAAIAIAAFLARRLHLSLRMLREGALAVAHRDLPDAVTRLQDADSLGEGGVDRIVAETRDPFRLTDRDEFGQVAEAFNMVHREAIRVAAEQAALRTSVSAMFLSLARRSQALVDRMIGELDQIERTEEDPKRLAKLFDLDHLATRMRRNDENLLVLAGADVGAPRREDALLVDVLRAAQSEVEQYHRIEFGAIDTDVAVAAAAVNDVVRLIAELLDNATRFSPPTTVVMAHGRRSGEQLVVQVEDRGLGITPEQLEVINRRLAEPAEVDVAAFRLMGFAVIARLAARHGITVRLLPHREGGTIAEISLPAEVTVLPGMQSTPGRAASWTRPGPPPQAIAGAERATPEVRPPVRTVPAPTAPAAPRWAAIEPGPQPDLDLRPTPDRPPLPTRVPKPDVGAEPAPTPLFTPAAAPVSAHPVSAHPVSVHPVSAPIQVRMQHSWFEGEAAAGPRGMPTAGYAPAPVSAMPATAPVSAAPVSVPAASAASVSVPAASAASVSVPAASAAPVSGGGAVPRPRPALEDRWPS

SEQ ID NO: 10245 - protein, 456 aa, Actinoplanes utahensis
MKLLATTATAAAVVGAGQLGIAYGLGIVRLDRVLDVTARDQWTAHLAWVAWITMTAAALGAIVGTGMRARWLPHPAGAGGALATGLAGGLGSLAVLPLTMQPARAAQVAGVQPVFVIGVVAGLGAAAGIFAGWAAAAKPAARWNVATLSVLIWLIALVTIGPSLRAGHTPPAVRLGVLGGSLIPAAVSAHTALLTMPTLALLAGLVIGSTARGRRMSTLAAGLAGLAGPALLTVAYLIAGPELKAAGFADDPYWAAMTACGAGVLGSVLAAIVRGNPAPTESADSPAETASLPKRDVPARSAIAQAAAAAAARRPEEQVRPADTGVIPAGQPGTPDNPFSGGTGSPFRSGTPFPPQPVPTQAPPQAPAPEKAPRFSGQQPTPIATGRGGWRGRRSTPAPASTPAPAADSFNGFAAAQPPPSPAQRGPVVEPTSISSPRRSGQETDYVDWVSGLGGQ

SEQ ID NO: 10246 - protein, 134 aa, Actinoplanes utahensis
MTTSLPRLRKLLLSLALILGLAGTALAVPSAAQAAVYSSCTISRCSAARTAYTGWQTLGWPLSSGWYVWPYGSYNYTGGTFQNREGYLPSATYNEYDVYSRAKGASRDAYRIVVNRSTKVAYFTPDHYVTFYKL

SEQ ID NO: 10247 - protein, 150 aa, Actinoplanes utahensis
MRSMLQLVGGVAAAGVVAAGATAFTAPGLTNSVATSTKVISAGSLSFSTVEGAELTSVVTLSSRTNKAEITGVRLYLAGLNSTALNTTTTVVNASITGTSAPAGSVVGTVRTLTCAYNSTPAAWDCNVTTAGTDYLTALTAVTVDVQAGV

SEQ ID NO: 10248 - protein, 988 aa, Actinoplanes utahensis
MAAILLMAAIAAWAIGTHRISYVVTHGISMNPVYYAGDLVVVVKSDSYEVGQIAAYHGVGGVETLHRIIGGDPDTGYVFKGDNNQSIDIPHPTADQLIGRAVLHVSQGGVWVRRLLSPATLGMVGFLIIGAGSPAGARTRRDLRRRRRERKAKGMAGQGGSWTAAAVVVKAVSRLHPLLRVLAVGTACCALTGLVLGVLSWMKPATQASPSSSSSGESVTFSYSAQVQSSAAYDGTVAYSPDPIYRKLAHFVDLRLQYHGKPGRIGVDARLSAQAWHSTVQLAQSRQFTADRYTGTVLLDLDGIDERVADAADAIGTDLTPVTIMVTAHIEHPDGTSFEPQLSLSLSSLQLSLSGDANSLIVSQSGRTSGGGIYPRQIAVLGHDLITAGRARTYALRLLLIAIVGIIGIGLAAVRHVPLATRAQIQRRYGHLLVPVEPLNGKQGEAVITVASVPALVKLAEKYGQMILTWTRPDGADDFVVRDDGVMYRFRITPQRPVTGKPPLSGVPHPARRSQRSAALGIASLVTAPPQHTTEATAATEPATPSPEPAAATAPDPSPEPAPAVPAEPAAASEPTPEPVAEAPASATEYPQPAPEPVVEAPTPATEYPQPAPEPVVEPAPENRQPGPQPVAEAPEPVAKAPASDSPEPTPSAPESAVPAPDEEELKKEPEDSEPAKADAADEGPEAAAETPVPEQRTEPPAEAGFAPPAEPESTSEADTTESSAEAVAAEEKAEASTEKEPMPAPVLEPGPSAEEEPAAEARPEVPAEAKPDAPAQVKPETAAEAKPETAAQAPAEAKPETAAESPAPAQAQRPRRTRKPRQKPESKPDPDPTIAAPETNAAPEAKVAQETTAATVPEAEATQERTAAAAPQAEAVTAGKTPQKRAPRRKPRPRKATPSPTETKATTPMSTEFAPAEVTAKAAVDERQAAEDLADRNKDLDEAITRKAVRDQAAADRARQQRLAKSAPRDPAYDFLPRNQRPDQPED

SEQ ID NO: 10249 - protein, 505 aa, Actinoplanes utahensis
MRRKVYVEGSRPEIRVPFTEVVLTGDNPSVRLYDTSGPGSDPEQGLPALRKPWWDGRTQLAAARAGDITPEMEFVAVREGVDPSLVRDEIAAGRAVLPANRNHPESEPMIIGSKFLVKVNANIGTSAVTSSVAEEVEKLTWATRWGADTVMDLSTGPRIHETREAIVRNSPVPIGTVPIYQALEKVNGDPLKLTWELFRETVIEQAEQGVDYMTIHAGVLLAYVPLAAERVTGIVSRGGSIMAAWCLAEHRENFLYTHFRELCEIFREYDITFSLGDGLRPGSIADANDEAQFAELRTLGELTHIAWEYDVQVMVEGPGHVPMHKIKENVDLQRELCDGAPFYTLGPLATDIAPAYDHITSAIGAAMIGMFGTAMLCYVTPKEHLGLPNKDDVKAGMIAYKIAAHSADLAKGHPGAQAWDDALSHARFDFRWEDQFELALDPETARSYHDETLPAAPAKTAHFCSMCGPKFCSMKISHELRAAGMKAKSEEFVDGGARVYLPVVP

SEQ ID NO: 10250 - protein, 253 aa, Actinoplanes utahensis
MTPPVVLTIAGSDSGGGAGIQADLKTFAALGAYGVSVLTAITAQNTLGVTAIHPVPAGIVAAQLDAVLTDFTVAAVKVGMIADSAVAKVIAERAAELPNLVVDPVLVSTSGSRLGEAATVRVLTAYARVVTPNREEAAALAGCRAETVPEMAAAAAEIAATGPRAVVVTGSDLAVDVLWDAGRITELHGEPVSTPNNHGSGCTFSSAIAVRLAMGDPVPAAVAAAKEYVSGALRGGAAWRLGAGPGPLNHFSG

SEQ ID NO: 10251 - protein, 202 aa, Actinoplanes utahensis
MVTPTGLVVLTDRRSAAGPLVETVAAAVRGGAGWVILRERDLPYGDRAALAAQLRAVVPPGRLIVAGPDPLGGAAVHLAAADPRPGGVPLVGRSWHGTEPVSEVDYVTLSPIFPTATKPGYGPDLGVDRAARLAAGMPWLALGGVDSAARAASCATAGADGVAVLGAIMRAANPERVARVLAGAFAAAAAGSPAAADLGGVR

SEQ ID NO: 10252 - protein, 249 aa, Actinoplanes utahensis
MGDLLPENGLIVGTGGANSLAALEEAIVASQTDLVTVALRRIEAAGPGLLPMLDRLRVRILPNTAGCYTAGDAVKTARMAREAFETDLIKLEVIGDERTLLPDGVELLRAAETLVADGFTVLPYTTDDPVLARRLADAGCAAVMPAGSPIGSGLGIANPHHIELIRQSVDVPVVLDAGIGTASDAVLAMELGCDAVLIASAITRADEPAVMATAMRHAVAAGRLARQAGRIPRRFHAVASTPDEGIPVW

SEQ ID NO: 10253 - protein, 338 aa, Actinoplanes utahensis
MRVGIVGGGMIGLATAVELLRRGADVTVYDPEPDGSAGAWHVAAGMLAPGGESVFEFPGLERLLAASNALWPAFAASLGDVGYDTAGTIGVAMTADDVAEMAREWKHQKLTPLTGSRVRELAPALSPRVRAGVFAPTEKQVDPRRVVAALRGILGGRIVRADVRDLCEVDADVTVVAAGCGTAPLTGLPIRPVKGQMLRLRGEPGLLRHVIDGAADGRHVYLVPRADGEVVVGATQEERTDRQATAGGVHDLLRAALDLVPGLAEHALAEVTVGHRPGTPDNAPILGVLRPGVLVAAGHHRNGVLLAPITARLIADLVLTGTTDPIIDDFTPGRFGCA

SEQ ID NO: 10254 - protein, 194 aa, Actinoplanes utahensis
MGAVSFPRLHVITDDLDVVRAVAQPGVAVQIRVKTNDFAAYAVAREAVPRCRTAGALCLVNDRIGVALATGADGVHLGADDLPVAAARRVLGPEAVIGATCRTPEAARAAVADGATYLGVGPAFPTSTKDGLPPPLGPDGVNAVAAAVPGIPVVAIGGITLERVGLLTTYGVAAVKAFDGDPAGAAAAFLAALQ

SEQ ID NO: 10255 - protein, 548 aa, Actinoplanes utahensis
MGYVDVAGAGFVLPDGRELFADVSFRVGEGAKVALVGPNGAGKTTLMRMVAGDIPAQTGTVARVGGLGVMRQFIGMIGDDRTLEDLALSLVAPPLRAAGERLATATAALDETERTQLAYANALAHWGEVGGYDAEVLFDTVTVAILGRSWDEARSRIVRTLSGGEQKRFALDLLLRGPDEVLLLDEPDNFLDVPAKRWLEQRIRESAKSILYVSHDRELLAQTADRVVAVEGGGAWTHPGGFASWHEARSNRHERMEELRRRWEEEHEKLRELVFTLKNKAAFNDGLASRYQAAQTRLRKFEEAGPPPLPPKEQSVRMNLRGGRTGKRSVICESLELEDLTFPFDLEIWYGDRVAVLGANGTGKSHFLRLLAAGGSEPDLEHKPVDGAPLAHVAHSGVARLGARVRPGHFSQTHDRPELTERTLVEILWRGDEHRSGVDRAGAMKALSRYELGAQGDQRFGTLSGGQQARFLVLLLELSGATLLLLDEPTDNLDLASAEALEEGLKAFDGTVIAVTHDRWFTRSFDRFVLFRSDNEVVEVPEPVWDVR

SEQ ID NO: 10256 - protein, 213 aa, Actinoplanes utahensis
MTRETDRVSAEHYFSTDPDAPLRRSAIEFSVAGRDYRLAVANGVFSAGRLDPGTAVLLRKAELPGPATEGALLDIGCGYGPITCVLASEAPRVTVHAIDVNSRARELTVENAAALGLAGRVRVSAPDDVPAGVSFTQIWSNPPTHVGKAELHALMDRWLPRLAPGGVGWLVINRNLGGDSLHTWLTDRGWVVERIASQKGFRVLRVTGKPAAI

SEQ ID NO: 10257 - protein, 269 aa, Actinoplanes utahensis
MRYATPSRSAHRAAPAPDLMLLLRSFAWPPPRAAGPFRAAGSGRPAAGQHRTPARTRRHAWREPHPAHLMLARGLAALIVLGIIATLSFLIVSDDQQPGTDPDQALTSRAADPEPLTVAEAFPPGAAGYRVENTRAQSDCTLAVTGALRSALTAYGCSQAVRATLTVPDGDYRVTTGILNLVDAPGAAAVADQVRHLVETGDGSFTALTGTPVEPGTPVGWRARGHYLVYCAITGPGGVAATGQDRRLSEITAQLLDTYLSNQVLARRA

SEQ ID NO: 10258 - protein, 276 aa, Actinoplanes utahensis
MTDTIRLRLDVTYDGAGFSGWAAQPERRTVAGVLTEALHRILGAAGADLPLGLTVAGRTDAGVHATGQVCHIDLPAERYADLAGTLLRRLNGLLPPDARVKGVLPVPATFDARFSATFRRYEYRVCDDGWGPEPLRRHDTLGWVRPLDLDLLNAAAAGLLGEHDFAAFCKRKEHATTIRAIARLDWRREPDRTLVATVQADAFCQAMVRSLVGAMLAVGEGRRPPDWPAKLLTLRERSSEVTVAPAHGLTLVAVGYPTEADYAVRADATRRLRTLP

SEQ ID NO: 10259 - protein, 192 aa, Actinoplanes utahensis
MPTPTKGARLGGSPAHEKLIMANLATELFRHGKIKTTETKAKRLRPLAEQLITKAKRGDLHARRRVLTVVKDKDVVYALFEQIAPRYTGRPGGYTRITKTGPRKGDAAPMAIIELVEEAPVAATTAPAAKAAARKAAAQQDKVEALAPEETVPAVADDTVADDQDAEAPVNASGDKGAEGPGNQAEGDDIKA

SEQ ID NO: 10260 - protein, 340 aa, Actinoplanes utahensis
MLISQRPSLSEESLSETRSRFTIEPLEPGFGYTLGNSLRRTLLSSIPGAAVTSIKVDGVLHEFTTIPGVKEDVVELVMNVKELTVSSEHDEPVSMYLRKQGPGDVTAGDIQPPAGVSVHNPDLKLATLNSKGRLDMELTVERGRGYVTAAQNKSAGAEIGRIPVDSIYSPVLKVTYRVEATRVEQRTDFDRLIIDVESKASISPRTALASAGSTLVELFGLCRELDETAEGIDIGPSPQDAQLAADLALPIEELDLTVRSYNCLKREGINSVGELIGRTEADLLDIRNFGQKSIDEVKMKLAGMGLGLKDSAPSFDPAHVVDSFGDVDYDTDDYRETEQL

SEQ ID NO: 10261 - protein, 208 aa, Actinoplanes utahensis
MARYVGADCKRCRREKMKLFLKGSKCDGPKCPFESRPFPPGQHGRGRTKETEYLLQHREKQKARRVYGVLEKQFRGYYEEAVTKPGKTGEVLLQILESRLDNVVYRAGYAASRDAARQLVKHGHFLVNGVKVDIPSYRVKEHDIVTLREKSKEMTPFVVAQAQAGSRPVPAWLEPIPSEMKILIHTLPARAVIDTQVQEQLIVELYSK

SEQ ID NO: 10262 - protein, 135 aa, Actinoplanes utahensis
MPPKARAGAAVKKVRRKERKNVAHGQAHIKSTFNNTIVSITDPTGAVISWASSGQVGFKGSRKSTPFAAQLAAEAAARRAMEHGMRKVDVFVKGPGSGRETAIRSLQAAGLEVGQISDVTPQPHNGCRPPKRRRV

SEQ ID NO: 10263 - protein, 126 aa, Actinoplanes utahensis
MARLVGVDLPREKRMEIALTYIFGIGRTRSVEALTATAIDLNKRAKDLTEEELLKLREYIEANFKVEGDLRREVAADIRRKVEIGCYAGIRHRKGLPVRGQRTRTNARTRKGPKRTVAGKKKPGRK

SEQ ID NO: 10264 - protein, 38 aa, Actinoplanes utahensis
MKVKPSVKRICNNCRIIRRHGRVMVICSTDPRHKQRQG

SEQ ID NO: 10265 - protein, 73 aa, Actinoplanes utahensis
MPKKDGAIEIEGRVIEPLPNAMFRVELANGHKVLAHISGKMRQHYIRILPEDRVVVELSPYDLTRGRIVYRYK

SEQ ID NO: 10266 - protein, 147 aa, Actinoplanes utahensis
MRAADSDRQRVADQLKSALDEGRLDLNEYDERVQRAYSARTYGDLDGLLDDLPGTVPVQHAQVQPAPPPPQPHPLAPPIPQQPWKKDPQTGRHTFGSALSAFLVCTLIWTITSVAAGHAYYFWPAWVLIPVVITAVGALTERNRRGR

SEQ ID NO: 10267 - protein, 278 aa, Actinoplanes utahensis
MRRQELDIQLKTPEQIEKMRAAGLVVHAALEAMRAAVAPGVSTADLDAIAEKTIREAGAIPSFKGYHGFPASICASVNEQVVHGIPGAQQILAEGDLISLDCGAILDGWHGDSAITVGVGETDPALLRMAEVAEDAMWAGIAAAARGAANGRGRLTDISFNVEKVIRKAGRYGIVDGYGGHGIGTEMHQEPHVLNHGKPGRGPRLVVGMALAIEPMITMGSPRTVELSDGWTVVTRDGSRAAHVEHTMALLEDGVWVTTALDGGRARLGDLVTARQPL

SEQ ID NO: 10268 - protein, 217 aa, Actinoplanes utahensis
MRLVLVGPPGAGKGTQAEFIAAHLAVPKISTGDIFRANVSQGTPLGVEAKRYMDAGQLVPDEVTINMVRDRLAEPDAGDGFLLDGFPRTVPQAAALDKLLADLGTALDLVMELVVDDDEVIRRLSGRRTCRGCGKIWHVEFDPTSKENICDRCGSELFQRDDDKAETIANRLVEYADKTAPLVDYYGAQGKLVGIDATGPVEDVTVRAIDALRSYGG

SEQ ID NO: 10269 - protein, 446 aa, Actinoplanes utahensis
MLSAFSSALRTPDLRKKLLFTVAIIALYRLGATLPSPGVSYHNVQACLKIEEQSGNQVLNLLNLFSGGALLQLSVFALGIMPYITASIILQLLTVVIPRLEQLRKEGQSGQAKITQYTRYLTLGLAILQSSAFVALARTGQLFGGLCDQDNPQFQIIPENTGIPIWLTLSVLVMTMTAGTGVVMWLGELVTDRGVGNGMSVLIFTSIAARLPGEGWTIKQSAGTAKFLLVIALVLVIIALVVFIEQAQRRIPVQYAKRMIGRRMYGGTSTYIPLKVNQAGVVPVIFASSLLYLPQLYLQFFNKNTLKDYQIWIQNWLATPTSWLYITVYFLLIIFFTYFYVSITFNPTEVAENMKKYGGFVPGIRPGKPTADYLDFILSRITLPGALYLGLISVLPNFFFIWLDQKQYQNFPFGGTAVLIMVGVGLETVKQIESQLMQRNYEGFLR

SEQ ID NO: 10270 - protein, 149 aa, Actinoplanes utahensis
MAIKIHDLKPAPGAKTKKTRVGRGEGSKGKTAGRGTKGTGARKNTPASFEGGQMPIHMRLPKIKGLKNRPRNKVIFQVVNLDKLAELFPNGGEVGPSELVEAGAVRKNQPVKVLGSGELGGVSLTISAHAFSESAKEKIAAAGGSTTEL

SEQ ID NO: 10271 - protein, 60 aa, Actinoplanes utahensis
MARLKVTQIRSEIGRKQNQRDSLRSLGLKRINDVVVKEDRPEIRGMIFAVNHLVTVEEVE

SEQ ID NO: 10272 - protein, 207 aa, Actinoplanes utahensis
MPGQQRRGGGSGGNTEGGGRRDNRREGGRGNAPVEKTPHLERVVAINRVAKVVKGGRRFSFTALVIVGDGDGTVGVGYGKAKEVPAAIAKGVEEAKKHFFKVPRIGATIPHPITGEAAAGVVLLKPASAGTGVIAGGPVRAVLECAGIHDILSKSLGSSNPINIVHATVAALKGLESPEQVAARRSLPVEDVAPAAMLAARAEAAVH

SEQ ID NO: 10273 - protein, 131 aa, Actinoplanes utahensis
MTATLLKRRNGGGIASRRAVGKARRHFRVRKNVRGTAERPRLVVTRSTRNITAQIIDDLKGHTLASASTLDTSIRGTEGDKSSQAGKVGALLAERAKAAGISKVVFDRGGNKYAGRIAALADAAREAGLEF

SEQ ID NO: 10274 - protein, 179 aa, Actinoplanes utahensis
MSRIGRKSIPVPAGVDVTITGQTVKVKGPKGELSHIVAEPITVSQEGAELVVNRPNDERKAKELHGLSRTLVANMIVGVTEGYKKTLEINGTGYRVTAKGKDLEFALGFSHPVNIVPPAGITFSVEKPTQFTVAGIDKQLVGEVAANIRKIRPPEPYKGKGVKYQGEVIRRKAGKAGKK

SEQ ID NO: 10275 - protein, 135 aa, Actinoplanes utahensis
MTMTDPIADMLTRLRNANQAYHDKVTMPYSKIKANIAEVLKAEGYIASWTSEEPEEGAVGKRLVVELKYGQNRERSLAGIKRVSKPGLRVYAKSDELPRVLGGLGVAIISTSQGLLTDKQARKRSVGGEVLAFVW

SEQ ID NO: 10276 - protein, 61 aa, Actinoplanes utahensis
MAKKALIIKAAAKPKFAVRAYTRCQKCGRPHSVYRKFGLCRVCVRDMAHRGELPGVSKASW

SEQ ID NO: 10277 - protein, 189 aa, Actinoplanes utahensis
MTAATETKALPRLKSKYRAEVIPALQEQHKYANPMQIPGLVKVVVNMGVGEAARDAKLIDGAVRDLTTITGQKPLIRRATKSIAQFKLREGMPIGAKVTLRGDRMWEFLDRLLSISLPRIRDFRGLDGRKLDGHGNYTFGLTEQSVFHEIDQDKIDRPRGMDITVVTTASTDDEGRALLKLLGFPFKEN

SEQ ID NO: 10278 - protein, 104 aa, Actinoplanes utahensis
MKIKKGDTVVVIAGKDKGAKGKVIAAFPARDKVLVEGVNRVKKHERIRTTQRGSKTGGIVTQEAAIHISNVQIVDDQGKPTRIGYRIDENGNKVRIARTTGKEL

SEQ ID NO: 10279 - protein, 122 aa, Actinoplanes utahensis
MIQQESRLRVADNTGAREILCIRVLGGSGRRYASIGDVIVATVKDAIPGAGVKKGDVVKAVIVRTSKERRRPDGSYIRFDENAAVIIKDGGDPRGTRIFGPVGRELRDKRFMKIISLAPEVL

SEQ ID NO: 10280 - protein, 90 aa, Actinoplanes utahensis
MSENTVAPRAQRKVREGLVVSDKMDKTVVVEVEDRVKHALYGKVIRRTRKLKVHDEQNSAGTGDRVSIMETRPLSATKRWRIVEILEKAK

SEQ ID NO: 10281 - protein, 77 aa, Actinoplanes utahensis
MAAGVKAAELRESSDEELIAKLREAKAELFNLRVQRATGQLDNHRRLQVVRKDIAKIYTIMRERELGLSVAPDEVSA

SEQ ID NO: 10282 - protein, 141 aa, Actinoplanes utahensis
MLMPRKPPKGFRKPHHPDRHGASKGGNRVVFGEFGIQALEPAYVTNRQIESARIAMTRHIKRGGKVWISIFPDQALTKKPAETRMGSGKGSPEWWVANVKPGRILFEMSFPNETVAREAMRRAIHKLPMKCRIVTREVGES

SEQ ID NO: 10283 - protein, 283 aa, Actinoplanes utahensis
MGQKVHPTGFRLGISTDWKSRWFADKLYKDYIGEDVKIRRMMSKGLERAGISKVDIERTRDRVRVDIHTARPGIVIGRKGAEADRIRGELEKLTGKQVQLNILEVKSPESDAQLVAQGVAEQLSSRVSFRRAMRKAMQSAMKNPICKGIRVQVSGRLGGAEMSRTEFYREGRVPLHTLRANIEYGFFEARTTFGRIGVKVWIYKGDAVPGREAVAEAPARPRRDRAERPERPRRGRSGSSGTTAGGTEAGRAAAQSRSTADGDNANDAAVAAAPAPAETQQEG

SEQ ID NO: 10284 - protein, 152 aa, Actinoplanes utahensis
MPAKGDAPVLPGARAVARHVRISPNKARRVVNLVRGLPAKEALTVLQFAPQAASEQVYKVLASAVANAENNERLDPDALLVSEAFVDEGPTLKRFRPRAQGRAYRIRKRTSHITIAVEAVQVARPAKKATAKKAAKPAEPQAAESQSTEGAE

SEQ ID NO: 10285 - protein, 93 aa, Actinoplanes utahensis
MPRSLKKGPFVDDHLLKKVEVQNEKNSKNVIKTWSRRSTIIPDMLGHTIAVHDGRKHVPVFVTEAMVGHKLGEFALTRTFKGHEKDDRKSRRR

SEQ ID NO: 10286 - protein, 279 aa, Actinoplanes utahensis
MAIRKYKPTTPGRRGSSVADFAEITRSTPEKSLLVPLPKKGGRNVHGRITTRHQGGGHKRQYRLIDFKRNDKDGVPAKVAHIEYDPNRTARIALLHYADGEKRYIVAPKDLKQGDRVESGVGADIKPGNNLPLRNIPVGTTIHNVELRPGGGAKLARSAGVGIQLLGREGVYATLRMPSGEIRRVDVRCRATVGEIGNAEQSNINWGKAGRMRWKGKRPTVRGVAMNPVDHPHGGGEGKTSGGRHPVNPAGKPEGRTRRKGQPSDKLIVRRRYATRKRG

SEQ ID NO: 10287 - protein, 100 aa, Actinoplanes utahensis
MSTIADPRDIIVAPVVSEKSYSVLDQNWYTFLVNPDANKTQIKIAIQQIFNVRVLTVNTANREGKRKRTKTGFGQRKATKRAMVKLADGDRIEAFGGPVS

SEQ ID NO: 10288 - protein, 215 aa, Actinoplanes utahensis
MSSVDIINAEGAKAGSVDLPASVFDAQANIPLMHQVVVAQLAAARQGTHKAKTRGEVAGGGKKPYKQKGTGRARQGSIRAPQFTGGGVVHGPVPRDYSQRTPKKMKAAALRGALSDRARDGRVFVVESFVSGETPSTKAAVATLRKVAQTTKVLVVLDSQDELNWISLRNEPTVHLIEAGQLNTYDVLVADEVVFTKVALDEFLGGSETSEEGDK

SEQ ID NO: 10289 - protein, 216 aa, Actinoplanes utahensis
MDRQVKGILGAKLGMTQVWDNNKVVPVTVVQAGPCVVTQVRTDEKDGYSAVQLAYGAIDPRKVNKPESGHYAKAGVSPRRHIVELRTVDASEYELGQEVTVEAFAAGTAIDVTGKTKGKGYAGVMKRHGFHGLRASHGVERKHRSPGSIGACATPGRVFKGVKMAGRMGGKRYTVQNLTVQAVDTERNLILVRGAVPGPKGALILVRTAAKKGGVK

SEQ ID NO: 10290 - protein, 102 aa, Actinoplanes utahensis
MAGQKIRIRLKAYDHEVVDSSARKIVETVTRTGAQVAGPVPLPTEINRFCVIRSPHKYKDSREHFEMRTHKRLIDIIDPTPKTVDSLMRLDLPAGVDIEIKL

SEQ ID NO: 10291 - protein, 397 aa, Actinoplanes utahensis
MAKAKFERTKPHVNIGTIGHIDHGKTTLTAAITKVLHDEFPELNPYTPFDEIDKAPEEKARGITISIAHVEYQTAARHYAHVDCPGHADYIKNMITGAAQMDGAILVVAATDGPMPQTKEHVLLARQVGVPYIVVALNKSDMVEDEELLELVELEVRELLSTYEFPGDDLPVVRVSALKALEGDPEWTGKLLELMNAVDTAIPQPERETEKPFLMPIEDVFTITGRGTVVTGRAERGILKPNEEVEIVGIREKSTKTVCTGIEMFRKLLDEARAGENVGLLLRGIKREDVERGMVVVKPGTSTPHTEFEGQVYILSKEEGGRHTPFFQNYRPQFYFRTTDVTGVVTLPEGTEMVMPGDSTSMAVKLIQPIAMEQGLKFAIREGGRTVGAGTVTKITK

SEQ ID NO: 10292 - protein, 698 aa, Actinoplanes utahensis
MAAADALAKVRNIGIMAHIDAGKTTTTERILFYTGITYKIGEVHEGAAVMDWMEQEQERGITITSAATKCEWKGYTIQIIDTPGHVDFTVEVERSLRVLDGAVAVYDGVAGVEPQTENVWRQADKYHVPRMCFVNKLDRTGADFFRCVQMMIDRLNATPLVLQIPIGLEADHIGVVDLINMKALTWRGETQKGEDYAIEEIPADLVDSANEWREKLVETLADVDDAVMEKYLEGEEVSIDEIRAAIRRATIASKANPVLCGSAFKNKGVQPMLDAVVDYLPSPLDIPAIEGTATDGETPMLRKPSNDEPFSGLAFKIQTDKHLGKLTYVRVYSGTLDSGSQVVNSTKDRKERIGKIYQMHANKREERATAQAGDIIAVQGLKQTTTGDTLSDPANPVILESMTFPEPVIQVAIEPKTKSDQEKLGTAIQRLAEEDPTFRVFNDEETGQTIIAGMGELHLDILVDRMRREFNVEANIGKPQVAYRETIRGTVEKHTYVHKKQTGGSGQYAKVVVNVEPLSLEADGPTYEFVNAVTGGRIPKEFIPSVDAGAQDSLQYGVLAGYPLVGVKFTLVDGQYHEVDSSEMAFKIAGSMAMKEVARKADPALLEPMMSVEVTTPEDNMGDVIGDLNSRRGMIQSMEERHGARVVKALVPLSEMFGYVGDLRSKTAGRASYSMQFDSYAEVPQNVAKEIIAKATGA

SEQ ID NO: 10293 - protein, 156 aa, Actinoplanes utahensis
MPRKGPAQRHPVVADPVYNSPLVTQLVNKILVGGKRQLAERIVYGALEGAREKSGTDPVVILKRAMDNVKPTLEVRSRRVGGATYQVPVEVRTPRQTTLGLRWLVQYSKARREKTMIERLQNELLDASNGLGAAVKRREDTHKMAESNKAFAHYRW

SEQ ID NO: 10294 - protein, 124 aa, Actinoplanes utahensis
MPTIQQLVRKGRQAKTTKTKTPALKGSPQRRGVCTRVYTTTPKKPNSALRKVARVKLSSQIEVTAYIPGVGHNLQEHSIVLVRGGRVKDLPGVRYKIVRGSLDTQGVRNRKQARSRYGAKKEKS

SEQ ID NO: 10295 - protein, 159 aa, Actinoplanes utahensis
MLQTMMQPPPPLPYGPPSYGAPVPPPPAGAGWEPERVDVVSGTDFGLVQLRVVPITSGLAIGSLIVGIGSILVALITACFGFGGASAWVAGAFSLLSVLAGGGAVTAAVIAMRQIKRSGGPGRVRFTGRGLAISGIACGAAGSGISLLALVLGVVLQTS

SEQ ID NO: 10296 - protein, 110 aa, Actinoplanes utahensis
MPTRHPLDPEPAPSTKARAVFVLGLVGLLAGPLVGGVIPATVALLLARQTAREAYAAGGYLTGGAWIRRGRRLAWGGLVLALTALVVALIAGLLHLAATPAGQQFSPGTD

SEQ ID NO: 10297 - protein, 1296 aa, Actinoplanes utahensis
MLDVNFFDELRIGLATADDIRQWSHGEVKKPETINYRTLKPEKDGLFCEKIFGPQRDWECYCGKYKRVRFKGIICERCGVEVTRSKVRRERMGHIELAASVTHIWYFKGVPSRLGYLLDLAPKDLEKIIYFASYVVTSVDAEARHRDMSTIENEIFAEKRQSENSRDSEIEKRAAKLEQDLAELEAEGAKADVRRKVKEAGEREMRQIRDKAQREIDRLDEVLDTFRKLDSKQLVTDELLYRELRDRFGEYFTGGMGAEAIKALLQNMDLDAEADNLREIIRSGKGQRKIRALKRLKVVAAFLNTRNSPLGMVLDCVPVIPPDLRPMVQLDGGRFATSDLNDLYRRVINRNNRLKRLIDLGAPEIIVNNEKRMLQEAVDALFDNGRRGRPVTGPGNRPLKSLSDMLKGKQGRFRQNLLGKRVDYSGRSVIVVGPRLKLHQCGLPKQMALELFKPFVMKRLVDLNHAQNIKSAKRMVERQRPVVWDVLEEVISEHPVLLNRAPTLHRLGIQAFEPQLVEGKAIQIHPLVCTAFNADFDGDQMAVHVPLSAEAQAEARILMLSSNNILKPADGKPVTMPTQDMVIGLYHLTHLTAGAKGEGRVFSSDAEARMAFDNGELHLQAPVKIRLRDVIGVDNGAKQAAWEAPEEWVEGEPLLVETTLGRVIFNETLPPGYRFVNYEIRKGQLSAIVNDLAERFPKVALAATLDALKEAGFHWATWSGVTIGMGDVIGPPRKPEILARYQVEADRIDKQYQRGLMTAEERRGELIEIWTKATNEISKEMETALPQENPLWVMINSGARGNLLQLRQIAAIRGLVANPKGEIIPRPITSSYREGLTVLEYFISTHGARKGLADTALRTADSGYLTRRLVDVSQDVIIREEDCGTDRAIPMAVGEREPDGTLVVHTHAETGVHARTIADDISDPNGNLVVARGTDLNSIIVDQLVAAGVENVRVRSVLTCESKLGVCAACYGRSLPTGKSVDIGEAVGIIAAQSIGEPGTQLTMRTFHTGGVAGEDITQGLPRVQEIFEARVPKGKAPIADTPGRIRIEDGERSRKIIVIPDDGSEEIVYDKISKRVKLRAHDGDHVQVGEKLTEGTIDPHELLRIMGPRAVQVHLTSEVQEVYRSQGVLIHDKHIEIIIRQMLKRVTVIDSGATEFLPGVLVDRALFESENRRLVGEGGEPAAGRPVLMGITKASLATDSWLSAASFQETTRVLTDAAINSRSDSLVGLKENVIIGKLIPAGTGISKYRNIRVEPTEEAKAKVYSMTGYPETDYGFGPASGQAVPLDDFDFGSYR

SEQ ID NO: 10298 - protein, 1146 aa, Actinoplanes utahensis
MAASRPAKTSRTSSAYAPRRVSFGRITEQLEVPNLLALQTDSFDWLVGNEAWQARTTDDPHAHSGLAEILEEISPIEDFSGTMSLSFSAPRFDEVKASIEECKEKDLTYCAPLFVTAEFTNNTTGEIKSQTVFMGDFPMMTPKGTFVINGTERVVVSQLVRSPGVYFTKEPDKTSDRDLTSVKVIPSRGAWLEFDIDKRDTVGVRIDRKRRQAVTVLLKAIGWSADQIRERFGWSELLMTTLEKDHIAGQDEALLDIYRKLRPGEPPTRENAQTLLDNLFFNPKRYDVAKVGRYKFNKKLEIDVPIVRGTLSEEDIVKTVEYLCRLHAGEEGYEADDIDHFGNRRLRTVGELIQNQVRVGLSRMERVVRERMTTQDVEAITPQTLINIRPVVAAIKEFFGTSQLSQFMDQTNPLAGLTHRRRLSALGPGGLSRERAGFEVRDVHPSHYGRMCPIETPEGPNIGLIGALSTFARVNPFGFIETPYRKVENGVVTDEVHYLTADEEDRYIKAQANAVLSSDNTFAEDRVLVRRKGGEVDYVPGTEVDYMDVSPRQMTSVATAMIPFLEHDDANRALMGANMQRQAVPLVKAESPLVGTGMEYRAAVDAGDVVVAEVAGVVEDLCADYVTVHQDDGHRRTYLLHKFRRSNAGSCVNQKPVVFEGDRVEAGQVIADGPCTDEGEMALGRNLLVAFMCWEGHNYEDAIILSQRLVQQDVLTSIHIEEHEVDARDTKLGPEEITRDIPNVSEEMLADLDERGIIRIGAEVVPGDILVGKVTPKGETELTPEERLLRAIFGEKAREVRDTSLKVPHGETGTVIGVRTFSREDGDELPPGVNELVRVYVAQKRKIQDGDKLAGRHGNKGVISKILPVEDMPFLEDGTPVDIVLNPLGVPSRMNIGQVLETHLGWIAKTGWSIEGDDEEWKRQLRSIEAHESPADSNVATPVFDGAQEEEIKGLLESTLVNRDGKRLVNGDGKAQLFDGRSGEPLPDPISVGYVYILKLNHLVDDKIHARSTGPYSMITQQPLGGKAQFGGQRFGEMECWAMQAYGAAYALQELLTIKSDDVLGRVKVYEAIVKGENIPEPGIPESFKVLLKELQSLCLNVEVLSSDGVALEMRETDDEVFRAAEELGIDLSRRPNEGVSSVEEI

SEQ ID NO: 10299 - protein, 35 aa, Actinoplanes utahensis
MAEIRPGSPPSASLDPWRCFVVMSPLLSVGESEPG

SEQ ID NO: 10300 - protein, 126 aa, Actinoplanes utahensis
MAKLSTDDLLDAFKEMTLIELSEFVKQFEEVFDVKAAVAVAAAGPAAAAPAEAAVEQDSFDVVLESDGGKKIQVIKVVRELTGLGLKEAKDAVEAAPKAIIEGVNKEKAEAAKAKLEAEGAKVTLK

SEQ ID NO: 10301 - protein, 182 aa, Actinoplanes utahensis
MADKPVRADKATAVAELTENFRDSAATVLTEYRGLTVKQLTELRRSLGQQAKYSVAKNTLAKRAAGDAGIEGLDALFTGPTALAFVSGDVVEAAKGLRAFAKANPALVIKGGVFEGKAISAEDVSKLADLESREVLLAKLAGAMKGNLSKAAATFQAPLSQAVRLVDALRDKREKDGSAEAA

SEQ ID NO: 10302 - protein, 232 aa, Actinoplanes utahensis
MTALIRMRLAGFFHGGRVLAPLIAVLVVLGVLYGGGASPAATAYGYSAAALFPILAWLAKVVLDTEPDVQRRLARLAVGPVREGLAGLLAATLAGAAVCAAAMLTPWAFHAIRGPEPGSAEASLPAGILLGVLAHLLALPAAVALGALSGRAVTRRILPGVAVLVTGSLLVVVLGLNGSFAPWLAPPVMAVARVLTDGAVPPAAELARLTIWSLAWCTVALATYGWLRRARS

SEQ ID NO: 10303 - protein, 291 aa, Actinoplanes utahensis
MRFDGVGFRYARRAPWALRDVSVTIDPGRSVVVLGPNGAGKSTLLQLAAGVLRPVRGVLRDRPPVVGWVPERFPADQPFTALGYLRATAAVRRVPATAADHWLERLLLSEHADTPLTALSKGTAQKVGLAQALLARPGLLVLDEPWEGLDAQARTLIPQIVAEVTTAGGIVLVSDHRGEITTLPDTIHWSVAAGAVTVAQPVGTDRDAVAGEPEAVTGEPGAVTGEPDAVVAERDEVVVEIAVPRTAAARTLVQLRSAGHHVLRVRDRADYGVRDELSPPRADRTPDGEAR

SEQ ID NO: 10304 - protein, 239 aa, Actinoplanes utahensis
MAQRSKIYRAAAAKIDDGKLYEPKDAVALAKETSSAKFDATVEVAMRLGVDPRKADQMVRGTVNLPHGTGKTARVIVFAQGAKAEEALAAGADEVGTDELVARIQGGWLEFDAAIATPDQMAKIGRIARILGPRGLMPNPKTGTVTVDVTKAVNEIKGGKITFRVDKHSNLHLIIGKASFSTEQLIDNYAAVLDEVLRAKPSAAKGKYLKKVTVSTTTGPGVPVDPNAQKNLRGESADA

SEQ ID NO: 10305 - protein, 238 aa, Actinoplanes utahensis
MPEYDDETAQFADEQSSPITDESVEEADETPVAVQEPEADEDYDPVKELRQKLRYAPGDWYVVHSYAGYENKVKTNLETRITSLDMEDFIFQVEVPTREEVEVKNGKRNQVQAKVFPGYILVRMDLTPESYSCVRNTPGVTGFVGATDRVDRPAPLSLDEVLKWLAPAVQAEEKKAKPEIKVLDFEVGDSVTVTDGAFASLPASISEINADQQKLKVLVSIFGRETPVELNFNQVTKI

SEQ ID NO: 10306 - protein, 125 aa, Actinoplanes utahensis
MADKNRPGDDVPGDDELLADVVDGDDADEADAPVSRGGGTAVAERTKDDDSPKTKKERKRTGFFGRIGGFFREVISELRKVIWPTRKELLTYTTVVIAFVTIMTAIVGVLDYGFAQGMIHALGGK

SEQ ID NO: 10307 - protein, 131 aa, Actinoplanes utahensis
MGDVLEPQTFRITRADLVRYAGASGDFNPIHWSDRIATGVGLPGVIAHGMFTMALVGRAVTAWAGAPDSVKEFSVRFSRPVPVPDTDEGTEVVVTATVKEITEDGDTRLALTATCNGDKVLSLAQALIGKR

SEQ ID NO: 10308 - protein, 166 aa, Actinoplanes utahensis
MRRPESLRAAHCSLWGMPLDQTFAGRTWPPTDTYLVGREKIREFARAIGATEAEYHDPEAARALGHPDVVAPPTFPVTITMAASRQVINDPALGIDYSRVVHGDQRFAYTRPLVAGDAVVCVNTVDEITTRGGHWFVTIRTEVRTEAGEPIVTAWSKLVQRGEESA

SEQ ID NO: 10309 - protein, 55 aa, Actinoplanes utahensis
MAKATDVRPKITLACTECKDRNYITKKNRRNDPDRVELKKFCPRDGKHTLHRETR

SEQ ID NO: 10310 - protein, 842 aa, Actinoplanes utahensis
MPRPSGPQQRSEQYSWAITGPMALFAVVCTTGFWVTDTDWWRAWPLGLLICVLWTVASFAAFNVVVRRSSFVLHLNEVPLVLGLFYLPPMMVILTIVCGNLLTLLKGPYSPVKTFYNLARAAASICAALLVIEPFRPLVATSPKTWAILFFATVLMLLVQLASLFGVLSVVQGIQAGRNVVRPMLSSFIVPCISATVGLLFLNALDATGWSVLLMAVLIGALVFVLRSFAGFFRQHQTLADVYEITQAVRNEVSDHGLPDVLLGRVRTLMNAEFATLWLAPRERYPEMLLSAQVDNAGLLDMSPLPSAVRDLVVERRSPIAFGRQFAEDARVRGALRGVRVKDAVVVPLRSGQAVIGTVEVVNRIGEGRTFRDSDVQVLETIAAHAAVAVENSRLVDRLRYDAYHDRLTAMPNRRRMLDALAESVRVAVEGEVVAVLLFDVDGQRNVNESMGHAAGDKLLAEVAERLRGIAGPGALVGRVGGDEFMVTLRAQGIDATIELATQMRERLRGPMAVGSLTLDVDTAVGVSVHPDHGADPETLLQRAELAANAAKVLPYGVQPFHPALESRAVRRLGIAADLRRAIDSDQLEVYFQPKVTLTDRHVLGVECLARWVHPAHGEVAPEDFVAVAEHTGQLARLTEVVLTAGLRHCRAWADADRPLSVAVNLSARTLLDSRFPDLVQDLLGVHQVDPGQVTFEISEPGMLSDIERVLPTLYRLRDLGVRLSVDDFGTGASSLGYLRQWPVHEVKIDDTFVQGMATDSGDLAIVRAIVSLAREFGLTVVAEGVESELTLELLEEMGCEIGQGYLFSRPLPFERLEAWLSAQTEPESTPTGEVRRLRAVI

SEQ ID NO: 10311 - protein, 130 aa, Actinoplanes utahensis
MTPDDLERHHTLTTATRRYDDLRMRDALAAMGRDDDNPGLTPAETLEMLALSEIISRKAGYGRQAMVRSARAAGVSWTRIGAALGTSKQAAWEAHQRWIDDQARQHEQTGYQGLDPESAHDARGLAGRPD

SEQ ID NO: 10312 - protein, 269 aa, Actinoplanes utahensis
MIDAVVDQDWLRAHAAEVIVADVRWYLDGRSGRAAYERGHLPGAVFIDLDTALAAPASPAEGRHPLPDPAVFAAAMSAAGIGDADTVVAYDDAGGVIAARLVWLLRALGCEAALLDGGLPAYAAELTAEPAPRRAAVFSARPWPEDRLATLADTADGGHLVLDARDAARFRGDSEPVDPRAGHIPGARSLPCRDNVSADGRFLPVPELRERFAAVGVSDASEVISYCGSGVTACHNLLAMEHAGLGRGRLYPGSWSQYSATDRPAAIGD

SEQ ID NO: 10313 - protein, 208 aa, Actinoplanes utahensis
MTHAVLSFALLGALLTITPGLDTALVVRSAVTMGRGPAFATALGINAGALVWGAAAAVGVSALLTASAVAYTVLRVVGAGYMLYLGVRMIVSALRKPAVTGEVAVASAATWWNTFGRGLLTNLLNPKFGAFYVAVLPQFIPAGSPPLGAGLLLALVHDLEGLLWFTLLIFGARAARGFLARRTVRRTVDAGTGAVLIGFGLRLGLSGD

SEQ ID NO: 10314 - protein, 96 aa, Actinoplanes utahensis
MSTEVLGGLAGLALFIFGMRMLVWGQAPGMIVRSFRSVRDAGYYHLLFGLALLIYVGGLHLPGTVAAQAAGLLAVVLVGVAVVRFRPRGRGPTRKA

SEQ ID NO: 10315 - protein, 163 aa, Actinoplanes utahensis
MAANPSFDIVSKVDRQEVDNAYHQAEKELSTRFDFRGTGTELAKSGEAFTITSETEERATAALDVFKEKLVKRNISLKSLDAGEPRQSGKTFKIDLKVLEGIESDKAKAISKKIRDEGPKGVQAQIQGDSLRVTGKKRDDLQAVIALLKAEDFGVALQFTNYR

SEQ ID NO: 10316 - protein, 341 aa, Actinoplanes utahensis
MVCVDCEVYSEVMAAVIERWTVTGPEFRGFYNVNAVAQTDAGVAIVRSRIPATDQMDLRPLDEVAILEAIAGRVYAPQVWRTDPARRFFVCSFVGEATLNEISPRGTAVMMQQMDSIIGTMAALTTVPVSAFVAMQRDSISALGLPVTSTLDMLVSHLGLLANEAIERRPILAAALSLPSVDGIVSAIPQREVARPDVLMHCDLHRKNLRTGAPGGGLYVLDWELALVGDPLYDLAVHIHKMSYPEWQKEAFISAWKERVMPTGWSDRDFGAYLAIERSKSAYVDLLRSMQNVLQGTVDAETMAIKYRSKLVDLARVVDVPVPSVESIAAEFRAEAARNEK

SEQ ID NO: 10317 - protein, 185 aa, Actinoplanes utahensis
MSVGVVDHVGPWTEDEYFALGETTDRIELIDGSLVVSPAPSMSHQRLSRRLANALDEGAEPAGLFVYEAINVRLNTGRIVIPDLAVVDQDEEAVTADASRVLLIGEIVSPSNAAMDRVLKMQLYAAAGIGWYLLVEHEAPDSLTLRLNRLDGQHYVEETVVKTGASLTSEYPFRFDLDTRSLVRR

SEQ ID NO: 10318 - protein, 100 aa, Actinoplanes utahensis
MEFTVAEVPDKGRFEARTDTGALAGVLTYQMTGPIVVFTHTEVDPAFEHQGVGSALARTALEDARARSRTVVPMCPFIAAWLDQHKEFEPLVARNTRRIK

SEQ ID NO: 10319 - protein, 218 aa, Actinoplanes utahensis
MNGIALSVNVGASEPSMGKDVPTTGINKKPVSAPVQVRAPGPRRTGLHSGIVGDHIGDTRHHGGDDQAVYAYATEDYAWWAANLGRDLAPATFGENLTTSGLDLRDGVIGEQWQFGSGLLLQVTFGRIPCLTFQNRMAEPRWVKRFSQANRTGAYLRVLTPGTLVPGDRITVTDRPSHGLTLTEAYEIYMHDPTRLPRLLEAPELPPAMLAEVTDRLT

SEQ ID NO: 10320 - protein, 270 aa, Actinoplanes utahensis
MTWEIRSDLDRFAAVAGDFLRASPVRHTVFLTLIDNLRSRGLHAYGAGDPVFGWWITPGDDSVSGVLLQTPPHPVMFTALPAPAVPAAAAALRSRPLPGVNMLVDDLPAFVGSRAHQPGMRTRLHPLGTLTPPSPPGAARPAGPADRDLVTAWLTDFFAVTGEPRADVAAVVDELLPRVTLRVDDATPVSMAVRSRPAAGMIRILYVWTPPALRRHGYAAGATAAATRAALDEGAAEVVLYTDLDNPTSNALYHRLGYRPVEDRAVVTFA

SEQ ID NO: 10321 - protein, 347 aa, Actinoplanes utahensis
MAPTRFSGLDEVMTRVPLSVLDLATVREGHGSADALRGTIATARAADELGYARFWVAEHHNMPAVASTSPPVLIGAVAAQTGRIRVGSGGVMLPNHMPFVVAEQFALLEALYPGRVDLGIGRAPGTDQATAAALRGVSPHLTVERFPEHLRTVLGLLGDARVAGAAGRLHATPAPETYPQVWILGSSTYGAQVAAALGLPFCYAYHFAIAADVDAALQLYRSGFQPSPGLPEPHVMVSASVIAAETTEEAEFLAGPSRIMALSLRTGRLGPIISPEQAATRELSDLDRQMLHALPGTQYAGTADEVVAGLDALVARTGADELMLAGTVYDPETRRDTLARIAKAWGR

SEQ ID NO: 10322 - protein, 158 aa, Actinoplanes utahensis
MAKEVTGPGRRGEQIESLRAADSDRQLIADQLKGALDEGRLSLHEYDDRVAAAYAAQTYAELLVLVRDLPQPGTSAAEVRARQAAESRRESRRLPVALIVLWTVWAALAAVNLVVYALVRTTVDHEIYPWPVWMLVPGAALAAVTAGVQVLRHQQRRP

SEQ ID NO: 10323 - protein, 301 aa, Actinoplanes utahensis
MPKESNVHSHHNGLKTAALLGLLTGLILAVGYWLGGSTGLVIAVIFSLVTNAVSYFFSDRIALRAMGAQPVSEAEFPALHQIVRELAAQAGQPMPRLYVSPSMQPNAFATGRDPQHAAVAVTAGITRILDARELRGVIGHELSHVYNRDILISSVAGALAGIVTMLAQLAIFLPFGGSDDDDAPNPASLLLMLILGPLAASIIQLAISRNREFQADASGATLTGDPLALASALEKIHYGTQRMPLPAEGQLTSAAHLMIANPFRAEGIAALFATHPPMVERIRRLHEQASLTGGASRPYLR

SEQ ID NO: 10324 - protein, 484 aa, Actinoplanes utahensis
MSQSVDHFALLPLYAAAGTAILAFLADLFLANRTAVLSATALGGLATAVLALVVGPEPGTFCTTGACSWLPTWPAAVTAALFAALTVGVLALSTPALRLGIAPAGEFCFLLACSMTGGVVIAYAGDLITLIVGLETLTLPLYVLVGLRRFAPGERPTTAGVSASLTFFLISVVSTAVTLLGAALNYAATGSVHLALLHPATGPFRPLAGVGVALLVIGLAFKVAAVPLHAWAPATYDGAPLPVAAYLSTASKLGGVLALAAIVARLDARAVMAVLAVLTMTIGNLVALRQTRMVRLLAWSSIAQAGYILAALALGAPGVPAALAYAVLFMVLEFIAFTVVTALRLPGADGGTILDHRGAARRNPWPGAALTLSLAGLAGLPPGLAGLFAKLSVVDVLIRHHWSWLAAVVVLNAVIALAYYIRVTATLYSLPPRIGMTVADPALMDAALHPRLPVSRPVAATLAVSVAVAIVLGFAPQLLFAALS

SEQ ID NO: 10325 - protein, 519 aa, Actinoplanes utahensis
MFHDYAYDTATWTAGSVLLLALLVVPAVGAAVVAVLPARHDRRARIVATVFAGITFGLSIVPVFAGQRGQVWVGFTGRDTVPLMPWVNLDLPWVPALGLRFHLGVDGVSYPLIVLTGLLTLLCCAYTVRKVPRGGGSGRTLSALLLILEVGVLGTFLALDLLLFFVFFEVVLLPMYAVIAGWGGPERRAAARKFVLYTLAGSVLLLLGVLLVTTRVGTGDLISLTGAPMLSRTTQCVVFALLAVAFAIKAPLWPLHTWLPDAHTEAPTVGSVVLAGVLLKMGTYGLIRVGVGVAPQGASWAAPVLGVLAVIAILAGSLICLRQRDLKRLIAYSSVGHMGFVLLGIATLTVTGLQAALLGNVAHGLITGLLFFLAGTIKDRAGTGSLDQLSGLRETAPRLAGLLGFAAIASLGLPGLAGFWGEAFAVLAAVRRGGPLWLTLAAVAALGGALTAAYFLRLLRRVTHGPTTPTVHALRPSIAGVEWFAWTPLILLTLAVGVIPALVIAKTAVPLTTLLGGHP

SEQ ID NO: 10326 - protein, 637 aa, Actinoplanes utahensis
MTTDVLGALLPGIPLLLGLLGLTLRPGDGGPRRLAATLGIAGAALALLDAIALLAITTSRAAPLAAGTTWARFGDIEVTLGFAVGPAALYVALAVCVVALCVQVYSTTYLHDDPRYAPYAAQVALFTGAMLLVVSSGDLIGLLIGWEVMGACSYLLIGHDRRLPEAPAAAVKAFLVTRVGDVGFLLGIALLVAGAGTSRLSVVLTHSYGHGTLIAALLLLLAGVAGKSAQFPLHTWLPDAMAGPTPISALIHAATMVAAGVYVVFRTFPLFQQSPAALATLAVMSSITILLGALSAMAQDDMKRVLAWSTVSQIGYMTGALAVGSPAAALFHLLTHAAFKALLFLAAGAVIHTVGGNHLSRMGGLRTHMPVTFWSFVIGLSALAGLPPLAGFWSKENVLTAAAHATDGGGTAPVWAAWLVWVAALLGVGLTAWYATRLLLRAFFGPSRAHGPAGPHWEVGFDDARYQSPAVPHDPPGPMRWPILLLAIPAALLGLAAFAPGFRHALELDDPHLSVAILLPMLLLATGAGTAWWLWWAVPGADPAEALGRARPLFAAGFHLDHVQSLLVVRPAKALARFATAADERVVDAAVEGAGTATRGLGGMFADAHRASLPGAAVLVLFGALILSVVAWLGALG

SEQ ID NO: 10327 - protein, 118 aa, Actinoplanes utahensis
MHVTVPYVIGAWLFGLGAYGVVRRRNAILVLMAVELMLNAVNLILVTADVSLRPTLRGVPSESWATPNAQPGSGGVFALFVIVLAAAEVGVGLAIVLQYYRMRRAVAIDEVALDEVDQ

SEQ ID NO: 10328 - protein, 189 aa, Actinoplanes utahensis
MTVADVLMLALGAVAVGSGALVVTSAHLVRSGLYLVVSLGAIAGLYLVLGAELVAWTQVLVYVGAVVVLLLFAVMLTRAPIGPSPDLDRPAGPSALIGAGVGLGLAALFADAFRWIEYPRAAPGTAERIGAQVFGTWVLPFEVLSILLLSALVGAIVLSRPDIGRRTGHPSAPGETTDRQTDEDEEVPA

SEQ ID NO: 10329 - protein, 199 aa, Actinoplanes utahensis
MTDDGDHLVPGKGLINGLAVTLKTLTRKTITQQYPDVEPELPPRSRGVIALLEENCTVCMLCARECPDWCIYIDSHKEEVVVPGAARARQRNVLDRFDIDFSLCMYCGICIEVCPFDALHWTPEFEYAETDVLSLLHDKGRLGEWMRTVPPPPAHDVLGEPSKEEATAARKAAGPGAATAAKTARPATVRPQQRPESQQ

SEQ ID NO: 10330 - protein, 319 aa, Actinoplanes utahensis
MPLWLDLLIRVAAVMVGFLVLPLLVGQAEHKVMAHMQGRVGPMYAGAFHGWAQLVADGVKFVQKEDVHPDGADRPVFRLAPIVALFPYLVVILTLPLGPHGLVAQRLDIGLFLVLAILGIGVVAVLMSAWASANKYSLLGGLRGAAQLLGYELPLVLAAASVAMAAGTLSLPGIVEAWRPWWLIWQAPAALVFFIAGLAEIRRPPFDMPIADSELVFGYMTEYTGLRFAFFLLAEYVGIIVIAALTTVLFLGGWHGPFADHLGWLWTLLKMAALSFVIIWFRVTYPRLREDQLQRLCWLILVPVSLAQLVLTVAVKSLL

SEQ ID NO: 10331 - protein, 206 aa, Actinoplanes utahensis
MTPEEVGERLVHLMETDDPGLGVVTAGVSGGGPGHSRAVVDVPVARWWHAATIARDPGALGCDFFDWLSAVDELDDGFDVVAHLWSTRRRHGLLLRTRVPRADPEVESLVDLYPGADWHERETFEMFGIVFARHPGLRPLLLPPEFEGHPLRKEFVLAARVAKPWPGAKEPGESEHGTAKRAPMRPPGVPDPSEWGPRRTRGGEAG

SEQ ID NO: 10332 - protein, 164 aa, Actinoplanes utahensis
MPPDPPSFDEVYAAHYADLTVQLYAYFGDRQEAQDVVQEAFCRAFTRWRKVSGYGDPVGWIRRVAWNLAVSRWRRVRTSIGFLRRQTVAELHTEGPGPDRVALISALATLPGAHRRALVLHYLADMPITEVARREGVAEGTVKSWLHRGRAAMAARLNLTIGGE

SEQ ID NO: 10333 - protein, 322 aa, Actinoplanes utahensis
MAASRSRGDGRPAESDHRRRVMADQIERLFADLRTDTLPRIRPPGADAARRTVRRRRRRAAAVTGIGLAVLAVAAFTTPLRLSSPAEPAAPLSQAERDSLALDAARVIRLHDYPQTNGGTITGDGPLVTLDVLPGEYDFVAACAGQAGTVDLRAGETHLELPCGPAPDKKAITVAVTGRRQQISVAARSDPAALGRVGIGWALNLSEKSRAQLMAAARQAIGDNASSTFLDDNGASGVQDNSVRAGSYRVTAACIGTGPVHGQAGNQQATGPFHPLKAFVVECDGKAHDFDVTMPAGSKMGFFEFSTVASAQGALGYRVTRR

SEQ ID NO: 10334 - protein, 433 aa, Actinoplanes utahensis
MSSASRADFIVDVLAREFGELMAIDPTAFRRKFRKMAASPFAFYRGSASLFYADQVGDFRDDSYLDERTSRVWIHGDLHAENFGTYMNSSGRLVFNVNDFDEAYVGPFSWDLKRFSASVALIGYSKALSDDSISALVTTFAESYLTELRAIAQGGDDAIGSITLENADGVLRRVLQEARLNTRVALLDGQTTVDDYERRFSLGDGVFEVDEATVARVTAAFDRYLATLPDTGRPISTNIKDIKLRKGVGIGSAGLPSYNLLLEGHTEALENDVIIYMKQAQVPAVARWIDDERVRSYFKHQGHRTAESQRALQAHADPWLGYTELGGVGQLVAEVSPYAADLDWSDVNEPEELSGVIADLGRAVARMHSVADDESSHDLVDFSTEEAIVAVVDKDEKGFVAHLVDFAHKYGDQAREDHQDFVDVFRNGRIPGL

SEQ ID NO: 10335 - protein, 178 aa, Actinoplanes utahensis
MALPGVLGEPIRFVLNWGRRYSLWVFNFGLACCAIEFIASSMSRHDFMRLGVIPFAHGPRQADLMVVSGTVTDKMAPAIKRLYDQMPEPKYVISFGSCSNCGGPYWDSYAVTKGVDQIIPVDVYVPGCPPRPEALLHGILRLQEKIAAEQSGPGGVSRPDPLTRTAAALTAPVVAPPV

SEQ ID NO: 10336 - protein, 361 aa, Actinoplanes utahensis
MRERLRHQIQSRPSKWEQGLRKFLTADAVAASNSIEGFRVSTADVQDLMDGERDVEVSDENREETLAYQRMMTYVQTLHDFADFSYSKGLLNALHWMLQGHRHTPNKPAGQWRHGPVYVTAPGHRTRTLAYTAPDASEVPGLMSELVDWLDTDDGAHPLIRAAMAHLILVSIHPWADGNGRMSRSLQTLMIAREGVLAPEFSSIEAWLGQSLNTFEYYRVLQARGSTYRPNQDVSPWIRCNLTAYHQQAQMVQGQADLSATVWERLFSFAGQKGLDERVVSALHDVAVFGRIRRHRYEQAEGLTLQQAQRDLRDLAAAGMLEPVGRTRARYYIEGSNFPQQVLEDARRPMSLIDPYENAVG

SEQ ID NO: 10337 - protein, 33 aa, Actinoplanes utahensis
MAKSFAHHVDLGEDRLVSGFKSGSRVEHDSIKQ

SEQ ID NO: 10338 - protein, 56 aa, Actinoplanes utahensis
MAGYAFGSLVTGAFGTVPGLLLPPYLTDTLGVAAGVAGLLVLSPKAWDALSTRWPS

SEQ ID NO: 10339 - protein, 463 aa, Actinoplanes utahensis
MGSVAAGVAASHPATARTGVRILEAGGSAADAAVGAVLACCVAETIYTGLGGGGFATYFDAHTGQVTCLDFFVAVPGLDGDRKPEPMVAVDVFFGGLPQIYSIGGASVAVPGVPAGLGEVHRRWGRLPWRDVVAPAAGLARTGVLLPAAHARTLQSCAPALAFGEGAAPYQPGGRLLQSDELLFHDGLATAMDALASDGPGVFYGGEYADLLVATVRAAGGTLGPGDLGSYRVAEVAVDHATLAGYRVCARHDLNRTVDTIGALPADLSRPGRAAAVATALRNLGAQRLGDTTNVSVVDPDGNACVVTTTLGLGAGVWLPGLGINLNSMLGEGELLTEPLVPGQRMSSYMCPLVVIGPDDSLTVAAGSAGASRIRTALVDTLLGVLVDGLDVADAIARPRFHAVGDTIHAENGCPPAELATLREAGWHVVEWPELNHYFGGVTAVGQAGVAGDPRRGGVGLLL

SEQ ID NO: 10340 - protein, 324 aa, Actinoplanes utahensis
MCHRCSRQRAVLTKENDMHVIIGSGPIGANVARLLADRGERVRIVTRSGSGPEHALIERVAGDAADAQRLTELARGAEVVYNCANPKYTEWADKWPPMNHAMIEAARAADAVYAITGNLYGYGPQPGGVMTEDTPLAATGRKGRIRARMWQDALASGVRTVEARASDYVGAGAVSTISAVLLPAINKGRAAMAPGDPEAPHTFTYTGDMARTLVTLARDERAWGKPWHVPSGPAISMRELADRYCDAAGVPRVKVKGLPRFVMRTAGLVVPIARELAEMDYQFYAPFHMDSSRTQRTFGLTPTDLDVALRETAAAAEATAARRM

SEQ ID NO: 10341 - protein, 240 aa, Actinoplanes utahensis
MQEHCSRCGTLAPMKAANLRARVRAEMTEEIKQVAQRHLATDGANLSLRAVARDLGMASSAVYRYFASRDELLTAMIIDAYDAVGAAAEQAAETTDDPMRRWVAIGHAVRDWAVANPHQWALIYGSPVPGYQAPQDTVVPATRVIFALAATTQMALAQGRLGEVPAQPEGRFGEEMAAVAAQINPDAPAHLVGAVMYGFVHLCGAVSAELFGQLNNTIEDDRRGFFEWQMRAAGRFAGLL

SEQ ID NO: 10342 - protein, 269 aa, Actinoplanes utahensis
METGQASRTAYAAARYRAAHQVLEDGAIFADPLALRILGHQPDELLGDAPRRGMRLFIAARHRFAEDHLAAAVGRGIRTAVVLGAGLDTFAYRNPHPGLEVIEIDHPDTQAWKRERLASTGIGIPGNLRYVGIDFERDDLEARLTLEQPAFFLWMGVVPYLTVDGFTETLRFVGGREGNEVVFDYAQSPERMPAERRAALEARAARVAKIGEPWLTFFEPEEIAATLGAHGFGDIEDLGPSGLAARFFGRTDVPADTAGGHILHARRGV

SEQ ID NO: 10343 - protein, 107 aa, Actinoplanes utahensis
MTPQEYVEAVLTLVESIPEGRVMSYGAVADALAEVSGRNSPRQIGGIMSRHGGGVPWHRVVTSAGRLPPGHEREARARLLAEGVPLRGDRVLIEKAGWSPDGDRTGE

SEQ ID NO: 10344 - protein, 393 aa, Actinoplanes utahensis
MSSPATIWDPDRIDTGRPSRMGRVREVVTGARRIVVKVGSSSLTTAAGGIDEQRLDSLVDALGRLAGAGREVVLVSSGAIAAGLAPLQLPRRPRDLATQQAAAAVGQGLLIGRYTAGFARHGRTVAQVLLTVDDVTRRSHYRNAYQTLRKLLDLGALPIVNENDTVATEEIRFGDNDRLAALVAALVDADLLVLLSDVDALYTGSPSDPASRRIPLVRDDADLAGVAIGSAGRSGVGTGGMVTKVEAARIATGFGIPVVLTAAPLAADALTGAEVGTLFQAAESRPTARLFWLAHATAPRGRLHLDAGAVTAVVARRKSLLPAGITAVDGSFAAGDPVDLVDAGSGAPVARGLVNYDAVELPALLGRSTPELAAALGPGYEREVVHRDDLVLL

SEQ ID NO: 10345 - protein, 413 aa, Actinoplanes utahensis
MSVLEQAAAARIAAIDLAGATRADKDAALLLMADRLVERTDDIVAANAVDVAAAREAGTGEAIVDRLALSPARVAAMADGLRQLAALPDPIGDVVRGSTLANGLELRQVRVPFGVVGMIYEGRPNVTADAAGICLKSGNAALLRGSRSAFSSNAAIVAVLRKAVADAGLPINTIQLLDATTRDSVKDLMRARGLVDVLIPRGGADLIRTVVEESTVPVIETGVGNCHVYVDAAADLEKALSITMNSKTQRNSVCNAAESLLVHTEIADSFLPLILSAFAEAGVTVHGDSRVAGYSDAVVPATEQDWGTEYLSADISVAVVDSLEDALDHIRQFGSGHTEAIVSESLGATRRFTAGVDAAAVVVNASTRFTDGGEFGFGAEIGISTQKLHARGPMGLPELTSTKYIVTGDGHIR

SEQ ID NO: 10346 - protein, 268 aa, Actinoplanes utahensis
MVDIDAAIGYVVAHGDPVERARLHYLRTGQPASPEIIDRLSGGQMSEGGWPASADGQVPSVDATCFRLSELDDLGGLQAGPVAERALTWLASAQRSDGTWQEHESLAGEAPAWAMPGEPEATLYLTSVAGFWLTAAAVESDPYQTRGRNGEVLGRAAAFVASQLRPDGSWPSFLAAGWHLAGLLHQQQYFYESSRVQIVLGERLGDMAPADVAAMAAALRRVNLGDDWLLRNTWKRLGETQRSDGGWDSNEGPVFDVNVTLTALRACR

SEQ ID NO: 10347 - protein, 393 aa, Actinoplanes utahensis
MALPPLVEPAAELSVDEIRRYSRHLIIPDVGMDGQKRLKNAKVLAVGAGGLGSPTLLYLAAAGVGTLGIIDFDTVDESNLQRQIIHGVSDVGTPKAESAARSIAEVNPLVNVVIHNTALDRDNVKEIFSQYDLIVDGTDNFATRYMVNDAAVLLGKPYVWGSIYRFDGQASVFWEEHGPCYRCLYPEPPPPGMVPSCAEGGVLGVLCASIGSIQVNEAIKLITGIGEPLVGRLMVYDALEMEYRKIKVRKDPNCVLCGENPTLTDLMDDYEDFCGAVSEEAQEAVTGSTITARELKDWQDTGKDVFLVDVREPAEWEINRIPGAVLIPKGEILSGEALAKFPQDRQIVLHCKSGVRSAEALAALKAAGFKDAVHVQGGIVSWVNTVDPSLPSY

SEQ ID NO: 10348 - protein, 960 aa, Actinoplanes utahensis
MAAETSTAARPRKTLSSDASPAGTTPRKPAAGTPRKPAGGATPRKTISRGGEPARPALHPGSDRDESGGRHRRSGEPVETSGGRHRMSGEEPLARHRAEGAPPRLNPSAGALQGSAAGGPQGSAAGALQGSAAGALHGSAPGAPPGSSVGSADQPAGVPDRSSAARHAQPRPAPPPVDPETGLPPGMTRGILELAAERLAASRAAQAAARAAQATPTDTDSAVPTRQDAAEPGAPGVPDAGWAAADLRRHSPEASVGHGHRPSFLPDAGPQAARGVDVYGQPVETAPRASAAGAASAAPDVDVYHQPVVITEAELHAPAEVEPQPVDWQSMRRMRAARAAALSEQRAEPRPDPAAVDGQGAGLQQQEPPAEAEPIVEPDRPSRRRPILRTTADTPAQPQDAGQAVHPEAGQTAYSPGTEPTAYPQGAGPTAYPQAAGPTAYPQAMGQQDAAIRWSEADLDSLRPALPPQFVSDTAEIPRVYPDLHDRSVAWPEPEPEDPHDAWFWSTTDHPPAGLPESLRLPAGIPEGLWHPAEDERAAAGSDLAGTGLAASDVAGMDPAWPAEDAGSAGYPEYAELAGDVGFAASMGHTGYANPADQTAFGEQATHEQPAYVDPQQSGHIPAPAAAPAGADAAGLTGAHAAGLAEAHAVEVNTAAAAEVHADDLPTARGGATPVVEIDRDAPPDVDGQPEESGTLTPDGRKLLRRRRRVTFLAYVMVVALVLVVGHELRDRQRPVAEPEAARPAPIGAPEADRGQRDHLAEQRGSALSETNGKAGHFRYVTSRGSVLGTGGDLHRFKVAVEETVGDVAPDDFARTVDRTLGDRRSWIGGGKVRLRRVPKSADNAEFTVFLASPTTSEKMCAAGGLHTEGFTSCRVPGQVIINAERWATAIPEYDGHLGEYREYTINHEVGHQLGHGHEGCPGKGEPAPVMLQQTYGLEGCTRNAWPFLDGERYAGDARP

SEQ ID NO: 10349 - protein, 293 aa, Actinoplanes utahensis
MVPSGTPTLEPPARATDRWRQWWPALFAITLVLLVVITVAVRHSGRPTPSAAATPSPAASPSAAPTSAAPTLEHTSAPPSAGPTSLDPEILQVPGAVPTHGSGDFVYAVKRGAVLGGKGPIRRFHVAVEKGSGEDANAFATLVVSTLGDARSWVGDGNLRLQMVDADDHADFTVYLATRETAGEMCQRGGTNIHIGGVPYTSCRVPGAAIINLDRYRKSAKPYLAAKIPLATYRMYVINHEVGHELGHHHEGCPEPGGPAPVMVQQTLMLRGCVPYSWPRLDNHPFTGPSVSH

SEQ ID NO: 10350 - protein, 315 aa, Actinoplanes utahensis
MLAGEDTLLPEGEVPPPWPARRVEVGGAMLHVRDTPALGPDAEPAVYVHGLGGSSQNFTDLAGLLADRFDGQAVDLPGFGYSDPSPRYSIPAFAATLIDYLDASGRGPVHLVGNSLGGSISVRVAALRPDLVRTLTLISPAMPFLDPRRTAQGPVLPLLALPGAERLMAWALTRVTAEQMAEQVLAACFGDTSKVHPQRRAEAMAEIQLRYTVAHYPRAYLGTLRGLVGSFLRAYLPGVNSQWRLAAQIQAPTLVIGGLTDKLVDPRVPVQVARTIPDSRLLILPGVGHVAQMEVPRLVARAIVGMLEDIRAPHR

SEQ ID NO: 10351 - protein, 614 aa, Actinoplanes utahensis
MDETGHSGDAGAAHGGNGADARDRNRVNGWVNGENPWSNAGSAREQEADVPPWRRGAIGRQPSPTRPFGPAPSSAVPAQVPPPPGFVDPPPSTEIPPSGAAEPTPWPAERSRLADILGHRPRPVDTASTGPAPSSAPPYPYEGDLDDSYHSATAQRAAVPMPRPVPSARGDWQPAEPGPTLGDPLSRTDAPSEPIRSRHALVNDTLAQGLPRVEPAAPQGDQRSVDNEARTGLPTYDASSFSRRAYEPSAPPAFPAPVFPGYSGTPEEVAAALGEPSDALPQRVPAQPDVPRVPEPPSVEPSAEAPALARIATHLRRGDVVPAQERQEGFDVQAILAAVREVDGVRDASLKATPAGAHSLRLDLADGADAAEVSRHVARLLAERMGLDAAMPGGMPAGPLPADPLSPGPLQSSPTPPPTPAPRPARASVKPVSPAPVPTPAPVSAAPVSTPPAPATERAAVTPRDLNGPRPLDPGDRPGPRVLIENVHVNTFGADASVEVRLRAGDRTASGVATGPAVDGYLLRLCATATAGAVDELLAVSTHTDGPARCFVEHAAAVSFGSTQVAVVVLLLSCAGGGWVEQLSGSAVVTGDDRHAMVRATLAAVNRRAEALLA

SEQ ID NO: 10352 - protein, 219 aa, Actinoplanes utahensis
MTAASGGAQTTRPTRLPRSARRKQLLAAAQQIFVAHGYHAAAMDDIAERAGVSKPVLYQHFPGKLELYLALLDTHCDAIIAKVRGALEATPDNKERVKGAVRAYFDFMDHESEAFRLVFESDLRNDPQVRQRVERVEQGCIVALTETIISDTGLRPDQAQLLASGLAGASGAAAQYWLANGRRTPKAEAESLVAALIWRGIASFPLQGGSTAGTAPEIG

SEQ ID NO: 10353 - protein, 74 aa, Actinoplanes utahensis
MEVKIGVQQSPRELVLESAQTPAEVEQAVSEALAKDGVLSLTDEKGRKVIVPVTKLAYVEIAEASHRPFGFTTR

SEQ ID NO: 10354 - protein, 451 aa, Actinoplanes utahensis
MTDIEQALIPVTNRAPVRPDSPTFADLGVRPETVEALAKAGITHAFAIQEYALPIALRGTDLIGQAPTGTGKTLGFGLPLLERVLAPSEGADGRPQALIVVPTRELGLQVARDLAAAGSTRGVRVLPIYGGVAYEPQVEQLKKGVEILVGTPGRLLDLAKQKQLKLNAVAALVLDEADRMLDLGFLDDVEKILAMLPEQRQTMLFSATMPDPIVALSRRFLRNPMTIHAGHTTDSGPNPLTKQVVYRTHPLNKIEMVSRILQARDRGLTMIFTRTKRAADKVSEELDFRGFAVAAVHGDLGQGARERALRAFRSGKIDVLVATDVAARGLDVSGVTHVLNYDCPEDPETYTHRIGRTGRAGATGVAVTFVDWEDMPRWVLIDKSLVLGMPEPPETYHTSPALYADLDIPSDVSGTLPTAERNRAGLSAEIEEDLGGGGRGRRSSRPARLAS

SEQ ID NO: 10355 - protein, 102 aa, Actinoplanes utahensis
MRSAAFDRATGFVAHHGARYLGDLDGGQWLGAAVLEVYRFRREGYRFFVFEGVDPELFPACYYRQLDATPWCRAEQHAFLAEVTAAGQLSVNLLTDLADRWL

SEQ ID NO: 10356 - protein, 112 aa, Actinoplanes utahensis
MWSLADPPNTGMLSGQLRRILGEAYAAVRHHRFVVALAGGRLPIAAYAELVAQHWFVYESLELATAAMACDPVAGRFHFPELFRVPAIEADLRFLHGPCWTGRIAALPATTT

SEQ ID NO: 10357 - protein, 388 aa, Actinoplanes utahensis
MATGQNGGMPQPLDQALAEVRELLLAPGLTRAVAAGRRRGQLPSVTRAQLRPVTLKSGPKLQIVTDDGARPATRNVTPGAEAAAAIDELLAEPFGNWHIETDSATVQVRITKKGEAQVHRAATVAAPVAQDHDRAKQWLLDPGDPLFEVIGGNAAKRRQIDAFLRALAATLPDELPPTLRVVDLGCGNAYLTFAAYRYLAGRGVTLQIAGVDVREDQRVRNNAVAAQLGCAAEVSFVAGTIEEAELPFTPDLVLALHACDTATDQALARAVRWEARWVLAAPCCHHDIAAQLKGGAAPSPYAEFTRHAIVRERFADVLTDSLRAALLRLHGYRVDVVEFIDSAHTPRNLMLRARRSGAAATPEQHAEYDALIRQWGVTPALSRLLADG

SEQ ID NO: 10358 - protein, 366 aa, Actinoplanes utahensis
MPDQPGADATTHRGELAGEGRAADPTPAVPEPQSAIKKQKSVKSGRWSLPDTTDDALHQDDEPEHPPSGNTFRLAAFGALLIVVLFAGYGLGRLNNGTATPAAAGPSPTTGMVMNENMPHTHGTTGTGVTMAAALGGLSLSSDGLTLHPAATSFDAGHRARLSFVIDGPGGAPVTSYAIVHDKPLHLIIVRRDLTGFQHLHPTMATDGTWSIDLTLDRPGAYRMITDFTALAGGRQIATTLGTDLTVAGDYAPQPLPPADRRTTTGGFTVSYEGAPNTQAVQPVLISVTGADGRPATVEPYLGAFGHLVVLRRGDVAYLHIHPELQPVDGKVKFWVTAPGPGDYRMFFDFQVAGQVHTAEWTLTVG

SEQ ID NO: 10359 - protein, 70 aa, Actinoplanes utahensis
MAVTSTYTVQGMTCSHCVNAVTEEISALPGVAEVSVDLASGGVTVTSEAPLTDDAVRAAVDEAGYQLADA

SEQ ID NO: 10360 - protein, 120 aa, Actinoplanes utahensis
MSGERYASPADTGGGYARGMSEEANTGHGPHGYSGDKAALLGRLRRIEGQIRGLQRMVDEDTYCIDVLTQISAAKSALQAVAVGLLEDHLAHCVVDAARAGDPSDKVKEASNAIARLIKS

SEQ ID NO: 10361 - protein, 311 aa, Actinoplanes utahensis
MAHRSALDHVVTLIAGSEWAETVVLRGSMAMPAWVGDAARPPGDLDLILLPSPIVGVDTREPWPFVPHLGPSQHWPEAVHGGARNEIWTFEEFETGGLRPVLPPEGLHWMTSLDVSEPFDFAHQFLIDLLTGHPRTPDGVLLDLDAATENLSWDYSEPDEYTTTSENGRARLRIPWTTPAGLPGHMQIDLSYDEPLPTPPVLTAVPRVAAPPIAVLTAGRELSLAWKLHWLAADQQSEGRSAAKDLYDAVLLAELPQIRLRPRLQRLALPQPLSPTALAGWTIDGPLPGGPAPWLTRLATALPHLTAAPAP

SEQ ID NO: 10362 - protein, 151 aa, Actinoplanes utahensis
MEDREKDGYVLTDDAGRVDIDRVHRWLAEESYWATGRPLDLVTRSIDGSVPYSILHNGEQVGFARVVTDGATFAWVCDVFIAESHRGHGLGVWLVDTIVEDMTARGILRLLLATRDAHEVYRRSGFTPLEGPGRFMEIDRRPTRNAILGRS

SEQ ID NO: 10363 - protein, 708 aa, Actinoplanes utahensis
MTADAAERASVRERAEQVLRRLAGEHARLREDQWRAIEALTVDRRRVLCVQRTGWGKSAVYFVATALLRAGGSAGPTVIVSPLLALMRNQVDAAARAGIRARTINSANLDEWSEIEQEIRAGTVDVLLISPERLNNPDFRDNVLPGLAHSTGLLVVDEAHCVSDWGHDFRPDYRRLRTFLAGLPGRTPVLATTATANARVTADVADQLGDALVLRGPLDRDSLRLAVLRLPEPAHRLAWLADHLERLPGSGIVYTLTVAAATETADFLRSRNFPVASYTGQVDDAERRAAEQDLLDNKIKALVATSALGMGFDKPDLGFVVHLGAPNSPIAYYQQVGRAGRAVEHAEVVLLPGPEDAAIWRYFASLAFPPEDQVRSVLAQLSADRPMSTQALEPLVDLRRNRLELMLKVLDVDGAVRRTRGGWLATGEPWTYDTARLRRVAEARSAEQQTMLEYAVTPTCRMEFLRRCLDDPEATPCGRCDNCAEPLFGPDVSAGSLAAAEAFLGRPGVEVAPKKMWPTGMTAVGISLKGKIGPAEQVEPGRAVGRLSDLGWGARLRGVVGPESPDAPIPAELAAAVVEVLKAWARGDDAWAQRPVGVVAVGSRRHPQLVHSLAEHIATVGRLPLLGVLTSAGSGEETFRGNSAQRVRALHNAFTVPPEVAAGLTVHQGPLLLVDDLVDSGWTMALAGRTLRQSGAHSVLPLALAVAS

SEQ ID NO: 10364 - protein, 153 aa, Actinoplanes utahensis
MTGWHRPQIRPGPTAEWKSQGMSKTIAEKLLIKPNSTVWLSQPARLPLLTPMPEGVRETGSLAAAGTAVLFAEDAASVRAQLTEHRADLDKPSAFWIAYPKGNKADINRDTLWPIVADFDMRPCGQVAIDDRWSGLRFRPNRPDEGRFTGGSQ

SEQ ID NO: 10365 - protein, 241 aa, Actinoplanes utahensis
MTRLAVVTGGGTGIGKATAGMLAGEGYDVIIVGRRPEVLADAVKWIGPQASAVTADAADPAQVPRIVEAVAGRAVDVLVNNAGAFIGGDDSTLDGVAARWRANLDSNVLTAVLTTTALLPLLRRPGGKIILTSSIAAQRGGGGPYSAAKSALHGYALDLAVNLGGEGITANVISPGYITDSEFFDGRMTPEGHAKRVDSALVKRAGEPQEIAEAVRWLVGPGGGFVTGQIVNVNGGTVLGR

SEQ ID NO: 10366 - protein, 653 aa, Actinoplanes utahensis
MRHRRLSPSGENRRMGRTERNGHEGSLRIAGRYRLVEKLGTGGMSVVWRAYDETLSRDVAVKVLTPQLATDRAFRDRLRQEALAAARLCHPHITGVYDFGEALLSDHLTVPYVVMELNDGESVGARIGRQGTLDWREAVMVCAEVASALATAHARGVVHRDVTPANVMLTGAGAKVVDFGISAVVGQRDAGPDGSLLGTPAYLAPERLGGAPVSPATDVYALGLLLYRALTGRMPWPAASTTEALRAHLYADPDPVPDVPGMPAAVADLCLRCLAKAPADRPVSAEVARALAATVGVRPIIPPLRPGERPAVPVARAVVPAPAGSEAPRRARLSWLSGSPHRRLRRPAAPHGASGRSGSSYGSVAESGPGLPDRRPWSSGPSCRLRLRELRLRAALRFGTVLRTGAVHPLGNGLFLGSRLRQAGAVAAWVRHGRPARARNRLSAAAALATVVLLAGSALTWSARREAADADQSSASAAGPGADTTQRVRCSVQYQVRRDSGGAFEARMTVLTTGGSAGWRLEFSFPGTQRLAGPPRSVAQHGRRVVVRGAGRSRVITLRGGYRDRNPLPLAFAMNGHPCRAEVLGVVSDPATKDDAVSAASAKDDRPGPEETIHQRKRPPSRHGGARRKAAPSPADPSPAAPAKPNSGFSLAL

SEQ ID NO: 10367 - protein, 365 aa, Actinoplanes utahensis
MAAFPPRRRTDLLADSTRAPFAVIRRRGGLFLSRSGRPARFAALVAATLAAVLVVSGTPARAADPEGGTKALRANLEAAAKGYDLAKTKLAESKKRQTQLTATLKAAQTRVDGLTRRVAAVANRSYQMGRMNTMMLLLNSGSPDSFVERVQGLDMLAQLDGSTLAAYKTDIDTTKKAQTALSAEIIEQNRQVNVMAQKKKQAEIALGAVGGGSVGGFVSADSAAAAPAPRNSDGSWPKESCTVDDPTSTGCITPRTLHAYQEARSDGFTHYTVCWSQRDSGEHPKGRACDFSANPSTFKDAAATGSDKAYGDRLAAYFVKNADALGIMYVIWYRQIWMPSTGWRAYSASGGPSVVHTNHVHLSML

SEQ ID NO: 10368 - protein, 257 aa, Actinoplanes utahensis
MTSYLDELFGLNGRTALVTGGSSGIGREIALALGRAGARVVLLARRAGPLAEVVAELEKHGAEGGAITADLADRSAVRSAVGEMNSRYGEPDILVNSAAVNLRPPLDELAEDVWDLTVEANLTSPFLLGQAFGPGMAARGWGRIINIASQQAFRAYGNSGAYGAAKAGLVGLTRSQAEAWSRHGVCANAIAPGVVHTPLTEPVFGDPSKVAAHAARTMIGRNGLPEDFAGCAVFLASGASQAVTGQTLFVDGGYSAT

SEQ ID NO: 10369 - protein, 272 aa, Actinoplanes utahensis
MLDQVSDLVREVAQTVVLPRFQRLDSADVHQKAPGDLVTIADQESERALTRGLTALLPGSTVVGEEAVAADPAVRDRIDEGGAVWIVDPVDGTNNFAAGRTPFCVMVALVRERETVAAWILDVVEDSLTVAEAGSGTFRDGVRVKARADDPPAGDLHGVIANKYFPPDMQAHIDAHAGALGGYTPGRHCAGYEYPAIATDAQQFGMFWRILPWDHAPGTLIVREAGGVARHLDGVEYMPINRRKGLLVAGNEEIWHTVQNTLFPDGPPVIED

SEQ ID NO: 10370 - protein, 151 aa, Actinoplanes utahensis
MSTEFRDSGTPIEVLLVEDDPGDVLMTQEAFEEHKVRNRLTVVSDGAEALAYLRREGQFAEAVRPDLILLDLNLPRRDGREVLEEIKNDDDLGRIPVVVLTTSSADEDILRSYQLHANAYVTKPVDFERFIAVIRQIDEFFVSVVKLPPRA

SEQ ID NO: 10371 - protein, 530 aa, Actinoplanes utahensis
MNVRTWSLRGRIVALCAVVGLILTALGIFAATTAATHNRQLDDVLNRVSPMRAASETLGTALVDQETGIRGFAITGRDASLEPYRQGLVEQNTQVSRIDGFLRPDDGQIRADLAAVRARIDDWHRDVAEPVIATVRDQGAAAGQAKVEAGDTRQFDAVRDALSVMQTHIQTLRAHSAAAAKESSHTMVAIEIAAAAIVVLAGIFLLLLLDRLISRPILELAGQVRDVAAGDYERHIESSVGAPELVGLAADIDRMRQQIATELTEVRDARQQVEWVNQQLQSQAEELTRSNRDLEQFAYVASHDLQEPLRKVASFCQLLQRRYAGKLDDRADQYIGFAVDGAQRMQRLINDLLAFSRIGRLTSGFTDVDLDRVLGDVKSQLDARAGEDGEITWGRMPTVEGEEPLLTTLFVNLIGNSLKFRRPDVAPRVRVTAERDGSEWKFNVRDNGIGIEAEFADKVFVIFQRLHARDAYEGTGIGLAIVKKIVEYHGGRIWLDVDVSPGASIWFTLPALIGLDEPGEEHEEREAVGV

SEQ ID NO: 10372 - protein, 446 aa, Actinoplanes utahensis
MCAGWPRPAMATLPAGRREDRSRGGDRCCAAAPGGTRFPGQLCVESGLGMMERSFAPRAHALAQMERLRILLVEDDEGDAFLVRELLSEAEAPFELTVASSLRQARGLVADADCVLLDLGLPDAEGIDGLRKLLAVAGNAAVCVLTGRSDEHLGVQAVAEGAQDYLVKGQVDGVWLVRALRYAVERKRADENARRLREVELRQEESARLERGLLPQPLMQTTEVTVETFYRSGRAAGLLGGDFFDVVQTGGKLHVIVGDVCGHGVDEAALGVELRVAWRALVLAGVPEEQVLASLEQVLMSERRAREVFATVASATIDLAANRATVRLAGHPPPVVLTDGRAGPVHARTGIVLGVRPTPTPATELEFTGDDWSLLMYTDGLIEGHTGPGNERLDVDGLCKLLDEPAAREVPLSDLPAWLVGRADQDNGGPLTDDVAMLLISRGGGR

SEQ ID NO: 10373 - protein, 118 aa, Actinoplanes utahensis
MTASFDPAAVIAEFIDAVAPYDPQPEVPPVALLGLRTALGDQTFALSDHVIRAMCRALESYRDPEDRGECVECGGRHLDENLHCRDCGRLHGILGQVIAEHVRRVAAAGDGNAPSGPA

SEQ ID NO: 10374 - protein, 789 aa, Actinoplanes utahensis
MSPMRDAALLRPARRGFAALAVLAVLALGGFAAVRSILPPAAAPASAPGGEFSAERAFQSVRTIAAAPHPAGSAANDTVRDHLLRTLRGLGLSPQVQDTVTAQGGELSASAGGTGLARVRNVVTLIPGSASTGRVFLVAHYDSAQTGPGGNDDAAGTASLLEIARALTTGPKLRNDVVLVMTDAEEACLCGAEAFVRQNPLAAGGGVVINLEARGSSGPAIMFETSARNARLVDAYAHTPDPVGTSFAVEIYRLLPNDTDFTAFREAGFTGLNSAYIDGAAVYHAPTDLPAAMDRDSLQHHGANALALTRTLGDTDRLAAATRAGGDATYFPALGLLVRYPGGLVWPLAGLAVLAVAALAWRARRTGRLTGRRLALAGLLTLAPIVVAPVLAQLFWTVLTLIRPEYGALPIDPYRPGLYRIAVIAIAAAVVFCWFALLRRRLGAAALAVAGLGWLAGLGVVLAAVTPGGAYLATLPALAGALTGLLTPHVRPWAGAAVSTLSGLVAVVILLPTVVMLFPALGMAMGAAGAFLTVLMLLALLPVIDLIHPSAEPVQGLPAGRARRRGALATLVASLTALACTAAGLAVDRFDAAHPSLTQLMYALDTDTGRAQWLSAEAKTQDWTAQYVSGAPKAVATTLPAFGAEELRTGPAPAASLPAPALTVESDTPSPDGGRVLKLLLKPQRTVRFTTLHVAAAHQVTAATVAGQQVPVGRAAGGGWGFGFIFHAPPAEGVEVVLTVRGTGPVKLRAMDASDNVTEMPGFHARPSGVGVLGSHSSEMVAVAKTYQF

SEQ ID NO: 10375 - protein, 94 aa, Actinoplanes utahensis
MKLKLDLHDIFNKGHEIDRALRGIVDEAIQKKAALVEIIPGKGSGALKKKVLRFLDQKEIKQLYHRVEKDGDNWGRLFIHFRHDAPTGRRGRGR

SEQ ID NO: 10376 - protein, 123 aa, Actinoplanes utahensis
MDLLEEYRRANFFFESGDPLGASRLLEPIVEAEPQNTAVRQLLARAYFNSAQLNGAETQLRALIEHDPSDHYAHHVLGRTLERAGRFREALPHLRLAAAMKQQPDYQDALRRVETWLGKNEPA

SEQ ID NO: 10377 - protein, 243 aa, Actinoplanes utahensis
MANADSSTELRRPDGTPVRVLVVDDEPTLAELLSMALRYEGWEVKSAADGLSAVRTARDFRPDAVILDMMLPDIDGLEVLRRLRGETPEVPVLFLTAKDSVEDRITGLTAGGDDYVTKPFSLEEVVARLRGLMRRMGHAPMRTESQLIVGDLTLDEDSHEVRRGGALITLTATEFELLRYLMRNPRRVLSKPQILDRVWNYDFGGQANVVELYISYLRKKIDAGRTPMIHTMRGAGYVLKPAD

SEQ ID NO: 10378 - protein, 541 aa, Actinoplanes utahensis
MAAAVTARPRPARWRSPAGWPLRTRLVATMIALLAVLGLVVGGTAELYVYKTLHDQAVKDLQEASKRLGVGFDCPDPADPGHAGQRSCPPLPSGPDGPSQAGSNPLADRRMFNGIQRDPIVLWMLADGTLSGGIVHFADNFGLKTDPLSATALATVHNKVTGSRSVEVNVGSDLPRYLMTKQTTRSGDRTYYVGVSLKNMDATLLAVAGFTGCVVLGALLIAGWAGALIVRRTLQPLDRVAATASRVAELRLDRGAVQLAQRVPESDTDPRTEVGQVGAALNRMLDHVGSALEARHASEMQVRQFVADASHELRTPLAAIRGYAELTRRSRQPIPDEVAHVLGRVESEAKRMTTLVEDLLLLARLDAGRPLAQDPVDLTMLAVDATSDAHAAGPRHYWQLDLPDEPVTVIGDGARLHQVLANLLANARTHTPEGSTVTVKVDTVPDAAVLQVIDNGPGIQAELVPHIFERFARGDSSRSRAAGSTGLGLSIVHAVVTSHGGKVGVQSRPGQTIFTVMLPSAPASPVVPSAEHHTPYLPRVG

SEQ ID NO: 10379 - protein, 354 aa, Actinoplanes utahensis
MTAPEVQRVRDQRIEKIVPLMSPALLHHELPLTTELHDTVLAGRKQVEDVLNGRDQRLLVVVGPCSVHDPAAAGEYADRLQAEAERLKDDLLIVMRVYFEKPRSTVGWKGLIMDPALDGSGDVGAGLRIARKLLLEVVSRGLPVAVEFLDPITPQYIADTVAWGAIGARTVESQVHRQLSSGLSMPIGMKNRPDGSVSTAVDAIHAAAAQHVFPGIDYSGTPAILHTTGNPDCHLVLRGGGGKPNYSAQDVEASLALLRKAGLPERLVIDCSHGNSNKDHNRQPLVAEDIAGQMEAGQHAISGVMLESFLVPGRQELGAEMTYGQSVTDACMGWDGTVAVLERLAAASAKRRTL

SEQ ID NO: 10380 - protein, 681 aa, Actinoplanes utahensis
MITTTPAPVEAAAPAPPDPNPRWVRPAVIALLVGTAVLYLWGLRASGWANAFYSAAVQAGSASWKAFFYGSSDAANSITVDKTPASLWIMALSVRVFGLSSWSILVPQALLGVAGTGLLFATVRRAFGPVAGLIAGAVAALTPVAVLMFRFNNPDALLVLLMVAGAYATLRAVESGSTRWIVLAGVFVGFGFLTKMLQALLVVPAYGLAYLIAGPPKLLKRIWQLLLSLGALIVSAGWYLAIVELVPAADRPFIGGSQNNSLLELTLGYNGLGRLNGAETGSVGGGGRGGNGGSMWGQAGWTRMFDSAQGGQISWLLPAALIVLAAGLVITLRRTRADLQRAGLILWGSWLLITGLIFSFMQGIFHAYYTVALAPAVGAVVAMGVTLLWRHRANLVAALTLGAAIAVTAWWSWKLLGRSADFLPWLRLPVLILGIGAAVAVVAAFRLPRRIALVGAVVALVTALAGPAAYAVQTASQAHSGSIPSAGPAVAGGFGGPGGGGRGGFPGGGRAGNPPGGFPGGGFPGGGFPGGGSPGGNNQAGGGTTDGGGRGGRVGGGGGMGGLLDATSVSSEMKALLEQDADRYTWVAAAIGSQNASGYQLATEKPVMAVGGFNGTDPSPTLAQFKAYVAAGRIHYFIGGRGFDGGGSGSSDSSRIAEWVASTFTAKTVGSTTVYDLTVTS

SEQ ID NO: 10381 - protein, 409 aa, Actinoplanes utahensis
MSLSTLPSQDAGSARVTAPVLDVVVPVYNEEVDLEPCVRRLHAYLAAHFPYRFRITVADNASIDGTAAVAQRLKAEFPEVEAVHLTQKGRGRALNHVWTHSDAAVLAYMDVDLSTDLGALLPLVAPLISGHSDLAIGSRLARGSRVVRGAKREFISRSYNLILRTTMAARFSDAQCGFKAIRSDVARRLLPMVEDTGWFFDTEMLVLAERSGLRIHEVPVDWIDDPDSRVDIVATAIADLKGIVRITRALSTGRLPVAALREQLGRNPLPVDGVPTGLTGQLIRFAAVGVASTLAYLALYALLRVGVGPQAANLIALLVTAVANTAANRRLTFGVSGTDGALRHQAQGLVVFAVGLGLTSGSLALLDAAAAQPSRFVELTVLVLANLIATAVRFLMLRVWVFRTSRDRT

SEQ ID NO: 10382 - protein, 93 aa, Actinoplanes utahensis
MLSKEDSRRLAQLERQLRRDDPDFCARMGGGNFSVPTPRPPLTLFFVAAAIAVAAIVLGILGWWIAATLVATWGLATAAAATYRLRRFRTRTP

SEQ ID NO: 10383 - protein, 195 aa, Actinoplanes utahensis
MGTIGFLHTADVHVATFRALVGEVAPGWRDRHVVDPGLLADARAGLPVEEGVRARLAELAGCDVIVCTCSTIGPEAERAGVLRGDRPMAQAAVAVGGRIAVAYAVESTREPTTALLLDADPAADLLLVPCLAAWEYFESGDLPAYYRGIADQLRDVEADVVVLAQPSMAPAADLLPGRSVLSSPRAAVVAAVRGR

SEQ ID NO: 10384 - protein, 417 aa, Actinoplanes utahensis
MLKVDRAQVMAYRLAALGLSARGAIRPADLPVLDLGVQDYTPGSTRVALAARTRVALDDDRLLTVWAARGAPHLHRAVDLPRLTAQLWPLSHADAAARINSNQIPAAARLGIEAFRVTAAAMREVVRAPMPRGEASTRVSARVPAELTFECKTCRARHISGNVWQQSGLAGGVQVLSRGRDAMLGPLPDAGLPLSDAGLPLSGAGLPLSDAGLPLPDVALPLAGAGLALSDAGRGAGALPGAALPASDAGRGIGALITTYLRFLGPAGPSEVARYLSTTTEEIRSVWPDGLVEVDVAGRRAWLPEVDVPALGSPPTPAGVRLLPAMDPLLQARDRDLLVPDRERQKEVWRALGNPGVLLLDGEIAGVWRPRMSGRRRVDLTVSPFRPLTATQRERIEGEAAEVARARDVPSATTAFD

SEQ ID NO: 10385 - protein, 208 aa, Actinoplanes utahensis
MGRIRSVTASPLPHPLTLAGNGIVLREWSPDDLADLVGLLDEPDIARWTPMPSPFDVDAGIAYLKRARQGRLTGRRIQLAITADGGPPLGEVLLFGVDPALREAELGYLVGARFRRRGLAAAALSLLTDYACGTLRLNRLLLRIDPDNTASTAVARRCGYRLTGEPPIPQEGPYGPTSLDTWEYVRGLPGTRREGLRNVASRRYGRRT

SEQ ID NO: 10386 - protein, 196 aa, Actinoplanes utahensis
MPDPVNTPEHWTEYNAHQGDRAVRDTCRIAMDLAGPGAGRTAVDLGCGAGIETRALLDAGWRVSAYDSEPAMLAGLDHPWLTAHRLRFEAIGALPPADLVYAGYALPWQTRGSFDRLWTLIRTAVRPGGRIAVDLFGVRDAWSGNPAMTFLTAAEARSLADGLVIDHWHEQDETAPAYRGPKHWHVFTLVAHRPEN

SEQ ID NO: 10387 - protein, 456 aa, Actinoplanes utahensis
MVRARSAVGKENPLTLISAASHGFPGFVTGGCTHRPARGAQSPTMSDRSRDYEVIVYGATGFVGALVARHLAGHAPAGTRIALAGRSPAKLEAVKTRLGVDWPIVVADAGDPDAMATLAGRAHVIITTVGPYAKYGRALAHACAAAGTDYVDLTGEVLFARDSIDENHELARGTGARIVHSCGFDSIPSDIGVHVLHQQVVADGAGELTDTTLVVTSMHGGVSGGTIDSMRNQVDVMKKDPSLRRVAGSPYSLSPDRQAEPKLGRQSDMDTIPASEVDPKLRGRLAPFVMASYNTRVVRRSNALRGWAYGRAFKYREAMSVGASPLSPVLAAGIKLGLGALIVGLAVPPTRYLLDRILPKPGDGPGEKTQQDGHFTMDIFTTTTTGARYRARVRAKGDPGYAATAVMLGESALALALDRDALPESEGGVLTPATGIGDALVARLRAAGMEITAYKL

SEQ ID NO: 10388 - protein, 280 aa, Actinoplanes utahensis
MDEPRGEAAPVRPGSSARTRQLTSQAWRENFMLHLNQRVRRVLSRRAQSPRALNRLAQAPATAGLVTESTAGPGRHRRTEVRRARIHLIALPNARPGFKRALGIAIAGLAGTVGLLATGASPASAAAADVNWDAVAKCESSGNWGINTGNGYYGGLQFSRSTWRAHGGTRYGSTANLASKSEQILIAERVLRHQGIGAWPTCGRRGLTRAHRTTSVSPYRLASYTTPLRASHTYVVRRGDTLSRIASRYHVRGGWRALYRTNAKRLSSPNRLSVGQRLAI

SEQ ID NO: 10389 - protein, 122 aa, Actinoplanes utahensis
MTSSEKAFQPEDLTRLFVERANAKDAEGLALLYEEDAVMAYPPGSQTVGRAAIQKLWAELLPKMPRFEPEPPLPTLISGDLALTATPPKDGAGARAQVVRRQADGSWLRVLDHPEMRPGQQA

SEQ ID NO: 10390 - protein, 283 aa, Actinoplanes utahensis
MDLRQLEYFVAVAETGSFTRAAQRVHITQSGVSAQIKALEHELGAELFIRSGRTARLTDAGSVALRHARAALDSTLDLRDAIDEVKGLIRGRLTIGMVIGCEVAPLFDALAAFHAEHPGIELELAEANSDQLVAGVRTGSLDVALAGLAGVPPEHLATRVLIRERLVALVPPTSDLAGSPGVPISLLSAYPVICLPVGTGIRDALDRSTPGRSAVALVATSPDTVAGLTRRGLGVAVLSESMAAAHPDLTAVPIDGADVPALLALVWQERPNPALTAFLKHFP

SEQ ID NO: 10391 - protein, 1599 aa, Actinoplanes utahensis
MRPYLRSVSAAASPQAIRALGAAALATALGFGFSGPAFAAEAQIPFISEIHYDNAGSDSGEAVEIEAPVGFDLSGWQIVLYNGHTNTSYDTKTLSGAVPAAGVVVQTYPANGVENGPDDGVALVKPDGTVVEFLSYEGTLVPVDGPATGLTSTDIGVAETTSTPVGQSLQKIDGKWTGPAANTFGALNKAGGTDPDPAPAGCTTAVTNTIAEVQGTGAASPLAGQKVTVEGVVTADHRTGGFAGFYLQTAGSGGADRPVAAGAASDAVFVHGGTADIKIGEQVRVTGTVTEFNSLTELSYTAKSDVQVCATDATLPTAVPLKLPAGDAVRESVEGMLVAPVGDYTASDPYYLTTYGEVVLAAGDKVAKVPTDVAKAGSAEAAAVKAENRDRRILLDDGKTTNLSANGIAPPYISKEQPIRAGDKVASFGPVVLDYAYGDWLLEPTTPVSADTPAASRTTFDDSNPRTAKPAAVGGDIKVASFNVLNYFVHFGGDARGATDAAQLAKQQAKIVSAISSLDADVVALMEIENSVKFDANDPQLALKTLVGALNEKDGAGTWDYVRTPAELPGPESQDVITTAIIFKPAKVTPKGASRSVNDESVWSNAREPIAQTFHAGSIDFTVVANHLKSKSTGVPPTGDNVDAGDGQGPYNGDRKRQAAAVVNFVKGVEKDSGTDKVILLGDFNSYTQEDPMQVLYSAGYTDVHSAKAPGKNSYVFGGESGSLDHALTTPSLTDRVTGVDIWNINSVESYGFQYNGYAPFYSPDPYRASDHDPVVIGLDTSAPKPIDLQLLTINDFHGRIEAPSAGVGGAAQLVGMVDKLRKDNPNTLWTSAGDNIGASTFVSSIDGDNPTLDALSTGGLAASAVGNHEFDKGIADLTGHVQSRAKFPYLGANVYVDGKRALPAYSVQTVGGVRVGYIGVVTGETKSLVSPDGIKGVEFHDPVAEANQVAAELSDGNEANGEADVVVLLTHEGAATANISSAEALQNDPVFGPFTKAGPDIDVIFSGHTHQPYAFEIPIPGTDRLRPVIQAEDYGVKLGRAKLTYDPVTRSVTASTAELLPVTGYPENADVAAIVTAAKANSAELGKKVLGKITGDIKRAVSSTGSEDRGAESDMGKLIADVQLDQTRDAGRGGAQIAVMNPGGLRNDLLYGADGTVTYAQAYAVQPFANDVVTKTLTGAQLKTALEQQWQPDTASRPVLWLGVSKGFTYQYDPTLPKGSRIIASSMKLNGVTIDPAGSYRVTMNSFLASGGDNFTVLGENNPSRTTTGDNDLTMLVNYFAQHSPVSPDPTPRSVKFTDGTAPTGAYAVNAAAIWTGQTVTLTQSSLADDKSAAAKIKQVVNWGDGSAAETLEAGAKSATHKYATAGSFTIQVTITDEAGNAATVAGGTVTVAAQAGQFKLDRASIWTTQAVTLTGSVVTADSVNIGWGDGTTGSASADIAVAHAYTKAGKYTVTVTPVNKLGAGAAIQAGVVTVADDVFAPAPSLLVPNPANVAEKWTNLHGTVTDQGLGVASVRVKAVEYRVDGKWYYYHAGAWWKSASKETAISRADLLTAAVSGNLWSVRVHGVATGTLRISYSAVDRAGNTSPGYVVNQKLTR

SEQ ID NO: 10392 - protein, 183 aa, Actinoplanes utahensis
MRNTMRVLGLAGLGVLGGAVLATGPAAAAPSTAATGHSQAPAKAQRDPWNDDEVVGYYRTFWACERAGQVGERFRAWDDHACERVRWGVRRGAFALVVDQNDWDQRWDSRWRPGIWPSNWPNRPNWPGHGRPDHDGPGGHDGPGGHEGPGGPGGHGGPGGHEGPGGHDGPGAGGPGGHGGLAS

SEQ ID NO: 10393 - protein, 536 aa, Actinoplanes utahensis
MLTDRATPQTVRPDDDPLADPNWQEPEQPGERLSWFRLLFLILALGAVGAGSTFGAMRLRENAGTRAKSWAVPYVDVTLTPTFEFQDPDANPANDVALGFVVADRTDGCVPSWGGAYTLDEAAASLELDRRISQLRAAGGNIMVSVGGQSNTELAVACADQARLTEAYRQLVKRYQLATLDLDVEGAALGDQASLKRRAAALKTVQDERKAAGDPLAVWLTVPVSPSGLTADGLAAVRATLDGGVALRGVNVMTMDYGTGNSANPDMLGLTTQALDNTHKQLTDLYLRLGAQLTSAQVWSRIGATPMIGQNDVDTERFTVADAQGLATFAVDKGLGRVSMWSLNRDARCKGTFTNVVVHSNTCSGVDQQALAFSKVFAGLPGTSVGSSGRDAVEIPNRSSAIDDPTTSPYPVWRLTAQYVGGYKVVWHGVVYQAKWANSGADPSADDTAGAPNPWSVVGPVTTGDKRPTPTPNVTGVTNVWNPGTSYHRGDRVTYNDLPYEARWTTRGDAPSTDYPVDPDEAWAPLFTVPGEPVVN

SEQ ID NO: 10394 - protein, 1004 aa, Actinoplanes utahensis
MQRTSVAQPRPDAQRQWGADRRSAPHPVVPPPISEGRIARGRLAIVLTIAVWAGYLAYTIFEQFIVGRASTARLAVEAIVYMLVITGLAASAMAYLITRIGFFYRSRGHQRSPRIVLDAFLAEPKTPTVTVLVPSYQEDERVVRTTLLSAALQEYPGLRVVLLIDDPQQPKTRSARDLLLSARRLPGAIEAELAVPFNRAQAAFEQFEQALADRGQRVGTSDDMRALAAEYRAATGWLYGLANRQEMVDHTDTFFVDHILNALAEELSTIAEALETGAEENATLPVARLVQLYSRLLAIFGVSMTSFERKRYVSLSGEPNKAMNLNSYIGLMGGSYQEVRTPMGLALVPAGPGRAQLTVPNPDYVLTLDADSVLLPDYALRLVHMMEQGASAGVAVAQTPYSAFPGAATRVERISGATTDIQHIVHQGMTQYDATFWVGANAVLRKKALDDICETAYEGDWEIKRYIQDRTVIEDTESTIDLGVHGWTLYNYPERLAYSATPPDFGSLCIQRQRWANGGLLILSRLKDQFKARNKREQKNRFGELFLRVNYMASIFWSSVCLVVMLVYPFNKDLLNPVLLLVSVPYFMMMAGDLKANGYKRLDVLRIYGFNLILLPVNLSGSFASLLQLLTGEKSQFKRTPKVRNRTTAATFYLLAPLALIALCGYTVVHDVQHKLWNNLAFAGFNLLLSLYAMIAFVGLGNTLIDLFAHLRAWLYRPVKPKNKATGTPVSSVPAPAALGGGAIGDWASVLHYGGAERGGSGMVAVRSSQAPVTRGRKASVSHSFEEFNFFTVFQPIFELESGDVVGYEALTRFADGSTPQLSLAAAQDQGLHIDLDAALIRAALASANSLPAGAWLAVNVSNDLLRRPHELAPLLDEANRPLVLEFRSPEAGDLERLPAGARFAVDDAGAGFDTLSRMETLRPEILKLGPATLAGIETSAARQAAIRTLVEFAEANDCTVIAEGIESAPQRDALRACGIRLGQGFYLGKPVPVERALADATSR

SEQ ID NO: 10395 - protein, 210 aa, Actinoplanes utahensis
MTVTIGQAAQVRTRVTVPLEFPDGYATTAEVFTFTGLADGREHLALGLGDWRNATNPLVRPHSECLTGDVFGSQRCDCGPQLREAAERITEAGGILLYLRQEGRGIGLYAKLDAYALQDTGLDTYQANLALGHGEDERDYTPAAQMLHALGAERIRLLSNNPDKAGQLAALGVEVTEQLPTGVHLSPANARYLAAKRDHTAHTLDLTGAA

SEQ ID NO: 10396 - protein, 157 aa, Actinoplanes utahensis
MTLRDATEADLFWTRSAIDLSRLSPPSPTHYAVGAVVVGPAGNPMATGYTGETDPHFHAEEEALAKLAGRGFDLGAATLYTSLEPCTVRKSRPVSCTELILASGIRRVVLALREPLHFADCTGVETLLGHGVQVVEIAALGEAVRDINAHVMGMQTT

SEQ ID NO: 10397 - protein, 157 aa, Actinoplanes utahensis
MTQDALATDTRWLSSPEMAAWLNLTQLLMLLPSALDRQLRDDAGIPHAYYQILANLSAAPGHQMRMTDLARMVGTTTSRLSHAVTSLEQRGWLCRRACPFDKRGQIAALTEAGMAVLEAAAPGHVAEVRRLIFDHLSATEVDQLREITGKILPAATA

SEQ ID NO: 10398 - protein, 897 aa, Actinoplanes utahensis
MRKILVAAIAASTLLLGLPMPASADPPGSTADALPRGWSLEHRSLTWTSDRAIRTGDAAVEFWSGDRLLGRARGTRDPHAFTLPGTPPGGLKDLQVKVGGKRVDAAAPASVQRRAAGSPVIPPILPANPVDPGVPGPYRTTTGEYQLPGVHLSTYKAKVEMQAVVVAPKGAPGKRPLALFLHGRHWTCFAGTDENAISADWPCAAGSAPVPSYRGYLQAQQLLASQGYVTVSISANGINAQDDADADGGAQARSALVRMHLAHWADWAGSGRRAAPAIVRAAPPADLSQVLLMGHSRGGEGVNRAALDSVNPAPGAHDDYQGKVRWTIRGLLLIGPTAFGQNPQPDVPSATILPGCDGDVSDLEGQMYVDATRGLSSGRALHSALHVTGANHNYFNTEWTPGQAVGPAFDDFSSETPDPLCTPGTAPARLTPQQEQTVGATYIATAARVFLGGDDRARPLLDGSGVRARSAGPARVLSHALGGNRRPVIVPDAALTVRGARLCDEVATDAAKGCLDTDTIAGASPHFVPFAVPEPGRVAVALNGTGTATLQPAKPMPVAGSQALALRLIVPPNAPATSFAVAVTDDHGRRTDLGPATVTGMPGTGVTTSYWAQEVRLPLPRTVGTVARVEITARGNRPAWLIDAWGWQPGTPAPRPAALDRIDVGDLTVAEGDSGTRTHSVPVRVRGRQAADVRLFLTDPGTSETKSWVARVKPGDTRISVPIKVTGDTVYTGDRSYPLTAKAVRNAVVGDYSGGVRVREDDPMPKVTITPAVATATEGSPLTWTVHLSTVAGGPVYVEFVTQAPPAGPELSSTDVDARWFTDQTGEDPKPSRPLSGAGLQLFVAIEPGTTSLAVTVPTVADGVAEGAEHVRFKTQVYPSDFGDPIPLGVIDGTVTD

SEQ ID NO: 10399 - protein, 327 aa, Actinoplanes utahensis
MISRPLSRLLALATLLLGTLAGVVAAGPPTEAAVRPPRVLRNLAYAPAQPAGSHGHLIDLYLPAQPATTPRPLLIVMGGSGWFADDGKGYAPVLVPYFTAHGFAVAGVSTRSSYQAKFPAQVEDIQAAIRWLRANAARFEVDRARIAVLGDSSGGWTALWAGFTDPGVRAVVDLYAPIDFLEMDPQMLPGACASFNRAFRLADCHIDARSPESSLLGCAILSCPERVAEANPLHRITPAAPPVLIIHGTQDALVPLDQSDMLFDALQAAAVPATYYTVPGVGHNRDIVSPRAARARVRHTTPALTPDAARPTYATIETFLRAAFRTG

SEQ ID NO: 10400 - protein, 231 aa, Actinoplanes utahensis
MPGIHPSRWLPWRAERLPLAPVYCLRMPTKRRDAEANRDRILRAAQELLSRQPTASMDDVAQAAGVVRRTVYSHFPTREALLDGLADKVSGHLLGALGGTDRSGLEPDVALADFALTVWAVGAEYRLLMTLAEADLSAARLHELLAPIRAQGLELLVRGRAGGRFATHLPPELLTLALQGMTLSMIQAVNDGVWHDDGVAASTAVLVAAGLPVQAAESAIAAARDLKLAHI

SEQ ID NO: 10401 - protein, 853 aa, Actinoplanes utahensis
MSSALHRLAAAVVRHRGRTLAGWLITLVLLAGGGLLISRGTDDAFTIPGSESQQALDTLKRVFPEVSGSSAQIVITGVDPATIKPEITAAVRRAERLDQVVAVISPFDERFRGNRTARAAIVTVQFDVAFMDVKPSTKAAVDAIGASIPHASVVVGGDAYADRVPKPSPVEGLGLAVALMVLLITFGSLVAAGLPLLTAILGVGLSVGLLYGVTRVVTVPSTAVTLAMMLGLAVGIDYALFILSRHRDQLRDGLSVAESIARAVATAGSAVVFAGLTVVIALVGLVVAGIPFLTTMGLCAALAVAIAVLIAITLMPALLALAGDRIRPAAKPRQRQGRIFERWVGAVTRHPVITIVVLLAGLGALTLPAGELRLALPDGASEAPGSVARRTYDVISAEFGPGYNGPLLVTADIIASHDPVGLMTKLGAEISRVPGVALVPIATPNPSAEIGIVQVVPASAPDSPETVALVARLRALEPHFRQEYGVGTAVTGITAVGVDVSARLGGALVPFGILVVGLSLLLLTMVFRSVAVPVKATAGYLLSVGSAFGVTALVFQRGWLANQLNVAHTGSVISFLPIILMGVLFGLAMDYEVFLVSRIREEYVHTGDARHAIDAGFRASAPVVVAAAAIMFAVFAAFVPEGAATVKPIALSLAVGVFVDAFLVRMTLVPAVLALLGDRAWWLPARLDRALPSFDVEGAGVTRELALADWPEPDSTDVIAADGLPFLPRQVRIGPGELVEVVGDPHTTSAFLLAVGGRTTGVSGRIKTLGHVLPQRAGSVRAVAALLRRPSLRDITEAAAAGPPLLLIDGFEHLPERALALDALRAAAGRGSTVLVTGRDQHPDITETIEVYA

SEQ ID NO: 10402 - protein, 409 aa, Actinoplanes utahensis
MRTLPRWAAALLVPVLATTALLAAFQDPAGHLETVTAAVVNGDEPVTVNGRTVPLGRELAARLVAHTGDNYTWVLTGADDAAAGLNSGRYRVAVTIPANFSRAATSVGNADPATAERARVSVSSSRTAAGIDPVVSRTLTGAAVATLNQTVVETYLDNVYLGFNRMHRQLGDAADGAGKVSDGATRVADGNRQLVVGLRQLAAGSDALADGTDRLSTGASTLADGTGELRDGANRLATGTGQLATGAGRLASGAGQVAAGTGKLADGLGTLRDSTKNLPTQTRKLADGAEQVAEGNRKLAGTVVPIADQIVNGIDRLPDLDKLADRCETPADVCAQLRRAADALAAAGNPVADLRNQVVTFRDGISALADGSQRVADGADQLADRTPALTGAINQAAGGAARLDKALAS

SEQ ID NO: 10403 - protein, 220 aa, Actinoplanes utahensis
MPTYTDAERAHLRDVAATPIEATETAVGGLTAGPIVVLVLWLGALVTLILTPAARRDPLTWHGPTWRLAVLNARPLLRYAAAQAVVVSAAAEAFLRLAPLRVIALLAVAVLIGVAFILVIQALLIGFRTAGRLAAILVPVLALTTAVISAVPGALTTTASYLPTYGPILAVRALTAHGGAAGTGLMLTVGWLAIGVLGVLCATAHRRTVPVRYGAAPSHA

SEQ ID NO: 10404 - protein, 1207 aa, Actinoplanes utahensis
MALNSGGGTNTSFTIYDGFLRPRQTQSEAVGGGRVVTDTLYDQFGRADMAFGAHAEPDAPSGTLWWEPEWSVPTQTLTEYDRAGRATASIFRSGDGTTNVVEKWRTTTSYEGDRTTQVPPAGSTPTTTLTDVLGRTSELWQYNTAAGIAGGHDTVKYGYDAKNRMTSAADSAGDTWTYKYDLLGRQIETKDPDKGASSSTYNDFGDLLTTKDATGHVLAYEYDSLGRKTGLYDGSITEANKRAEWKYDTLANGLYMYGKVTQATRYETAADGTRQPYIWRPTGFSARNQVSVEQWVIPAAETGLGGTYSYVHSFSPYTGAETGITYPAAATLTSEGVETTYDKASGLPTALKSLWSDPGSYVSAQQYDAYGKPTSTMLKITGGVYAQQMMSYEGDTRRVHEVKVKPETATGTVADRTYNYDASGNIQQVTDAPEVGQTDTQCYVYDSLIRLTSAWTPKSGVDCKTSPTVANLGGPAPYWIDWTIDALGNRTKEVSHGMAGDTSRSYAVPTAGKDVVRPHAVTGMTTTTPAQSSTTVGYAYDDAGNMTSRPGDTGTQTITWDAEGHPVKTVEGSKVTTDLFDADGSRLIRRDSTGATLFLPGQEIRRLGASTTANDATRYYSFGGAVVASRTVADRSLTWLFSDHQGTQSTAVNAYTQQVSIRRQTPYGAPRGTNPTWANNKGFVGGDLEPTGLTHLGAREYDPALGRFISVDPVQDLTDPQQWNAYSYCGNNPITQSDPTGLRGDDQYYGPQAAAKRESPAYTGDPDSGGAGDGTHDYNGGGSSHGSGGGGDGGSGSHNQPKPKKKSWWERGVDWVSENKNTLIGAGVGIATFMGCEAVTAGAGTPACMMAAGAAGKLTTDALDGNIHGVVDVINSAGAGALEGALAVPLAAADAVSQVGNIANDVKNGDWAAAAGHTALGALDVMTVVDGVKAGPKKEVASQEEGVRPPSTCKNSFTAMTLVLLANGTSKPISDIKIGDKVRATDPQTGKDTAEPVETLYDNLDHDFVDLTVKHPDGTSAVINTTAHHPFWDQSDHKWTDAADLQVGHHLRDTHGQAATTITKVHAYTGAHHMHNLTVTSLHTYYVLAGATPVLVHNCGGAHRAEGESSQGEDYEPRHGRPESLDVYPLRHAVAGAAEGAITKWDNSLPKRIIGMLPGDSWKSVADVVGRAAYGAFYGRRAYYDWGGGYPAVHRAPDDYSGRHRAN

SEQ ID NO: 10405 - protein, 282 aa, Actinoplanes utahensis
MRRLGPPRIPGLEGPTQRVVGDVGDPLVDVGDADGTITPNYPDMAIRDFNGDQTTDVLARDTGGTTYVYGGDGKGVFEPQTSAGTALSGYNFVLSPGDATATFPVTLDRTGPAISHITPGDMKLVRGTSFTTTASVTDPSGVAATSVNGVGTPGTAATGKVPTGRDGRLTVTWQATDRFGNQSSASRTVVVDNTKPALAISAAPATGTRLTRAATITAAASDHNGIAKVQMLVNGTVVATDTTAGYRFTLNPANYGRTFSVQLRAYDRAGNVSHSSTRTYHR

SEQ ID NO: 10406 - protein, 164 aa, Actinoplanes utahensis
MSGAEQEFRVFVLGIAASLHRTAFLLCGDWHLADDLVQEALAKAYSHWRKVQRAENPSAYVRRILINQSRSHWRRHRNVPTYGDSDLGQLTVPDLSDGVVSRADLVQALQSLAIRQRATVVLRFLEGLSERETAAVLGCTEGTVKSQTSRALAKLKSVLNRGDH

SEQ ID NO: 10407 - protein, 334 aa, Actinoplanes utahensis
MPNDTEEQLSTALHDIVKDRPYTPDFDRIESRGRTLKNRRLAWRAGGGATFAVAAVTAIAVAVGGTGTQAPARTEAQPGPTRSATATSPATSATQQPLVQLAAYLTTIEKQPGDAALVRRDEWNAYNSPHKDVVWDLYADNGKYYFAKTRAGLPAKVRHNQTDAGDTFRVAVEAAKYAVNGDLTVARKKMADMTGAFQVEDPGPGVVPPYQGPIGKKVPRQIRDVLKVNLVDNRVWLNSIFALEAGAGSPTVRAGVLRLLSTLPEVKVTQGILDGKATLTLTVGKPAMAGDRTEALTIDATTGVPMRFLSGAGASGANYQVTRVSLADVAAGRF

SEQ ID NO: 10408 - protein, 525 aa, Actinoplanes utahensis
MAARGKVAELAAELDLLEEDIGWDLAESHARLDRLIEALRPSGESELFWRATLLRADAIEREGDGATAARLVGEVRRWAAEHGSQLLISRTHRLLARLATNAGDLGGGLEHMLQCVMALGDDTPPAERILALIKLADAFAATGSMAAARERFEQALAAAAEIGHLERQMTALNNWAYSEYEAGEPQRSWEVLQRLRALARAHDRPLDAAELDTVARVALELGHVEEAERAARDALELYPHDKVEADAQAAYLLTFGMARHRRGDLEGARAALAESAELCERHRLGRLAAGVMTEQAALLASAGRFEDAYRKLCEANEAERRQRDADREEQARNLQAAYEVADARRQAESFRDQARRDSLTGLRNRRFVDEHLRGLLSRGGTGATPVIAALLDLDHFKRINDSLSHQAGDAVLVAFAGLLAQVDAGVDGFAARLGGEEFLLVMTGVAAPEAIMRVADFRRSVLAHRWTSITGDLPVTVSIGVTTAAPDCTVADLLGRADEALYAAKRAGRDRVHLDELADLATGAS

SEQ ID NO: 10409 - protein, 961 aa, Actinoplanes utahensis
MRPLSVPSATRRVGAAAAGVFLLAALLPQQAQAAPLPGAVTAGTDSKAPRRADYDSRANLVAAAQAQAPATASKGSASSRAFATAPSASAVQSMRNKLGVQGIVDIDRATGTPRRVAKLDGFLTGPSHKKPTTIALDYIKAHPEIFGLDAADLATLELRRDYVDVAGTHHLSWVQVADGVPVFGNGLKAHVAKDGRLVQVDGSPLKSLPSTAGAAKVTATGARAAAVKDVLGTSTAKATKTAAGTTTFSDNGTAKKVWFQTVSGPRLAWQTIVVDEGYVHVIDAVSGEVLYRHSTIANDSAEVWKNYPGAPKGGVPQKVDLTAKGWLPDNTRQLSGNVAHVYSDVNDNNQADPTEEVGPSGLHRWDYPLADFNVAVGGLCSAAYPCSWDPKTANSWQVNRKQNAVQLFTFLGTFHDHLKSSPIGFTRAAGNFEARDGDAVQGQAMDGADTAKGLPDADHTDNANMNTPPDGIPPVMQMYLLNPAPDAVAANTGDESDVVFHEYTHGLSNRLVIDAAGNSTLSNIQGGAMGEAWSDWYAEDYLHATGLEKDTAKPGDVLIGKYWSAGGTIRSEGLDCTVGIVSAACPGTPNAGPGGYTYGDFGKVSSRGPEVHADGEIWAQTLWDLRRAIGSTKAESIVTRGMELSPDNPSYLDMRNSIIAADLVVNGGKNAKTIWKVFAKRGMGYFAAAIDGDDTQPVEDFSTPPAAGTPRGTLTGKVTDQDTKAPVAGLTIAFGGHASGFAGDYRATTAADGTYKISGIIPGTYAKVYARGAGYDQIVKTLSVNSGTKAENWAVRHDWAASSGGAGIISATGPDYTAYGCGPGELLDQSQISGWGSDVAAEGQNAVIRLSGAVNVAQLVVNPSSTCGDDKTASTSGYRIETSKDGKTWTVAASGKFPAGTVTPTPVALAAGTGDAIEYVRYTMLTTQAQDAGLCAAGQPGTANGCKFMDSTELAVYGPAA

SEQ ID NO: 10410 - protein, 540 aa, Actinoplanes utahensis
MTEARRTDRSPAPATVAALAAELDELTRNRGSDIAVALPRLLKVEQCAAEMGEDILKWRATLLRADLTDRTGDFAAAARLSWQALQWGTEHGCAQVVSRAHELIGRGSRTMGDPLKNLDHMLQAVEALDDTVPKSAYLGILVKLADALAETGSMPEARQRYEAAARLALEVGDVERQAMIYNNWAHGEYEAGCPDDARTAVDRLLAFNTATGRALDCCDLDTVARIRLLLGEHRAAEEAARAALDAYRESDKVEADREAELLLTVAVTQRHQGDLAGAQVSLDLSRSFCDDLNLGLLAALVQREQSEIHAAAGRWEQAYRALRAHQEIETKRADAQREAQARNRQVMFGLSEARRQAESFREQARRDPLTGLHNRRHMDEQLPGLLAEAARTGAPITAAVLDLDHFKRINDTLSHEAGDTVLSRLAARLSQVPLGDDGLAVRLGGEEFLLVITGVRPAEAIFRLEDLRRDIAEESWATITGDLPVTVSIGVTTSDAGSTVNGLLGRADAALYEAKHGGRNQVRVDPGCDLTERRWFRSLR

SEQ ID NO: 10411 - protein, 229 aa, Actinoplanes utahensis
MRSRVYRGAVGRRRKAIGAVVVAGVLGVGTVTGVQFANASTTPRAATDLAAFGGRQAAAPGQNPAGAKDAAARAAAAKAAAAKRLAAFCAANGQAAGDNAAGNAAAGKGAAFGKAAAGKGAAFGKAAAGKGAAFGKAAAGKGAKGKGIAAKIAAAKADAAKRIAAKCAAINGAAANGAAADAGAGNAGKANSIAAKIAAAKAAAAKRAAARLAAAKAAAAKRAAGAAGK

SEQ ID NO: 10412 - protein, 217 aa, Actinoplanes utahensis
MTQRTSPGKLRRPIWRGWIHLIWFLLSLPAGGLLIAGARGEGAVVAAAVYAGTVSAMFGTSALYHRVSRPPALRRLLQRLDHLMIFVLIAGSATPPYQLAVPARYHGICLVVMWALAAVTATLHVARMQAPERAVGGTYIGLAAVAGLALPLIWIHAGPAAGALAVAGGLLYVAGALAYHYRRPDPAPSVFGYHEVFHALVSAGATCHYAAVFMLVT

SEQ ID NO: 10413 - protein, 481 aa, Actinoplanes utahensis
MWHGGRVAGTRLRRPAGVRTRLPRRDFSRSWSGSRDRSPRRAVFAPEAAGVAHPRRARRRPRPAVRAPEPFSIVSRDFPAVSDLPVLRIPPAPATPAAPVRRVRTGTAPAPVPPLFPAWPAVALYLVLRAVSLIFTWHFVAEKHRDPWALLGAYDAAWYAGIARHGYDTAIPVHADGTLAPTNLAFFPLFPALARLADPLVPGGADRAGIAVAWLAGLVAAGCLYAVGARLHDRATGILLAGLWAVLPHAVVESMGYTETLFTALAAAAVHALTRGRWLTAAALCALAGLTRPTAAALIAVVGAAALVAIVRRRDGWRPWAAAALAPIGLLGYAGWVGWRLGRADGYVHVQKDAWRMSYDLGGYTVRAARGLLTGESTPAYFVVTLLLIAALTLLAVLATDPVAPWQLKIYSAAIVALAFFGHGYYHSKARLLLPAFPLLLPVAATLARARRTTVVAVLAAMTLISAAYGVYLCTVWTWSP

SEQ ID NO: 10414 - protein, 188 aa, Actinoplanes utahensis
MTTGRTAVPVQGVMTRRRVRDMRDGAEQEYIEYVTARIPALRRLAFLLVGDEHRADDLVQQTITTLYLKWRRASAAEHLDAYVRTMLVRTYVDERRLAWARVRLFQHAPEPPPLEPGGFEERQVVRAALARLPRRQQAVLVLRFFYDLPVEDVAATLGCSTGTVKSHTSRGLITLRRLLGEPELAVTN

SEQ ID NO: 10415 - protein, 395 aa, Actinoplanes utahensis
MPSDFDLLRSIDTEPRATSTVDVGRAISTARRRRSRQRTTYAGVAALAAVVLTGGVLTWRPSTPTAADSTPGSAAPVGVKPPTRCTVRQLPIPDGAPAALVAGADRTGRYLVGRSYPKENEWQPVIWQDGAASTVPIPGTFEKQLADVNASGVAVGWGFSSKTTSLPYVFGNGQVTRLPGVTGGQALAINDRGAIVGDDGSRPVLWRSATAQPTRLPVPPGTTHAQATDIDQDGTVVGTIDDRIPYVWLPDGTHHPLSLPDLDGEPVEGRAFHISGGWVSGVVNTRGAAAGLAAERGEIRVVRWNLRTGAATPVTAFDKRADAINAQGWQTGIAAGGGGAVLVADGTTLPLSGLAPAGDDRLAVIANAVSYDGRTVAGQADDAAGRIQPVVWTCS

SEQ ID NO: 10416 - protein, 239 aa, Actinoplanes utahensis
MSAGPDFAPRYFRIEQELRARIAQARPHDPLPSEPELAREFGVSRMTARAAVTQLVNDGLAYRAPGRGTFVAVPTGPRRADNLIRLSEEIRKRGKEPSSRVVSAELRPATVIEATRLRQRAGDVVAIYRVRQADGDPFAFEHACYPGVLGALLDFDLSQSVHEALVALGRIPTRGTSTITAQPANEEDARELGVPAGTALLVEERLILDQEGRPLELSESRYTGTKYRLDVAFGVEPHQ

SEQ ID NO: 10417 - protein, 255 aa, Actinoplanes utahensis
MRHTLPIATTCLDRRLSRQVRFGPMDFSVSQIARMIDHSILQPQFTLEDVRQGCAVAAKYQVASVCVRPSDVPLAVELLRGTDVRVGTVIGFPHGDTSTEVKAAETEQAVARGASEIDMVINIGWLRSGDVAAVETEIKEIVRVAGEAHVKVILETAYLTDEEKLAACRAAERAGAAFVKTSTGFAPTGATIDDLALMRSAVSAKVQVKASGGIRGLDTLLAMAAVGVTRFGTSATEEILEDLARRQATTYARRA

SEQ ID NO: 10418 - protein, 405 aa, Actinoplanes utahensis
MIHKRLSTMVAAGLIGAATLLGATPAHADETDPPRVELVLDVSGSMRAADIDGETRIAVAKRAFGKVVDALPADTRLGIRVLGATYAGKNRKVACQDTQQIVGVGPVSAVQAKNAIATLKPTGYTPIGLALRKAAADLGDSGSVRRIVLITDGEDTCTPPDPCEVARELAAQGTHLVIDTLGLTPDEKTRKQLVCISTATGGTYAAAKSEQELTDRVQQLVDRAVVPPPVKPAVVTGTAACAGAPLLAPGVYTDREQISQHRFYRVAVPPGQELRASVSIALDRAVNPDYGVLLTASTPGGRELVRGLDAGSGRTDVLSAGLRWAAEQGSEVCLTVSNSFATATTSPLGMPVELTIGLTGASHAPDAPGLGRGFLFLLVLAVAGLIAGILAGWATRYWVATWREN

SEQ ID NO: 10419 - protein, 256 aa, Actinoplanes utahensis
MRSTTYAAAAVALAALAVPAPALADDPSPAPAVHLAGTSFLTAVPISAGQPVQVGAVTGDYLYWQFSADAGQRPELTAAVTLPATGRTGDESWIIEVFDGLRRRQACVAGEQSPVAARDAAQVTVGCRIRQVRSWAEPQDGDPLPGTYYVRLSSTRTPETDLGLPLKVSLTLTADSGDLDTDQGTLAQPLVPDNRPGTVLTTPAPSATPSAAADSTFSADWLPDFSGRWFWTAGGGILAALTGLFGFSLTRRRRLR

SEQ ID NO: 10420 - protein, 331 aa, Actinoplanes utahensis
MLLDPGMDLTLRPMKYPHFFDRFKDAIKNTWTVEEVDLHSDLADLAVLSDAEKHLVSRLVAFFATGDTIVANNLVLNLYQHVNSPEGRLYLSRQLFEEAVHVQFYLNLLDTYVPDEAERFEAFAAIENIPSIARKAEFCFKWIDSVFDLRRLETREHRRAFLLNVICFAACIEGLFFYGAFAYVYFLRSRGVLQGLASGTNWVFRDESMHMAFAFDVVDQVRREEPDLFDAEMQQQVRDMLAEAVECEVQFAADLLEQGVSGMSLADMREYLQHVADRRLQVLGIAPVYGSKNPFAFMELQDVQELSNFFERRVSAYQVGVTGSVTFDDDF

SEQ ID NO: 10421 - protein, 822 aa, Actinoplanes utahensis
MTLTPEKTGVPEQRRHVMRVRKRNGEFEPVDVNKIVTAVERWITGLDEVDPLRVATKTISGLYDGATTEELDKLSIQTAAELIGEEPQYSRLAARLLIDLVEQEVREQGATTFSESIELGFAQGLIGDDAHAFVVAHRAELDAAVDVANDLRFEYFGLRTVADRYLLRHPIKRVPVETPQYFLMRVACGLSQTAQEAIGFYRLMASLAYLPSSPTLFNSGTRHTQMSSCFLVDSPKDELDSIYERYHQVAKLSKFSGGIGIAWSRVRGRGALIRGTNGKSNGIVPFLKTLDAGVAAVNQGGRRKGAACVYLEPWHPDVEEFLELRDNTGEESRRTHNLNLANWIPDEFMRRVEADEDWSLIDPSDAPELPDLFGDAFTEAYRIAEKKAVKKIKARELYGRMMRTLAQTGNGWMTFKDRSNALSNQTGAPGNTIHLSNLCTEILEVNSDDETAVCNLGSINLGAHTTADGVDWERLRATVRTAVVFLDRVIDINYYPSQQAAVSNPRWRPVGLGLMGLQDAFFTLRLPFDSPAAKELSTRVQEEIFLTSLEASAGLAEQFGAHPAYAETRAAQGDLHPELWGAPMTQGARWAAVKERIAAHGLRNSLLVAIAPTATIASIAGCYECIEPQVSNLFKRETMSGEFLQINNYLVRELKSRGLWTPEIREAIKRAEGSVQDIAALPADVKEIFRTAWELPQRALIDLAAARAPFIDQSQSLNLFLAAPTIGKLSSMYLYAWKSGLKTSYYLRSRPATRIQQATTAVAATTVVPAATIPVVPAATTTLVANPSGPGQVATLSLNLLGDTDGALAASLENPDICEACQ

SEQ ID NO: 10422 - protein, 193 aa, Actinoplanes utahensis
MSHEKRAADRKRRMAELMAEAEEQRAEARASMEAAATVEGGPGSWLIEVAFVVILMVISAALFGTAVTISRFTGADIADARRTGEATVEQCERDGPIGLSGFGYVKACAVSIRWNGGGGERVMIGKPGFFTDEKPGDTFTIGENTGSRGSVGYSRAEVPPRRWVTALVTLISIIGVAPLLFAIGFVRYRLRRR

SEQ ID NO: 10423 - protein, 344 aa, Actinoplanes utahensis
MSDSFAVSRAPLTAPAADTKWYEGAGILEAVAGAADGFSQGDFLTGFGNSVVAGMSALGAVLDPFQAVFAAGVGWLMEHLNCLREPLDWLAGDPKEIEGHAATWRNVRDQVNAAVNFFAAQVTAATAPWEAQAVHEYRAKAAGIADGVRALGVVSGAVADATLAAGAMVGVVRNTVRDLIAEVVGAAISKALQALLVVTIPEVLTSVAMMVAECSAKIVRVLRRLSADMVRLGMKFPQLERLCAFLRGFLDKVASDISMPAVLLNSAKVNADTYPADSSGSWGGWKEAYRTFGDADDAVYGTKIEIASDAIREALKGNSIQNGGATGDAMIGDAETSPDVDMPR

SEQ ID NO: 10424 - protein, 101 aa, Actinoplanes utahensis
MSVEISPDEVRRHARDVDEVARMLDEARSAGAGARMSSDAYGYLIGPLFTNLYLHPQGDELIDVMRHASEGMRGLADQLRTMATAFEETDGISAAGLRRIR

SEQ ID NO: 10425 - protein, 129 aa, Actinoplanes utahensis
MIVRFDVDDPMRSFQARVEESAQRTLRFSAALEAIEATGRAPGGEVSVRVNSAGGLADLRFHPEADRLSLDELARLVVETTHRAQGRLAEHVGELVASVYGSDSGTAALINEAYAKRYPKPAVDEENRR

SEQ ID NO: 10426 - protein, 395 aa, Actinoplanes utahensis
MKIDKRRLSGMVAAVLAASGIVALSSGSPASAADCGYLFDDFHYNTSSDAALTANGWTPRSYSGGPGVAGATWSPANITFPTANGDKVAQLTAYTDGTAAGTGHAELYSAQKRFLDGTYASRIRFSDTPAAGTDGDHINETFFTISPLNGDLDPTYSELDISEYLPNGGWGETGPINYQTTWYTYQNDPWYADNLHSSQRSSLDGWHDLVAQVANGHVVYWIDGVQVGDHGGKYYPRQTMTINWNLWFIDLAAHAGGKSTYNEQIDWVLFAKNQVLSPAQATAQAAAYRTGGTGFLDTVASSGTCSTPTTPPSSPSTPPSSPPTSQPPATGCSDAPEWAFSSVYLGGALVKHEKSKNGDPSGPPSGQGEHLWRARYWTQGSEPGWTQQWEDLGRC

SEQ ID NO: 10427 - protein, 250 aa, Actinoplanes utahensis
MSVTSEEFLHQVRAVVDRVGAGQAEEKRRAAELLATTVLNGGVIQAFGCGHSEALAMEIAGRAGGLVPTNRIALRDIVLYGGDPLEALADPMVERGTEIAHRLYELAPIKPDDAFVIASNSGINGAVVEMGLLVKEHGHALIAITSAQHSAGVASRHPSGRKLGEIADVVLDNGAPYGDAILPLPGGGAVGAVSSITAALLAQQIVTEVVATLIAAGVTPPVYLSDNVPGGKEHNAEIEARYTGRIRRTA

SEQ ID NO: 10428 - protein, 393 aa, Actinoplanes utahensis
MTQRLPDSGGDRPDRRPARRDRIAGTGLTSADDAGRTGQHGTRPGATRVDSQHQLHAQGSKHEYFLLTRRRSGRNFHRQQQSMKRMTTVTGESGGLLGRLRIEGPGMPEALARIAETILADPETSAHASIVDLAERSGTSTATVTRFSRTLGFKGYASLRVAIATETGRAEQARWETDISGDIAPDDPLTDVLGVVTAADTRAIQSTAAGLDVAAVERVAAAIAGAQRVEIFGLGSSGTSAREMAFRLERIRVPIWHRPDSHTALTNAALLLPGDVAIGLSHSGRTREVIETLAEAADHGALTVAVTSYARSPLAEVADVVFTTSVQETTFRLAALSALHSQLLVLDLIYVAVAQRTFERTAEALELTVRAVDAHRLPEKIPTRRRGRAKGQP

SEQ ID NO: 10429 - protein, 508 aa, Actinoplanes utahensis
MLVVARTVTALTRLLDVLSLIAADRRIQIVFTVDDEHPAIFEAGVTALLDDLAPRTIDWRQARKTRFDLILSASENDGLADLTGPVLLFPHGLAFQKFYPDSDVVAGLRPGLPDGVTTALTHPAQSRTASGRTAVLGDPAWARMLASRQRRGVYRTALDTTGRRLVVLASTWGPDSLLGTVPDLPERLVADLPIDEYRLVTVLHPGVWAEHGRWQVRAWLAYAADAGVLVLDPDSGWQAALLAADLVVADHGSLGGYSALLGVPLLLGPRPSGSTVPGSVAARLGEQCHRLNPHAALRPQIDAVLDGHDPDRYRRAVADAVVEPRDTAARLSRWVYRALDLPRPSAPPGFPPLPVPLPVPAPVAAWVAGVHEEPDAIAVSRFPLVGDRHEDLPYRHVVARVERATLTQVAGAAVLGVDAAGDDDLFRLWPHARLVVSVDDRGCRARFRDGDAVHIRADDPVVDPWVLASWAYWRMRRGESPVGTTRLRVGRRLVTVVAVSRRGLPDDD

SEQ ID NO: 10430 - protein, 725 aa, Actinoplanes utahensis
MSTIEVLTSEAVRVIAPGVANAAEAGIRRLIDRFLKRGSRFPDDPAERRAYLRRLIEEDAEFRELLDDLVTTAGRNAVHVDEQPHYVDHADLRRRLAQPGVWLINGARESGKTALTRQVAVDMRDRLTGYAEIDLDEYRTGGVLRITEVQQRILRRLDVDEVAVTAADVDLQYRRFLRRGRCLVVLDNLVGAEEAEALAHIGPAGTVLITTRQLTPDLRAWYPGRPEPVEGVDPASARQILADRCGRGPLAAEPDAVDELIRLCDAYPALLRQFGGRLAIRGNVPDAVAEEVRWFRTDPGVEVLFANSVRRSAGLLGADSAAGLALLAGHPGTDLSDAGASAWLGYPSRDLIADLLDTSLITRDRSGRLSFPWSVRRYAATALRPGEETSNAAFHRYLTWFRDLAGAADLAMDPAGVTDRARDGRLRRYPAPPAITWPFPAVRPVDWLAAEAHNVEDLLREAHFRGHHAEVVQIAGALEALLTMRGRHWTCLRANESALASAAALGRTAAVIRLHIVQARILTLLGLLEQAGHEADRADAGIAGLADPQLTASLRETQARREQEIARRGDPAALDRAAALLRQSVDIDQAIGDRRALGLHLRMLANVLIEAGSGRDALDLLADVHLPAGDPRNAARVHTVRAKAWLSLGDAVEGRRDWARAVELTGLSGAGQYQGELLELQARLAELEGDRQTARDCLSRLAIHYARDKHPREQEFSRRLAALGD

SEQ ID NO: 10431 - protein, 347 aa, Actinoplanes utahensis
MTALLDARLVVRRGDFELDIALSVARGETVALLGPNGAGKTTALRALAGLTPLGGGHLTLDGRDLSRTPPERRPIGVVFQDYLLFPHLSARDNVAFGPRRHGADRRTAHATADHWLDRVGLTAFARRKPRLLSGGQAQRVALARALAVDPTLLLLDEPLAALDARTRLETRAELRRHLAAHPGATLLVTHDPLDALVLADRLVVIEGGRVVQEGDAATITARPRTDYVAQLVGLNLYRGRADGHAVRLESGVVLTATDIVHGDAFVAFPPAAVALHPAKPDGSPRNTWSAVLTDIQRHGDNVRVRLDGPLVVAADVTPAAAAHLDLVPGRELWVAVKASETRAYPAT

SEQ ID NO: 10432 - protein, 255 aa, Actinoplanes utahensis
MALLVPAIGGLIFLVLPLAGLLGRTPWASLPDRLTRPEVLAALRLSLLTASLATTLCLLLGVPLAWLLARVDFPGRRLVRALVTVPLVLPPVVGGIALLLALGRRGLLGGWLAATFGVSLPFTTAGVVVAESFVALPFLVIAVEGALRGADSRYEEAAATLGATRWTTFTHVTLPLVAPGIAAGGVLCWARALGEFGATITFAGNYPGITQTMPIAVYQTMESGDLDGAVVLSLILLVVSVTILAALRDRWLTTP

SEQ ID NO: 10433 - protein, 246 aa, Actinoplanes utahensis
MKRVTAVALLAVSLAGCSSPAKDTTPTDVSVFAAASLTESFTTLGRQFEASHRGTRVTFNFAGSAALATQINQGAPADVFASAASRNMATIGDAAVTPTTFVKNQLVIATAKGNPKHITGLAELAKPGLKVALCAAEVPCGAAAQSALAASGVKLTPVTLEQDVKAALSKVELGEVDAALVYRTDARTASAQVDAVEFPESAEAINEYPIAVLKRAANPTGAREFVDYVLSPEGTRVLTAAGFQTP

SEQ ID NO: 10434 - protein, 176 aa, Actinoplanes utahensis
MPGAKGFFAFPQMRADSLVEPEDARGGRHAGWQLRLTRVSGMTVFPMGEAADLLGVSPDTVRRWVDAGRLAATRDEHGHRVIDGADLAGFVRARNADAAERSDSSSARNRLRGIVTAVVKDTVMAQVDIQAGPFRLVSLMSREAVDELDLQVGSLAVAVIKSTTVVVERATPGRIG

SEQ ID NO: 10435 - protein, 71 aa, Actinoplanes utahensis
MSAKGYAAAFDPATAVWLRSGNDEDGYVEIARLPDGGAAMRNSRDTGTTLFFTKGEWDAFTGGVFDGEFDI

SEQ ID NO: 10436 - protein, 495 aa, Actinoplanes utahensis
MAQSLGSPAPASEPGTIRSLIPARIDRLSWSPFHTRMILALGTAWVLDGLEITIASAIGPVLSDKATLAMTSAEVGAIATVYLIGEVFGALFFGRLSDKLGRKNLFVVTLGVYLAGNALTALTWGSGTAAIVFLYLTRFIAGAGIGGEYAAINSAIDEMMPAKYRGRVDIGVNGTYWGGAILGTLGTFVLLNHMNLNLGWRLGFLIGPVIGLCIWNLRKHLPESPRWLIMHGREAEAEENIAQIERAVESSGQTLAPIDDSRAIDIRPTQSHGYLSLLRVLFKQLPQRSILGASLMITQSFLYNAIFFTYTLVLTKFYGVDEKNAPIYLIAFAAGNLIGPLTIGHLFDVVGRRKMIAGTYLLSGVLLAITAVLFNAGALNAITQTICWCVIFFFASAGASSAYLTVSEIFPLEIRAQAIAVFFAIAQCFGAIGPVFYGWLIGEGDDPGKLFIGYLIGAAVMAIGGVVEIFLGVDAEGKSLEDVATPLSAVVRTAD

SEQ ID NO: 10437 - protein, 313 aa, Actinoplanes utahensis
MLGSLGGAFAAAEGLGTTLSQTLLVTGGAGFVGTALIRSLLTEFPDATVVSLDNYFTGSPANHIHDPRVTYLEGSTAEIAKIWAGHGLPAPELVFHLGEYSRIVQSFEDHDLTWDFNVLGTKEVVKFTASAGAKLIYAGSSSKFGNDGDDENLNPYAWTKAKNIEYIKNYSNWFGLDYAIAYFYNVYGPGQIGNGKYATVIGIFERQYLAGEPLTVVSPGTQTRDFTHIDDIVRGLILVARGGAGDGYLLGTGREWPLAEVAQLFGAEFQLIPALPGERVRGKADLTKAAGLGWQPQRRLDEYIAEFVAAHPR

SEQ ID NO: 10438 - protein, 763 aa, Actinoplanes utahensis
MTGVQVTVSGLDQAAGRVSSPSGTAPTTYHRSPQAAASRNVARSPPGRVIRVQAGAAGRALQAASIEMTSMPQEIQARMKDPSISSAKQDRPLWSRSHDSMVGGMSAPPRWAALLVTPLVILGVLAIGPTDPALAHPPSANPAATRAALDPALVAGRGATVAFAEQEAEQAVTTGSVLSPDRTPYTLAAEASGRSAVTLDPGEYVEFTLPEAANAITVRYSIPDAATGGGITAPLSVGTPGGTRTMTLTSQYSWLYNQYPFSDDPRAGLLHPDWWITECGCVPAATTPAPAITEPFRPMHFYDEQRLALGRTYRAGDRIRLTAREVPTTIDLLDSELVGPPKVDLGAVNVLLFGADPTGRRDAAGAIERAIAFARKVHRAVYLPPGTFQVNRHIVVDDVTVTGAGNWYTVVKGHQVTLSTPAADGSVHTGVGFYGKEGGSHDVHLADFAIQGDVRERIDTDQVNGIGGAMSDSSIERLYIQHTKVGLWFDGPMANTTISGTIIVDQIADGLNFHTGVTGSVVRNSFIRNTGDDGLAMWSEKTADSGNTFDHDTVQTPTLANGIAVYGGADNTVSNNLVADPIREGSGIHAGSRFGAEPFTGHLWITGNTTVRAGTYDLNWRIGLGAIWFLALDAGIDADIRVTGDDFLDNTYNAIMLVSDWGVKDRYAITGVHFKDIRVDGTGTSVVSARAAGGATFENVDARNVGAVGVNNCGSFHFTPSGSEFTLSDLGGNDGGWLGPFVPNVITCDDRPAVVPPPAPSAW

SEQ ID NO: 10439 - protein, 528 aa, Actinoplanes utahensis
MTGNRGLGQWCRDRKVATKVLAVAGVAITGTIVTGVLSVTGISAMEKTRNAEVGRMAPYVKNLGDAALQLKAAANDERGFLLKGDAKFSDESLGRQAKADASLAAARAIAAPDDVTRVDAIRAASDTWFEALKSEFALYKSDPEKATTLGLGANRDLRKAYEALLTADLDKANKDLLAGQSFDHTVTRTRTLVIVALSLALLLGLGSALLVARLIIVPLRRVSGVLDQVAEGDLTGDPDVWQRDELGHMADSLRAATGSLRQTVTDLTAHAESLATEAGGLAETSRQSSASAAEGAEQAATVADSAATMSVNIQTVAAGSEEMGASIREISESATLAVQVANRAVEVTANTSAVMAKLGESSAEIGDVIKTITAIAEQTNLLALNATIEAARAGEMGKGFAVVASEVKELSQETARATEDIGQRVAAIQTDTAGAVAAIEEISEIIGRINDFQTTIASAVEEQTVTTNEMSRNVGEAAEAGGRVAETITGVAASVQLTTVGVAEADRSAAHLAGMSTDLRRIVDRFKV

SEQ ID NO: 10440 - protein, 419 aa, Actinoplanes utahensis
MRRPGRGDRGGPGPPDGLGRPDRAAPLLGRLRSAAVQEVFFRESFGRIVATLIRLTGDWTLAEDCAMDAIETALRRWPVDGEPGNPGGWLMTAARNRAIDQLRRAATADRKLQELALLQPDEPPPAADDRLRLIFTCCHPALAPESRVALTLRVVAGVPTADVARLFLVAEPAMARRLSRAKARIEQAGIPYRVPQGPALAERLPGVLAVLYLLFTHGYDTADSQAEEAIRLARLLVALMPAEPEVAALLALFLLQHSRRAARRDPAGDLVPLAEQDRSRWDHAAIAEAVGLLTAHPVTGPYAIQAHLAACHATARDFAATDWPTVAGWYDQLARVHPTPMVAVNRAVAHGYAYGAQAGLDLLAEVRGAVGGYALAAEADLTERAGDHRMAAGLFRRAAAAATSEPERRALRRRAEALG

SEQ ID NO: 10441 - protein, 199 aa, Actinoplanes utahensis
MPPQKPIILYVVKQPHRIREIALRAGLSPATVDRVLHRRGGVRDSTVARVRRAVADLDRECAEPDDFAAGATAAYLIEQWLHDRAGDVLVIAGPGTGKRIDGFRSALGPGRRLRTVTDPGQVPATLAGTHTVRAVYTARPDGCAGVITAFEDAGRNFDVFVAHGADQEILALLRQFRINAVLRDGAPPEIITPFNVPVS

SEQ ID NO: 10442 - protein, 282 aa, Actinoplanes utahensis
MRVISRWADGGVEVFDESLEPCRSFPVPPEVEGWAVPASRDSLIHAIGNTVIRIGPGAEERWRCDLSLRERPTAWPSAVTLSADETRIWVYAPGREDGHDAWFVLDAGTGREIRRYRLPTGGQRGQQFPVRDGSMLLSVSRGQDGWATYRAGPDGTVHDYAWDDRALVDLSPDQRQFMTVDHWQEDVAFHDFADGAVRFRIGAEAFGLDRPDVEYAGGYLDDETAIVVAVADDDSWRHFRVGARTGEVLGDLGIMTIDEYDLQPLGDGTYVITDTDGTLRRM

SEQ ID NO: 10443 - protein, 486 aa, Actinoplanes utahensis
MSDKLRSVNGLDFAIADINLAEAGRHQLRLAEHEMPGLMSLRAEFGESKPLAGARIAGSLHMTVQTAVLIETLVALGAEVRWVSCNIFSTQDEAAAAVAVGPTGTVDAPAGVPVFAWKGETLEEYWWATTQLFDFGNGRGPNMILDDGGDATLLVHKGVEFEAAGAVPQTTEADSHEYSIILDTLRASLAEDPQRFTRIAAEIRGVTEETTTGVARLYKLAKEGTLLFPAINVNDAVTKSKFDNKYGIRHSLVDGLNRATDVMLGGKLAVVCGYGDVGKGSAETLRGQGARVVVTEVDPICALQAAMDGMQVVRLEDVVGEADIFVTTTGGTDIIRVEHLQAMKHNAIVGNVGHFDDEIDMAGLAKVPGVEKVEIKPQVHEWRFPDGHSVIILSEGRLMNLGNATGHPSFVMSNSFTNQVMAQIELWTKPGEYAKQVFVLPKHLDEKVARLHLDALGVRLTTLTKKQAEYLGVDVEGPFKPEHYRY

SEQ ID NO: 10444 - protein, 173 aa, Actinoplanes utahensis
MRRIFTAFGLTAAMLLPLTTASAAKAAPARLDPDAAFLRTAHQGDLAQIAIGRLAVQRSANPVIRHLGTRFAADSTRLDTAVRATAQRLHVRLDAAPNATVQQSLAAFETAQGPAFDRLFLTGQTGLHAQAAHLIRAELTDGDEPAVQQIARRALPLIKRHRLALKNLGNKIR

SEQ ID NO: 10445 - protein, 546 aa, Actinoplanes utahensis
MSHEETLLFGLVAITIIVIIVVVRWISGKTGLPAAVLLTVIGIAYTRLPGKNIEIDPDLILTFILPPLLYTAALDSSLLDIRRNLRTVISLSVALVIVTALLVGLGFSLWVTGVGLAAGIALGAAVAPPDPVAALAVGRKAGLPTNLITLIQGEGLLNDATALTILLVARDVAIGAEHFSVNATVGRFVLAAAGGVLVGWAVARLIRLLRVLRADPLTANALSLATPFLAYLAGERLHVSGLLAVVVAGLIIGHDTPRYASGASRLQTSAVWRLIDFLLEGVVFLLIGQQMDGVLKHLKNYETSTILAALAVTLGVVLFLRPLWLVLTQLLPRSLHTRLGGEDDSGTILEKSLTGRESAVLSWAGTRGVITLAAVYSLPDTLPNRDLLAFCAFAVVLVTLVGQGLTFAPLVRWLGLKANETDKAKLRNEARSAAVRAALNRIDDIQSEHHDHVEDEAMHTMRKQLQVRLDRYQHRLDVLEQVDTPEVPPSPQYEAALMVRQAVIDAEREELLRWRDAGRLDDENLRVLNRELDHEELVLPQRNKGH

SEQ ID NO: 10446 - protein, 405 aa, Actinoplanes utahensis
MGAVRRRPAGHPDRLPDRRRAGDRDDDRRRAAGRRLGRLRRGVHPQRLAVRRGRGDRGATDQRRPRCPHHRGAGPGRLLRAAARRRHLGAGRRPARPALLALADRLGAADLPVRGGRPLAGPARPARHRRDRRRRRPPAGPPRPRVRPDRRPARPGARRPGARFAVRPGLAAAPGPLLGWTAGFGALGLVFGGVGTSVVQLSRESSGVSDVFSRLGGSGTVTDAYFATTAGLCGLVISLYAVQAALRMRDEEQTGHAELILGTRASRVGWAAGHLLFVLLGPVVALAVEGLLAGLAFGEPGRVPAASLAQAPAVWVLGAIAVLLVGALPRHSAAAWGSVAICLLVLLVGGLLGMPQWVLDISPFTHVPQLPAAGFTVVPEIVLILIAALLSGAGLTALRRRDIPA

SEQ ID NO: 10447 - protein, 299 aa, Actinoplanes utahensis
MTEAIDAAGLIKRFGKVTALDGLDLRVRTGEVHGFLGPNGAGKTTAIRILLGLTRLDGGRARLLGGDPWADATTLHRRLAYVPGDVTFWPNLTGGEVIDLLGRLRGGLDRRRRDDLVERFQLDPRKKSRTYSKGNRQKVALVAALASDVELLLLDEPTSGLDPLMEEVFREVILQEKLRGDRTVLLSSHILAEVEALCDRVTIIRAGRAVETGTLADLRHLTRTTIRAELTGPVNGLAGIAGVHDLSTADGRVAFDVDAEALEPALRSLVAAGVRSLVSQPPSLEELFLRHYAHDEAGK

SEQ ID NO: 10448 - protein, 204 aa, Actinoplanes utahensis
MSSDSDLTARARIRDAAIRLFAERGIDGATIREIAQAAGVSSGLLRHHFGSKEGLRDACDEWAMSRVAELQIRFAETRIIGALPPDTMSLQRYLVRSLMDGSPAGMRMFAESVDRGGLWLERTGIDSADPRAFVAVVAAMKMGMFLMHEQLGEVLGESVSEMPGWLRMIRAAVEIFQQPLLTPEQADQARKALDRLATHEGEQP

SEQ ID NO: 10449 - protein, 302 aa, Actinoplanes utahensis
MNVVRRALTVSGLLAVLAAGGCTAAAEDAGTTASGLDLTGAVTVDGSLRAKLPPAVRNRGFIRLVTDASYAPMEYFAADGRTIIGFEPDLSAALGGVLGIRVETVAGDFATAIDEVDKGTYDGVFSSMTDTAEREKKADFVDYFSTGTSILVQRGNPDHIRNLADLCGRTIAVETGTFQEDMLRRRQKGCAGEPMTIDVRKTNADALVRLRTGRAVAVLNDFPPASYLVSQVKTNLYYELASDMQYEPGLFGIAVSKDNSALRDALQGALARLIRTGTYGELLQRWNLGSGAVTEATVNGGN

SEQ ID NO: 10450 - protein, 652 aa, Actinoplanes utahensis
MRLRRVRRRAGVRTSSRLFATYAAASLIPVMVLGAVMWQGYRRDAAEQGRRQGLAQAAVIAEMAVAPALDGADLNAGLTGTELEDMRLATQLALFNGSVLRLRVRGFAGQVVFSDDGSTGGGVPTTDPDFRAATAGQSRVKVIGDHGSEVIRVVQPLVASASGQAIGVLELYLPYQGIAAQMRAQLTRFAQRVAGGLAALYLVLALLAGWTTRSLGRYAARQEYHASHDMLTGLPNRAAYRRHAEAILEVAARDGGHGAVVLLDLNRFKEVNDTLGHHAGDELLRVVSERMRAGLAEGDLLARLGGDEFAMLLPGRDVAQAVAVLTGIRARVAEELVLDGVPLNMEASFGVALYPEHGTDLQDLKMRADAAMYQGKRGTEDIVVYAGGATGHPHQWLKIQAELRHALERDELVLWYQPKVGLPSTEINGVEALVRWQHPERGLLPPGEFLPAAEHSGLIAPLTEWVLRRALADQAGWTATGRDWTLSVNVSARNLDAPGFVGYVAALLAETGARPDRLILEVTETALAGDADNAVRAVRELGALGVGISVDDFGTGYTSLSHLRGLPISEIKVDRAFVADVDHDPQSQAIVRSVIELAHGLGSRVTAEGVETTAIHAWLVEAGCDEGQGYLYGRPVPWPQVAVEPITERSLR

SEQ ID NO: 10451 - protein, 381 aa, Actinoplanes utahensis
MRISPQPRLVLLAAVALVAVLLGWSPARAAPVGARSPELPRFNGSVYAVAFRGGIVYVGGDFTAATTDGRRVGRQRLAAFDARTGDLLDWAPTADRTVRALAVAGDAVYAAGDFGTVSGAARDAVAMLDADSGAVGGFAHELDGYPRALAVAHGRLYLGGDFTAVDGAQRTRLAAFRIGDGTLDDDWQPSADATVYTLATAGRRVYLGGSFHRTNEMRSTGRLTAVDAVSGDLVQGFRPQPTAVVYSVAADGRGVYAGLGGLGGRAESWTSGGRLRWSRTFDGDVQAVAALDGTAYVGGHFDRACTSANVDKFGDCSDDSRSRVKLAAIDADGDLSDWAPQANGVHGVRAIAASRALGALAVGGDFTMVGGATHHRIATFH

SEQ ID NO: 10452 - protein, 253 aa, Actinoplanes utahensis
MTTPVLAANGLTKRYGRVVAIDGSDLELLPGEILAVIGDNGAGKSSLIKALSGALIPDSGEIRLDGQPVQFRNPMEARSAGIETVYQTLAVAPGLDIADNLFLGREERRAGPLGSIFRMLDRRRMREEAARHMSELGVATLQNIGQAVESLSGGQRQAVAVARAAAFGSKVVILDEPTAALGVKEGNRVLQLIRDVRDRGLPVILISHNMPHVFEVADRIHIQRLGRRIAVITPASHSMSDAVAIMTGAAPAS

SEQ ID NO: 10453 - protein, 337 aa, Actinoplanes utahensis
MSTTATDFDVRKHDSLGLRVQHTLHGNPVLGPLAVLILAIVAFSIVNTRFFAAANLSLVLLQVTVIATLALGQTLIILTAGIDLSAGAIAVFSSILMAQFCVKAGMPGLIALLLGLACGTAMGAINGMLVTRIKLPPFIVTLGTLTIFFSLNSVVSNSETVRGSDMPHLMTWTGDAIAIGNFQLTYGSILMLLLFAYFYYALGRTAWGRHVYATGDDAEAARLAGIRTGRVLFSVYTVAGLLYAVGGWILIGRLASASPNVGTEYNLDSITAVVLGGTSLFGGRGGVIGTLIGALIVGVFRNGLQLAGVEVVWQGFAIGLLVLVAVSLDQWIRKVKS

SEQ ID NO: 10454 - protein, 340 aa, Actinoplanes utahensis
MRRLMAVAGCVTLVLAGAACNRGSGDPVVGLITKTDTNPFFVTMKHGAQHAAQQQGVDLQTFAGKVDGDNEAQVQAIENLISYGARGFLITPNDSKAIVPSLDRAHKAHMLVIALDTPVDPANAADATFATDNYQAGKLIGQWAKAKFAKDGKPAKIAMLDLNPNQVSVDVKRDQGFLDGFGVPVGDPNRIGDENDPRIAGHDVTDGNEDGGRTAMENLLQRDPAINLVYTINEPAAAGAYQALKAAGREKDVTIVSIDGGCPGVDNVAGQVIGATSMQFPIKMAELGVEAIAKYAKDGTKPQNTAGKDFIDTGVQLITDDPQAGVEAKDSAWGKQNCWG

SEQ ID NO: 10455 - protein, 728 aa, Actinoplanes utahensis
MRRSRWRSGAIVGLTAAVVAGYAAITMTGASAAETLLSQGRPATASSTEAAGAYLASEAVDGNTGTRWSSAFSDPQWLQVDLGSTQAITRVELNWETAAAKAFQIQVSDNAAAWTPIYSTTTSTGGNQSLTVNGSGRYVRMYGTQRTTGYGYSLWEFKVYGGGVVTPTPSTTPSGPALPGGGSLGAQVTVFDPTMSSATIQARADAIFKQQETNQFGTQRNLLAFKPGTYNGLNIQVGFNTSVIGLGQNPDDVRINGDITVDAGWFNGNATQNFWRSVENMSLYPVSGADRWAVSQAAPFRRMDVHGDLNLAPNGYGWASGGYIADTRISGVEGQYSQQQWFTRNSRIGSNSNAVWNQTFVGVQGAPAQSFPNPPYTTIGTAPVIREKPYLYLDGSDYAVFVPSLSTNSSGVSWANGNTPGTSIPLNQFYVAKPGDSAATINQALAQGLNLIFQPGVYHVNQTITVNRANTVVLGLGYATIIPDNGVTPLQVADVDGVKVAGLLFDAGTTNSANLLVIGPNGSSANHAANPTTVQDVFFRIGGSIAGKATNSLLVNSNNTIIDHIWAWRADHGNAGTYGWTVNTADSGLIVNGQNVTAYGLFVEHYQKYEVVWNGNGGRTYFLQNEQPYDPPSQAAWRSGANGYAAYKVADSVTSHEAWGLGSYCNFTADSTIHSNNGFEVPVNSGVRMHDLLTVSLGGAGVIDHVINNTGAAAQGTATVPVYLASFN

SEQ ID NO: 10456 - protein, 476 aa, Actinoplanes utahensis
MSDAELNAESVAFRSALEVVRSVEPRIADAIAKELTDQRESLKLIASENYASPAVLLAMGNWLSDKYAEGTIGRRFYAGCQNVDTVESVAVEHAKALFGAPYAYVQPHSGIDANLVAYWAILADRVEVPYLKKFEKRQINDLTDAEWAELRQAFGNQRLLGMSLDAGGHLTHGFRPNISGKMFDQRSYGVDPATGQIDYAALLETAKEFKPTVIVGGYSAYPRKVNFAKMREIADAVGATFMVDMAHFAGLVAGGVFTGDYNPIPHAHIVTTTTHKSLRGPRGGAVFCQPELSSQVDRGCPMVLGGPLPHVMAAKAIAFAEARRPEFATYAQQIVTNSQALAEGLRRRGVQLVSGGTDNHLVLLDVHPFGLTGRQAEQALLDSGIVTNRNAIPSDPNGAWYTSGIRVGTPALTSRGLGVAEMDQIAELIHTVLAGTTPDPTSKAKFTLDPALSESISKQASELLSPFPLYPSVNLG

SEQ ID NO: 10457 - protein, 124 aa, Actinoplanes utahensis
MTPVLIRQWSLGDADELRVLRRGLRAEIGDGELFERMAVVGTELATNALRHGCPPVTVRLLAEPARLTLDVSDGDPASEPLFGTRRPFGAGGLGLLLVRTFARDSGWYRRGASKHVWAVFDHRA

SEQ ID NO: 10458 - protein, 270 aa, Actinoplanes utahensis
MTVTQTSTTVDRSTVTSAESPVDSAAELLNAMAAMPAGHPSRAALRDRAIEAWLPLARHLANRYAGRGEPTDDLIQTATVGLIKAVDKFDPERGVDFAGYAIPTIIGEIKRHFRDRTWSVRVPRRLQELRLAITEANATLTHSLGRSPTVPDIATHLGISEEEVLEGLEGARAYNATSLSTPISADGTTELGETLGGEDHEFELAETRVALAPALAMLDEREQRILTLRFYGNLTQSQIADQIGISQMHVSRLLTKALVKLRGQLAAETL

SEQ ID NO: 10459 - protein, 222 aa, Actinoplanes utahensis
MPPSAELPGFLHSVAPILDRWGYLALAGVIGVESFGVPAPGQTIMVAAAIYAGAGRMNIYVVALICFVAAVLGDNIGYWIGLRGGRAVVNRFGRYIFVTPERLEKAEQFFARRGNRIIVVARFIDGLRQLNGVIAGITRMPWRTFLLYNAIGAALWVGWWTTVSYLLGQNLVTIIDQAHRYKWPAIALVVLAVATYVALHVRHIRRRRARAAAAQPPGEKPV

SEQ ID NO: 10460 - protein, 276 aa, Actinoplanes utahensis
MRRFSFAGRTCVITGAAGGIGAALALELARRRSVLVLVDKDAEGLERVAGLARDLGVSGVTTYTVDLGDGEDRLDLAAEVSSRLGGADLLINNAGVTLSGTFEQNRLADVEWLLEINLHAVIRMTKAFLPQLLARPGSHLVNISSLFGLIAPPGQVAYATSKFAVRGFTESLRHELTPRGVGVTVVHPGGVRTGIALNARLSGPDPDGEQAAQNRNFHERALTLPPEEAARQIVAAVQSRRPRLVITREARAADLLVRLLPASYWSLSQRVARRFD

SEQ ID NO: 10461 - protein, 486 aa, Actinoplanes utahensis
MLRWAIRAGNLPVLGNWLRSGSHSLRPWHTGLPSTTPASQAGILHGASRQIPAFRWFEKETGKVMVSNRPRDAAVIERRLSDGHGLLRDGGVSISNAFGGDAVTNLLTISHAALPGRSARGWAAFMASPYGFTRALVLGVAEVFTELHQARLQRRRNVQPRVSRSGAYLALRPAAMLLRDVNISLVAEQMARGVPVVYCDLVDYDEVAHHAGPARPESMRQLESLDRMLGVLERLSPEAARRYHLVVLSDHGQSQGATFRQRHGETLDEVVERLTSEPAAAPRESDPAPIAAPLLVLSSGNLSLVYLARLPHRVLRAEIEQRYPRLIAGLAAHPGVGLVIVGDEHGPIAFGPGGSHRLRDGKIDGKDPLLPYGRHARADLLRHQESAHLGDLVVISSVDPETDEVAAFEELVGSHGGLGGWQTDAMLVHPAAWPITADLHGPDAVHRQLIEWLVMLGLREQVTPALSGISVETTRDPLAERPVRGR

SEQ ID NO: 10462 - protein, 540 aa, Actinoplanes utahensis
MTARMAAVTRLGRPLIRLAGSSSRATTITMTWAITPDSMAPQPPSAVIPSSSSGRSTAPTTATSTTRPSVSTMSAPATPGISHSVTVTTTKVVTALRSTPRARPSTRRQVNRARTSGLSGTPSTISQPDTDRVSAPFRRSSASFGTVRVRSVLMIPFVLIMAACQAPEKADPAPPVSRVVAGYFTEWGAYGRGYRVKNLVSSGAAGRLTHLLYAFGKVDGGRCGVGDPYAAYEKPIAATDSVDGAADAPTAPLRGNFGQLKKLKATHPGLKILWSFGGWTWSAGFTQAARDPAAFAKSCHDLVTDPRWAGVFDGIDIDWEYPNACGLQCDTSGREALAKVLAALRTAFGAGTPVTAAVPGDLKKLQAVDYSAAAAQATWLSAMTYDYFGAGTADKQTAPHSPLTGYPGIPRPGATTDATVTQLLNQGVPPAKLLFGVGFYGRGWTGVRSPAPGGRATGPAPGTYEKGMEDYRVLAGRCPPTGTVGGTAYARCGVQWWSYDTPDTIRGKVNYARERGLAGVFAWELSGDTPDGRLLTALAG

SEQ ID NO: 10463 - protein, 335 aa, Actinoplanes utahensis
MPARHRHRGSRPPAAQRRHPARRRPAAGQLHLRAPVDLHRPGADAPRGVRGAHHVRGDPGRHGAARAAPGPGAGGPAERLRRPAGDRTTAHLGAPRTGARGVPDAHPGTELLRLTGADGMLPPPVPVMIVRYDFDAPGLTRDTSGFGHTLRIVTARGGRIRTVVHGTGTALAFPARCDTGPCPHVALQSPGTADLNPGLRNLAYGADVLLAPGQTSKGENVVQKGYSKTSSQYKLQVDGMAGAPSCVLVDVRRPGLIRMVRSSVTAADGRWHAVRCERAGSRFEIYVDDVLRGRTRIPADLEVANDRPLSIGGKGAFRDNDQFNGVLDNVWVRIG

SEQ ID NO: 10464 - protein, 145 aa, Actinoplanes utahensis
MTVRIPDEDAAIATAFEHLYAGLRRITPREELSLTAASTLARLERSGPHRLCELHAPEGVSQPAMTQLVTRLEREGLATRRSDPADGRAVVVTITDDGRAAVTRRRAGRAEALSDLLRQLTAEDRAAITAALPALGRLNDLLTKD

SEQ ID NO: 10465 - protein, 599 aa, Actinoplanes utahensis
MLPVDHPRYKWVALSNTTLGNLLATINSSIVLISLPAIFKGIKINPLAPGNVSYLLWMLMGYMLVTAVLVVTLGRLGDMYGRVKIYNAGFAIFAVVSIILSIDPFTGSGGAIWLIGWRVLQAIGGAMLMANSAAIITDAFPPRQRGMALGVNIVSALAGSFIGLVAGGVLAEWDWRSVFWVNIPLGVIGAIWAYRSLHDTGVRRHATIDWWGNATFAIGLTAVLVGITYGIQPYGGHTQGWTNPWVLTGLIGGAVVLIIFGIIETRVAEPMFPLKLFRNAAFTGGNVANLLASVARGGLQFMLIIWLQGIWLPLHGYDYERTPLWAGIFLVPMTIGFLAAGPLSGFLSDRYGARPFAAGGLLVMAASFAGLLLIPGDFSYPVFALLIFINGLGGGLFSAPNTSLLMSTVPANMRGAASGMRATFMNAGQVLSIGVFFSLMVAGLADSLPASLHAGLTAQGVPADVATRAAGLPPVGTLFAAFLGYNPIAELLGPQTLAALPAGNAQNLTGLEFFPRLIADPFHDGLVVVFWMAIGMAVLGALASLIRPQPESSLPTDGAADGPDLVAHEAELSAELAEAQPLQPATRMPEPREDPATRD

SEQ ID NO: 10466 - protein, 237 aa, Actinoplanes utahensis
MTDLAPTAPPPYPGAAERPFADPADPAIARAAALFENMQPAEAAAALEPVLAANPESPAGWILMARIRLALDQVEPAFAAAHRAIEQAPEDPRPLAIASRALTLQGKHDEAMSMAYRAVIVEPKNPLWHDRVAWALLAADRQLADAEQAARTAIGLDPNEAHYYFTHGVALAALGHVDQARQALTTSLRLEPNNPVARQRLDILNGDAAPVVEKKKRGWKLFGRKGDSVPIRPEERT

SEQ ID NO: 10467 - protein, 346 aa, Actinoplanes utahensis
MTTAQPIAMARLQLQRGEAQAAAELLGPVLAAEPDHVTALVLMTHAQLALEKPDLAHEVAARAVRYAPGSAEALTALSRTLTALGRHDEAIATAQAATARQPENPYRHNRLAWALLEQGLRPVEAEHAAREAVRLDPDEADFRITYAMVMKQLNLPERAREALRDALRIAPDNAIARHELAAFDVVHRNPFALRRLARGVTGLVAALRADPRQEASRHLLDAALRQFLTYAAVMMGVFAYLGWRVAGESAPWARVLAGAAFLVPAAYASYFVARLDRVLKTYLREVVNRHRAASVAAAVTLALLLTATVAPAAWLPALLGLACLAGFIVRLLSLTVNLRNRRRPPK

SEQ ID NO: 10468 - protein, 231 aa, Actinoplanes utahensis
MVRFVELSHVIRDGMVTYPGLPAPRYAEHLSRVESRDRYAPGTEFAIDRITMVGNTGTYLDSPFHRYADGTDLAGLPLERLAGLPTVVVRAAGGPARGITAAQVAGLPVAGHAVLLHTGGDRHWATRDYAVDAPYLTGEAARALVDGGAVLVGIDAVNIDDISAEARGERPAHSLLLAAGIPIVEHLTNLAALPVHGAQFTAVPPRLAGFGTFPVRAFATVPIVPGPREQG

SEQ ID NO: 10469 - protein, 195 aa, Actinoplanes utahensis
MSGFAAALGLSFAVIFVAELGDKSQLMAMTFATRFRPLPVLIGITVATALVHLVSVGIGYGLGAALPTHWISLVAGIAFLAFGAWTLRGDKLTDEEKSKAERSTGSAILAVGGAFFLAELGDKTMLATITLATQHGWFGTWVGSTIGMVAADALAILVGRLLGRHLPEHIIKWGAAALFAIFGIWLIVEGVVGLS

SEQ ID NO: 10470 - protein, 626 aa, Actinoplanes utahensis
MKRIWAAAIVVALGAAGTATTSAQAALPHGAPNGGQAASPDGVAGNKQVTSSGGAASGGSAASSGGAASGGSAASPGGAASGGSAASPGGAASGGSAASLGGAVGDGTAAQPGGAAGGGVAGLRRGTPNYTPTAIVWNACTELSLKAQGAECGMVSVPMDYDNPGGTKIELAVARVKHTVPAAQYQGVMLVNPGGPGGAGRGMATLGAKVPNDVGDAYDWIGFDPRGVGASKPKLTCDSAYAGYRRPAYVPVTAALEDSWHRRATKYAADCAKAGGPLLDHMRTEDSVRDMDSIRKALGADKINFYGFSYGTYLGQVYATQFPDRVRRMVLDGNVNPTRVWYQSNIDQDIAFDRNIKIYFGWLAKNDKSYHLGRTAKDVEALYYRQLAELTRKPAGGVIGPAELTDIFLQPGYYIFGWESVGRAFSNWVVKKDPAGLKKLYDDNNPQTAGADNNYAVYLAVQCTDAPWPAKWADWSQDNWKVYHQAPFETWGNAWYNAPCRHWAAKPDRPVRVDGSKAPPILLLSETLDAATPYTGSLEVRRIFPRSVLVEGVNGTTHAGSLFGDSCVDDTVAAYLGTGALPARVSGNHSDKQCKPLQPPTPGKPPLQRSGQLSDRLRLQQLINRR

SEQ ID NO: 10471 - protein, 66 aa, Actinoplanes utahensis
MLAMGLCVCRRFCGRGGFRVGAGLTGQLSRCCELPGWRAGGGRVCAVSVVPGLGGRLLTGAADRVG

SEQ ID NO: 10472 - protein, 408 aa, Actinoplanes utahensis
MTTATARQPAPTVVPARLSRPAAFTAIAAILVTFAAASAVPSPLYVVYQHLWGFSPAMLTVVFAVYVVALIATLLTLGALSDYIGRRPVLAGAILLEAVALTLFLTAGDVGTLLAARVVQGVATGAALSTLGATLIDLNPAHAPGRAGLISGIAPVAGLGIGAFGCGVLVKFAPFPTHLVYALLLAGMVVAALAVAWMPETSGRRPGAAASLIPRLGVPARLRGDLFALIPIIVASWALGGLYLSLGPSVASDSFGIHDHLAGGLVVALVCGTGAVTSFLLRQVATPRVLTIAGSGLLLGGALGFAGLETGSLPLAVIGSIISGAGFGAAALASFSTLARIAEPHERGELLAVALTISYAALSIPAVIAGQTATHIGLHITALWYAAIVAALALLALVAQRLRSRSRA

SEQ ID NO: 10473 - protein, 194 aa, Actinoplanes utahensis
MSVGSPRRSPRQSVRERLLAAADELFYAEGVHTVGIDRVIEQAGVAKASLYTVFGNKDGLVRAYLHGRHEQRRDRIMRHVDQHTDTRGRLLAVFDSLAEAAEVPGFRGCAFYNAGAEADPNGVVREEATANRAWTRQLLTRLAAEADAPDPDALAAQLVVLYDGATVGARQDGPAAAKTARTLAETLLEATLPH

SEQ ID NO: 10474 - protein, 371 aa, Actinoplanes utahensis
MPNSLPPAPTVCGKDARSAHAGATIGEMTATGAPAAATSAAGPPRRWRRGPVVAAVMVIILGTELIIGWPALSGAIGQLRAPHWGWVGAALAAEIVSMGTYARMQRALLRGAGKKVSVRRHVAMAYAAHSLSVTLPGGPVFSTSFNFRQMRRYGVTPAEASWCIALSGVLSTGALILVGSVGGLLARNTGSWRSLAGYALGAIAVTAAVRLLAKHPLWLDRPVRALLGSVNKVRRRPPEHGADRLFGFVTQLRAIRVHPVHFLVAVLLACANWLFDALCLWVCCIAVGADRITPVHLLIAYCAGMAAASVPVIPGGLGVVDAALILGLVAGGLTSASAIAAVVLYRAISFVFIIGAGWLVWLLLRRRARAE

SEQ ID NO: 10475 - protein, 421 aa, Actinoplanes utahensis
MPRPRILIVGAGFAGHAAARRLARIAGGRAEIVLLNPTDYFLYLPLLPEVATGLLEPRRVSVPLARDGVRVVLGHAGSFDLDARTVEWADPEGRRGVLGYHRLVLALGSVNRLLPIPGVTEYAHGFRGLAEALYLRDHLIRQIELAAQSSDPVERRARCTFVVAGAGYTGTEVTAQGALFTAALAASRPLIRDLPRWLILDTADRVLPTLDPRLSHTAADVLRRRGVRVLTGASVQEAGADGVRLSTGEKILTRTLVWCVGVRPEPLVTGLGLATREGRLVVDEFLNVPGRPDVFACGDAAAVPDVLRPGSLTGMTAQHAVRQGRLVAGNIAASYGQGRRRPYRHRDLGFTVDLGGWAAAANPFGVPLSGVVAKAMTRGYHLAAMPGNRVRVTADWALDAALSRQPVQLGMVRGSAVPLRG

SEQ ID NO: 10476 - protein, 514 aa, Actinoplanes utahensis
MGTPDEPSDPDDPAPAHLAAGRLGAGSAAFFGVAAAAPIVTVVTVIPPVLAVGAGPLAALAVVAVAIVLLILGTPYATMIRRRPSAGAVYPQLARGLGRPVAVTGGWLALAGYHAIQFGLYAMLGQAAAPVLHSWFGLTAPWWAVTAAGWALVGWCGMLRIEFAAAVLAVLTVTEAAVLTGLAAANLLRPAGGRIETGTYLPGELSRVGRPLLGVLLVVAVLAFAGFESTAGYAEEARNRHRTAGRAARLAIGLLTVLLAGVTWSMIVTAGPRGVAGRAAARGPELLFALADERVAPWAVTLGRLALVAGLLAAIMAVHHAIARYLFALGREGVLPGVLADLSPRTGAPRAASLTQTLVAGAASTGAYLAGAETSARTARWLTVGGGLAILVLLLLTALAALLHLNREPATEGIWARFLAPLLSTVFLGVLVHLAVLDLPALVGGGPAAGWVLGGLAVCLAIGIGHALVLRSVRPVVYAGIGLGGAALVVTPQTAVQIPKQRDPGAHRPERVNR

SEQ ID NO: 10477 - protein, 779 aa, Actinoplanes utahensis
MAHRLDRVANPQLGGLPADSNHVLATQQLTEFLAVVADRPDEAAAQHAAVECAMRALDADLAVLMVDGGVAAAVGLPVVPAYALAEAAAGRRASLDIDGRVYAVTLAHLGGLAPGVLVLGRETPFSIEEVCLLRGMARVLELSLQALHLIEAERRQAAENDRLINSLQRRQRLFEELSSVQRAIARREPLRRILDQIVASAADLLDVEMAGLTVLDLDDPSRTSLIASQGVPEEGVQRMQSVPVAALGAAGLAIMGDELVAIDDYANSPIAVPEIVRARLKSVAAVPVHEDGVVVGAMFVGSFTAVRHWDRASQEILQAFAEHISLAITDARTLREMSHAFHDSLTGLANRTLFTTRMENALATVGAGGVTALLVDLDRFKVVNDSLGHAAGDRLLAGVADRLRDCLRTGDTAARLGGDEFAVLIPGVVGSEAAVPVARRIVAALREPFDLDGREVFASCSVGVAWAEVGETDADDLLVRADLAMFEAKKLGKDQYAIFEPAMRESFQKHLQMEADLRRAVLRHEFELRFQPIVRLRTEEISGLEALVRWQHPDRGMIPPLEFIPLAEETGLIVPIGEWVLREACRQAARWNTQRSGQAPLTVSVNLSAVQLERADLPQLVAAALADSGLPAKCLIIELTESLLVDHRPETLRRLEEIKELGVRLAIDDFGTGYSSLAYLRKFPVDIIKIDKSFVDDIGDMPAAAALTLGIIQLGQALQLSTVAEGIEHVGQLSELAGGNCELGQGYYFAEPLTAAAMDDLLFPAEAPPASEQTTAHGE

SEQ ID NO: 10478 - protein, 130 aa, Actinoplanes utahensis
MDLDIDRRAVAVVSAGGIIGALTRYAIGTAWPHTPSDFPWSTWVINTSGCFLIGVLFTLLARFRPGHRLTRLFLGTGVLGGYTTFSTAEVDVLRTTPAIAVLYLGATITAALLAVWIGSALASVPKGAGR

SEQ ID NO: 10479 - protein, 118 aa, Actinoplanes utahensis
MTVLLVAIGAAIGAPLRYVTDRYLQVRYGTAFPWGTLTVNVTGSLILGFVLGMPLSPTATALLGTGFCGALTTYSTFSWETLTLTRRGEQASALGYVLLSLLSGMGAATLGTLLARAL

SEQ ID NO: 10480 - protein, 732 aa, Actinoplanes utahensis
MEHRGKVKGIAARAAIWSARHRVLAILGWIAFVAATVVLSGQLGTRQATGAEQGSGDSGRADKIVEAAGFPVQPAGEMVLIQNRSGSDRAAAAAEVTRTLKSLHDVTDVQPAIQSPDGRSTLVSFSITGDPETAKERVGPALDAVAQVQTAHPDLYVAEAGDASGDKLIGDELDAGLSRLSMMSIPVTLGILLVAFGAVVAALLPVGLAVTAVIAAIGLMAAGSRFAHTVDATTHVMLLVGLAVGVDYCLFYIRRERDERRAGADPERALMIAAQTSGRSIWISGLTVIVAMAGMFLTRDTTFISFGLGTILVVATAVLGSLTVLPALLSALGDRVDAIKIPGLYRRRSDGRMWNAMLRVVLARPLISTLVAVGLLGALAAPVVDMRTRGQNILDISPKAPVVQAFQAINEAFPSKTSPAQVVVQASTVRGERFDRAVADFKTAVGRSGGRLVEPIDVRVNPAGTVAVVSVGLVGNGENKASTDALKLLRGQVVPAAFGGLTGATVLVSGDAAGNADFNHQMQKSLPWVFGFVLGLAFVLLLVSFRSVVVAITGVVLNLLSVAAAYGMLVFVFQYGHFDKQLGFLPSDGIINWIPLFLFVILFGLSMDYHVFVLSRIREGHDRGLPTREAIREGVGRTAGVITSAAVVMMAVFALFATLPLTSTKELGVGLAAAVLLDATIVRAVLLPAVMALLGRANWWLPRWLGWLPEIAHDVPPVAETEDEPRALAPVG

SEQ ID NO: 10481 - protein, 214 aa, Actinoplanes utahensis
MRVVIADDAVLLREGLIRLVEENGHTVVAAVGDGPSLVEAVVEHRPDVSIVDVRMPPSHTDEGLRAAVEARSRVPGTPILVLSQYVEVSYADDLLADRRGAVGYLLKDRVSLVADFLDGLRRVAEGGTVLDPEVVGQLLVRRRRDDPLRSLTPREREVLGLMAEGMSNTAVARKMVVTEGAVEKHVRNIFTKLDLHQDEEQHRRVLAVLAYLQT

SEQ ID NO: 10482 - protein, 429 aa, Actinoplanes utahensis
MHSVKDMTSTRRHLRQLGIDTQYVLLGFPLGLITLVLCLTGFFLGLGTAIIWIGLPIMAGSLAMSRGFAHLERLRIGSVLGRRIPHPHYRSSRERGWVRRMFAPLADGQSWLDLVHGAFRFIPSTIAFSFVLVWWCAALTSITYPAYDWAVPHTADNTELPELLGFADNAPTRIIFYLILGAFFTLTLYPVVRGAALLEALFARGLLSGVDELRQQVADANAARDVAQHQKAAAVSAEATALRRLERDIHDGPQQRLVRLAMDLGRAEQQFATDPEAARATVAEALSQTRETLDELRALSRGIAPPILVDRGLQAALTALAGRCTVPVDLDAPVFERLDPAVESTAYFVVAEALTNVAKHSDATEVQVSVQRIATGLLVTVSDDGVGGASLAKGHGLAGLDDRVTAAGGVLAVDSADGEGTRLTAALPL

SEQ ID NO: 10483 - protein, 338 aa, Actinoplanes utahensis
MRAAVFAEPGPASAVLHLVERELPLAGADEVRVRIVLSAVNPTDVGTRAGRGVPDGVRPPRVPNQDGAGVVDALGEGVTDLEPGDRVWVWDAGYGRADGTAQEYVVLPRRQVVRMNDDIPFEVGADLGIPALTAHRCLTVASDGPARLGPGALEGRTVLVAGGAGAVGNAAIQLAKWSGATVLTTVSSKEKGALAAAAGADAVIDYREEDVAARIRELSGTGPHLIVEVDTANLTLDLDVIAPGGNIAIYVAGEVRVPFFTANLKNASLDFVLTYTTLPEEKANAVAAVAEAANAGVFRVGEEHGLPIIRFPLDGVAAAHEAVENHAVGKVVIDVTQP

SEQ ID NO: 10484 - protein, 239 aa, Actinoplanes utahensis
MQHGGGGTGLGENGSTHVLTLCRREALSRSRAPPKQQRKLRFLYAVSMTFSISAVRLSGLSAVPNMSRHVAARPLEVRVYTVLIADDEIDHRDLLALALRRFGYHVVAASDAAEALEALTRGGIDAALIDVRMPGLSGIDLCRRIRCDPALDALPIMVISADVHHRQVTAALHAGADDYLTKPFARDELVARLGDLLRRPGTGTSRSTAASRVALAAARHAVPVAPVIRHQEVHVRHSA

SEQ ID NO: 10485 - protein, 531 aa, Actinoplanes utahensis
MEPAPHGTSAQLSSPVRYGTAAARRVLLATVLGSSLAFIDATVVNLALPELGRGLHASAAGLQWTVNGYALSLASLILVGGSLGDRFGRKRVFLAGVAWFALASLLCGLAPSIELLITARVLQGIGGALLTPGALAILEASFAPDDRARAIGAWSGLGGIGGALGPFLGGWLLQIGSWRLLFLINVPVAALVLWVAHRHVPESRDPAAARGFDIAGLLTGIVGLGGLTYGFTAWPAHGAGSPVVLIPLALGVLGMAAFVLAELRAPHPMVPPEIFRHRAFTGANLVTFLVYAANGGVFFLVVVNLQVVAGYPALAAGLSMLPITVIMLLLSARGGALGQRIGPRIPMTAGPLVCAAALLLMSTIGPHAPYATRVLPAVILFGLGLALLVAPLTATALGALDDAHAGIASGVNNAVARAAGLLAVAVLPLAAGLGSGSLTDAAALHPVYHHAMLLCAALMLAGSLTAFLTVPTRPPTTSSTPSPHSPDSADSTPTPAITAGRTPAIPHRSFCDPASPPIPPRDSHPIPSSPR

SEQ ID NO: 10486 - protein, 345 aa, Actinoplanes utahensis
MARELPKLRAGDRVAVLSPSFASPGLFPERHEQAIRRIRDDLGLEPVEFPTTRRLGASAADRAADLTAAFADPSIRAVFATIGGDDQITVLPHLDPAVFQADPKPFFGFSDNTNLLNWLWSHGIPAYHGGSTMMHLAQGDGIPPIHLASLRAALFTGGDLPITPIDTFSEEEIDWSDPRSLTDPLPTAPGPGWIWHQPTRVLTAPTWGGNLEILHWNLAADRWIRPVADYAGHILLLETSEEMPPAEEVFRILRNFGERGLLHQFPAALFATAKATVFTSPRPHPERQKYRDDQREAVLRAFATYHPTAMLTFGVDFGHTSPQWVLPYGGRLTVNGPARTITAHY

SEQ ID NO: 10487 - protein, 240 aa, Actinoplanes utahensis
MSDLDEHDSLHRLLGGYLLGGLDEADTDRLDAHLHDCAECRAELDRLAPVPEMLQHLPDVRQLGGDLPPLTVAPAARPSPQNIENLLSRMRAERTHKTRMVRTRWLVAASVAVLAAGAIGYGVLVHDNDATTQQSPPLAAATITANFEPTAGGALHGQATLVKKAWGVSVSLNMTGMQGKAPFFCMVKRADGTMEQAAAWGETPEHTAKVDGASSVTATDVRAIVITDSDGKVLGTAPVT

SEQ ID NO: 10488 - protein, 179 aa, Actinoplanes utahensis
MKRRVSSPDEQLMTALYTEHYAILINFVSRYVSDRHKAEDLVQETLLRAWKHIDHLDPEPGRTRSYLLTIARNVVTNAWRAEQRRPRLVSDETAVNSVPSADNVDQMVEGWLVAEAMERLSPEHRAVIQAMYYEGQSVADAARRLSVPEGTVKSRAYYAVRALRAVFEEMGMLRSGGAA

SEQ ID NO: 10489 - protein, 373 aa, Actinoplanes utahensis
MLKSRRGLLAAGLSVAVIGAIGVASTLNAGAEQIPDAAPTASVAAAPADLIPPANLPWGQRPTRVKRGRDGANSRSLQAAGLSVAGPSEGDNGTPDPEYAPKGRSSRSSFLRTAKTSVVPPPEPSADPSAPASASASASASAPASADPSTTPGSTGPTVNFLYNVGAQAAVSDGAYINLTINKPKLAKQDYHTLAELAVQSADGNQIVEIGWNVDRVVNGDDDPHLFVYHWVNRQTSCYNGCGFVQYSKAVVPGDTLAVDQQKKFGIQFYNGGWWVAYDTEWVGYFPAKLWGDVSFTKSGLVQVFGEVAAASDKPCTEMGNGKKSDDTTSARIGSIAYVNGPTADLVVRSTSDFYTVNQLSNRTFRYGGPGSC

SEQ ID NO: 10490 - protein, 156 aa, Actinoplanes utahensis
MPATAVRLDHLAIARQFANAPEGWVVPPRFDPVERWYHRLEVADDHEVWLLTWLPGQQTELHDHGGSAGAFQVFSGVLTEDTVSGPADAPRVTTRDLGEGAGRRFGSHHVHRIVNRGPDPAISIHVYGPALTSMTKYRLSPAGLETRTVERAGAQW

SEQ ID NO: 10491 - protein, 132 aa, Actinoplanes utahensis
MVTAAPPGSRGIAEILDEARTRLTRLDPLETAAAVRDGAVLIDIRPAAQRAEHGEIPGALIIERNVLEWRLDPRSDARLPFADSYDLPVIITCQEGYTSSLAAAALQDLGLHRATDLAGGFRAWQEAGLPTI

SEQ ID NO: 10492 - protein, 236 aa, Actinoplanes utahensis
MKTSPWSPLPDKRPARVQLDREQIIDAALRIVDAEGVEAVSTRRVAAEFGTGPSSLYAHVSNKDELLRLMFDRVCGEIDLPTPDPARWAEQIRQMMCQVHEVLLGHNDLARVALASIPNGPNALRCSEWMIGLLIEGGVSPRTAAWALDRIFLYVTTDAYEISIWVTQLRHLELPQDEVEKQVKGEMAKHFEDLPADRFPYLRTHAAAMTSGTSQERFEFGLDLLIDGLTRSVGKG

SEQ ID NO: 10493 - protein, 556 aa, Actinoplanes utahensis
MSVTTNSVQTEIQATDTPYRYRWIVLFVILAVEVMDLLDSLVTTIAGPVIRSELGGSYSLIQWLGAAYTLSMAIGLLTGGRLGDIYGRRRMFLIGAAGFTLASLACALAPMPGFLLGARAVQGLFGALMLPQGLGMLREMFAPAERAKAFGAFGPVMGLSSVGGPILAGWLVDADYFDSGWRMIFFINLPLGIFAVFGALRFLPESRLDRAPRLDWLGVLFAAGGAFLLLYPLVQGRELGWPAWTFAMLAVGVLAFGLFAVYEARRDKRGLDPLVTPSLFRKRAFTGGLALGLMFFASLIGTSLVFTFYLQIGLGYTPLKAGLTTLPQALGMVAGFIVAGAGLAEKLGRKLLQLGTIVMVIGTGVFAATIHWAGSGITPWHLIPALLLLGIGMGLAMAPFFGIVLAGVDDEESGSASGAITSVQQLGGAFGIAVLGTIFFALLPGAVGHHVDTSADRLRATLSTAGVPADAQPAVIAGLRTCLTDRVAETNPDVVPPSCHSDAAGPDLSQYVGEQVRAGFEDTTVRTSAVTLILLLAAFGLTFLMPLQGRPEGEGH

SEQ ID NO: 10494 - protein, 181 aa, Actinoplanes utahensis
MRHVKAMLALAALALTAGGCGRETVRTAASPSPGATWHLLTTGSPTPSPTPSRLTARPSAPGLGASVSPFPSCTKTFTATEAVLIPVDVTPIAGGFKVEWPRQYGSNYRVTAVPQKLVLGAQPEPSWKNVPPGTGCTVSTTITGLVPGAAYIVWLDAPNTGYERDGTRHLYSGRSGVVYPR

SEQ ID NO: 10495 - protein, 409 aa, Actinoplanes utahensis
MAVDRGGSDLHPALLLQGALADRDPLCGVPRPLCGRAAVLAAGGDRVRFRHGLIVGKFYPPHAGHHALIEAAAAACDRVTVVVAPSSRESIPLAVRLEWLRAAHGPDVRFAGVYDDHPIDYADPAVWDLHMVVFRDAVGAEPVDAVFSSEAYGAELARRFGAVAVPVDPDRRRVPISGSAIRADPIAHWAHLGPGPRAWLARRVIVVGAESTGTTTTARALARHYRTRGGVWASTGWVPEFGRELTGRKLAALRRVRPEATVFDVTWDRDDFITVAVEQAAAEDAVAAAGSPVVFGDTDAFATTIWEERYLGSTSAKVGELVRDPDLYLLTDDAGVPFEDDGLRDGEHLRRWMTGRFRAELAARDVPWIELTGGYRERLTTAIRAVDRLLAAGWRFAPPLSPAGQAAEG

SEQ ID NO: 10496 - protein, 119 aa, Actinoplanes utahensis
MHPAPRVDTTVLDAAALLAIAMGRASETGLGVRSHPPRVVTGAAVAGAWRSPDGTVKLQLRTDGTYHGEVAGRRNRPSGTYRVEGAALVLHDDTSGLNTAVHVRHEGELEMAGHRLLPE

SEQ ID NO: 10497 - protein, 201 aa, Actinoplanes utahensis
MATVKRAPAGAAVLRNDITVAIRNAVMSELAEVGYGRLSIEAVARRAGVGKTAIYRRWSNKLEMVLEIITDVAGRKVPVPDTGSFASDLDLLMMIVSRALQHRVASQIIPDLMAEAARNPQIAETLQRVLRLHQQSVGDKLVGQAVARGELPEGTDADVAVDLILGPLYWRLAVSRQPIDDAYLEKLAAAVLGSLRGGSAT

SEQ ID NO: 10498 - protein, 300 aa, Actinoplanes utahensis
MPETAVADAATGIPLKELARRHGLSSSGRLLGPLEYARQVWGYRYFITAHAKAKTVSTLGTTNLGTLWQVLTPAINALVYYVIFGVIIGTGANNPNFIPYLCIGVFVFGFTQSTVSQGVNSITGNLGLIRALHFPRASLPLSAALVEIRNFITATGVLLIIVLLCHEPITVQWLLIFPVMLLQSLFNFGLAMGGARLGSTFRDIKQLVPFIMRFWMYGSAVLYPVTRFTHAHALQGWKLHLIEANPMLVFVELYRHSLMEGQELVGTPKMLWIEGVIWAVVVGTAGFLYFWRGEKGYGRG

SEQ ID NO: 10499 - protein, 256 aa, Actinoplanes utahensis
MADERIPTVIADDAHIVYKIVGAIGANQVSPVSALKRLVTKTNSANVREVHAVKGVSFVAYKGEAVGLIGSNGSGKSTLLRAVAGLLPVHRGAIYAAGQPSLLGVNAALMNDLSGERNVELGCLAMGMTPAEVKERKKEIIDFSGINERGDFASLPMRTYSSGMGARLRFSIAAAKQHDVLLIDEALATGDAKFRRRSEARVRELRAQAGTVFLVSHSEQSIRDTCERVIWLESGLIRADGPTEDVLKEYETYMKK

SEQ ID NO: 10500 - protein, 345 aa, Actinoplanes utahensis
MQDVTARRRWAAVLALLVAACGIAGVTTPAAAAPRPLAAPGESGDDGEGGSKSLLDKLDEASKGYVTASAKLKQSRAEQTKLAAELKQLDADMGPRQAALNRYAAQAYTMGRLGPLSALLTANTSAGFLDRAQMLGTVAAKQTLALDELKATRAGRQQAKAAIDQAVTDQAKLTKVMAARKTQAEQALKNANQGGDSGGDNSGGGSSSNADKPGGSLAGGCTVDDPTTTGCITPRLLFAMKQAQKAGFTHYVACFRHQNSGEHPKGRACDFAADKGGFGGVATGSSKTYGTDLANYFIHNSDTLGVLYVIWFKRIWLPSSGWKAYSGVGGTPSTDHTNHVHLSVI

SEQ ID NO: 10501 - protein, 345 aa, Actinoplanes utahensis
MTARPRRWLMLALAPLVATTIFVAPVTPAHAAPSGSSSTTPSEGDDGDDLSDQIEATNRRYVNAKLAVEASQKKQKDLATQISAAEKRRDALIPEVNAIARQQYQIGQLTTVGFLLRADSSSDFLHKAIGLEEINKLNDDKLKDLNTTLATITNSKSALDAELKNEQQQLSIQQKQHDTAESQLDLLGGGTGINKTITAGFVDATSKVAAPAPRNSSGGFSPESCTVDDPTTSGCITKRTLHLYQEVKKAGFNRFVGCHRDGGPFEHPKGRACDWSLQKSGFSVAHNSDMMRYGNDLTAFLVRNADRLGIYYVIWYKQIWFPATNNWHAYHGPSDHTDHVHVSLL

SEQ ID NO: 10502 - protein, 767 aa, Actinoplanes utahensis
MIRERAYPVDPWHIRETRLDLDLLAQSESVFALSNGHIGIRGNLDEGEPHGLPGTYLNSFFELRPMPHAEAGYGFPESGQTMVNVTNAKLMRLLVDDEPFDVRYGELRSHERVLDMRAGTLERVVEWVSPSGQGVRVRTVRLVSFTQRAVVAFLYEVEPLDGAARLILQSELVANEQLPPQSKDPRVAAVLEQPLQAEEMLEQRSGGLLVHHTKVSDLRMAAAMEHLVETPGRHAITTEGHDDWLRTTVACRLEPGQKLRVVKLAAYGWSSMRSLPALRDQVGAALASARLDGWEGLVQQQREFLDGFWDHSDVRVEGDPEVQQAVRFGLFHTLQAGARAEQRPIGSKGLTGPGYDGHTFWDAETFVLPALTYTQPSAAADVLRWRHSTLDLARERAQTLGLQGAAFPWRTIRGQECSGYWPAGTAGFHIGADIADAVRRYVQATGDYDFEREVGLELLVETARLWRSLGHHDRHGRFHIDGVTGPDEYTAVVNDNIYTNLMAQQNLMAAVDACKRHPDLARRFGVDDEEAASWRDAAAAVHIPYDRELGVHQQCEGFTRLQEWDFENTPPEGYPLLLNYPYFDLYRKQVVKQADLVMAMYIRGDAFTPEEKARNFAYYDARTVRDSSLSACIQAVMAAETGHLELAHDYLGEAALMDLHDLHQNARDGVHVASLAGSWIALVAGLGGMRDFNGQLSFAPRLPSRINNLEFSLLWRGLRLRVNVTASEVTYSLRNGGGSARLTLLHHGKEIEVTQVRPVTMAIPAPG

SEQ ID NO: 10503 - protein, 256 aa, Actinoplanes utahensis
MCGGCDYIGRVLGLPSQVTACLFDLDGVLTQTALVHSAAWKQTFDTFLESWARQHDQEFVPFDSGADYHRYVDGRQRADGVRTFLASRGITLPEGTPDDDPDQETVNGVGNRKNILVLQKIKEGAVQVYPGSVEYLKAAKAAGLRRAVVSASANCKDVLEAAGIADLLEARVDGVVARELGLPGKPAPDTFLHGAKLLGLDPAACAVFEDAQAGVAAGRAGRFGLVIGVDRVGQAEALRENGADVVVDDLADLLDQ

SEQ ID NO: 10504 - protein, 173 aa, Actinoplanes utahensis
MPPATERPQRVGCSTVEDRIGQTVRSAPGGEPRVDAARPRPVSPVLLDRAFGHADITLLRHEVTRLLPAVGVSGDRLSGYVLAINEVITNVVLHAGGHGRIVLRLEAGSVWCVVTDSGPGIPEGCLDGDLLPGTDEIGGRGLWLAHQLCDEVTTATGPIGTSIGLRMDLVTAS

SEQ ID NO: 10505 - protein, 431 aa, Actinoplanes utahensis
MSTVALKDVSKVWPDGTLAVDRVSLDVRDGEFMVLLGPSGCGKSTVLRMIAGLEDPTEGDILLNGEPVLDVPPRDRSIAMVFQDFALYPHMTVADNIGFPLKLSGVEPGSRSDRVGTVAGALGIGEVLGRRPSQLSGGQRQRVAMGRAMVRRPGIFLMDEPLSNLDSGLRAELRAEITSMTRELGVTTMYVTHDQAEALTMADRVAIMRRGVLQDLGTPTEVYRRPATLYVAAFLGSPRMNLLEAQVYVHLDRFVALNFGEQTLYLGWTDPRSRAVARYHGERIVVGVRAEALTPVTPDTPGTVLHGRIRYLEHHGHESLAYLDVGATAIVVDEVGGPVRGPATGGGALKRLGGALQRLTRSAPEEASESPVAPVSVLNDPGRHHRKPAELSVRLAPYPAVTPGHPLTVAVQMDAVHFFDERGDRIDVGWR

SEQ ID NO: 10506 - protein, 89 aa, Actinoplanes utahensis
MARYLTSKWSRAKPPRPPLKEWMTVTRPLASHSLTRPRDNRMIGGVCAGLARRFGLSTGVVRLAFVLSCLLPGPQFIAYLVLWALMPSE

SEQ ID NO: 10507 - protein, 247 aa, Actinoplanes utahensis
MANSPDVEEPTTEYPAVPEEAEPGAPAVPQEHRPSFFARLLIFIGVVFALIVASCFGLRALHVLPSFDNPFADKTTDRSQPVLLQSMRDLHRYVAADGTFQVIVDLQQNKDNIPDFLVNRRILFVGSGTVETYVDFSALSGDALKVDNEKKTIELTLPPPQQSQAALDMQKSYVVEEDRGLLTSIGDAFHSDTDKQQRVYAAAQQKITEAAKSSGLDQRAQQNTQAMLESLFTRLGYTSVKVTFTNP

SEQ ID NO: 10508 - protein, 391 aa, Actinoplanes utahensis
MVARPLDLLDLDDLLTDDDRAARALARQVANDHIRPGVAQWYENGDPPIRDLAVEFGKAGLFGMHLTGYGLPGATTISYGVACMELEAADSGIRSLVSVQGSLVMYAIWRYGSDDQKDRWLPALAAGRTIGCFGLAEPDHGSDPTGMSTRARRDGDDWILDGVKTWILNAPIADVAVIWARAEKGVAGFVVPTDTPGLTTRAFRHTMSLRAASVGELALDGVRLPDSARLPAARSLMAPLSCLTEARLSIIFGVLGAARDCLDVTLDYAAGREQFGRPISAFQLTQAKLADMALELQKGFLLAVHLGRMRDAGGAPLRPEQVSIGKLNNVREALKIARECRTILGGNGIRGEMPVMRHAGNLESVLTYEGTSEIHQLSIGQKLTGLNAFSH

SEQ ID NO: 10509 - protein, 98 aa, Actinoplanes utahensis
MIFKAVRDGAPYPDHHTTLKAWAEIPPRPIRLADLITTKRELALDKLLAEDSTFYGDLFPHVVEYQGALYLEDGLHRALRAALQQRNQIHARVLVVEG

SEQ ID NO: 10510 - protein, 207 aa, Actinoplanes utahensis
MEFDEVIRRRRMIRGYDVSRPVPPELIDKIVRHGLRAPSAGFAQGWSFLVLSSPDDCDRFWSATTVEQHTDAWLARMRTAPLIIIALSNKSVYLDRYAESDKGWADRDESRWSVPYWDIDTGFAALLMHLTAVNEELASCFIGLPAAKVADFRAAFGVPDEFTPVGALTVGYPGDDKRSPSLRRGHRPVDEVVHHGRWAAGGGSGRG

SEQ ID NO: 10511 - protein, 305 aa, Actinoplanes utahensis
MTETAAKSGVQWSIEADGRRAVLAEVGGTLRSFSSGGVELLDGFSVDEISPGSAGQILAPWPNRIRDGRYTFGEQTYQLALTEPARHNAIHGLVNWARWRATEHTASAVTLEYDLPAQVGYPWPLTLRTRWSVSAEGLRCAQEVVNTGDAAAPWGYSVHPYLRLPGVSVEDTVLTVPARTRILADNRLLPLGAVKVAGTEFDYAEPRRIGTAILDTTFGDIDFGPDGLTEVVLADPSSDAKIVVWADEKFKYWQVFSGDTLHGERHRRSVAVEPMTCPPDAFRSGRDLVTLAPGETWTTAWGIRA

SEQ ID NO: 10512 - protein, 430 aa, Actinoplanes utahensis
MSVVEEKSKRSWMIDTTPLRVTSFRRMWVGNGASFFGFQFTAVAVPVQMFAITHSSFWVGLLGVAGLVPLLIFGLWGGAIADVVDRRRLLLTSSALTWVVTLGLLAQAIAGVRSEHLLLALTAVQSIGFAISSPARQSIIPRIVPAEMVPAANTLNYTTTTAGGVLGPLAAGLIMGIWSTGTGVAVAYAVDALLFTVTFWATWRLPAIPPIEPDDAGEKPTAGLRGIVAGLRFLVTQPVLLLSFGIDLIAMVFAMPRALFPAVAETRFGDSSAVGWLFSAIAIGSVLAGFTSGWISRVRRQGVALTAAVVGWGIAIALSGLAHQLWLAVLLLAVAGAADLVSAVYRQTIMQTFAPDRLRGRLQGVFTVVVAGGPRLGDLRAGATAQFTSVTTSWVAGGVLAAVLAVGLALAFPALLRYRPVPDPVADPER

SEQ ID NO: 10513 - protein, 224 aa, Actinoplanes utahensis
MSADPPSPAGMRRDYTEHPPLLEGSLAGHWSDQFAAWFADATAAGLPEPNAMIVATADAQGRPSARTVLLKGYDSTGFVFFTNYESRKGSDVRHNPYTSVVFPWFAMQRQVIVTGAVERVSRAETEEYFASRPRGSQLGAWASPQSRVLPGPEAIDARLAEVIERFGDGPVPPPPHWGGLRVLPETVEFWQGRSSRLHDRLRYRAVGENRSAVERDWIVERLAP

SEQ ID NO: 10514 - protein, 381 aa, Actinoplanes utahensis
MNHSPQPRLPGSAVSDFKPGLEGVIAFETEIAEPDRDGGALRYRGVDIEDLIGQVSFGNVWGLLVDGRFGPGLPPAEPFPVPVHSGDIRVDVQSAVAMLAPYWGLDQLLDITDERARRDLARVSVTALSFVAQAARGLGLPAVPQKDIDKAETIVERFMRRWRGEPDPRHVKAVDAYFISAAEHGLNASTFTTRIVASTGADVAACISSGIGALSGPLHGGAPTRVLHMLEAVERSGDAEGYVKDVLDRGDRLMGFGHRVYRAEDPRARVLRRIAKELGAPRFEVAAALEAAALTELRERKPKCELWTNVDFWSAVVLDFAEVPVHMFTSMFTCARVAGWSAHILEQKKLGRILRPGLRYVGPEPRRPSEVEGWSQLTHNV

SEQ ID NO: 10515 - protein, 374 aa, Actinoplanes utahensis
MIVADIRIPDTIKPVDGRFGSGPSKVRPEGVEALSAVSRTFMGTSHRQRTVKDQVARLRRGLAEFFSMPEGYEVVLANGGTSAFWEIATFGLVRDRAQFAEFGEFGAKFVQAVTDAPFLAQPTVHRAPGGQAAFLTAEAGVDVYATVQNETSTGVSVPVRRVAGADPGALLLTDATSGGGSLDVDLRETDVYYLAPQKALGSDGGLWLALMSPAAIERAFEIKASKRYIPQFLDLVTAIEQSRLDQTYNTPALATVFLAAEQLDWMNAQGGLSWAVKRSAESAAAIYGWADRSSYAEPFVTDPALRSAAVATIDFTDGVDAATIAKVLRANDIVDTEPYRKLGRNQLRIALYPTVDPTDVTALTSCIDYVVERL

SEQ ID NO: 10516 - protein, 228 aa, Actinoplanes utahensis
MRPVRFVALSEDGQALVLADEVGRLLALPLDDRVAGVLTDSPAPPSTAVAVLAPDVQASLSPRDIQARIRSGESAEDVARVAGVPVDRVLRYAGPVLQERAMLAQHARRTRLKTSDSGQPLAEVVDSRLAQHGIDTEKISWDAFRREDGTWRIVATWPSGKATAQAIWDLDKGRQVVSPHDDMAQYLCAERPTQILGQDPVPERGGHGLPGPARSAEPTRGGHGLPPS

SEQ ID NO: 10517 - protein, 329 aa, Actinoplanes utahensis
MSCSAAAPRPASPPDPVARPRPSARPPAPSRITPRGRPAASRITPAAAPHLPHHLPAAASPSLPLSPAPHRPTPWRRRSTDSPGRHRSIAFPNAVALLFLPAALPLPLVSVALLFLPAAPPVTVALLFLPPLCHVSLWPTPRRPDVTRRSATRSRFALTRLFVAVFPPPPARDDLLRRLPPDARYTRPSKWHVTLAFLGDVEDHRVPDVAAALTTVPPRPAFSLHAAGGGRFGPVIWAGLAGDVRPLADLRESVRDALAAAGFAIDPRPFRPHLTISYRSAPGLLAALTGYAGPAWQVSELALVESRLGNYHCLQWFPVSGDQHGPAPT

SEQ ID NO: 10518 - protein, 97 aa, Actinoplanes utahensis
MAGARDQPVLPAGAGDQPVLRACPGRDWLTSRVLWGDQPVLQACPGRDGLTSRVLPACPGGRRFRPCGAQPLPAAGIGGSDGAWAGVMSGRGRAGRR

SEQ ID NO: 10519 - protein, 180 aa, Actinoplanes utahensis
MAQLVVISAAWMTLLIVPCARILLRRPAKRRPETSGHLPRRRSSFRRVPAPGRVPRKGAPAYWARRPGPQTRDLRRLDRELPGIDLTGRLESLPPVPIEQLAYDLRRLDRQRRSGVLRSSEACLAAILRAYDARLLLACRALGVAEHLQPLQGVDRECERLRVEDRLEAAGLVLRDHQDN

SEQ ID NO: 10520 - protein, 465 aa, Actinoplanes utahensis
MRAVLDTTFRSLRVRNYRLFAVGQLIKLIGVWTMFTAQDWLVLDLSHNSPSALGVVTALQFVPVMLLTLYSGRLADRYDKRKLLIVANTAFAVTAVSFAVIVASGIVQLWHVFLFALLFGIANSVETPVRQAFVSELVELPLLPNALALSAATFNSARIGGPAMAGVLLSVLSIRVVFLIATVLVIAPIFTYTRMNRAELLGIERKARGGARVLDGLTYVGKRPDLLLTICLMAVIGMIGFNFPVTLAALAKINFHAGASSFGLLTTALAVGALGGALAGSGRRTRPGMYRVIGAALAFGVFEFAVGFAPTFLVAMVLLVPTGFFSIYLAQAANHRVQMGVDAEYRGRVMSLYVLVFLGTTPIGASLAGWWGSHFGVPSSIWVGGLVSFLASGVALAWQLRAGGERIEVRLRPRPRLRLIPAPATPPAVPAEAAPLAEADLPEVPPMAVRRGHRPGRAPEPAGHV

SEQ ID NO: 10521 - protein, 143 aa, Actinoplanes utahensis
MTTERTAASLAKTLREAIIRFSRRVRQARPVGDLTFSQLSALTSLQLHGALTPRELADVERVQPPTMTKIVGKLEDRGLVARTPHPTDGRQVILAATDEGRAVYTQNEDIRNEWLAGQLDRLTPEERDTLARAAEIMLRVARG

SEQ ID NO: 10522 - protein, 480 aa, Actinoplanes utahensis
MSTTAETTARSGFDRFFEITKRGSTLSREIRGGFVTFFTMAYIVVLNPLILAGGTDKAGAHLPLAALAAGTALVAGVMTILMGVVARFPLALAAGLGVNALVAYEIAPQMTWADAMGLVVIEGLLIGLLVLTGLRTMVFRAVPTQLKTAIGVGIGLFLMIIGLVDSGFVHRVPDVANTTVPVEMGLGGKLLTWPTLVFAIGLIFTLILFVRKVRGAILIGILGSTVLAIVVEALAHVGSVVQNPHGWSLNVPKMPAQVVSTPDLSLLGHFNVLGSWRHGGWLVALMFVFTLLVADFFDTMGTMVAVGQEGELLDDEGMPPRTREILLVDSLAAAAGGAASVSSNTSFVESASGVGEGARTGVANLVTGGLFLLAMFFAPLVQVVPFEAASTALVVVGFLMMTAVRQIDWTDWSIAVPAFLTITIMPFTYSISNGIGAGILSYVVLKAATGRAREVHPILYGVAVLFVLYFARGPLENWIL

SEQ ID NO: 10523 - protein, 92 aa, Actinoplanes utahensis
MSDLSPGLSVVTGSKPRPEPLDPPMVPFALAGLAAFAVAALICLLAGAPDRWLHTSVAGFLVGIPGLITMIVHDRNRKRRRALSHAEFREIS

SEQ ID NO: 10524 - protein, 581 aa, Actinoplanes utahensis
MSRSITARRRGQSGSTNHSQIRANTAAARVVTPSTSAHCRSLVFQAYRPDSAIVARAAASGSSARISASSSSIRVVIDVGGIATKSGRYFVAEISRTRPAANGSSASHPASARAWAPGRPPSCSRRRTTSRLNVSASGESANRLARSASGPRRICVMARPCGNRRRNANPRPYGMTMLAVTSDLSAAPVRRLLSGRFGWFLAGRAVDIFGTSMTTVALSLGVLQASGRATDLGVVLATSMVPTLVLLLAGGVLADRTSRRGLLIAANAVSAAAVGGIAVVLITGRYHLGTVAGLSLVSGAATAFASPALRGIVPELVDDADLQRANALLSGTRNGTRIIAPAVAGLLTVTAGGGWALAADAASCLVAAALFLRLPPGSRTAATAPGLGADFATGWRVFRSMRWVMLTSFSYALVNAFAVGPWNVLGPTIVAAHGGAFGWGAVLSVRAAGLLATSLVAVKLVFRRPLRTGLLLGVTSASPLLALGLSGEAWTVAGAAFVGGIGFTIAGVTWDTALQTRVPREALSRVSSFDDLFSFIAIPLSQVAMGPLAAAAGAGRVVVVCGVAYVGACLLPFLSPEIRRG

SEQ ID NO: 10525 - protein, 273 aa, Actinoplanes utahensis
MTSRTVARAARLDQVCADAVGVARGAITDVDPTDIGEHLEAIAEGDRVVTHFFESHLAGYRGWRWAVTVTRVPRSRHVTICETVLLPGPDALMAPGWVPWNERVQPGDLGVGDLMPTAPDDDRLTPGYVLSDDAAVEEVSWELGLGRSRVMSKDGRMETAQRWYDGDAGPEAPISTAAPRNARCGTCGFYLPLAGTLRQMFGVCGNLYAPDDGRAVSADHGCGAHSEALLAGTEQPVDELPTIYDDSEVEAVAVSRGHGSVESGEPAEDFGHS

SEQ ID NO: 10526 - protein, 660 aa, Actinoplanes utahensis
MPLLPTLGRTVGTGVKAVRVVVRGCVRGTAWATRRVGTIRARGAAGEIGMIRLFDLHAVSCAGDALIAIGLAGTIFSVPLGEARGKVALYLLITMVPFALLAPVVGPLLDHFRHGRRYALAVTMLGRAFLAYVMSDHLAGWALYPAAFGVLALSRAYGVARSAAVPRLLPDGVGLSQVGARASVYGTFAGAVVAPIGLLAFRFGPQWPMRVATLIFIVGMVIALRLPPRADSDPPEAMPRAWRTLLGLGRGPDRPLSGRLILATLVGSAGLRLLYGYLLLFLTFAIMAGDVGTGILGLTVGNGTAVGIVGGALALGTFLSTAAGTGLHIRRPLALQAGGLMVTAGAAVLAAVVANLATITLLALLAATFSGIAKLAVDATIQERVPERLRATAFAHSETVLMLAWVTGGGLGLIPLTGRLGIALAALLASLAAARAGWSAARLRGERLSGRSGFAEDNPGDPVAVSGDGRFAGTPEAPTTAPIPPAPRPSATHPDRPAGRLDDEAVFDEAADPWPDAPTVPDQAGHNPPVQRRTTRPGPPDVDTRPSATGPGTRDHDTRQSTTGPGARDHDVPAGPRAEHPLDTTLVDEPGHRRWWSRRRPAKKPTTPPPASPGVPEPTQQFPTEAPPGPSPAPPGYHVYRPSSAGPSTGNGDSESSDNA

SEQ ID NO: 10527 - protein, 332 aa, Actinoplanes utahensis
MVPPQAREEADHPAARLPGRSGADAAVPDRGPARPVPGTARLSRLPALLGRPVHRERRLRKQRQRVNPLLLVTAVPAEADALRAALGPAATAAGHTTTAAGPGSTAAGHTTTADPGSTDAAHSTADPHAMPDPAAVPGRGGGADPHSLAVVVEAVGVGPAAAAAGTARLLARRPYRAVISVGIAGGFPGRAAVGDTVLAARTIAADLGAESPSGFLPIEELGFGSSTLTIDAELLQSLRAALPHAITGDILTLSTVTGTAATTARLATRFPQAVAEAMEGYGVAIAAAAAAVPFAELRTISNPIGPRDRAAWRLADAFAALRAAAPALLTLP

SEQ ID NO: 10528 - protein, 391 aa, Actinoplanes utahensis
MDEMSAAARARLIGAGYAAQGLGYAAIVTALPAFKDRQHLTDGKVSAILLFVCVTAALGSVVADQLAARWGSRHALAGGLFLVGAGLAATLVGTPTVLFVTILLLYGVGLGIVDASLSMQGVLVQARLGRSVMSRLFAAYTAAAIVAALLMSWSLDRHHGATVPLGAAAGYAVLVGLAGWRAFEPGRTERSSAVHDTGSRAVRRVVVVCGMLIFTAFLVDSAVSTWSSVYLKDSLHSRAAMVPIGYAAYQATVLVSRLVADHLVPRAGRLTMAVGALAVSGVGCALVVLLPSTAAAIAGFTVAGIGVGVLVPLAFSAAGEAAAESSDEVIARVNLFNYGGALVGAVLLGALSEPIGLRIAFLIPVAGVIFTVPLARQLLHLTPAPAPRPAP

SEQ ID NO: 10529 - protein, 189 aa, Actinoplanes utahensis
MFAATWRVVRARGVDGTTTRAIADEAGCSLSVLAHFLGGKDDILVAAQRAVYDRIVERAFRIGGDLLGLAALRTALDAVLPIDEERAADAHVNVAFAGAALSHPLLAESRRGSHRVIRMHLRTCLREARELRELRAGVEDEAVIDDFIILVEGSTLLSLVDGWAEEGRAERLTRLADAFVNQLRSPGRG

SEQ ID NO: 10530 - protein, 447 aa, Actinoplanes utahensis
MRFPPGFRFGMATSAYQIEGAADAGGKAPSIWDTFTAQPGRVRHGEDGRVAIDHYHRYAEDVGHIADAGVHDYRFSISWTRALADPGFYDRLVDELLAAGVRPVPTLYHWDLPQDLEDRGGWLTRDTAHRLADYAGTVALRLGDRVRHWITMNEMSVQTLYGYGLTSHAPGRGLGLEALPVAHHQLLAHGLAVQVLRAHDAGAVGIANQHFPVYAASDDPADAVAADMFRDLTNWTFSDPILLGDYPDEMIRAGVGVEETQLDRDLALIGAPLDFYGVNFYEPTAIEAPREGKDYSGILEVDIPEGMPFSPVPVKSDERTDFGWAIVPAALTEILVTLKERYPLLPPVIVTENGASFHDGPPGEDGRVGDPRRIAYLQAHLEAVAAAIEAGAPVQGYYVWSAFDNFEWAAGYDERFGLVYVDRETQARTRKDSWYWYRDLIRSAAAG

SEQ ID NO: 10531 - protein, 392 aa, Actinoplanes utahensis
MTITEVPVRTRWMVAYALAMIGVAAGWFGPIQILLPEQAARLAEATGGGKEALLALVTAVGAAASLVANPIWGAVSDRMGSRRPIFVAGTVIGVAGLLVLAAADTRTTMIVGWVLVQVGLNGPLAALAAMIGDRVPERQRGTVGALFGVAQIVGVVLGTALAVASGGYLAVAVAVPALGAALLLIHREPVLVPDRTAVRWSALLRPGAPFAWAWLIRFLLNLVNALVLVYLFYYLSDRVGVGDAATWVLILTVVNVVFAGIFGFAGGVLSDRWERRRIFVAAAAVILAAGTVLLALIPVVAVAILASVLVGAGWGAYVAVDMAVITHVLPDAETRATMLGVANIAGTLPQLLAPVIAAPIVTRLGGYPTLYLFTAAVALLALACLPRLEALS

SEQ ID NO: 10532 - protein, 675 aa, Actinoplanes utahensis
MRRRLLAGVLVLGLTGGLSAPAEAAVTWTPANDLEGACVTLQAFNGSTPLGYVFKDSVGYGFTGTAAKAEPFRFEATQLGRYVLRDHTGAPPYQSMLGWVWAGDSYGDRADWTVSSATGRYRLVSTATGQQMGRYLGGLGAGSATMALTPATGCAAIPDIATGVGGTPGPSVGADGKLVGWIDAHAHITAGEAFGGSLHCGDAYAAGGAPVALAGCPSHATLGWGALLEAIIAGTDPINSSEQGWPSFTDWPQHDTELHEASYFRSLERAWQSGQRVLNVLLVANRVICELTPVHTSCDEMDQIRAQSTYLRRMQDYIDARSGGPGKGWFRLATTPAEVRAIAAQGRLAVTIGVENSEIFGCREIRDVPQCTTADIDRGLDELQGMGVSGFYPVHKFDNAFGGTRFDSGLTGAAINVGQLLSSGHWWQATSCTGPSDNDQPLVSDDLAKLLSLGVGLPAGTILPVYPSGKICNTRGLTTIGRYLIQKMIDRGLIIHIDHMSVKTANDVLDMAVQAGYPGVTSVHSWADRALVDRVLQAGGFVAGYAFAATDDGQGTGTFLDEWRANNALPNGNRIVGYGVGTDVNGLGTQAAPRLTAGAGPLTYPFAGLNGTTINRQVWGTRTFDLNTDGVAQYGLYADWITDLVQQAGPDRAKLRAQLMQGAEAYVEMWEKARP

SEQ ID NO: 10533 - protein, 273 aa, Actinoplanes utahensis
MNAVALSLAVSPCPNDTFVFHALIHGLVPGAPAVDLTFADVDVTNTAAEQGAFDLVKVSYAALPWLLGDYELLPCGGALGRGCGPLVLTRDGRTDLTGATVAVPGDRTTAYLLMRLWSAEHPPARIEVVPFHQIMPGVAAGTWDAGLVIHEARFTYQRYGLTALADLGEWWESDTGLPIPLGAILAKRGVVDPAAATGWIRDSLRQGWLDPAASQDFILANAQEMEPAVVRQHIELYVNEFTLDLGKDGLAAADALLGRAAAAGLTPAVPSFL

SEQ ID NO: 10534 - protein, 132 aa, Actinoplanes utahensis
MPTGRVKWYDATKGFGFVTSDEGGDVFLPKGALPAGVADLKTGQRIEFGVVDSRKGAQALGVKLLDAPPSLALRDAEARRRPAEETASMIEDMIKVLENTVQPVLQRGRYPDKKTAAKIAQLMHAVAREFEL

SEQ ID NO: 10535 - protein, 71 aa, Actinoplanes utahensis
MTGPGVAGPLSGGGRNVASKAKKQESPALKGHLQVSELVSDRAAAPSPFGDDQSFPLPLERLRSLPESQTH

SEQ ID NO: 10536 - protein, 666 aa, Actinoplanes utahensis
MATTFADQLRSLPDEALGALLQLRPDLVVPVPADISALAVRAQSRGSVARCLDGLDEFTLTILDAARVTRSADTALTSVDAIVELASGVAADDVRVAVDRLRVRFLLHGPPEALQVVAAVDEVTSPYPAGLGRPADYLDAHAAALVADRARMRRTVLAAPPGARAVLDRLAAGPPVGSLARDAVAEPIRWLVDQHILVPISEAGRAPRPDGDLVELPREVGLLLRRESGPLGPLRPFPPLPQAPVRDAKAVDSAGAGQTMEAVRAVEAVLEALAAEPAPVLKTGGLGVRDLKRLARVAGVDEAGAALLVEVAYAAGLLGESETSAHRVPGAVQDIFLPTGAYDLWRAAGMAHRWATLARAWLLMTRQPGLVGRRDERDRPINALAPDAERAGAPQARREALDALADLEPGAAPAVDDLLALLAWQAPRRARGRELGHRDGCAGAALLGVTGLGALTSYGRLLISAPELTESDPLGLHPEETPADAVRALDVLLPAPVDHVLVQADLTVVVPGPPEPELAAELDVIAEPESVGGASVFRVTPASVRRALDVGYTAADLHAVFRRRSRTPVPQTLEYLIDDAARRHGGLRSGSAGSYLRSDDEALIAEVLADRRVTGLDLRRIAPTVLVSPRPVARLLGALREAGFAPVAEDAGGAAVLTRPKARLAS

SEQ ID NO: 10537 - protein, 107 aa, Actinoplanes utahensis
MVEQLRRGDIATRAARRAPVTVRAAQGQAVPGLTAVQQHSQAMAVLQQAVRDRAKVWVGYVDSHGATLSRLVRPVSLSAGYLRAEDERGENTHTFALHRITAAVTEE

SEQ ID NO: 10538 - protein, 548 aa, Actinoplanes utahensis
MNGGPLIVQSDKTLLLEVDHPDAQACRMAIAPFAELERSPEHVHTYRLTPLGLWNSRAAGHDAESVVDALITYSRYPVPHALLVDVAETMDRYGRLQLLNDPVHGLVLRGLDRIVLLEVSKSKKLAGMLGARLDDETIAVHASERGRLKQALLKLGWPAEDLAGYVDGEAHPIELRQDGWTLRSYQQEAVDGFWAGGSGVVVLPCGAGKTLVGAAAMATAKATTLILVTNTVAGRQWKRELIARTTLTEEEIGEYSGERKEIRPVTIATYQVLTARRGGNFTHLDLFGARDWGLVVYDEVHLLPAPIFRFTADLQARRRLGLTATLVREDGREGDVFSLIGPKRYDAPWKDIEAQGWIAPAECVEVRVTLTEQERMAYAVTDAEERYKAAATARTKLPVVKALVARHPQEQVLVIGGFLDQLHTLGEYLDAPIVEGSTSNKERERLFDAFRSGELRTLVLSKVGNFSIDLPEAAVAIQVSGTFGSRQEEAQRLGRVLRPKGDGRQAHFYSVVSRDTIDTEYAAHRQRFLAEQGYAYTIVDADDVLQVD

SEQ ID NO: 10539 - protein, 167 aa, Actinoplanes utahensis
MKPNQTDLVGEYLHEVDLRLSGLPLLQRRELLADLAAHIATERTDRDVRSEAELIEILERLGSPEVVAAAAYEEAGAGTPRTASVPPPFVAPPPFAAPSFAAPPPAPRTARPPRLLWLFGALAAVGVMLVLCLAGALMVSRSTQDSPPAVTTPVQATPATPTTPSTP

SEQ ID NO: 10540 - protein, 114 aa, Actinoplanes utahensis
MGEAAQLASGLKRGTLEFCVLAMVEFEDRYGTEIVRRLAEEQSLAATEGTIYPLLSRLRRGGMLDSKWAESPSGPPRRYYSLTPSGKSALENFRTEWVPFRQTVDRLVGTGGVA

SEQ ID NO: 10541 - protein, 435 aa, Actinoplanes utahensis
MTDRKRRLSVDLTPLRTSRDFRLVFVSGAVTSFGSFISYVTIPYQVAKLTNDPLMVGLIGVCELAPILIMAFVGGALADYLDRRLLVRGSEAALALICGLLLVNSLSDTPRLWPLYVCAFLTAAVAGLQRPAMSAMLPRLVRSDELPAAMALQSLSMQFAQLIGPSLAGLLIAALDLHWVYLFDLFTFAVSLVCLTMVKAVPPPAEADRPSLRSVADGLRYAGSRPELLGTYLVDINAMFFGMPSALYPFLAERLGGPQVLGLLYAAPAVGSLIATVGSGWTARVHRHGLMVIIAAALWGVGIVGVGLSHMLWLTLFCLAFAGAADMVSGLFRMIIWNQTIPDHLRGRLGGIEMLSYTTGPLLGQLRSGLMARTSLGVGGSIWVGGALCVAGSLALAAALPRFVRYDGEHGVALKEAADAEWAAGAEGRAAAAAG

SEQ ID NO: 10542 - protein, 162 aa, Actinoplanes utahensis
MGLTWAESYLGKVRASIGDTDTIFFVGARTVVFDEQGRLLLIQRSDNHRWAIPAGAMELGESMEDCAVRELWEETGLRATSLTPYAFYTAYTYTNDYGHTYQQVLMSFVVHSWEGELLRQTDESVDAGWFALDELPGPKSFVLDEALADLETFTTTNRLVMK

SEQ ID NO: 10543 - protein, 305 aa, Actinoplanes utahensis
MRAIWKGAVSFGLVSIAVKLYSATEEKDIRFHQVHRTDGGRIKYQRTCSVDGEAVSYDDIAKGYDIGGGEMVILTDEDFADLPLSTSRAIDVLEFVPAEQIDPILFAKSYYLEPEGQAAKPYVLLRDALRDADRVAIVKIAIRQREQLATLRVREGVLVLNTMLWPDEVRVPEFGFLDDEVKARPAELAMASSLIDSMAADFQPDEFTDNYRAALQEVIDAKVEGREVVQPEEAEEAAPAAVDLMAALKASVERAKKARGEAAEEKPGKKAAPAKKAAPAKKAAPAKKAAPRKSAASGRAAKKSA

SEQ ID NO: 10544 - protein, 301 aa, Actinoplanes utahensis
MPDRIPIRLDGHDLELSNLDKVLFPATGVTKAEVIDYYTRIAPVLLPHLRDRPVTRIRYPNGVEGAHFFEKNKPAGTPDWVRLVTLPVPGSTKSRETVEFVVVDELATLVWLANLAAIELHTPQWRVGAHPDMLVVDLDPGAPAGLRECSAVAVLMRDRLAEDGIAAFPKTSGKKGMQLCCPISGAQDAGVVSGYAKRVAEELARLVPGSITAKMAKQLRPGKIFIDWSQNNAAKTTVTPYSLRAGPAPTASTPLTWPETEAMAIGDAEARQFTAAEALDRAQTHGDLLTGLLESGPAVPV

SEQ ID NO: 10545 - protein, 305 aa, Actinoplanes utahensis
MPEGDSPTVARRRVRLALREAREKADLTQLQVADEMEWSLSKVIRIENGDVSISPNDLRPLLAFLGIRDRPTVAALIGDARIARTRQRQAWFQLPEFRENLTDATRKLIEYEHEAAQMRSYSVYYIPGPLQTPDYARALMTRFEDELSDAQMSRRIEARKLRRESLLTRAQSGQVRIAVMLDESVLRRTIGGATVFAAQLRELRRLIDAGTITMRMVPFSLDAAVTNNASFDLLVLGEGEVLYRETGLSDEMIEDRDVTAKHRARWNKVWDEVADEAATLAFIDRQIKILENPIEAYGRQPPLPD

SEQ ID NO: 10546 - protein, 152 aa, Actinoplanes utahensis
MESRLRIAGQAVQPVLVMFPLGLFAMAVLFDLADLLGGPNILGALAYWNVAAGLVVGVLAALAGAIDVMFLRRPQARRLGALRTLINIGVLVVFAVVLMVRVRAPERVAGGGLFMIELLALGLAGFGAWFTSELANGRTPAFARAAAGARDF

SEQ ID NO: 10547 - protein, 145 aa, Actinoplanes utahensis
MSTRTYYSGSDAEVTDALFTWHTAPESLIFAIADLRHVGLVQSPARTRPYAPHLAAGALLAVAAGWTLLADPTLYVIGFLAIIGPVLAFSWRERRRWELHAQYHGSAVVLYSSGDVRVFNQVGRALRRAMEDGRRTPWGYGLAAA

SEQ ID NO: 10548 - protein, 303 aa, Actinoplanes utahensis
MAEGDSPTVARRRVRLAIREARERADLTQLHVAEAMEWSLSKVIRIENGDVSISPNDLRPLLSLLGIRDRAEVTALLADTRIARAKQRAAWYQTPDFRDGLTDATRKLVEYENESTEIRSYSIYYVPGHLQTPGYASALMTRFEDELSAEQIGRRIEARRLRRDSLLPRAASGQLEILVMVDESVLRRTIGGPVVFAEQLGELAGLATNGAIRMRMVPFRLDAAVTNNASFDLLAFGEGEVLYRETGLGDEMIEDREATAKHRARFDKVWHEAADEDDTITFIRQQITALENRDHNRGARAHT

SEQ ID NO: 10549 - protein, 64 aa, Actinoplanes utahensis
MENMNAPAWRKSSRCGTSTCVEVAKVDDNYMIRDSKNPDAAALTFTKAEWDAFVEGVNAGEFHF

SEQ ID NO: 10550 - protein, 261 aa, Actinoplanes utahensis
MHRNDQNDQGAALAAEQTLRPRIVRRGRESGRAGPHPGLEGSRRRTTGLRPAGLGRLPRRSQGRRIRQSVKPRPPELLGAAGRARHTALVEGNQRATDPDRFTDLHEAAETLLDELTERYQVERRETKEPLGLDEALARTVRLIPRTPSAAPLAIQFTGAGLHLRFGRWWRESLPICDCDTCADRPGPLTDQLRRHAAALVEGGLWERVRRGLSGSWFEARLIGAGVKADREGPLSAAGAREARRDGFAAAVQWGPWQVRS

SEQ ID NO: 10551 - protein, 392 aa, Actinoplanes utahensis
MSRLLSVLGEPEWDVAVIGAGPAGLAAAHAAASRGARVAVLERAEHPRYKTCGGGLLGSSLRLSAARLASVPVRDTISSITFTLAGRREFTRVSAEPLISLVRRDEFDQAWCRAAEQAGAEIFPHTIVRTLDQHDDGVIVTLAGGETLTARVAVGADGSAGITGRHVGVLLEQQDLGLEVELAATPQDQERWRGRVLLDWGPLPGSYGWVFPKGDELTVGVIMEKGRGADTKRYLREFVEQVGLSGRPVLRDSGHLTRCRAVSSPVRRGRVLVAGDAAGLLEPWTREGISYAIRSGIWAGEIAAGSRDLAAYDRIIAAELQPEIVAGRRLLGVFSRHPSIVHTAMSTGLGWRAFSGFCRGDFSMAGALGRPTVKTALRLLGSRPPRPQPVGG

SEQ ID NO: 10552 - protein, 123 aa, Actinoplanes utahensis
MDGRPAVERVADALLAALPDFDYVYSNNIEAYDRFSPGLFFWEVVQATVRSYLGDQDEPDWRSTLDFMESAVRSGSQDERKAVGFHFLWNLPNRGDPGHDLVGELGPELTRILTRMQHGQPVD

SEQ ID NO: 10553 - protein, 786 aa, Actinoplanes utahensis
MQAARTSINKATAARADADMTAQAAQDAVRQSAVASFWSRISGRAAIDARITAAGIADPAASAIDVASGYAATDSDAAMAVDIANNALQIADSQATAAQQHADDAAAAAAHAQQMADLAVAQVKPAYVAAQKAAEAANRAVQAANTAIQAAKSAAKEAQGAVDAAKDAAEAARDAGNSAQDAAIAAAQAGSDSGTAQQAANNASGYASKAQQAATNANVLSGKISDVSTNITNLSNSIWGIAQAMSGIAKDLKNAAWAKYNAEQAAAEAKVNDWIDDKANWLNDHVFGGSQIGKGITDSAAGMAKGLLVTSSCVGGTFLGSDNAAGDEWSVPDVSYLPKSDKACNALVKGIKDLILHPWELLHWSDWKEKGWQYTLGEVIFDVVTIGGTDGLGIFAKLGESGAIQTAKAAIKDIAKMSAKDLLAGAAKFTVDNLSNAIKALGTVDVARLLELSGKIGAKLTFSPEELAALSKAAVTKGMDAIEDTLRKLGSTPVLQGLKDLVERCFTPHSFTADTRVVLADGSTRRIADIAVGDRVLAVDPITYVRRAEPVTALHRDIDTTLADVKVRDRAGRISVIHTTPGHVFWDQSNLRWVEAARLASGTLLASADAQRVTVVDVQTFGGSQPMYDLTVAAIHSFMVVAGRSAVLVHNEQTARAPKPDVDHDYLKTMVRYLYKSLDLAPELNITIYGDGTTMAALMNEWKTGEATNGSEHLTKIRDVQNGLTKFLNTEGYWKKPKKGEKKVWIDFTTRTSKDIAVATDLLKAVNDSLANSYVDFSDYKALLGC

SEQ ID NO: 10554 - protein, 650 aa, Actinoplanes utahensis
MQRRRLRWIVGLAAGLAVAVAVPGGAAVAAPRVQAPVVQPHALTVQEALQQLLGADTKAPADTPIDDADLDRMLTQDLADYDADPAVRAAATAVLATNDPAQIKDFLDNGLPVYRKADQQRQKDQADHNRVQVQEWAVSGSPTVRQRAQAALDSNDNAKIAAFVATGHDAADLADKQDALNAAQQAKLIQGRVEQMVANGGYEVQKLGQAALDSEDPVVIAEFYNTGYAAASKQDADAQQQITDALAARSKAVADLTDLAQRAAQAADAQKKIIQASVAATQALTSASNAMGLANKEAKQADSIYAADIPLRNAGKATHTTDVMNLRMQACQDAVTAQGYADQVTGQSGVAATAAQTLDKTGLSHNIAWADVIQAQADAGTSAAGAAMTACQAATATEGASRTLDADHAATVDANNAVKYRQAAEREQASAEKLADRAEKLAAAAQAAATDAHNQRVRAENDADSAQGHADNAAADYQAAKQQQAKARAAASAAISQSITAYQAAGRAIDQQNIVIGKAGEAKTKQEDALAAGAAFAGKAQRAKTLIEKAKADDQNTSSKEFAAQAAEAHLLSAEMACKYPDNPSGNGCPGTAEMQRLRNDAASLRAIANAAKNASDQSKRDANAASDASSAAAADARQAAAAAAAAAAS

SEQ ID NO: 10555 - protein, 644 aa, Actinoplanes utahensis
MQSYSKPPVADTSDRRLPVICREGRVCPYAIDHRNCRRTREKFFRLRPGCRWSPAGRPDRPSRRGGNVVGALRSLRRGLAIGPVVLAAGAGCLTGAAPAAAATTPAVAAEQVIVSLQDASRVAGVEALVRRSGGTVQRELPIVDGFTAQVSPALVTTLRATAGVRSVTANSTGHLKAVDPALGYDATKDEGSLSFVRNTMHVNDAWKAGYTGKGVDVALIDSGVATVPGLTSGNVVNGPDLSFESQYADVRYRDTFGHGTHMASIIAGRDSAGTPAQYSASTGFTGMAPDARIVSLKVAASDGSADVSQVIAAIGWVAQHAHDSGLNIRVLNLSYGTDSTQSSVLDPLSYAVEQAWRRGIVVVVSAGNDGTTREELADPASNPYVIAVGAEDPKNTAGAADDLIPAFAQRGTGTRHVDVVAPGVHILGLRVPNSYVDQNNPAGRVGTRFIRGSGTSQATAVVSGVAALLAQKYPAATPDQIKWLITAKANPFPLAKSIWQGTGLVDVHMSLGLNPASAPVQNFTATTGLGTLEGARGSGHVLIDGIPLTGEKDIFGQSWNVARTAWSGGTFNGTTWTGTGWDPSTAGWTAPSWTGSDWTGRSWAGRSWAGRSWADNGWDGRSWASNCWYGRSWASDGWADASWS

SEQ ID NO: 10556 - protein, 584 aa, Actinoplanes utahensis
MPSVTDDKSMPVVPPPAGWSGAEHTVPTRPTSMDPQELGFTPKQPIGWLAPLLLLSTGLRALLAILFGAYMDKRELQNALDADFFDHSATADGEIWLDYVADLGDGFDATYSIAWLLAQPRLTVDGAALPRGRLLLMGGDQVYPLASGDGYESRMKGPYRAALPEAPAGEPRPTLFALPGNHDWYDGLTAFLRLFARRKDGFIGGWRTEQRRSYFAVKLPNNWWLFAVDEQFGAYIDDPQLLYFEKAAREVTPDDRIILMTPSPTWVKARNDPEAYDAVDYFLRTILAPTRAQVRVLVSGDLHHYARYTGEQRELITCGGGGAYLLGTHNLPEQLVVPPRETLTRSRSLSRVYDLAARFPAPAASRRLGWGAFRRVPRRNAGFATMLGIIHTLTMLAMAGAASQGGIIQRLFSIPLLLMLVLIMLGTVLFAKPPGAASAKHARHWILGVLHGLAQIGLAAAGAWVWLRLPFQEWAWPGPFAVAAVLYGPVIGLVATQVLALYLVIASMFDVNFNELYAGQGIEDAKSFLRLHIDAAGTLTIHPLGVDRICHRWSADPDGEPHAPWLRPEQPLDVQHIEPPIIIS

SEQ ID NO: 10557 - protein, 130 aa, Actinoplanes utahensis
MPDDDAADPRELLAAFDASPYGVVLGDDLRRRRLVFEALAQSEDAMTREVGEQLFTGAIEPREVLRSSAYREFVRDALVRGEKMDIKELGVRLDALTRSGALTGDLERDSRAQADPKPGGRRPADGDDRR

SEQ ID NO: 10558 - protein, 375 aa, Actinoplanes utahensis
MRFWVDIPAARGLPSAFRRMEQDAKAAQDYVKANTALNYGHGLLAQARGSHQAIVDHLHTYLHRIEYDVAFCGAAMITSALNWYDNTDRENAGKLDDSWPGATVDRTELGPYSYDTPGGAQAFTDRFEPQARLTALPDYDNTDEYRYAPAVGDAASPTSGIRDTIWGATWLAAKIGVFDRPYDVFEEWTKPLAGDWTGVRQCADVFNNVALAVRDMGENSRWHALGVDAVWGGNGADALIVNCWTNGKKMIEWTPLLQETADRYQTSAEAMFEIGKVVGSLIMDLSDAAMVFAAAMTGAGGTPEAGIGPLVLGGASLYEAYRMWDITKEIMDLMGRADAASSAVASAAGDLGFIGSLGPIADLPPTATVPDLPMR

SEQ ID NO: 10559 - protein, 144 aa, Actinoplanes utahensis
MSTQNLTRAPDHWLPASLMGIAHDQCVWRRSGSYCRIYDPTAARMRTVTFVRMTFEVGVTERHVVEFYFSKFWGGVKITVDGVVALRTVQLLSFSVVKRYNLTVGTSEQHAVTIEKRRALLFSAFRQQPVRAYVDGTLVAEGAA

SEQ ID NO: 10560 - protein, 280 aa, Actinoplanes utahensis
MGMLCAVSFNRYGRLYYLDPGEFSPSVGDRVLVPTDDGPEVAECVWPPQWVSEETDGFPKILGLAVDDDLRRDELLRKRKAEAKVAAKKLIKAHELPMKVVAVDHVLDPAGANGDRTTIYFTAPHRVDFRSLVRDLGATLHCRVELRQLSARDSARVQGGIGSCGRDLCCATFLTDFEPVTIRMAKDQDLPLNPLRISGACGRLMCCLKYEHPLYSGSSDTYPRPGERVKTADGAEGRVVARHPPSESVTVRGIEDGQLRRCPVADVCGSRRAYESGGNQ

SEQ ID NO: 10561 - protein, 631 aa, Actinoplanes utahensis
MTPARSLAASVAALGFASTLTAPLPAHAASTLAPAPAPCQQAHRYAAQSEAELLRIERLDLRPTPNRDHGAGLPRHDSGERPSIAPTESAGEVLQQLTPDDPAATAGSGSPDSPAAGEDADSADTSDATAMPAPGVVPAAYHPGHRARSGLDAAGNRDVRWKRDAAGNRDVRWQRDAAYNREVRWRLDALDSSHADRDARIELGKPGATGGGDANGDTRPATAGAGDTTQVIGGVGVGDARSVMIADGPVKSAAAAQTLDGRVAGAPAAEQVLQQTPPTHSGPVEQHTAAERLGPIQTGTTTLSAHARWTDAMACAATAGETSRAATALDRVTLTGATGELIRVPAKSSTISNTALTGHGTTAKAVASATVRAAEFTLAGGEIHVRVLRAPSLQVSMSAATGGEVRYQPAAVEISGPHFPRTRLSTATDHADITVSDAARPTESATVPVLPSRGPALPSIPNLPVPSPTTGPGSSTGTSARSSDKTSTRAGNGPDAGGTVARGPVLESAPAGQALVRISLGDVRQASKGHALAARATAIKIAVLRSQHSSKDRGNPGYESSAVIANLGVGILEAAAVAPEQGKRTLESGVQGGTLPVTGPRSAPLFITGAGLLIGGLCAFLLGTRRRRPTP

SEQ ID NO: 10562 - protein, 196 aa, Actinoplanes utahensis
MLARRRRESKGRYGSSMPLNNPWLAGDVPDRRLPKDRLEERIRNLFSSQNMGVLATAGGQGPVATPVRYYSLDLAVMFTASPRSPKMRNIADDPRVSFGIFAPLVGLASSRGAQLFGRARVLGPGDPGQVPYWEAFRWENEHAERGRLLSEPPAETLVVLDPDRIVYTEHWLRRDGYAPRQIWRRADPGKPVRPGS

SEQ ID NO: 10563 - protein, 202 aa, Actinoplanes utahensis
MDRLDQLLTVADPLLSRVDQLLTSVGAPAGHDVWPELRRVRLLPGDAVRAVAALHPAALADAVPELRAQARVCADTADALPLATTWTGHAAEAYEATRRRTAEQLNVGPDSLSRRMTATADLAGALHDWMTHTRAALAYALADSLNSAEALTVTVSSGFPQPAETRAAAAIATHVLRTIADSYDRAENLLDDSSSLTTPQST

SEQ ID NO: 10564 - protein, 98 aa, Actinoplanes utahensis
MDRIADRIDQAAAELSTIDRRAPHLLPGPGAFGADDVGRPGRLGHRLHERWAAVLQARADEAAGLSGRLTDLAQSVRSTSRDYSQTDESVRHRLLRGL

SEQ ID NO: 10565 - protein, 108 aa, Actinoplanes utahensis
MAREIDETWIDEAIDRYRRVEGLRAEFDKAVATHQVSVHSPDQTIEVVVTATGEIVDVRVQGEFVKRTAAEFSRELRAVIASATEAARWARDKLHAEVFGAFRSLEDH

SEQ ID NO: 10566 - protein, 394 aa, Actinoplanes utahensis
MFSDLVGQAEPVETLRRAAGAAARVVAGEQVASGAMTHAWIFTGPAGAGRSVAARAFAAALQCERGGSGCGECHGCHTVLGRTHADVRFVAPEGLSIGVNEMRALVLRAATAPSGGRWQVVVIEDADRLTEAAGNALLKAIEEPPPRTVFLLCTPSTHPDDISVTIRSRCRLVALRQPPADTVAAALVERDGMAPDTAAWAAAAAQGDIVRARLLAADPEARARREAVLAVPKRLTGVGAAFEIAAGLVAAAKAEAAGSVAESDASERSALEQALGAGGTGRGAAGAMRGAAGQIKDLEKRQKSRATRAQRDALDRALVDLAGFYRDVLVTAMRAPVAVVHGDVAQQSGAAARKWTAESTLRRLEAVLACRDAINANVKPEIAVEAMMLTLWKG

SEQ ID NO: 10567 - protein, 363 aa, Actinoplanes utahensis
MRSTRIAVLLAVGLVVAGSAPLRAVASPRPSATSARSVLSALDPGSLRAAARGTGVRIGTAVDMTALAADAPYQATVAREFDTVTPENVMKWEAVEPQPGVHDWAAADQLVDFARHHGQLVRGHTLVWHNQNPSWLTESAYTPAQLRTLLRQHIFAEVGHFKGKIWAWDVANEVFNEDGTLRDTLWLRALGPDYIADAFRWAHQADPKAILFLNDYNVEGLNAKSDAYYALIKKLRGQGVPVQGFGIQGHLALQYDLPITAADNVRRFDRLGVKTAFTEVDVRMQLPADTAEVAGQSEGFGLLLRACLLAEHCISYTVWGFSDKYSWVPGVFDGQGSATPMTETFEPKPAYRTLRETFLIARR

SEQ ID NO: 10568 - protein, 758 aa, Actinoplanes utahensis
MARSRRWRRASRSVSTPARYLDPDQRERHSSLAYPMVGTPDDQGGRIQCSPSSDHGEVGAINTESRQETAPVDLTGAAALRSVLRIRPFRRLWLVLGAASFGDWIGLLATGLFASAQFSNSAAQGAAFGGTIAVRLLPALLLGPIAGVFADRFDRRYTMVITDLIRFVFYGSIPLVPLLGGSPALTVTWATIATFIGETITLIWIPAKEAAVPNLLHHKSQIEVSNQLTLVTTYGITPILGALTLSALTAGVQHSGVSLPAWAQPVQLALYMNALSRLATALTVFFGIREIGGKSAERQQAAEQSMFHQFLDGWKYIGRTPLVRGLVLGIFGAFAAGGVVIGAARTYATSLGAGEAAFYLLFGTIFLGLAVGIGLGPMIVKELSRRRWFGMNIVLASGSVMFLGLAFHLSMALVGALLVGAGAGMAFLAGTTLLYGEVDDTVRGRVFAVVQIGVRMVLLLAITLAGLLVGLGSSRRVNLGPVHFDISSTRVLLLVAGAIGIWVGIGSFRQMDDKKGVPILADLIGSVRGRPLTPAEEFLRSGLFVVFEGGEGAGKSTQVDRLADVLRAEGRDVVVTREPGATDLGGRIRGLVLDHSEDGPSPRAEALLYAADRAHHVATVVRPALARGAVVISDRYVDSSLAYQGAGRTLPVQEISWLSSWATGGLKPDLVVLLDVDPAIGLKRASARGAGVDRLESESQAFHDRVRYAFLDLAAADPKRYLVLDAARPAGDLAEMVVDRMSGLLASRPAASPSSSSA

SEQ ID NO: 10569 - protein, 401 aa, Actinoplanes utahensis
MLTDRDALRQRLERATDHLETPVAAVDLAAFDDNADRLTARAAGKPIRVASKSVRCRALLERVLARPGWHGVMAYTLPEAIWLVRSGVTDDVLVAYPTAHRAALRELAGDESLAAAISIMVDHPAQLDLVDQVTGPGDRATVRLCMDLDASWKPAAALHVGVRRSPVHSAVQAGELARTIAARPGFRLVGLMSYEAHIAGVGDDPPGQALRARAIRLMQSRAFPELLRRRAAAVRAVREHADLRYVNGGGTGSVAATSADPSVTEVTAGSGLYGPTLFDAYRNWRPTPAAFFALSVVRRPAPRIATVLGGGWIASGPAETSRLPQPYLPAGLAFKADEGPGEVQTPLLGEAAEVLRPGDRVWFRHAKAGEMCEHVNEVHLIDGDRSTPAPTYRGEGHAFLG

SEQ ID NO: 10570 - protein, 209 aa, Actinoplanes utahensis
MSTPTVSTGPLRRVPVQGRSVARVQRMLDACAELVDEVGYEGLTTTLLAERAEVAIGSVYQFFPDKRAIVQALALRNMDAYLQSLSDRFASETFAHWWDAVDAAIDGYIHMHRSVPGFRTLHFGDVVDLHLLDSDRDNNAVIAERLAELLTDQFRLVDRNRVRFALQISVEAADALIKLAFRRDPSGDEAVLTEVKALIREYLHRHVQA

SEQ ID NO: 10571 - protein, 432 aa, Actinoplanes utahensis
MTTPVNARRWTNWGQNQESVAEVLAPAGIDEVAAMVTAAAQAGRRIKTVGTGHSFTAIAVAEDQRMLLHRMTDLVAVDGPLVTVQAGMPLSVLNAVLAQHGLAMPNLGDIDVQTVAGAISTATHGTGIGHGTLASCVEAVTLVTAAGKVERYDPGSPEFPAVRAGLGALGVLVEVTLRCVPAFTLLADEKPMALADVLAGVEEWVDGNDHVEFFWYPYTDRASVKINNRVPEHDRPLSRFRGWLDDDFLSNTVFQGVCKVGQRFPGSVRTISSLTARALSARSYTDRSDRVFCSPRRVTFTEMEYEIPRAALPEVIDALPRLIDALPFKVLFPVEVRFTGPDDVWLSHGYGRESAYIAVHQFRGSPYEPYFKALEALCEPLGGRPHWGKMHYRSAADLRPAYPRFDDFLAVRDRLDPARVFTNAYLDRVLGA

SEQ ID NO: 10572 - protein, 926 aa, Actinoplanes utahensis
MPSDARTTRLVIVESPSKAKTIAGYLGPDYLVEASVGHIRDLPKNADEVPAKYKGQPWARLGVDVDNGFHALYVVSAGRREQVAKLQRLAKEVDEIFLATDEDREGEAIAWHLIETIKPKVPVKRMVFHEITKPAIQAAVANPRDIDRSLVDAQEARRILDRLYGYEVSPVLWKKVMRGLSAGRVQSVATRIVVERERQRMAFRSAEYWDIQALLAVQGPVDGPRNFSATLIALDGDRIASGKDFEPTTGQLKPGAAVVQLDGDGARGLAARLADRPFTVSRVEEKPYRRRPYAPFTTSTLQQEASRKLRSSSKQTMSTAQSLYEKGYITYMRTDSVNLSETAIAAARRQIAELYGANNVPPQPRRYTTKSKNAQEAHEAIRPAGDNFRTPGEVAKELNTAEFKLYELIWRRTIASQMTDAIGNSISVRIRAVSTANEEADFAASGKTITDPGFLRAYVESSDDENAEAEDAERRLPNLVKDQPLTADELNALGHHTSPPPRYTEASLVKMLEELGIGRPSTYTSIMQTIQDRGYVEKRGQAMIPTFPAFAVVGLLENHYGRLVDYNFTAAMEGQLDDIASGDHTAVDFLTSFYFGSQAGGADEEIAKAGGLKKMVTEDLSAIDAREVNSIPLFTDDQNRQVVVRVGKFGPYLQRSNTQVADGAEEASEDRASIPEGVAPDELTREKVEELFLAGNGDRTLGDNPATGEPVLVKSGRFGPYVQSGESKSSLFQSQSPQTLTLEQALQLLSLPRVVGKDPEGNEIIARNGKFGPFIQRLKDSRSLESEERLFTVTLDEALAMLAAPKVRGQRGAPKPPLRDLEGVDPVSEKPLLVKDGRFGPYVTDGETNVTLRRGQTPEELTLQEAIEMIAEKRAKGPAPKKAPAKKAAPAKKAAAKAATPAKKATAKKAAPAKKAAPRKAAASSE

SEQ ID NO: 10573 - protein, 249 aa, Actinoplanes utahensis
MTSLPETGWPLIPRETLPPPIPVAGRRSAQRGAPGRPAGRQLSMFGAETTEASPADLAGLLAGPGQLGRMGGTARVSVVVDAAWRVHVLVAELVARGLATTWAPVEDQDQDPIDAVRDERSAEGETSDTPEEPPPRFEVRTAYSRRLNALATAWPAAAAQLFLSGPRLRLWVAAAGHPHPGGYRLGLDPGKDPVEVDAALVRAGLAGRVTEDRRAYVIAGRRRLTRLTELVGIRPEAAPSELWPGGAGA

SEQ ID NO: 10574 - protein, 176 aa, Actinoplanes utahensis
MRAVRTISLALVLVLGPPLAACSSGHGAEAWAAAVCGTLRPWRSEISSLTSRTQQQMTTRTTPGQAKENLARLFDGARSASETARAGVERAGVPDVTDGKKIADAFVGSLAGMRDAYGSAHDGIQALATAPSASFYTEVGKVVDRLNSEYEQSGLDTSKLDSVELRRAFESLPECQ

SEQ ID NO: 10575 - protein, 807 aa, Actinoplanes utahensis
MSGTSIDLAAGGGGVSLSGSNVVFVIVALVFALIALGFAAMFVQSVLRTGRGTKNMQEIAGAVQEGASAYLFRQFKTLAVFVVIAVVLLFLLPVHDTDNETWVKIGRSLFFVVGAVFSSFIGGAGMALATRANLRVAAAAGEPGGRETAMGIAFRTGGVVGFLTVGLGLFGGALVVLIFRSDAPTVLEGFGFGAALLAMFMRVGGGIFTKAADVGADLVGKVEKNIPEDDPRNAATIADNVGDNVGDCAGMAADLFESYAVTLVAALILGQAAFGQDGLIFPLIVSTIGVVIAILGVFITRLRPSDRNGLTAINRAFYLSAVVSAVAVAVVTFLYLPDSFAGFGDAGIAKDIVDSGRNPQWVAIGAVVIGIVLAAAIQALTGYFTETNKRPVQDIGKSSQTGAATVVLAGISVGLESAVYSALLIGAAVYGAFLLGGSSLTLSLFAVALAGTGLLTTVGVIVAMDTFGPISDNAQGIAEMSGDVDETGAQILTELDAVGNTTKAITKGIAIATAVLAATALFGSYTNSLVSSLTDAKVADVQGQIYQLLNIANPRSLVGLLIGAAVVFLFSGLAINAVSRSAGAVVMEVRRQFREFPGIMDRTQRPEYGRVVDICTRDAQRELLTPGLLAITAPIAVGFGLGAGALAAYLAGAIGTGTLMAVFLANSGGAWDNAKKLVEDGAHGGKGSEAHAATVIGDTVGDPFKDTAGPAINPLIKVMNLVSLLIAPAVVTWSVGADANTPLRVIVALIAVALVTGAVVWSKRKSIAMGDEPAGATAVGAADTAKAVQDAQHSDAAAQSRIKDNVG

SEQ ID NO: 10576 - protein, 145 aa, Actinoplanes utahensis
MATVRLSFSPAPVHVRTARLVGVAVARRAGVDEALLDEVRLAIGEACTRAVALHRQYGLADLVTVEMSDSGSYTVRVIDHAPIEASIGLTKLPPDELAAESLTEDDLTTGVGFALLAGFVDDLQVRPVEDGAGTEVRMVWPVTRR

SEQ ID NO: 10577 - protein, 118 aa, Actinoplanes utahensis
MELSLATRTVAGHTVLEVGGEVDVYTAPRLRERLIELVDAGARDVVVDLERVEFLDSTGLGVLVGALKRLRTAQGTFGLVCAKEPLLKIFRITALDQVFPIYSTVEAATERNGSGPAS

SEQ ID NO: 10578 - protein, 853 aa, Actinoplanes utahensis
MLGVTATASGPAELLHRLRARAGNAGQSPITHVERVPARTGRPAPWPSWTHPEVREAFARQGITAPWQHQADAAGLAFEGTHVVLATGTASGKSLAYQLPALTALTTDPKATVLYLAPTKALAADQLRKLTRLGLADIRPAALDGDVPREEREWIRQHARFLLTNPDMLHHSLLPGHSRWATFFRRLTYVVIDECHAYRGVFGSHVAHVLRRLRRTTARYGGSPTFILASATSGDPAGSTSRLLGTPVTAVTEDASPRGAVTFALWEPPLLPPEPATPTFVPPPTIPVPAQPTAPAVAPARPTAAARHTDSSRPTAAARPTDSSRLAAAARPTEPLTPAALSPLAVPPPEADFDELDLPPVRRSALRETADLLTDAVIAGTRTLAFVRSRRGAEVVAAVARRSLDEVVPGLGSRVAAYRGGYLREDRRAIERALLAGDLLGLASTNALELGVDLAGLDAVLICGWPGTRASLWQQAGRAGRAGGAALAVLIARDDPLDTYLVHHPEALFGHPVEATVLDPANPYVLGPQLCCAASEAPLTEKDLPLFGPATRPVIDQLVAEGALRRRPSGWYWTERGRPDVDLRGSGGAPVQVVEAATGRLLGTVDQGSSHVMLHEGAVHLHQGTTYVVDELDLEDATALVHQEDPDWSTHARDVTDVSVVRVFSYADAGPVGLFLGEVDVTSQVVSYQRRRLGSGEVIDIRPLDLPVRELRTVAVWFTVSPQALAAAGIEPNDVPGALHAAEHAAIGLLPLMATCDRWDIGGLSTANHPDTEAPTVFVYDGHPGGAGFAERAHATAAAWLTATREAIAACACDSGCPSCVQSPKCGNGNNPLSKPGALKVLDTVLAALPETP

SEQ ID NO: 10579 - protein, 217 aa, Actinoplanes utahensis
MKRDPRRGIRPLLPTQEDSFASIRHDVPAAAHGGGRRRIQHRGVRGGGSRGGRPRTAPVQGADQHVDPERTEHHDSSGAEVIGRRRAGRGRDGHRRAGRGPGRDRGAFTVELAAGLPALVVLMFAGITAVTAVVTKAQCLDAAREAALAEARGEHSVSAARTAPDGADIRVVGDRDSVTATVTVRVRVLGARLPGIRVVGSAVAAREPGPQPIEGRR

SEQ ID NO: 10580 - protein, 334 aa, Actinoplanes utahensis
MWRAGGVRGVGGAAAGWAGSGAAARVLRRGAARGGRFRQRLSSGCPGAPGEPGRARSAADPSRSARSAGPVGSGRPDSPGGSDGPVESFAVGSGPSDGGGHMSRWGRAGRRLGRLRSAGLSDAARSRSPDVAADPVPARRRHALLGLLAGASAAGLVGGWWGLPVGLVTAIGVERALRNQEPADVRRERHQAGADLPLGVDLLAAALRAGAPVDRAAAAVADAVGGPLGARMQRTARSLRLGAGPAEAWAHLAGLPGADRLTATAIRSSASGGALAAALERLAGDLRADRAVATQAAAERAAVFIVLPLGLCFLPAFLLAGLVPVLIAVLGRLL

SEQ ID NO: 10581 - protein, 239 aa, Actinoplanes utahensis
MIAVLVACLLGCAVVIAWPRAGTLARLSGRSPGLRLPRPRLPEPDRRGAAALAGATALVALVAGGPVAAVGGAVYAGIGGAAWVRRTRQKRAAAGRLAALDALSSLVADLRAGLPPGFGVPSTGLDGDERIARLSATVWRLAERTGAPAADLLERIEADARAADRARASAAAQAAGVQATSLLLAVLPVGGLGLGYAIGADSLHILLRTRLGAVCAIGALALQLAGLQWARRIANGPRR

SEQ ID NO: 10582 - protein, 657 aa, Actinoplanes utahensis
MAHSGIPRRRARRGAARGRAVADRATRHPAPAARRLPHPRRDRRPRRRRGQHPRRRTRRDRGRRGPPHPADRRRPTRRRPRPGARLGAGQRPALARARRGRRPGRPAGPAQRTATPRRPGAALLRPGPDDRGAGRGDGRHPGRRPARSRRDRRRPTPATRRRRGAGPAGRRPDPAGGPRRAAGHSGRGTDPGPDPAALRAGLGRGARARPRATAAPRHRADARSAPGRGAAARPGDVPGPRTRDSAGHERERAARRALPAAGRRTDAAAGGGGMSVVDRVRRQLAYDGVEATPAAVVSAVRRDGEVLGDHAVLRLADRVRDQMIGAGPLAPLLSDPLVTDVLVNGVQVWVDRGAGLQRAAVRLGDPEDVRRLAQRLVAACGRRLDDGQPYADARLPDGTRLHAVLPPVATHGPYLSLRTFRQRPFSLGDLVTHATVPAAAAPLLEAVVAAGLAYLVTGGTGSGKTTLLATLLGLVPPTERIVLVEDAAELRPVHPHVVALQARTANVEGAGAIGLTDLVRQALRMRPDRLVIGECRGPEIVDLLGALNTGHDGGAGTLHANAPGDVPARLEALGLLGGLPRAALHAQVLAALQVVLHLRRVGGARLLESIGILVPAGTERLTSVVTAWDRTTGPGPGPFARMLRARGITAPPVPAAS

SEQ ID NO: 10583 - protein, 119 aa, Actinoplanes utahensis
MESSIRTTLADDGTVTITVFGEIDFSNADEVADGIRHAVADWSPPLVQIDLRDASFIDSTGLGALIDGYRTATESNVRYLVINASPTFRRVLTVTGLSGFFGVTDSFEESAGQAHATGA

SEQ ID NO: 10584 - protein, 266 aa, Actinoplanes utahensis
MGPSAAFFDLDKTVIAKSSALAFGRPFYRDGLITRRDVVKSAYAQLMFRLGGGTDEQAMARTRDYLATLCKGWRIEQVQQIVAETLNELINPYVYAEAAALIAEHQAAGRDVVLVSASGDEMVRPIGELLGISDVIATRMAIVDGRYSGDVEFYAAGPAKVVGIRALAATRGYDLGQCFAYSDSSSDLPMLEAVGHPSVVNPDRALRRVAAERSWPVLEFRHPIALGKRLRDRPAVPVAAALGVGVGVAIGFALYGRHRRARAAAA

SEQ ID NO: 10585 - protein, 140 aa, Actinoplanes utahensis
MSTVQQPGGDDPHEGGSTTCGGGPVATCLPWLIARGFPVAVHETRSSTVQQIGHPVILDARKAGDSDCRWCRFLVGPATPFYAAPGMIARYRASKSGDHRLLRPKTSALVIALQQLPGDAGAVPVHDPIQDQIHDVVCPR

SEQ ID NO: 10586 - protein, 151 aa, Actinoplanes utahensis
MRPYDPGTGRWLVIAWEAFALTMLTWASVRQFDLMGHGVRVVACLLAAVWVIGAWRILQLGVYVSPDGVLVRGLLRSRMLRWRDIAGVRLHRATHRLGPWEIEGGNTVLLERLDGATINTELWERGVDFHSRPKVFRAVYQEIRHRHQAAR

SEQ ID NO: 10587 - protein, 270 aa, Actinoplanes utahensis
MVLRESCQFHSYLCTPRFRGFTGYRVQVDPLAPLLDLADVAPALAAARDSVDTAMRHRALRRHGGQVAAEASLRAAVASAALEGNVHDLDDVRAGTITDPVVQGALRVAEGLGGLVDLWPRAPRQVLAKLHVLAARGVVPADELGRLTGGAERIDALAGLVAGNEETPPLLLAAIVHAELITLRPFAGPAGVVARAAARLTLIGRGFDPRGLVGVETGHLAREPEYVGSAGAYATGTPDGVRSWLRHYAAAITAGAEEITAIGDSVLASV

SEQ ID NO: 10588 - protein, 661 aa, Actinoplanes utahensis
MSETLENLYSETRQFPPPADLAAGANVKAEAYEEAAADRLAYWERQAERLTWAKPWDQVLDWSHPPFAKWFVGGELNVAYNCVDRHVEAGHGDKVAIHWEGEPGDTRTVTYAELLKLVSQAANTLTELGVRAGDRVAIYLPMIPEAAVAMLACARIGATHSVVFGGFSVEALATRIQDADAKVVITADGGYRRGKPSALKPTVDEAVARCASIEHVLVVRRTGQEVAWTAKDKWWHETVENAGSEHVAQPFDAEHPLFILYTSGTTGKPKGILHTTGGYLTQTSYTHDAVFDLKPESDVYWCTADIGWVTGHSYIVYGPLSNGATQVMYEGTPDTPDRGRFWQIVDKYKVSILYTAPTLIRTMMKWGDDIPAKYDLSSLRVLGSVGEPINPEAWMWYREHVGHERTPVVDTWWQTETGAVMISPLPGVTAAKPGSAMTALPGISADVVDDTATPVPNGGGGFLVLTEPWPSMLRTIWGDDQRFIDTYWSRFGAGAGNGDKWIYFAGDGAKKDEDGALWLLGRVDDVMLVSGHNISTTEVESALVSHPSVAEAAVVGATDPTTGQAIVAFAIPRGHVATEGAAGQELIQELRNHVAKTLGPIAKPRQIMLVAELPKTRSGKIMRRLLRDVAENRSLGDVTTLQDSTVMDLISSGMKSSTSED

SEQ ID NO: 10589 - protein, 807 aa, Actinoplanes utahensis
MRKVVAGLLGAAMVTSVGASFPATAFAAPPVDTAPSTSADTVNVDDLPQPLEAKRRELRQQAVADVISGKAKIENRHGSQVVNLGRAPSGRGPLGHIGQNQYVELGNERTDRIFVILAEFGDQRDPAYPDKDTDPTTAGPTTFSGPLHNQIPQPDRKVDNSTIWQSDYSADHFRQMYFGTGAGAESLKTYFETQSSGRYSVGGEVTDWVKVPYNEARYGRSNDPVKDEDTTNPANDPAVCHSSTCNNTWALVRDAANAWVADQKKAGRTDAQIAEDMKSFDQYDRYDYDGDGNFNEPDGYIDHFQIVHAGGDQADGDPQQGEDAIWSHRWYAYGTDVGSTGPATNRLGGTEIGNTGIWIGDYTIQPENGGLSVFTHEYTHDLGLPDDYNTDGDHPGDNPNEYWTLMAQSRLNGRHDQGIGNRPGDLGAWNKLQLGWLNYEKVDAGQKKVVNLGPEEYNTKKKQAVVVNLPEKPVSYDMGAPAAGTKQFYSGNADNLNTSMTTTVDLTGKTTAALSLKGRYNIETGYDYQFFEASADGGTTWTKLDGTVGDKPFPRDAGGNPGLTGNGGKSWSDITVPLTAYAGKKISLRLRYVSDSGTNKGGFFGDEITVSADGATLSTDGAEGNGVWTLAGFTVIGSTVVQNYPNYYIAGYRSYTSYDKYLATGPYNFGFADKPDWVEHYNYQTGLLISYWDTSQADNNTPAHPGSGRNLYIDAHPKPFLAPDGKPWRVRVQIYDAPFGLYPTDGMLLHQAGKPSLITPQWGRTVFNDKDKYYYDELPNQGVKLPAVGVKIKVLSQLGTSMTVAVS

SEQ ID NO: 10590 - protein, 126 aa, Actinoplanes utahensis
MRSHLVRAGLAVITGALVAGCGAAPAAVPTADPAPLPTLTRPVKPPRDPTDTKPNTGWLTGVVSRGGSGPCYGFTSDDGAAFALYNGDGLTLTEGARVQVKLESTLLKIYCGPGDLMAVTAAAPVG

SEQ ID NO: 10591 - protein, 303 aa, Actinoplanes utahensis
MDESVVMAEGPWTHRFVGANGSRFHVAEMGSGPLVLFLHGFPEFWWAWHDIMTRVADAGYRAAAIDLRGYGHSDKPPRGYDGYTMAADVTGLIRALGERSATIVGAGAGGMIGWAAAAFHPKLVNRLVVLGAAHPLRLRAALFADPRGQFAASATILKFQVPRYEHVLTRDDAALIGELMQHWSSPEWAATPEFADYSYRCRQAMQIPQASFCALEAYRWVARSALRLQGYRFVKLMQQPLGMPTLQLHGSLDTAILPRTAQGSGRYVTAPYEWRLLPGAGHFIHQEAPDFVTGEILRWLKTP

SEQ ID NO: 10592 - protein, 120 aa, Actinoplanes utahensis
MRDGYVVSWQGQEYDAVPDGDRVRIYTAQATEGFAEVKPGRYVRVLEPDEYDEVAYVRTMCTWRGEPFIVLAEADTWLRLEYTGGRAPVARRLGLEEFDYGVYQGWAPANEIRDRYEHRV

SEQ ID NO: 10593 - protein, 1224 aa, Actinoplanes utahensis
MSEWEPVTDAEVAMRDALRTDDQESYFRILAGVELLLPVSADALAGLAPLGWGTWSTGGRTHVLAFTSQEALRACLSDYTGASRRVAYAELANTWPNLEWWLAVNPGLPIEGYLPAWFVAQLARGDLRLPTRGPGREVHGTSKIQELGAAALAAKRAGEGPGGPTHETSAAAASGGPGHPAGPGGASGVGSRPPQPGAVPSSLPQRGAPVPAGAAQFGPGGQLGAGPGGSGGQFAAAPGGSGGELGGAPGGQPGGAPMNTPSGLPVRAPSLPTRSTTPSGLPVRTPAAGESPAAPAADQPPAAYQAPGVPGVPGGLPGRTPAGSGSATPGWNSDSMPFGPENDPRGPLQDLNAPLPVRTPMANTPPIPEHVKPYDPAEAQVDPNWAAIGGGRAGDPASPGAPAPSGLGAPAGPGASSGLGAPAAAPLPSRGGSDLPRRQPGQAAGPSQTTSFSGFTNARTMPGSASAPPPGFPQGPASPQAAAAQSAPAPGGPGLGSPALGAPGSGAPSPGAASPGGSNGGLPRRQVTPPSERPASMAAAAQALTGGHTPAPDPGLAQRDVPPADRFGPSGPAPALPQRSDLGQGGGDRPAPGGRPGLLPPVIPGAPGADRGGIPGGYGGASGPGTPGSGLGPSGAPVSGSGPSGFPEGRPAPAAAGAPAPAAAAAPVSAPAVPGIPISAPPAPGAPVSPPPAPDAPVSGPAAPGVPVSAALGAPISGAAAPGVPLSGAGTPGVANGLPAATGSPASAYAAPGSPASAYAIPTGPAPAYAPSIPAGYSSPPAGYTGPSTPVPGGYSAPAVPAPGGYGAPASDGYGASPVSGPGGHGGTSAPAPAAYSAPTAPGPAFGMPPQGSPASAYASQAHATQIISLTPQTTAAPTSGASGLGIAGSSTGGSSGQGGRAREDFVPANETERELQDAADAGNTDVFLSTLLLAHVLVPVAHHSRPGSAPGESGFAFQPEEVEGEKFLVVFTSKDRLSEHFGEPTRTVGVRFYELIRNWPDPNWSFAVNPGTPVGAKYPGTQIIALANWATEAGLGAEPIESPSAEEPAAVVPAPEPASDEAQHATVMQKTIAAGQVDYYLDRGYDRVAGFVHRASEVEHLRTPAELFGALGLSYDGSPFQADAKEAFVLRWPAFRPSLYRIPYGGQNEQALRAMDGWVIERPPFRGNGFAPGEGRDVIAEFKVDSVRLPHGAQLWRLDADGNERMVAIFDADGPLWRRVGEQ

SEQ ID NO: 10594 - protein, 248 aa, Actinoplanes utahensis
MITLRIHAWSRPSFRCPQQRTGGDLRNGLHPSGDHGDGPHRREIRPGQRCPAGDAGHADDRARRPERHVEGPRCGSLRAGQEAVRGGSAAPQQRTRRDGRVDSGVRGRLSRRRLRGRQPGRPHRWHLHAAALTFQHHPAPARSPIHSRRILVNDGLLLVNFGALQQAGANIDKALGTLRDQLAQLEQDAAPLVSNWAGEAQHAYAQRQATWRAASADLEAILSRIRLAVDESATDYLTTERAATQRFQ

SEQ ID NO: 10595 - protein, 838 aa, Actinoplanes utahensis
MTTGPATAPRFSAVRLHQVIATQAAVVLLLIGAAAGGLVLISAAAGAAALLTMTWLRVRGRWAFQWLAADWRFRARRRAGATMLELAAPGAQVTSIALPRGPAAVLADEFGLTMLLELGDPAGPLAEPRSGLAAPWELLRDAQQRPPSRIQLLLTAAPVTAGPGPVASSYRMLTGGATLGYTRTVLAVRVLRTDGWTEGELRQALRGQARKLASRLRARPLPQAAAVRALADLTYADPAAEVQEQWPVLRAGPLSQVTFQARPRADVAPSAGLLTRLLQLPVTATTVTVTADLPEPESSEPPRISLSVRLTAPDRAALESAAQTLTRLARAERIELRRRDGEHLHGLTATLPLALPGDSAVLTGDPLDLALLPVRHSDSLHPAPAAPGTTHHAPDPTSAAAPGTTHHAPDTASAAPGTTRSALAPAPVSPSTTGFRRDPGLRGEKPAPSADTVQPEPFRSRSPRRRRGLVDPRLKPTMRRGAVTHPRPSAPLHPPAPEPSDGESEPRPSITSEQFGRLTLPTGSSGVAVGQDRHGKPVLIPLFRPAPTRVLVVGGFRCAQLLAFRAMAVGAQVLVRTLRPGDWTAFARATASPGVAIGIVPPDRPVDLPLASPLRPILTILDVDPLPAPGPHPGGHSPGPGRPSPSPSPRPSPRPRPQPAVTHPVVATSSVTTPAPTTPATPGTATPATAASATATSVTAGVYALGTGAPGDGGHIATTGDDPPGRDTADQTDDDTDRWLECMQDSGPWEATLMLRREFAASDGRTATDADLVLLQPLRADEAERAGDALPLGDAARLLSRMRSGMIGIAGPHGIRWAMLAPTAIEKVLIGDLTRRNI

SEQ ID NO: 10596 - protein, 134 aa, Actinoplanes utahensis
MAPSRAMGIIIRLVITAVSLWISTLVIDGIDLTANTATSKAGTLLAVAVIFGVVNAILRPIIKTIGCGLYVFTLGLIAVVVNGLLFMLTSWIAGQFDLGFHVDHFWPSAVLGALLVGIVSWVLNMLVPDGGDDN

SEQ ID NO: 10597 - protein, 308 aa, Actinoplanes utahensis
MRPYGKGMSDERRGYLYGITAYVLWGFFPIYFKLLKPSPPLEILAHRIIWSVVFVALLLTAMRNWSFLGRILRTPRLLGGVTAAALLIGVNWATYIYGVNSSRVVEAALGYFITPLVVVLLGVTVQRERLHPWQWIAVGIGGLAVAILTVDYGRLPYIALILAASFGSYSLIKKRMSLPPAEGLFVESAVLALPALAYLTWLNLGHGAKFGHVSGVHTALMLFSGIATAVPLLLFAGAANRVPLVGLGILQYIAPILQLACGILIYHEPMPPARLAGFALVWLALIIFTAHGIHSARTTARQRATTRV

SEQ ID NO: 10598 - protein, 233 aa, Actinoplanes utahensis
MRCEDGHDDAAYVLGALSPAERAAYEQHLATCSFCREAVADLSRVPDMLDRLDADEFARLLDPSLLDQSPPARPFAAPAAERSHRATPPPRARTFPVRLLSTAAAVLLVMILGVGVTLWLMNRAEPGSAASGPAVAMAAVNNSSPISANIRLTGTAGGTKIEMVCRYAESEKPYTFGLIAYGPDDQSEQVGSWTAHPGAEFRMLANTHFTIEGLDRIDLVRFDGKIMLTYRPR

SEQ ID NO: 10599 - protein, 264 aa, Actinoplanes utahensis
MRDPLAEPSDLIRSVSRALRVLESVGRAPRGLTVKQIARRCELTVATTYHLVRTLAYEGYVIRREDGTYIVGLEIADRYRELVSAFRGPPAVGDALRRAALDTGYSHYLGRFVGGRIAVTASAEGARSPFLDDVAPGFDEGGHATALGKALLATLTPDQRGRYLRDYGMRAFTPTTLTTPEALEADLAAGERRGMQIEMGQFRQGLASAAVVVVADRDMERRLVLACSMPAAEMLTSARVVRAKLTAAARNVAEALSGGESATA

SEQ ID NO: 10600 - protein, 337 aa, Actinoplanes utahensis
MSTGELTLSSLGLDVDPAMDASVSAMLTAVEEALRVRVASADPLVTEAARHLADAGGKRLRPILVALGAQFGDPARPELIDAANVVELTHLATLYHDDVMDEAPVRRGTPSANARWGNSVAILVGDYLFAQAAELAAKLGTEAVHLQAQTFSRLVHGQIAETVGPRGTDPIQHYLQVIADKTGSLIATAARFGGLFSGARPELVEALAGYGELIGLVFQLSDDLLDIASESVQSGKTPGTDLREGVPTLPVLYALAGDDADPAAVRLRELLSAGPITDDALHAEALGLLRESAAMKQARETVRGYAEAARERLAPLPEGEAKRAMELLCDYMADRTN

SEQ ID NO: 10601 - protein, 831 aa, Actinoplanes utahensis
MGQRRTHLRLRGARQGRAVDQHGHRPLAVPRLLRGVRDQGAVLPVPHLAAGLRCGRPGRCGRPAGRRDGQGRHVRHPAVLPPAVPRGVPLVRAGRPGHRGDRDHLRGPARGRSERPEAARVIHLDRALRIHRHRHLRLHHPGWHRLGAVHGQPRSGHRPAVHRGRHVRGPPRIVAGQRLRRGRQAGPGAGRGAVLRRSGLTGPARHGAVRQRIPGAARHVQHAQGVRGGRHRRHRAGRGVRALDDPADHPGHAQPGPRGEAGHADRPHPAGEGRGRPADRAPAGARLLPEAGHRRDQPGGADDTAARRRHAGPGPGGRGRKGWPMKLPPIDYGALAPMLILFGVACLGVLLEVLVPRRSRNVVQLSLALLGVAAALTVLVIHRNDRLVTIGGAVAIDGPTVFLQGAILLLGAVSLFLIGERSVEAGGAFVAQAAVVVGSDKDSRQSAGQPGLTEVYPLATFALGGMLLFVAANDLLTMFVALEVFSLPLYLLCALARRRRLLSQEAALKYFLLGSYASAFFLFGVALLYGFAGGVQLSVIHQAVVSPQRDQLLLYGGLGLVAIGLLFKSALAPFHVWTPDVYQGAPTPVTAFMAACTKVAAFGALLRVFYVAFEGVRWDFQPVLGAVAVLTMFIGAILAVTQTDMKRLLAYSSIANAGYLMVGVLALNEDGLSSTMFYLVAYGFSVIAAFAIVSLVRDADGEATHLSRWAGIGRKSPLLAGVFTLVLLAFAGIPLTSGFTAKFAVFAAATAGGQTWLVIFGVISSMLIAFPYVRVIVLMWQSEPSENTPSVSIPGFLTSAALGLGVLVTVALGVVPGALIDLTRDAAQFVR

SEQ ID NO: 10602 - protein, 635 aa, Actinoplanes utahensis
MEHTYAPATGVLSGIWLLVAIPLVSSAILLLLGRRADRWGHWLGVLAVAASFVLGLIFFIKLGGLAAEQRSAELSLFDFIDVGSLKVDFGLLFDPLAGVFVLLITGVGSLIHLYAVGYMEHDPGRRRFFGYFNLFVAAMLLLVLGNNYVMLYFGWEGVGVASYLLISFWYTRPSAATAGKKAFLMNRVGDAGLAIGVFLMFTTVGGTQYSTVFGRIGSLGSTTVLIMGLLLLLGACGKSGQFPLQAWLPDAMEGPTPVSALIHAATMVTAGVYLIARSNPIFSANDTLQLVVVSVGALTLLIGCIIGTAKDDIKRVLAWSTVSQIGYMFLGVGLGGAAYALAIIHLLAHGFFKANMFLGAGSVMHGMHDQVDIRRFGGLSKYMKTTWLTFMMGWLAIIGIPPLSGFFTKEPIIAAAFDRPGWTGWLFGGAAMLGAGLTAFYMTRLFVLTFHGPQRYTEENTHPHESPAIMTIPLILLALGSVVAGWVMSTTVVDWLNPVFGEQPEHTEKLWITLLSILLTLIGAGLAWARFRRGTEPAPEPAGVVVTAARRNLYTDAFNEAVFERPGIYLTRALVYLDGRGIDGLVNGLAAAVGGGSGRLRRLQTGFVRSYALSMLTGAMLLVGAFLAIQLGWLA

SEQ ID NO: 10603 - protein, 99 aa, Actinoplanes utahensis
MTPDYYLILAVILFTVGAAGVLVRRNAIVLFMCIELMLNAANLALVTFSRINGGLDGQIISFFVMVVAAAEVVVGLAIIMSIFRTRRSASVDDANLLKY

SEQ ID NO: 10604 - protein, 247 aa, Actinoplanes utahensis
MTHVSTGEQIAFWILGPLAVLGALGMVLARNAVHSALCLVVTMLNLGILYVVNQAPFLGFVQIIVYTGAIMMLFLFVLMLVGRDASDSLIETLRGQRVAAILLGLGFALLVGTGLGRALNHTPTVGLDQANQKGNVQGLAALLFTRYVFAFEVTSALLITAAVGAMILAHVEVAKGDKADQVTRMKERFRPGNYPGPKPGPGVYANTMSVAAPARLPDGNGTENSISPILPVRELTASEVAPKGTEK

SEQ ID NO: 10605 - protein, 186 aa, Actinoplanes utahensis
MNTFTGSFKGFGVTFAHMFRKVVTTDYPFTPPKPAPRYHGRHILNRHPDGLEKCIGCELCAWACPADAIYVEGGDNTDEQRFSPGERFAKIYQINYTRCIFCGLCIEACPTRSLTMSNEYELARDSRQDLIFTKEQLLAPLLPGMEQPPHPMRLGETDKDYYVGALTNPGTSAGAEKAPLHRGDEQ

SEQ ID NO: 10606 - protein, 455 aa, Actinoplanes utahensis
MIELLAAHATDPAPESFGQDVWWIALIKLVGLFALLLILTLFTINYERKVVARMAVRPGPNQVGFRGYLTSLSDGLKLPFKEEIIPRTADKVVYFIAPVISATTAFTAFSVIPFGGVVTMFGHRTALQLTDVPVSVLVLLACSSMSVYGVVLAGWASGSTYPLLGGLRSSAQMISYEVAMGLSIVAVFMTAGTMSTSQIVAAQASGQPVVLFGWHVTAPGWYCVLLLPSFLVYMISAVGETNRAPFDLPEAESELVGGFHTEYSSFKFALFFLAEYINMITVSAFCTTLFLGGWRAPWPITAVWHGANSGYWALLWFFLKVFTLLFGFIWLRATLPRMRYDQFMRFGWKVLIPVNLVWILALAFWKVIRHGLISDTVKFSTVGVLVVIILVAAYAWPSAEKPRQLSLEEELARRPPGSFPVPPIDLQVPPSPRARRAVAERAPAAVGGDSESKEV

SEQ ID NO: 10607 - protein, 831 aa, Actinoplanes utahensis
MTDVAKRADTVKLTIDGVEVVAEKGELLIRVAERMGIAIPRFCDHPLLAPAGACRQCLVEVEGQRKPIASCTQTVADGMVVKTQLSSPVAAKAQAGVMELLLINHPLDCPTCDKGGECPLQNQAMSTGRADSRFHEHKREYEKPIHISSQVLLDRERCVLCQRCTRFSEEIAGDKFIDLMDRSSGEQINVYRDDFFGGAGTGDGQVGEGAGDVAFNSYFSGNTIQICPVGALTGEQYRFRARPFDLVSSPTACEHCAAGCSMRADHRRGKVLRRLAGDDPAVNEEWNCDKGRWGFRYATATDRITTPLIRDARTGQLREASWSEALVTAAEGLKAARERGVGVLTGGRLTVEDAYAYAKFARIVLGTNDIDFRARPVRASGSPAEITEEADFLAAAVAGVSDLSYADVEAAPSILIVGLEPEEECPILFLRLRKASRRQLRVTAVAPHLTRGFEKLGATLVAAVPGDEARLLNTDPTVAAALSAPGSLLLVGERLATVPGGLSAAAALAARTGARLAWVPRRAGDRGAVDAGCLPNLLPGGRPVGDTSSRAELSLSWSVDAGVLPSRPGRDVDAIIAAAADGTLGGLLVGAVDPGDLTDPALAERALDAVPFLVSLELRHSAVTARADVVLPVAPAVEKSGTYMDWEGRLRSFGTVLRGSTAMTDGRVLEAIAALLDVTLNTGDVQAVRRELGAMPAGQARPALPSVAAEAVADPGERSAVLATWHQLIDLGTLLDGDDVLAGTARPPVVRLGKELAEQLRVADGDLLTVRTDRGSVTLPAAIADLPRQVVWLPTNSPGSTVRRSLGVTAGAVVRLSAGLPGPILAEGVDR

SEQ ID NO: 10608 - protein, 438 aa, Actinoplanes utahensis
MTQPRPEVLQKLTPVLTKRWLSPDAWQIGVYERLDGYQAVRKALDVHPDDVIQLIKDSGLRGRGGAGFPTGLKWGFIPQGDGKPHYLVINADEGEPGTCKDLPLMTYDPHSLVEGAIIASYAIRANRAFIYIRGEAVHAARRLRNAVREAYAAGYLGTDILGSGYDLDLVVHSGAGAYICGEETALLDSLEGFRGQPRLRPPFPAIAGLYASPTVVNNVGTIASVPYIVLGGADWWKSMGTEKSAGPMIYSLSGRVVNPGQYECGLGITLRELIELAGGMQPGHELKFWTPGGSSTPILTAEHIDTPMDFEGVAAAGSILGTTAMQIFSDQDCPVYNTWRWLEFYHHESCGKCTPCREGNYWMVRTYRRILAGQGTYADLDTLQDTADNIFGRSFCGLGDGAATPVVSTLKWFRDDYLGYIEGRTAPRLSEKSLVGAH

SEQ ID NO: 10609 - protein, 372 aa, Actinoplanes utahensis
MTELAGRLRRNTEASEKQVEFTPAAAPLAEKLLGSAQEILARYPAGRERSALLPLLHLVQTEEGHVSPAGVAFCAEVLGINKAQVGAVATFYTMYKRRPTGEYLVSVCTNTLCNVLGGQAVYDRLTEHLGVGHDETTADGRITLEHAECLAACDYAPVVTVNYDFTVDQATPDSAVELVDSLRNGERPTPSRGARICSLREMQYQLAGFADPRDGAVGDGVAGAPTLRGVRLAQEHGIAVAGFDPETPITRTKPAREGDAQPKPAPDGKAEKPGRVASVVHAATTAVKAVAGKVEERRHAGHTTEDPQVRTAALRNPTASEPAGAAASAGGPPPENAAETAGAAANAPAGDGKPAGDSPRTPDPTRGTEEEK

SEQ ID NO: 10610 - protein, 441 aa, Actinoplanes utahensis
MTTSEYASARETTEGRVFTVTGGDWDSVTSGIDPLSNEKIVVNMGPQHPSTHGVLRLVLELEGETVTEARPVIGYLHTGIEKNLEYRTWTQGVTFVTRMDYLSNMSNEAAYCLAVEKLLGITDQITERATTIRVLFMELQRIASHLVWLATTGMELGAISMMLYGFREREYILDIFEETSGLRMNNGYIRPGGLSQDLPDSAVKKIRDFLVYLPKKLKEYEAMLSGQVIWQKRTQGVAVLDVTGCLALGITGPVLRSAGLPWDLRKTMPYCGYETYEFDVPTATTGDVWGRYLVRLAEIKESLKIVEQALDRLKPGPIWVADKKIAWPSQLALGVDGLGNSLEHVAKIMGQSMESLIHHFKLVTEGFRVPPGQVYVAVEHPRGELGVHAVSDGGTHPYRVHYREPSFVNLQAIPAMAEGALLADVIAGGASLDPVMGGCDR

SEQ ID NO: 10611 - protein, 239 aa, Actinoplanes utahensis
MSIQPGTDGNVPVTATTGANLDAPAQTPPSPDKGMFGVKGTGDVSGFGRLVRPRPAVFDSPRPYGGYFDDVYDALEEAYPAFSEAIEKVVVDRAELTLHIRAERITDVCQVMRDDDSLRFELCSSVDAVDYLGSDERRFHIAYQLTSMTYRRRVRLEVSVADGVPVPSVTGIYPTADWQEREVYDMFGVVFAGHPNLTRILMPDDWEGHPQRKDYPLGGVPVEYKGAEIPPPDQRRVYQ

SEQ ID NO: 10612 - protein, 222 aa, Actinoplanes utahensis
MGIEEKLPSGILLTSVEKLSNWARKSSFWGATFGLACCAIEMMAAGGPHYDLGRWGMEVFRASPRQADLMIVAGRVSQKMAPVVRQIYDQMPEPRSVISMGVCASSGGMFNNYAIVQGVDHIVPVDIYLPGCPPRPEMLIDAILKMREKVMAQPLGPNGRKMLEQRRAEGKLPLVAPGAMPSSYRVDKARRAEWTQAVKEGREEQLRIENWMKLQPHLREGK

SEQ ID NO: 10613 - protein, 121 aa, Actinoplanes utahensis
MTINPYVPIVGLLILGALFALFSVSVAPIVGPKRYNRAKMDAYECGIEPAPQPVGGGRFPVKFYLTAMLFIVFDIETIFLYPWAVSFEALGLFGFVEMVLFIVTVFIAYTYVWRRGGLNWD

SEQ ID NO: 10614 - protein, 428 aa, Actinoplanes utahensis
MNEPLPVAGEADVIVVGAGPGGSAAAYHLARHGHRVLLLEKTEFPREKVCGDGLTPRAVRQLVRMGIDTSEKAGWLQNRGLRVIGGGVRLELDWPELASFPSYGLVRTRLDFDDMLAERAVEAGALLRTNVNVGGPVLNDEGYVIGVQAKVGPEKEPVQFRAPLVIAADGVSGKFPLAMGLAKRDDRPLGVAVRRYYRSAVKADDNYLESWLELRSAQDPSRLLPGYGWIFGLGDGRVNAGLGILNSSSAFGRTNYKNMLTDWLGSTPQEWGLRGEENAEGPTLGAALPMGFNRVPHYTRGVLLVGDSGGMVNPMNGEGIAYAMESGELAAEVAAQALARPAGPERERALRAYPTELSLRFGGYYRLGGVFVKLIGNPQVMRLATKHGMPHPTLMRFVLKLLANLTDPRGGDAMDRIINGLTKVAPAV

SEQ ID NO: 10615 - protein, 86 aa, Actinoplanes utahensis
MTKLGQLEDTDIDIAIDEGEAGERRASELANRIRMVAAQDPLLAQDLVEELIVALDRAMDGTIRDHLEGPARGIAERVLGDSDPIQ

SEQ ID NO: 10616 - protein, 234 aa, Actinoplanes utahensis
MGRVTRADLDKQPHEVAEMFDGVAKRYDLTNTVLSFGQDRGWRRATRAALGLRPGERVLDVGAGTGISTDELGRSGAFAVGADLSVGMLQAGRAVRPVVPLLAGDALKLPFADATFDAVTISFALRNVVDTGAALREFGRVTRPGGRLVVCEFSTPTNPAFRTVYMQYLMRSLPVVARGVSSNPDAYVYLAESIRAWPDQAGLATRIAEAGPWDRVGWRNLTGGVVALHRAIRR

SEQ ID NO: 10617 - protein, 413 aa, Actinoplanes utahensis
MTANREIDSILQRGADGGRISPEEALLLYTEAPFHALGEAADTVRRRRYPDGIVTYLIDRNINYTNVCVTACKFCAFFRAPKHKEGWSHPTEEILRRCGEAVELGATQVMLQGGHHPDYGVEYYEELFSSVKQAFPQLAIHSIGPSEILHMAKVSQVSIEDAIVRIKAAGLDSIAGAGAEMLPDRPRQAIAPLKESGARWLEVMAVAHRNGLSSTATMMMGTGETNAERIEHIRMIRDVQDLAVANGYRDVPVEESHDVGGFRAFIPWTYQPENNHLKGRTQATTMEYLRFIAVSRLFFDNVAHLQASWLTTGKDIGQLSLHMGVDDLGSIMLEENVISSAGARHRSNLQELISMIRTADRIPAWRDTWYRHLAVHHTAAEDPTDDRVVSHFSSIAMPGGGAGRTPLPLVEVN

SEQ ID NO: 10618 - protein, 284 aa, Actinoplanes utahensis
MAVDLTRMAASPGRLAVRRTQYAVQEWSATPMAEARRTMDLLWFPEAVERKRGRRPGLSVARVVETGIALADAEGLEGVSMRRVATELGVVPMTLYTYVPDKATLLELMLDRVYLAMPRAELPGRSWRDRAAAIAEENRALVAAHPWVAAMPASRPPLGPGLMAKYEHELRAFDGCGLDDVTVDSALTFLLGFVQAAARAAAEVRATAERAHQTDWEWWQERGPALQVVLDEHTYPTAARVGAAAGAALGAAYDPDHAYEFGLRRVLDGLAALIDGEPAGDPGR

SEQ ID NO: 10619 - protein, 130 aa, Actinoplanes utahensis
MRVRSTAIALTVDDVPTSTKFLADHFGYTERMAADGFASLGRDHTGPDLIFMRRGLEVLPPTLRDVHTAGTIVAFVVDDLDAEQDRLRAEGVEPFLPIREEPWGERLLLVSDPNGVVYELVEWADPGSGR

SEQ ID NO: 10620 - protein, 1016 aa, Actinoplanes utahensis
MLVVHGGWAPGSGRPGRLLLWAEEPSRTESSSASRAKVRPHPFAATATVLTTALGDLPSEPTAGIATIQLPGTARGPLPSPDTGVETTSPRGVRLAGWTVPVLAVPGEAALAVLATIAEPDPAAPWVPGPSLRYLGLLAGWACDLARHGRMLPQLVLEEGVPAARWRSVITGADLATYRDFAAGMPPVARAVTPAGQAVTPAGQQAGRTLRDALETMLDAAARSVLPEKILGGHRAGLRAPLADRWVTALTAPDPTLPGAAAAELRELRRALDDWMRAAQAANEPVRVSFRLIEPEPGEDDWELEFALQSAEDSALYLPAEAVWAGERFPGLPRRPDETLLAGLGRAVRLFPALHEALRTQQPAAMTLDTAEAYDFLRQAAPLLQAAGFGVQLPSWAGRKGVGLKLTTRSKSRAGTSRAVADSGFGLSEIVAFRLDLVIGDGVVSAAELAELARLKVPLVRVRGQWVELDDRQLKAALKAVGRRREGELTAAEILQQVVEGGEEDLPLVEVDADGTLGDLLSGQASERLDPMPTPPGFQGALRPYQERGLSWLHFLSRLGLGGILADDMGLGKTAQTLSLLLTGQADETRPAERTLLICPMSLITNWRKEAARFAPSLRVYVHHGATRQRGEDFRAAVDAADLVLTTYGTAARDLEALREVEWSRVACDEAQAIKNHGTRQSQAVRAIPARTRLALTGTPVENHLAELWSIMDFCNPGLLGPAKRFRRRFQEPIEINQSEDATAALKRATGPFVLRRLKTDKTIISDLPEKNEMKVWCSLTAEQATLYQAVVEDMMSEIEGSEGIQRRGNVLAAMMKLKQVCNHPAHLLKDGSRLPDRSGKLARLEELAEEIVEDGDKALVFTQYAEWGSLLQPYLAAHLDRPVLWLHGGLSKSRRDELVERFQTSPEPMLFLLSLKAAGTGLNLTAANHVVHFDRWWNPAVEDQATDRAFRIGQSRDVQVRKFICTGTLEEKIDAMIERKKALASAVVGTGEEWITDLSTDQLRELFALDPGVVG

SEQ ID NO: 10621 - protein, 278 aa, Actinoplanes utahensis
MPFDRSGKFYEAARPIEVDGGLAVRSKRGAIGEQWWSRRFVDVLEGICDPGRLARGRAYARKGQVIDFALQPGQLVARVQGSRPTPYQVTIRISAFDDAQWAEITEALGAQALYRAALLAGEMPREIVELFTDLGFPLFPESLDIDCSCPDWGVPCKHGSAALYVLAEAFDDDPFLVLAWRGRAREPLLDALRGTADPGEAIDPLQVTETPLDDRLADFYSPGISLGRLRERPARGGAPPELLLRALDPPPIRVRHIPLIDLLRPLYRELGTPHEEED

SEQ ID NO: 10622 - protein, 318 aa, Actinoplanes utahensis
MTEMSYRRLGESGLVVSVVGIGCNNFGRKLDADGTREVVDAAFDAGITLFDTADIYGTPHGSSEELLGAALKGRRDEVVLATKFGMDMAGLNGRDFGARGSRRYIVRAVEASLRRLETDYIDLYQLHEPDPATPIEETLSALDDLVRAGKVRYLGNSNFSGWQIADADWTARAADLTPFISAQNRYSLLHRDVEIEVVPACERFGLGLLPFFPLDSGLLSGKYRRGEKPAAGTRLAQDRYAPWLEHADWNRIDALTAFGAERGHSLLEVAIAGLAARPAVTSVIAGATTPDQVHANAAAAAWDLTAADVATLDEILTD

SEQ ID NO: 10623 - protein, 283 aa, Actinoplanes utahensis
MSDSVRRPRVGHIQFLNCLPIYWGLMRSGALLDVDLHKDTPDRLSAALIAGDLDIGPITLVEYLKHADQLLLLPDLAVGSDGPVLSVNLVSTRPPAELDKRPVALGSTSRTGVLLAQLLLSERYGVEPTYFRCPPDLPLMLREADAAALIGDPALRALYEAPAMGLQVIDLAEAWKEWTGLPMVFAVWAVRKDFAAAHPGQVKGVHEAFQRSKELCLGELDAVAEAAARWEPFDAATLANYFRALDFSLGDRQIQGVREFARRAADRGDVPALPAEGPLFADV

SEQ ID NO: 10624 - protein, 408 aa, Actinoplanes utahensis
MSFTSAESRWSDVHLVAGGKAISLCGDFLAATTLALVLQQTGHGGLAVAGLLLASAVPMAVLTPLTGRLVDRADSRTLLVTVGLAQALICGLLAFTTDSRLVIALVALLAAGLAVTQPTLQALLPQMVRDDDLAKAGGLVMSAGQVGTLIAPALAGFLVGTTGPRVPLLIDAASYLALVVMAMLIHTRRRGAVTRQEAGGPVEFRLRADRSLAVMTVAIAAVVGGVGAINVFEVFFIRDTLHASTTVFGLVTASWTVGMLLGGPLCARLPRHRLTVRTVLAVLAGSCLPILAAAAVGSWAWLVPLWIVGGVCNGALNVCMTVIIADRVPAAAHGRAFAGVAAVVQGAGLLGFLVAGPLVEAFDPRLLVGAAGGAGLLAALCCWPLVRLQPREAPSLGEPVVVGDTVTS

SEQ ID NO: 10625 - protein, 265 aa, Actinoplanes utahensis
MGAFGVELNIEIRRGHGHPRQVVAAAALAYPVVRMGRRRRGDARCGACSPRPSSGPPRYASPQRCPPNFRRYDNGGMAERENVRVSDARTLRALAHPARIEIVDHLNVSGATVTATEMAGLVGLSPSATSYHLRELAKYGLVEQAPSQGDGRERRWRATGKNLWLEAEVEQPEALAAERALIDMYLSRDRERIYEWLDRQGTETTEWREASVIMGQQLLVSAAELAKLNEQVRTLIEPYRVRDRQENPTDGARRVAVQYLAFPMD

SEQ ID NO: 10626 - protein, 288 aa, Actinoplanes utahensis
MPRLGVMFDRDLSPEDLPAFATAVEEAGADDLWVVEDLGWAGSISAAALALAATSRIRVGIGIAPAPLRSPALLAMELAMLARVQPGRLVAGIGHGVSEWMRQVGVEPTSKLAMLEETVRAVRGLLRGETVTLDGREVHIDGVRLVHPPAVVPPIVTGVVRPRSLELSGRVADGTIIAEGNGPAQLRDALTHIRRGGADDGHELIVFTYLHVNDDPADAARVTGQMVEGQAGWLGVPPEEVFSLIGPVTEVPGKVAALTGAGAATIVLRPLGPDPVPQVRAALAALGR

SEQ ID NO: 10627 - protein, 404 aa, Actinoplanes utahensis
MDDLLVALCGNPALPPALVDRLIGLAAENAAATAAATAGKNADVRAMVAGNPATPPETLVVLVANDPPAAVCRVCEQEPIPFRHDPDCLRGDCTLPPGARCTGSHESAVHNLRHRAVDNPSTPAGTVARLAVDPPLALRYALAARPDLPHWAAERLVTDPAPGVRHTLAENPGLAPDLIERLAGDPLAPVRQRLARNPALPLAVLARLTGTTRIGPVLLPRVAAATEAEVRDLAASADPELRMLVAVRRDLPDDVRDALAEDPDAKVVAAVAGHPGLAGAVLGRMVAVHGVRVNCQVAGNPDAPADLLRQLARGIPRVPKALREIARHPNADAATLELCLATVEPSDYRARAIAAGHPALPPGRIAALLADPDPRVAESAAGNPSLPVAAMIRLVSDRERPARP

SEQ ID NO: 10628 - protein, 492 aa, Actinoplanes utahensis
MPQSATRRSSTNEHPDPCGTRAEGSLHCGFVSLRGIAERFHPTRPLALTPVAVRGPDAVRPGVGVQHHRVRTGTAQRTEPLLGGGDQATTEPGAAAVRGDRQPVEVAPPAVPARDDRADDLVAVHGQDQRLRIPTHQRLDRRRGIRRPAVVLRRRRPEIQDPAPLGSLRRSQDHISHATTLGPRAARPAWRREVTDSVRAHSPLASGDRSSSSCRPALGWWMGDSFARAAVSGCDHAAMTAPSPSGPNWVDLATSDLDAAIRFYTSLFGWTADVSGDDFGGYTTFLLNGLPVAGAGPLYGEGQPTAWSTYLATADADRSAALVEAAAGKVLVAPFDVMDQGRMAAFLDPSGAPFSVWEPRSMRGAEVFDVPGALTWNELNTRDLDTARTFYGAVFGWTFRTAEVGGLPYLLCDNGRRPVAGIHPMTGDGWSDDISPYWLTYFATGDCDAAAEHAFALGGRIISPPTTIPIGRYAVLTDPQGATFALLTTARR

SEQ ID NO: 10629 - protein, 145 aa, Actinoplanes utahensis
MGDVILRAAQASEWSRILDFWASAAENDSRPADTPAAVEALVGRDPEALILAVDGDKIVGTIIAGWDGWRCHLYRLAVAPDRRRAGLGGRLIAAAEQRFRALGGTRADAMVLDANTGAHGIWAAYGYRSQREWSRWVKSLGDSTQ

SEQ ID NO: 10630 - protein, 89 aa, Actinoplanes utahensis
MTDTMVVELGLQAMTIAAKVAAPVLLTALAVGFAVSLFQSVTQIQEATLAFVPKAVAIGAMLLFSGNWMLHEMITYTGQLFDKIPDLLH

SEQ ID NO: 10631 - protein, 44 aa, Actinoplanes utahensis
MQTGRAPVAVRFAPRTFLKSAAPLPRDRQRARPAQERTATTSGP

SEQ ID NO: 10632 - protein, 263 aa, Actinoplanes utahensis
MSSPGRETAAIAVADLAVRRDGALIVDNITLSVGEGEWVTVIGPNGAGKSTALRAVAGLLPFTGSVRLYGSPVDRLHRRDRAKAIAVVMQNPVVPPAMTVFDYVLLGRTPYIPALGRESAADLAAVDEELAALDLVPFAGRRLDTLSGGERQRVFLARALAQGARILLLDEPTSALDIGHQQEVLELVDRLRAERALTVLATMHDLSTAGEYADRMVMLAGGRVVAAGTPTEVLTESNLAEHYRVRVRVIAGDHGPLVVAVRS

SEQ ID NO: 10633 - protein, 347 aa, Actinoplanes utahensis
MRPAGLRPAWLLAGVLSVLVAVTAGLAFGSVSLPPGGVAAELLNLIPGVRLHSGLSERDVAILMELRLPRVVLGLLVGAMLSLAGAAYQGAFRNPLADPHLLGVAAGAGLGVTAVLVLRPAGAAEAGLPIGVPAAAFAGALIAVALTWVLGAVGGRDRSPAALILAGVAVSAFLAAMQTYLLQRHVESLREVYSWLLGRLATAGWHDVLVVLPYTVLTAAIMLTQGRELDVLTVGDEEATSLGLHPQRSRYLLIVAASLGTAAAVSVSGLIGFVGIIVPHTLRLLAGPSYRSLLPLSVLFGAAFLTLTDLLARVAGGAAEIPIGVVTAFLGAPFFVVVLRTTRSAAT

SEQ ID NO: 10634 - protein, 309 aa, Actinoplanes utahensis
MKRAIIAATAAALLLTGCGDKADSTKEPAAAASSAGTGFPVTVGPLTLGARPEKIVSLSPTATEMLFAIGAGPQVTAVDDQSNHPAEAPKTDLSGFKPNAEAIAAKNPDLVVLSGDADQIVAQLGKLKIPTFVSPAAASLDDTYREIDELGSLTGHSGEATQLSQTMKTEIDQIVKGVPARTKPLSYFYELGPELYSATSKTFIGGVFHLFGMTNVADSADADGSKGGYPQLSAETLVKANPDTVFLADTKCCRQSADSVKARKGWASITAVQKGRIYPLDDDIASRWGPRTVDLVKAVADAVSKVPAS

SEQ ID NO: 10635 - protein, 137 aa, Actinoplanes utahensis
MSPAVKYTLGRIGLFLVVFAALFPLPLNILVKAMIAFVASAGFSFFVLRKWRDEMAEQLGASAQRRATEKARLRSALAGDDEAAAAGDRVAAADATSGGDRIADAAAAGSADTETAAAAGEIKTEGAKAEGRTEAGK

SEQ ID NO: 10636 - protein, 125 aa, Actinoplanes utahensis
MATVGDLLGAAFAGLVVGIAVVLVLEGILVLTGVSRFGQTNGWLILILPVWLFVEQFRAAGFGADRVLAAVLGIGFGAAAGMTIAGVVAPYAPPLVSGGAGAVTAAVVHCFVWFYGLRWLRQRSG

SEQ ID NO: 10637 - protein, 389 aa, Actinoplanes utahensis
MDAGLKRDLEAKVYAGERLTREDGIALYDSDDLAWLGRLAHHRRTELNGDRVMFNVNRHLNLTNVCSASCAYCSFQRKPGEKDAYTMRIDEAVRKAKEMEDEQLTELHIVNGLHPTLPWRYYPKVLRELKAALPNVKLKCFTATEVQWFEKISGLSASEILDELMDAGLESLTGGGAEIFDWEVRQHIVDHACHWEDWSRIHRLAHQKGMRTPATMLYGHIEEPRHRVDHVLRLRELQDETGGFAVFIPLRYQHDFHDSADGIVRNRIQARTTMAAPAESLKTFAVSRLLFDNVPHVKCFWVMHGLSVAQLSLNFGADDLDGSVVEYKITHDADSYGTPSTMHRDDLLHLIWDAGFQPVERNTRYEVVREYEKPVGLAERRSEPQKVWA

SEQ ID NO: 10638 - protein, 514 aa, Actinoplanes utahensis
MSKALRYGQDSSRSVHARLRPVTLSAAVAAALAALFQPIPAMAAPGDGQPISAGVPDSGSRPTQVGSLVLPNTPISTTPVSTIPGSATNKVLHQIEQGRIQVDQLGDQLLQLKADRDLAQGQVSTAQLKVSEAQTGLQSAQTDAVTAAGQAMQQAAAVPPGALDSGLLGLDQLARLQRGEKPTDATTAQHLESAEIAAQIAIDEQTLATEKYDGVLKQYEKLNATLTKKQAAQQKLEAAHKDELAAAESVANAADQALGAQYLGGASAGRGADPRAIQALQFALAQRGDPYVWSEEGPDAYDCSGLIFASYHSVGYPMVRVSRDQYWQTRNKVVDRYSLVPGDLLFFSYTNSWTGIHHVAMYAGNGMMVEAPRTGLNVRLVPVRWSQLFQATRVFGSVEGGTTGIPLGTADPEEPATGGGTNGGGHTGGGGATPSTKPTTKPSTGGSSTPTKKPRPPASSAPAKPSPTPGPSSSSPSTGTSTPAGGSSSGGTSSGGTSSGGTSSGGTSSGGTTS

SEQ ID NO: 10639 - protein, 208 aa, Actinoplanes utahensis
MSHGTPGNSDMTMPINLATAGSDMTMPVNLAASGTSDMTMPINLAAANADLTMPVNLAGANADLTMPVNLAGANADLTMPVHLAGANGDLTMPVNLAMATNIDSTMPVNYVPTQPGPAQRGSGQIYSTGGYPSIDMTMPVSDPSENSGSLTGHILAQGWHDAQVDQRRGNFKVIVAMLIVLGLLVTVSLVFVLTVGSSLSGMFKSFGG

SEQ ID NO: 10640 - protein, 659 aa, Actinoplanes utahensis
MTTFADPSTFPSVFESNSTETTEAVDTATAPAAEQEQSAAAAEQEQAAAATEQEQATEPATAEQAAAEPAAIAEEQAAEQAEEPAAEQAPVLTFADLGLPAEIVRVLTREGITTPFEIQAATVPDALAGRDVLGRGQTGSGKTLAFGLPVLARTAQGGKARPHHPKALILVPTRELAMQVADSLMPVGRAVGVFLKTAVGGVPYDRQMDALRRGVEVIVATPGRLADLIERGACKLDDVEITVLDEADQMADMGFLPEVTDLLSKTPENAQRLLFSATLDGDVDALVQRFMHDPVTHSTAPAEASVSTMDHHLLLIPPAEKFPITSWIANRAGKTIVFARTQMGVDRLVEQLHAVGVRAGALHGGKTQRVRTRTLAEFKEGRTNVLVATDVAARGIHVDGVSLVVHVDPPKDPKDYLHRAGRTARAGESGAVVTLVLPKQRRTTQQMMAKAGVSPAEVRVRIGDEKLAAITGAQEPSGVPVVEEPEPRRERSGGGRRFGGGDRGDRPRYGDRPQRSYGDRNDRFGDRPAGGGYRGDRPTGGGYRGDRPADGGYRGDRPAEGGYRGDRPADGGYRGDRPNRERGGFGDRTDRPAADRGGFNDRDRPRADRPFGERTDRHFADRPARTGDRPSGQRRDGQRIDRREGGPGRFNSSRPARSH

SEQ ID NO: 10641 - protein, 213 aa, Actinoplanes utahensis
MGVLSTGLFWERRDVPGSEHVRLDARNGLYAQGTALAAAPIGYACHYEIQTDPGWATARLDVRAEGAGWARGVRLELAAGRWRVTTSEQGDLDAALLAAGHARAGLPGIEDPDLLYGAFDADLGGSPLTNTLPIRRLGLLSGESVSHRLSVAWVLVPSLEVVQADQIYTPLGEGRIRFASETFSADLTVDDDGFVTDYPGLARRVVTPARGSS

SEQ ID NO: 10642 - protein, 464 aa, Actinoplanes utahensis
MEEASHPVAPPLESPAVAPFGSLDGPVLGPWEGPALAPTRQRRTAFLAAVTAVVLAVAAAGAVLLWPSSDKPAKATATTRPSRPPTPFEEALALLQGQATALERGDQEGWLAPLNPANTRMVDRYRTIFTNLRALELSHAEFHATRVPDQGNDSTIVAEVQLAYCLSGVACPSWRKFSFTEGPPEAAYRVTFTRVAGVFQIVAMTEKIASEDNDLQPAPWDGRELTVVKGSRVIVAGPANQAKLISQVLPMAEKAAKVVDRYAGYIHTEQRRYRIYIADEQGWKTWYGGGNQKWVVGYEIPLNATGGDVILRAKVSGDFSALAVTIQHELTHVVTVAEGYHGDHDEQWLVEGIAEYIGALPKKPQDTINHLVLKDSFARRGVPKSIAYPALARNADDLTVDTLYAMGHYATACMAAQYGEPKLLQFTSQVLRDGKAPDEAAQATYGKPFAAVDKACLSWIRERV

SEQ ID NO: 10643 - protein, 149 aa, Actinoplanes utahensis
MDSIDLRLIDLLRENARSSYAELARKVGLSAPAVHERVGKLEAAGTIRGYRADVDHEAVGLGVTALIGIVEDSGADTDDVLAAVRAMPEVESCYFMAGVESYQLIVRVGTIAELEQLIVRINRTPGVASTRTAIALSTKWENRPQPGVG

SEQ ID NO: 10644 - protein, 91 aa, Actinoplanes utahensis
MDTGDRLLTPGEVAALFRVDPKTVTRWAAAGRIGSIRTPGGHRRFRESEVKALLEGDGVIEEMREDDAANKPRNSGPANPGAGYGPPNGLR

SEQ ID NO: 10645 - protein, 205 aa, Actinoplanes utahensis
MRQPWIVGVSGASGTPYARAVLTALLDAGEAVDLVVSRAARLTLLDETGATIRDAHWKDDVAAWLGRDLGDLTYWPAGDLAAGPSSGSYPARGMAVVPASTAACAGIAVGLSKDLLQRAAEVNLKERRRTVIVPRETPVTRSHLEHLIALHDAGAVVLPASPGFYGSGADATAQQLIDFIAGKVLDSLGVEHTLMRRWNGRLGER

SEQ ID NO: 10646 - protein, 296 aa, Actinoplanes utahensis
MTAVAPEKPGKVKAFLRLVMIEHSVFALPFAYLSALVAIDRDGTGRHWLDLVLVTVAMVSGRTFAMAANRILDRRIDALNPRTQNRELVTGAVSVRTAWTGAIVSLVVLILAAGLLNPLCLVLSPLAVIPLVIYPYAKRFTDFPHYVLALAQAVAPVGAWLAITGTFHGSGPAWVLGVAVGLWIGGFDIIYACQDVEVDRRIGVHSTPARFGVPVALHISTVTHVVTFALFVLFGQLVGLGWLWWIGLALTAGGLIYQHVVVTPTDLSKVNRAFFTANGFIGIALFVFAVLDLAVL

SEQ ID NO: 10647 - protein, 584 aa, Actinoplanes utahensis
MLTRTADSRTLARQAPGAEREAGAEGGRVEGGPATPQTGSRPGRAEFAGLATASAATSPASAHQRATLRSVTTPQRESQITSDGPREPAARSGARLVRMASRGFPYADLQSFLAALEKAGELRRVTVPVDPTLEISEVVTRTVRSNGPALVFERPTRGEMPIAINLFGTEKRMAMALGVESLDEIGDRIGALIKPELPVGWSGIREGMGKVLQLKSLPPRKVKTAPCQEVVLKGDEVDLGKLPGLQVWPGDGGIFHNFGLTHTKHPETGKRNLGLYRLQQHSKNTLGMHWQIHKDSTAHHAVAERLGQRLPVAVAIGADPVVCYAASAPLPGDIDEYMFAGFLRGERVEMVDCVTVPLQVPANAQVILEGYLEPGERLPEGPFGDHTGYYTPVEPFPVLHIECMTMRRKPIYHSIVTSQPPQEDHGLGKATERIFLPLTKLLIPDIVDYDMPAAGVFHNCLIVSIRKRYPKHAQKVMNAVWGAHLMSLTKLIVVVDEDCDVHDYAEVAFRAFGNVDYARDLLLTEGPVDHLDHASYQQFWGGKAGVDATRKLPAEGYGRGWPEEMVMSPEVTSLVDKRWKEYGI

SEQ ID NO: 10648 - protein, 218 aa, Actinoplanes utahensis
MSKPPGFTPSGYHHLGAATSAEWSGVSGRFGVVDTTIRPGTYDFIASRFMVKRDLGKGNIAWLEAGWSETGWASAGRPHIYTYNTNTKAWQFYDQYPVKPGDTVWLDLHTDSDGVWQAWLWWSNRWNLLTAQKLPIGGSAFVEQYVEVHVDDTKPGRVDVPPVKVDNVQLRPAGGGPPRFWREDVGTLTGVAPGLQQTSGGYCLNWVTRFDTWDAGDC

SEQ ID NO: 10649 - protein, 324 aa, Actinoplanes utahensis
MGQLSNQLMALTVLAYLTAMVCYAGEYAFGRRSLIGKAAARPARQLVGAGAAAPVAADVPPVVATPVRRDRGELSGRIGAAVNVLALVLHAATLVARGIAADRMPWGNMYEYILSATFVGSTVWVGVLLRRPALRHLGLFASLALVVLLGAADMVAYTPPAPLVPALHSYWFFVHVTTIIISSGIFLIGAVPAAMFLVKNGYDEGSRRFPYTLGKRVPTSAVALERLTFRLHAFAFPLFTFGALIAGPLWAEASWGRYWGWDPKEVWAFISWVVYAAYLHARATPSVKRTWATWIAILGFVTMLMNLFGVNLFFEGLHSYANAR

SEQ ID NO: 10650 - protein, 535 aa, Actinoplanes utahensis
MTVLEERPEAGEVPPPRRVNPVWALLRNSWRQLTSMRTALVLLFLLAVAAIPGSYFPQTSVNRERVSQYYTAHPQLAPWIDRFGGFDVFASAWFAAIYLLLFTSLIGCVLPRLRDHARALRTVPPEAPRRLERLPQHTPARPHAAAPAEAAAELSRTLRRKLYRTRVRELPDGGFAVSGEKGYLKETGNLLFHFALLSVLIGVGFGHWYGWHGNRLLVAGEDQGFCDSITQYDDSALGPRVTAADLPQFCLRMTRFNATYQSTGQPKSFLATVEVKEGSGAYRPATFTVNDPLRLHHANVHLIGQGYAPVLRYTDRYGVSQTKVVPFLPTDAMQTSEGVAQFPDVNIDPKTNQRDEQLQVGFEGVYLPTGGTDGSAVSKYPAENSPVLFLAAYRGNLGLDVGKPGSVYALDRGQITNGELKKVSGDRPHTLHPGETWTLDDGTRLEFLGTRQFATLAIRYDPTQSLLLVGAVLGLIGLMLSLFVHRRRVWFRVLPAIDQEAGGSVVEAGGLPRTDYPGFEAEFAALTRPAEEGTP

SEQ ID NO: 10651 - protein, 262 aa, Actinoplanes utahensis
MGSAFSDAAASGPLVLAIGAAAVAGLVSILSPCVLPLVPGYLSYVTGLAGSDLEVATGAATATKTRTVALKGRVLAGSGLFVLGFATVFTLLASLVANIGIALKTHEQTLNLVLGVLVILLGLGYLGVIPGLQREARVSKLPAAGLIGAPIFGAIFALSWLPCVGPTLGAVLALATTSGQTDRAVILALAYSLGLGLPFVLFGLFFRKLLGVFQAIRRNSRWVTRIGGVLLIAVGVTLVSGQWNHFLIWLLTTFDFGGGTLL

SEQ ID NO: 10652 - protein, 185 aa, Actinoplanes utahensis
MRRLLAAALAATAAAGALAGCGSGKNWAQDCTTTNGVVECDTAHRPQVGDVSGELLDGGAYNVADDRGKVVVVNFWGSWCAPCRAEAADLEKTYQATKARNVTFLGINSRDDRDSAKAFEKGRVTYPSIYDYEGSVALKFDVTQTSTPATLILDRQGRIAAAIRRSTTAGELQPLVERVAAEGNG

SEQ ID NO: 10653 - protein, 218 aa, Actinoplanes utahensis
MSESTRTTVHVFRHGEVFNPTKILYGRLPDFHLSELGHQMAKAAAQALSGRDVTHVVASPLERAQETAAPISAEFKLETASDVRLIESANFFEGKRVSVGDGAFSNPRHWWVLRDPITPSWGEPYLEIAKRMFEALQAARVAAEGHEAVCVSHQLPIWTLRRYVEGKRLWHDPRKRQCGLASLTSFRFEGAKVVGIDYTEPAAHLVALSATAKTAKGA

SEQ ID NO: 10654 - protein, 443 aa, Actinoplanes utahensis
MTTTYPTADLPYPEDAPVSQALFDRARTIIPGGVNSPVRAFRAVGGTPRFMASGSGPWLTDVDGRRYVDLVCSWGPLIHGHAHPEIVAAVQRAAALGTSFGTPTGGEVDLAEEIVRRTAIDEVRLVNSGTEATMTAIRLARGYTGRSKVVKFAGCYHGHVDALLAAAGSGVATLGLPDSPGVTGAAAAETIVLPYNDIDAVTAAFAQDGGEIAAIITEAAPGNMGVVVPRDGFNQKLAEIAHANGALLIVDEVMTGFRVSAGGWTGLHPVDADLFTFGKVMGGGLPAAAFGGRREIMSRLAPAGPVYQAGTLSGNPLACAAGLASLRLADADVYKRLDELATTIGQLASTALSAAGVAHRLSYAGNMFSIFFTETEVVDYDTARTQDAAAFKAFFHTMLARGVYLPPSAFESWFVSTAIDDAALEQIATALPHAARAAAGSPS

SEQ ID NO: 10655 - protein, 108 aa, Actinoplanes utahensis
MERPELSITVHRAPDEVSIQLAGEIDVLTVTELAALVNEVLAAEPPGRIVLDMAGVTFCDSQGLGTLVVLSRKAQHNQTVLALANVGDFLMRVLDITGLRSALMISTS

SEQ ID NO: 10656 - protein, 239 aa, Actinoplanes utahensis
MTLTEDELRAVLRAQVRAHRPDRAAILDRVTGTATRDRAARRRAPRVRIAGATAAVAAVIGGGGFAQWALAGGTGPDRPAPPPPSSFPTVPPSSPPPRPSHQPGRPASAAPAATPVLRAAGTVEVGGRTRASGVVTIRATGRLTALRVTIRVAKTPGLVARDGSQQVPGASVTSDVTEEAGAVVYHFTLSSKDTLGPGTYTFFARYTFPAGGRDAGADTYSADATGGSGTSVRVSGTFG

SEQ ID NO: 10657 - protein, 167 aa, Actinoplanes utahensis
MRDAAYHAFFERHYDSLSRLAYLMIGDASAADDLAADTLTEVWRHWERVQAADDPAAYAHGILMNLARNWIRRRSRERLFSLEVLKRAPESDVPAVLDVRRALARLPHRRRACVVLRYAFDMSEREVAATLGISEGTVKSATSRGAKQLAEMLGGSLARIGGWEAAR

SEQ ID NO: 10658 - protein, 488 aa, Actinoplanes utahensis
MRHAHPDDAQAARRRRRRIITGVGAAGAAGAVTALVAVLVPNASASTMFSDDFENGVSAWSKSGGDWSVVTDGSKAYRQSKADSQLARVLAGETTWTDYSVSAKVKGISLGSGGLAGVAARVSSSSTMYRLVLTGAGRAELQAAKGSVVSVLASAAVSGVTTWHTLRIDASGSAVKGFVDGAAIGGGTGTLSAKGRIGLVTSRGSADFDDVAVGPAGAATGSPATSATPTRTATGTPTKTATAAPTKSATPTKSATTAPAASTTWPTPTGQKAVTSTIKVTSSLDGGNVRFFGSGALGTDSQSEDQGPLFELADGASLSNVILGDPAADGVHCLGSCTLTNVWWENVGEDAATFKGGTSAVYTVNGGGARGADDKVFQHNGGGTLTIKNFQVSDYGKLYRSCGNCKTQVKRSVIVQNVIATGKAKALVGINSNFGDTATLSNITVVGFPGLKVCDKFKGNSTGAEPTEAGSGADGLNCKFSDSDITFK

SEQ ID NO: 10659 - protein, 182 aa, Actinoplanes utahensis
MGERAKALLVDDRKDNLLALEAILQGLPVTAVAVESGEAALKQLLTDDFAVILLDAHMPNMDGFETASHIKRRERTRHVPILFLTAADRDAQLALRGYAVGAVDYLTKPFDPWVLRAKVSVFVELWTKNQQLKAQAEATKERDAQWLRLTETVDEAARVLRAGGDDAATEALALLEKARWGS

SEQ ID NO: 10660 - protein, 1465 aa, Actinoplanes utahensis
MTAAKEASVGGPDETVLFGELADALRRVRRGDLKVRLPRRGGAAGAVAEAFNEVVSLQERQNLDLRRISRIVGRDGRLTERLDEEGLDGSWADSVRSVNSLIDDLGRPTTEISRVVGAVAEGDLSQHMALEMDGRPLRGEFLRIGRTVNTMVDQLSSFADEVTRVAREVGTEGELGGQADVRGVAGTWKDLTDSVNLMASNLTHQVRSISQVATAMARGDLSQKITVSARGEVAELADTMNGLTDTLRLFAEQVTRVAREVGTEGKLGGQAEVPNVAGTWKDLTDSVNSMASNLTSQVRNIAQVSTAVAKGDLSQKITVAAQGEILELKDTVNTMVDQLSSFADEVTRVAREVGTEGRLGGQAQVRGVSGTWRDLTENVNQLAANLTAQVRNISQVSTAVAKGDLSQKITVDARGEIAELKNTVNTMVDQLSSFADEVTRVAREVGSEGKLGGQAQVKGVSGTWRDLTDNVNYMASNLTSQVRNIASVTTAVAKGDLGQKITVDARGEILELKSTVNTMVDQLSSFADEVTRVAREVGTEGKLGGQAQVRGVAGTWRDLTDNVNSMASNLTSQVRNIAQVSTAVAKGDLSQKITVDAQGEILELKNTVNTMVDQLSSFADEVTRVAREVGSEGKLGGQAQVRGVAGTWRDLTDNVNYMASNLTAQVRNIASVTTAVAKGDLGQKITVDARGEILELKNTVNTMVDQLSSFADEVTRVAREVGSEGKLGGQAQVKGVSGTWRDLTDNVNQLASTLTIQLRAIAEVSTAVTRGDLTQSVAVEAQGEVAELKDNINQMIVTLRDTTKTNAEQGWLDSNLARIGGLLQGQRDVGEVCRMIMTEVTPLVDAQLGAFFLVDNEEAVIRLRLAASYGYVARDHEVTFGPGEGLVGQAAVSRRTIRVRATHDGILTMRSGLLAMPPNDLVVLPVLFEGEMLGVIEFASVAAFSGLHLTFLERLVATIGVALNTIQANRRTEELLSQSQRLAREMQDQSAELQRTNAELEDKAKLLSDQKANIELKNREIELARLGLEEKAQQLSRANTYKSEFLANMSHELRTPLNSLLLLARLLADNTERNLTGKQIEFARTIHSAGSDLLSLIDDILDLSKIEAGRMDVEPDVVDFDGIRSYVEQAFVPQAEEKGLRLEVELAPDLPDSIVTDPQRLQQILRNLLSNAVKFTDNGSVTLRIFAPSPESDDVPALVSARQVVAFAVRDTGIGISDEKLAIIFEPFQQADGTTTRKYGGTGLGLSISREFAALLGGTIAVRSVPGEGSTFTLYMPEALTPDTIPMPALPAATTKAVAARPATSLDLPLEMAPLGAPRQEEPAAVHPAGRQLDGATVLIVDDDVRNVFALTSALEMHGLHVLYSDNGVDGVRILNEHPEVDIVLMDAMMPDQDGYETTRGIRRNQRFRDLPVVFLTAKAMPGDRESALAAGASDYITKPVDLDELIALMARWVNAEESAEPENG

SEQ ID NO: 10661 - protein, 826 aa, Actinoplanes utahensis
MVGRPRSSISEFTERTLSAQEPSSPSSSRRSVSRPSRPTIRLIRRRSRFCRSCSETTSLKASATAPAAPPRRGRRTLRSPRRTRRRASASSPNRTVSSGPPTLASLAAVMLSSLAVHLPGYLSSLARPGQCERRLCAYTHPRERMHAVPAEVGTRTSVPSGAPTGTLVRKARLPNDRRTPAAARALVRSVLEEAGLDGLLNEALLLTTELSTNAVVHANTDLDIEVTADPAGLTVTVTDFAPGPVEQLAVGPRNESPDIGEVAERGRGLLLVDHFASRWGTVHEGDGKGVWFHLDHHAPDGGDGSRIPPPSDAPSLGALTALLRSGSDRQTDEGLTELAADLLSRLARLTGAAGGVLRVDRGDGMGRQLLARYGRAPRDNADTIRVPLTVHRPYSGELELDAAPVGYAQTLAVMVAERFSLHLENDRLRRADVRRATWITFLAEASELLAQSLDVNLTMALIPQLVVPRLGQWCAVHTTDAWGRLQLAAATHAEEATLAHLHASLAESGPESILARLEEASRLGTQVMFGAPLEGFAVPLVARGSRLGTLAVGRHVKHRHDADEVAVLEDVARRAALAIDNARIHDERRKVARTLQASLLPPALPHVEGIGFAAEYVPTGSEVGGDFYDVMPFGTDQWLVVVGDVSGKGVQAATVTGLVRDVIRILVDDGKSLTEILDRVNRTLVQRGGGRYCTLAMASVTRRPDGGLGVCLHLAGHDRAVLVRSEGKASFVGAGGTALGLLESITSPNVEVTLGPADSLIFYTDGVTERRRGRELFGSARLREAAAPLAGYPADAMAARLRSTTINFSVEEPRDDIAILVLRNDA

SEQ ID NO: 10662 - protein, 187 aa, Actinoplanes utahensis
MTTQYYTATTIDGYIADEHHSLDWLFEVDDGGDANPFGAFFADVGAFAMGATTYEWVLAHENVVAEPEKWLSPYGDTPAWIFTHRDLPRVPGANLTFVRGDVTAVHRQMAAAAGDKNIWLVGGGELVACFADAGLLDELILGVAPATLGAGAPLLPRRLTAKRLTLTSVSRLGQFANLRYSVGPPAS

SEQ ID NO: 10663 - protein, 204 aa, Actinoplanes utahensis
MAKTQYYTATSIDGYIADESNSLDWLFEVDEGTENPFGEFFAGVGAFAMGATTYEWVLKNDNLLEEPQNWHDMYGDVPCWVFTHRDLPPVPDANVFMISGDVRRVHEAMLVAAQGKNVWLAGGGNLVAQFAQQHLLDEIILGIAPAVLGTGTPMLRHKIGVDELILTGVREVGQFAYLTYAVGDVARMGRHLAAEAATLLPARF

SEQ ID NO: 10664 - protein, 288 aa, Actinoplanes utahensis
MWDHHGATATVAAGTSLAAVRVALALQGKRLAVDPPSPGATVGGMLAVNEAGPLAHRYGSPADQTLSVMYAEADGAELETDGENGRPGIANIRGVITAAVLRLHPLPETRRWVGRSVTTPAGVAELVEQAVEQDLEPSAIEVDLPGAAEGTVAVLIEGDTGSVAGRAAKLGQVWGPEAAVVEHGPPWWGRYPFGAGDVAVRISVPPEGLQAVTYALRDACGVPVPLRGSAGLGTVHAVLPAGLPARRLAEIVDGVDQVLMARSGKIVVVSAPPALAVALPMATPRDLF

SEQ ID NO: 10665 - protein, 707 aa, Actinoplanes utahensis
MCNELIPDRSTGNVVRVTTESPAGPPTARLAPSERTHHGDTVTDEYAWLMDKEDPATIAYLEAENAWTETATAHLADLREKVFQEIKGRTQETDLSVPSRKGGFWYYTRTEEGKQYGIQCRVPVRPGETDPPMGDDRPGEEVLLDGNLLAEGKDFFALGTFDVSPDGNWLAFSTDFDGAERFTLRVKDLRTGEVLADEIPDTFYGSAWSADGSVLFYITVDEAWRPDRVHRHFVGQPADRDAVVYHETDERFWVGVDLTRSEKFIVIDAQSKITSEVRVIPADTPDAEPVVIAERRQGVEYQIEHHGHRFLILHNRDAEDFAVAYTSVDAPGDWVELIPHQPGTRLESVDAFARHIVISLRRDGLTGLRVMGDGSTDAYDMDFPEPLYSVGLSGNPEYDTSAIRITYTSLVTPDSVYDVDLVTRSMTLRKQKPVLGGYDPAGYEQFREWATAPDGTRVPISIVARRGVPRNGSAPAVLYGYGSYEHSIDPYFSIARLSMLDRGVVFAIAHVRGGGEMGRRWYEDGKMLAKRNTFTDFVACAEALIRNRWTSADRLVARGGSAGGLLMGAVANLAPESFAGIVAEVPFVDPLTSILDPSLPLTVTEWEEWGNPLESAEVYAYMKSYSPYENVAKLPYSKILAVTSLNDTRVLYHEPAKWIARLRAVVPDGEFLLKTEMGAGHAGPSGRYDSWKEEAFVLAWILDTVGA

SEQ ID NO: 10666 - protein, 75 aa, Actinoplanes utahensis
MSVSVLTAATVVAVLAAGLAALQAHHAPSVPMLCIAVVLGTDVVALFLLLGLLRPAAPERPTSTEPMLTDLSAES

SEQ ID NO: 10667 - protein, 176 aa, Actinoplanes utahensis
MGPPGDRSIHVTGWDEGQLAAGFRSMVMLSALVERGGRPAPVAPTVRLRPAERQYGWFPADVDGDGRRVVVITSQRLIVGDREWSLRSITGVDSEPRDCTVSLRLRGRPAPLVLSGPWVPWLGVVICAELYQPVAQHGAQVPRQRGLVHPDLGLQRQRVVVPHPVHRGDRHPGATV

SEQ ID NO: 10668 - protein, 442 aa, Actinoplanes utahensis
MVGDRRAGHLVPDVRPARPHPAAVRHRPAVAAPAAVGLRAGGARRGEPGAARRPAPRRRPGQPGAGRGRLGAGGADRPGHPLAGVRALGRGAARPAGRPLAAAQALPQHGLPGRVLRHLAQQQRRLARRQHLRQHGEPARFPGAAPPARAQRGAAGRRPPPPLTPDIAGNHSPVPRDYGCMACERWREMLSAQLDGEDDPALRPLVDEHVSGCAGCRAWLDAAAAVNRMTSTGRMPDVPDLSASILAALPPSAPARPAPARWWRRLPVAALLYVSLALVGAVQIILGLAQIGGDSAAGHVHLGLSATPGHLWNESAAWNAAIGAGYLFIALRRTRPVGLVPMLTAFVAMLLLLSLNDLTGGRVDVARLVGHGFVIVGYLLVVVLSRGAGDTARPPGARAGAGWRLTGAAEDEPGIAAPHRPGLRLVPPTGPLTAHHDDQQAA

SEQ ID NO: 10669 - protein, 76 aa, Actinoplanes utahensis
MEQRKHWWNGKWGRLARKDVYLRTNGDQWYVEQRAGGSDGTSHFFEYDSEDAALDMVRALLNGPDEWRELSVRPPR

SEQ ID NO: 10670 - protein, 155 aa, Actinoplanes utahensis
MFQGFKDFIMRGNVVDLAVGVVIGSAFTAVVTSLTNGFLKPLIQVISGGNGMDAGSFKIRGVKFDYATFINSAITFLLTAAVLYFLVVYPLNVLAERRRRGEEPPPKSPSEEVKLLTEIRDALVAQAAAGRGNTQGQVYGSAVDEVLQRRQDPPR

SEQ ID NO: 10671 - protein, 117 aa, Actinoplanes utahensis
MSLTVQTEQRGDMVVVSVAGELDMATAPQLQDQISDLLEKGRTRLVFDLAEVSFCDSTGLSVFVRAKNSTDDAGGTVRLAAPQRGVLRILEVSGLVEVLHTYPTVDEAVTAEEPALD

SEQ ID NO: 10672 - protein, 286 aa, Actinoplanes utahensis
MALSPDESGRFADLLKEHADGLVARWAVLVGVSLQGRMSRPELERQTRDLHKGFQQALAAGAQDLGDEAAGELRAQLSELSSSRARQGFSATETAVSVFALKDAVLEVLGDAGDDAHTLRGYVAFSAFVDRAALFTFDAYVRVRESLIADQAEQLLELSTPVVKLWEGVVAVPLVGTLDSARAQVVMERLLQTLVDTGSPYAIIDITGVPAVDTQVAQHILKTVVAARLMGADCIISGIRPQIAQTIVALGIEFGDIATKSSLADALRYVLGRNSYKVVTAKRTER

SEQ ID NO: 10673 - protein, 141 aa, Actinoplanes utahensis
MERVPVLKIGDILLVSIQIDMEDQTALQLQEDLAERIVATGCHGVIIDISALDIVDSFVGRTLATIASVSRVLDAETVVVGMRPAVAITLVELGLSLPGIRTALNVELAIEMLAQSRAVTMGEFDDDEDEDEADQTAVTAP

SEQ ID NO: 10674 - protein, 134 aa, Actinoplanes utahensis
MNEESRRIPVTTDQDVVRVRQLVRTVSVEAKLSLVDQTKLVTAASELARNTLVYGGGGEVEVSRVRNDLRAGIRIVFSDQGPGIADLDLALTDGYTTGGGLGLGLSGARRLVDEFSIETAVGEGTTITVTKWCR

SEQ ID NO: 10675 - protein, 338 aa, Actinoplanes utahensis
MALVPEGLLDEGVWFRVEAAGTAAAVRRAAERLAAELAMPERRIADLSIVAAEMAGNLVKHAHQGTILVRTVRTAEQAGVELIAIDSGPGMSDVPHAFGDGHSTAGTLGIGLGAIQRQAGRWDLHSVPGRGTVLAVQVWPGVTPPPAWASGLTRPITGETVSGDAVAIREMDGRRQMLVCDGLGHGGLAAAASREAVRVFRETPATSPAAIVEALHRAMGHTRGAALAVADLDPATRQARYAGLGNIAGTIFSFEGTRRGMISMPGIAGHQRRQIREYEYPLPPDGFVLMHSDGVVDRWNPTDYPGLLTRSPELIAATVLRDAGTRRDDAGVLVARLP

SEQ ID NO: 10676 - protein, 449 aa, Actinoplanes utahensis
MTASEPLMRMRLRVEQDIFAVRQFGREVARAVGMESQDQTRLATALSEVGRVLLAAGTHADVTFTVEPYGVPSLQVTMAHSAPDSVSWLTGQLQQVGRLVDTMEVDDGGPGTTIRMARRLPVGAPFLTPDRMDEIRARLAQHVPGTPLDELGVQNQQLITALNEVRAQRDELARLNAELEETNRGVMALYHQLSDELEETNRGVVALYAELDEKSVQLRAASEAKSRFLANVSHELRAPVTAIIGLGRLITDSSSDDLTEEQSRQIELIRTSASDLLTLVNGLLDLAKAEAGRIEPNWSAVDLKAVFGQLRGTLRPLATRPEVRFVVDEPAVPTIHSDEVLLAQVLRNLLTNALKFTETGTVRLSVRRTGDDAEFTVSDTGTGIPHELQERIFEEFYQVPGSKPVSGRGTGLGLPYARRLAGILGGGLRVDSTPGEGSVFTLQLPIGPA

SEQ ID NO: 10677 - protein, 524 aa, Actinoplanes utahensis
MTELARVERLVQGHVKATVLVVDDSATKRYLLVSWLTRAGFTVIEAETGGEALRKLGEDLVEADLVVLDVKLPDMSGFEVCERIKTDQRYGVLPVIHVSAHAVDVNDRTQGLNRGADAYLVEPIEPDELIATVQAVLRYYRARQRAELLAARLVRLAETTLAINSASTLPALLEAAAVGAADIFGGPVVVVAETSEGESLAAAGPPLGVRKWAVPHHRVAVGSLVRTDEPADWDVVDWPAGESVAVAAARLRIDRPPVYLAVSGSTQTPGFPVLRQLSQAVAAAVEAQRSFDEEHRIAVTLQRSLLQSTLPRVPGVEMAVRYEPAGAQTEVGGDFYELTVLDGKLLVAIGDVAGHSLHAATVMAEVRHAVRAYAVEGHSPGAVLGLTNRFMRTVLPADSATLCLFTLDPATGRIRMASAGHLPPLLHVDGEVRFLSPRGALLGLDAPERTELELELPPGGTLVLYTDGLIERRDADIDEGLRALAACAADVEPDLDAFCSRLLTRLGGSGDQADDIAVVALRRA

SEQ ID NO: 10678 - protein, 1040 aa, Actinoplanes utahensis
MLVSRSISGDEPMSTAARRGLAAAGCIALSAAGLTALPVTPAHATVALPQPSEVSVVPAYPTRTDFPVDSLVLAGETGFLHQYGGSSWATSTWLWTRYADGSTRVVTELAGLTAPALAWAGGDRIWVKTDVAGHSDDRSLTIFDAAAGTWSNPTLPTDGTKLAYSAGTMLVRLGTAGPLELRKFAADGTYTTIPITGVPDGTAVSGGSGTVFDSTTFLVSFSGTTDGVKWQRLGLLDFTSGKVSLLPQFTFGTVNQILLSATHLGFRGGNTVRVFSRAAITAGTATDPAVITVPSVPYLTLVGGDMLVRASAADNRAPARLISADGSERTVLPMSQSNPYAMATAPGGALLVGGSGAADWAVQRITADGVQPVMSEVRTNFSAGITISRGQLRHVRAGARPFESPVYDFSNHELIPGLTGLPVTGPTMTGVTSCAADVTCVRTMDGNRYGTGWTSSTETTTTVRFADGASGGFSLVLAGGGGSLVDVSDDYAIVNTTSPAKQYVIPTANPDARTERAVTAAALDYATLWTAGAGQIRSKDLTTGKTAAPISIGAACTPSELQAAGRFVFWSCGVAGPAGVYDVPQRINHPLPAGRYLLGDGYAVRHDAATGRLISYDVTLRGAPKTAILGTLDRGTPADDRNITWAVDKYSGNVAYVDAAGAAHVIDPAVVERPPTVIRSTTSADVVYHDHDRPWVRQYTLSRPVASWRAEIAELHSGKVVMTLNGGASTGEVRLAWDGYLADKTPAPAGRYRVNLVVTTPDGVGHDIAGSPVYLDGERPRLHSYGLDGMPSMLSVDPQGNGAWWHAYADRRSLVYQYISEFWDLGTGNSQISALVPYGDINGDRNNDVLARTGNGVLWAHLGFGEDYFGSDRNRVVKIGTGWNRFDTLITTGDVTGDGITDLLARDARTGKVLRYAGNGTGGFTNGVPLSGSYQGFRLIGPGDVDGDGHADLLLIDGRGGLYAQYGTGTGTFGASTRIGSGFKAYNVVLGIGDLNLDGLNDLLARDASGKLYRFLGTDAGTFGAAERIGSGYQTYAGLF

SEQ ID NO: 10679 - protein, 763 aa, Actinoplanes utahensis
MPMTRRGLAATCCSLLALTGISVAAPASATVPLSNPHEVATIPADPPFEYREDHVAFAGRTGYLHSRANGGGTWQWTTYADHTTTTVTTLGRLYPGDFVSAGGDTVYVDADVDGHSEADTVSTLDLGTMTWQHRPRTADFRAVYGDTWYVRSSSATPALRHFAVDGSSIDVPMTGIPAGTASILAVRGDSTGMVIRFGGKPNTFGWQFGLLDLASGKVSPFGGNRATVASSVLLSAGRVALLDEGADTGTAEIFDRAAVLNGTAPASPEPIHLPLTQQYRLALAGNDVLASPEPRGGGVAPAVYRYSADGSHRTLFAQSQPGSGSLTQAEDGAVVVGGADSGDWGIHRITAAGDTRLADLSAKAGTTGVTISQGMVRRVQTVTWAGDQYTFLHLINHHLSEGIDRQVPVDGGRVGAFLCQPAAFCIRTVDGNRYGTSFAAGYSVLTMDSVARPSVDTDISGLTVNDAAVVDAGLEYVVSDFPRANVQVILRAGAGDTDVVQRPITGAALWFNTLWTGLPGKIQPTNVTTRVSSPAIPIGAACTPSELQATDRYVYWSCGTAGPAGVYDGVTKTSRQVPPAQYLLGDGYLVRHDAATGKLIRIDLRLRGTLGRSATLGTIPRGTLADDRNITWAVDKYSGDVAYVDAANTIHVIDTGVARSAPAVVGRPAGNLNPAAGQSSSWSFTLNRPVDVWTATITQNGVVVRTLTGGPADRTAQVTWDGLRADGRPAAAGRYQLTFAAVAGGVSGTPSTATVNVSAAASR

SEQ ID NO: 10680 - protein, 178 aa, Actinoplanes utahensis
MSTAHVLLGLLADGPRHGYELKRAHDDRLPLAKPLAFGQVYATLGRLERDGLVVRSGQDQESGPERTSFELTSLGRDRLAAWLTEVEPPAPHVTSTLFSKVVVALLAAGADRARDYLVAQRAAHMARMRELTSTKTMPGASVGDIVAADYAIGHLDADLRWLQTTLARVADLHKEVTA

SEQ ID NO: 10681 - protein, 228 aa, Actinoplanes utahensis
MSTPLLTGTGIVKSYGATPALRGVDVTVGAGEIVAITGPSGCGKSTLLHCLAGIIRPDAGSVVYRDQDLTLWSEASRSRLRRTEFGVLFQFGQLVPELTAAENVALPLLLAGSGRREARGAALGWLDRFGVAEVADKRPGAMSGGQQQRCAAARALVTEPAVIFADEPTGALDQLSGEQVMAAMVQVVREQGSAVVLVTHEAPIAAYADREIVLRDGAVDASGIGIFG

SEQ ID NO: 10682 - protein, 500 aa, Actinoplanes utahensis
MRAGTLVRLSLAGNRTDRLRTALTAGSGALAALALLAAATVAAIHGGEWVYDPADPARRSNLSPGSSQYSSALLAEHGLRPGVIFALVMLALPVLALAGQCIRLGAPARDRRLAALRLAGATPGETALVAGAETAAAGLLGSLAGYGLFLLLRVLLNRRTADGKLLLPTDVLPGPVATVLVLLLVPVLSGLIGTLLMRRVVVTPLGVVRQIRDDGPRPWPGVLIAVGLVLFAPRTLHLIPPGWHVPDWTPLVMMGASVLLVVIGVVLGTGWISYTTGRLLRRFGRGPVTLLAGARLMADPWNGSRTLGALLAAVVFGAGTLGYRADLAADFAARERFDQLTDPQYGRYGPAFDTGFYFGAIRLILVAVVLALVVASAGILVTFAEGITARRRTFAAMTAGGVPRGKLGAMLFWHTFAPLLPALLLALTAGVSLIRTMRTEVDVSEPGPAGDLAVVHMPIPLPLAQLTLLGAATLATMLLVTGAGLLVLRAGTDLEELRAG

SEQ ID NO: 10683 - protein, 240 aa, Actinoplanes utahensis
MTPPDPGSPPVMRLLTAAVVIGLGVRVVRSRHRRFLHPAGRSFAGTLEIWGGAEPLGATLLDTPAVHDVTVRVSKGAGTRGARVDIRGVAVRVGPADLLLSSTGRTALTKRLPVPRLSFDTVYGAITPYRTGTRKLYLEAVPDPDARPLGRALSSIPAGAALLLRADDRTVGRVALRHALPEATDAALAFDPIRNATPDLHPTGLIHGSRALAYRLSQRWRGATPPATDPAALARTVTHH

SEQ ID NO: 10684 - protein, 376 aa, Actinoplanes utahensis
MIKREMEDYVRARHIEEGFQYVGTPHITKEGLFHTSGHLPYYKDTMFPPLQMEGADYYLKAMNCPMHNLIFKSRGRSYRELPLRLFEFGSVYRYEKSGVVHGLTRVRGFAQDDSHSYVTAEGAADEVRHLLNFVLSLLRDFGMDDFYLELSTRDPKSDKFIGSDEQWAVATKVLEDVCIESGLDLVPDPGGAAFYGPKVSVQVKDAIGRTWQMSTIQYDFSQPAGFGLEYQAADGSRQEPVMIHSAKFGSIERFFGVLTEHYAGAFPAWLAPVQVVGIPIRDDHADYLSSFVERLRREGIRAEVDYSSDRMQKKIRTAQQQKIPFMAIAGDDDVNGGTVSFRYRDGSQRNGVTLDEAVAHVAEVVRSRVNTGPSAA

SEQ ID NO: 10685 - protein, 596 aa, Actinoplanes utahensis
MGRAGRRRRAGPGRAPALAGPDGGEPPPAGAGPAVRPAERRRGGPADPGAGRRAGPSAGRLRGRLDPAPQPVHRDTPAPAGRAGALRDQVRHPGHRRADDRRTGPYRTTLSGQPVRDRRAVRGQRPAGPGRGTVRAGRRGRLGPRCDRRLPGLRVPPAGRRPGRRRTVTAAAGRPGPRGRHRAVHMMTVLTSWWRANLPADPAGRRFVAGSLVDNLGSGVRDVILPLFLVQIAGLPVAEVGTGLLVSGLIGLLGAPFAGRAADRAGAKTALTLGCTLNAVVSCLLISIHSLAAMCLLLAVSRVATQFSRVGRLTILAHVAGERRNTLRAQINIFNNVGVAVGMGVSATALTLGTRSAYLAGFLLDAVTFLIAVAIQLPIRVDAIAGPAVTPPRAPAPWRHLFTDHRYAVATALNGLLCLHQAILFLGIPLWIAATHLVPRPVTAVLFLLNLTLVIALQVRFSAPVRGLAPAARSWRRSATGVAGACALMVAATRVDSTAVRVALVVGAGALLTLGELCYSAAETEISTVLAPAEHRGLYQGVFVLGRDAAQTAGPLVAALFCVSLHAWGWGLLLAGFALFAVLAPAAVRHPEPVSV

SEQ ID NO: 10686 - protein, 240 aa, Actinoplanes utahensis
MIQQLAPGTVSFARFDEAEYRRVLDEHGFVRAVDVPDGFDHAAFLSRFGRFRPGPSGKVIDDIVAEPGMDDVYYGSNRRALLPHTEGYEFAGLPPRYLALWCRTPAAGDGGQTTIFDSRPVLAGLSAAERDFLRRTTFDFVSSEGLRRHGLGQTNRHPMLETVDGIELLRFSCNNVRLGERDGPARSLIRRVLDAWDDGHVAVTYARNDLLHFDNWRVLHSRNAYTDPRRHLRRIQLDQV

SEQ ID NO: 10687 - protein, 303 aa, Actinoplanes utahensis
MTTAVTPPRAGLDRSVLIALAGVVQRRVLLTMTAMAALYAGALTLALRLDEPVVTVAATLALTMVMSGFIQAAHDCVHGSHLRSRRANRVMGAAWCTPILINFTNYRYQHLVHHRFTGVPGDTEPEKTFTGLGAYLYSMSGITLWRYNVITATRTWQHRFPASVTGHPDRRRASRQDNLVICLWVAVALTLTAIFPYAVLLGYWLPLLASTVVARFTGLTEHYGLWGVPDIERNTRTVRSNPVMRFFMWNANYHAEHHRFPAVPTLNLHRLHRALPEPHPLQAASYTAFHLRLIRHLTPGETS

SEQ ID NO: 10688 - protein, 135 aa, Actinoplanes utahensis
MSDAQERTWHDGRCHCGNVRFSVSLTSHLTVTLCNCGICHMSGHQELMLPEDFFRLHQGQEFLKPYRFGTMVADHTFCAVCGIMPFYRPRSHPTGYFSVNARCLDLSFAEHVEYAEFDGQNWEASIAAGRHKLTA

SEQ ID NO: 10689 - protein, 428 aa, Actinoplanes utahensis
MRRVIIVNIRADYAADIVHRLPSVTSCLRLIWMARPGDVVVVPAAVAPGFLAHIEATLGWPTGSVRVLSWPGILSDEVLTSDEFTAALRPLLDATGWTVAPCFVTEGTAALADRLGLPPAPGDTFAAQRGFELFNRKSHFRQIAAGAGLPLAAGSIARSPGALSRAIGRLLPETGRVIVKTDNAGGGSGNIVLTSDDSGPLPGARETRRIRGDLTGVGRRIWDELTDDGSRVVVAEAYHPAVRMFYFEYLIDEAGRARFLNSGSIRLEPAGDPDAPALSWIGLRIPADLPPFSLTEAATWAAAYAGHAARLGYRGHLNIDAMLTPDQRLIFNECNGRWGGGLVLHEVAERLLGPRYADRWLLTNLRDVPAVPPGSLPGLTGDGVIVLAADPDGGEPTECLLFAETPERLAAIEDTVRDAASRLTGTPV

SEQ ID NO: 10690 - protein, 405 aa, Actinoplanes utahensis
MTTVVVLEPQSSGLSLLRYGKAAGHRIVVLSRDAGDRRVPDDHRRYIDELIEVETNDQAAVDAALDRLPRIDAVVPGLEFHVGVAARAAARLGLPGLPVTTVDLVRDKHLMRAALDRAGLPAPRWAAVTSPREAVRAATAIGYPLVLKPADFCGSFHVTKVTDEVELTAAYRRMAADETRDFGRTAGARALVEEYLTGPELSVEGYVHDGRVTVAAIVEKRLSPEPSFVEIGHVVPAELDAGVADRIRRHTGAVARALGVTMGPFHHEIRLTADGPVTIELAARLAGGQIYELIELTTGVCLPRAMLAGYLGRAPRETRTKDAAGAAATVFFIPAGPVSGTRALGADRVESLPGYVRHRFTVVPGAAVPAGTDHRCRLGYAILRAGSTAEARRLSTTAAGLVTFE

SEQ ID NO: 10691 - protein, 414 aa, Actinoplanes utahensis
MAAATFTTLLTPANACAALPVVVEEELLLADRDTGTAVPADEALAAALAPHGRVIGGTVTLVSSPSTALTTLRADLLRGRRAAAAAAAEHGAHLLAVGMTPEDPAAALCGLTIHVGVPDGRAAVRVCRRLPAWLPVVEALTANSPFARGADTGHASWRFVQAQRRALGAFGPALRSAGAIAMTPSGAGASRSDEALPSGEASLSGEPLRSGGPLRSGEASLSAAASLSAGALRSAGALRSGEAAIEAAAAVSAAVQAAEAGLPESLRYWRVRPSPTPAVQIRVGDVGLSADDTVVAVGLLRAAVLAAVQDTGPGHRPVPVGPAVLRAAHWRASRQGLQARLFDPASGRPAPSWHVIDQIAAAMFLPSGDFETVRDGLARLRDEGNGADRQRRIVARADDGRAVRSALARLTIQG

SEQ ID NO: 10692 - protein, 372 aa, Actinoplanes utahensis
MPTTTGVTIEDDLDLIAEEYARLLATADQATDRRLRAEMIDRMVPFARRLAQRYRHSGEPFEDLVQVASLGLVKAVSRYLPERGSFTAYAVATISGELKRHFRDHTWSVRAPRRLQHLAAQTRVAEVELAHELGRAPTEGEVAQRCHIDSETLDEARTAASGYRAVSLSLPLGEGDGELADLLGSADPAFNQVADYLAVAKLARRLPPRVRRILILRFYQDRTQAQIAAEIGISQMHVSRVLTRALTWLREALLQDTVPPWPGNDADPMDGRVVSRLRPDGATEARICGEIDADSAVLLQETLMDTLRRLGGGALVLDLAGVSLLSAAGARVLRGVADAGRAHGVTVRLTGVRPTVRRVVAVAGLTRLLAPA

SEQ ID NO: 10693 - protein, 625 aa, Actinoplanes utahensis
MRFDGPQTAQNGEASVPDAPDELDVQVGRARAVRAVFDSMPVALAGLTGPQHRVDAVNHAFREVFGGFAVVGLPLSVPALLDICDQVFVSGVPQTLDGWPAGDREIDLTVAPRRDAAGSVAGVELIGVPRRESAAAGDEVAAVQRELLPTGLPLLPSVRLDGGYLPAGDADAAGGDWLDAVALGEGRVALIVGDVVGHGVAAAAAMGQLRAVLHDRLGATGDLLDAVGAADRLARRVPEAYAATVCIVQLDPADGRLTYCSAGHPPPLLAGPRAARFLPASGHGPLGTGATYLARTARLEPDEIVLLYSDGLIERPGGTPAAGNDALCRAVAGALSGPGPRDVLTALDLLIQRTGHTDDITVLVAARRDPPPSLRLTAPPGSVSVRGLRAGVEDWADALATGDQDRVAFAHVVTELVTNALEHGAGTVTLTAGVSPDGEARITVADQGRWRERPRPGDDDFRRDHGFGLAMVASFADRLDIDTGAVGTTVTVHRRLSRPLRPLTAGQSGSVRPGADPELMMIVDQPNAPSSRVAIHGPLDAGNVDDLSAELDRLTLGGSHDLVVDLSAVTLLASAAVSQLYRSDPRATGRRCPLRLYAPAGSTADQVLTLVDLPHATVDPHALAR

SEQ ID NO: 10694 - protein, 380 aa, Actinoplanes utahensis
MSSMTATATTTTGPDTPPALTLGVEEEFLLLDPATGGNVPLADRVTAALPEPVRSRSRREMRRSMVEVVTGVCTGLPDMRAQLAEQRRAAADAADAAGAHLVAIGATPVTEQDVTVPPDPRYQDLVTRYGPVALDPAACGLHVHVGVPDREIAVQVCNHLQVWLPVIRSLTGNSPFFQGVDTGHASWRSVQLLRWPSMGPTPYFASAREYDRTVAQLVASGMVLDEAAIYWYARLSPTYPTVEIRVGDVCTDIDDTILVAALVRAAVATAIADIRAGRPAPRPRDCLLNAANWQSAHDGLSGDLIDLRLGRARPAWEFIDEFVATVSPALRAAGDLETVLDGLTRLRAGGDGATRQRAIHHGTGDLRAVLATLAAWTRAG

SEQ ID NO: 10695 - protein, 176 aa, Actinoplanes utahensis
MTGYGDDVGTTSDRYTINAGRYWASAVAAALVAALVAIAGVLIARGLFDVPVLARRSHGAWGDAHTATYATGAALATLLAAGLLHLLTLAVAEPRRFFRWIMALITLIGVITPLTLADKPGPRIATALITLAIGVTITAILDSVASATSHPRPAEQRDALAATRRWTAEPPTYRQS

SEQ ID NO: 10696 - protein, 298 aa, Actinoplanes utahensis
MGRLARLPGGGGRSLVPMTGRRLAAVRTTLLLTTLLLLTACRPGVPAATVRPGATEVTSQPDAQRWVPAPGVTWQWQLTVPVDPTVNATVYDIDGFLNGADLVSDLHRRGRRVVCYVEVGSAEEFRPDYLDWPRELLGRPNGWPGERWLDIRDPARLRPVLAAQFDMCRAKGFDAIEPDLMDGYANDTGFPASAADQLRFNRFVARLAHDRGLSVALKNDVEQAAELVGDFDFTVNEECAAFAECSRLTPFIRAGKAVLHAEYDLAPAEYCAESHRLRLSSLHKNRNLDAVATPCPAG

SEQ ID NO: 10697 - protein, 298 aa, Actinoplanes utahensis
MRCLLIGASGFIGGRVRERLGADPAVTVIPAGRSGPLRLDLAGASHDELVARLRETEPDVVINCAGTTDGDPAGLAAGNVVAVARLLAALRSSAHHGKLIHLGSAAEYGPVPEGLAVPESCPPRPVSAYGMSKLAGTELVLAARRDGLAATVLRIFNPIGPGTPETLLPGRLVSAVRTSAVTGDRAQLGPLDGHRDFVDVRDVAEAVAAAVTAAGPLPEILNIGSGRATPLRDLAAMAAEMAGVAMPAEERSGSPRSAAVTWQQADITAAASTLGFQPAYPLLTSLRDMGVADPPPAR

SEQ ID NO: 10698 - protein, 243 aa, Actinoplanes utahensis
MHAVILAGGKGVRLRPYTTVLPKPLVPIGDQYSILEIIMRQLSQFGFRSATLAIGHLGHLIRAYVGDGRQWGLERVDFTTEESPLGTIGPLLGLRDQLPEHFVVMNGDVLTDLNYADLLDRHRNSGSELTVATFARQVKIDFGVLTSVGGRIVDFTEKPTMDYRVSMGVYGMSASALRRYTPGLPLGFDELVLDMLAQGRGPAEYEFDGNWLDIGRPDDYDRANTEFGVLAPLLLPQLRAEAA

SEQ ID NO: 10699 - protein, 330 aa, Actinoplanes utahensis
MTTVAVTGADGFIGSHLVENLVERGHRVRAMAQYNSLGTWGWLDALSPDVMANVEVLTGDVTDSDTVRDLITGAGTVYHLAALIAIPYSYRAPRSYVNTNVIGTLNVLEAVREQGCDRLVHTSTSETYGTAMTVPISETHPVQAQSPYAASKAGADKLVDSYHASFDTPTVIMRPFNTFGPRQSARAVIPTVISQLAAGADEIRLGALDPTRDFLFVHDTAEAFATVGTAPAEKVVGQSFNAGTGDEISIGKLAEMICALMGRPVPVRLENERLRPTNSEVMRLVCDSSKLRAATGWAPAHDLASGLKLTIDWFLDPANLAKYRPGTYAR

SEQ ID NO: 10700 - protein, 454 aa, Actinoplanes utahensis
MTVDSPYADLIEKMSPVCAVAVDSYEVAAVLEADGITDVAAQERYSARDVFDLADRLFRLRPRVRQADRPAPDPWQATPVTHVLRGVLFALPALAYLAVADRIAGPRPTALLVVSVLLSWTVGQGLAHLGYARLGRADQRAAAVLGGAALIVGLPAVTVVAALGIALGVSLTVTLIAAGQVAYVLAATVALVLGREWWLLAALVPGVGAGIGRLVAGPDAGPSGLLAAAAALSVAAAIVVAGWQHLRGVRPQLPSRVDVAAASPNAAFGAVVGALLIFTPVARALDATPDPRIGVGTALAMVLPLSVSMGVAEWLLFRYRSAARRAMAEARTLQAFGRRASTALSGVTTAYLAVLVTIFLAGIGLTALLTGVLPAAWPVAAAVLTGVALFLALLLMSFHLRGPAVLACLAALAASLLLAPFAPPETIQAVTAAGLLIGLYAYAHVTLRRAQLHL

SEQ ID NO: 10701 - protein, 504 aa, Actinoplanes utahensis
MKVALLTEGTYPHSMGGVSVWCDQLLRGLKHHEFDVYAIVASGVEPAVWELPANVTAHGIALWPPVAGRPRSRTPRTAERLASAYGDLIEALLLPSESAADAFAAALRGIVEHAASETVGTDLSPYGEMAVSRLLKAWAANAALSQVAVPSVLDALTAVDVIERSLRPLLHPTPRADVTHAVTNGLAALPGLAAKWRYGTPMLLTEHGVYLRERYLGLRAAEYNWPIKATLAAFLRLLCTTVYRSADLVAPGNKYNRRWETKFGAHPELIETVYNGVEPDDFPTAGAEPEAPTVTWAGRVDPIKDLETLIRSFALVHAEMPEARLRIFGGTPAGAEGYRQRCEALVVKLGLAGAATFEGRVAEIRDAYAAGHVVALSSISEGFPYTLIEAMTSGRATVSTDVGGVSEAVGSTGLVVPPRDPEAMAAACLALLRDDTRRRELGRQARERALANFTVDKAVDSYDAIYHDLAFRQSRRLENTAVADTVVLNIVVPDPAGPEAAGIR

SEQ ID NO: 10702 - protein, 676 aa, Actinoplanes utahensis
MVRSWRSALTTAGATAATAVLTVTPAFAAAPAGSRVELKVLVVTDGGPATAAIAAELKSEGTPYQEVNLRDGGRPTVDAAFLADTVTSGGRLVDRAHYQAVVVPGPDSFGNAAESAALTAYEQKFDIPQVNAYVYPGVGMGLQTPTYAGSLDGVTATLTPAGLGVFSYLKGSVPFEDNSPAVTESYGFLAEPSPADVATGAIATPLLTATAPNGTAGNSLITEYRADNRRQLSLSFVYNAAQQQFRLLAPGIVNWMTGGVHLGLSRNFLSVQVDDVFMPDARWSTTGNCTPGEDCPDGTATTDIRMTSADVSAVSSWQTSRNFTFDMVFNGNGSAEAAADAFLGVDPLTAALVARRGSFRWTNHTWNHEYLGCVRDVTVIPWKCSTTTAGTTDWASRSLINSEISKNVTWATSFLRQLPIDRTELVTGEHSGLFYLPQQPQTNPNLAPALTSQGIKWLAADNSRMPEQIQVGSALTVPRYPMTAYYNVGKRAEMVDEYNWIYTSRADGGSGICEDNPATTTCITPLNTTTGYQDYIVPLETRLALNRTLGNDPRPYYVHQANLAEDRILLTMMDSILTRYRSLIADNAPFVNPRMSAAGLELQRQNAWRAAVAGGKVSGYLQDKTVHIDAPASLAAPITAITGTRRGTTTFGEAYAGNRSAWTIPAVNGTVDLVLP

SEQ ID NO: 10703 - protein, 173 aa, Actinoplanes utahensis
MFDLDLFRHLVVPPDNAPVANDWSAVEARLGTGLPSDYKSLVDTYGLGSFGNFFHVFCPDAGSKRGLDLEYQHERTTWALDYLAERGHTLPHPSADLLSCGRSDNGDVAYWITAGSDDPEQWRIGLGETRGHLWEEFDGGLGEWLAAVLSRRIRMKIFPKDFPRRTVRFTPIT

SEQ ID NO: 10704 - protein, 116 aa, Actinoplanes utahensis
MRTTLCHLLSATDALVVIGFAANVLLLIQNSPSSLPSVPRYSVGMVLPPERVFAIGTSLRDQSTPAGVPEAALNHSEIECEFDEARCRFGRFTRDDVPLNAAEVAALVASGPAPAV

SEQ ID NO: 10705 - protein, 294 aa, Actinoplanes utahensis
MGVYCVPMTHADLRYLAEALTPRHAIAVNDPVDRQRLGDLVDVDTSEHLLGFISQAGRVVAETVGPGETVLAETDIAMDADGGWEPGPPSEVWKVPAGTRREDMWDDVARLFLAQSLRTGAASQVCGWRDRVVAIVPEEVGPKESTIIRTLANGGIETTHTYNVLDAYGTYAKWLNELALEFGSGDEAMASDTPQPPGLVRNVVAAWLMREAGEAELNQARFSLKIGLAGYARITERAPNVDLPIAELARSLYTDRANLTKVIKAAEKDAVITEIHDAIASKDTDRIAAALRKS

SEQ ID NO: 10706 - protein, 2128 aa, Actinoplanes utahensis
MTRRVVRLRLFNFVRARYVMRATVATTVAAMVLSTADASAAWAATTDWNLGNTSASQVADLTAPATGVVRNDGLKTCLERVSGATANGTVAASSTCTGASGQMWTFKPPTFSTQGNLTPAGVPTSCLSVVSRNGGPAREVAAAGAAQMLLTDDGQVWARTQNGLNAELGPWVKETDAKVQDIAGGSDGTQMIIGADWHVYARNNVGADGWTNEGTQAATAIATNGGTQLYLASDGTVYARSGIGDATGWVAETAAGGAKAIAVGSDGTQMMIGADGSVYARSAIGNASGWVKELGPGAQAIATNGGLQMLVDARSEVYVKTGISLNGWTKEAVTSASGAAVTAPASPLRRVITVDSDRTQMMQGSDGNAYARLASDTTWTVQNGPVLTGTDVVGRTAIAVGSSGRLIILNTGTVSARTAASRGRYVSASDPTADSADGVPVKLYDCHDWANQGWVFEYSKSGSIQLRNPASNRCLNTPNDSTTSGTALTIATCTGSLGQQFTNPTTPPPPSGPITNPVVNKCAVPASTTSTPDTGAAVVINPCGVGYTTGPVLPWTLNKDGTLTAGTMCLSLTGGETATTNGTKTTMSKCAGTLDQQWVVGFDTTGRTQLINPNSARCLEDPNANLTTGTPLQIATCNNGDAQVWSIPHTGHAFAGPITATTTVIPAGTGTERLVAMQTAARVRDTRAHLALLMHAGGPNVRQIAAQWLAGPDTALNVEWGDWVDKNWIAEDWVNGWKWADASSDTAPAGPLGADIVAAGTADQARQQRETARDAFLAGYPMGDYGSRPSFDTDVTNFLSKGSTRELAVEAAYFHPLITQASKAEQDKVWEIYERHLKSEPGNGYFTADNIKKVVEGSADDVRRFIQFDSYPRVAPQPNTPEFRIEVEALKTRWAQGDPSNPLDPDHVLLDVEETAWAEWQAELNSQAQPRADILAAEMQSLDALRASSETMHDGLGYAWTARGIQWAQDQKFNSGKPAWTGVDISRAPHDLGVIKAKVAALAAAAKNSAAVAKDAADKAVAARDAAYTTATAAGLPQGRGLTYAQQSAQVAQAAAAATQATANAMQTVVAAVNATLANSATLLANASAQAHAARALYLRQSAEDSAAHAAQLAAQAKQEEKEAATAAAKAAADKTKIATVEADAKSALARADAAAADAAKQEKIAADAQATAERERQNAAAAMTAAQNQAAIAESKKNEAASAAAKAGQDETAAKLAETFAMDAWRRAAKAQAEMVATAQAAAEADAKAAAAAGTDAADDAEAQAVKARKAADDAAAAADTAGTEADAAQAAASRARSAAGTARAAAQRAAADLETAKAAASQTHADAVEGHALAADAISNARYAASQAAQARKAAADAKAEADSAKAAAQQAQTEAADALADSAVAIGQAVATGQAAQETAVAAATVAAPADTAIDLATPWAATDSAAGLAGLSSQAAETISAAQANIAAAQATQAAALAVDAQDAANRASGDAKLALQAAAAAAVSASQAAASAAAATKSANQAAADAKATKQASARIDEMDAKAQQDVTKTQGSADAADAHATAAEAAADESERDADAAHHAYYSAQDSANEASEYADDAEASAQAAREAAENANTSLEGAQAAGAALASATVNDPQQLTDLNAKASPLGDGIWVRPEAKVTFTPDGPCVGVGGCDVTGTAHVTGYNVYFYAACAVPDPADPNHCFTTASGSVLNLYPLATIPINQPPYKITHHIDQMALYDTYVKHLPETLFHEFIGCYHKLTSADDGGSLFDCGLVVGELFGAEIIKAASTALRALRIAMIAYDVEGIDGAINAIKALKIEYQTLIELQKIAAAARAEALEKRILECLGGHSFAEGTGVLMADGTVKPIEAVRVGDLVRNATPSGGVETHQVTQTHRTTTDTEFTELTVVAGDRRVNIVGTQNHPFYDVTRAEFVNAGDLAVGDQLRTGSSGTITVAAVRNYTGAMATYDLTIEGLHTYFVDNNGLPVLVHNSTACPPGWVADALREMTDRKLPVTTGFLYVGGRRVAELSARTEEESKYINAYLHKIFPNVPAKTTFRASWHADGKLAWWMRLEYRNSGFTSEELKNGIMIINNKNGPCGGVKYDLGCLQDMANILYRDQKISVFWPGRAEPYPVQGVASR

SEQ ID NO: 10707 - protein, 321 aa, Actinoplanes utahensis
MKTPGLFKQCGCRDAGTRQRLRARCPRIGERGHGTWYYRCYIRDMLGESVQISHGGYRTLTEARQARTAVQAESREQYAGRTWTIARWLTYWLTTRTAIRPTTHAIYTRHVHQFLIPAIGYLRLTELTSRHLTAMFAELAAGTTTTGLPRSPATLQRIRATLRAAYNAAIREGMITDNPARRVEIPAGRRPQAVVWTEGRVEDWRTDGARPSVAVWTPAQLTEFLEFVADDPLYPLWWLIALRGLRRGEAAGLRWEDLDLNNRQLTTTNQRTTAGYQIIEGPPKSAASRRTIALDRRTVAVLRDHLRHQRAHYLLTGRSSS

SEQ ID NO: 10708 - protein, 442 aa, Actinoplanes utahensis
MSCNEVEGVFRRCGCKDTVTGRRFDGRCPRLADPKHGSWYFSVQLPDEQSRPTRFRRGGFRTARQAQAVRNQTVASAAAGAGLRRVTVEQWLRRWLLSLPGQVRRSTAAGYSIHVRRYLIPHLGHHTLTGLRAAHIEAMFTTITAQPSRTGAPLSAATLQKIRATLRRALNMAIREQLLAINPARLVLLPRPRRHRPQPWSASRVAAWQDDGHKPVVAVWTPQQLAEFLLFVRDDPLFALWWLAALRGLRRGEICALRWTDVDLAEGTLTVSHTIAHANGRPYWDTPKTAAGQRTVALDRMTVAVLLRSQRQQRRRRAECAGERWQPNGPVFTRQGRAIRPDWLTHRFATLVDASKLPPIRLHCLRHGAATLALAAHVDLKTVQDMLGHTSYAFTADTYATVLPDQAKHAAESTARLVLDALNEARPAVGARLGPGLATASS

SEQ ID NO: 10709 - protein, 232 aa, Actinoplanes utahensis
MLRTSMLSSSTWRRSLLAGAAVTASLMLSACGGDDTSSDSGMNHGGMTPTATASAQAAATFNDADVMFASMMIPHHQQAVEMAALADGRAASAEVKNLAAKIKSAQQPEIDTMNQWLTAWGHPMPAMAASGMPGMDASAMPGMSASAMPGMDHGAMPGAMSQADMDKLAKAKGAAFDKQFLAMMISHHEGAITMAQQEVAQGSSPDAKALAQKIVTDQQAEIVTMKGLLSKP

SEQ ID NO: 10710 - protein, 212 aa, Actinoplanes utahensis
MMRTFVLPSIGWRRGLLAGAAACAVLAVAGCGDTPTAGPGPTHAASPAAAGAASTAGFNQADVTFAQQMIPHHQSAIAMAKMATGHVGDARVAKLAGQIQAAQQPEITTMNRWPAQWGKPMPSAGADAMDDPDHGEMAGIDELDMTALMNAKGTPWDKQFLAVMVKHHQAAVTMAQQELAHGLNTDAKALAQKIIDDQQAQITEMKQIRASL

SEQ ID NO: 10711 - protein, 123 aa, Actinoplanes utahensis
MMLQLVLRVVTVALMLLCATSVDHCGLDAEHSQLTSGAASMQQDAATAIALLDSSHPSCSLAEHPAHRCEMASKLPDLDGLNPQLSPDLLTPPPGLRLSAGAPACAPPAGAASVLSRICVCRT

SEQ ID NO: 10712 - protein, 371 aa, Actinoplanes utahensis
MTNQTITRPTGLPTPSQLISHSTCHQLAQLVGNTPVMWIPDIATPSGHGFWAKLEGNNPGGIKDRPGLHLIQRARERGDLAPGAPIVESTSGTLGLGLALAGQIYHHPVTLVTDPGMEPSVRNLLTAYGAQVDIVTAPHPDGGWQQARRDRVTQLLADRPGSYCPDQYHNPDNVEAYQHLALELVAQLGRIDVLVCSVGTGGHSAGTARVLREFFPHLRLAGVDATGSTIFGQPARPRLMRGLGSSIHPRNVDYPAFDEVHWVAPAEAVWACRTLAADRYVSGGWSVGAVALVASWLARTMPDDVRIAAVFPDGPHRYAETVYSDDYCRQHHLLGPAPAADPDHIRHPAEREVTRWTRCTRIIDPAGQDAA

SEQ ID NO: 10713 - protein, 432 aa, Actinoplanes utahensis
MKATITATRSFSRPVQLLLVNQLTINIGFYMLMPYLAGYLSGNLALAGWAVGLVLGVRNLSQQGMFLLGGSLADRLGYKPLILAGLGLRVVGFALLGFVDTLPGLIVASLLTGLAGALFNPAVRAYLAAESGDRKTDAFAVFNVFYQAGILAGPLIGLALLTLDFRWVCLVAAGLFLLLLIAQTRALPARRAVPDHSRQSMLADWRQVFGNGPFLLFCGAMIGSYVLNFQVYLGLPLEVRRITGHETGVAVLFAVSGLLTVAGQVKVTAWAKARWSPQQAIVRGLLVMAAAFVPLTLSAGAGPGRAGVIGVAVALAPVLLSTVLLTIATMIVYPFEMATIVALAGQRLVGTYYGLYNTIAGLGIAAGNLLTGAALDTGRRHGFPALPWLALTGLGAACAAAVWALSRTGRLHAPEPDLDSAAPPMPARNGSR

SEQ ID NO: 10714 - protein, 238 aa, Actinoplanes utahensis
MREQTLPPVRTSHLWRGLQGRWNYDMWGCNGRPVVLLPAVLFDRTMWWPLAAELRPYAAVIAIDLPGHGNSSDTRAHYAPSDLVDDLADLIYSVGIRRAPIIVGHASSTGLATLFATRYATHAVVTVDAGDQASPTPVDREQYLATMRLQDIPAEFQPLVQPSDNPALLAAYQPLLSGTAAQAPGAVTAALAVHSTSPSPGCFDTAPHRWQHHVYNRPGRFAQLSDMHRLSSDIQALL

SEQ ID NO: 10715 - protein, 238 aa, Actinoplanes utahensis
MRRKSHRHARIGLSSAALLLAVSGCSSPPDPVWGDAAPSTAPSTTASVSRATSPHPTPSSVTAAPSGPYVFPVAGTNSYAHSHHDYPASDLMTACGNTFVAVTNGVVIFTNTVDRWTAKANLGPTRGGLSVAIVGDDGVRYYGSHLSAISPGISPGTRVKAGQTLGKTGKTGDTTACHVHFGISPPCARGADWYTQRGAIWPWPYLDSWRTGGQRSAAAEISTWQAKNGCPSEAKVDP

SEQ ID NO: 10716 - protein, 330 aa, Actinoplanes utahensis
MLATRHAAALRRRGWTVALLAAVLSLGMTAPARANPSPQQIEKQLDQQWNQLEPTIEQYNQVHTQLQTSRSQQQKLTKQLQPLQARVDAAMSGVGQLASRAYMQGGDIALSSLLISGNPADLTDKLTYLDVMASSRRSQVAGVITLRDKYASDKKQLDTVTASLAARDADLAAKKNTIQKKINDLQQLRVKAYGAGGGASGNLRTGACPATYTNDPGGKAAAKACSLIGKPYIWADAGPDGYDCSGLTLAAWATVGVSLRHYTKWQWEDTKPVSRADLKPGDLVFWYSDLHHMGMYVGNNTVVHAPHTGDFVRMAGLDAVGPVAGFRRPS

SEQ ID NO: 10717 - protein, 179 aa, Actinoplanes utahensis
MPVIALPASRRYAAAGGAIRSPRASVAVWRRGRVAAVWRLLRLLLIAGTALGVATLHTLGHTDVGLDEHRMFPLGGGQALTTTVAVLPGIQIAAADDDGGCDGDGCTQSALVGTSREAWHSWQVCQAILSPVAVAVAVTATRPTPIAGSRRPSAHQRTPVGQARAPVGLTLASTAVLRT

SEQ ID NO: 10718 - protein, 201 aa, Actinoplanes utahensis
MAELAGRGVTAIGVDVSEAMVALGRSRYPGADLRVGAAEQLPLGDGKAAGYRADKVFHELSDPAAAVAEARRVLRPGGRIVLLGQDWDTIVIDADDGSLTRRIVQARADAVRWPRVARAYRTLLLDAGFEQVSLQVRTGVFTGGLMLPMLTGFAHAAVKAAAITPAQADTWLAEQRNRAAVDRFLLALPLFVGAATNPDRR

SEQ ID NO: 10719 - protein, 152 aa, Actinoplanes utahensis
MLRGMCHPARVESQVDLKSTSDDPVLGIGQAGQRFGVAAHVLRHWESMGLLSPERTRDGHRRYHRADLIRIAVILRAKDAGLSLDAIHHMITCDDPGTRQQALQHQRDALAERIARQQAALALLDCALTCSHRDVATCPHFQQMIAQRAGLA

SEQ ID NO: 10720 - protein, 471 aa, Actinoplanes utahensis
MAEPQRPYRWRRLPLRVRLVAGFAIAMLIVLTGAGGFVYLRVRYALDLRLNEDLIAQAGQLTSSVNSGGPPAVTTGTEYQLLDAANQVVAASTGLNGTSLLSSGQLATARTTAVRTDRGPLFPIHADTLRLYAIPVHPVSGSATVAVVALRRDQRDEALRELIGQLALANLAALAIASMVSYRLTRAALAPVERYRTEATRIAGGATGLRLAVPQRTDDEITRLGNTLNQMLAALETALDRERQFVHDASHELRTPLTLISTEIELALRRPRSTAELEETLRNVAGDADRLRELADTLLTVGVQPPPAPGDTVDLGALAVDAAARYPNTHAEQHAPAVAFGDATRLQQVVTNLLDNATRHGTPPITITTGRHSDAAYLRVHDHGPGMDPGFLAHATARFTRADTARSTPGTGLGLAVVEAIITAQHGELRLCANGTHHRVGTHFPTGCDHPDNGTTITVLLPAATASEPAR

SEQ ID NO: 10721 - protein, 225 aa, Actinoplanes utahensis
MRVLVVEDEPRLASLLARGLREAGHDADVRHTGGDGLLAATGGDYDAVVLDLMLPGLDGLAVCRKLRERGIRVPVLMLTARGEVPDRIAGLDAGADDYLSKPFSFDELLARLRALHRRAADPAIAELAAGDLRLDAAARTVYRSSTAIELSAREFDILALLMSRAGQCVTRYQILDEVWDGETDLRSNVIDVYIASLRGKVDKPFARQAISTVRGAGYRLERDGG

SEQ ID NO: 10722 - protein, 199 aa, Actinoplanes utahensis
MDVSWFLAVNRFARATPWLHPVLAGYAVYGVGLFALLLLAGWWRARQRGRGMPAALWAPLGVLLAVAVNQPIVAAFAEPRPYTHLTGVLVLVTRSTDPSFPSDHATMAGAAVAGLWLVERRLGLLAGAAALVMCFARVYVGAHYPRDVLAGLIVGAVVAVAGYWLAAPLLRRLLTWARSTPLRPLIERRQPHVPIGSAS

SEQ ID NO: 10723 - protein, 476 aa, Actinoplanes utahensis
MPAPGQTAIIAGAGAAGHGRLNIVVVAVVAFAAAASSPAPPACPGPDSCCSTRSARRCGSACGQPSATWPVTTGRRSPPSRTAMSRTSWPGSWSPPWHCCGGGCAASITTAAPIIRRANLTFSCSAPLFASTPPRRPDNPPGRVTASCGFHARSIPSLVMSDVLAVDAVDLTKTYGALTAVDRLNLQVSQGEVYGVLGPNGAGKTTFLRMLFGLIRPDSGTLRVLGRTWTADGVRALDGVAGFIESPKFYPGLSGRKNLQLLAGLDGGTSRMKIDEVLETVDLRDRQRDKVAGYSFGMRQRLGVAASLLREPKLLVLDEPANGLDPAGIRDMRALVKRLAASGLTVLLSSHDMGEVEEICDDVTIMRTGTVVYHGSIAALRQRAPEQAHTMQTTDDDRAAQLATARGLDVSRNADGLAVRGPQPEIDALVAEIITDGIALRELARRETPLEALFFMLTEPDTDTPAPELATTGARR

SEQ ID NO: 10724 - protein, 290 aa, Actinoplanes utahensis
MTATTLRPASAAATPTNSGQPGLGAALRWEIVKLAAQIRSKALLAGALIIPIPVVAVLNGQEQPPSDTIYGKLIHLSGYAMPLLMLAWAAQWVLPLLAAIVAGDIFANEDQHGTWKTILTRSVSRTHIFWAKTLTALTYNLVLLTAFAASTIISSLLIVGHQPLTGLSGQTIASGHALRLVIAAWATAIPPVIGFTALALLLSVRTKNPAFGIAAPVVAGFAMQLLGSVTGLDLTRKLLLTTPFDAWHGLFAEHPFTGPLLTGLAVSAAWTLICLASAYLSLRRRDITGG

SEQ ID NO: 10725 - protein, 150 aa, Actinoplanes utahensis
MRPIVTRTALVLAVGAGIAATIAAGQPEITKAGLEKALVPTFTNLYIQQAGILGIPGITSQSIGASTNCDKGGPKIADTGAGPNWVCMMSWIDNHGQHQDGKFEVTVHTDATYVAGGPSKIVGLATITDKQGRDVRNPVFEFDGVITTNS

SEQ ID NO: 10726 - protein, 131 aa, Actinoplanes utahensis
MTTTLDDVTPRKKKSEPSAEAAAAAELVRLAKEQGLSLTGPDGLLKQLTKAVLETALNEEMTGHLGYAKHDAAGAGSGNVRNGSRSKKVLTDATGHVEIEASADTSTVAKKKELVVTPEGVEAELVGRLVE

SEQ ID NO: 10727 - protein, 276 aa, Actinoplanes utahensis
MSQPGTPANRAAADPLTANLLDHQTEDRLRDLVAKVPAVTVGFWVVKVLATTLGETGGDSLSMSMGLGYLVSTMIFAVVFVAAVILQVRATRFNQWVYWFTIVATTTLGTTIADYVDRSLGLGYPGGTTILVISLACSFALWYKATGTIAVTSIQTPRTEAFYWLTILFSQTLGTALGDWTADTIGLEYTGGALLFTALLAILAAAYRWTRLSRTLLFWAAFVLTRPLGAVVGDFLDKPIAKGGLNLDRYAASAALLVAIVAILLARRQHPATRPH

SEQ ID NO: 10728 - protein, 205 aa, Actinoplanes utahensis
MKRGLGFRLVSLLATACCTLALPVAAQAAATHGSGAHSSVAVRALPPYAAWISDVTAVTDTAQQYLTTRLPDPSIKAAIVLDIDNTALETTYHPGLTSPATAPVLALARQAQAAGAAVFFVTARPELLEWQTALNLRSAGYPITDIYLRPTFDFDPDATLKSGARIAIEGRGYRIVANIGNSGSDLQGGHAERTFKLPDYNGQLP

SEQ ID NO: 10729 - protein, 36 aa, Actinoplanes utahensis
MSLHFGHEGTIAASAPLLAGLKARGLHPVTVSDLVG

SEQ ID NO: 10730 - protein, 33 aa, Actinoplanes utahensis
MSELPGLSYDVDSRDFADPGTHAIVAATLAAEQ

SEQ ID NO: 10731 - protein, 140 aa, Actinoplanes utahensis
MVAEGAQAVVAGALVMLAAVVVAAAAAAAVLAAAAVWREPVGVRSGLAPKRLGYLAAGAAVVMLPPLATAVMTLPNFISAVLATSLTCLLPWGASIAAIAWLRGRSAAAAGATVVASVVLFVVSNIAMHRMGHVYPPTSD

SEQ ID NO: 10732 - protein, 164 aa, Actinoplanes utahensis
MKRITRVLAISGLGLGAALAIAAGPAQAAIVTAQPAGHSASAQAGGHWDDTDVVGYFRTRFGCERVGRLGEFHGRWDDYDCSRVWSGFNRGAWVLEVATDDWNGEWDDDNWYHGWYDGWHGGDFNGGWDHGGWHRDHGGWDGDHPDGSGRVAVFPLHSRSRSAN

SEQ ID NO: 10733 - protein, 212 aa, Actinoplanes utahensis
MLKALATGATLLASLAATGTAAHAAPSTIVPGEDMAITVAAANGSGCPEGSADVTVSPDNKAFTVTYSKFTAQTGPDAKPTDFRKNCQLALNVHVPQGYTFAIAGADYRGYARLERGATGSESANYYFQGEPQSTRIRHDFSGPADTDWQRSDTVGIGSLSFLPCGEDRYLNVNTELRVNRGWSSRNATSFLTMDSTDGRIDTVYHVAWKQC

SEQ ID NO: 10734 - protein, 423 aa, Actinoplanes utahensis
MTQSNRQVCDTRNEPVALISRIVAERAVEPLFQPIVDLDTRRLVGVEALARGPAGSPLEFPDQLFEAAARVDLLPELDQLCAARAHEIAQAPGAVVPPLVFINKEPAGADRPLSDDLRLRLASISTYRYVLEFTERALAAHPSALLEVAARAHRTGGALALDDVGADRLSLAFLPLLEPEVVKLDMHLLRDPYSAHTIETTALVCGYAQRTGAMVIAEGIETEQDLQVARALGAGWGQGWLFARPGPLSAVRDWPVDPSARLRAPRPELYVPGASAFDMASARHCARAGDRHLLDGLTEYVLRQLPFAGPYGVVLGAYPNLATGHGWIPRLAAAASTTALVGISGPGPGLPVPSPIRTSITDGLSGVESESALVIVDPHVTVALCTRRRHDDAIAFVLTFDPDEVLAVARTLLHRLGPQDLPG

SEQ ID NO: 10735 - protein, 32 aa, Actinoplanes utahensis
MDNSLLTSVVVAVRRSHRPPGRGLLVVMKTCA

SEQ ID NO: 10736 - protein, 54 aa, Actinoplanes utahensis
MTTSSPRPGGRWLRRTATTTLVSSELSKLYALPDLVDPPLLSEIVCELAAGHDA

SEQ ID NO: 10737 - protein, 97 aa, Actinoplanes utahensis
MFIVLLRFTENKTAAGEHMAGHQQWIKQGLEDQVFLLVGGIQPQLGGAVLAHNTSLPQLQQRVDADPFVIHRVVDAEILEITPGMADPRLDFLMPAR

SEQ ID NO: 10738 - protein, 357 aa, Actinoplanes utahensis
MSTGLFELFPLGDLTLANRMVMAPLTRNRADHDGVVTPMMVTHYRQRATAGLIISESTPVSAEGVGYPNTPGIHTEAQAAGWLRLTEAVHAESGRVFVQLQHCGRISHPSLLPDGSTPVAPSALRPSGRTLTPSGLQEFVTPRELEAHEVPEIVAQFEHAAKRALDAEFDGVEVHAGNGYLVDQFLRDASNIRTDAYGGSPRNRMRLLNEILDAVCAVWPAHRVGVRFTPENSFNSMADTNPQAHFRYFLEQLRTRDLAYVHTLEGDMTTKTSALDYRALRDAFTGTYIANNGYDLTRAQAAIRDGAADLIAFGVPFLANPDLIRRYRDGLPLNTADPSTYYTGGPLGYIDYPTYDA

SEQ ID NO: 10739 - protein, 188 aa, Actinoplanes utahensis
MGGAKATREQIIEAADRLFYQQGYEHTSFAAIAEAVQISRGNFYYHFKTKDDILAAVIDARLAERRRMLDRWEAEEPTPAGRIRKYIEIPLANRADVQMYGCPVGTLTTELAKLDHASFVEANSVFTLFRTWLREQFALLGHESEADALAMHVIAFSQGVATLANAFRDEGFIWREVKQMSDWLTAYE

SEQ ID NO: 10740 - protein, 98 aa, Actinoplanes utahensis
MRIRTAVAALAMTAGAAAGSLALTGPAMATPQNGLVNVYAQDIASGNQVILLQNVPVDVAANVCGLTVNVLSTELLSGNHAVCTAKNTPTTKSWVSYS

SEQ ID NO: 10741 - protein, 37 aa, Actinoplanes utahensis
MQLQGDVAGVLAYADHVLVLDLQQGADHGGVEELHRG

SEQ ID NO: 10742 - protein, 107 aa, Actinoplanes utahensis
MNPTWQHSVHRDAATSTIALRGELDLAATATLSDLFAEQLSLSGITTVRVDLTAVTFIDSTVISTLIVARNTATSSNRQFTVTHAAGHVRRVLTVAGVLNTLTTDFS

SEQ ID NO: 10743 - protein, 185 aa, Actinoplanes utahensis
MRTPAPALARPVDGPAPTLDSRFTAAVLTDLRHAVRTATADAGLHGERLDDFIVAVQELTTNAVRHGGGRGRLLLRRHDDTVTCEISDHGSGFPDGIPATGSPPPAGVPGGRGLWLATQLSDTLLITDRRDGVTVTITICLTAPGIPAGAAPAAGSGTVPAPQQSELAIKPGPPLHGNPGRSTPA

SEQ ID NO: 10744 - protein, 716 aa, Actinoplanes utahensis
MSCLAAVMGEEHPAEGDGDAGASVQQMELTAGAMSWEAANKLAAVTARAAGAPTALIHLTDGDHLRLAGGAGLPDGWKRIGHVPVSSGLAGIILGSGEPLIVTDTAADVRVPAGAPISAVAGRAYAGFPIRDPQGTLVGVCAVLDYQVRQWTDEELAGVREGAQACTAFVAEQQARQQADQQRRFLDALLASLQAGVTACDAQGRLVLANDLAVQWAGESSPPADLKQWAARQHLADAEGRPLPAHAVPLLRALAGEQLRDVEITVRNPGQRRTVLRTDAQPITGADGERLGAVVVAQDVTDQRRAARFRDVEFAVAEALAHASSVQQAGSRVLEAICSTLHWPYAELWLVDEQAQALMPSAHYAADHVEAGELSPQPQPGDMLTGAAWRTGKPIWIGDIDAAPGNSAAPGLHLRTGLAIPVPSGGRVLAVLSFFADVVEDPADSLIALLSGTAAHVGEFLERRRAEELALALARTKDEYLVLVGHELRTPLTSISGCADFLLTAEPAVLLADAPELLEIIARNSRTVLHIVDELLDLTGLDSGHTIIACEPVDLAAAVRSAAATAAPAAESAGVEMGLQLAAEPVVIGDHGRLQQVIGHLIANAIAHSQTGDQVSVTVTQPAPTVAEVTVTDTGIGIPAEERHRLFSRFYRSSRTRERRIPGAGLGLVLSRAIIERHHGTIQLNPDTGAATSVTVRLPTDRCEPQRPSPGAGTTL

SEQ ID NO: 10745 - protein, 106 aa, Actinoplanes utahensis
MPAVSAWLRPLASRVALGAGDCAGRGDHQRSSSAGGTVRACSTTSAGSASAEGRLPADPLGGEGGGTLFGHVGRLGFQAGVPGRCGIRLRHFLLLFERIGLWHRSQ

SEQ ID NO: 10746 - protein, 352 aa, Actinoplanes utahensis
MNHRRNLRVAAAAAAATLTTLSMSGAAMAAKGHKPKPAVPAVRDSDHDGMPDTWEKANGLNPRRNDASGDADHDGLRNLAEFKARTSARAADTDRDGMPDGWEVGNRLDPLRNDASDDADADKLTNHQEYLVHDNPRAGDTDRDGTDDGTEDPDNDGLSNVQDFELGDNPLKADSDGDGVADGAEDADGDGLSNVDEFQLGDDPQKADSDGDGVSDGDEDSDDDGVSDGDELDSGDNPRDGDSDHDGVRDGEDNAGTIAGYDSTTAALTLSTAAGMTVTVTVTDHTEIGWYRRSAACPDPATIDDLTPGQAVHKLKTDDNDNDNEDSDDNENDRGDSVTGAPTAEKITLVCS

SEQ ID NO: 10747 - protein, 154 aa, Actinoplanes utahensis
MAFIVAAITDRHTRDRIQELLTAEGHIPMLFSRATPAATEIVDGLPDVVVLDAYLPEPEMTHVLTVMHEHAATAGIPVLVYGSLRGLPETQLVETGGTLIQVSTVPTLLASAVQMVLNARRDWNPGAGRRSCPPAGGASVQGGSGSVAPKPKII

SEQ ID NO: 10748 - protein, 415 aa, Actinoplanes utahensis
MNASESLRQLLRQSHHARPDDLPQMAMRAAPLLNATAIILYLVDHQQRLLIPLLGGTAPQRDPFAVDGTLAGRAFTLIAPCVSDTEPGGVRLWLPLVDGAERLGVVEFILGSPPGDDTLDGCAAVASLLAGLVVTRSLYSDAIEQVRRREPMQLAAEMLRAQLPPLTFSTGHLVISGVLEPAYDVGGDAFDYAVNADTAHLALFDAVGHGSAGGLRPVMLASLALAAYRNARRAGLDLTATYHHIDTAVHGYDRGGFITAVLAEFDQRTGTLKVISAGHPSGIVIRDGKVVKILPTPTALPVVMGRHRPPLVVEEVLEPGDRLLLYTDGIIEARALDGAEFGLDRLIDFAVKAAADQLSLPETARRLVHAIHEHQDDQLQDDATVLLAEWRTPAPPASDTELLTAPPGAPLDLPT

SEQ ID NO: 10749 - protein, 131 aa, Actinoplanes utahensis
MLRLLLFVLPLGLDSFAVAAALGALSPSRRERWRITGLFVAFEAGMPLLGVAIGAPIAHAVAGIADYLAAAALAGVGAWMLLGGDEDAEEERVRQLSKAHGMAILGLGIAISLDELAIGFSLGPGYPSPKS

SEQ ID NO: 10750 - protein, 718 aa, Actinoplanes utahensis
MVLKEGRGAPLRHRRQGAALSFAWARGRGSMQGLALVGLAVCAMAVVLGAAVPAAAGTAAPLLDDRCRTDLTDVSSAHARVWFSSAAGTPERDLAMGVAQAMEQAYGKLVADPALSFLAPLSDLRPARAKCADGVTYPDRGDGRLDVFVVPFGDAGHPDGDPKLVRAAQTNPYPADSGVAGCASWIEINDAIGAAGMGYNAVHEFMHAVENSYRCGGDIPDNDAWWYEASATWAEQYVIPTGDHPLSMAKSFFMPTPSQGMPEEPSTRWYGEFLFPWYIQHVVDKDKPAPQTLRRIWELFGTTPSTSATEAVDVAVGGLDHRWPEFARYHWNGDYNAAVPSDNSYAAWDGRFLGVQPAVTDHRLELGGAPDVLYPLQIATPGTAGSTPLRLPPLSSAYFHVSVDDDHIRSLVFHNGWTYRLSQINTHSEDPVVGMDGQSLVEQDLPGAAPAGLHVQALVKIQGYWHDEDLTEQPWRAWCRDVYEQHVEDLVVIVTNARIDATAQVSPAEKDPTIQASNIGCAKVDPGGGVRNSYADSDSDLAVSTSLTFGAPVPTGLSGQTSSHLAGQHAFQGWTFPVTGGTSTINEQIHEVDGDHCAGHGNATSALPNLSPPFEIGLHLFVNVLPGGLEYRHYRFGGLPAVTHHKFSFPIACDEYSDTTTEKGWRWAPATIADGDPPAYVPYLIAADGLSVTADHLDVPDGGGTDGEYSYTYRFHLN

SEQ ID NO: 10751 - protein, 598 aa, Actinoplanes utahensis
MQTLVNGCRTLDTLTDVDVASLPSRSQSIAQAMLQSLRVVYVTPAQTREAGYLELDHFGTSIRGFSSHYDLTGVTQRWLRDLLWDYVADQLRTPGSPRTKGPYDDTRRACLELSAYLEVAAESGGHDPTRLHADHFHRFLADQRHRARHQLPSLVVRLKTGKASTVTETTLHFIFSHARKIMRWALERGETDRIGLNRDFVVAFPSMGTGTHRTRSPFTDDVAQALAAEDNLRRFADVHDPADRGLRDIWEIIIVTGRRASEVIKLSLDCVGRYSKLPMLWHDQTKVGNYDQAIRIPEYTYQRILERQRQTLARFEGRFGHPATPPERARMALFPAPKHNPGFARSLSYGWYGAAFKAWVSELELGSCVTHQARHTLATKLLANGAGLHHIKRFLGHVSNRMTEHYAKVAVSEIEDVLQHVGVSGPGAARPGEMLSTGTTPLDRHEAQALALDLTRRSMLAEGGFCTFQPVVDGGACPWNLNCHTCDKFVLSGADLLYWRRKREQWMSIAERAPDDATADYLHQVFEPTARAIDGLEKALAGLGLLQDALALDLRRPQDYFHRMWSTAFRATDLADAVATEAMTYDDGIADEREEPCA

SEQ ID NO: 10752 - protein, 195 aa, Actinoplanes utahensis
MNNAAVPDLRTAAALAARRRSTEANIARVHDALARLRREGLPISVAAVARRATVSRTFLYANPQAKVAVSDAMAEAGERRSQVLDDQAVGREATWRERALNAEDALKAARTEILTQRARIGELLGQIRSMETEWAEESIQRITTENTTLKQQLRQLTADTRILDERLKAARSNIRFQDRRIADLEARLADPAPST

SEQ ID NO: 10753 - protein, 130 aa, Actinoplanes utahensis
MDTTEGSTTTVTDPRPRPKRRRRLVIAAVVLVAAVGATSFVWWGNPRMGEGSVISPGEGMSWANDGVTETRMVVRGRHAATVTATFSVRNDGHLPFTVHGLDASTRSNGSHISRSPSWRASPDSISRRPH

SEQ ID NO: 10754 - protein, 392 aa, Actinoplanes utahensis
MTVVLHVHGTGVREPDYSTGFDSFRVKLQAIRPELRVEPCYWGGEHGARLRAEGVSIPAGRSAREPQEPADRDVALWSLLAADPLFELSTLAAAEAAAARGGAGNFDPMAVRGAAKLIEQAPGLAAELQAGIAELGLADVFPGAVRAVLASEEISSLAHSEVRPADLRRPFARAVVAQSLLLAAEAARPPIDGTHRDALVAEIVAALGGTDRGLGADAGKLGLRLALRMGAGKPVERRRAAITRSTSAVAGDVLLYLARGAAIRDHLRSRIEELGDDVVVVAHSLGGVAAVDLLATTPLPAVTGLVTVGSQAPLLYELGALPGLEFGTPLPVGFPRWLNIFDRRDLLGFTSGGLFPGRVTDAEVDNRWPFPYAHTTYFGNDALYEELDSFLR

SEQ ID NO: 10755 - protein, 704 aa, Actinoplanes utahensis
MIDPLRTRAVVVGIERYDLGESWNLDGPALDACRFVEWLLAERVPAGNIRLHVSPLADNAAEVESHVAGRLDVRPAEFGPIRNSLLDVGEESSDLLILFWGGHGVRPPTEFTHLLCADARDRDRSNHRLDLLLHIMRTTAFAQHPRQLVIVDACQADVPRHWQLPVHQYQDADLVRAFRQQDTLLAASPGQSAGNDDRNRTGRFSDAVLAELSWPDEGRFDELYQRVKARVASAEQQPVRLAFLQDGVEQDVWVPRPASPKVVPLTDLTAYRASAAASPGDGRPPVDERYRVRLDVACCLDRAPGLAVLAGPVEPDYAAQLAAALTAAEDHLAAAGAVEPEAVRRWLVLTPSTGRPPATAEEIGAEPGWLRAPVQGAVVTGLTDVRVAGEYLRAIRRLVPGLAVLAVAGPERAARLARTLELPELLVAAFAPVETAGRPVPFPFPAGGALVALVAHLRAYGAQLPAVAGEPPAIPDEVDPVAWAAQVVAELNDPGHPGYDEAALLTSARDRRPGLYPALLAQYAERRAAPGRLTSLTVAAGTDAELSYWLTHATEPPDPAREMPAPEVVDALAVVLRRRSLEAAAPWAPYAGRRVSDLVTLPAAAAPGLFATASAEVALLAIRCGLGEGVEPAAVEHGPVRPGAWALLVQQGITADTAKWLSGLDDHLRRLVGLRPEDLSVADREALAAIRSALHPMLPLPHAA

SEQ ID NO: 10756 - protein, 2979 aa, Actinoplanes utahensis
MLADWYLCATQGLSLSGTDAYLDALRALDEPAERVELAEEAINQLRRVEPGLMLYALPRVLAAYRRHADRLSLAGRTAAYLAELDELAGGHPELRAAFDALADSPRRLRARIVALAEVVAADPADAETAETADAPGPAAVPDPYDDLFSAPLATAAVALAAELAARSPQTAREWLGDGEPELLTAAFDGRYGRLPFLLAVRFSALIDGTAENRQRLLARLWAFGRGAADLEPDLVQEAAGLSRAQASDVTETLTEAVAGLDLAAWRKNEPGLDPQRREIAQARWGGSGAPGAAATAAVLWQVAMWRVAAERDPAATLAGLRTWWAAPTLVERSRKTADLIVPFTVPYGEKGYEAAWNNLSTLARVRSWDQRRQPPRLQLTDGPVSATPAASASLVGSPWLLRAVQRWRASAERRAYPDWNDPPSLIRLSAAATLATDLLAAVPPGPAEDADHLLALLLLIRDTAVCSPLRDAIDPRAAVGSPLPGALVALYHHALMVADRCGKGDGPHAVPRRIVRLLTAGRAARARCDAEPTQWARLMIFAAPMAAFWWLRETVSGGWPEESEDEDGWLTGTAPTPAARLLRLLLAERLDLDSGQRAAPALLERDLRPDSRHAAGWDWRPHEEPDWDWLPNAETYGLTPPGADAAEQPRTRHVNANVLLLAPRHGLDEWRWWSTRLVKALGDEPAPMALQTVRLEALMHSPAEADWADDWADDWAKSVLRRVEPWELARIVRRRMIDLLRAPIDGDESEKLVGRVGEIVIDAILDLSRAAQWYHQLLLRELTRVAAPPSLATQWRYRAVGTLYRLGTEAAGHGAISPYEVIGQRVSAGLTANNVRELLFQHGGAPIVGQAAALGEAVERLWRDLRTGPPVRRVETPLSDLDHARADDLTTVAVQLDRYHGKLVSYHDSRDGVFDAFTQRDRVAAVTSALLAGADGYGIVCAVDQPARTVWVNAGLGHPARHKLANRDRMPGLGDLVVAHFAGTPGAPVVDRALAPIDRPLDTAEVREATVRPLAGAPWLAVEIGGMDVYPGLGATDERDRAARWRWDPDLARRYGAPGEPVETGACWDETIERWVPLDRGGRELIAGERAAFADGLRLVLAEQVTEDEQTRLRFVTRPGRAYLLGADDFAPDDWARLLGLVGDGRPGLAVTVRPADPDGLLVLLDEVDERNRDWLRIFDEPEDSEVAVHTAVWSSAGWHLRVEPPAGFPAEIAVTGLDGSAENALCVVREWGEPQARAATVAAERMADRGVPRPTEASEVRWHALAHLPKDSRVRLQRIVAGNLRKASLLGITQAGMGVFVATESVSLAADPATIHRFGRDREVIVESDRANEPVPQRDPVAVPDDQLLRLSAAAGLEAVLAGADALDGMVVQQVLDTEKRIIQYGLWLRNGNRVSHAVVPEPTLSALKAEVGDHIDFRRATTGWIGHIRRRQIRGRALYTGVAKVGPGWLPVGEVERDGRPYTVYQAPEAPQLATGKAAERVTERHTVSRLDNRSWSYNGQAYVRVLVERGNRAYVGEAREFPTGSLMRVRSTDLRLTQHPGDDNPRYTVRRTFSLEAVIKQPPRPAASAEIELDRWERALRDGHQHMVGIRDGDRLLLSGYRAPLPDGTLARWLPLRPDELPLVDGHAYDNGSVRALIEDVDAGHVASFARATPLDVAGFAAALSLPVDDTRTDLPDPLYYVGAEPGHHRFEWGFGWTVDVPVEALTIDGEPAGSGLFHGDRVRAVRLVHDPAPPGGIGLRLEGRDVATALSGRLMQESAAGMIHRIQVEIDLVHGRVAVLGVHTQRQGASGDRIEVAAHPIRAELADAEAVVARERKAGRSGKVTRQLHARLDTSEAARQGRRKVFTLIDPARLAEGDLLYARADRIVDTGNELCLELRPLGSAGQKWTFSVARRQFSPQVGLLARQLRSPGGANAYRGRQFMVRLVRKAPNRRDRWHGSIVDTPARPAATLASWVRQQGAACFAVLGRDDVLEVGPGVFYDAAGVPGARRLEPGTLLRLLAVGAGKPLQLEVAIPADLRYVRNGRPALALPKNSVLGPGGLGQARNGNAFTLADLPAIEARPDRGLNVRSLLQTAHPKIVYAVSPAPDDHARLRSIDPGTVVGSLELDPAGPARLHPVGGAEPHTLPWAQLSFAEGSRAELARRLRDGTWEYHDATTGHWDADGRECRRQELGPGNAERWPVFFADRGGPTVRYPRNQLLRLGLPTAELLDRPIRGREEETYVVADATTLEGIPALWLELSPGRVAEIPVALFASRRQSLADLDWSQMRGGDLVTVRRRRNEQTGHVTLELRDWTPGLRGAWPGSPGIVLPVVATDRAAGALQLGAGGHTRWYPAEPELLDRHPVGSRVRLTSANRLGAGTVRTDDTVLLMPRDGGWGLAGFGDVEVTLAGDGPTPWPGAAWLRDLLAGPAAASGLLTALGGALPVTVDELGRSGERLTVTVSRRNQPSGRWPRRRIVRTEVVTSIRGSLVLRAGHALYLIAADKAVPGLDSSAVAAAATALRDRRAVLWWHHEEDELRPGTSAGTGHAEQAVLIEAPIEVDGQFLGLIGRNTETGALGWLPSRLASWIGEPDPRLPGLLAGPAPVPMVRERQQFSVVDRPAAAREHRLTEVGSVLSVVVAALPAAGQPGYLVRTAYTGVLLTLTAASGLALGQRLRAEVTAVRGGRFPQIVAVPAGDRRAELDLPRTIAERLAAIHATADEPLAAVHAGSPAIDWDQPFRDYRAANLAAECPVDPAAAVVWSAAHRADPGVLARWLAAGGREALAGRADQHLAPLLAACQVAAELGESDARAAALAVLIAHQIGRRAIRSLHVEPLVTHWLAQPERQTEPGLWAQIKRLELAPEMPPDRLTVVVQRCQAILARPVLHGREDLRAPVAHALLFATGSPARVERFGDRANWQPDAPLLSELAALGRGLTPPAGRPVAQPALLPPQRQIVNRAAREVIGQALPVILLPTLSAPPAQWQTLLDTDGR

SEQ ID NO: 10757 - protein, 92 aa, Actinoplanes utahensis
MTVGGSANIRICLRTVHPASQIRDAGTIGRAPSLEVAPSAEVISFADKAYQGVGGTVRTPFKRHRCRPELSARQKPVNQAHARIHAQASAPS

SEQ ID NO: 10758 - protein, 119 aa, Actinoplanes utahensis
MSDLLRHALVRHRGEQNTADSGRSRPATHSAPHCGHATRWSCFAAASRARLRRTVRQCRARHAVEQNSIDIRVVGGNRSPQTGHRRGGSSAESRTALDGCGTSDSQPRAPRFAPLIPQA

SEQ ID NO: 10759 - protein, 278 aa, Actinoplanes utahensis
MTHRRAYPSDLSDARWALIEPRLSAWRQKRTDAGVGGRTAEHDLREIFNAILYVNRTGIAWRYLPHDLPPWQTVYWYFKTWTEDGIFTDLNYDLNGLVRNKSGRSTTPTASIMDSQSVKTSTNVPTASQGIDAGKRIVGRKRGIITDTLGLLLAVIVTAASVSDNTIGIDLLDRATRIYPTLTKAWVDAGFRTKVVEHGATLGVDVEIVTKDPQVKGFSVIKRRWVVERTIGWLMQHRRLARDYETLPVTSATMIRIAMIDNLTKEAVDETTPTWRDT

SEQ ID NO: 10760 - protein, 169 aa, Actinoplanes utahensis
MTRRFGDRARFAVEVGEAWPPPPARATGELRTVDLWAAGKWLTTEDNTVFLPTFIGFLRSTAAKVRRRQVSPCPFPEHSPEEVFQLLYADDETDFREQFWLMHWGENVDNVTSYAYLDADDLVIVFSHRRAEHHPAGGPDKVSVTRIPADEFATVLDEAADLLDAELVR

SEQ ID NO: 10761 - protein, 51 aa, Actinoplanes utahensis
MLGSAVVLEEKWPVLGRHERAAEWLRVWTDLGRAPRTIDAYARGLAEYLLI

SEQ ID NO: 10762 - protein, 298 aa, Actinoplanes utahensis
MTAGRLHVAAFVKDLSTRPSRRGENVVALDSGAGLANATLQQRLVPVRLFYDYLIEEGLRESNPVGRGRYTPGRKFGSHERGLVPRLVKLPWIPSEQQWLDLLDVVRQEPVRNRVMLALAYDAALRREELCSLRTDDVDPAHRTLRIRAETTKTRRERVVPYSAPTGVLLSGYLAHRATISRARGPLFLSESHRNHGQPLSLWTWSKVIRRVALAADLPRFSTHTTRHLCLTDLARMGWELHAIATFAGHRHTESTMTYIHLSGRDLAEKLNRGMQQIHSWRIDMLTRVGNSGGMNSR

SEQ ID NO: 10763 - protein, 774 aa, Actinoplanes utahensis
MTATTTKAAAGSARLPASWPWPLDLDRYDRRALVTGAEAKALAVLEIEQLRRLGLTPQAAPRRLVEPLAHARDCLQWAPGTGHQRRFASDAAGLILIRCGELGRSYWGWSDEDWTDLIDRSGGEFRRRWSGQIGSNARPFVIAYAYLLGGFTAFEQIGRFQRPTLAHRVFGQALVDGAVGKILAVLGDWGYQRRPERLVSAVCQALLLNRSPRLEDLSGPALAAIRASVAMQESEWASDLHGIHRAVAALGHADPPPRPRHGPGPTAIEGTSGAWVDWVERWHATSTLTPKVRSSYRSVLAKIGRWLATEHPDVTAPEHWTRQTCASWVTAVDRMAVGDYSQWTTGMRSQGRIGKPLTPQAKSGYIQVPRTFFRDLHEWEWIPQRFNPAHALRTPRSVQALMGPDPRVIADDIWAKLLWAGLNVESGDLPTADGRTYPAELIRGITLTWLFAGQRSDEIARLRVGCIRWQHDGMPIPGDSGEVLARDAVCLLDVPTHKTGTAFTKPVDPLLGQAIEAWQAVRPDQPAILDPKTNEPVDFLFAFRARRVSKHYINGTIIPMLCRKAGVPTADVRGNITSHRGRSTIASQLYNAKEPMTLFELQEWLGHRTPEATAHYAKITPNTLARAYNDAGYFARNVRTIEVLVDRDAVASGAAAAGEPWQYYDMGHGYCTYTFFEQCQHRMACARCDFYTPKASSKGQLLEAKDNLQRMLASIPLTDDERAAVDDGQAALDQLLERLVDVPTPAGSTPRQIGAPATATLLPILAITKRPHDE

SEQ ID NO: 10764 - protein, 117 aa, Actinoplanes utahensis
MSITSGGVPSSAHLAAELDTLDNNVYGFMHNTFDLESLAGSFAQLGWAARRSASDEYEITCSWCRLNLFNSGGMPKFAGVVEPTRVDDLADVFRSLDVDYEIELYDVEGELVRTLLP

SEQ ID NO: 10765 - protein, 549 aa, Actinoplanes utahensis
MDSQSVKTSTNVPTASQGIDAGKRIVGRKRGIITDTLGLLLAVIVTAASVSDNTIGIDLLNRATRIYPTLTKAWVDAGFRTKVVEHGATLGVDVEIVTKDPQVKGFSVIKRRWVVERTIGWLMQHRRLARDYETLPATSATMIRIAMIDNLTKRAVQLPDEQSRPTRFRRGGFRTARQAQTARNQTVASAAAGAGPRRVTVEQWLRRWLLSLPGQVRRSTAAGYSIHVRRYLIPHLGHHTLTGLRAAHIEAMFTTITAQPSRTGAPLSAATLQKIRATLRRALNMAIREQLLAINPARLVLLPRPRRHRPQPWSASRVAAWQANGCKPVVAVWTPQQLAEFLLFVRDDPLFALWWLAALRGLRRGEICALRWTDVDLAEGTLTVSHTIAHANGRPYWDTPKTAAGQRTVALDRMTVAVLLRSQRQQRRQAQCAGERWRPDGPVFTRQGRAIRPDWLTHRFATLVAASGLPPIRLHCLRHGAATLALAAHVDLKTVQDMLGHTSYAFTADTYATVLPDQAKHAAESTARLVLNALHKACTAAGAGSQTGS

SEQ ID NO: 10766 - protein, 402 aa, Actinoplanes utahensis
MGSSEHGDEPLKKAFAASSLFGDPEIFRLTEPLASLFGRIAADQAQQRDRFAKLIGDITGTARARESLSALAEAVAADQAQQHARLTEMAANLTGTTQLTKSLTSIAGHITADQIGQRDKLIKTIGEVAGAAAMDKDALSFMAHQVAADQAQQRARLSEIAADLAGATQFTESLTSTAGRVFTDQAGRYDSLAQTIGPPAVGVRLTESLTSPLGRMAVLEPGQIEGLARACRPNLDDLAESLSTVITQINPDLTHRTVSASVDVLQRIVADGLGEESLDQLADEVTASSGYADLWRDIQTEVKTVLQEAGEESGHAGVRDAAAWHISWLWLLLRESLPTVTTVEKISKVVSISTVAFICCAVLRTTHPKLWADLEELQLTPFDFVGYLFGVLAWAETQKDRS

SEQ ID NO: 10767 - protein, 60 aa, Actinoplanes utahensis
MTGSRNITHGPLAAIAEIPLDYAGYGIVALFFLAWIIAIAVWHFGRVEERWSANLASNTK

SEQ ID NO: 10768 - protein, 93 aa, Actinoplanes utahensis
MIPAGPGLAFLAAQQAAGVVAAKHRGDFAGAEQLLVAMGDAQVQARGFCLLAELALSLVRRQTGQSMDELVQELTLLIADCGPPSPPPGEGDG

SEQ ID NO: 10769 - protein, 209 aa, Actinoplanes utahensis
MAIYTLPDMPYDYGALEPAMSGQILELHHSKHHAAYVKGSNDTLDQLAEARDKGDYTALVGLEKTLAFNLSGHVLHSIFWNNLRPGASADRPDGELEAAIVEHFGSFEAFSAQLSTATKGVQGSGWGVLAWEPLSQRLIVEQVYDHHGNVGQGSTPILVFDAWEHAYYLQYKNVRPDYVDRLWSLVNWADVTKRFDAARAAGNPIIVAP

SEQ ID NO: 10770 - protein, 352 aa, Actinoplanes utahensis
MTTRQRTLRKYAAATIIAMTATGSAISPPTPAAAAAPTAAATWSSMMYRSLTHDEQLATLRTSLAAQQAIRRAADTELAAATDALRTAQSALTTATTANTQAQAQLTAARAALSTAQRTLRTVSHRKPRNAAALTRARNAVTTATQTVATRNSEAAKGVAALTTAHAAVTAATSRTSQASTAVTDGTAGLNRAENAITALPSAATLAAQAAAISRDVVTQIRAGFAITDTTQVYGVTVNKTIAFAFQHMIDDAKADGVQMSGGGFRTTQRQAELRTINGCPDVWTAPPSSCRVPTAIPGRSLHEIGLAVDISSGGKTITKKTPAYTWLTRHAKQYGFVNLPAEAWHWSITGN

SEQ ID NO: 10771 - protein, 471 aa, Actinoplanes utahensis
MSSSSDREVRRVLWPVRSGIGPVANGGWDRSRRLAGYPGYGSAAADVAVAEELVFMAGHHHSHAAPGGVSLPHARRLTVALLIPAVLLTAVGMLLLWPRHPPKAETAAGGPAQAQGVVLSTATAACAPVPAGETRPAGCGTAVVRLRDGAQVSTELPSGPGAPVISSGDRVTLIGLQDERGSVTWSIADHQRSRELWLLGVAFVLAVIAFGRWRGLSALAGLGVTFAILLYFIVPAILDGRSPMAVAVVGSAAIMLTVLYLTHGLNVTTTIAVAGTLASLIITTVLAEISVAAVHLTGVSDDTSNFLSVSQGRVNMQGLLLASIVIGSLGVLDDITVTQSATVSELALANPAYGFRQLYGAASRIGRAHIASVINTIVLAYAGASLPLMLLFATGGTPVGDLLTGQLIAQELVRSAVGTVGLITAVPITTALAALAAHRMAAPSAKPAEPEAGRSARHRLPPERPWAASER

SEQ ID NO: 10772 - protein, 61 aa, Actinoplanes utahensis
MSDRRRRPAARGSCVSITAPAADTYTVVADGYAVSSGSTAYDYRDVYYSKLPGLLTVLATR

SEQ ID NO: 10773 - protein, 191 aa, Actinoplanes utahensis
MSSPRGMSRVEAREVTVALAGPGDLVEAEAMMREVLEADLGGYRPQWHRDLDDLEAAYLRSAGCALIVARDPDGIVGTAGVKPCALASPPNPQWLAHRYSQPDVCQLVRVWVAAGGRRRGVGRAVAERAVAWSVGPGGYRRVYLHTDASVPGAEAFWRSLPTREVCDTRPDPFNTVHFEIDVAAMLRTSEC

SEQ ID NO: 10774 - protein, 287 aa, Actinoplanes utahensis
MLSVPVAPARDVDERVLAGRILRVYDGLRAQDSLAPSPEVNSLFADLVSICAHADPADASSALTDPRITEARDGLVRLCAEGESRLEQWWARRTLAAADPHAELAAFPYLRNYQQLAHLERHALAGTGHRPGESRRLCFLGGGPLPLSAIMLSRMLDTQVTVVDRDADAVALSRRLLDRLGLAEQISVLLADASSASDLAYATASCDVVVVAALVGTTRIEKQAALRAVGTALEADTRVLIRSAQGLRSLLYPVVDVRDVHDAGLVPEVLLHPFGEVINSVFVARCR

SEQ ID NO: 10775 - protein, 398 aa, Actinoplanes utahensis
MVYRAAHAFDGEKFIPGGLQVHVAANRIAAVRAYAEPLPAGQPVVDRPGCTVLPGLIDTHVHLVAGGEPDALRWDAGRSAAEREQVVRRSLLAQVGAGVTTVRDLGDNRFAVVDRTVRDDEPSVVGSGPPITSTGGHCAALGGAARDRAGLRAAVAQRYDRGAQIIKVIVSGGAMTAGSDLLRLQFDVAEVRDVVDEAHRRGLPVTAHAHPVSAVQVCLAAGVDAIEHCTCLTDTGIATPDAVIDALAARRVTVCPTFGRLPGLPPSPQAIEVMRRTGMTLEARFAQVGRLHAAGVPLLAGSDAGIHPAKPHGVLAYAVEELVRSGLPVHAAVAAATSGAAAACGLAGTVGRLRPGMAADLLIVDGDVERDILALTRVRDVVLRGRQIVNDTGPRTPS

SEQ ID NO: 10776 - protein, 368 aa, Actinoplanes utahensis
MSSAPPRTGPTRPSRRTAVVLVTALAAGGVLLSTTPRRSNSAPAAGPVTVAAAWPHARRADLPGTLADGTRFNPDLFLAADTVIGTAATGDGRQVRLLLRSTGGLRELRRQPADAAPQFDNFAVAGDDVVWTESTDAGSTEIWSVNTRDGRPAHRLTADTGDTVFYGTQNDLVIAGGRVYWAAALKQGQDTEIRSVALTGGAVTARRESGTWALTTWPWLTDSTGGPSRMLRMRNFNTGRDVQVATSAEDAAECSPVWCRVMISGSEGLVRIDLMHPDGSARRRIAGADASAAVTDVAILDRFEILSQTIPGSDVTGVAALRVYDISTGTTVDISPAVSAAFTRAGVLWWSTGSTDTVMWHILDLRTV

SEQ ID NO: 10777 - protein, 236 aa, Actinoplanes utahensis
MSQAVIMLLFGGAITRATLTDVFLRYVKEGLRPFLLVAGILLVAAAVMTLWHEWRPGGDGHHDDGHGHGQHEPAVGWLLILPVLAILLISPPALGSYTAKQAGSVSVQPDTTSDYPPLPAGEPVTVNLLDYASRAIFDKGKSLAGRTVRMTGFITPDAAGKPMLTRIVLICCAADGQPIKVGLTGGTPIDAPADTWVEIIGVYSTQTGTDPVNKAPIAYVEVKSWQQIAQPKQPYA

SEQ ID NO: 10778 - protein, 347 aa, Actinoplanes utahensis
MTTSDVDSHEHPRPMSEPAGQSEVPQPGRRREAGIGSLEVLAGLLIVLVLVRGKLSGLLTGPGLQTWATVFVSVLVQAVPFLVFGVVLSAVIAVFVPRSFWARALPSHPALAVPAAGVAGVILPGCECGSVPIAGSLIRRGVTPAAALAFLLAAPAINPIVLTATVIAFPGRPQMAVARGVASLVVAVAVGWLWLRLGKTEWIKLPHRPDLDDSSRSRAFWAACRHDIMHAGGFLVLGAAAAATINVVVPASWLQSLAGNPVVSVIALATLAVLLSICSEADAFVAASLTQFSLTSRLVFLVVGPMVDLKLISMQAGVFGRRFAFRFAPATFVAAMLVGTGFGLVLL

SEQ ID NO: 10779 - protein, 99 aa, Actinoplanes utahensis
MTARPAVSETALHRAAAAMRGMAYEHRLHILVILRDGEATPTQLAAALAVHTTVVAHHLRHLADARLVRRRRRGQRVLYSLPDEATNRLVAEVLRYARE

SEQ ID NO: 10780 - protein, 283 aa, Actinoplanes utahensis
MSWWADALHRATAEVILVGALAGLIGVQVVLRRLSFFTMALTHATFPGVVAASIIGVNILAGGAVAGAAVALGVAALTSRRGQDAAAATGVVLSAGFALGAALVATQNGFSRDLSAFLVGSILTVTTADLITTLVALVVVALVLAVFARPLLLVGFDRTGAQAAGLSTGTWDLVLLLSIELVVVTLVPAAGTILALSLIVAPAAAARLWTDRLPVMTVLAVGFAAGSGLAGLWASGRFDIAAGASISLTATAILLISWTATRLRPAAQRATAHRAGSTKPVRA

SEQ ID NO: 10781 - protein, 296 aa, Actinoplanes utahensis
MIEPFAAPFMARALTEIALLALICGPVSVFVFARRLSFVSDALTHTIFPGVVVGFLAGGIEGLFAGALVAGVVTALVLTLLTRGGRISDDAATAVVLTAMFSIGVALVSRRASYTADLTSFLFGRLLTVSPRQIAETAVLVVVVLAALLIGARALLFRTFDPAGAAAAGFRVGWLDLGLNILVALVVVAAVRAVGTILVVALLIVPAAAGRMVTDRLVAMAILGTVLVLGAGYGGLWLSWTASMDYGVSLTAASAVVLLLVAAYCLLIPVRWIRDRRRRRHVPLPRQRSAAHELVG

SEQ ID NO: 10782 - protein, 286 aa, Actinoplanes utahensis
MPCTATASAPTAPRKAPTSVPSSTTPRSSSPRWPADMTAAFTYSQVSIGYQGTPVLTHVDLTLAPGQRLALVGPNGAGKSTLIKSMLGLVPVLGGAVTVLGDSPAAARGRAGYVPQTDTLDADFPVSVRQVVMMGRYRRIGWWRPAGRYDRQAVADALEQVGLPDRAAHRFGTLSGGQRQRVLLARAIAAEPRLLLLDEPFNGVDAVSQDAIVRVLRELSAGGAALVFSTHDLQVARDLADQVCLINGRQWAAGAPAKTLTADNLRRTYAGSAIDLADGRMVLVEP

SEQ ID NO: 10783 - protein, 317 aa, Actinoplanes utahensis
MTFRHPLLWLASLTAAATVLAGCGSGGDAAAAPAGSGGKPLPVVATTPEVTDFVRAIGGSDVTVTQIIKVGVDPHEYEPTPADIQAISAAKVVVKNGVGLERWLDQTIASAGFTGAVVDSSHGVALRKGDPGDAEMADGDPHIWHNPQNAKIMVTNIEKALAAADPARAETFAENLAGYCAKLDKLDADNQAAFATLPPADRKLVTNHDAFGYYVDRYQLQFVGSVIPSMDTSAELSAQQLTDLVAKIKATGTKAIFTESSLPPKTAEAIATQTGVKIVAGQDALYGDSLGADGTPQGTYLGAEQHNTQVIVSALAG

SEQ ID NO: 10784 - protein, 62 aa, Actinoplanes utahensis
MPRITTCGSRPVSLPAIATASSASSGDRRPRGPAAESTAQRVLAVILAEVTVVEPAAPHRPR

SEQ ID NO: 10785 - protein, 436 aa, Actinoplanes utahensis
MAATSNGTVFARCACRSAETGKQLGARCPRLGQVGHGRWYIDAHVPGADGRQKRLRRGGFSSRAEAERGLAEVLELPGPEAMAETWTVKRWLEFWLSQIEDRVRPSTVRAYRSVTYRHLVPWLGRYRVAELDGRRGAKLVQRAVDGIGRQEKRDGDLVAASTVHRVVAVLRSALSEARRQGLVSSNAAWRLRLPTGARPQAVAWTREREALWRATGARPRVAVWDVENVAKFLEAVEGDPLFPLWWLVALRGLRRGEVAALRAMDLNAEFRELSVERQLLIVDGKVRLGPPKSAAGVRVLALDEFTNQLLRQHRDRQQARFAGTDRNPRRYLFTHADGRPVRPDWLTHRFHALVAEFGLPPVRFHDLRHGAASLAGAAGVELKVIQHDLGHSSAVTTADTYWTVFRELADRAVAATAGLLRTHARIRLNLGAASQA

SEQ ID NO: 10786 - protein, 182 aa, Actinoplanes utahensis
MREEEQEDLSRRAAAGDRAALESLLGLIQPSVLRRCARFLPCYQDAEEACQDVLMQVARNIAGFEGRSKFSTWLHVIIANSSRQTYRMLKRRAAEQSHDETPIDVADPRTTSVIAGSRLDLLDALERLENRRAELVAPMVLRDICQLDYREIAEHLGIPEGTVKSRIHQARSDVRGFLLAGL

SEQ ID NO: 10787 - protein, 439 aa, Actinoplanes utahensis
MIGRYRVTRRLGSGAFATVWLAEDDVLESYVAIKVLAENWAHHPDVRARFEQEAQVLRRADSERLVRVHDFGELADGRPYQVMTYAGGGTLADRLEAGPMPLGAALRTAVAIADAVTVLHHSGVLHRDLKPSNVLFDTVRGHERVLVADLGLAKEIAQASGFTVVAGTPGYMAPEQSRPGGGLDVRADVHAIGALTYQMLTGRTPLEGRGAAPSRLRPGIPRQVDRAVLRALSTDRDRRFPSAEAFASALDLSGRRRPLRSFARFAGTSLALAALACTTAATLPDATPPGWTRVGDAARAISVAVPSSWAHQMRDSGWDPASLGLPAAHWPGLQVGADLRDPAAITPAVLAGAGDWTGRLVATTLPRHRACTEQPPRPVSVDGLTGQVRRWTSCSGTAVSFSEVLLTAPGGRGAYLQIRQDGPRDRTDELLRTLRAAHS

SEQ ID NO: 10788 - protein, 216 aa, Actinoplanes utahensis
MRRTIATLTAVAGLSLALTGCTRKPDVVSGEAAPIGGIVSATTTPPPAAAGSPTTTTPTTKPAVRVVSTGNTDPAPAKRLILGPDGLSALKIGMTAQDALATGMIVGYHASTACTTSHLKGHDDAVVQHSPGKGIIAISAYGDIRTPEGIHLGSTLEEVMKAYGKRFKPSEVDGTVQSRTGRAWATSTDLVNYRFFVKKDKVVELEVEHAHQDCYE

SEQ ID NO: 10789 - protein, 348 aa, Actinoplanes utahensis
MQRTSGIAALVALTTLAAGTPAFASERRPAREITAEAETAALHDDDPGGNGDTDDAAVWVDPANRTGSLVIGTARNGGLRVSDLTGREVQSIATPDGGRFSNVDIVSGFRLAGQKVDLAVVTDRGLDRLRVYRIGASGLTDVTSADAPLLFSRDQAEVRAQATGYGLATYGRYAVVSRRRTTRLGLFRLEERQGRVTYRTSDTLDLPSSFRLPDGGTWSPCAEPGQGPQIEGLVVDAEAGVLYAAQEDVALWRIPLTGGTFSSIPRIVPSSSLPRTVAFRSLPRTGPSRSLPWALDAGKPCDTTASVSLPGYPKGLLVLPHGENITTNDRASTDFKFLDWRNLQITTF

SEQ ID NO: 10790 - protein, 512 aa, Actinoplanes utahensis
MSTTRPPPPASRCSNAPRRPACGPPSSCTAGSWTRSRRPTTTCSPGGSRCRTGAGPRSPSAACSPGPAPRSNWRPEMGARVALFTRDLRIHDNPLLSGPDPVVPLFVLDPRLSGLSANRSRFLHQSLADLRNSLRERGADLVIREGDPVAETIAVASEVDASTITVAADVTGYAQRRERRLRDERFRVKTVPSVTVLPPGTVRPGGGGESYRVFTPYFKAWEKAGWRAPSATPGKVAMPAGIAPGRLPEMPAGDSPDAVAGGETEGRRRLQAWQKEMARYAEDHDDMAADNTSRLSAYLRFGCLSPLELALAAKADDSPGAQAYLRQLCWRDFYYQVTATFPEISTRPLREKADQNWRYDDDALRHWQDGLTGVPIVDAGMRQLRAEGWMHNRARLITAAFLTKHLGIDWRPGLQWFFRWLLDGDVPNNSGNWQWTAGTGNDTRPYRRFNPIRQAQRFDAQGVYVRRYVPELKDIDGVTVHQPWRLPESVRRGLDYPGPLESHRDEAVWLRD

SEQ ID NO: 10791 - protein, 295 aa, Actinoplanes utahensis
METDLAAAYERCRELHREHGRTYYLATRLLPAWKRRHVHALYGFTRFADEIVDRTEAQPPAERAAELATWSAGFLAGLRGEPVDDPLLPAVLHTIAVFGLDLEDFAKFLRSMEMDLTVTGYRTYDDLLDYMEGSAAVIGTMMLPILGSTDPAAAREPARQLGFAFQLTNFIRDVAEDLARDRIYLPEEHLAEFGVTRADLAAGVATPAIRALIRAEVDRAREHYAAAAPGIPLLERTSQACMRTAFQLYGGILDEIEAADYDVFARRVTVPNRRRAAVAVRSLLTRPGTPVELAA

SEQ ID NO: 10792 - protein, 356 aa, Actinoplanes utahensis
MANDTLEGNRLAAIPRQSVSHTGLVGAVEGTLADFLASQIASLDAVDPSLGGFGRTARDLVMAGGKRLRPTFAYWGWRGVAGPAADAETLLPALGALELMHTFALVHDDVMDDSSTRRGRPTAHRIFAAQHGGRFGTSAAILVGDLCLVWADQLLARTPVPAATLLAVRAHYDRMRIEAVAGQYLDVLGETDPASWSVERALLVARHKTASYTVQRPLDFGLALAGVEDVEVAEAYRTYGIAVGEAFQLRDDLLGVYGDPAVTGKPVSDDLRTGKPTALLMLARRMATPGQLAELESAEIERKAQVVAETGAPARVEEMIRARVTEGLTALASAPIDAEARATLIELATVATQRPA

SEQ ID NO: 10793 - protein, 504 aa, Actinoplanes utahensis
MMKPPTPWSRGVRTVTGPTDRVVIVGAGLAGLSCALHLAAAGRQVTVVEREPVPGGRAGRLSVGGYDFDTGPTVLTMPELIAEPLAAVGENLSDWLELTPLDPAYRAYYPDGSTLDVRTDTTRMAAEIAQVCGAREADGYLRFVDYTRRLWQLERDHFIDRNLDSPLDLLNLNLLKLLGMGAFGRLQPKINEFFRDPRTQRIFSFQAMYAGLAPHDAMAIYAVIAYLDSVAGVYYPKGGMHAVPKALAGAAEKHGVTFRYDTTVERVLTQHGRATGVVTVGGDVIEADTVVLNPDLPIAYRDLLPARNSRNLRFSPSCVVLHIGSSQRYSKIAHHNIHFGTTWRRTFDEVINRGLLMSDPSLLVTNPTHTDPSAAPDGKQTYYVLAPAPNLVSGPMNWRGGLAERYADELLRTLEQRGYIGFRDGVEVERIITPADWADDGMAAGTPFAAAHTFAQTGPFRPANLHPTLPNVVFTGSGTQPGVGVPMVLISGKLAASRITQGAS

SEQ ID NO: 10794 - protein, 194 aa, Actinoplanes utahensis
MSSIGHLNREDHLVELVNEEGQPLGSATVSDAHLSPGALHRAFSVFLTDDEGRVLLQQRAAAKTRFPLRWGNTCCGHPAPGEPVTVAAARRLTEELAVRDVTLTEIGVYTYRATDPVTGRVEHEYDHVLIGALPDGVVPHPDPAEIATLRWASLPGLRTGLTESPELYAPWLPGVFEILTERSGVLSTERSGGR

SEQ ID NO: 10795 - protein, 189 aa, Actinoplanes utahensis
MSFPRSGRVAGEALSAEIPTSPGSSVASSHDIPATAGPGAVRTGPVAAAPGGPSDTPLTDATAAASGAADDASRARPATATDDASRTGPATAATDSPDDAVRTGVADAAPAGRAGDVALSAGAAARRLGVAVTTLRTWHQRYGLGPSRHEPGHHRRYTAEDMDRLQVMQRLTTQGVAPAEAAAWARSTS

SEQ ID NO: 10796 - protein, 224 aa, Actinoplanes utahensis
MASPPTPAAPGTAPRSAPAGRGTRPTRGPAPTARGLTRAAMRLDVRGMRDILCSTLHDRGVIPAWTEVMVPALAAIGDRYEATRRFVEVEHLLSRAVTEILASVPHPAGSPRVLLAAADEEQHTLPLEALAAALAEGGVPSRLFGARVPSQALLDAIARTGPAAVVLWSQRPATGIVTQLTRVRDIPHPPLVIAAAGPGWPHDLPSGITRLTGLTEAVHLLATV

SEQ ID NO: 10797 - protein, 116 aa, Actinoplanes utahensis
MLAVSVRLARRHSDVQSFTNEAEQTAYNLAEALAEKAMTFMRNAEEAAETFRRGRIAMRRQFMARGLSEAEADIRFAGTTQASRAIADNTFFMSQASMYNTAAATQYAKALYLKKQ

SEQ ID NO: 10798 - protein, 173 aa, Actinoplanes utahensis
MTWLFRGPLARRPIRGRPEAGGRTAFPESFAAERGLTITRTVWNVTEAPQHAFDDATQILTSALSGDSDAVASTFNAVVSRDGVVGAWDVAWCLAATMVGQLPGIGAWTLEFPGIDDARYDKRWVARFVSAYVNGDANTGEALFGAAIADGQLPDCLLALAGSTVATLRHRAA

SEQ ID NO: 10799 - protein, 132 aa, Actinoplanes utahensis
MQHLFTSNGGGALAERMGIVITEATAERVVGTMPVEGNTQPYGLLHGGASCVLAETLGSVGAVLHGQTVDRPFAVGVDINATHHKAARSGLVTGVAVPVHRGRAVATYEVVLEDEAGERVCTARITCLLRGA

SEQ ID NO: 10800 - protein, 84 aa, Actinoplanes utahensis
MSEPQEIVETRGDDRVDLITSDANHDGKVDVWVSDTDGDGKPDLFQFDTDGDGKVDVTMVDLDEDGTPDTIVDGDGGLPPAGTV

SEQ ID NO: 10801 - protein, 322 aa, Actinoplanes utahensis
MSEPVRPGDTRLDTLVRVPAFWVVITLLAAGAVRMSQLLARFLHLYPIATITALGLFALLAVPFWMFVQELDFLEREPAGLLAVAFAWGGVVATSVSIPGSTALENLIAKLGSPGLAADWGAALAGPTVEEIAKTLGVVAIVLIARSQVNSVLDGVVYGALVGLGFQIVEDIVFAIGAVALAGQGDEVRPVITTFLVRGFLAGVWSHTLFGALAGAGIGYLVVHTDRSRSRRLTMAGLALFGAWASHVLWNSPLFRDGLGNGAVALLAVLTFKGLPPLLLILFLVRRAHDREAEYYVARLAGLGDPEVITEAELHALGSGAR

SEQ ID NO: 10802 - protein, 191 aa, Actinoplanes utahensis
MGTVTRRHLTDLPSTPGLLGAIVLVALLAALAFGLPALDHAVSAQRAVPAGQPYRVGAGVTVVPPTGATLDVTGTRPGEDQGTALFRLGPVRYAIAVQPFSGNLTQAAVRLRQRITGTAGYQITGTQLAVSTAGGLAGLQGGYTAGDRGGRYAVFVVHGLTIEVTVSGADLDLDHTLPAIDASTRTVRYEG

SEQ ID NO: 10803 - protein, 210 aa, Actinoplanes utahensis
MASEIGRPAGPPVLPCGHGAESLTELTRDQVRLSRRMSLVLRHRPETAGLTLDPQGWVPVADFLAALGISRAELDHVVAFNDKSRFAVAAGPDGVERIRASQGHSRRVEVDLDLPPAIPPATLFHGTPRANLDAILRDGLRPRTRHHVHLSADVPTALVVGRRRSPDVVVFEVAAGVMAAAGHVFHRSENGVWLTSVVPPVHLSLKRTNP

SEQ ID NO: 10804 - protein, 258 aa, Actinoplanes utahensis
MEQPTIGDAFGEMITDAYAVRTGIGPRPLAGGRLPRPVIEVIERDDGLINGAPADHYLDEPDAWQPHDHRALRLCRGHVLDIGVGAARIALELQRRGMAVTGLDTSPGAIAVARKRGLRDTVLSTVDRYATATARYDTFLLLGNNLGLIEGPERAPAFLAALSRLANPGARIIAQGADPYGTKDPVHVSYHRRNRERGRLGGQLRLRLRYRLVATDWFDYLNCSVDELDALLQGTGWHLKSVDRQDHPYYLAVMEQNH

SEQ ID NO: 10805 - protein, 69 aa, Actinoplanes utahensis
MASRTHDPEPLLTPAEVASMFRVDPKTVTRWAKAGKLSAIRTLGGHRRYRESEVRALLQGQIPTQRQGD

SEQ ID NO: 10806 - protein, 279 aa, Actinoplanes utahensis
MPSLFASYLRVYEPLTAFDRERQVFWRRYAKEGRDLGPIEGPVRQRTAVLEALGAGWTRLPDLPDEAYVLEWENALLICPWNLRLRVAEAALSARDGVPAVLADAFVPPVLAGQAKAVVEDWRSGARVLEQGVPRVHEQIATWGVPLRWFAFVDLEEREIALTGRRRTLRYRTEISKARRRAHRAVSVLRKSLGDAPITEAVEEGTRWLEEFHPRSVVELDYGGLVNLLPEDKLTGDDSPGLVAAGLSALSQGDADAAGEAYEKLVARWRSVQLLERCN

SEQ ID NO: 10807 - protein, 359 aa, Actinoplanes utahensis
MGVFDTDGTDASGHEQVVFCQDRVSGLKAIIGIYSTALGPALGGTRFYPYESEEAALADVLRLSRGMAYKNALAGLDLGGGKAVIWGDPATVKSEALLRAYGRFVESLRGRYYTACDVGTYVPDMDVIARETRYVTGRSVEHGGAGDSSVLTAWGVFQGMRAAAEHTWGSPTLAGRTVGVAGLGKVGKYLVGHLVADGATVVATDVNEAALQWARTTHPEVHLVPDNQTLITSDLDVYAPCALGGALNDDTVPLLRARVVTGAANNQLAHPGIGKLLDDRGILYTPDYVVNAGGVIQVADEIEGFNFERAKLRATGIFETTRRILQLADDEGVPPAVAADRLAERRMADVGRLRSIHLG

SEQ ID NO: 10808 - protein, 72 aa, Actinoplanes utahensis
MGRGRAKAKQTKVARELKYHSPNTDLTALQRELAGSTRQSDHHFDDDNEEFVDDDEDDADDDQDSWSPPRRI

SEQ ID NO: 10809 - protein, 75 aa, Actinoplanes utahensis
MPEITSPRPSDAVETDPVTARVHDTRAGLAALIAEAETARRQRAEEATPESGSAVCAWNHFENIPTFYNWNNRPR

SEQ ID NO: 10810 - protein, 374 aa, Actinoplanes utahensis
MADAWSGMRGISPEPGYVVMQPTTLCNLACNYCYLPFRRENRKMPVAVAEAVAAEVAGFARAGRFSVVWHGGEPLTAGAAHLAALFAPFGPDVEHHIQTNATLIDDAWCEFFKAHDVRVSVSVDGPPDRNGDRVDRAGKPAYDLIAKGIAALRRHGIPFSALCVVADPRPGVATELYEYFLGLGCEVLGINVEEQEGVNLRQNSHDPAAVSAFWAELVGAWRREPRIHLREVEWSLRYVAAVLDGTADRLLPRRLDPIPTIAHDGSVVLLSPELAGFHDPRYGDFTSGNVLTTPLRQILADAGRTPWIGEFLQGVEACRQSCPYFGFCGGAHAANRYFEHGRFDVTETNHCRNSKIRLLEGVLDHARDHEPTAV

SEQ ID NO: 10811 - protein, 378 aa, Actinoplanes utahensis
MTHVSERNAGSEGDRQLWTAGAGRGPRKRAATYADAGVSIHAGDRAVELLKSKVKKTTRPEVMGDLGGFSGLFRLNTAKYKSPILASSTDGVGTKLVIAQQLDIHDTIGIDLVAMVVDDLVACGAEPLFLLDYIACGEVVPDKIAEIGAGIADGCRYAGCALLGGETAEHPGVLRPDEYDVSATGVGVVEESEILGKERVEVGDAVIAMRSSGLHSNGYSLVRHVLLGAGRMRLDTVVDDFGTSRTLGEELLTPTKIYAKDCLGLIEETDVRAFSHVTGGGIPGNLVRVLPEHVDAVVDRSTWRPQPIFDLIQAKGRIEDSEMEATFNMGVGMFAVVSADDADRAMAYLAGRGVEAWQVGEVLEGTGQVQMMGSYTRG

SEQ ID NO: 10812 - protein, 524 aa, Actinoplanes utahensis
MPRGDGRLTDDLDPQERGPQDACGVFGVWAPEEEVAKLTYFGLYALQHRGQEAAGIAVSDGSGVVVYKDVGLVSQVFDEPTLASLRGHLAIGHARYSTTGGNTWENAQPTIRATTAGTTIALAHNGNLVNTAELAKEVADRGLEVGDATSDTMLVTTLLAGRPDLSVEAAAMEVLPTLRGAFSFVFMDEHTLYAARDAQGVRPLVLGRMENGWVVASETAALDITGASFVREVEPGEILAIDEHGLRSTRFAAPEPKGCLFEYVYLARPDTTIAGRNIYAARVEVGRKLAKEHPAEADLVIGVPESGIPAAIGYAEASGIPYSAGFMKNAYVGRTFIQPSQTIRQLGIRLKLNPLREVVRGKRIVVVDDSIVRGNTQRAQIRMLREAGALEVHVRISSPPVKWPCFYGIDFATRAELIANGLEIDGIRRSIGADSLGYVSLDGLVQSTEQPKSRLCMACFDGEYPIELPAADLIGKHVLEGVSRRAEAVAELETDYEAREHQDDHPAPAPLVASPGGATALHHP

SEQ ID NO: 10813 - protein, 120 aa, Actinoplanes utahensis
MSPAHNNSDSVSKALDALDAGTQPDRTVLRDAVRALLTELSGRAPGRSVEVRIPPFGAIQCVPGPRHTRGTPPNVVETDPVTWLLVATGRLAWAEAVADGRLRASGIRTDLSEFLPLTPE

SEQ ID NO: 10814 - protein, 331 aa, Actinoplanes utahensis
MTTHLRGRAARAGAFLALVVGLMAGVQTAALAAPGDASGNLTVQGQANSGESVTVQYTVSNPGTGAVKFTVKAAGADCAPCPTDNVSAGGGTSNTAKLQMPTVAAGQTASVSVTLTADDGTGPKTIDGPKTITVNGPAAPTTTRQVAGKIKDSTGAGLAGANVGLQDSKGHQYQTTSNGDGGFSFTSSDAAPIATGSILIGAKMKGYTGASARVTGTAGKSVSVSITLKSATAASASPTANASAAASLPADDAGTDDATTDAVTNAAGTPAADASKTSHDSGGSSWLLIVMGGLLVAAGVGAMVLVWLRRKNAAKDDGSDTGVGLGGSGGN

SEQ ID NO: 10815 - protein, 281 aa, Actinoplanes utahensis
MVAGAGMGAGQGMGGGGLGDAPTMIHRPPVEDEFPDPYGAPMPPQGGFVGSNNSQWDNQAGGGNYGGGTAAAGAGAGGNYGGGTAAAGAGGNYGGATSVYGAQQGGYDDAPQQRYDERTGMYQPDNGGYEDQGGYGVQGGWDNHADNGGGYGQQPQAGGTYGGGTYGQQQGGYDQGGQQQAGYDQGGYGQPGGYDQGGYGQQPGGGYDQGGYGQEQHDQGSYGQQQGYGQQQGGNYGGHQGGYEQQPTSGYGQPQGQQPQGQRGGTYGQQDPNRRNREWDE

SEQ ID NO: 10816 - protein, 797 aa, Actinoplanes utahensis
MTTQDKTGFAATDVLAEGFADGPDTVQKAEQTSDDLQPYAELGLKDDEYAKIKDILGRRPTASELAMYSIMWSEHCSYKSSKVHLREFVAKVPKNTRMLAGIGENAGVVQVSDDLAVTFKVESHNHPSYVEPYQGAATGVGGIVRDILAMGARPIAVMDPLRFGAHDHPDTARVLPGVVAGIGGYGNCLGLPNIGGEIVFDPCYQGNPLVNALSIGVLPVERLQKKEATGTGNIVVLLGARTGRDGIGGVSVLASATFDEEAEQRRPSVQVGDPFMEKLLIESCLELYDAGLVTGIQDLGGAGLTCALTETAAAAGTGMRVWLERVPLREASMSPTEILASESQERMLLIVTPENLDAVLKVAEKWGVWATAIGEVTPRAEDGTPGRLHITWNDHVVVDVPPGSLADDGPIYERPLREPSDLILLQADRAETLPRPTTGAELRETVLRMAASPNLCDKTWVTEQYDRYVLGNTVLAQPEDSGVLRLDEQTNLGVALSVDGNGRFARLDPYEGAKLALAEAYRNVAVTGAEPIAVTDCLNFGSPEDPAVMWQFARAVQGLADGCQQLGTPVTGGNVSFYNQTGAAAIHPTPVVGVMGLFDDVTRRVPMGFKAAGELLFLLGETREELSGSEWAWVTHGHLGGRPPKVDLAAEQTLGRLMARVSQTGLVSAAHDLSDGGLAQVLVESCLRYGTGASVTVESAFVGLFSESAARVLVSVPQGHEKAFVALAAELGVPCAKIGTTTEAAALEVTGQFTIPLDELRAAWSGTLPKLFGGAEPAAEGRSVTLELTEPKPGGPL

SEQ ID NO: 10817 - protein, 233 aa, Actinoplanes utahensis
MRIGVVTFPGSLDDGDAARAARIAGAEAVRLWHGDPDLHGVDAVVLPGGFSYGDYLRCGAIARFAPVMESIIDAARGGLPVLGICNGFQVLCEAHLLPGALTRNQHLHFRNRDQWLKVEATNTAWTNGFRPGQEILIPVKNGEGCFVADPATLDRLEAEGRVIARYINGNPNGSQRDIAGITNEAGNVVGIMPHPEHAVEALTGPSLDGLGFFTSVLRALAGSSAGGSQGGQQ

SEQ ID NO: 10818 - protein, 83 aa, Actinoplanes utahensis
MARVVVDVMLKPEILDPQGQAVANALPRLGVTDVSSVRIGRRIEIEFDGEPDLDRAREIADKLLANPVIEDYTVRVESAAEVA

SEQ ID NO: 10819 - protein, 473 aa, Actinoplanes utahensis
MTIPNVLASRYASAELVTLWSPEEKIRMERRLWLAVLKAQRDLGVAVPDGAVEAYESVLDQVDLASIAARERVTRHDVKARIEEFSELAGFEQIHKGMTSRDLTENVEQLQIRASLELIRDRVVAALARLAALAVEHSDLVITGRSHNVAAQATTLGKRFASATEELLIAYERLEDLLGRYPLRGIKGPVGTAADQLDLLDGSYADFEQLEAKVAEHLGFTRVLSSVGQVYPRSLDFDVVSALAQIVAGPSSLATTIRLMVGQELVTEGFKPGQVGSSAMPHKMNTRSSERVNGLAVIVRGYLSMVGELAGDQWNEGDVSCSVVRRVALPDAFFATDGLFQTFLTVLDEFGAYPAVIARELDRFLPFLTTTKLLVASVRKGVGREVAHEVIKEHAVGVALAMREKGVAVNDLFDRLADDGRLQLSRAEIDTLVADRAAFVGAAPAQVRAVADRVAAIVEHHPAAAGYAPAPIL

SEQ ID NO: 10820 - protein, 168 aa, Actinoplanes utahensis
MPPFRAVCHSQTNVGRSTGPSPRLSTMSLGDASLRALAHPVRLRIMSLLTGAELTAADVARALGITHANASYHLRHLSAGGLIAAAGEEKIRGGLAKRYRCTAAQRLTTDVWVDPAAWRAARDRIAEAVRHLRDAAVPPGTPGAIRAVAVIELEPQPGPPDEMGESVP

SEQ ID NO: 10821 - protein, 149 aa, Actinoplanes utahensis
MTEFNPESLSSIGPKEFAQLVKSTPDARLGEVMASDARGKILDEVFNRMPTLFRAEKAGDAQAVIHWIITGPNGLSNPYETVIENGQCTVTNEPVRDPKLAMTMDAVTFLKVVAGDGNPMMLFMTGKIKAKGDLSLAANIAKLFDIPKG

SEQ ID NO: 10822 - protein, 416 aa, Actinoplanes utahensis
MAVVRVLLIGSGGREHALAIGLAADPSVEFLAAAPGNPGIAQVAEIHPVTATDPAAVAALATELSADLVVIGPEAPLVSGVADAVRAKGIACFGPSAAAARLEGSKAFANEVMAAAGVPTARSAACESAAEVSAALDTFGAPYVVKNDGLAAGKGVVVTDDREAAERHAAECGKVVIEEFLPGPEVSLFVITDGTAVAPLMPAQDFKRLLNDDEGPNTGGMGAYAPLDWAPADLTERVLRETVEPTLAEMRRRGTPFAGLLYVGLALTPDGPKVIEFNARFGDPETQVVLALLATPLAGLLTAAATGTLAEHPPLTWHDGAAITVVVASHNYPGTPRTGDVITGAEVPGVIHAGTARNADGDLVSAGGRVLSVTATGVDLAAAREAAYALVDGVALDGAQFRTDIALRALNGQIKI

SEQ ID NO: 10823 - protein, 430 aa, Actinoplanes utahensis
MPVIVLVGAQWGDEGKGKATDLLGDRLDYVVKFNGGNNAGHTVVIDGEKYALHLLPSGILSPNVVPVIGNGVVVDLNVLFQEIDGLEARGIDTSRLRVSANAHVIASYNRSLDKVSERFLGARRIGTTGRGIGPTYADKMNRVGIRVQDLFDESILRQKVTAALAFKNQVLSKIYNRSAVKAEDVVQELLSYVDRLRPYVADTALELSQALDAGKVVLCEAGQATLLDVDHGTYPFVTSSNATSGGACTGSGIPPTRIDRVVAVLKAFTSRVGEGPFPTELHDKWGDYLREVGHEYGTTTGRPRRIGWLDLVIGRYATRINGVTDFAMTKLDNYDGLDEIPVCVAYDVNGVRHDEMPVNQTDFHHAKPIYETLPGWKQDISGCRKFEELPREAQDFVEFVEARIGARISIVGVGPGREAVIERHSVLGEA

SEQ ID NO: 10824 - protein, 314 aa, Actinoplanes utahensis
MVDVVLLSLAEGSGDSCGSGCGGCTAVCATPRTPVLACADVLRNAGATVETVLAGSDQEIDAVLARFDGPARPDGLTWPSLNSPARLVIAVATDGQLRAVVRRMVRRWAPAPSKRPADLEATRTVPDLPPVAILPLDPGSTTDLAAQLGLPRTPADVANAVLSGAVRRLDLLRNDGGSVTLDGALLGGADDNGAAVPWRGRVEVDDSVLSEGEEPILACVIGNGGGYAEFDGLRLLAEGNPTDGRVEVAVAVPVVVKQRFRGTRVRVEVRRARGRAVSVLPREGELQFLDDGVAGSTTRKRSWWTEAGAWAVYA

SEQ ID NO: 10825 - protein, 185 aa, Actinoplanes utahensis
MPDMAGEIRRAGIALAGCTAALLAGCAGGTAEPPVAGPLASPVPMSRTGSIPADAMRPAGTPQINDRWTSCAAAFPATSSVPSSYRIPRYDPSFTAVSVIMCVDAGGGTVRERRTGDVGPVLAALQLPDIPPLDPDRCTADGEIPMELVLLDARGRWVRPGVPADVVCAKRRPEVQQALHRSGLA

SEQ ID NO: 10826 - protein, 140 aa, Actinoplanes utahensis
MQNLLPEPPATRLPADAEADQALAAAATAGTDEASKAVAAKYPAYSAVWAPLAAAALAAGEPVTAYAYARTGYHRGLDALRRNGWKGHGPVPWSHEPNQGFLRCLHVLSQAAAVIGEADEAARCAQFLRDSDPAAADALS

SEQ ID NO: 10827 - protein, 329 aa, Actinoplanes utahensis
MRAASGSMFGLAYGDALGKPTEFMDYSAIVSRYGPAGPRQLHGEPALVTDDTQMALAVGEALLEVRVPTPGRLEPVLRRRFMAWAYSPENDRAPGMTCLRSIGALADGRPWIQATQTGSKGCGANMRVTPVGLVPGLTDDQRAGIAQLQAGMTHGHPTALAASELTAYAVHWLRGGLAPAHLLGALRDRCDEQRKIYRGEWLGELWRRPLVDSPEEFIARGWDECAAALDAVAAGLATGSSEGDPCLVTGAGWIAEEALATALYCYLISPDEPVAVLGRAAASSGDSDSIACLAGAFAGAALGLGAWPAGWQTQIEYADRLLKLGTTWD

SEQ ID NO: 10828 - protein, 395 aa, Actinoplanes utahensis
MPDPLQPVLGGDAPFDATEFEIESREELDTHLVKNTLAGLIVLGLRLDRNPPDLSTVDVRDTLFVGCRLVSPEVEVDLIRRGAHIVPPFSTLPYPTHPALLYTPDDLAAGFAEGGFAGMYDTVVYRHFVARGGAVPDVREALAQRLHDAGIDNALGKALSAWAATHGTAGPVGIMGGHAEARGSQAYRMAATLARRLAKGGRLIVTGGGPGVMEAANLGAYFASRTEREMAAAIDMLVPAPDFRDHDPYTAAALGVRATYPLPAVDLADRLRYGGLALPTWLYGHEPANLFAGQIGKYFSNAVREDSILRLSRGGIVFAPGWAGTVQEVFQAATKTFYRTDGPSGAFVFLGADHWAKLPVVDLLGTLLARSPHGDQSGLILVTDSLDEAMTALTT

SEQ ID NO: 10829 - protein, 54 aa, Actinoplanes utahensis
MFFVLLRTVPMIIVVATLAVRRRRNSGDPDYHGPASTGYESGATRFYGATGSNG

SEQ ID NO: 10830 - protein, 171 aa, Actinoplanes utahensis
MLTIEGWKPEWHHDAEALAATHRHMFVRLIGRKLRSSWLLWDVAQRGWFADGPVILDFGLSRVEITHRKFDECAITWEQIDMSVPIDMYEHFDWRADPHAALRHARGRQLRAVNAIERTTSADWRPRVLHAIEFLFDGARLAIYNAMDENGLTDVPESDLPPVHWRRVHIA

SEQ ID NO: 10831 - protein, 341 aa, Actinoplanes utahensis
MPIASPEVYAEMIDRAKAGAFAYPAINVTSSQTLNAALQGFAEAGSDGIVQISTGGAEYASGPTIKNMITGAVALAEYATEVAKHYPVNIALHTDHCPKDKLDKYVRPLIAISQERVNKGLAPLFQSHMWDGSAVPLDENLQIAEELLASAAAAKIILEIEVGVVGGEEDGVSAAIDDKLYSTVEDGLATAAKLGLGERGRYLTALTFGNVHGVYKPGNVKLRPEILKEIQDAIGAKYGKEKPLDLVFHGGSGSLLSEIHGALDFGVVKMNIDTDTQYAFTRPVVDHIMKNYDGVLKIDGEVGNKKAYDPRAWGKLAENGLAKRVVEACEHLRSTGTTLAK

SEQ ID NO: 10832 - protein, 61 aa, Actinoplanes utahensis
MIRLTEEADVETPEVDAAEQAVIAVPSWQDDEPAGTWSVTEANEWDAAEQHRIVEFDDDYR

SEQ ID NO: 10833 - protein, 453 aa, Actinoplanes utahensis
MLLTVTTTHRPATDLGYLLVKHPDRVHEFDMPTGTAYVMYPEATDARCTAALLLDVDPQRLRARADAFELSQYVNDRPYAASSLLASALSKVFRTALRGVSKDRPELAAEAIPLEIHVPVLRGSADLVTRLFAPLGWAVTASAIPLEPELGGDSRYVDLRLAGTLRLADALNHLYVLLPVLDDGKHYWVAPDEIEKLVRSGAGWLATHPERVLIARRYLAHRKSLATTALDLLDADQPATEEEAELPVARKAPLAEQRRDAVLAALAEAGASRVLDLGCGPGALLSALLRDSRFTEIVGADVSSRALDQAARRLRLERMPQRQRDRIKLIQTALTYHDDRLTGYDAAVLMEVIEHVDPPRLPALEASVFGRARPGAVVVTTPNVEYNVHYAGLSGMRHSDHRFEWTRAEFAAWAADVAERHGYTVTIRGVGDPDETTGAPTQLALFTRTEVTA

SEQ ID NO: 10834 - protein, 830 aa, Actinoplanes utahensis
MIDIPELSLVALVGISGSGKSTFARSHFASTQVLSSDFFRGLIADDENDQAASAEAFDALHYIAGKRLAAGRLTVVDATNLQSHGRAALIKLAREHDVLPVAIVLDVPEALAWERTQARPDRTFGRQVVSRMHRDLRRSLGQLAREGFRKVHVLRGPEEIAAAEIRYEKLFNDRRDEHGPFDIVGDVHGCRAELETLLGKLGWELIRDAAGRPIDATHPAGRTAVFVGDLVDRGPDSPGVLRLVMGMVAAGHAICVPGNHEQKLARKLNGRNVQLTHGLPETLEQLAAEPAEFVTEVRTFIESLVSHYVLDDGKLVVAHAGLKEAYQGRASGRVRSFALYGETTGETDEYGLPVRYPWAQEYRGSAAVVYGHVPTPRSEWLNNTICLDTGCVFGGALTALRWPERELVDTPAAKEYYAPVRPLFTAVAEPDRGLDIADVTGRKHLDYGYGRTTVPAENAAAALEVMGRFSVDPETLIWLPPTMAPCSSSTVEGYLEHPSSAFADLRGAGVDRVVCEEKHMGSRAVVRVSASGTGDAIWTRTGRPFFGPELDQPLLARVRAAIEPVLAELETEWLLLDTELLPWSAKAGSLIREQYAGVGAAGRAALPVALAVVDQVAGRGLDVAALRDRLALRSSEIDGYSAAYRSYVKPTDGLTGVTLAPFAVLAGAGTTYATRDHGWHLAIADRLVAADPELFTPTRRMVVDLADPAAEAAATDWWLTLTGAGGEGMVVKPFAGLAAVDGKGRLVQPGVKCRGREYLRIIYGPEYTRPEQLTRLRQRNLGRKRNLALREHGLGLAALDRLAEGAPSWRVHELVFAILAAESEPVDPRL

SEQ ID NO: 10835 - protein, 273 aa, Actinoplanes utahensis
MDIRALTEQLALNPLDASQLLHTFGLYGVWAILFAETGLLIGFFFPGDSLLFLAGIAASPVADALFGDGTRISLAGLLIGAPICAIAGAQFGHYLGARYGRRMFERPDSKLFKREYVDKAEHYFQKFGPAKAVVLARFIPVVRTFLNPVAGTLGMPARQFLLWNVVGGVIWTDGVLLIGYALAKQIYHAVGDKIDHYILPVVVIIVLISALPIFIEILRERKAKKNGTHTGPQPAAAVGVVAAASIAGLAEAAHLRDEDDDEDRPRRPRSHRA

SEQ ID NO: 10836 - protein, 224 aa, Actinoplanes utahensis
MNYVPGDLRDQLAHVGYDVVQAGLVCGSGGNLSARIPDEDAIWITASGTWLDRLSRPSFVPVDITDGEVVAIGNMPPPRIEPTSELALHLALYRARPDVNAVVHLHPQTALLLDALGEHIRIVTTDHAFYLRRVSTVPFRLPGTTELAALTAAMAADGTDCLVLSQHGCVVMGDSVELAHKRARNLEEAATLTYRALAAGRLENLRDCPEAFLDRLAGSAAVTV

SEQ ID NO: 10837 - protein, 125 aa, Actinoplanes utahensis
MEIVGTALAEMTMPQISPLAGEPIERADAERLAGVLKALADPARLRLLSLIQSATDGEACVCDLTAPLGLSQPTVSHHLRILTEAGLLEREKRGVWAYYRLVPTAIATIADLLTPPRKRATKKAR

SEQ ID NO: 10838 - protein, 33 aa, Actinoplanes utahensis
MSVQAKTPTGRPIYCYPDSRSGDSEGNRLYPFE

SEQ ID NO: 10839 - protein, 585 aa, Actinoplanes utahensis
MSYSAQPPVTAAPPPPSTGARPPAVTTASTLLWLMGAAGLLYAIATIVVATGTVSRFRDAASGDAADNFVTVVWLGAALSAVLSILFFALFVVLGLALRRGSRAARIVALVVCTLGTLGGVAGLITAVVQRSGDPAPGSLSDALGSAYPEGWLGLNIVVCALQALGYLAVGAMLLASPRAFFGLAPSRPASPPGTHPSAFPQPGPGTHPGVLPQPAPGAYPGAFPQSVPGVQPGSGAYSAPTAYPLPGDHPGSSAFPVSGVYPGSGGYPGSGDAYPGPGAYPGSGAYPGPGAYPGSGAYPGPGAYPGSSAYPGLGAYVAQPGDSEAQAGALPQQPGGAPMTPSPYAPHLSPYGPAGPPGFTPPVPPSVDHSAYMPPAASPSGYPPIGGVPTQSAAAVSSASPAPEAPAAPAQAAPAPAASAPAAPAAPAAPAAPAPSSATADPTAHPAEPAPETPDALPGSARPSGAADGSQAPAGSAAGTFDGSRAPAGPGDGPFASVGFPTVAGVDGGAAGDSGTSGGVAKGASGEGERSSDSVTHRSNASSNVSPVTQRGQGHIGDSARPGDPGANRPAPGSDDEYWRRPEE

SEQ ID NO: 10840 - protein, 541 aa, Actinoplanes utahensis
MTVPTYPPSYPAAPPPPGGRPATVTVASVLLFIVAVLQVGYAILAFSALNKAGDVYDEEYGSTDFQDIGTGITTIGVLLIIVYLILAIGLGLLGFFNLRGKQPARVITWVTAGVLMCCSVVVPSTMTALVTDFASVVHDSNGTSGLPSQHELDTRLAGVVPDWFDTFGLFFTLFALAALIAVVILLSVPPSNRFFRGMTGGWSPYQPGYPAGYPQAGAGYPQQPAYGQPYPGGYGQPGAGWAGGYGQPGAGSAGGYGQPGSPGQPGAFGQPGHGASAQPGFGQPGQPAPGLPPYPGQPAAYPPPVSGPGAYPAPTSGPGAYRVPTSGPGAYPPPGYSPAGPGGSATPYASPSAAAGSPPPSDPLAEFGPPSDPWQLPPSPPVPPSPSPSPSVPPPPSDSSTHSPLPSGSSPDADSSAGWAPSDTGDAPSAVSSDSAHDSSPSSAPSSASSASSASSASSASSAASSSDSGSSSGSSPSGGSHSSPSAAGDRLPPASSAAGDRLPPASSAAGDQLPPASSAAGDQLPPASSADGQRPPHDPA

SEQ ID NO: 10841 - protein, 58 aa, Actinoplanes utahensis
MPHADTLTVVHHDDTRTRFEDVRYQLHRDGIRIWSADGEHAFSDILMTHAYRHQKTAS

SEQ ID NO: 10842 - protein, 861 aa, Actinoplanes utahensis
MNAERLTTKSRDVIKSAVATAAQSGHATVEPWHMLLSLLDTAGSTAPALLRAVGANPADVRRAAARAVEQLPSARGASTAEPSLSREFVNAIGEAELIAQPLGDEYVSTEHLLAGLARGGGAVSQTLKAAGAAEDALVAAFPQVRGGDRKVTNADPEQTYKALEKYSVDLTALAREGKIDPVIGRDAEIRRVVQVLSRRTKNNPVLIGEPGVGKTAIVEGLAQRIVAGDVPETLRDKKLVSLDLGAMVAGAQYRGQFEERLKSVLEEIRGSNGQVVTFLDELHTVVGAGKGEGSMDAGNMLKPMLARGELRMVGATTLDEYREHIEKDPALERRFQPVVVGEPTVEDTIGILRGLKSRYEAHHRVQITDAALVAAASLSDRYISDRFLPDKAIDLIDEAASRLRMEIDSRPVELDQLQRQVDRMRVEKLALERETDPASVARLERLDRDLADREEELTALNARWERERGGLNRVGELKKQLDEARAAQERAQRDGDLLQASRLLYEVIPGLERELATAAESEEETTEPPMVKEEVGADDIAEVISSWTGIPAGRMMEGETAKLLRMEESLQAKVIGQREAVAAVAGAVRRARAGIADPDRPTGSFLFLGPTGVGKTELAKALAGFLFDDERAMVRIDMSEYAEKHSVARLVGAPPGYVGYEEGGQLTEAVRRRPYSVVLLDEVEKAHPDVFDVLLQVLDDGRLTDGQGRTVDFRNAILVLTSNLGSANSDFTMSDEERHDEVLAAVRAHFKPEFLNRLDDIVVFHALTRDDLIRIVDIQLARLRARLAERRLTLSVAEDAVDWLGEHGYDPIYGARPLRRLVQATIGDLLAKALLAGEIRDGDTVQVALNSAKDGLAVQRG

SEQ ID NO: 10843 - protein, 412 aa, Actinoplanes utahensis
MTRLLSRRLVPLGFMFLASGIATAVVGPFLGLFLSTAVHANPFQVSAFLIVASLSGVGMSQFIARVSDRRPMRRMLLITAALAGFAGTGLTSMVRDYWVLLAITMTVTALAGSFYPQSFAYARQVLAREDPRRAAMGISSLRTVFSIAWVGGPPLAAVLLDVGSFRWVYGTAAVMYLVAALIATRWLPEAEAPAPAGQSSRDDTRPPRVMYPIIAGFVLLTTTMVLGVQAMSLYVTDDLHGSVGDTGLILGLCAALEIPLMLGFGALSTRVPLRRLILGGGVAAVAYQTVAATAHSTGMLATAQVLNAVFIATCSGLGISYVQDLMPAHPGRATTMFTNAFPIGNILAAPLFGLAQEFGYRLAYTMNLILTVLGLLLLLVAKPPAEIARPRAADKAEREAEPIGPEAAAEAG

SEQ ID NO: 10844 - protein, 168 aa, Actinoplanes utahensis
MGLVRVRVEQTSLPGIGVRHDLVTSSGRTVGVVSHRNGRRDLVLYDVDDPDACLASIPLTDDEAEALADVLGASLMLSQLAGLRQQAAGLLTEQIALPAGSPFVGRQLGDTRARTRTSASIVAVLRDREVIPSPGPAFQFEANDVVVAVGTRHGLDGVTAILAGDTTG

SEQ ID NO: 10845 - protein, 402 aa, Actinoplanes utahensis
MHHTTVLLIEIGALLFGLGMLGRAGRRFGLSPIPLYLLAGLFFGHGGLVPLSASEEFIGIGAQIGVILLLVMLGLEYSADELVGNLRSAAPAGVIDMLLNALPGALFALLLGWDAKAALVLAGITWVSSSGVIAKVLADLGRLGNRETPVILSVLVIEDLAMAFYLPIATAVLAGAGLAGGLSTLGVAVVTVVAVLVVAIRYGGAISRFMSVKDPEALLLSVLGLTLFVAGVAAELKVSEAVGAFLVGIALSGPVAHHATEMLSPLRDLFAAVFFVFFGLATDPSDMPPVLLPALGLAVLTMLTKAATGYLAARRVGVALPGRLRAGLALTPRGEFSVVIAGLAVASGVEPRLAPLATAYVLITVVCGPMLARLSDYVWFKNLVRRRMAAQRSSTKPLPSAE

SEQ ID NO: 10846 - protein, 172 aa, Actinoplanes utahensis
MGRSTLATDSGSSVAFRTVNKAAALSLREATFIGFGNPVDPRPVELESWAYHPEAVPLSAMPKDWDLLISGDVLGPTLFELAMDRQCPARRFAQHCMYIYAADGVRQNATSQRKRRLKKFVERAEEVGDEPMQIWAHNCRVLMTRPELFDHHDWMEGGLVRHPRRIGLFNRR

SEQ ID NO: 10847 - protein, 147 aa, Actinoplanes utahensis
MYEEISISVEQASDAKVLIISVAARLAGMHPQTLRQYDRLGLVQPGRAGGGGRRYSERDVALLREVQKLSQEDGVNLAGIKRIIGLEQLVADLQHRVVELEQQLDDAYARIAEVESMNPYVSRGDLVRQERHSTALVVWRPRRSPDR

SEQ ID NO: 10848 - protein, 401 aa, Actinoplanes utahensis
MSSKDWLEKDFYAVLGVNKSASTDEIKKAYRKLARDLHPDRNPDNKEAEEKFKAASEAYDVLADDKKRKEYDEMRSLFGSGAFRRGAGRPGAGGAQFDPSDLFGGFTGAAAGGGAGADRRFGGTGFSDIFSSIFSGGGAAGAPAGRRGPQRGRDVETEVTLDFAQAVRGTTLPLTLRTAGACDTCHGNGAKPGTIPRSCAKCHGTGLISSNQGSFSFSEPCRDCSGSGSIVDEKCPECRGSGSVTKSRTINVRFPAGVADGQRIRLSGRGEPGDRGGPAGDLYVQVKVRPDELFGRSGDDLTLTVPITVAEAVLGTDLRVPSLDNPVTLRVPPGTPSGRKLRVRGKGVARKEGQSGDLIVTVEVQIPVGVTGEARDALERFAKLTPPAGRERLEARVRKTG

SEQ ID NO: 10849 - protein, 204 aa, Actinoplanes utahensis
MSAADDDNDGPVTEREVIQGETDSAAETTPDTKRKAAGAHRARDEEEGGAPVAEESKPGLGAELEALRGELDERTHDLQRVTAEYANYRKRVDRDRGAAAEQTTGSVLTALLPVLDDIDRAREHGDLVGPFASVAEQLTAVTGKLGLVAFGEKGDPFDPNRHEAVAHLTSADVTEPTCVEVMRRGYTLGERLLRPAMVAVADPE

SEQ ID NO: 10850 - protein, 619 aa, Actinoplanes utahensis
MARAVGIDLGTTNSCVSVLEGGEPTVIANAEGSRTTPSIVAFARNGEVLVGEVAKRQAVTNPDRTIRSVKREIGTNWSIDIDGKKYTPQEISARVLMKLKRDSEAYLGETITDAVITVPAYFNDAQRQATKEAGEIAGLNVLRIVNEPTAAALAYGLDKGSKEQTVLVFDLGGGTFDVSLLELGDGVIEVKSTSGDNHLGGDDWDQRIIDHLVKTFRGEHGIDLSQDKMALQRLREAAEKAKIELSAATTTSINLPYITAGANGPLHLDMSLSRAEFQRMTQDLLDRCKGPFESAIKDADVKLSDIDHVILVGGSTRMPAVTELVQSLIGREPNKGVNPDEVVAVGAALQAGVLKGEVKDVLLLDVTPLSLGIETKGGIMHKLVERNTTIPAHRSEVYTTADDNQPSVLIQVYQGEREMAAYNKKLGTFELSGIAPAPRGVPQIEVSFDIDANGIVHVSAKDLGTGKEQKMTITGGSALPKEDIERMMRDAESHADDDKKRREDAETRNLAEQLQWQTEKFLAESGDKLPEESKGKIGEALGELRGALGGTDIEKIKSAHERLSQVSQEAGSALYSQGEAPQAGPEGATGAPGGATGAGPAGGSGDDVVDAEIVEDDKK

SEQ ID NO: 10851 - protein, 588 aa, Actinoplanes utahensis
MARPANKENGITTPVSPPPAVGRLASALRRLRAALGTVSYPLVLPSAEEARRVGTALLAQLDDYLVPRLSRLDAPLLVVVGGSTGAGKSTLVNSLVQERVTSAGVLRPTTRSPVLVAHPENLGWFEQPHLLPGLIRTVKTSDDPNSLQVIGARGIGPGLALLDAPDVDSVVDHNRKLAAQLLAAADLWLFVTTAARYADAVPWELLKTARLRGTVIALVLDRVPLDAAAEISAHLGEMLTEHDLGNAPLFVLPESQLDERGMLPHPAIQPIQQWFAQLSADPRARDAVVRQTLDGALAALAPAIEGLAEAAEEQVRTAQALDERVESAYRTARRTIAEGLQDGRLLRGEVLARWQEFIGTGELVRNLESRVGHLRDRLVAAVTGRPEPSRNLQVALESQLVTLLRGVATDAAEQAYAAWQAHPAGEALLLPELKTASDGLALRADRMVRDWQKWVLDLVRREGGDKRSVARGAAYAVNGAGLAVMIAVFTSTAFIPTGLEVAVGAGTTVAAQKVLEAVFGDQAIRSLATRARTELVARFDELLTAEAARFADRTAIVRREAEPGTLLRRAAAEVESARKDIALTGSGS

SEQ ID NO: 10852 - protein, 305 aa, Actinoplanes utahensis
MSLVENVRDTGRVDAESLTRRLEALSRFLRLVDPYLPDSELVTAHTVVERASGRLTLSLDHTVVALAGSTGSGKSSLFNALARFKLSPVGVRRPTTGTAHAVVWGPLEPASRLLDWVGVLPRQRFVRESALDGDDEASLRGLVLLDLPDFDSIEQAHQLEVDRLLGLVDQIVWVVDPQKYGDRILHRAYLSQFNTHAGVTIVVLNQADRLSAPDTEAVLTDLRRLLDDDGLSGAPVLATSAKQPGMLNELRSALEGTVAGRQAALRRLAADVDVAGEELAAMMGPPAAEDEVDRATVRQLTDLAS

SEQ ID NO: 10853 - protein, 216 aa, Actinoplanes utahensis
MRPDPLRKLHLGEPVKTDGVSTDVVPRTSLPEADAAQKSAVGLSVRTVAKRAAAPLPEVWAPALNTAARSKAADLPDALDRAIATTDLGTEHRPAWWRLVGGLQWVLLAAATAGLLWLILGYVMSALKLPDIDGPHVGSVPLATVLLLGGLFAGLLLWLLLKPVVEAGGRRARRQAEQKLRAAVTDVGRQYVVAPVREVLNAYAQAREALGVVRSE

SEQ ID NO: 10854 - protein, 400 aa, Actinoplanes utahensis
MPAPQSVYEAVLHAARDVLQLSCALDAEMLGAALLGSIYAMAEGDRAAAVQEFVGEFLSATDRRAEPFAEAIREVFATLVPAADGADRVGPGRQAPAWAGQLGRVHVTGCYAYGDVYGDQTSYLVTYAYDDTDDGGPEHALVALVDHNIGIVKDVFVASSAEILTQVRTVCEHDELTWFRDEDPGRARDEVGRHLRVTDELGELPADGSLATDRALVGARLAVLPEVTTPPLDEPDPPKVPELIHDFLASPEAAREGLTGPDTDQPSLQFCLGLLVDHAASLSSGDPLRWSPAVAGFFLLDWVHRRAVLDIDDAAMLPRVVRAWSAYATWRRGLPPAAVAETAAEVEKLVPEFARLYSTGERRSPATAAVAQLIAEGVDPSDDSAIDAWLQANRDRLGDD

SEQ ID NO: 10855 - protein, 185 aa, Actinoplanes utahensis
MPGLPEVPDDDWPGPLGRRALPSDDPAPDDPGFDEPASGDLSGSDSTASDEPDSSDDADSTDDGDDDADEPDQDAPHHRCEPDIISDRPRGWSPTSRRSTVTERPHNVNAARIIEYSYGGSGRNVRNAMAQPRSDEARNSNRPYRGHHRAEHTLHDENNPARQRSSRVGRHHREHITGEHHANHR

SEQ ID NO: 10856 - protein, 133 aa, Actinoplanes utahensis
MPHLPDDDGYEPPLKVLRKRFNGVYREDYGLSGPTRRYLLLVVMLVGLASVPTLAVITAGTSEIAGNGRSGAMDAPFLAPPAPGPVRSSPSGPSPSRSPIDSGTSSTASPGVSPPPGRDPATLPTVPGLPRAS

SEQ ID NO: 10857 - protein, 381 aa, Actinoplanes utahensis
MAKGERKAGGGSDAPAGGFVQLLTPDGEHLGSVTTADGATYSVDFTDDEYRGLYRDLVTVRRLDAEATALQRQGELGLWASLLGQEAAQVGSGRALRPQDMAFPTYREHGVLYCRGIDPIMPFGLFRGVDQGGWDSNEHKFNSYTIVIGSQTLHATGYAMGVTMDGKTGSADGEAVIAYFGDGATSQGEVNEAFVWSGVFNAPIVFFCQNNQYAISEPLERQTRIPLYRRAAGYGFPGIRIDGNDVLATYAVTRAALDNARNGQGPTLIEAYTYRMGAHTSSDDPTRYRIASEVESWKAKDPISRVAAFLAKQKLADDDFFAEVDATAGKLALDLRERVLAMPDPQPVTMFDNVYPTGSPELDRQRAAFTGYHASFEGSGH

SEQ ID NO: 10858 - protein, 328 aa, Actinoplanes utahensis
MAETITLGKALNHGLRRALENDPKVVIMGEDVGKLGGVFRITDGLQKDFGEDRVIDTPLAEAGIVGTAVGLAIRGYRPVCEIQFDGFVFPAYNQIVAQVAKMFYRSKGKVRVPMVIRIPFGGGIGAVEHHSESPEAYFSHTPGLKVVSCSNPADAYSMIQQAIASDDPVVFFEPKRRYWEKGEVDLDAPLSGAHPLHSARIARPGTDATILAYGPMVRVALDAAAAAAEDGRNLEVIDLRSLSPVDYPVLFESVKRTGRAVVVHEAPGNIGLGAELAARVTEECFYSLEAPVLRVTGYDIPYPAARSEEEYLPDLDRLLDAVDRSFGW

SEQ ID NO: 10859 - protein, 504 aa, Actinoplanes utahensis
MLLLPGGPGPAGDRLRHPVPGGPLGGGVPSRSGPAARRRRPLLRLVTAMSRIKEFNLPDLGEGLTEGEILAWLVKVGDTIELNQPIVEVETAKAAVEIPAKWAGVVTRIFHEAGTTVEVGQPIISIDTDPGAGDLPATPEPAAAPAAATPHGGGRTPVLVGYGVRESSAKRRPRISAPAASAPVIPAAPVAAPAPVAPVAPVAQAAAVAVPVRSGPVLAKPPVRKLAKDLGVDLATLTGSGPLGSITRDDVHKALEMPAQPVSVLNGDREQRIPVKGVRKLTAENMVASAFTAPHVTEFLTVDVTRSMKALEKLKARRDFADLRVSPLLLVAKAVLLAVKRYPMVNSSWSAAGPSTAEIVVKDYVNLGIAAATERGLIVPNIKDAGRLTLRELAESLNELVRTAKSGRTSPADMAHGTLSITNVGVFGVDTGTPILPPGESAILAFGAIRPTPWVHKGKIKVRQVTTLGLSFDHRIIDGELGSKFLRDIGEFLTDPEAALLAWT

SEQ ID NO: 10860 - protein, 64 aa, Actinoplanes utahensis
MSATSGPAAHVEISGAPAMSMINRIRQRRLVKREDRALDRAWQAAPTPAMRHEINIFASHRQPL

SEQ ID NO: 10861 - protein, 1075 aa, Actinoplanes utahensis
MTSEGHHAGQPAEAASGGPDSEGQRVSGRASAPAPAEGTPTSYGPPPQTAPGGGSPFVVPAVATFGSGSNPTGTPYGSARTPQGEEASPYGSVSPGAAPTYGSGPAGDSPWAPPQPPTTASGLPTRTPGASAAAADQSTFSAFGEQKARVPGATLTDLPGSGTGRPGSPDSGVGRPGLTGPAENSWLGSAARPAGESAPTANTFPTRQGDSGGFPTRAPAGPTAAEEPSGPTPNLDLPIRSTAGHAAPPSPFGAEAEQASGFPQRVPGAALGSGGSLSANPPAAAVPAPAAPAFPPPSSSFQPSGGAGFPPAGAASTPGSGFASGPGSAAVPGSAPVPTASASGAVPQPRDAGAARPVTGSARPATASVSVPGMVQPPADGAEIPPAGAAPQARVYGRAAAAEEASPLGSTPFPGARVPDNGGQTSPFAPESPFAPDSGGQGSPFAPDSGVQGSPFAPDNGGQASPFAPAGDRQSNPFGSDNERQNSPFAPDNGRQADPFAQDAGRQTDPFAQGPENSGGSFGARSEGFGSFAPTQRAEENSGGFGAFPPPQRGEESSGGFGGFPPPQGETSGAAPQSPARATARASASARVTPPEQASSGGPGSGIPAAPGSGGPGSGPAGSPGSGIPSSTPGSGVYGSPGSHSGPESGVYGSAGAGSESGVYGSPGSAPESGVYGAPGAPGVPPAGPTSGSARVSQPDATAPFPGSPAAFSSGPGGPGTAPGFPPPSFGGTAPASPPFGGNPPGSPFGGNAPAAPPSGSAPATPLSGNAPPVPFGGNPPTAPFGDNPATVPFGGHHPGSPFGSAAPASPPFGGTAPASSPFGERPQRPQFEGINEPTFPPPSSSFPGAPSASGAPATFPGAPAQPGTYGSAPQNAPAWGQPATGGDQFSEHTTDVSGRGNSPFDAPPMPPGQGSAHPFGDRSMPAGPVSGDPFGADPAARATVTPPVPEDTTSWPATTEQGKFDQFKPEAAPAPTPAKVRTIPVALAVVVGAALLLGIVFGLVYLISGGGGGSFSANAGDCVKNGDKVVKVACSEPGAYQIKQVVDAKEQCADKAQPYVVADKKVYCLVKPAG

SEQ ID NO: 10862 - protein, 600 aa, Actinoplanes utahensis
MNSRVRAPELKGRGWLNTGGKALTLADLRGKILILDFWTFCCINCLHVLDELRPLEEKYGDALVVIGVHSPKFEHERDPRALAAAVERYGVHHPVVDDGDMHLWQQYAAKAWPTLAVVDPTGYLVASMAGEGHAEGLSRLIDELVAKHGADGTLHRGDGPFVPPPAPAGLLHFPGKAIELPGGNLLVSDSARHSVVELTPDGATLVRRFGGPGRGEPFSEPQGLVLLPAEVRELAGYDVVVADTVNHQLRALNLSTGEVTLVAGSGRPWRSAVDDHAHDALATDLSSPWDLAWFDDKVIIAMAGIHQLWWFDPIKRTVGVYAGTTVEALRDGPLPDVWMAQPSGLSVHGDRLWIADSETSALRFVEDGVLHTAVGQGLFDFGHVDGPAGAALFQHPLGVAALADGSVLVADTYNGAVRRFDPASNEVSTVDAGLAEPSDVLVTAAGEVLVVESAAHRLVRLAPGVLQTGRTVDGERHRTERPPSHLAPGEVTLDVIFTPAPGQKLDSQFGSPVRLTVSASPAELLLDGAGVTTELSRRLVLNPAVPKGVLQVVAQAATCDVDAEFGACHLTRQDWGVPIVVDPAAPDRLPLILRGLDESA

SEQ ID NO: 10863 - protein, 196 aa, Actinoplanes utahensis
MQVSEPDDAAIILRSHRAPEEFAALFDRHAPHIHRYLARRLGDQVADDLVAETFLTAFRRRDTFWPGPHDARPWLYGIATNLVAQHRRDEARALRLRHAVAPDPDSFCHADQVAADVTAAALRDALTAALATLADGDRDVLLLIAQEELTYEQVAVALDIPVGTVRSRLHRARTALKAALGGHNPLTFVEEEVRHG

SEQ ID NO: 10864 - protein, 300 aa, Actinoplanes utahensis
MDEITLTGELGREVPLPTAADLAPARARLLAELTAAAPPVRNVRKLRLRWAAVATGTVAAAAAAAGIVAIAPGTPSSTSAPPAPAAPVPVAQFLDDAATVAGQGRDVVPRGDQFLYTRVRATDGTWTDYWSSIDGRHLGEERSSSGKKTIIAACVNGKSYDPSDPVDVGCEPTRLYLPDLPTDPERMVAWLKARNPGLDGAPYNANGVAKEIWSLSDSYWLRPAQRAALYRALGRFDGISLVPGAKDGTGQVGTGVSWISPGDTAPRVMWVFDPKRHVLLGYQNASIDAYALVDRIGATH

SEQ ID NO: 10865 - protein, 259 aa, Actinoplanes utahensis
MDDDFSMTAVDLNADLGEGFGAWRLGDDEALLDVVTSANVACGFHAGDPSTMHRVCRAAAERGVAIGAQVGYRDLAGFGRRRIDYEFGELRDDVLYQIGALEAFCKVAGDRIRYVKPHGALYNTAAVDRGQADAVVAAILAYDPALPVLCQPGSVLFRQAVAAGLTAVGEGFADRGYLPDGRLVPRSRPDALVHDPAAVVERATRMVAAGEVIAADGTPIRCAVRSICVHGDTPGAVDLARAVRAGLQTADVAVRPFSR

SEQ ID NO: 10866 - protein, 224 aa, Actinoplanes utahensis
MTTSAPFRMKPTDLGKPRLRGRLHQYAFFVAAVCGIVLCSIALSRPGWGPFVSCLIYSVTVCGLFGTSALYHRRVWSERGYQIMRRMDHSMIFIFIAGTYTPFCVELLGRSKAELMLGLVWGGALGGVALKMIWPHLPRWAGAPLYVALGWAAVAILPDVLHGGVTCLVLLIAGGLIYTVGAVFYALRRPNPWPTVFGHHEFFHACTLVAAICHHIAIYFALYK

SEQ ID NO: 10867 - protein, 233 aa, Actinoplanes utahensis
MSALTANARIAPRASRKMLAPMPIGPSSESGRAGWLDHPEYVDRGHTHTREVPIRQAVRMTLRTLILLRHAKAETPGEIADFDRSLTDRGMSDADAAGSWLVDERLHPDLVLCSPARRTRQTWQAASLALAQGNSSHGALSPEVHYEDQLYYGGRTEVFDLLRAVSDTVRTILLVGHNPTVSEVSALLVPDDQWDGVTVELKTSGLAVHTGEVPWASSSPGGMRLARRHTARG

SEQ ID NO: 10868 - protein, 618 aa, Actinoplanes utahensis
MTHYQSNLRDLQFNLFEVFGADKAFGQAPFDEIDAETARDVLAEVNRLAREDLAASYADADRNPPVFDPATHTAPLPESFKKSYETFMASEFWRLDLPGTLGGTFAPRTLWWALAEQILGSNAPIWMYASGPSFAHVAHTEGTPEQQEWAKLFVEKQWGSTMVLTEPDAGSDVGAGRTRAIPQPDGSWHIEGVKRFITSGEHDLSDNIIHYVLARPVGVEGVGGPGTKGLSLFIVPKFHFDPQTGELGERNGVYATNVEHKMGLKVSNTCEMTFGEHGTPAKGWLLGDKHDGIRQMFMIIEYARMMVGTKAIATLSTGYLNALEYAKNRVQGADLVSNGDKAAPRVTITHHPDVRRSLMLQKSYSEALRALVIYTASWQDKVAIAEAAGDEKAAKIASKINDFLLPLVKGVGSERAYELLGHESLQTFGGSGFLQDYPLEQYVRDAKIDTLYEGTTAIQSLDLIFRKIVKDNGRALGTIATEIQTFIETEAGNGQLKDERLALGKALGEMQQILGTALGWLSAVQGGETRELYKIGLTSRRILLALGDVILAWLLLRQAEVALNALNGEVSEADKNFYTGKVAAARFFTREILPRIGSDRRIIENTTLDLMDLSEDVF

SEQ ID NO: 10869 - protein, 50 aa, Actinoplanes utahensis
MFATIKSLIPEPRQAGQPRNYVGRHRQPEPVAAPAPTAPSPAEPEDNTAA

SEQ ID NO: 10870 - protein, 375 aa, Actinoplanes utahensis
MLFGGTMPTFVPGRRPMSPGNRAGLGAAVVLLVIVSAVELASPRTVGYVGLFALVPVTAALFAVWQYVLGAGIAATLAGAIFVGRAGNAGPGVMVYLLGIMLATGIAVAAATMRQRQSDRIAELLQLASVAQQAVLRPIGPQVGSLAVSGRYISATAAADIGGDLYEALNTPYGVRIIIGDVRGKGLDAVRLASIVLGSYRHVAYERAELKAIVADLDRAVARSVGDEDFVTAALVEERGGTLTIVNCGHPAPLLLRRGLVIPLEPPAPAPPLGFMPEVKARVERLEPGDRLLLFTDGLGEARREGEFFPTADRAWRLLGHGTVGDGLASLETALVDWVRGRLEDDIALVLLEYAGPDAGASVPVPSWEVGAAGS

SEQ ID NO: 10871 - protein, 196 aa, Actinoplanes utahensis
MVTDDLRDRLRGAFRWTDPGPPADYLVSDRSGWWRDPVILDGLGPALADLFRADRPTVVVSPEVTGFLLGPLVARALGVGFVEAYRAGARRAIAEPMIWAEVPADHRGDIQHLGVRRERLAVDDRVLVVDDWAATGSQARGLRKLVGDRYIGTAVIVDECPPGVTAELTIRSLLSAADLEPIVECDAPQSDASPPR

SEQ ID NO: 10872 - protein, 92 aa, Actinoplanes utahensis
MISTYQKPLAEVDQARDEHMAFVTDLEERGLSVTAGRQDPPVGGVILLDVDTEAEAQELLAQDPYVVRGLATYAAVGWHPSRGALAGYQRRR

SEQ ID NO: 10873 - protein, 80 aa, Actinoplanes utahensis
MVQFGTGTPQAGDGGVARSDEIGRHAYAWRAFRSVEALSGQLMFGTRGGRWVRVPTSGLSPAQVEQVLGAAFAQGLRVHR

SEQ ID NO: 10874 - protein, 296 aa, Actinoplanes utahensis
MDAGAAVGADRGEIAHAGAVLLQERTDAGRERGRGSGEFGPGSHTSILSNKRSNRPLKTPIRAAQIPWTASAGGGPAGWRERVNAVAGREAPGGARRTARYGVAMLLSDRDLVSEIKAGDLSLEPFEPSLMQPSSIDVRLDRFFRVFNNHLYTHIDPAEQQDELTAEVEVEDGQPFVLHPGEFVLASTLEVITLGQQLAARLEGKSSLGRLGLLTHSTAGFIDPGFSGHVTLELSNVANLPIKLWPGMKIGQLCIFRLSSPADHPYGSAVYGSRYQGQRGPTASRSALNFRTWPTR

SEQ ID NO: 10875 - protein, 301 aa, Actinoplanes utahensis
MSGVSARTASDNADNNPMHHSRRRAHSFGALSTTLLLGSLLLLAPRPGTPAIGGPAIRLATPPAAGVLPNATRFPLPADLGRVQTASAPVSLRYDFDGGVGKPIEDTGGGHELRPLGQNGGELRLVPEGSGLAVAYPDRCTLARERDCPRAILEGQRDDTLNPGRRPLRYGASVLMTHADLADGANVVQKGYSVGGVSQFKLQVDHRQGHPSCVITGNRAHIYRAEPPIDVADGHWHDLECSRTEGRLALQVDGTPYASVPVPPSLSIANAEPLRVGGKGPARGNDQFAGEIDNVFLTIGP

SEQ ID NO: 10876 - protein, 350 aa, Actinoplanes utahensis
MTNVLITVLLLLGNGLFVGGEFALIASRRTAIEPLAATSKAARWALSAMNQIPLMIAGAQLGITICSLTLGAIAEKALAQVLQSHFQTVHLPERAAHPVALVLALVVVVFLHTVVGEMVPKNITLAGPERSALILGPFMLAFCTATKPLLIAMRWASRTVLRLWKIEATDAVKTVFTAEELAGMVTQARSEGLLGSEQYARIHAALGLNNRTAADTLLSWSRVTTVAADVSPATLEAVATRSGRSRFPVVQRDTRRVLGFVHVKDILGYSGAQRRLPIPAEVIRPLAVVAPERSLAELLLTMRRDRLHIVLVSDGRRPLGVITLDDVLHAVIGERSHAAAHSAPVVARPR

SEQ ID NO: 10877 - protein, 445 aa, Actinoplanes utahensis
MDGLLLTAVLPLAAFALLTAGNAFFVAAEFGLVTVDRAEIDQRAAEGDRRARTVRTALHSLSFQLSGAQLGITLTALLTGYLAEPALSRLIMPAVEPVAGAAAETVTHVLALVVATLVSMLFGELVPKNAALARPMGLALATAGPLRGFSRLFKFMIAALNGTANWLVRRIGVEPQEELASARSPEELGLLAAISARAGALPTETATLMRRTIRFGEKRAAKAMTPRVDVVGLKTTASVADLITVARETGHTRFPVYENTLDVVTGVAGVNDALGVPPERRAATRVSVLAREPVYVPESLGLDKVLAALRAADADLAIVVDEYGGTDGVVSVEDLIEELVGEIADEYDTELDETGTAELTAPGGEKTYLVDGLLREDEVLEQTGFALPEGPYETLAGFLLARLGHIPVVGESLEEHGWEFTVMEVDRHRIEQVRVVAPPEEPADD

SEQ ID NO: 10878 - protein, 715 aa, Actinoplanes utahensis
MGYAQIIATVLSVAVTVVAVALAVRAVLTITRVIRSGQPAPERFTDKGTRTKTLLRESVGHTRMLKWSAIGAAHWFVMFSFIILSSLVLEAYWEVVTPHGELPLIGEWSIFGFVTEWFGILGTIGILYLILVRQRNKPGATKRSRFLGSTMWQAYFVESIIVGVLVCGFLIRGFKVANGTFPYPTWAAPLSHAIGGVLPAWHDAPTWVALVKLLISMGWLITISLNPTMGVAWHRFLAFFNIFFKRSPEKPAGSGLGALKPMMSEGKPLDFEEADPEKDLFGVAQVEQFTWKGLLDFSTCTECGRCQSQCPAWNTAKPLSPKLLVLSLRDHAYAKAPYLLAGGGKDLTGEEKATEAQLAHMDVLALAEGNRPLIGGVDENGVIDPDVLWSCTTCGACVEQCPVDIEHIDHIVDMRRYQVLIESSFPSEAGVMLRNLENKGNPWGAPQNTREDWTKGLDFEVPRVGETEDFDYLFWVGCAGAFEDRAKKTTRAVATLLHEAGVNYAILGEGETCTGDPARRIGNEFIFQMLAQQNVETLTEAFGDRKVKRIVATCPHCFNTLGNEYEQLGLKVEVVHHTQLLAHLVKEGKLTPVQPIDGDITYHDPCYLGRHNRVFDAPREVLGETGNLIEMPRNSERSFCCGAGGARMWMEERIGKRINVERTEEALATGAKTIAVGCPFCYTMIGDGVTGKGKQEEVEVVDVATVLLRSLKQEA

SEQ ID NO: 10879 - protein, 87 aa, Actinoplanes utahensis
MPKSQVRKKKVYTPPSDIRPAVTAASKKPSPVWLPALAVALIVVGIAWLVVYYLSSQQYPVESWRYWNLAVGFGCMVASLGILSRWR

SEQ ID NO: 10880 - protein, 258 aa, Actinoplanes utahensis
MAFRDAWRVVLGRAAGGRQTIWSVGVPLIALAAGLLFTTSATTADGTALRDDRRPQLAQVIADKRERLTATEKREAALRAEVDQETARLAEVDTPVKVARQQADAVREPAGFTALHGPGLTVTLNDSPRRGTDFGDNAPDNDDLVVHQGDVQAVVNAMWAGGAEAMTIMDVRVISTSAVRCVGNTLLLHGQVFSPPFKITAIGEPTAMHRALESAEGVRQFREAVADFGLGYTEKPEKDVTVRAYDGSTDLRSAQAAQ

SEQ ID NO: 10881 - protein, 110 aa, Actinoplanes utahensis
MTTPPAEQPAAPAGRGRHRAPDAEAQTAYIPRLSDASPDGVPGGPLTPPVGLGANVSPSPARSARNPAASDTAILKADAAARQRIAAAQIPARSTSHAEATQTPRTDLAS

SEQ ID NO: 10882 - protein, 644 aa, Actinoplanes utahensis
MTGAASAARPYEPAPGGPAPTGPATPGSPAYGPTSGSRVHGSATSGSPAHGSAAPGHGPGTPGGPVSGSPGHGTGTPGGPVSGSPAPSSPAYGSATPGSPAPAFGSPAPAFGSPASVAPGSPVGGSASVPGWTADTGKPSGPAWTPAAESTASAGWDAEPTRQTAPVPGRRDADPAVPAAGNPAIPAPVPTVGAPAAAARVAASWDPEATGRIETGPAAASTTTSWPAAHQAPETPWDATQAPATPSATPWAPQAPTLPPAAPSGPPAAPPAAVSAPTAPVPAASPPQMGSPNTRWMSNEPTEIAPPVNPNPSETQIIRTIDAPTGILPTLSPDTPLPGKLTALPPGKAAAAARDAAGPEVALGAASVAATPKAPADEPLEPTLEEPPKRGEKVVKLRPEQTDEGYKSVYSELTRPTAASRLRTGIRGAGELMITFGLIVLLFAGYEVFGNSAAVQDEQDHLAQELDQSWNDPTVSPSNAVKGPAAPGDNLVGRLYIPKLDKEWVVVNGVRAQDIKYAPGHYPETALPGQVGNFSVAGHRIKKIFWRIDELQPGDVIGVETRDSWYVYQVYGQQVVKPNQVEVVDPVPNEPGVAPTKRLLTLTTCNPKFNNYQRLIVHAELVKSVPRDQTKPDAGMPAEMKTKA

SEQ ID NO: 10883 - protein, 98 aa, Actinoplanes utahensis
MYAWIWRKLPGQLWSKLAMSVVLLGTVGWLLWNVIFPKAVPLLPFDDVQVGDTSQIDPNSVTPDQVPGPSADPDASAPDVIPYSTSSNHPDPGGLAGD

SEQ ID NO: 10884 - protein, 219 aa, Actinoplanes utahensis
MTDVRILVIDNYDSFVFNLVQYLGQLGAECEVRRNDEITVEDAGRLGAAGILLSPGPGEPTRAGIMLDVIRSYAGKIPLFGVCLGHQAIGAAFGATVTRAPELLHGKTSLVHHRGVGVLAGLPDPFTATRYHSLAVLPETLPDEIEVTGRTDSGVVMAMRHRTLPIEGVQFHPESVLTEGGHTMLANWLAACGLPEALERAPELAAEVETRRRSAFATA

SEQ ID NO: 10885 - protein, 591 aa, Actinoplanes utahensis
MTAQARLLGGRYQVGELLGYGGMAEVHRGRDLRLGRDVAIKMLRTDLARDATFQERFRREAQNSAALNHPAIVAVYDTGEEISATGEKLPFIVMEFVNGRTLKEVLAQEQRLQPRRALEIIADICAALEFSHRHGIIHRDIKPGNVMITQNGQVKVMDFGIARALASGATTMTQTSAVIGTAQYLSPEQARGEAVDARSDVYAAGCVLFELLVGHPPFVGDSPVSVAYQHVREDPRAPSSISRDIPPDVDAIVLKALAKNPLNRYQSAQEMRADALRAVSGRPVMATPVMNQAETVALNNGPRQWQPQAATTMQRPMPAAVAGGRPADNRQSWVWAALAGLGVLVVIVLGVALALNKTDKGGDQKPAAQAQVPDLKGLTAGQAQQKLSQLGFTNVTAGDPKEDKDCKGEVSDQTPPKGNTVPVTTQVTYTICNPPKSVQVPTGLVGGTKSSAEQALRNVGLVPKFKPVDSTSPKDQVVNVDQQGDSVPPGTEIVVSISNNELILVPDVVGRSQDAAMALLQNAGLNVTVETVNTGGDPGKVISQSRKPKSKAKAGDPISITVVSTDTPPSGDPSPDPTDTSGTGGGIGTNE

SEQ ID NO: 10886 - protein, 457 aa, Actinoplanes utahensis
MIRPGVTLGGRYRLEERIAGGGMGDVWRGTDDVLGRTVAVKILLPALLDEPGFAERFRGEARTMATINHPGVVDVYDYGSDQQLAFLVMEYVEGDALSRTLSRVGRLTPARTMALVAQAADALQAAHANGIVHRDVKPGNLLVRPNGTLVLTDFGIARSALVGQLTVAGAVLGTASYISPEQAAGDVATPASDVYALGVVAYQCLSGHRPFDGATPIEIAMKHVRETPRPLPGDIPPAVRAIVERALSKDPAARWPSAAAMAAVARQAAASLTTTVQPPMNHHQPVRATSSGPAPQARASVPRPISGARGAASVPSSVPPVQSVPPVPSVPPVQSAPPVPTPMPPHYRPPSGPPVSNYPQQPMRMTKPEGAFGRQVLIVLAVVLALLVLLCAGVISFLYRHGISAAAAENALGDRSSSAAILRMGVADDRVSTASYRLMKAGPQLGLIRPNEGRQTL

SEQ ID NO: 10887 - protein, 499 aa, Actinoplanes utahensis
MNAPLRRAGVVVLVLFGLIFANLNWVQAYKADDYRTAARNPRVTVAEYERPRGGIEADGTPLAENKATDDTLKYLRVYPKKEIYAPVLGYKPVNLGATGIEESENDFLSGESDKLFADRLSDMFTGEETGGGNVLLSLKTKAQEVAWKQMTENQRGAKRGAAVAIDPRTGAIQALVSMPSYDPNLLATHDKNAAAKAYKELNATKDQPMLNRALSQTLPPGSTFKVIVSAAALQNGYDVDSQIPAGSVYEESGAVIRNAEDEVCPGSSISLKEALTESCNTGYAKLGVKLGADKVKAEAKAFGFEDESLKVGDLESGDGLPVAASHTGAIANPDGTTDKGALAQSSIGQRDVRMTPLQGALIAATVANGGEQMRPYLVQKLVSQDRRTIYTVSPKKRSNPIDGEVASKLKEMMVSVVENGTGKKAKIDGFTVGGKTGTAQNAEGANPHGWFIGFAFNDKGEAVSAVCVMLENVSGGHASAEAARIAGLIMKAAAGGGGN

SEQ ID NO: 10888 - protein, 500 aa, Actinoplanes utahensis
MTAPAVPAPSPSSTGELSRIPGLKTRRNAELGLLAFAMLLVATFAATVEANQFDKLSGTFWVPPALLSLLFLGLHVVVRFVAPYADPVLIPAVALINGIGVAFLRRLDLARAIANKDPIPGVFAGTGGRQLAWTLASLILAAVLLLVVRDHKVVSRYAYTLGLAGIVLVMIPAVLPGSLSEVNGAKLWIKFGAFSIQPGEFAKLALVSFFAYYLVRKREVLSLASHRFLGLDFPRGRDLGPVLTVWLLSLLVLVFEKDLGTALMYFGLFVVTLYVATERSSWLIIGLLLFFGGVYVAYLLGAAIGGPFANFYDRAQVWLDPFATANYERVGGSYQLVQGLLGLGTGGLFGSGPGGGSPGFIPEVRTDFIFAGLGEEIGLFGLSALLVAYLLIVERGLRAALTVRDSFGKLVAGGLAFTLGLQIFVILGGITGLIPLTGQTTPFLSAGGSSLMANWLLVAMLLRISNAARGPAAGGGQDRPTGPKKAPTQLHGAMTEVIKP

SEQ ID NO: 10889 - protein, 478 aa, Actinoplanes utahensis
MTLTLRYAAQSDRGLIRDLNQDSVYAGPRLLAVADGMGGMAAGDVASNIVIAAMAPLDDDVPGDALVDALRHAVGTANQQLRDTVDANPQMEGMGTTLTAVLFTGSKFGMVHIGDSRAYLLRKGEFAQITKDDTYVQMLVDEGRVSPEEASSHPQRSLLTRALDGRDIDPEYSVRQVLKGDRYLICSDGLSGVVSAETIGQTMREIADPKACVERLVQLALRGGGPDNISVVIADATDADIVEQAPIVGGAASLDRGNTTVADSSTPASRAAALKQAPPRPAQPEPDAFDRDAEPAGHPVRTGLLVLLVLAVLGGGLWAGWRYTQDQYYVGATDDGQLAIFRGVPGQIAGLDLSTVSEASTVRLDELTTVAQDRVKQGIHAGSKVDARSMLTELTSDEPSNPNLKPVCSVATATPAASTPAGAKPAVTKPAGAKPSASGAVRPAATTASSAPAIAPSVQPSESASTAPVDTTGCRTAD

SEQ ID NO: 10890 - protein, 160 aa, Actinoplanes utahensis
MPEFVLTVARFGFLILLWIFVFTVVGVIRRDLFAGARSKSIVASPRGVGGVVLPGRPAKVKRGKAARQLVVTAGQLAGTRITLGEAPITIGRAEDSTLVITDDFASARHARLVPRDGQWFVEDLGSTNGTYLDRGKVSGPTPVPLGVPIRIGRTSLELRP

SEQ ID NO: 10891 - protein, 282 aa, Actinoplanes utahensis
MPAALGLRMRKRRPDTIMSSEPEEEPVSVLQRFEKRLEGLVEGAFAKVFKGVVHPVEILNAMQREAEAHKAILAGGRTLVPNRYVIDLSPYDHSRLAPYAAALAQELAQSQAEFIGEQAWTVYGDVIVEIERGDGLDTGMFRVTAEVYTGGEVAPVQQPAYDAGPQYSPYDQQHGGGYPPHGGGAHGGPRSVGLVSGDGRTYPLQMGSTVIGRGDQANLRLPDVGISRRHARLDYDGNQVVLTDLGSTNGTMVNGQRVSAVALNPGDMIQLGTTTLTFRVDG

SEQ ID NO: 10892 - protein, 108 aa, Actinoplanes utahensis
MNTAVDVTLIGALAAVWLTAGLLADGLAAASTAHSMRRRAGLLTVLAGAGAALFVAVPVATALLPGASSAPVAALLPAVPAVVVLTAGLRKLSWVRRGAGAFATAPQA

SEQ ID NO: 10893 - protein, 37 aa, Actinoplanes utahensis
MLVTVIGIRAAIRHSRLAPLVLAPLDRVRQRARATTH

SEQ ID NO: 10894 - protein, 153 aa, Actinoplanes utahensis
MTIGSENLSNGSSTAQDRFSGGVSAYRQGRREALHADLGDGELLSRGSSGLPTRSPGHSRSIDSRSLEPASALDRAAKLPSLDLHGLTEPVFSASWSDGTNTSMADHPLLRGLLLELPARGTLPPSDWLDRWFEAARSILELLYVQEAKKQAH

SEQ ID NO: 10895 - protein, 74 aa, Actinoplanes utahensis
MELEVKGLRVDLSRAEWFKSTRSGADSDNCVEVAFVDGAIAVRDSKNQSGPALIFTSAEWDAFVHGAKDGEFDL

SEQ ID NO: 10896 - protein, 100 aa, Actinoplanes utahensis
MLLPRSGDVIHVTKAASVQFATPMLFRVIRVHDWPTYEGWVWLDGYELNSAGDAVERRSIFVQVNGLRPVGKAPDPRARNGRQPATRPSVAPVRPARAPR

SEQ ID NO: 10897 - protein, 206 aa, Actinoplanes utahensis
MDERQPDWDPAPQDDLWTGRAEVRPSAFDQNSDRYEVDEEVEGEPAGHWWMPIVVGTVGLLLLALLGYGIYVIALHARKPAPTTTVAPAAVTTVPATSATPTTAPTTTAVSVPPTPVETTVVTTEPATTEVAVPALRGMPLADAKIALQRSGLGYRVIGRPSDAEPGTVIDSDPPEGRVVPPDTAITLVVAAGRTGGPAPTTPNGG

SEQ ID NO: 10898 - protein, 487 aa, Actinoplanes utahensis
MRGMADKGWTAQAAAAAGIAAGAGAAQLGLGYGLGVIEWPATATATDSTWLNSLGWATWITASATVLGAVIAGRLRADRAGRWRTLWRIALAAAAALGALVSVALVALPARSAAQTPLFTHSPQLVAVSYSLIGLLAGVIVAFWAVSSAPVAANLVGTAAWLWALAIAGVTAELSTNRNLETYLTSWQFAEDQTPVRYGGIYWPSALLTLAAAFAIGLVAAWPAARRGRLGLGTATSGAVGPLLVAVAFLALAPLLTQAAGPLQSAYLMAPYAVLAGLAGSALTVSLGRSRGRAAASGPLTEPTGGPAAAALPAAPSAPASSASSATSAVSAAPSEPSATRSASSATRSASSATRSVAPAAPSVASAPSIAPSAAPSVPESAPRGRWSPFGRKRPAEEPAAPATQKPAEKPTAQPAEKPAPKSAAKPTGKTAPKPVEPLTAGLADPELAAAARSSKATKRTPTRKEPRSTITPPPANPPIARINPDS

SEQ ID NO: 10899 - protein, 189 aa, Actinoplanes utahensis
MTVSTREFEGLQFPAAGTYELDAAHKRVGFVVKHLMVSKVRGQFSEASATIVVGENPLDSSVTATINTASVQTGQVDRDNHLRTGDFFEAEKYPTMEFRSTGIKSHAGTEFVLDGELTIKGVTKPVELVVEFEGATTSPYGQHVFGFSATTEIDRDDWGLNWNVALESGGFMVSKNVKIEIEGEAVLQA

SEQ ID NO: 10900 - protein, 168 aa, Actinoplanes utahensis
MPVIVEGVNTDLDDPRLTAVGLLAEAYTGLMNRLAAQFEEHRLSTVEFEVLMRLARSPGNRLRMTDLAGQTTLSTSGVTRVVDRMERDGLVRREACPSDRRSSYAVITDAGQERLAQVLPGHLELVQRWYVGLLPPEHFTGLLDSLRTIRDAVNPSATAGSAEAVTQA

SEQ ID NO: 10901 - protein, 448 aa, Actinoplanes utahensis
MASDQGFGALLRELRRRAGLTQEELAVRAAIGVRTVRDLERGRAARPQRTTADLLARALGLAGADHDGFLAAARSRPAGTPFLRSAPTDDLIGRDTDIAELTASLADPAGPRGVTLVGAAGVGKTSLAAVVARRLAGAYPGGVAGVAVADGVTAAELTGGLLAGFGVSRPEELAGPGAARVAEPGGAPVLLFVDALDRAPSVAAEVLAELLAEVPQLRFLATGRAAAGLDGERVRTVLPLAMPPGGSVTGTVGELMTYPAIGLFLERLGRVRRSHLAPDELVPLVALVRRLGGVPLAIELAAARGRVLTVPEILASYAEAPVTHPASAEPGVIALPVVVGETYRLLAPAEQRALRLLATFRQRWSRESAEALLTTSDNPGGEVVHLLDRLVALGLLNVSGDPGVRFRLPSAVRDYALARAAVEGELADDRFRHAGAPAGRPAAEADMP

SEQ ID NO: 10902 - protein, 385 aa, Actinoplanes utahensis
MVDFRLGDELEDLRGSVRQFAREQVAPVIAEHYEHKTFPYDVIRQMGKMGLFGLPFPEEVGGMGGDYFALCIALEEIARVDSSVAVTLEAAVSLGAMPIFRYGTPAQKERWLPALTSGEALAGFGLTEPGSGSDAAGTTTRAVLDESTGEWVINGTKAFITNSGTDITSLVTVMAATGTNPDGSRELSTIIVPSGTPGFTVAPQYSKVGWCASDTHELSFDDVRVPAENLLGQRGRGFAQFLRILDEGRIAIAALSVGLAQGCVDESVAYAKQRVAFGRPIGDNQAVQFLIADMELRAHLARLGYYDAAARMLAGEDFKRYAAIAKLNASNAAMENSRYATQVHGGYGFMNESAVGRFYRDAKILEIGEGTSEVQRMLIARGLGL

SEQ ID NO: 10903 - protein, 507 aa, Actinoplanes utahensis
MDGDALAQVRKRVLAGGAERYHAANAGKGKLFVRERVALLVDEGSFVEDGLYANSLAEGLPADGVITGAARIDGRDVCVMANDSTVKAGSWGARTVEKIVRVIERAYQLGVPMIYLVDSAGARITDQVDLFPGRRGAGKIFHTQVKASGSIPQICALFGPSAAGGAYIPAFCDVVAMVEGNASMYLGSDRMVEMVTGEKTTLEAMGGARVHCAESGVGHFLCKTEQDALDVVRGYLSYVPQNWTQRPPSASATDSSGADLGALVPASERQAFDMRRYVKGLVDDGSFFEIQALWARELTVGFARLDGEVIGVLGNNSMFKGGVLFVDSADKASRFVQLCDAFNIPLLFLADVPGFMVGSAVEKQGIIRHGAKMITAISEATVPKICVVVRKAYGAGLYAMAGPGFEPDATIALPTAKIAVMGAEAAVNAVYANKIAAIEDPDERAAFVAERRAEYERDIDIMRLASELVVDAVVEPGDLRAELIRRFSAARGKDRTFSRRRHGVTPV

SEQ ID NO: 10904 - protein, 482 aa, Actinoplanes utahensis
MFWNQPIEYAEILADHFLKGITFLMKKTWVRKTLSVGIMAAGALLMAPAAAQAGGHSHGGFAPSAAQDGITQFSSTNLGALNGTQFAAPLTAPVNMNGNAIALGGISSANGGGVNHIAEGSRARRGGSGIAQQSGGNVGFLNGTQIAVPVTVPINQNGNADSLFGVSSARGSGVNHVTEGAHVAGGGWNDGIAQQSGGNVGFLNGTQIAVPITIPINQCGNADSLFGVSSAQATCANFIGGPTGRSVRQGGAGANNWGGGAGAHNWGGGAGADNWGGGNRVGGWDNGIRQSSFGNIGFLNGSQFAAPVVAPINACGNSLGSLLGTANSQAFCVNRIGDSGPVWVKGHRHGHHGAVQGDQGQGNCGCGDDNTGDVRGDQGYNGGGEAPAVNDDNGYSNDDNSGDVKGDKGGHKGHGHKGHKADTGYGDVKDDNNGNAKGDKGYGDVSPDKYGDSTGGRNNIESTSVSGLTGSLGGLDLLDSLR

SEQ ID NO: 10905 - protein, 353 aa, Actinoplanes utahensis
MAGWRVERTPRTASRSVPVTPGGSPLMPPHSQGAERRPERRAGRAGSRWVLRAFVVGGLAGAAWLLTGAAAHAAGTGAEPVPVAQAAGLTENPAGLTEKPAGLNEEPAPVAQVAGPGEPLGAVLDGDVESAPAWLDENQDRTVGDLLKAAVQPLETHHHIVTSLPAATHDEPAIDPEPHGEPLPTTAAPLRSSSGTADAQRQPATEGPAADSVAPPALSHPFAPVGEPAPATFVKRAGTRVTRAPAGDKPARRVTALSRSRVHRHAPAARPVAPEAIRQDMPGGDGPAPARTNLGAVSGIPASSGSGGNTENGSSAVLPTGTANGPVACHRCPVAPDVDARRNDAVAPTVSPD

SEQ ID NO: 10906 - protein, 292 aa, Actinoplanes utahensis
MPAISIREVAPRDGLQNEEPVPTDGKVALIDALSDTGVGRIEAVSFVHPKAIPQMADADEVWSRITRNPDVRYSALIPNTRGAQRAIAAGFREIEVVVSASDTHNRRNLNRSTEESLDDIAGLIPLVHAAGATLEVIVATSFGCPYEGDIPPERVAGIVERVRRDGADRIAFGDTTGMGTPRRVRDLLAEVRPDLLHFHDTRGTGLANIVTALDLGVTEFDASAGGLGGCPYAPGASGNVATEEVVHMLHDMGLDTGIDLDKLIEAAELAERLVGRTLSSGVLRAGPRTRLV

SEQ ID NO: 10907 - protein, 443 aa, Actinoplanes utahensis
MIESLLVANRGEIARRIIRTANRLGIRTIAVHSEADADLPFVREADEAVCVGPANPAQSYRNADAILAAAKQTGAQAVHPGYGFLSENADFARTVEANGLIWVGPGADAITAMGDKINARNLMAAAGVPVAPGTAEPVAGVDDAVAAAATIGYPVMVKAAAGGGGMGMGVATDEAALRTEFGKVQAFAERMFGDGSVLLERYFPRVRHVEVQILGLADGRVVALSERECSVQRRNQKLVEEAPSPAVTPELRERMKQAAVKAGEVVNYRNAGTVECLLDPATGEFFFLEMNTRLQVEHPITELIHGIDLVEAQLRIASGEDVSDQFGQSGHAIEFRVNAEDPKRFLPGPGAITTWEEPAGFRVDSGYTEGNTVTPFYDSLLAKLIVFGADREEALAKARDAVAGFRIAGPKNNLPFFAELLENDEFRSGDYDTGIVARMKGVK

SEQ ID NO: 10908 - protein, 201 aa, Actinoplanes utahensis
MTTVDQRHRTTPPAPRRRSRRDEILEIAVGLFAARGYHGVSMDDIGSAAGVTGPALYHHFAGKEAMLVAALIPVSESLLEGGRERVARHPAEAEAALADLIDFHVDFALANPAVIALHLHELDRLPEEPRRQIRRLQRLYVEEWVGVLTLLRPELEASEARVLAHAAFGLMNSTPFLGGEVERRRRADLLREATMHALTGR

SEQ ID NO: 10909 - protein, 926 aa, Actinoplanes utahensis
MKTAEELWNVLDEAHHLPYGAAQIALVEQVLRHVDGAGDPALAFYTRLFATTAYIYGGESVKSFATFSWCVADFDKNPQPYHERWTHNLLWLFKTMISALTRFPEIPLARTYAVLDDMERRYRETGHGMQPVYKHRYLVARHLGLTEEAEGWFEKWRTAPRNALSDCAGCDPTTMVIHLNTRERFAEAVELSAPVLAGELNCNEQPQSILSELMVSYLQTGHLTDAADAHRRSYLVERGNLADLAGIGDHILFCARTGNEARGLEILQRHIDWLDRAPSPSAGMHFAATGVALLRRLAARGHGDTLIRRSGRPDVTAEALAAELETYATGLAARFDARNGTGHQGRLVAETMTAEPYGVDLPLAPTARRPAPTPAAAVAPLREATPEPVEIPADLDETELLDLAERFLDDDAHDEFAAVLEAFAKRFPDPIDPLAAGRLWTFRGVALPDDDHDGTIAAWEQAVIAFTRAGDGSRVSALRARIAIERARAERGEPADDVALVRSDVAYQEEHGTARDRANAWLRLSTMYFMADSLDEANEAGDRADAYAAESGRPRRVAYHALVRARNRGAAHRHEEAGAAAREAWSFYREHGPARASAEAATIVGQVSDDPAEVVAAMTESLTTGLPGAELAGHALRGRALMSLERPEEAIDDFVEAVAICAEHDLEQPGVFARQDLAQAYRAAGRLPEAAEVAEEAVLGFERLGFPEPLNDTRYMLAGIYRDLDDTGRALELYRQLIEVLADNPAGRGQLGEDAGMVLYKLDRDAEAALTFRAAAEALREAGDPAGELRVLRRRLMALNYADQVDEAEELIGLVTRRYEELPAELAEQPGVQWGRAIFAFEVGNLLMRRGRWAEALPHLDGAPERLRAIGARDDADRVTGMLSEALLRSGRPAEALALMESLPEEKRFAELYAEARAAVDRLNDR

SEQ ID NO: 10910 - protein, 602 aa, Actinoplanes utahensis
MVPAPRRSEITPVLSYRTGTVRAVSNTFQVDLRGIVDLLSHHLYASPRVYVRELLQNAVDAITAVGPDHAGRVEITTGPVLRITDNGIGLTEAQVHELLATIGRSSKRDELGFARHEFLGQFGIGLLSCFLVADEIRVHTRRQGAAPVLWTGHSDGRYDVRPGDDREPGTTVTLLPRRGAEHYLTGATVTELAELYGSLLPVEVTVDGRRVTAGTVPWALPAGERNAYADSVLGFRPFDVIDLNVPGSGLSGAAFVLPTPVNPASRGGHRVYLKRMLLSESVEGLLPDWAFFARCVVDSTELRPTASREALYDDGMLAETREAIADQLRGWLVRLSATDPRRLGQFLQIHHLGVKALALHDDEMLRLVEQWYPMQTNMGELTLAEFRARFGALRYAATADEFRQLAAVAAAQDVGLINGGYVYDADLIERLAATDPEVRAERLDPTDLTTRFTAVDAESELRLRPFLSAAQRRLDKLGCEVVVRAFDPVTLPALYLVSRAAAFHDEFTASRDQADDLWGGVLDALSSTVPNDRPQLVLNHRNPLIRRVAALGDAELAALAVESLYGQALLLGHHPIRPADAALLTTSFLGLLDRAVPGEGTR

SEQ ID NO: 10911 - protein, 299 aa, Actinoplanes utahensis
MSVANDPAQALQAYAHPDKLVTTEWLAANLDTPGLVVVESDEDVLLYDTGHIPGAVKVDWHLELNDQLTRDYLDPAAFAAMCEAKGIGRDDTIVFYGDNFNWWAAYALWVFSLFGHRDVRLLDGGRQKWVAEGRPVTRDKTVRERAGYPVPVRNDAAIRAFRDQVMGHIAGGRPLVDVRSPQEYTGELTHMAAYPQEGALRGGHIPGAVSKPWKSAANDDGSFKSHDDLIKIYQDELGLESGDDIIAYCRIGERSSHTWFVLHHLLGYPQVRNYDGSWTEWGNLVRAPIAKGTEPGGLS

SEQ ID NO: 10912 - protein, 256 aa, Actinoplanes utahensis
MAWRSFVAMGDSFTEGMCDEYPDGTYRGWADLVATRLAVDSGPDFGYANLAIRGRLLDQVIAEQLEPALAMRPGLVSFAAGGNDILRPRVDPHTLVERIDPVIARIRATGADVIMFRFADVAVHIPGGQRMIGSRAAVLNDGFREIAERHGAHLVDLFADHAYLHRDMWSDDRLHLSAAGHRRVAGHVLTALGVGVEEEWMLVPPAPQPTPWRLAVSADLRWAREHLAPWVSRHLRGRSSGDLVTAKRPVLAPIND

SEQ ID NO: 10913 - protein, 129 aa, Actinoplanes utahensis
MARRIADVMTRRVVYLPADTPLDEAAQAMRDQGIGDVVVTQGPAVSGIVTDRDIVVRAVAEGLAPAKTTLGAIATRELIMIEESATVEEAVQAMRSRAVRRLVVCDAERNAVGLLSLSDIALLPLPSAA

SEQ ID NO: 10914 - protein, 139 aa, Actinoplanes utahensis
MPPKLAEIVEEFASAPREVVLEMLLEFSDAVPPLPADLVGHEGMEQVPECQTQFFLKATVQPDTTVTTWFDCPPEAPTTRAFAGILAEGLAGASATEILAVPDDLYARMGLAQAISPLRIRGGTAILARLKRQITEQLP

SEQ ID NO: 10915 - protein, 213 aa, Actinoplanes utahensis
MDIQVWSDVVCPWCYIGKRRLENALADFGESVTVTYRAYQLDASPVPQPLPIKQAMASKFGDADRAEQMFAHVTEIGASEGLTLDFDRVVAANTFAAHRLIAWAAGHGRQAEVLDALQRAYFTHGADIGSLPVLAKIAASAGLDGAAALGYLTSEAGTAAVTTDLAAARELGITSVPTFVVDGKYAIQGAQESATLLSALAEITRREAVEAGQ

SEQ ID NO: 10916 - protein, 195 aa, Actinoplanes utahensis
MAGTGRGNDGGVMGSLQTESAQSRLDLLAGPVAKALSVWPEDAPVDVDQVLVASIDPGLADTAAFCEAYGIPLGESANCVIVAGRRGETVRYAACVVLATTRADVNGTVRRLLDVRKCSFAPMDEAVSLTGMEYGGITPIGLPDDWPILVDSRVVATPHVIIGSGVRHSKIAVAGPVLGALPGARVIEGLAKEAG

SEQ ID NO: 10917 - protein, 199 aa, Actinoplanes utahensis
MSEIVEEANAAERRKARIGTVSGLALLTGTTAMAAVGGGHHSFPATALLALLALGMAHSFTVEIQRQAHRRTGRWGRPDTVNTALLSGWAVASLTVAVLPYPPTAMRVMGLLLTTSYVAACAYFVAERHRATAARRSTPPAPHPREDTAIEAAHSLATATLQPGENTAIEAARTLATPTPHPSENTRRETARMSLEAAP

SEQ ID NO: 10918 - protein, 190 aa, Actinoplanes utahensis
MREARWAGQAMLSPAGWRPVEAIVGRTTIRGGTATPFVSIGSSGTGSQSRPSGSGPLPSSGLTRGSPSATDTANTDVMPDGYGISNTYRRSLTTRPVSSKTSRRTASSGVSPGSTPPPGRVHHSPPPVRRLRSWTISTRPSRTITAAARLRSLTSTQANRRKPRAQESIAPLWISDSGRTGKYGTTPSER

SEQ ID NO: 10919 - protein, 173 aa, Actinoplanes utahensis
MPVLPLSDIHRGAIDSCARGFRRLACVLVSERRRAAAVIVRDGRVLMVHERSRRTGGGEWWTLPGGGVEPGETPEEAVRREVFEETGLVVSDLRYVLEMPYPSGMTSVFAVSVADGEPRVSPDDGSGPEPLGLDWLPVPELPIETNGVAVPPLMVVLPTMASTGRQPAGDSIA

SEQ ID NO: 10920 - protein, 169 aa, Actinoplanes utahensis
MALQPVSGDQGHLWAAADGPLGRGFCLTLVRGRKPVQVVRTVGGKAHEMVYWRQLVGPGDGEAAGRRYFVGMARLSHWTLILQDGDFDGGLGMDPAIAGRLAAGTDVVVCRCDRAGRGRVRTYRDGVVGTDVTDHTEEAIRLVEKRAGIRLTGALLEQKRYLLVTVPKA

SEQ ID NO: 10921 - protein, 148 aa, Actinoplanes utahensis
MPAPTTPAATADTLDGMDRISLPVVPAVAAAALVPWTIGLATLLPRTATARHWNIVWAGLDVAIIAGLASTSWLARRRDRRVTPAAVATATLMCADAWFDVCTSDAGLPFATACAAAAIEVAVAATCLVAARAADPAEGFRARQSASR

SEQ ID NO: 10922 - protein, 199 aa, Actinoplanes utahensis
MPAVLWSRRTWPAVAGLLIGAVLWLVPAALTMTIVGAGMLIGSEHPPPGLGGSEKLGGTVGGTVPLVVVLPVLLALTFRFTVWHQARLRLLGADLAPPAARPPGMSRRSWLARQAVSATTWRQVRYHALGGAFLTAAGVVVLAGLVFGPGFVVAAALSGKGSLLQRSPIAALGVGMAVAAGWLARGAAALDLALARRLL

SEQ ID NO: 10923 - protein, 169 aa, Actinoplanes utahensis
MNLGMTRAAVADADPAVRAAVAAAHEEAKQALAELRDLIRGLYPAVLDELGLDAALSGIAARSPVPVRLVVDLRGRPPAPIEAVAYFVVSEALSNVAKHAAATRADVVVRQQPGGLTLAVADDGRGGADPVRGTGLRGLRQRVESVDGTLSIASPAGGPTSIRVSLPCG

SEQ ID NO: 10924 - protein, 212 aa, Actinoplanes utahensis
MRVVLAEDSVLLRDGLSRLFASRDCPVVAAVGDAEALLRAVGEHRPDLLVADVRMPPGYADEGLRAAIQVRRQWPGVGVLVLSQYVEERYATKLLTGDTSRLGYLLKDRVADVDDFVSAARRIAGGGTVLDPEVVSQLLVRRTGPLDRLTPREHDVLALMAEGRSNAGIAGALVVSESAVAKHVNGIFAKLGLAPADSDHRRVLAVLRFLGG

SEQ ID NO: 10925 - protein, 162 aa, Actinoplanes utahensis
MAVATAVMVAPVAALADSYAPCNTMESTVKAGQTSKAQSITCVQKPTCGESWGQIYDVTWDMVVHTGGVTVKSMKIHVTHTRGEDITLGVKNIRGTNADINIGGKDLIPANQTSWTKTYDITDRYFAKNSLGFVDFWLAISSDKANGCSGSSTWLRYGLKIA

SEQ ID NO: 10926 - protein, 44 aa, Actinoplanes utahensis
MSMLKKLLIVAAVVGAATLVVKKVKASSDERALWHEATTAPDLR

SEQ ID NO: 10927 - protein, 146 aa, Actinoplanes utahensis
MGAARVSEAVRSARSTVSPAAARGPRRARLNLKRIDPWSVMKFSFAVSIVLFIVVVVATSVLYLALDTMGVWTSVNSSLQELVTAGGGTDPSSGFRITAWGVIGTSMLIGAVNVVLFTALATLSAFIYNVCADLVGGIELTLAERD

SEQ ID NO: 10928 - protein, 54 aa, Actinoplanes utahensis
MAPPPGEPAAGQDTEAKRPGGPAVAKASAAVPVVTKGKGAAPGTAAARPATLAS

SEQ ID NO: 10929 - protein, 837 aa, Actinoplanes utahensis
MTDTPEPPDGDEIPAETGGGVTQRVEPVGLEVEMQRSYLDYAMSVIVGRALPDVRDGLKPVHRKILYAMYDSGFRPDRGYVKCARVVGDVMGNYHPHGDSSIYDALVRMGQPWSLRYPLIDGNGNFGSPGNDPPAAMRYTESKLSPLAMEMLRDIDEDTVDMQDNYDGRTKEPTILPSRFPNLLVNGSEGIAVGMATKIPPHNLREIAAAVQWCLDNIDADEATTLDALIEIVKGPDFPTYGLIVGQQAIQDAYRTGRGSIRMRAVVEVEEDQRGRPCLVVTELPYQVNPDNLAERVAELVKEGKLTGIADIRDESSGRTGMRLILVLKRDAVAKVVLNNLYKHTQLQETFGANMLALVDGVPRTLNLAQFIRYYVEHQIEVIRRRTAYRLRKAEERAHILRGLAKALDMLDEVIALIRRSPTVEDSRQGLMTLLDVDEIQATAILDMQLRRLAALERQRIVDELAKIEIEIADFKDILAKPERQRAIISEELGEIVQKFGDDRRTQIIPFDGEVSMEDLIAREDVVVTITRTGYAKRTKVDMYRSQKRGGKGVSGATLRQDDIVSHFYVISTHDWMLFFTNKGRVYRAKAYELPEANRTAKGQHVANLLAFQPDEHIAQVIQIPNYQVAPYLVLATKNGLVKKTRLDEFDSNRSGGIIAINLREDDELVGAALVASEDDLLLVSKHAQAIRFNATDEALRPMGRATSGVIGMRFGDNDELLAMEVVREGMDVLVATNGGYAKRTPIEEYPVQGRGGKGVLTAKITERRGGLVGALVISPEDELFAITSNGGVIRTPVKPVRRTRDRNTMGVKLMDLPEGVTIVALARNADEPDEQD

SEQ ID NO: 10930 - protein, 726 aa, Actinoplanes utahensis
MTVSRPLHAAIFVTLRGFSSRSRSAGRPRRPACMVPPVVRSPRGVIRPVPPARRSLLGACQPRAGPLGSGARKRPRMAENNQEYGAESITVLEGLEAVRKRPGMYIGSTGERGLHHLIWEVVDNAVDEALAGYCDTIDVILLADGGVSVTDNGRGFPVDLHPKLKKPGVEVALTVLHAGGKFDNQAYKVSGGLHGVGVSVVNALSTRMAVKIHKNGFVWRQKYNASVPEELIKGEATETTGSTVQFWPDPAIFETVEFDFQTIYRRLQEMAFLNRALTINFTDERPEFLDENGEPRKVTFMYAGGISDFVRHLNATKSAIHKTVIEFGAEDNEAGMGVEIAMQWNESYGESVYTFANRINTHEGGTHEEGFRAALTTIVNKYGIEKKFLKGDQKLSGEDIREGLAAIISVTLREPQFEGQTKTKLGNTDMKSFVQKVANEQLADWFDRNPADARLIITKADQAARARIAAQQARKLARRKSLLESGSMPGKLADCQSTDPRETELFIVEGDSAGGSAKQGRSSKYQAILPIRGKILNVEKARIDRVLKNNEVQALITALGTGIHDEFDIGKLRYHKIILMADADVDGQHIQTLLLTLLFRFMRPLVEQGHVYLASPPLYKLKWNKRGDDAQYAYSDRERDGLIALRQQKKPNAKPDDIQRFKGLGEMNFHELWDTTMDPDTRTLRQVTLDDAAVADELFSVLMGEDVEARRSFIQRNAKDVRFLDI

SEQ ID NO: 10931 - protein, 188 aa, Actinoplanes utahensis
MAHDKGLDNVAVHWPRTNQYYDPVAPAEFVDFGAIADAPEIAAPTGALALHIAKTGTVRATAYTELVDLLLGLEGVLYATDAAAEDEDPVIDPDGCAWIAGGLERFVEGHEKFGDLVTFDTVAEVLRTAIASGRLAEQQLRWLDHRLAALRDDAGNAPHWSFARTELAVLAGFYRRCAERGFAIFADY

SEQ ID NO: 10932 - protein, 103 aa, Actinoplanes utahensis
MVLRRRLVVLLMLVLGSVPFAASPVLAATRSVPCQATAARCQHEGLAARDRVWDGMRWSLFLGAGAGVLLLIIGGEMWWLGRNGQTTPANPAAADRKRSSPVA

SEQ ID NO: 10933 - protein, 176 aa, Actinoplanes utahensis
MPDEMSPAAEAAKGGPELARAVLDAALAKRRENSRQPRRRTGGGGEKRLRGYSGPGPDPRDPQLFGTVLQRLMKTRGWERPTAEATVFGSWEKVVGADIAAHSRPIKLDGGVLTVEAESTAWATQLRMLSGRLLKQIAGEVGHNVVTRLNIHGPAAPSWSRGPRRVQGRGPRDTYG

SEQ ID NO: 10934 - protein, 376 aa, Actinoplanes utahensis
MHVRRVELVDFRSYERVAVDLDPGVSVLVGQNGMGKTNLIEALGYVATLDSHRVATDAPLVRFGATSAVVRCAIVHDGRELLVELEIVPGRANRARLNRSPVRRPREVLGALRMVLFAPEDLELVRGDPSERRRYLDDLLVARQPRYAGVRADYDRVVKQRNALLRTAYLTRKVGGTRGQDLSTLAVWDQHLAYHGAELLAGRLELAAALGPHLTKAYDAVAAGRSAASIAYASRLGEGLVPDRGALEAALLARMQERRPAEIERGTTLVGPHRDDLTLALGEMPAKGYASHGESWSFALALRLAAYDLLRSDGIEPILVLDDVFAELDAGRRDRLAALVSDAAQLLVTCAVAEDVPAALRGARFAVTLGSVDQAG

SEQ ID NO: 10935 - protein, 290 aa, Actinoplanes utahensis
MQLGLIGLGRMGGNMRERLRAAGHEVVGYDQNLDVSDATSLADLAEKLTTPRVVWTMVPSGKITEDTIDALAEVLSPGDVIIDGGNSKFTDDAPRAERLAKKGIKYMDVGVSGGVWGKTNGYALMVGGDKETVAHCMPIFEALKPAGEFGFAHAGGPGAGHYAKMVHNGIEYGLMHAYAEGFEILEASEHVDDVPAIIKSWREGSVVKSWLLDLLDRALDEDPKLAGIKGYADDTGEGRWTVDEAVRLAVPAHVISASLFARFASRQDDSPAMKAVAALRNQFGGHSVKR

SEQ ID NO: 10936 - protein, 377 aa, Actinoplanes utahensis
MKFRVERDSLADAVAWTAKSLPSRPSVPVLAGVLLRVTDGRLQVSGFDYEVSSQVSVEVQADADGAALVSGRLLAEITKALPGKPVDIASVGAHLELVCGSARFTLPTMPVEDYPTLPDMPSSAGTVDAATFASAVSQVAIAAGRDETLPMMTGVRIELNGSTMAMLATDRYRLAMREIEWTPDDPEISLNALVPAKTLNDTAKALGPLGGAVTLALAQGNAGEGMIGFAGGARRTTSRLLDGANYPPVRSLFPAAHNAEARIAVSALVEVVRRVALVAERTTPVLLSFSEDGLVVEAGTTEEARASEAMEAEFSGEALTIGFNPQYLIDGLQNLGAPTAVFSFVDAFKPAVISPAGESGEIIPGYRYLIMPIRVTR

SEQ ID NO: 10937 - protein, 613 aa, Actinoplanes utahensis
MADQVDLGKLWQDTLSELSEEIASRQQRAYLRFTRLRAIVEDTALLSVPDAYTRDVIELRLRPAITEALTRRLSRPIQVAVTVRPPEDGSGIPGTVYGTPVEAEAQPAPRDAQPLHYADPPRTPDPRPYQPELPTYPAEQHYQQPGFGPPERAPEPYPTGSAQHSAPAAPYVRNVPPASDGQEALFADPMPPAAQPQRPTAARPTEKTADPAPNEAAILRLPADPAQLRDNQRRPDDRRDDPMPMRGDNGPGRAPLDPRGPGSSPRPGGQDGNRLNPKYMFETFVIGSSNRFAHAASVAVAESPAKAYNPLFIYGSSGLGKTHLLHAIGHYATTLGHARSVRYVSTEEFTNDFINSLRDDKTQAFQRRYRDVDILLIDDIQFLENRERTQEEFFHTFNTLHNANKQIVISSDRSPRQLATLEDRMRTRFEWGLLADIQPPDLETRIAILQKKAAQERMYAPDDVLEFIASRVSNSIRELEGALIRVTAFASLTRSPVQLSLAEEVLRDFMPDGAGPEITADQIMVSTADYFGVSLEDLRGHSRSRVLVNARQVAMYLCRELTDLSLPRIGQAFGGRDHTTVMHADRKIRQHMAERRSLYNQIAELTNRIKQNS

SEQ ID NO: 10938 - protein, 45 aa, Actinoplanes utahensis
MSKRTYQPNNRRRAKTHGFRLRMRTRAGRAILSARRGKGRDKLSA

SEQ ID NO: 10939 - protein, 118 aa, Actinoplanes utahensis
MLAATQRLRRSADFAAAIRGGRRAGRGTLVVHLLIEEPAHASEARAGFVVSKAVGNAVVRNKVRRRLRHLVRPLLADLPPGALLVVRALPPAAQAGYAELGIDLDGALASARRPRRPR

SEQ ID NO: 10940 - protein, 340 aa, Actinoplanes utahensis
MSLDWIYYAISWILLRWHSLWDAIGIPDDRVLGTNWSWVLSIFFLVVTLRVILFPVFVKQIKSQRAMQALQPKVKALQEKHKGDRETLQKEMMELYKTEKANPLMGCLPMFLQVPVFIGLFHVLRHLNPNLPEHLKTIYGWKLEQFNSATAAHLFNVPISAKFGSTPAELAAMHANGTTVKVLAGVLILVMMGTTFLTSRQMILKTGWAEDPQQKMVQRLMLYGIPCSLLISGSLFPIGVVIYWVTNNLFTLGQQQWVLRKFPPPNMAGKGGATTARPANATASDVKNPVQPGRSGGLFGRKAVAEEATPVVDTKALAPKPGAKPVNPKKGARPANKPKG

SEQ ID NO: 10941 - protein, 195 aa, Actinoplanes utahensis
MTDTSTPPASESPAPSAVAPETDAAPSEAVSAEGKKSESVASDSDLFRQSEIAADYVEGLLDILDYDGDIDELVSAGRPMVEVVGGRLQPLVGQRGATLEALQELTRLAIFRATGSPSRLLLDIGGYRASRRKELAAVARNAVEKVKEHGEAVRLEPMSAFERKCVHDVVNAIAGVQSESEGVEPNRRIVVRAAE

SEQ ID NO: 10942 - protein, 295 aa, Actinoplanes utahensis
MTDPRFGAGEGGPGVTAPGPPSSRGPSGSYAARPGLPGAAGVPVPAEEPADVDVLQPPAVMEMAAREVFGDRLALAGRFAQLLATEGVLRGLIGPRETPRLWERHLVNCGVMSQLFPIGASVVDVGSGAGLPGIVLAVARPDLEITLVEPLARRTAFLTETVDELELHNVTVVRGRASEVIGQVADADVVTARAVAALDVLAGWCLPLARVGGTLLALKGASAEEEIGEHGAQIARLGGGRPEIRFCGAGLIEPPATVVEIVKEREVAAGRGRDRVVRAARREGRGGGRGNKRRG

SEQ ID NO: 10943 - protein, 478 aa, Actinoplanes utahensis
MGKRGARKRKSLPAGGAAADEHAVTLPPPSGRGPLGRGLAMRLVSGVMEFVSPTGDDDAALRSTHPVRGHGDVRPPAVGWPGVDSVDRISPAETHVSPADPFLANRDKTVHEYGVSRETESPLDRPSRVNAGDQGVPQPRPSGTTYGYGVPAPRTDAPLPAAPAAVAPVSGTPVQPVEHVSRETPGGDEDDPPLAMEALRAVQILNPSGEIIMPRPDHPRVICVANQKGGVGKTTTTVNLAVALALHGNRVLVVDLDPQGNASTGLNVPHHAGVPDVYDCLIDNVPLAEVAQAVEGIPNLFCVPATIDLAGAEIELVSVVARESRLARAIASHPEKFDYVFIDCPPSLGLLTVNALCAAQEVLIPIQCEYYALEGLNQLINNINLVRQHLNPTLDVSTILLTMYDRRTRLADAVEQDVRNHFGTKVLNAVIPRNVRVSEAPSYGQSVMTYDPGSRGATSYFEAALEIAVRGVNTGGAA

SEQ ID NO: 10944 - protein, 353 aa, Actinoplanes utahensis
MKNRPRGGLGRGLGALIPTAPAAEPESPVAVAADGLPSSAPSVAPVSIPAPSPASAPPAVAVLADDELAPVPGARFAELPVSSIEPNAKQPRHVFDEEALEELKISIQEVGFLQPIVVRELGDGRYELVMGERRWRAAQAVGRESIPAIIRDTPDDVMLRDALLENIHRANLNPLEEAAAYSQLLEEFGVSHEELARRIGRSRPQISNTIRLMNLPAPVQRRVAAGVLSAGHARALLGLEGSEAQEELAKRIVAEGLSVRATEEIVKLAESEGPARKAAPARRAKVHAPALNDLAERLSDRFDTRVKVDIGRNKGKITIEFATVDDLERIVGMIGVEEEGARSSTPSGVDSDE

SEQ ID NO: 10945 - protein, 210 aa, Actinoplanes utahensis
MRLDAGMTAMIRSMAADLGLPLVGYYGLHALGADDTTALLAGTVAAAVRIGWVAIRSRSLSPFSILMGSVFGIGLVFTLVTGDPRFMLIKHSIMSAVIGMVFLATALWGRKPLTLSAQQSFMPAKAAELAEQFKTSAAVRRGHRTASTVWGAGLLVEAAVRAVLVFLLPVDVMVGLSTALTVVTFTVLLGWNARYIAAHRRAAAAVLVAA

SEQ ID NO: 10946 - protein, 303 aa, Actinoplanes utahensis
MSENTGSLPDFTRWPSFPFEGDMRVKKLAPPVEVEPPRSGEDGADCVACTTPDDAYIWVSERWRVRAMDRPTGLPAVLILECRSHLDLGDLPNLLAAELGVMTVRLERAIRSLDGVARVHVNRWGDGSAHLHMWFLARPYGRLQLRGTFLSLWDDILPVIPEPQWRENLALVAAWLADFGGQANAAPAPIEWESPSTLNVPTGTGDGREETRRPATLGDMQAAATPATDSWVRHTDAPSAGSPPASAAPSPAAEAGIPHQSTVPAPGSTGVIASTENERIPFGTGILSTGAGAAAAGAGNTDG

SEQ ID NO: 10947 - protein, 320 aa, Actinoplanes utahensis
MITTMELRVLVLAGGLSYERDVSLRSGRRVLDALRSRGIEAELHDADVSLLPALQADPPDAVVIALHGATGEDGSLRGVLDLCAVPYVGADARTARLAWDKPSAKARLRESGIPTPDWVALPHDRFSELGAVAVLDRIVSRLGLPLMVKPAQGGSGLGAAVVRDAADLPAAMVGCFAYDSTALVEQYVSGTRLAVSIVDLGSGPRALPIVEIVPRDGVYDYAARYTAGLTTWHVPARLSAAVASRVSETALAAYQALGLRDLSRIDVIVGEDGEAQVLGCNVSPGMTETSLLPLAVQADGADLGEILGVLVERAVDRKAL

SEQ ID NO: 10948 - protein, 436 aa, Actinoplanes utahensis
MTGTTQDDYTDRYARRVRGMTTSEIRALFAVASRPEVVSLAGGSPFIAALPLDAVGEMMSRLAVDHGATSLQYGIGQGTIELRERICEVMALSGIQGASPDDVVVTVGGQQALDLLARLFLDPGDVVLAEGPTYVGALGVFQAAQAQVRHVAMDADGLIPEALEEAIAAGVAAGRPAKFLYTIPTFQNPAGVTLSEQRRERVLDICERAGLLVIEDDPYGMLAFEGDAPRPLRARRRDGVFYCSTFSKTFAPGLRVGWILAPHAVREKLVMMSEANVLCPSAFAQGAVTQYLTTMPWREQIKVYREIYRERRDALLSALTDLMPAGTAWTRPAGGLFVWATLPDGLDSKAMMPRAIAARVAYVPGTGFYADGTGRGNMRLNFSFSAPERLREGVRRLSGVMEQDLAMRAVFGGSAALSSQRRRGPAAADAPGPDLA

SEQ ID NO: 10949 - protein, 216 aa, Actinoplanes utahensis
MSRRLVNLTLDTLEDLPRPCRQCVYWELDPVSAERACASGDPGLEKEAWVSQTLLEWGSCGKLAYVDGMPAGFVMFAPPAYVPRSMAFPTSPVSADAALLTTAKVVPAFAGGGLGRMLVQGVARDLTKRGVKAIEAFGDAKPDEDAEGACVAPVDFFLSVGFKTVRPHPRYPRLRLELRTALSWKSDVEYALEKLLGSMSPEKLLRPMPATSSIEN

SEQ ID NO: 10950 - protein, 383 aa, Actinoplanes utahensis
MRSIRRGDTGPAVSEIRSILIGLELLAEPEPDVFDEPLENAVREFQQSRGLGVDGMVGDETWRALDGARWRLGSRTLFHSVPGALTGEDVHALQERLLEMGYDPGRPDSIYGARTARAVAQFQREVGLAPDGSVGPQTMKALRRLGRKVVGGRPQWLREAEAFRQSGPNLVGKTIVIDPGHGGGADTGVLVPDGPLRWTEADLVFDLAARLEGRLAAAGMRVHLTRGPQPAEPMSGTDRAALANSLGADLLISLHLDGHPSEAAEGVATYHYGTGSGLSSTVGERLAALVQREIVVRTGMHDCRTHAKTWDLLRLTRMPAVRVDLGYLTSPADRERLVNPMFREQIVEAILAAVQRMYFPVERDVPTGSIDVRALRMALADRT

SEQ ID NO: 10951 - protein, 105 aa, Actinoplanes utahensis
MKVVTDKSFATDVLASDKPVLVDFWAEWCVPCKKVDPLLAEIAESELGSQVEIVKVNIDENPQTALAYQVMSVPTLAIFKDGERVNLVTGAKPKSFLVNFIESAL

SEQ ID NO: 10952 - protein, 408 aa, Actinoplanes utahensis
MADRRIAGLCPVQRQIGAGGAVQRGQRPVGVGEWRQLRIARWRRGHARFGPGTLNGTPGVRSDTSGTGGNGECLAWRSIGVDTNLEESAVDEVRNLIIIGSGPSGYTAALYAARAELKPLVIEGVQSGGALMTTTEVENFPGHRDGIMGPELMDNMRAQAEKFGAEFITDDVSRVELSDKPTEAGTEGLKTVWVGDQQYFARAVILATGSAWRPIGVPGEQELLGHGVSACATCDGFFFRNQHIVVVGGGDSAMEEATFLTRFAETVTIVHRRDSFRASKVMQKRALDNEKIKVEWNSVVEEILGADGKVVGVRLRNVQTNETKVLDVTGVFVAIGHDPRSELFKGQVELDDEGYVKVQSPSTRTNIPGVFAAGDLVDHTYRQAITASGTGCAAALDAERFIASFVEL

SEQ ID NO: 10953 - protein, 235 aa, Actinoplanes utahensis
MTLRDVPPGGLGAGDPVPSDAELVRAHVAGDREAFAELVRRHRDRLWAVALRTTGDREEAADAVQDALLSAHRAAAGFRGDSAVTTWLHRIVVNACLDRIRRRQAHPTVPLPDHHSGDDRRSAPEPVAPTPDQDTVLLVREALAALPVEQRAAIVLVDVQGYGVAEAAAMLGIAEGTVKSRCARGRARMALALRDLREAHSEPGHDGNRTGAAGVPSRSGGATPQPAGREGRDQR

SEQ ID NO: 10954 - protein, 517 aa, Actinoplanes utahensis
MTQVGEGHETAADEAGPVLTFGEPAVGEILAERYQLEQHVNNDSAGRQVWRGIDVVLRRPVAVVLRHPGGDSATEMLQAAVAASRVIHPNLVGVYDAIDEQQRAYVVREWVDGESLRDLIASEGPLDPARAIAIAHSVSDALAAVHATGMIHGNVHPGTTLIGDDGRVVLADARADAADSSEADVRAVGGLLYFALTGRWPHAEVGRSALPDATRDGSGAPAAPRQARAGVPAYLDDLTMDLLDGRIAAPPAEALTAELGRLDAAAEDEDFEDVGPLRFVQGGGTPTEPARSTRKILVGVGALVIIAIVGLVFGIRAINKSSHPEASPSSPVQAGAGAQPSSAGTASGAPLGQPKKIPLTADMVRIVDPPQGERKDSGESDAVVDGNPDTAWKLSYYLQPNFGGRKPGMGVLIHLKEPRALSEVRVSLSAPGAVLDLRVGDKDPGDNSAGDDTIVKTYKKLSDADSTDVSTGDQPILNGFDPDKKYQYVLVFLTKLPRNEDTPGYQVNVNEIELYGY

SEQ ID NO: 10955 - protein, 615 aa, Actinoplanes utahensis
MVASNNLGTALEASVNGGLYRGSDTARGDDGLYRSAHSAGLPPSADAVPPSPAGYSSMPADGSVAEPEVPEAPEAGGGGLLRSSAIMAIGTLASRVTGFLRTTLLVAALGSAALGDAFNTANTMPNIVYDILLGGVLTAAHVPLLIRARNRSAEYGEEFEQRLFTILLGLLALITAGAMIAAPWLIDLYASRFPPAQHRVASMFLLFFLPQIFFYGFSAVAGASLNSRGRFAAAMWTPVLNNVVVIGVLGAFMAVTHGKLTPDNITDGQVTYLGIGVTAGVAVQALGLIPAMHRMGFNWRLRFDFRRAELTQIWGMASWTLVYVLAQQVALLVYTNLANAAGAQGVKEGIRYGVGLTPWTNAYMFFQLPYAVVAISIITAILPKMTQSAAEGRFDRLVTELREGLGLSLTLMLPAVAVLFGAAGEICLVVFAHGKSSPADAAMVAGVLRVFAVALTPFAVLQLLQRGFYALGDTRTPAMIALGSTGVGGLTAFLLSRVLPTADVVLGIAGAQGVAWACGCVISVVVLRRRLGRLGGGALFRVISKAGLASLATLLVVFLIHHTVTPHLHDSFPLTAVVLAVEGVLGLGAFVIAATLLRVPEVGQVIGMVRRKLGR

SEQ ID NO: 10956 - protein, 296 aa, Actinoplanes utahensis
MPPGTMGPVPVSEALSRLSLDPLFWTGELTEPEFLRVSLPVLDGYAFVLEIELPGDERALGLRRPAASDPVHLGSAPGGGPFPAALRWPELEVCARVIALADPTLPHPGLVVALLGPFAPAAAPDEGPLIAAMRETAYRSLRRAVPPPPPSGPEQAPLPLFTDDRWWPAPPVPSPQVLDEAAIAALSGPGEIGDQVRADRRFPHEDLTDLIRRATTHLAHLPLQPWYAAVSPLARRMVHAGHLDAVPDLLAALTEAGCDHPTILDALSEPLVPLEACWVVETLAGAEPGTLQQHHV

SEQ ID NO: 10957 - protein, 523 aa, Actinoplanes utahensis
MSSPVQNSGSRLSRLNASETGTGPIVPGGTGGHQARYPGNPMSVLNNASVLNEAQQNAVAELLRVSPVADELGRRFGAAGHELHLVGGSVRDALLGRLGDDLDFCTDAHPEQTLAVVKSWADAIWETGREFGTIGIQKNGLRIEITTFRAEAYDGVTRNPVVSYGTSLLDDLSRRDFTINAMAVSVPGHDFTDPFGGLADLASRVIRTPAAPEQSFGDDPLRMLRAARFAAKLQFTVAEPVIAAMRDMAADLDRITAERIRDEFTKLMCGTDPIAGLRLLVDTGLADRFLPEISGLKLEIDEHAQHKDVYEHTLIVVMNAMRLEGDTAPDFALRMAALMHDVGKPATKAVGRDGRVSFHHHEVVGARLTKQRMKALKYPKDVTSEVVGLVALHLRFYGYGRGEWTDSAVRRYVTDAGPLLSRLHKLTRSDVTTRNRRKAAQLAADYDALEERIARIEAEEDLAKVRPDLDGNAIMELLGVPPGPIVGQAWRHLKELRLDRGPLDRDEAEAELFRWARERGHIS

SEQ ID NO: 10958 - protein, 386 aa, Actinoplanes utahensis
MRNLDRDLRVTVADLAAGAPPLNDLAMVARIRGRRIRRRRQTALGAAVLVLAGLAITPFAVFRRHAEPAPPAVVPSVTPSSTPPPVAAIRTDWWKAPITLPGGVVITSVSRRGSFNSLDSIPASAGRTVHEGNVALDRATGRYRVYPIDYQEFVAAPTGRYVRVDGTVGGVGILNVQTGGVRQLHHGTGSGAMQWSADGQRMLLSLNAGGIRTIDAKTGQETDVTIPDTGCPDYCFYTWLPGEKEVAIGQVDPAVPQSEDRPDTVGSVKVYSASTGQLSRTLPVHGVPAGSAAWSADGRYVVVLPDASQPDGLRVIETATGRVVGTIPGFRFDYPAVSDQIRFIGNDRILTAEGLDLNYYDLTGKKLAGMRLPDDFADRDVAFGVE

SEQ ID NO: 10959 - protein, 169 aa, Actinoplanes utahensis
MKQALEAEFTAFVADRGQALLRIAHAMTGDRQAAEDLVQGALAKAYARWPRIHGEAEAYVRRIIYNDRISTWRRAGNRNEVTVAEVPDRPQAGRHEQEVTSRLALRAALLSLPVRQRAVLVMRYLEDRTVEETAEVLGCRPGTVASQASRALAKLRDVFGVDDWTEATR

SEQ ID NO: 10960 - protein, 489 aa, Actinoplanes utahensis
MAEETVSTAARLLSTGQKALAGAALAVLTAGLVVAPRVTAAVTVGACVLFYLLFALFKVLVTTAGRGHRMLLTEVLSSSTRQLPHYGVLLPVHREANMLRRLVARVSQLDYPRDRLHVYLLIEHDDEKTLAAAAAIGLRVHGDGTAAEGPLGHVVVVVVPPGGPKTKPNAMNVAFPILVADGCRYVTIYDAEDRPDPEQLRLAVATFRLARRDVVCLQAELVFWNDDTNWVSALYWVGYKVHFRHFLPGLARLGLPVPLGGTSNHFKVNALLEVALPGGLIWDPHNLTEDADLGARLATAGYRVDLMASVTLEEAPVSSRVVDKQQRRWKGGYLQTALVHSRRPWRAAARMGVHRWLAFLLMTYGTPLTFLLNPLFLALAGVWFASGSEVIVDLFPAPVYYTATGLLVVGNFGIMLELVQTTLAEASRTRGRFGLLKYMFMAQVMWLWMSFSTYVAVFEMVTGKRGWHKTPHGHAETDDDLVLVLQGAS

SEQ ID NO: 10961 - protein, 940 aa, Actinoplanes utahensis
MDELLDLRGGVRDGHRQAGLAQDAARACRDRRRPGARAAGRVVRARTRMIALVLGATQLAACGRLAPSIPAAPPVTTAAAPAASVSPAVRTPAQLGVQIFWHDVKPEQLRENAGRLLDYVAGLGANSVGLTFPIYTDGPKPTRVYIKPGNTPTPADIAALTAAARERGLRVLVRPLFDEVNLRPAKVWRGSIKPSDPDNWFKSYSTVLAPYLTAAQTAHADGFVMGSELDSMTTHPAQWRTAMAAAGTLFRGRLMYADNWGAWIAGRGGVPGADPGVDAYPRFDLPDTASVAQLTDAWTNWLRTRRDGRLGETVIQEVGITATPGAYAKSNAWPEPGQKLVPQIQANWFAGACAAARSLGMAGIYFWTLGEPGRRHRVRRRLLHRPWRSGDQGVLRVRMAGPVSTTERHLSLTQEIRIRNVQRLRRVEDRRTRRRADPAMIGVGLAATVLAVAACVYFYRAGRILGYHDTYSHLEISRRLLVGRTTGIAQLGAIWLPLPHLLQALFAWNTWLYTTGLAGSIVSMTAYVASSVLIYRMVRVYSPGRAAPAVAGAAVFMLGANVLHHQSTSMDELPFYAFALAATYGLMRWADSRQPTYLLHAAMASMLAMLCRYEGWFLAGVFTLAVPVIARRLGHSWPDTRGLTGMFAAFGLFTSAAGWMLYNWMIAGSPLNFLTGPNSSADQMSRRTTDVETGDLGRTLHAYAGALVADHGFVVLGLAVAGLVAFLLGERLSARSLPVFALGSVMPFFLYTIYRGQAPIGMPPVNEYVLNARFGLIAALPAAVLAGYLIARLPGRTALAASILVIAALGGLTTVTFRQDALVSVREVTDDLSSQQDQVRVAAFLAGHTSGPIMLDLVGNERAAFPVLDRVIYDGTKVGRRNVWREALTSPRSVGAEVVLMRGSGARGRDAVYNALHDASAMQGYRAVYEADGYTVYQLS

SEQ ID NO: 10962 - protein, 151 aa, Actinoplanes utahensis
MFVVESPIGPLGVAVEGDVVVGVRFGAAPGPAAEHPAAAQLTAYFAGESTAFTVPVRMRGGSDFERAVWTEIAKIPYGEMMTYGAIATALGDPGAARAVGTACNHNPVPVIVPCHRVVGAGGRMVGFGGGLERKRRLLELEARVALTRAWS

SEQ ID NO: 10963 - protein, 285 aa, Actinoplanes utahensis
MVVAVAGCDGAKGKPPAAVQQDPAQLIAELTRGISPSNPYRDPKADERTTIRQAARAIADQDANGNRDRLFSDLGFVVHRGTDPATGRAFDMYIATGTDKRTWGAVLIDTTRKPGIVLEVPHTGFDLNTEKLGLALHREVDSSVLLVAGAHRQAAGGLGDVAHNDKSLFHLFATELAGKGLEQLQLHGYADKNLPDSEAVVSTGKARVGPLAREVADALADAGVDICRAWKRRCGELEGKTNAQGRVASLEGDQFVHVEMSYSIRRDPGSWDRLVPDLAARINEG

SEQ ID NO: 10964 - protein, 347 aa, Actinoplanes utahensis
MNYQTYTRSQATLVTLAILLVLVGGGSVAYAAARSTMPEAVEISLGSEDQGSVAAGLGYRVRRGVDPARTEFLDATGKVMATMTDTSRTVHLNGPERTFAEARFTKAKLVTEYWVRLAPKPWHKGAETEKWFVDWFTKARTDRSPDVLALAFEYTYTAKPKKDATGRQYSGDAAFGPLSDIDPDGRAENSDFYDYLGVPWTFPDKKEKPSASHIRSLDCSGFLRMVYGYRLGYPLRGTNNPGPGLPRQAAGLAAVGPGTLLMPNTGKRAVNLDRLLPGDMVFFNAGPIKGTHIEHSGMFLGVDDRGHYRFISSRTKANGPTMGDAGGESILDGTGHWAELWRTARRI

SEQ ID NO: 10965 - protein, 161 aa, Actinoplanes utahensis
MTFGGELSAQLSTACLGIGLVFALLCYLTTNLSPGGMITPGWIALALIEDKMHAAVIVGMTVVTYTLTKVLQRMVILYGKRLFAAIVLLSVFLQLTLFVLVQQDLPLLFAHQTLGFVAPGLITYQLVRQPPKATLLATGLVTAMTYGVAFSGIVAGLVPTT

SEQ ID NO: 10966 - protein, 424 aa, Actinoplanes utahensis
MLYLYAVFSVCCLALLAAGVIEQRNHYRNLKLMPSRVLVNGIRGKSSITRLCAGALRGGNKVVVAKTTGTAARFIFPDASEEPVHRKFGIANVVEQIGIVRRAAVYHPDALVIECMAVMPALQEINQSKLIQSNIGVLCNVREDHLAEMGPTLDDVARSLSRSMPEGGVCITAEKDRLAILQEEADKRKCRLIAVDPESVTDREMAGFGWITFKENVAIALAVAAQLGVDRQSALAGMWAAPPDPGVLSVARVLYRDKRVRFANIFAANDPESTFMNIAQLEKQGLISRPLTMVINCRPDRVERNGQMGALAERVQPQHIVLIGEMTRSAKVAVPAGLQDRVTDLGKMPGDRMLAELMAVVGPDASIVAVGNIHGQGEVLLHELAALPSWEPQGSGRSDSMLRVSTTPGFDVLAETVFLERTHR

SEQ ID NO: 10967 - protein, 733 aa, Actinoplanes utahensis
MSSRSAQTVTSRAAELAQEQEELLAWRRRALTQQLPAAAFPAGTSAPSLAYLWASFFVVVAAVLGLTVNAHTGALPAIADSQRDIAIKLANGFEAEIHQETTVLDRILQSRGSLSQADLLVRAIADGNRVTGAAIVDMTTRKSVVAKGDAVPLDALPNPLPSGHPVAVTTADGPMLVYSAALDGTQSLLAVQPIFMRTLRLNPDAKHGIHLLTGDGKSSLLQGAHAIDVAHQAKVFDGLYGITSSKVREVIVDEWPDTRLIAAAAPVGRTGLVVVSLLTAPVAKGTTVTKGLLIGASLLAVALLSFLIMRKSLVRPVRELLNQAKEDASGATTRERRPLGVREAHRIAKALATTVGAEFPEGRRWRPSVTQGLALAAVIALLWPAAAVAMVWRSPDPQLPAQLVRDGETRAESAGFTLGHFLDDGLATVSRTSRLVKTDDLAATGHTLQRALADDDRLRALYLVDEKGEVLSKTGRQPLRTPVPVPGEVGIHLDDAIGRLPVVYAYNELPSGYAVIGEFDPDRLLGQIGRVKGRVRVVDSELRTLLDSRGYVAYQPLTGRLAREVAVEALPGVTVGRGAAADGHPELAAAVGMVEPASVAHLEWAVVVEQDVSGVRLPEMVEHRWLLLVAAVVVGIVLVTHMWQFYIFVVPLRRLAFFADKMSSGDLDHPVPPQRHDDIGAVAICLEICRQVRHTGSARFGGALRLRGEGPDRTTVLSLADRAVRSHSRSSKG

SEQ ID NO: 10968 - protein, 400 aa, Actinoplanes utahensis
MASNPQSTSPLKAVLSCLTAVAVSAGALYAFGPWSADTPDLASAARPLDPPVSVPGRTVSVLAAGDILAHPELWDQARRDGNGTMDFAPMMASAKETVSGADLALCHMETAVAPPGGPYIGFPKFSVPREVVQGIKSLGYDGCSTASNHSIDQGFEGVQRTLDALDAAGLGHTGSYRTAADAAKPKIYTAKGVKIAHLSYTKDFNGLKPPAGKAWVANQINVTKIRKDAAAARKAGAQIVIVSMHWGTEYEHEPDVDQQTWARAIAQIKDVDIVFGHHAHVVQPVEKIGNTWIIYGMGNQIARHAEPINSNRDGAMMKVTFGPSSVPGRWKVMALEAIPTFVDLNPNIRLVDLPRELAKPDLSAPQRKIYEAAVDRIDGNLLTHGASAAGLIVHGTGKSS

SEQ ID NO: 10969 - protein, 359 aa, Actinoplanes utahensis
MGSVRVAIVGVGNCASSLVQGVEYYKNADPNDRVPGLMHVTFGDYHVSDVKFVAAFDVDAKKVGMDLSEAIVASENNTIKLTDVPPTGVTVQRGPTFDGLGTYYREIIEESEAEPVDVVQVLRDAEVDVLVSYLPVGSEQADKFYAQAAIDAGVAFVNALPVFIASDPEWAQKFADAGVPIVGDDIKSQVGATIVHRALAKLFEDRGVELLRTYQLNFGGNMDFMNMLERNRLVSKKISKTQSVTSQIPHEMIKSDVHIGPSDHVPWLDDRKWAYIRLEGRSFGDTPLNAELKLEVWDSPNSAGVIIDAVRAAKIAKDRGIGGPILSASSYFMKSPPVQYSDHDAHNAVEAFIKGETER

SEQ ID NO: 10970 - protein, 217 aa, Actinoplanes utahensis
MLELAILGLLQEAPMHGYELRKELATKLGTLRAAISYGTLYPTLKRLKLAGWISEAVANNNEIVPPMTSKRGRVVYKITADGKERFSELLATAGPETYDDAGFGVHFAFFSRTDRATRLRILEGRRRRVEERREGLREILARAADRLDAYTLELQRHGLDACEREVRWLEELITNERSGRTPAFRQRAGLAGAYPDSAAHPAAESPSEPPRPHLDRP

SEQ ID NO: 10971 - protein, 144 aa, Actinoplanes utahensis
MRTQRQVVDYSLQRRAVLRDVRNGRISPLEVCDASPYLKNAATFHGEPTDERCPICRRENLTLVHYVYGDELKQSAGQAHKAAELPVLAMTLRECQVFVVEVCRSCSWNHLIERYVLGRDALDADEPPMQWKTGSVSHVGEGRR

SEQ ID NO: 10972 - protein, 909 aa, Actinoplanes utahensis
MNPYGEPQNPRARARVPGPSAASGPDEQDRPAPDAYRRSAGSAAVGGRASVGAASVGAASVGAASVGSAAVGGRASVGSASVGAASVGSAAVGGRASVGSASIGGRASVPPPPPPGGGGSGGSGGGDGGGGKRPRTKADKKYRRANILTAAAAVLVIMIGAGIVGGTYFFDDVELPVPKPEAQMNLIYNATGGLLAQEGDPRVNVPYQDISDNMAHAVAAAEDKNFYTHNGIDLKGIARAAWNNFTGGDKQGASTITQQYARHVADLKAISYSRKLREAVIARKLESKYNKAQIMGLYLNYIDLGEGRLGAEAAARGYFNATIKKGGDGKLKEITPYQAAVIASIIKQPYPNSVHKGYDPLVNEPASRDRWEYTMKNMLDMHWINQQQYDQRQYPKAQAKTPACKTCADGKPVGMIMRHVTYELHQLGITDDIIRKGGLSITTTIDPDIQAAAEAAGSRNSATSPLHTRPSTYQSAVIGIDPTDGEVLGYYAGDDPEGIDYGGYMAGDGSGVMESGGQSPASSFKIYTLSAALKANYSFNTLWDGNKERVGGGKISNAGQDGGKTCNDNGHSVSSCDLEQATVKSYNFPFYWIADQLHPDKVVAAAKAAGIHYIWNNDGKRIDLDHTDASTWDKYFSDEIGFGQFRVLPLDHASGVATIVAQGVRHQTHFIKAIKSVDPTSGKQTNLKTIPKDGTRVFDAAQMSDLTAVLKRIPGHANHTLAGGREAVGKSGSWELNQKESTKNGDAWFVGGIPQLAATVWVGGKKNRVPLVNGNGGKMFGANEPAAIWKKFIDAVAEKKNWEKKDFPPRQPGGDDSLGNGKPLPVQQPTQDNSQVCGALSFLCGGNNNGGGNNNGGGNNNGGGNNGGGNNNGGGNNGGGNTGGGPGTGPGGTGTGTTNNDGTTTNNGG

SEQ ID NO: 10973 - protein, 505 aa, Actinoplanes utahensis
MSAQPSTDRPDVPSATSDGFVRGLSQIIGGPLGSHATRPDARPHRFWTAPRFVLALTCLILALSWVQKSPCMSGDWQKNMQYTRFCYTDVLALYYAEGLSDGQVPYVGHEVEYPVVTGYFMGAIGLPVHWYGTTQNTKINQGSWFYNINALILSILAVATAAVLLALRRRRPWDAAIFALSPILLVTATVNWDFLAIGFAAVGLYLWVRRQPAWAGILLGLGAAAKLWPLFLLGPLLVLAMRSGRIRAFVEAALGTVAAWAVVNFPVWYWHHEAWLKFFRLNSERPVDWGTLWYVGRYLDGKWKSGAAGDQGPFQWLSDHVPTLNWVTYALFGLACLALVAVGLLAPKPPRLAQMAFLVVAFFLLTSKVWSQQYVLWLLPLVVLARPKWGAILAWTVAEIGYFAAFYAELIGAGGKPVIPEGTFVLASALRLITVAVLCGLVIREIWRPELDVVRQTYGGADPDAGELDGPDAPWIERMRLGFGLIKPTGPVELVPPDDPVVMKA

SEQ ID NO: 10974 - protein, 1159 aa, Actinoplanes utahensis
MTEQPQPLSTTSADDGAETPGSGKPRRKRLFGIFGSKRADEKGVTPSPPAQPASAPEGKPAPAPLPIASEPATSGGAEAIKDVDAAGDGKAVGAAVPAAAEASDPKSADAPAPDGPASGQTEKRASSADVADEAGAEIAGKDGDGKTDEKRAGSADSTDHKHSGGTQEADGTAAKSAAATPQGTRKRKELPETRPPGVPQDPWRAFAAIPEKPPGRIRRGLRATGRWFIHEYRLAIYACSLLAVGLTWPTLRYPLHTLPHDLGDPSRQAWQVAWLGHVLRTNPVKIWQSNAYFPTGDSFAYGDSLLGYAPAGLLGAGPESAVLRYNILFVLAHALLLFGAYALVRQLGARPTGAAVGAAAFAYAPWRLAQEGHLDIVSAGAIPLALALLARGHGWSIRYGFRPGKRHAGWAALGWLVAVWQLSLGFSLGLPFAFVLAAVVLFMLVAVPIRRLVQRRRRKKAAALAAATATAAGESGVDTGKPAVSGAEAAVSKTAADGKDPSGAQDSAGTKDSAGAKDSAGTKHSAGAKDSAGSKDSAGAKDSAGVEDPAGVKDSAGGEHALPGSEAAGGENPATAKGPAKATDMPAADEKSETGEDPVEGGEVPAAPGFAADDKKGAVASEGVTLAKTGVKADAVDREQPGAEDTAAGGRVKVASADEIKADGGDKAGSDAKADDAGRTDDAGKGSVGEKAAGSTTAGESGKAPGVENPAETEKAPEAKQPAGAEKAAGAATGAEAGNAAEAGAEGKKDTGAEAGGARKTAEDGKDAEAGKNAEAGKNAEAGTKDAGAGKDAGAGTKDVGKRRGRRAGAGGRRRRRGARHRKENARPSHAVLGWRLLLADFLGVLLFAGMGVVLAIPYLRVPDVPERWKQIGLLSPPVRSLLIGPAESRIWGTAHATPRGSLGAAAEMSLLPGFMLYALALAGLIFSIWRWRQRLFLILGLAVAMILTLGTTFFAGRWTYLPLFGHLPASFDLLVPGRLMIWVTLVLAILAAGAVDEFVRRIDHFAAQRTPPWPSPWLRLATLVPLLLVILEGWNATAHPVAPAQPAAMRTVGGPLLVLPTAEVTDQTVQLWTTSRYQQVANGGGRVAAVRQAEMRGKVASFPDLTSIEYLRSNKISTVLLIRSEVAGTPWEQAGDLPVDSLGIRREDLPDAVVFHLD

SEQ ID NO: 10975 - protein, 257 aa, Actinoplanes utahensis
MRIGAHVDSADPLAEAAARGAEAVQFFLSDPQSYKNPAPRADVEQLRASEVDIYIHAPYRLNVASPNNRIRIPSRKLLMTHARAAAEIGAKGLIVHGGHVEGGDLTVGFDNWRKAFEYAEKDGGLPLPILIENTAGGDNACARRFDDLARLWDAVGSFGAGFCLDTCHAFAGGEDLTGIVDRVKAITGRIDLIHANDSKGGFDSGQDRHDNLGSGKIDPELVVAAIRASGATAIVETPGGVAGQSADIALLRERSGS

SEQ ID NO: 10976 - protein, 321 aa, Actinoplanes utahensis
MSRQFRYRMAALVASGLIFGVPLLTNGTANADQLEPGARRVTFDGGMLGLSCGSKPSVERLRVPAESTLHVVNRTGHNARLELAGAPRGVIPENGAAEVVFRRGTTPVVLDPDCAGSDDPVPMLVTAVPSTPSALPDPAPGGSNAGTLPAIVAGSAGQSVAGSALPDDDATGSRPPHQVAGPRGVRDPDRRRTAKVHAAGETPRQDTDQKVKNDGSRTSVAGGPTFAGMPPGERKTVLPADRAAVVTASPAGTAPAAESPAAAEPPILTEPAAEPVAAIRPMRTTHPIGLLGLTAIVCVLGVLTAAIRAIVSQRASRSNLA

SEQ ID NO: 10977 - protein, 96 aa, Actinoplanes utahensis
MRHYELMVILDPSLEERTVAPSLDQYLNVIRTAGGSVEKLDVWGRRRLSFEINKKAEGIYAVVDLQATPEAVAELDRQLRLNESILRTKVIRPETR

SEQ ID NO: 10978 - protein, 190 aa, Actinoplanes utahensis
MAGETVITVVGNLVNDPELRFTQSGAAVCSFRIASTPRTLDRQSGDWKDGEPLFLSCSVWRDAAEHVSESLQRGARVIVQGRLRQRSYDTKEGEKRTVIELEVDEIGPSLRYATAKVQKASRSGGGGGGFGASGGGGGGNRQFSGGNNSGGGGGRGNSNDYDDPWATAAPASSGGRSGGGNSSFDDEPPF

SEQ ID NO: 10979 - protein, 79 aa, Actinoplanes utahensis
MAKAAALRKPKKKVNPLDKDGITYIDYKDTALLRKFISDRGKIRARRVTGVTSQQQRQIARAVKNAREMALLPYTATAR

SEQ ID NO: 10980 - protein, 149 aa, Actinoplanes utahensis
MKIILTQEVSGLGTPGDIVEVKNGYGRNYLLPQGFAIQWTKGAEKQVAVIKRAREAREIRDLGQANEVKGQLAGLKVTLSARTGNGGRLFGSITPAEIVDAVKTAGGPSLDRRRLELPGHIKTTGSYNVQVKLHPEVTATFPVNVVAAK

SEQ ID NO: 10981 - protein, 572 aa, Actinoplanes utahensis
MPVEPSYGMRELPAAPERRDDDTSWRSNGYGEPTRDRAPSGEPRDPRKPAYGAQRELPSGPTPWPGTDDYQDEPGRYADPRRRDDRDDPPYGGTGGRGQNDRRPSAWNGSEPSSWDGSGGYRRDVSPGTPGYRTGPDTGGGGYRPAGPGGDWRADLNGGAGHDGGAAVTTGPAGGTSLTAAPVSGTAGYRAAATPPAASVPGPAGDWRAELNGAAPTSSVPGAGSAPVADWRAQMNGSTAAPTSSAAGYRASAAAGTDWRADMGAAPTVGATAPVSGATGYRPPGTPAPAADDWRREMARESAPADGDPQRFSTSDFPPFRPSGSAAVEGAANLALSATSVIAVPPASPAEAPLTADTPWPPRRQPGTAAAEEDTSWPPRRQAGTAAVEEDTSWPPRRQPGTAAVEEDTSWPPRRQAGTAAVEEDTSWPPRRQVSGALFENTGSYERRPVSSGVLSSRQNDLLNPDDEDEPETSSSPLAAVGYTVVWYGVPVVLFIAGMLLLNSGQRAHALQTLANAAPEFGISLTLSIIVAFGLRFATSSWKSASVGLAAAVVGGGLATVLSSAITGNSLS

SEQ ID NO: 10982 - protein, 455 aa, Actinoplanes utahensis
MSRERRAADPWLTREREAEIDDAEPRWSALTDTGSMTPSPEALTWQRRADAWAQQSEIEPYSGGGGQAVEPANRWSDVAATGRPTFPADGTGWRTQTSEWRATGARWRQTTEWRSSTGSHVWRSTTEAWQPGDDDEQQQPTISGTAWPTPEDNTRDVSSSWSATKPVEQTWSSSGTPSWQQPATSWDSGRRTPGENTTDVAGWDRSGGSGWQSGPRDDGRHYVREDDRAAWRQADTEWSTRRGRRRAPEPDEQPSGGSGWSSGDETDNWAGHADTGNISYAPTSAPSFGSRSVRRGPQPPPPDDAAAAQRGQTPIQFGVRPGSRRAAPDEGPSGPIDTGAASAGQPERQRGQSRRGRGPQRYNANPTNWREDTASWDAEPDTSNWTRDPDTGQWSRAEDDPRVLAWRAEAARRDQMRQGDADEQPGRGEQPTPDGAVGWGGRRGQWDDEPSGLAS

SEQ ID NO: 10983 - protein, 477 aa, Actinoplanes utahensis
MSITDDARPDPRPPSQPSGGPQSGGSGRSDAPTGGSFDKAPPQDVAAEQGVLGGMLLSKDAIADVVEILKTGDFYRPIHATVFDVILDLYGRGEPADALTVAAALADSGDLQRVGGVPYLHTLIESVPTAANASYYARIVADRAILRRLVEAGTKIVQLGYGAGGNGGRDVDDIVDRAQQAIYDVTEKRVSEDFAALGDMLQPTLDEIEAVGASGGVMQGVPTGFQDLDRLLNGLHPGQLIIVAGRPGLGKSTASMDFARNAAIRHGCASAIFSLEMSKIEMVMRLLSAEARVPLHTLRSGQLSDDDWTKLARCMGEISEAPIFVDDTPNMNLMEIRAKARRLKQRHNLKLLVIDYLQLMSSPKKTESRQQEVSELSRGLKLLAKEVECPVIGVSQLNRGPEQRTDKRPQLSDLRESGSIEQDADVVILLHRDDYYDKESPRAGEADFIVAKHRNGPTDTITVAAQLHLSRFVDMAI

SEQ ID NO: 10984 - protein, 113 aa, Actinoplanes utahensis
MTETTDRAADQALRNDLANVYGRYEELRSGVDELQRSLATMQVSATSPDGLVRATVNADGDLVDLRLDQQACREWNVETLARVIVETVQHASAGKHRQVEQLVTTHRPPDETA

SEQ ID NO: 10985 - protein, 48 aa, Actinoplanes utahensis
MHHAPAAHYPPPVIHQPVVHYGHHGHYRHHGYHGHYHHRRSFLHDLFD

SEQ ID NO: 10986 - protein, 493 aa, Actinoplanes utahensis
MTKRADGLTADLGLYLISAAFALVTGLTSTLSPHRGWGLTAFWGYLAATLMVAGQLLTGRPVSDRFRTWQAWLTWAAVALVPLVVEAVQRAGGRTDRAQDEVLVVEAMGRSLLDHGTPYLSRAGIAALPVDERLLGYRPYQPGMAVFGLPRAIAGDHWWTDARVWFAITAILAVGSAVAVLRAAHPFPVRGLQAATVLPVTALTLATGGDDIPVLALCLLALALAATDRFGWAGIAVGAAAGAKLFAFPVVAVLAVLALVSGRGRRLLPGAVGLPLLALVPPLLVNADSLVENVLRFPLGHGLVTSPAQSPFPGYLVAQHLPAGHVLAAGLLGGAVLVIGWLLLRRPPRDAGAAAAYCGWGLLAAILLMPTTRFGYLLYPAAFLVWAHTLRPGDATADRGAATANAGATTADPGAATATTAHPGSTTADPGATTATTAHPGSTTADPGATTATTAHPGATAATTAADPGATADAGVAAADPVQETHRSFRPMA

SEQ ID NO: 10987 - protein, 839 aa, Actinoplanes utahensis
MSETGTNDDATDQRLQLLVGLVVMLAAGVGAIWAVYAYHAPQPRPPLFVLALLLAAVVTTNKLRVFVRIRSNFFGTAWDEVPVLVGLTLIPPVWLLLCAAAGHAILRIAVRAGLRKTAFAVAKETLAVSAAAAAFLALGIRPDLTAPALPILAITAGLLAYAFVDDLVFAPIVATNSHIGILQAARQNLLGKVISHLGQFVACLLVLWVLATDANVMLLLVVPLVVACMHLWQSRTTRTRQERESWQRLAKATDELNAVDLTQVLHSATTRAAQIFSAAEAAIDLTAGGADRTVRATGAHVLTDSPRTAGPTLPDETTVDLVAHDGGLRVGVLRLRFGGTVRLTEVEQYKLRTFASAVCTAIRNAQAYAELARIAAENAHAATHDPLTGLPNRRQLYEQAGHLFADGGHDGLAALLLIDLNHFKEVNDTLGHAAGDDVLREVARRLSGAAEPGDLVARLGGDEFAVLLTALPTPALASHRAAAMLGALEPGIEVEGMMITVEAAGGIALAAGAGGVEELMRRADIAMYQAKRAGEPTTIYAHARDTADVERLMLTGELRRAVSEHEFTVDFQPIVDLGSGEVVSAEALARWRHPDQGDLSPGRFLEAVERSGQLPAFADAVLEESLLAMQAWRAAGFDLPVAVNVSPRSLLDPHFPATVLARLERHDVPPGQLVLELTETLTLSQIDVVERTLAELRDAGVRLAVDDFGTGVSSLSVLSRIPVHQLKIDRGFVAAVETSAEAAAVIRTTVDLARNLQLTVVAEGVESEPQRRALWELGCLAGQGHLFARPLSSARFLSTLRRGSGGRPGVLATALHEVGAVVRMPARRVAGSSLPHLPA

SEQ ID NO: 10988 - protein, 163 aa, Actinoplanes utahensis
MPQESHLTHVDESGAARMVDVSGKTVSDRRAVAAGAVHTTAEVIDLLRGDNLPKGDALAVARLAGIMGAKKTPDLIPLCHPIGLHGVKVQLELGADVVHITAVTKTADRTGVEMEALTAVATAGLAMIDMIKAVDPAASLDAVRVLRKEGGKTGDWVRPENRP

SEQ ID NO: 10989 - protein, 157 aa, Actinoplanes utahensis
MTIRARVIVASNRAAAGVYADTSGPRLVTGLRELGCEVGEPVVVPDGEPVAEALRAAVADRIDVVLTSGGTGVTPTDRTPEATRGLLDFEIPGIAEAIRAYSRDRVPAAALSRGLAGVAGRTLIVNLPGSTGGAKDGLAVLGPLLAHTVDQIRGGDH

SEQ ID NO: 10990 - protein, 405 aa, Actinoplanes utahensis
MSTPAIGWDRARELAHQAGLTAATGVERIPLADGDGRTLAEPLRALTALPAFATSSIDGWAVRGDGPWRRAGQVLAGGTPPPLTEDGTCVEIATGAMVPAGAAALIRVEESEIGADGTVTGTPRPSPEWRLPGEEAALGEELLPAGTPVDPAVIGVAATCGHELLAVRRQPRAALLVFGDELLTSGRPGDGRVRDSLGPQVPSWLRRCGATVTSVSGPVKDTLDAHVEAVRAALDTADLICTTGGTMHGPVDHLHPALTELGAEYVVNTVGVRPGFPMLLARIPGPDGRPRFLAGLPGNPQSAVIALISLVAPLLTGLAGRPFRADLPLVTAARPIPGRGRDTHLALATLDHTGRIATPAGHVGSAMLRGLATAHGFAVIRPGVRVEAGDDVPFLPLPLLPGERP

SEQ ID NO: 10991 - protein, 163 aa, Actinoplanes utahensis
MTSPAAATPETGPDVEPVDTAERRSRVVLAEVLDTPLDLAAHEAAVTDRRAGAVVSFQGVVRDHDHGRGVTLLEYEGHPSAPAVLREVAEEIAADPAVYAIAVSHRIGPLEIGDVALVASVSTAHRAAAFAACARLVDEVKARLPIWKRQLFTDGAEEWVNCP

SEQ ID NO: 10992 - protein, 431 aa, Actinoplanes utahensis
MPVTQRRAPRATRTRSALVTVGALGTLALISLTLSRYGLSTLAVTHAAVRDWLGGGGLYTYRQPGTQAGAALPPGLAIILAPLALLPLKAAGWLLALTSVAALLLSAVVLTTPIARRHRRRRTPIALTAAALALLTEPVRATLGEGRPELLLFGLIVADLVALRRQLHWPTPADRHPPDHLPERLRQGWTEGSWAGVGTGLAAAFSVTPLFFLAGLLVLRQRRAAVTALATTITVTLAGLLFAPRETVTWFGDTLWELNRTEPLNASDNQALAGMLARIYGYPAPPVLVWLSFGAMLLAVGLIRARTANLAGDEVAAFTLIGLTAAGFGPMTTPAEMLWLLPAVLVMADRVVGRRMAGGTGCGRAGRAVLGGLTVGGYALLIATPGVLLRWDGYAVALFVLVGMLPWRPGPMWDRPGPGRRAAAIPGPRGG

SEQ ID NO: 10993 - protein, 192 aa, Actinoplanes utahensis
MKPVRTAARAMLASIFVISGVRVLIKPGEGRIQAARRVTDRFTPLLEKADPRLPTDPATLVRLKAGTDVLAGLALATGRLTRPAAAVLAAGLLPTTYAGHPFWAAPPEQRAEQQVHFLKNLGLLGGLLLAAADTEGEPGLRYRTTHAVDRGQRTLTHAVDRSRREVRRAVRTAKREAKIAALSAGAARKLPG

SEQ ID NO: 10994 - protein, 401 aa, Actinoplanes utahensis
MDPVRNPYAPGAGQRPPELAGRGRELDAFDVVLERVARGRPERSLVLTGLRGVGKTVLLNTLRSAAIGRLWGTGKIEARPDQSLRRPVSGALHMAIRELAPHHRDPDRVDEVLGVLKAFALRANDSTGKLRDRWAPGIDVPPARGRADSGDIEIDLVELFTDAASLATDVGTGIALFIDEMQDLSGTDVSALCAACHELSQLGAPLIVVGAGLPHLPAVLSAAKSYSERLFRYQRIDRLDRDAADLALGVPAEREGVDYDQEALDLLYEKSGGYPYFVQAYGKATWDHAPQSPITAGDVQMAAPEAESELAVGFFGSRFERATPAEREYMRAMAVLSGDPGNDMDAAVPTSDIATSLGRKPASLSPARDALIKKGLIYSGERGTVAFTVPHFGRYLRTQPV

SEQ ID NO: 10995 - protein, 207 aa, Actinoplanes utahensis
MSHNGPYSGPPWSGGRPEEPYAEPSDPWGESSRAVNDPAWGSPQIPHQQFSGSPAASAPGPAAGRSGPSRRGFAVGALIAVLSVLVGGGLATTVWYVLGRKDRAGTAASTPPAGVTVPRVQPSADARFANRGQCIRNEGTNAEPQLRIVACAANTYEVLKRVDGRTTGEKDAIAKCAKVPGYTKWYYYDTEYDDVDFVLCLREYQPE

SEQ ID NO: 10996 - protein, 168 aa, Actinoplanes utahensis
MTRQFYGVLSGFLVSALLAARCGPVPQLAVLLPAAAIGVRLALTDLRTLRLPDPLVVALALVTGLPLAVLAPGRILPALASAVLVGLTYLVLALLPGRGLGLGDVKLGAVLALLLGLFGGWPAVLTGFAVAHLVGGLTAAYLMITGRGRVFPFGPALLLGALAAITAA

SEQ ID NO: 10997 - protein, 1041 aa, Actinoplanes utahensis
MRDVEVSPDTYVADLHIHSRYSRACSRDLTLPNLAWWARRKGIALLGTGDFTHPAWFEHLRESLEPAESGLFRLGDEQPVTRRLPGSLQGTAPARFMLSVEISTIYKRDDRTRKVHHLLYAPDFESAGRINTALGRIGNLTADGRPILGLDSRDLLEITLEAGGYLIPAHIWTPWFSALGSKSGFDAIADCYADLADHITAVETGLSSDPAMNWRVSSLDRYRLVSNSDAHSPGALAREATLFTGAPDYFAVRDGIGLAGTLEFFPEEGKYHADGHRACNVNWEPERTRAAGGLCPECGRPLTVGVLSRVEDLADRPEGFTRDVHVEHLIQLHEILGEIHGVGPKSKTVESQLTHLVATLGAELDILRKVPVDEIGKAGGDELREAITRLRRGDVRRVAGYDGEYGVITLFEPGELRNRSSAPQVETLFDMFPEPKAPARPAAEKPKPKAKPVKAKPAPPPIAPPPSPHEPFEPMLAGMEEVGTGLLDRLDAMQRVAASAPGGPLLIVAGPGTGKTRTLTHRIAYLCAELGVFPERCLAITFTRRAAAELRERLESLLGDVAEDITVGTFHSLGLTILKENAKAAGLTAGWRIAEEPEQKQAREQAGDDESAYRKLLRQQDLVDLDDLISVPVALLREDPALVERYRKRWQWIFVDEYQDVDELQYELLRLLSPADGNLCAIGDPDQAIYSFRGADVRYFLRFNQDFVDARLVRLTRNYRSSAPILAAAVQAIAPSSLVSGRRLDPARLDPEAQLVGRYPARSVSDEADFVVRTIDELVGGLSHRSLDSGRVDSRAATAGALSFSDVAVLYRTDAQSGPILEALSRAGIPVQKRSHNRLRDRPGVEVIARELRHAGGLSGPLAARVRQAAQGLAQRYAAPTLDGGQIAPEDIWSAADLLTPLAQRAGDDLPLFLQQLETGAEVDALDPRAEAVNLLTLHAAKGLEFPVVFLVGCEDGLLPLRWPGATPTDEEIAEERRLFFVGLTRAQDRLYVSHSAKRSRHGSEREQQPTPFLDVIDSGLFERLGEAAPAKPKDRQLRLL

SEQ ID NO: 10998 - protein, 438 aa, Actinoplanes utahensis
MVAFVAVIILLLFALICAYVWKRLVRDTLRSRWGRRVGTVVALVLALLVPATLIGVRAGHVKWLAWPGYLWIAVLFYLVITLAVLEIPRLVLRVLWADRGRTAASAAGPLVRGGVADGELQPAGAVPAEGSAGVTGSGAADPSGAPGAPLPTAAGEAPADGGPPAGIDRRLVLARGAAIFAGLTAAGVTGYGVREATGAPRIDRVRIPIAKLPRSMDGTRLAVVSDIHLGPLTGIGHTERITRVINAVNADVVCVVGDLVDGTVAELGRLAEPLRGIESRRGAYFVTGNHEYYSGFRPWIDEVAELGMRPLRNERVAIDGLDLAGVNDLGGEDYGDPADFGRALGDRDVSRPVVLMAHQPLAARQAAPYGVDLQVSGHTHGGQMAPFNFVVKLQQPVVSGFGQVDGVPVYVTNGAGFWGPPVRVGAPPQVTVVELRVA

SEQ ID NO: 10999 - protein, 80 aa, Actinoplanes utahensis
MVTVRYFAGARAAAGGVSAEEVAAGSLDELSRLLTDRHGERLGLVLTAASFLVDGLTRHDRRAPLQAGATVDILPPFAGG

SEQ ID NO: 11000 - protein, 346 aa, Actinoplanes utahensis
MENSRTGPVAAVIALADRFGRVATDLRVSLTDRCNLRCTYCMPAEGLAWMPQPEQLTDDEVIRLVRIAVERLGVTGVRFTGGEPLIRRGLVGIVAATAGLRPRPRMSVTTNGIGLERLAGPLREAGLDRVNVSLDTLDPARFRSLTRRDRHADVLRGLRAAAEAGLTPVKINTVLMRGVNDDEAAPLLRFALEHGYQLRFIEQMPLDAQHQWDRHTMVTADEILAALKPFDLCPDVVSRGTAPAETWLVPGFVDAAGAPARVGVIGSVTRPFCGDCDRTRLTADGQVRNCLFATEESDLRKLLRDGAPDVEIAESWRVAMSGKRAGHGIDDPAFLQPARPMSAIGG

SEQ ID NO: 11001 - protein, 297 aa, Actinoplanes utahensis
MGCPSPEAQDNRVDMAYLRAHPEHLPTFLTHQRIRETPIHRGVTSTSRLTLDDGTSLFAKTATSCAAEAAGLRWLRAAGATPVPEIVVALPGMIAMEWIEPGAAGRAAAETFGRGLAALHRSGAETFGAPWPGWIGPLPLDNTPSAGPWSSWFADTRLLPYLRASVDRGALSGADAALVEEIIKTIAAYAVEEPPARIHGDLWPGNLLWGADGRAWLVDPAAHGGHRETDLATMSLFGGVAHADVILGAYRAEWPLADGWERRIPLHQLHLLLVHTAAFGAGYRDAVVAAARAVLRG

SEQ ID NO: 11002 - protein, 167 aa, Actinoplanes utahensis
MAPVVVRSYRPSDHSAGRRLWAELTRQQHQMYGESDDDGGAGFEEYLTRLDLSGLWVADHADDGVIGMVGLIMRNRAGEVEPVVVTITHRHKGVGRRLLQHVAGEAKKRNMTSLTISPSSRNVEAIRSLHAAGYDVVSSIELTMDLDRHAHAWQQEGLELQGLPFRN

SEQ ID NO: 11003 - protein, 354 aa, Actinoplanes utahensis
MARAAPGRRATLPRMTPDCRLAIRNPSELIAVVPFLMGYHPSDCVALVGLARDRVDFALCHDLPGPDWTDGDARAAAGSVADAVARQRARTVVVIGYGPPGRVSPAVLSTAQAVQDRGVEVLEMIRVTDGRWWSYTCADPLCCPPEGIRCLPGDSLVAAEATYHGRVALPSRRALTAQVAAVGGAEREAMAAATERARRRFTDLIADDLSADRYGRLIRQQGEAAVRAAEKRYRAGSRLDPDETAWLGVLLVNRKVEDLALDRVTGQGWQIQLWTDVLRRAEPAYVAPPACLLAFSAWRAGHGSLARVAVDRALAEEPEHQLAGLLHNVLGHGLAPHMVVLPPRGAGPWRPFRR

SEQ ID NO: 11004 - protein, 290 aa, Actinoplanes utahensis
MTTRSDSVGRKLRLMGRNSARRPVVRIDLGAAPGDRRQRPDELAAEEPLEIRVRRQPLAVTMRTPGHDIDLTMGFLLSEGMIGAAEDVVTAQLCAGTDTPNTYNVVDVVLAAHVPPPVTDLSRNFYTTSSCGVCGKASIDAVRTRSRFDVAADPLRVPAATLVELPGRLRAAQRTFDRTGGLHAAGLFTAAGELLVLREDVGRHNAVDKVLGWALRDGRLPLAGHVLMVSGRASFELTQKAWMAGLPMLAAVSAPSTLAAELADESGMTLVGFLRGSTMNVYSRAERVTV

SEQ ID NO: 11005 - protein, 224 aa, Actinoplanes utahensis
MRRSLRPTLSERVVTSATRSGYGTHVGGFAAVVLAGGAARRMGGADKPTLAVAGQSMLTRVLAAVHDADPRVVVGRVSADLPVPVHVTREEPPGGGPVAAAAAGLALVPETIAYTALLAADLPFLTGEAIDVLRLTMESAPMEGAVYRDTDGRLQILCGVWRTAALRAAIDRLAERRGGLHGAPVRELVEQLRVAEVSWRRPGPPPWFDCDTDDDLRTAEEWAR

SEQ ID NO: 11006 - protein, 81 aa, Actinoplanes utahensis
MSELDRWVAAASAELGVPREDVAVTTVLDMARDVAHSVVRPGAPVTAYLMGLAVGRGADLTEVAERVTAMALSWTPATEQA

SEQ ID NO: 11007 - protein, 359 aa, Actinoplanes utahensis
MTAEGVAAGDSPEGVLLDEPTTADLRAKVTEAWREFAGALAGVLSRLQPGAQVDLTLDPTASGTGTAVYSVSIRVLPDGVTEALAVGNAALPAEFRMNRAAVADMVALGWSPPGVLAGSGDFFGLRSEQAKATALATIVSRTLRDVYGAPHPAFLVYLVHDDEDEPIDAGPLATARPEAGLDAGLDLRELDDDPLLGDMVADEVVPLDERVRTVIATMSKTTVDQLQVDADGDVGIRAGSAMVFVRVRDNPPLVDVFSPILTEVEPTEQLYVKLSELTNRMPIGRLYCAQDTVWASIPVFGRNFQAVHLMLAVQVMTGLADELDDRLHGEFGGKRFFGEGDKPAAPKASDGEHRTGMYL

SEQ ID NO: 11008 - protein, 146 aa, Actinoplanes utahensis
MQMDAVDQRIIALLVADARASYAEIGAKVSLSAPAVKRRVDRLRAVGVIKGFTAVIEPEALGWTTEAFVELFCTGRTTPAQITVATRRHPEVVGAYTVSGQADALVHLRAADIGHLEQALERLRAEPFVTSTRSMIVLSRLIEMPF

SEQ ID NO: 11009 - protein, 262 aa, Actinoplanes utahensis
MCPPEHFTVEYAINPWMDTAVAVDAARAVKQWESLRSTLIDLGHVVHVLDARPGLPDMVYSANGAFSVDGTVYGARFRYPQRADEASAHRLFYEAAGTWKFIAPEHVNEGEGDFAYLPAAYGGIVLAGYGFRTDPAAHAEAQEVLGRPVISLRLVDPAFYHLDTALAALDDRHVTYYPEAFSPASQQVLAQLFPDAVLADRADAEAFGLNLVSDGRHVILNTDAVGMGRKVRDAGYQPVHVDLSELKRGGGSVKCAVAELRG

SEQ ID NO: 11010 - protein, 182 aa, Actinoplanes utahensis
MGRMTDDSRTTEHKEDGSVIVMGPDGRPMGTIEEDGTMSPEEPGNLIEQPAKVMRIGSMIKQLLEEVRAAPLDEASRGRLREIHQRSIKELEDGLAPELREELERLSLPFEGETPPSEPELRIAQAQLVGWLEGLFHGIQAALVAQQMAARLQLEQMRGGQGRPALPMGGIPGKERPTGQYL

SEQ ID NO: 11011 - protein, 262 aa, Actinoplanes utahensis
MGNYRLIATDIDGTLVDDERRISQVTLDVLAAVPARVVLVTGRPLRWVEELYAQLPAPLPAVCANGAVIHDPHTGEVLWSASLTSEVLVDVVERLRNAAPDLTLAVEMVDGAFRHEPAWPLRWPDPRVRVIAAPEELTSAPAIKLLARSGTADPDDFLELVTKALDGVAEATRSSSSALVEISAAGVTKAAGLAWYCEREGITADEVVAFGDMPNDIPMLTWAGRAVAMGNAHPAVRAVADDVTLANVDDGVAVYLRELYGL

SEQ ID NO: 11012 - protein, 270 aa, Actinoplanes utahensis
MLKPGLPKLIATDLDGTLVRSDDTVSAYTHEVLGRVHDAGIRIVAATGRGPRLTALTRNDIRVADYLVLAQGGWVLDQTEARYLRQARLPGRVLADVLAAMESVAGPLSVMFEALEHDDSPLWGDYDPTWRYPVTVEARTRAECLDGDVIKAFARSFQHHVDELLAIARRVVPTDVATVTQAGLDYVEICPAHVDKGTGLAVVAEAVGVDPADVLVFGDMPNDLPMFGWAGWGRVAVANAHPELLAVADEVTLTNDEDGVAVFLDRLLSR

SEQ ID NO: 11013 - protein, 419 aa, Actinoplanes utahensis
MIDLRLLRDDPDLIRASQRLRGESTELVDDLLRADEERRSATQRFETVRAEQRSIGKEVAKASGDERAALLTRTKELAAAVKAAEAAAGEAEQALKRAHLAVPNVVDGAPPGGEDDFVVLREVGPIPEIAEPKDHLEIGEALAAIDTERGAKVSGSRFYFLTGVGALLQLGMLQLAIQQAVEHGFTPSITPTLVRPESMEGTGFLGAHASEIYRLEADDLYLVGTSEVALAAYHSNEILDLSAGPSRFAGWSTCYRREAGSHGKDVRGILRVHQFDKVEMFSFCRPEDAAEEHQRLLAMEEEMLAKVEIPYRVIDVAAGDLGSSAVRKFDCEAWVPSQGRYREVTSTSNCTTFQARRLNIRYRDENGKPQTAATLNGTLATTRWLIPILENHQQPDGSVRVPKALQPFLGGREILEPSR

SEQ ID NO: 11014 - protein, 234 aa, Actinoplanes utahensis
MSDNPRLIMVHMSEMDTGAVVEFGAPERAGFLRGLGRDHRVAPLVGGLAAVAAFGSLISEWQVTTVDGLAFGSDEVGATKKLPTDLFDLDGVGAAYTVGLLILVVAVLLAVRGPAAGQRYARLAGLGVGGTLLALLAAMFRMLSGQSRLISRFYLIEIDTGHLKVALGRGLWCAVAGVTAAMLALWLSGRATAPAPPVAARAVAAPDDEPLELSITPTAPFAHTLDNRDKPHLR

SEQ ID NO: 11015 - protein, 161 aa, Actinoplanes utahensis
MSLGLSDTPSSPGWVSVLSMPIRSATARWEGNLTEGSGTVKTGKGGLQGSYSFKSRFEEGEGTNPEELIAAAHSGCFSMAFSKGLADAGFTPTSVETVAKVHMDKTDAGFGVSRIDLETVGDVPGIDEATFQKIAEGAKENCPISRLLSPGAPISLTAKLV

SEQ ID NO: 11016 - protein, 120 aa, Actinoplanes utahensis
MVGVPVEMSRERFEELVGEALDEVPPELLALMSNVVFLVEDAPPDGSDDLLGLYEGTALTDRGWDYAGVLPDRITIYRLATLRVCDSEQDVVEEVAVTVVHEIAHHFGIDDDRLHALGWG

SEQ ID NO: 11017 - protein, 315 aa, Actinoplanes utahensis
MPGTPPARFTYLGPEGTFTEAALRTIPAAEHGLRTPARSVPEAIEAVRSGEADAALVPLENSVGGAIPVTLDELVTGAPLMIAREVLLPVEFVLAADTLKPLAGLRTVAAHPQASAQCRRWLLANVPDAVVVDVLSNAAAAISAAAGEYDAALCAPIGVPRNRLTVLAEKVADRAEAVTRFALLTRPAAPPPPTGDDVTSLAVSIRHDQVGALLAVLTELAVRGVNLSRIESRPTGEQLGTYFFFLDCTGHVAEARLGEALQGLRRICAEVRFLGSYARHRLQPEPPVRAPAGLSDTDFADSAAWLRRLRAGEPG

SEQ ID NO: 11018 - protein, 210 aa, Actinoplanes utahensis
MSPHTRFVPLVVGAALLTAACGSPAGSEPAGTPSYTIGPQPSGAGPLPGASVPVPGYTMPNPGYTMPNPGYTMPNPGYPNPGYNPGYHPGYTLPTTTPAEGPLTKSPTPTPAHAAKCGGQPSPADILALIKGKPGIPSKTLQVQDGPFCSGTWSFTTVKLAGSGTDQMEPLMVVATGKAATLALVAAGSDVCNAQVQAAPAGIRVMACGF

SEQ ID NO: 11019 - protein, 116 aa, Actinoplanes utahensis
MCRLSAGSPLPTSLTTGPDDKSVISVTWGLDEISIICPSHRVPDGAEVDTAWRCLRVAELDLAMTGVIASLAVPLAEARVNIVTFSTYDTDYLLVPTVRLTEAVNTLVAAGHRIAG

SEQ ID NO: 11020 - protein, 153 aa, Actinoplanes utahensis
MAHVELSLSGAFVPQARTPAEAEFVGSIERWAGTVAVADEPCLIIDAGGAIVAVSPSCSELLGLGKPGDAIGKLLSTALRLIDFTAGAGPLDEPEAEKIPPLLAVRSERLARGLMRVVPDAGKPPLTVDAIATPLLAGDRVAGSMTFLSPVHY

SEQ ID NO: 11021 - protein, 242 aa, Actinoplanes utahensis
MTVFPTRPALPVPATNRALPPGPTPSPTLDRLTPVEWARRRRAERGARRMEAAGARALTRLDRLGSAWRIVDWPRADLSQSYYEPDPADDRAGFLAIGPGGVYAVTVADHGRSRVLIAGDVVQINGKRPGYVAEARRDARRAAKALSAAVGLNVPVTPVLTFVGSGVISVHGLPKDCLVATDKELDRLLLAGGARISAATASKLSAVAENPATWANAPYRPAGDYRWYSNGQTAADKRPTRR

SEQ ID NO: 11022 - protein, 394 aa, Actinoplanes utahensis
MYVDSEVSQLRTVLLHRPGKELARLTPRNSGSLLFDGIPWVGRAQEEHDAFAGALRSRGVEVLHLDRLLAETLAVPRAREELTAGVLADPRLGDGLRAGVAGYLADQDPERLAEVLIAGLAHEEVKPGGGSLVYEMLERHDFVIDPLPNLLFTRDSSVWVRDRVAVTSLAMPARRRETTLTHAIYRFHPRFAGGDLLYDPGLEHVEGGDVLVLAPQVIAIGVGERTTPAGAERLARRVLLAGLAHTVLVVPIAQERATMHLDTVCTMVDADAVVMYPVVADTLRAWTVTADGEELIVRPPRPFLEAAAEAMGIERLRVIDTGLDPVTAEREQWDDGNNTLAVAPRVCLAYERNIETNAQLERAGIEVIRIRGSELGSGRGGPRCMSCPIERVPI

SEQ ID NO: 11023 - protein, 317 aa, Actinoplanes utahensis
MRFCSFFAALEAPTSPRFRRHRLRWSLVSKRRKSQSEPRTKVRDIFVARPFEGLADEPEWVALRELVPAASAPLTLKPEIIEEYGDRPVTLSTVLPMAWPAMSRRDGQVFIGLQRHLQSGDVSRDLAVAILAALRTAPGDPVSVPALPGEGPRLQDVLADGPLEITMQDGFEYWLDADQLHDATVKASLERANASIYPTERLSAAKAAYWCRIAPDKGHVRWVLGEGEDPALDALARLSAAGELLLRDDTKFAGMFRAHGLLVPVWDIPGEPEAADWEAPLADFAKRYQDTLAITEPLDAAGRRAKQGLIGRQLTLR

SEQ ID NO: 11024 - protein, 397 aa, Actinoplanes utahensis
MPDRPDYPSLTRGQIAVLDRVNAGESGLPVLQRLVRLAQEALGARGAGFAEYSEGRGRIIAGTGVCEPAVGRRVDRPLESAGRTLLVPLDPALDSINDEFARQIEGGDLRHMLGARCESGGAFAGSLHVYFGGADGPPGPEHHAVLELLAGQIGQLYTRGAGLPVHPAAPPAQADRDLWVAVTSHELRTPVTVIKGYADTLTNHWETLGEPGRREAVRVIGNRAGELARLVDRLLSAASDGVAGATPAGPFDLVEALREAVDELPADLRRRLKLAHLPAGLPPAYGDRASIATILTELTTNAEKYSPPDTTVEVCAGADDDTLRFRVSDRGAGIAPEHVERAFERYWQAEGGDRHHHPGAGLGLYLVRRIVEQQHGWVSLRPREGGGTVAEVRLRRA

SEQ ID NO: 11025 - protein, 349 aa, Actinoplanes utahensis
MDGRPRARRPPPADDGGAGPDGRGAQRRRGGGDLPGRRPVRPGRRLSDEQRLGQRAQPRRWHEVLGRRRQGHGQRGRAAGPGGVSTGYRPLVFAHRGGADALPEHTLGAYLRALQDGVDGLECDVRLTRDGHLVCFHDRKLDRTSNGRGLVSRRTLAELDELDYGSWHPGYPADEPDEDLSRLLTLERLLEAVRDCGRAVRLLIETKHPSVYGAEVERRLVKLLRRYGLADPKPDDPVQVTVMSFAALALRRIRAQAPGLPTVYLLEVLPPMVGKGRLPFGARIAGPGVDLVRARSGLPAAMRAAGHQTYVWTVNRPDDLDLVLRHRVDGVISDRPKFVLDRLAELDHV

SEQ ID NO: 11026 - protein, 366 aa, Actinoplanes utahensis
MSATTSSSGNSSGRASVPPPYGREPGPGRPYRGGRTRPRWGRIALVTGATVVLLALVGTIYAFHYVNKIDGDLKRTNAFSGLSKDRPAKPIDGAFNILLVGSDSRDPDTKDDQANAWRADTLMIMHVPADHKTAQLVSIPRDLWVVVPRSNDAACSDGSRAKINASFAFGGLPRAVHTVECLTDVKIDHVMAVDFGGFKEVTDALGGVDLKVDQSITSIHPPHRVFTKGMMHMDGAQALDWVRQRKQFARGDFARMQHQQEFLKALMDKAASGGTLTSPGKLNDFLNAVAAAVTVDQDFSLKDMVEQFHSLRGDNLTFLTSPNKGSETIAGQSVVVSDREKALALFQAMSADRMSEWMTANPVKKS

SEQ ID NO: 11027 - protein, 555 aa, Actinoplanes utahensis
MLMAAAGTSSTSRTLTITLFLIFVAITLAITIWASRQTKTATDFYAGGRQFSGFQNGMAIGGDYMSAASFLGIAGLIALYGYDGFLYSIGFLVAWLVALLLVAEFLRNSGRYTMADVLAFRMRQRPVRTAASVSTVVVSIFYLIAQMVGAGALVSLLLGISADEKFLGMDASTAKVFTIILVGALMIVYVVVGGMKGTTYVQIVKAFMLMTGALVMTLMVLAHYRFNLSTLLGDAAAQSGKGSAFLEPGLRYGVETAGDATKTFYSKMDLLSLGLALVLGTAGLPHILTRFYTVPTARVARKSVLWAIGIIGVFYLFTLALGFGAAALVGGKAITAQDKAGNTAAPQLAQKLGIDYLGGDTGGAVLLAIIAAVAFATILAVVAGLTLASSSSTAHDFYASVIKKGTASERDEVRVARVAALVIGAIAIALSIFAQSLNVAFLVALAFAVAASANLPAVLYSLFWRRFNTSGALWSIYGGLLTAVILVFFSPVVSGSPTAMFPHEDWHWFPLSNPGIISIPLGFFFGWLGTVLSKESAADKYAELEVRSLTGHGAH

SEQ ID NO: 11028 - protein, 125 aa, Actinoplanes utahensis
MPESPLAHEGGDTVPATPERYLEVQNSDEFGRLRHTLRRFIFPTTVAFILWYALYVLLSAYARDFMAIKLVGNVNVALLFGLLQFVSTFVIAWYYARFAARRIDPVADDIHRQIENAPADEGSVL

SEQ ID NO: 11029 - protein, 167 aa, Actinoplanes utahensis
MTIHSTDPFAVPDEEKSAVRRFRGRLAAPVTIWTAPGPAGLTVSSTLVADGDPGRVLGLIDEESDFWAAAERAGRFTVVPLVPADRQLADRFAGLMPAPGGLFATGGWRETAYGPVPAHATAWAQCRLVDSRPCGWAMLVEAVIEAVTFEAPGAPLVHHRGSYRELR

SEQ ID NO: 11030 - protein, 92 aa, Actinoplanes utahensis
MPQVVLRPGDVVHVGAEASVQFSGERALTFRIIRVDPRVTYDGWIWLDGYVVGPAGNALQRRRIFVRQDGLRAIRVNRVPAPRSGSRPVGRP

SEQ ID NO: 11031 - protein, 285 aa, Actinoplanes utahensis
MLAAVGGLLWWWSRTLEQAMAGTATAGRHARVRADGRGPVDRLMFPWWPRNRFTALVARETRYWWRENRRRAGLVALTMAGLVLPLTSALGPGAGLTGGMAFVAGAVAPIALANQFGYDGGAYATNLAAGVPGRLEVHSRAAAHALFTVPLLTLVAVVTGMLSGDPARIPAQLGTLLAVYGTGLAVLLPISVRAAYALPESASPFSISSGGGLGKGLPSLAGMAGGIFGALPVVLAGFLLGPAWIWAGLPIGLGYGAAAYLVGSGMAGDLLDRRMPEVLAAVTPR

SEQ ID NO: 11032 - protein, 242 aa, Actinoplanes utahensis
MAVSPRHFVRLKLRITANGLRGRPTRVVLFVLGSCAASLLAVLGYAVFALPGHLHDAHLAGMLLPFGGAVLLLGWLFLPLLFFGVDESLDPARFALLPLPRRTLVAGLGTAALAGLPALATLAATAGMTDTAARLGGPVAGVAETAGVLGGLLLCVAVSRAVTSAFATALRSRRARDLATILLAVVATSVAPLQLLLLGLLDRADWTDVAGIAEVIGWTPLGAPYTLGLDVATGRAGPGPYR

SEQ ID NO: 11033 - protein, 260 aa, Actinoplanes utahensis
MTTPAAPPDESPVPAMSLRGLIRRFDTKLAVSGVSLDVPAGSFYGLLGPNGAGKTTTLSMAVGLLRPDAGRAHLLGYDVWSAPTEAKALVGVLPDGARMFDRLSGPELLAYQGLLRGMPAAVVDQRARDLLEVLDLGVDNRTLVVDYSAGMKKKIGLACALLHAPRLLVLDEPFEAVDPVAAALIRDILQRYVAGGGTVIFSSHVLEVVERLCSHVAIMSDGVLRMHGTMASVRGGRSLSDVFVQVVGGRVATGSELAWL

SEQ ID NO: 11034 - protein, 253 aa, Actinoplanes utahensis
MSVRRCCGCTPPSRCDHELRIFKVRSPAADEPALVIRGMKRFRRNGSPRTRKIALGAVLAVVAGGAVAVGTGMSHASTTCDGLDEALQRNLSFMADQQAHPNAQTDAVLANRQAVVDLINVQRRQAGCTGQVAQPAPAKPTRATTAPTAKPPVASTAPAAKPPAATGGTGAGEVVCKGSTVTLSGEAGAPFASSGTFPIGTRLKVTNLDNNKSITVTVQSTSGSCVLLNNAAFEQVREAGKFLIRRAVIERVG

SEQ ID NO: 11035 - protein, 167 aa, Actinoplanes utahensis
MTGGTSGTTAGRPPGTSSDSCHPWLMIDAAPIDIPPGAARLPDMADESPPPRTRVVLGDARRAADPSRTDLAQQTPVGEALVRGLVRAQLALALRLSLVVVAGLGALPLLFAAAPAVGRVDVFGMRLPWLVLGVLSFPFLVLVGAAYVHGAERNEQDFTAVVRRPGR

SEQ ID NO: 11036 - protein, 516 aa, Actinoplanes utahensis
MSTAPPALPTVQNLTKGPLHGPWPDTRLFRRRLPGPAGPAAPGTILAIVAGVAVTALTLPLGVTGVGWLITAVAWLAVLLTARPTAGPAFPPVPAAGAPRLGARLPWAAATIGLLSVGTFRSAGWLFALCVGTATLTFALAIGAGRSMRAVLTTYTLGPVAVLRAGPWLVRGLARVRRPRGAAPFRIAATAAVSVLLLVVFGLLFASADATFASVISAVLPEVSLDGVARWIFLAGLSAPLLSGVAYMWIAPPRLTDLDHTEGMRVGRLEAAVPLGLLTLLFAAFVAVQLTVLFGGDRHVRTTAGLTYAAYARGGFWQLCIVTGLTLLVLAGAARWAPREAPGDRAVFRAVLGSLTLLTLVIVASALFRMQVYIDTYGLTRLRLLVACCEGWFGVILLLVLLAGTRTRAPWLPRAAIAAGVLALIGLAAANPDLMIARNQMHRSPDRVDAGYLSGLSPDAVPALTGVDGPQRVCVLYRIRMTMPDDRWYEWNYGRAAARDIIGQLPPMAHDRCGAY

SEQ ID NO: 11037 - protein, 367 aa, Actinoplanes utahensis
MRIAGGGAGDGDVAGGAVRARLMQAVHDVAARLFRWLPRPLDPVRSIKAKLSLALGFAGGIGLLVFLWSIDFYRVDVLWIAIAAALGLVTLQVMAHGATIPLREMTVAARQMARGDYTHRIRTRSQDEVGELAQAFNQMAADLAAADRQRRELIANVSHELRTPITALRGLLENIVDGVAATDPETMRTALSQTERLSRLVDDLLDLSRLDAGVVPLRRELISVPEFLDEVVREAKVNADGIGQDVRFSVAAPALVLPGDRARLHQVFANLLDNAARHSPAGGLVTLRAERRDGQVLLAVTDEGDGIPVAERERVFERFTRGERPAGGGTGLGLAIARWVVQLHDGTIAAVEPADRRGAQIQVRLPL

SEQ ID NO: 11038 - protein, 322 aa, Actinoplanes utahensis
MGRCPASARLGSQPGFGRGAASATARLRPQPGLGRGSAWVAARLGSRPGLGRGPAWVAARLGSRPGFGRSPAWVGGGCGEFVRWRGVGVETMTERRVLVVEDERAIADAVAARLRAEGFLVQVVGDGPSAVEAARRVPPDVVVLDVMLPGFDGLEVCRRIQAERPVPVLMLTARGDETDLLVGLAVGADDYMAKPFSMRELAARVHALLRRVGKTGAARVAAPAGPPTLRLGDLEINQAERRVLRGGAEAHLTPTEFDLLVHLARTPRTVLPRERLLAEVWGWADASGTRTVDSHIKGLRRKLGADLIRTVHGVGYALDIER

SEQ ID NO: 11039 - protein, 245 aa, Actinoplanes utahensis
MSLVVLAVDDEPPALDELAYLLNADGRVAHVHRAGDATEALRVLRDTEVDAVFLDIRMPGLDGMELARILRRFAHPPAIVFVTAYDDGAVDAFDLGVTDYVRKPVRAERLGESLRRVAGLRAAPATAVPADEAAIPVELAGTTRMLPRSSVRWVEAQGDYARLHTADASHLVRVSLATLAERWANAGFVRIHRSFLVQLRLVTELRLTGSGYVVAVGGVELPVSRRHTRELKDRLIRAAKHDWGR

SEQ ID NO: 11040 - protein, 202 aa, Actinoplanes utahensis
MRALRAQISPHFIYNALTAIASFVRTDPERARELILEFAEFTRYSFRAHGEFTTLAEELRSIDRYLTIERARFGDRLQVRLQIAPEVLPVGLPFLCLQPLVENAVRHGLSRKPGVGMVSIEARDAGAECHITVEDDGVGMDPTVFGQDSADSEDGQHVGLVNVDERLRSVFGDHHGLVVETAPGAGTRVSMRVPKFHPQVRA

SEQ ID NO: 11041 - protein, 147 aa, Actinoplanes utahensis
MAGQIGSVLAVVAVLAALAAAVVAVLRLRARRGIATTMQRATYEVLHTASLAAEPLRAGLTPATAAKAARHLRTLIGAAGLSIADDERCLAHDGRGGHHTAQLTAAAQRALSARRSIVLTAAELPCDRVDCVVRGAVVAPLPGPDAS

SEQ ID NO: 11042 - protein, 340 aa, Actinoplanes utahensis
MRLTKTHLIIATAAVVTTLLSGCHGGSRTQSLSTVPGSAVDTAVVPTAAASAPVAAAAVAPRLGISFFGWDPKHENYLYVHNGQAKVALKGSEVYYGNTAVAPDGHRIAWVAAKDRSLWVANVDGTDRRRAGAPVNEMNYSIDWTADGTGLIATRNAAPNQPIVYGTVRIADGSFTALPKSLQGGLHFRMTPDGKHYLYIADGVSFASADLDGTHIVKTPIIGDRSLKKNPRHLRAVDIISSDATGDMLAVNTWDSFEYDRSVGSSLANTLIGRATGRVLALPVKGAVEQILFRADGNVLVRSRSGSTWTLTLLSPARKVLTTRTESSLTSGIGLLAVAG

SEQ ID NO: 11043 - protein, 34 aa, Actinoplanes utahensis
MTVLVTGHFDFLDKTSAKVSPGFARTRVYTGVSH

SEQ ID NO: 11044 - protein, 523 aa, Actinoplanes utahensis
MTTSLHRPTTDSSRSKPVRYDSFEWPQQDQQPPSNGVPRSAWTRQHRRVSRWHRPYTAVLIVLDLISTLGASWIASLLEKSQSGFQDKSWWFFSNGALFNFFAYLVLPLGWLLLLWTNGTYDRRYLGLGSEEFKRIVRTSVTVVAAVSLLAFATKTALSRGTVAAVSLSALAFILIGRVGARQVLHLARRRTGHGAHRMILVGTLPEALEVYTAVTRSPAAGLIPVAIHITDGYAATRGIETPIPVYTGRDVLSLVREVGADTIAVCGSASAEPGELRRLAWQLEGTGVDLVVAPQLTDIAGPRVHIRPIEGLPLLHVEEPTLSGPGWLIKNLLDRVTAALGLLLISPILGIIALGIRLSDPGPVFFRQTRVGHDGQTFKVWKFRTMYVDAEERKATLEELNESDGMLFKMKHDPRIFAFGQKLRATSLDELPQLINVLKGEMSLVGPRPLPADDGDYLGDVRRRLLVRPGITGLWQVSGRSDLSWDEAVRLDLYYVDNWSLTYDLSILWRTIGVVLKRKGAY

SEQ ID NO: 11045 - protein, 381 aa, Actinoplanes utahensis
MEMEQVRFFGFDQRGKIALSGPAQHRGHRQQRFLPGRHPGDRVGTPLERHHGHAGRAQLLDLGVDDDVLPGGDRLAIPVVCNHHLHGRKRYREGVPELPEVEALAAYLRERAVGHSVQRLEVASFSALKTYDPAPSALTGLPITSAGRHGKFLDIGIGLDVHLVVHLARAGWLHYRDTFKSPAPLKPGSGPIAIRLRLDDGSGFDLTEAGTQKSLAAYLVRDPQTEVPGVSRLGPDALAVTRDEFARLIRSRNGQVKGVLTDQEVLAGIGNAYSDEILHVAKMSPFALTGKLTEEQLTTLYEAMREVETDAVQRSVGQKAAELKGEKRAGMRVHARTGLPCPVCGDTVREVSFADKSLQYCATCQTGGKPLADRRLSKLVR

SEQ ID NO: 11046 - protein, 498 aa, Actinoplanes utahensis
MISRRALLAGSAAAVAAGGAGFALGRIPAAPAAPEQKTPVAAPKYRSRPDLQALPDVTITTPANRTVPGYILLTPASGHGLWGPLMVDETGSPVWFRKVPDPATVAIDLKAQIYRDKPVLTWWEGTIGGTGGQGVGQGEFVIADQQYREITRVRAAGTEQADQHDFVITPRDTALFWVYDPIAYDLSPVGGPADGVLHDGVLQEIDIATGKRLFQWRASEHVTLAESYAPLPQGDAAHLPYDYLHPNSVGLDADGHLLLSARHTWTVYKVHKQTGAVLWRAGGKKSDFAVEERAAFHWQHDFRRRRDGSYSVFDNGAGITKERDYSRGLVFTVDEAAKKINFMAEYVHPDRVSAPTQGNFRELGDGGSFIGWGQDPHFTEHNADGSVRLAGHLPLDNQSYRAYKAEWTGTPHDQPALGLRVEGGNVIVTASWNGHTGIARWRARAGGQPQELSTTVEAARTGFETTLTVQGTPEYVVAEALAANGTVLGSSSAIPVRV

SEQ ID NO: 11047 - protein, 251 aa, Actinoplanes utahensis
MKTHLYPVETRQPRQPTAADYYAVNRGGGLFSEAVSQRIGSRIAVFAFRRDLSPTLLTIVNLSIGLLTSFVVISAAEAVADGRVWGWLVGVLALAGWQLAYAFDCADGQLARVTGRSSSAGGRLDVLCDVAVQSALVASLAATAKVQEPGTPAWLLSAFAATWMVNLVTSVMQGGGQASSMVTSRSLPVRAVKLIRDYGAVIAVAGAVLAAAPQLTVWFIGVFTLVNGGFLAASIAFTGRTALHLDAHRDG

SEQ ID NO: 11048 - protein, 353 aa, Actinoplanes utahensis
MPLLARSVQTPLHIEVRRGAVADLGRILADGRISAGGDVAIVVGPGLGERIVDLLRPTLRSATVHVTAGGTLDAALELAGKLRAGNYDAVVGIGGGRTVDTAKYAASRWGLPMVSVATSLANDGVASPVASLVNDGIKGSYGVHIPFGVIVDLDFVETGPERVNRAGIGDVISNLSALADWELGRQVRGEPVDGIAASLARMGAEAVLTMPGDLNDDAFVTVLAEALIASGLAMAVCGSSRPCSGGCHEIIHAADALYPGTASHGELAGLGALFCTFLRGDRRRFGQMADCLARHQLPRSPYDVGLTVEQFVQVIDFAPRTRPDRYTILEHLALTPDEIRQRLAEYEDALVSR

SEQ ID NO: 11049 - protein, 243 aa, Actinoplanes utahensis
MIGLVLAAGAGRRLRPHTDTLPKALVPVDGDTTILDITLRNLSAAGLREVTIVVGYRADTIEERVETFERRYGVTITLVHNDRAEEWNNAYSLWLARDHFARGALVINGDTVHPVEVERILLAERGPSILLAVDTVKELADEEMKTVFDPNGQLTRITKLMDPSEAYGEYIGATIIEASAAAALADALRATWVRDPGRFYEDGFQEYAERGGEIRAAEIGKLDWVEVDNLDDLVKAREIACRC

SEQ ID NO: 11050 - protein, 365 aa, Actinoplanes utahensis
MTAEQLISFARGAPSLDIVDVEGLKAAAARAFDADPAGVTAYGTSVGYLPLRRWIADKHGVSPDQVIVTNGSLQADAFLFGHLVQPGDDVVVEKPTYDRTLLNLQNLGAKVHQVTLRPDGIDVDELRALLESGVRPKLAHIIPNYQNPAGLTLSEEKRRALLALAEQYEFIIFEDDPYVDIRFRGEPLPSMLSLDTNNLVVHASSFTKTVCPGVRVGYLVGPAALIDAIAKKATNLYISPGMVSEAIVHQFCVSGDIEKSVRKVSEALGERARVLAEAIRDRIPGATFTEPDGGYFLWVDLPADIDVEKLFPAAMKKGVAIVKGSDFLLEGGRNSVRLAYSAVTVDQIDEGVRRLAEAIDEVRGR

SEQ ID NO: 11051 - protein, 374 aa, Actinoplanes utahensis
MSEQNGAFSRNRPLSKAWAARAMNRILGANETHRHPDDADAQDSAVVDCGVYVAGERIPGLFTPDEAFAEVRRRDDAFVWLGLHQPSEREMIGIARTYGLHELSVEDAVKAEQRPKLEQFNDVHFLVLRTARYVPHQELTESSQVVETGQMMVFVGDRFVITVRHGEASEMSPVRADLEKQRANLLQQGPWAVAYAVTDRVVDHYLEVAEQVEADLDLIEEGVFSRDRSAPIQQVYQLKRELVEFRRAVVPLQRPLAGIIASQGVVPKEIRRYFRDVQDHLTRTVEQVSSYDDLLNSILQARLAQLSVDQNDDMRKIAAWAGIATVWTAAAGVYGMNFKYMPETHWRYGYPGLMALLAVITVILYRAFRRNGWL

SEQ ID NO: 11052 - protein, 57 aa, Actinoplanes utahensis
MGDIHHHRLVDAVAGHDGDPPRRRWLRLPVPSLLTGVMIAALTAGGLAAYAMITGRC

SEQ ID NO: 11053 - protein, 190 aa, Actinoplanes utahensis
MRGELGQSVDHLKRAASIAAQETTATVGPRLNAAVERVQPAADKAKDVATQSWDSALAALTPLVAAAADNVRQAGRTGKKVSKRELKAQRKRADKLQRKADKALGREKSGRGSKLAGYALLGTAVGLGAAWYAKRRNQAQWEEYDAAPNPVTSTAAADDAAFEPLEPTVYTTSNGTAASVDKTGKTGPAK

SEQ ID NO: 11054 - protein, 174 aa, Actinoplanes utahensis
MAETIYATLHTNHGPIRLQLFPDHAPATVRNFVELADGTKAYTDPRTGQPGNGPYYDGTISHRVIAGFMIQLGDPTGTGRGGPGFQFGDEFHPELSFDRPYLLAMANAGPGTNGSQFFITVAPTPHLNRRHTIFGQVADEQSAKVVDSIANTPTGPGDRPREDVVVERVEIERA

SEQ ID NO: 11055 - protein, 302 aa, Actinoplanes utahensis
MSEAPSTSPVCYRHPSRETVLRCSRCEKPICTSCMNEATVGHQCPDCVKEGRRGQRRALTAFGGDAAAGRAGYAVTGLVVVNCLVMVLSVAFGGLKSIAGSGGFMGLGGSGTRVTDALEVIGLAVYPDGAWHGVAHGEWYRLFTAMFVHYGVVHLLLNMMVLLQLGRYLEARLGPIRFLALYLLAGFGGNVACYLLTPQNQPSGGASTAVFGLIIGIIIVNRKLALDVRSLIPLLVVNVIFTFSIAGISKEGHLGGLLVGALATIALVYPAPPHRTVKQAIGWSVIFLALVVLAVWRTTQLT

SEQ ID NO: 11056 - protein, 233 aa, Actinoplanes utahensis
MTPSLSAASRTGTSTSRSAHPTSPQPISAASVQRTGSRPANATASATTATAPTSLRTGRTGRTRHCMGTLWHHDRCNSLFTSSGRCLRRSHSVKHVMDVISCTFLPATVEAGVAIPSRHLPIVERCVEADDSAVLVTHCTRPEAPLAGDHLLLLTRRRLVVIQKTPVLHRLRLHLNANLRHLSNVTWRPDLTRPALEMAATAVDGVRERFRIKFANTEAVWRFEGVLRDVFLA

SEQ ID NO: 11057 - protein, 301 aa, Actinoplanes utahensis
MRDTFVATTTALLDEDPRTALVLADISADAFAPALRRHPDRALNVGIREQLMVGVGGGLALTGMRPYLHSYAPFLIDRAYEQIKLDLGHQDTGAVLVSIGGSYDAAAAGYTHQSPGDVALLDTLDGWTVQVPGHRDEVPAMLRAAARHDDRVYIRLGLQENARAHPDAGRLRVVKRGGPLVLAVGPMLDPVLAATRDLDVTVAYTNTPRPLDVEGLRSLAEGEVVVVEPYLAGTSARLVSEALSGIPHRALHLGAGRAEIRDYGTWQDHAREHGLDAAGLRTSITAFLGQEAFLGQEAFLG

SEQ ID NO: 11058 - protein, 217 aa, Actinoplanes utahensis
MTVTTLRRLTGDEKHAPSAHSTLDVIRVLYERILRITPETADAPDRDRFLLSKGHGPAAYYAVLADRGFIPQEWLDRMGQWHSRLGTHPDRVLIPGVEIGTGSLGHGLGLAVGTALGLRAQGFSETRTYVLLGDAELDEGSNHEAIAYAAAVHLPLTAIVIDNRSATHGWPGGIPARFPGWSVSLVDGHDHDEIEQGLRVRSGRPHLVVASLEAKGS

SEQ ID NO: 11059 - protein, 153 aa, Actinoplanes utahensis
METLTIGDMAARSGVAPSALRYYEREGLLHAARTGGNQRRYERADLRRIAFIKIAQQVGVSLEEIREALAELPENRTPTRADWSRLSSRWRHRLDERIAMMERLRDQLTGCIGCGCLSLQRCSLINPRDRLASRGTGPQMILNPPAAEVSEDR

SEQ ID NO: 11060 - protein, 102 aa, Actinoplanes utahensis
MEQLGSGYGVLWSPISNTLADTPENMLSVVFALSCTGGGAVSFTVDAGGARKQPAQAHSCDGSVAQQSIAPAKHGPVSFSAEVTGSLAGSFAYAYYVEKTQS

SEQ ID NO: 11061 - protein, 320 aa, Actinoplanes utahensis
MRAIVIKDRQLHWAEVPDPEPGDGEVVVDVTAAAVNRADLLQRQGNYPPPPGAPAYPGLECSGVISALGPGVEGHHVGERVCALLAGGGYAERVAVPAGQLLPVPAGLSLVEAAALPEVACTVWSNVVAHDRLRAGEAFLVHGGGSGIGTFAVQLGKALGATVLVTARSAKHERLRALGADHLIDYQEHDFVREVHTATGGRGADVILDIIGAKYLARNIQALAVNGRISVIGFQGGTRAELDLGALMAKRGTVSSTSLRARPIADKARIVAGVRDQVWPLVAAGLIKPIIDTTVPLAEAAEAQRLMEASDHLGKILLVR

SEQ ID NO: 11062 - protein, 223 aa, Actinoplanes utahensis
MDGQRVRPSGAPRIRSLGDTVTYTPHRPPTVRVTDPDDDGVDEWALRWRTRIWVGGGLLVTLALITFGIWAVATADQPAGGPAVFRGLPPAGPADASRGGFGLRVTSVRCGVSAIGPDGLEQRAHGQFCLLDVRVTNNGTEPALFDSSAQRVYDADGAAYAVAADAAVFLNDDSPTLLDEIPPGTSVDGVLPFDVPKNAQLSEVSLLGSGVAPGIRMSLPAPE

SEQ ID NO: 11063 - protein, 307 aa, Actinoplanes utahensis
MLTAGALALAVIAPAVDPAEHATEAAPAPTALPANPESPAFAGGFAARDSRILSDDLDESLFMRRQAATARATRAMQRRAVTIRPAPLAPLRARPGAPSPGAAPTGRSAAGQRLARSASGQRAGQGQRSASGQRGTVEKRPAFGRHSAENALQRAVRAAQHRTVAQRRTTVSHRGMVRRTTHRTVSRTLRVSGGTGRMAAVIAYAKAQLGSRYVTGGEGRGGFDCSGLTRQAYARAGMRLPHSSRAQAARARSVARGQARPGDLVVGSGHVGIYMGRGMMIDAGNHRTGVVYRRMYRGLRVERIPGA

SEQ ID NO: 11064 - protein, 176 aa, Actinoplanes utahensis
MSLDRALAPDPYDLLPQVPSFTVTSADVTDGQPLDELHAHTSVGGKNLSPQLSWSGFPDETRGFVVTCFDPDAPTGSGFWHWVLVNLPLSVTSLDRGADPFPDGAFCVRNDYGERNYGGSAPPPGDRPHRYVFAVHAIDVDSLDVTPDATPAYVGFNLAFHTLARATIRPTFEVRG

SEQ ID NO: 11065 - protein, 237 aa, Actinoplanes utahensis
MADITGDQRIQSEVLEGLATAVNHRRWFVELALPYLGDNPIEIGSGLGDYALEWAEHLPRFTATEADPDRLVQLKERMAGHANIEVRQMLLPAQDAAGEYSAAVSYNVLEHIEDHVGALRSMRELVRPGGHVIIIVPAFMFAMSQVDIATGHIRRYTKKTLGAAYTEAGLEIEKIHYANALGLIGYYGATSIFKLAPKEGPMVKVYDSLVLPVTKAAERIVRPPFGQSVFCVGRVPR

SEQ ID NO: 11066 - protein, 694 aa, Actinoplanes utahensis
MDTRKTRVHIVSITLRPLIVELFPTSVRLADAMTITGFDSTGQTAGENVLPPRQLTAAEDLDAELLALGGGLITAAPTSPAPAGENTAEQAEAPVRRRPLWRVPTWRDVVAIASFLAVALFVTAPLWLNLDHELRDDPQDQAFFEWMLAHGARVLTDGVYPFFSDRMNYPDGVNMMANTSALAVSLPLTPVTLLFGPHVAFNVFLTGALALTGTSWYLVLSRRLVGSRLAAWVGALFATFAPSMIAHANGHPNIVSQFLVPVIIWRTLELRVPGRAVRNGLLLAGMLIWQAFINLEILFMTAVGVGVFCLVMGLVRVRRHRSEPFAFLRGLIVAGSVTLAVLAYPLSVQFAGPQSYKGLSEYVRSFGSDLASFTAYSTHSVAGNLEVPLTLAQNPSEQNAFFGWGLVILFFGLVLWLRRSAAALTLGGLGLLFAAISLGPNIRLNGADTGVPGIWSFLHHLPVFDSAVPTRFAMAIAPIVGIVLALGCQRAAELVRTQPQTRGPIRVAMITAVAMALVPLIPHQLDTVKMETVPSFVTSGQWRHYVDDNHTVVTLPLPDSYYPDPLRWSAYTKLDMRIAGAYALLPNQNPQDPTDHTAAFAPPWRPTSGLMSSIRQGNPTPEVSPARREMTLADLRYWKAGVVVLTPQTRDIEMLRTMSDLLGFRPTWTGGVWLWDVRNLVDNPDAVITADATS

SEQ ID NO: 11067 - protein, 260 aa, Actinoplanes utahensis
MTVTLERVGSRPLAPVSATLAGMFGGVQVPSLAPGLIVSEQAGWTPATHLAGPGLSPLLASAGRRWNAQPHAAAALAWKAYTYWAVLPAVLGWASARRVPLITAGNVLTNHDNPTVMITLGLRAGIPVAVLPTDPLALSGHPDAVVVPDETALLAEFRRAVLDEHLTPLLDAIHQRVRLGKRPLLGSLASGIAYGVLRSADTVPGSSAESIEKLLGVLGIRDLIDLAPGANGRLEVQRKTCCLAFTLPKPKLCPGCCIKP

SEQ ID NO: 11068 - protein, 509 aa, Actinoplanes utahensis
MTTSPVERAADQFVSALAQWRVERGMTKKQLAARMGFDPSYVSHVEGRRHKPTEDFARRAEAVLGAGGAIWQRFQEYDELRHARTPGPHRDSPVRSQWLPPGAGLVVEREIAELAYTDGAYRCRVLRSLYNAGVEPVTRYLVKMAVDRYPNDPTGSNRHHRENPLTFEELDVHAVAGEGDAAEPMRWRVKLDRDAAKEIWLLFANERGQFPLYPGERTTIQYAYTVGEEKWGQWFQRAVRLPTRSLTVRLNLPERFEPQVWGVEVSLNAEVPVRTPLERRNEGGRAIFEWSTDQPLLNARYRLEWRFRGADAPVHDDLAPAEPVLPRASHRMRGIGIIQRGSDLLRQRARHFQLPREAPAARETVTRLLTSLAQLEDLHEFSKGVGLAAPQIGLPVAAAVVRAPDREIEPVVLLNPRVVGESAARDEQYEGCLSFFDYRGLVVRPLRIEVEHARFDGARVVTVFERALARLVGHEIDHLEGRLYVDRMKSDAKLVPVAQYQQTGRPWDY

SEQ ID NO: 11069 - protein, 369 aa, Actinoplanes utahensis
MGDLARLLKESWSLVEEHQDKVAGYFYARMFLSYPDLRDLFPVQMDVQRTRLLHAIVTAVQTLEDPERFEDYLRSLGRDHRKFHVLPEHYEVVGGALIESMRAFAGEQWGVEYDQAWADAYAVIAAKMLAGAESDQNPPYWYGEVVQHERRSHDIAVFTVLPMQPLEYRAGQYLSVEASPYQPRLWRTYSPANAPRRDNTLEFHVRALGAGWVSSALVRKLKVGDMIKLAAPMGSMTLDRRSTRDAVFVAGGTGLAPIKSLLEELTRYNRTRWVHVFFGARTREDLYDLADLNRLAARYPWLSVVTACSDDPTFPGENGNISDVVARYGPWNEHDFFVSGSGPMVKATLRTLAELQVPSIRIKYDAFSD

SEQ ID NO: 11070 - protein, 257 aa, Actinoplanes utahensis
MTLEGQRSTRSAYPAEIAIVLLLSLGQSAIWSIVSLTAKLTDGKPLASHTATLNAPMSPRPYLDLTYQVLNIFFDLVPVALAWYLLRRDGIRPGRDLGIDFRRPGFDAGWGAGLAAGIGLPGLLLVYAAIKLGVSAQIVPSALQPYWWAVPVLVLSAVQNAVLEEVLVVGYLTTRLRQLEVSTGWIVAGSAVLRGSYHLYQGFGGFVGNIVMGVIFAFFYLRTKRVMPLIVAHSILDITAFVGYDLLPDSWLTWLHP

SEQ ID NO: 11071 - protein, 476 aa, Actinoplanes utahensis
MEEKQTPRARDPRAPFSAPEAEQAGGGRGRRGAPPAVTFQPPRPGVSAEGHPSGASSGTPEDSEPPRPAAKAAGRAARTSRAARTVAPVDNGAAGAADGQPERAADGTGAARKAPVKKVAPRSRAAAKAVPAANDQAATGDPAAAETVKRVARPRKAAAGKPPASKMPASGAPEAVKADRTPTTAEADQPATATAPAMTAPAPATTETDQAAATTTPGTAEADRVTDAATPGTAEADQVTDAATPGTAEADQVTDAATPGTAEADRVTDAATPGTAKVYAVGASRTPVVGNAAERLHWAVADQIVVDLWPRLVAEPRDAARILAEAAVQTLGPRAAAWAARTRAAYPAATPQGLARLATAQSVRAAERRGILSALSGTYAPIALVASAALTHADLVLHVAAAYGVDPTDPERAAELVVLLPSYRGGAAWAALRLADRAFPGASMLGAVLGGRNTAEAVAVRAERRYGWYASRRSQE

SEQ ID NO: 11072 - protein, 887 aa, Actinoplanes utahensis
MFSDHRSSTDAVSMTGMHPPARFWAVDLHVHTPGSADVDPLTYGASAAEEVVAAALSAGLDAIAVTDHNTVRWCDLVAAAATATSLIVLPGIEISTTEGHLLAVWDEGTPLHLMEDVLVELGIPRVDQGRLDVATRGGFAEAAEAVHRSGGIAIAAHADRPKGLLQLTVAANVSKIILNPALAGVEIVDPEAAERVSSKTAGRREMACVRGSDVTIPGGNVHVLEGIGRRRTWVKASRPDLCGLKHALADPELRVRLEEPAEPEHMIIESVRVSGGFLDGQTFELSADLNCLLGGTGTGKSLLIEVIRFALDQQTDSSDFPQVRREVDSRLDHALSQNASVEVVLRRKWARCVVRRAYFGDQSPSPEMSGDTEHFVNPSGRVAIRAFSQSEVIEHARTRVGRMTLIDSGLDLEDLVAADLEVRSRLADNSRLIVGLRDGIREAELLLEQRPVVVERLTELGKLFNGDIVRQQAAWSRERTWFNSLTSADALVAPHIPQVMSFVHAVAVEANRDLYDRAATALSALEATLKSVDEKLQQAYAAAGRELAGIVAEWRERQQEFDAKLRAVVAEADVEGKGLETLRTRLTELQTNKVTLDDVATKLETTLRPGLRTAMEHRETIIEELVVLRKERRKRRETRIRLLNKLMSGVVRIKLDSESEDEDYGAQIAALAKGSRLRADVLQQLCAKSHPVKLIRSFLDDDAEGVSKVTGVESRHIQTLFEHVIERHQEEEFLGLQSLELLDGLSVEFRKRGEGEYEHIERLAHGQKCTAILIIALADGAEPLIIDQPEDALHAPWIEEYLVERLRGLRGSRQYVFATRSPGLVASADAEMIITLTSGATQGTIEASGSLERYDLNRHALYHLEGGPQPFRRRTTKLGPSMSAVVS

SEQ ID NO: 11073 - protein, 44 aa, Actinoplanes utahensis
MPIVKPHTRQGKPVKGYYRLNSIWNFWFGFLLMLLLFAVVSKGN

SEQ ID NO: 11074 - protein, 87 aa, Actinoplanes utahensis
MPHVSGHYRNGRWVRPHYRRSTPRAVRSAGMIRVRGHRRDDGTYVRPHLRNAAPTLTPASSNSDWDWLGYLAMLLFVLFLIGAATQA

SEQ ID NO: 11075 - protein, 964 aa, Actinoplanes utahensis
MDLRASRTAVLEGLSALAPDNLVHRFDQQRLDPLPPAGPCDPRLNDAQQRASDACCAPGLQVVWGPPGTGKTHVIVNAIERLMTAGKRVLLVSNTNVAVDNAVEGIIKRLAPTAGRVIRVGTPRITTVARDERVSLNRLVEARQRTALARLSRLEDTIAELQSNHPQRRLADSEAALAGFDPSEHRRRQARRDNQHRAQQLTAQVQAAALHAAEAKGNLKQATADELLAHLLVAMVYERIARHDRDQAAQGLAEEERSTGLSRAMSTMRRRQARGAAHRAERELDAKRTERTAAEARLRQAGAEVSHALYVQAQAATIAQAHEWAAHAELHQSTAVRVKEAAAEALAAVRQRLSIAAAAAQPSEQDLQLLREAEMRGLPQLHEELSALRQSAVECDRKIRECQTQHDRLVTDLADKRPGMQAALIAEAAVIATTLSMLTLKKMILSTAFDMVIVDEAAAASLPELMFAVKAARTGATLLGDYLQNGPFVDPSLPKEDLIKAVYTRDCFEIFGLTDPATASQQPGCVVLTEQWRFGWELTELANRVAYGGLLTAKNPKTCEIVLVDTDGLGKALSGIRRARPDAVAGTWPIGALIARALAEYHHPRDGSVGIVTPYKEQAETTQELLAESACGPAIEVGTAHTFQGRECDIVVFDMVEDGRGWVAKGAHGSDAWKLQGLRLFNVATTRARQRLYLIGDGAAIRRRGSGPLGALRHMIDAGTIQRVLASDLLGIDEANAPVEETVHHDLWSALQPYIRLVGMYDEKQIIAEVQQRVDSAASSVWMWSPWVGKHSLGLQDSLVAAHARQVEVRVMALPEKEINAEVRATLNALRARLPHVVLVHKMHQKIVVVDLRWTFVGSMNILSHPRRPAEGRHEVMIQIDSARFARQILSFELADQMRNPPRCETCGNTMTEAKEAGRSPDRRWLWYCGRMINGEPCPQTLEFPERTGRNRAGSAPLKRNSTS

SEQ ID NO: 11076 - protein, 43 aa, Actinoplanes utahensis
MTPEDLADAAIDLAEEGMPRREMPIAAVFEMGGEIIASPTPEP

SEQ ID NO: 11077 - protein, 363 aa, Actinoplanes utahensis
MTDLNEAFGAVPVLAYTDHERYGPTVHRSVPEWIQREVTSLRVQAGHRVLEIGTGSGYSGALLARLCGPRGRVTSIDISEELINRARAIHAERGVTEIDCHVADGLAGFPTAAPFDRAVGWCTPPRLPRTWVEQITDGGRIVASLPIAPLPSTALITTITVDAGQPRVQAVVGGVYAQSTPAPVDDAVTVPGRWVDYCDRQPDPSWIAISWRTEDPHNSGARAALDRLLNPGHTETYGDMEADWRSWSAHTAAPPDPGLSMVSLRNQIRGIGHTTATSAAVILTDGTIIADTPDSASLTVLREWLILWQQAGRPTADSFIPRLVPNTSIDCPGGDLQLAVPADAVPASRAAIPQPRAGRVEPA

SEQ ID NO: 11078 - protein, 261 aa, Actinoplanes utahensis
MTKRFPAIVAAGSNAVVNRNGTGGHPRRDTQPLCVSGLDVRGRFAGSCRRRPVKPRSGMNALRRRTQWIRLPGRRCMPIADAEIAAAVAAYLDRYPAEKALLAEPIELLARGSNFASRRNFDLHVTVGALLTRGGEEILLVGHRAYGIPLQPGGHLEPSDTTLMGAAVRELAEETGIDPTTVTTASATPVYVEFGRVPARPQKDEPEHFHLDLGYAFTTTGDVGSLQESEVTSAAWYRLDEAERLVGSRVWRACNPSVRIG

SEQ ID NO: 11079 - protein, 53 aa, Actinoplanes utahensis
MIRIKGTALFGPVITPAPRGEAAGRLWDGLVLIAGTDGFFELKQTRTRKASFE

SEQ ID NO: 11080 - protein, 181 aa, Actinoplanes utahensis
MTRRLILAPLLLGAVVALTACDSGPANPADTPAAKKDQQMQVMKRTDAENLAKKLAEQVASLVGKPLTGWRTSSAACENTDGVVASDGRWDLSTGGNVEVARDDQVATLNKIRDDWTSRGYQITEFHLLPDGDTGGSTSALVPESGLTISVQSTVPRTGIAIIVVTPCYKPAGNENPARGY

SEQ ID NO: 11081 - protein, 551 aa, Actinoplanes utahensis
MVTFADLRDARVDRLTVAADVWRQLAGKCSKLEDRTELELSKPLQNGAWEGAAATEALRRMTSLEDEFSLYRMKARSIGMLLERIATDFQGLQQRLQSAIDAATSLGLTVTADGRVQADEVPQSALSDPGALEVNRLANQNADVYTEVIASILKDADHIDLTYAGMLRDFGPDVQGPNEFSWQHTTDAARELAGLNGLTADDITAAGTNPAQAAAWWHGLTADQRELLSMAYPAEVGRLNGLPATDRDTANRLALHELIGQGVNQRVDPNDPQHQRLVNLMNRLDAADYQTGKPLYLLSIDNQGTGRAAVAIGNPDTARHTAMLIPGVTNNLDGMVDQIGRADHIRDAAELLGASDVSVIAWLQYDPPQLDDSIVTAAGSDRAQEGATNLLAFTDGLRVSHDAGPVHMTAIGHSYGSVVVGDATSGGHRLAVDDVVVVGSPGMDVHRASDLSVGADHVWAGAAPDDMVASPDTAIPLETGIPVAGDGVQAAIRLKHGVEPHLPEFGARVFMTDTPGHTSYWQAGSQSLKSQASVVVGDYGNLIPRYGKFPS

SEQ ID NO: 11082 - protein, 101 aa, Actinoplanes utahensis
MGDELHVEPAVLHSARQVCEDLGVAWRRDEHGVEPVTEDAAAGLPGWMTGRALGDFVWYWQDDVKKLTGYLETFGDALQRAALTYEHTDHASADLFDIRGR

SEQ ID NO: 11083 - protein, 84 aa, Actinoplanes utahensis
MRLSVGRRGQCWDNAVAESFFATIKTELIHRQTWPTRKAAHQAIFEYVEGWYNTRRRHSSLGYRSPAAYEGGAAISLLPALKVA

SEQ ID NO: 11084 - protein, 184 aa, Actinoplanes utahensis
MPQDVDILKRTAFFRAGDPVNVYPFIEAEQTGKHNVKRACELLKVSRSAYYQHARGEQSTRDRVDARLTEQIIAVHAASNGTYGVPRIHAKLAAAGLRHGRKRVARRMRAAGIAGKCPRRWKTTTVADPHAGARPDLVDRNFRVDATAVDTRWCGDITYINTWEGWLYLATVIDLASRRVVLAS

SEQ ID NO: 11085 - protein, 57 aa, Actinoplanes utahensis
MSSIMESVGKKRSRPRRAFTPEFKAEIVELCQRGDRTVGQVARDFDLTETAVRAWVK

SEQ ID NO: 11086 - protein, 117 aa, Actinoplanes utahensis
MDLQLSARTSGACTVVKVGGEVDTDTVPQLEAFLQQVADGGGVRVVLDLADVSFLDSSGLGALIVWFKELQSRGGRLCVAAVQDLVAYVLRVAAVDQVVNVYDTVEAAEAGMPPSTA

SEQ ID NO: 11087 - protein, 154 aa, Actinoplanes utahensis
MPLIGVLVTLVGYLITNIGRPVPGVRYGVAPVAISHASICGVVALIASPVAPASRGIPAVQKELPPVRCLVPLISARQPALQVDLPLVGLGITPIRRLLPTSEVALAFIQKPPPLRVGRSGVHHLTMERDGLNSTGHRLAGMWTGWAVGFRDRI

SEQ ID NO: 11088 - protein, 618 aa, Actinoplanes utahensis
MGWLSKRRLARRLLVNAITIAVLVAVAVLGYSVSHRQETMAGQARQAQRLAESAQQVKFRAADFNGWQTAYALDIIRAVPGATADTSPSRAKFLDAAAKFDSELDALEVLSASSPSARTVDAVREAFEAFMTLDRTVVTLYRSGKPADRRAASELVLGREIQLYGQIANGCDATAALSAAAADTSIGRLDAVGAAIRRYILILSIVAAALTVLGAILAEARQRAIAQQAKEAQRMASLGRLAGGITHDFNNVLAIILNYTDFVAEHASPEALDDLAQIRKAAKRAAGLTAQLLCFIRHEAIQPQIFDINAAINEAHAMLARTLGEHIELVVMPSPEPLKICADTGQIQQILVNLAVNARDAMPDGGTLVIAASAVDLEENQANVHPPVAAGRYLQLLVTDTGTGMSPETVARIFEPFFTTKPKGHGTGLGLATVLDIVITAGGSIDVCSKLGIGTTFRLYFPAVDVPYGQESEGRNDVAPPRGHGQSILIVEDEPALGTSVARILAAGGYQVRSAVSGPDALAAYADDGCDLLIADVVMPDMSGSRLAEILHRTDPRLPVLYISGYIDGNLGANRLCTPETRVIEKPFTADQLLVAVGDALSPAPDENGITGGRPRPV

SEQ ID NO: 11089 - protein, 605 aa, Actinoplanes utahensis
MAVHVGKQQGVFRLRERIYRRFGRWSNRRIAVIGAGIVVLGALGVGTGMSYAGQNDAGAEPNTNCSLLVPADPLSAAGLATPYELSGTGRRRGACHEANPAQAAFVQASVVDPATGKVSVYNPLVIDKGTRPVLDPVVPVLPKNAVVGIWFGFNGENLRLVDSHGSLRGGACVNGVDGSLFSQFAYCNAPAFFSAAHTAIRAGKLKVPPLGTGRDGKPCPTTRDFTVVDQDQSDNVTSAYLIRGSHVAQDTAANRARLRHAPVLVNGSDNLLLVHFVDQALGCTPFQAPDLADNGTLTTSLALNELQAAANQRDPVALVPPNDPMAEVDGRFDRTKLNLYRQGVGMGTVSGTRGLAAPYCQQLVDLAPSRLRADRRFTQKIASPDPGVATNLFTFLAQRLSGSYGNLGCDRLIRSPNPVRLRTRDGVAVDASFPGATGTPTATPSPTARQTPTASPSPTARHTMTASPTVTASPTVTAGRTMTARQTMAASPAPSSARPSSAKPGSPASGSSPPGPSESTTVPDDASPSIETVAADNYTYSNDGGAPKVTAPEAAALPPTRNVSFLARTGGGSMALIAGSVLLTLVGLSVLALLPRRRNPGTYYR

SEQ ID NO: 11090 - protein, 285 aa, Actinoplanes utahensis
MRESSGHPAPARSASVTVEALLARRGRIQQGLIDAEIRATRRAILTQFRLRLRADVGTLSSTAFLTLADEPAVHTAIMIAVSGVARPDALLLHTCAPGAAPLRLTRHRGLPESGPHQVARIGSAVASVVPPEGDSAGPVVVHDLSAAVVGVSRLATRMLLDAGFRAVQCYPMRDGDGPRLGLLSLLYRSPDRYPVQESLARHAGKALAHLSETRIGTCPVVAPSAFPGPPASPPDAACLSGLLAVEPSRPGAKRSNPQGRGAKRWAGERSGRLAGVDGKPLSGAR

SEQ ID NO: 11091 - protein, 80 aa, Actinoplanes utahensis
MTPVSLDSDFTGTPGQRAAACLAFAARARARADQLERTAQTLIDRAAVAHRAAEDASARVTGSYPAARRQLLNVSLGDTP

SEQ ID NO: 11092 - protein, 190 aa, Actinoplanes utahensis
MPAAQTRFHGITPVSASMARYWRSLIALVSGALSDPVSPLNSPLLAEDLARTVATGALHVFPNTTMGRQHVPGPGAVTPGAVRRAVAFVDADAHLPVQLSEIAAAAGTSARALQYEFRRHLGTTPLRYLSRVRLELARQELHRADPTRGDTVGAIAATPSAPSRPGGVSPTPAVSPRPIEPLTACPRARR

SEQ ID NO: 11093 - protein, 67 aa, Actinoplanes utahensis
MIGADRVRTSIDYGGTSGTGFHDYVFFVVHTGSVQIDSPLGGTVASAADVAFYPLGFRSSSTCTTST

SEQ ID NO: 11094 - protein, 94 aa, Actinoplanes utahensis
MDVRTRSAPITGVSWVSAEKRAPLRTGAKRDLFSAYICRMNSVTSASSLDENDDRCTRPGWDVDMRASRPECYAAAASPEGGVHDRVTRRTGAG

SEQ ID NO: 11095 - protein, 293 aa, Actinoplanes utahensis
MRVGELARRTGTTIRALRYYEQVGLVVPRRLGNGYRDYEPIAERQVAQIRELTALGLTVEETRPFVESIANDDDVCAAAVATFRSTVTSLQTRIGELTTQREALDARIDAAAHRIVAGTPVTGGPPAGLIGRRLPELHFYATDGRPLRLDHLGPGRSVIFVYPLTGRPGVDLPRSLLEIPGARGQGDWLRDHHAEIRTAGAARVFGLSAQSTGYQRELVHRLRLPYPLIPDPKLTLAAATGLPVHTTGDLAVYERLTLIVRDDRVEHVFHPIPDPASHALHLMRWLTQRRSGG

SEQ ID NO: 11096 - protein, 424 aa, Actinoplanes utahensis
MTAISRVIGRQILDSRGNPSVEVDVVLADGSSGRAAVPSGASTGANEAVELRDGDPERFHGKGVSRAVAAVNGAIAAAVTGLEAEDQALVDTTMIDLDGTGDKGRLGANAILGVSLATAKAAAQAHRQPLYRYLGGAGARTLPVPMMNIINGGAHADNPLDFQEFMIAPIGAENFFEAVRIGSEVFHTLRRRLAAAGHSTNVGDEGGFAPNFADADEALRFVVQAVRDSGYRPGIDVTICLDPASSEFYRGGAYEYTGEGRTRTADEHIDYLLELAAAYPISSIEDPMAEDDFAGWRKLTAQAGDRIQLVGDDVFCTDADRLQSGIDGGYANAILVKVNQIGTLTETLRTVETAHRAGYRVVISHRSGETEDTTIADLAVATNCGQIKTGSLSRSDRTAKYNQLIRIEEQLGRSARYGSATSSR

SEQ ID NO: 11097 - protein, 203 aa, Actinoplanes utahensis
MHRVLTASLIAALGVSLAGSPAEAAALGGSPAQAAKPLDVVKKAVAARIDKRLDALRKDAAALGGAKHLQAAHKQALQQLIDGQSAGLTALKSKVEGETTAAGLKADARSMVVDYRVFMLTGPKVRLSVAIDAELAAADRLHDRPGADDAKLDAVQKSLAGKVDALLAIQPGADGAAVRAQVTTIRTTAKGARSDLKAISGKK

SEQ ID NO: 11098 - protein, 65 aa, Actinoplanes utahensis
MVMKRTLAVALMLGALITGGCDRGAPRATNPPAPAATQADDGVDSLLDDAGTQLSHDDQPAEDED

SEQ ID NO: 11099 - protein, 385 aa, Actinoplanes utahensis
MLGRSGRRWAQVAMAAAAGGALLLGAAAPAAADEPTTGVPSRMTDGAVTLVLGGKAHSVGGIQFTIKGQTVPIFCIDYHTGLAANEPYTEGTWDESEVKNLTKVQWVLAHGYPNGDINALLTAAHVQMPQLDEARQRKLLYFGTQTAVWHFSDGIDLGAYSDGARLTDKPQYDVVKGIYDYLTTNAVDQPEPAAQLTVTPASATAKAGEKAGPFTVAGPASAISVSVKGGSAVDADGKPVTSTSNGGKFWLTAADAGKATVTLNAEDSVSFGRVFLYSGGKDKHQKLILGSSIGKPVTASAEATFTPAPVTTTTAASPKPSASTSKASQSPSAAVPGASTSPTSGGHLALTGSAASTVAGGGVVLLVIGGLALMLVRRRRTRFTS

SEQ ID NO: 11100 - protein, 1005 aa, Actinoplanes utahensis
MSSTSADQRKRDAQRQWGADRRTDPHPIVPPPVSEGRITRGRLAIVVTITVWAGYIAYTIFEQFIVGKAYNARLGAEAIAYMLVITGLAASAIAYLITRIGYFYRGRGHQRAPRIMLDEFIGGKTPSLTVLVPSYQEDERTNRSTLLSAALQEYPGLRVTLLIDDPRAPKTRAARDMLLAARALPGKIEAELQVPYRRVAAAFAAFDEQVRFRGGHLVVPDDMRRLADEYRFASDWLYDLGARQEMVDHTDTFFVEHILHPLAVELGQIAGALVKGADEQVALPLPRMNQLHKRLLAIFDAQVTSFERKKYVSLSHEPNKAMNLNSYIGLMGGAYQEVNTPLGTALVTAGPNRADLVVPNPDYVLTLDADSVLLPEYALRLVHLMEQGAFAQHAVVQTPYSAYPGSGTRVERISGATTDIQYIVHQGMTHYGATFWVGANAVLRKKALDEICEVSYEGDWEIKRYIQDRTVIEDTESTIDLGVRGWTLHNYPERLAYSATPPDFGSLAIQRQRWANGGLLILSRLKDQFKAKSKREDKNRFGEYFLRVNYMASIFWSSMCLVIMLVYPFNNELLNPFLLLISVPYFFMMAADLKHLGYKRTDMLRIYGFNLILLPVNLSGSIASLLQLLTGEKSAFKRTPKVRNRTTTATSYLLLPLALVVLCLYTVWHDVRLHQWNNLVFAGLNLVLSLYAVIAFIGLGNTVVDLATHLRDWLVPVATPKKVRKSSASKKAAAPKAAAIGDWATVLHYRHETGATAGQVTVRLQRTDTGAWKTDRPTSASRAHLFEEFSFFTVFQPIHNMINGHVVGYEALTRFADGSNPREGLEAAAQRGVHVALDAALVQAAIASSSSLPNGTWLAVNVSTDLLRRPHELAPLLAEAKRPLIVEVGGPVPAEVGQLGGTVRLAVDDLGLGYETLALLESARPAFLKLSLDTVQNLENETARQASIRTLVEFAEQHGCTIIAEGIETAAQRDALVACGVPFGQGFYLGKPVPVERVLAGVGGW

SEQ ID NO: 11101 - protein, 534 aa, Actinoplanes utahensis
MTDRATAVAARTGIDPLADPDWQEPEQPRRRLSWTRLGMLVLALGAVGAGGTLGVMHLRDTSGPTAKSWAVPYVDVTLTPTFQFQDPTANPAKNVALGFVVADPKSACAPSWGGAYSLDAAATSLELDRRIDQLRQAGGDITLSLGGLANQELAVACADQAKLTDAYRQLVKRYDVKTLDLDIEGTAVADQASLQRRVTAVAAVQKEREAAGKPLAVWLTLPVTPNGLTDDGVGVVRGMLDGGVALRGVNVMTMDFNNGDSHPNMLGLSTSALDGTHKQLTDLYLRLGQKLTSPQVWSRIGATPMIGQNDVDAERFTVDNATGLATFAVDKGLGRVSMWSLNRDAPCRGTFANVVVHSNTCSGVDQDALAFSKVFAGLPGKAAGSSSQDSVDIPNQAATVDDPKTSPYPIWRLTALYTGGYKVVWHGVVYEAKWANSGVDPSAAPAAGTQNAWSVIGPVSPVEKAPKPTPAVTGVTRIWTPGTAYQRGDRVLLNGLPYEAKWTTKGETPSTEFPIDADDPWHPLFNVPGEPTTN

SEQ ID NO: 11102 - protein, 45 aa, Actinoplanes utahensis
MVRARSRVADVPAGTSPRHPARPCRAGPFLDVFRFLLRILRGADR

SEQ ID NO: 11103 - protein, 221 aa, Actinoplanes utahensis
MKKYDTRTAIAAVIDIPAGRVQVIAADRTDTVVEVRPLDAAKSRDVKVAEQTAVDFTDGILRIVAEAKNQIFGASGSVEVTVQLPAGSRVEVRAASAEFRGAGRLGDVVHRGAHGAIKLDEAASADVSTDAGDVTIGRLTGAAEIRTQKGDIRIAETSGGDLTLSTQAGDITVDTAAGVSASLDAGTSYGRIVNSLRNAGGEVEVAIRATTSYGTITARSL

SEQ ID NO: 11104 - protein, 730 aa, Actinoplanes utahensis
MQRRCNGIAVNATLSRDRGEGVHDAGRQAQSAGTSSDRAGVGRRPRLRGDRPAARPAHLDDHPRGAAQRRSGRLPRRPGPARHRAPRPPAPAVRRPRPGDTGVALRSRRRRHPGVRGVLHRRPDGLRPAPDGGPGADLPLHLRHQPDRRRPGRPPAGQQGLGVQSGRPAGESRPDPPRARQKSPGTVRSRRRRPLSVDDRQRPGQRTARGDRSGGGAPARSGHAFRGPAGEHRPLRRLRRGEHRPRRRTGPCPALHQATGRRLNGAARARTAGAQCRRDERNAGRPDRNGDHRDPRRRACGGGASGGRRYRALLPRLRGRTRSSRFRGARHQSPWRTPNRRRAMAHRRRAVGMFGYRVPAPNEALLISGRKQRGADALPFKIVTGHGVFVMPVFSKATRLTLAMQEAEVVEDCYTKQGLTLGVQAVIAFKVGDDHESIAAAARRFQGDQGQMPTLVGRIFSGHLRSIIGSMTVESIIREQQTLADAIVDASKTEMARIGLAVDSLQISSIDDKGVGYIKALAAPHQARVNQEAQVAQAAADRESAMAQQESARHQAEYSRQTAIAKAQFQAEIDQAQQTASQAGPLAAARAAQEVLAEQALVAQKNAELRQAQLIAEVVRPAEAEAERIRALARAEADATKLSAEAAAAQDRIALDQAIIDKLPEMLRAAAEGLQGANVTVLDGAEGLNSVVASLAAQGMTMLETLRSGMRPEPAQPGNAVAPINAKSVA

SEQ ID NO: 11105 - protein, 620 aa, Actinoplanes utahensis
MPKKTTRRRIASALTGVSVAAAAVALVQLPASAAGSTGGSALLPPIPANARHFALPYDKIPAGAVKAKTGPLKAGKRAKAFQTPGSKTKIVNGDIAHSADFPGVVGIQSDFIANDANGNPAWWTSTCTGTVLSPTRVLTAGHCTVDLPYGYTQVIAGRDNLADNTSGFVARVSNTWLHPSYNYQAQVTDPQNTPPKNDVSVLDLKDALPDVYKATDLIAQGAADPAAGQDATIVGYGITKEGGSDSGVLHSATVQTQKDSTCTQPSQFGTQFDPTTMLCAGDVVNHKDTCHGDSGGPIFLGGPAARVEIGVTSWGNVCGGAYYGAYAALNQLSGAVKAQVTNLQPTNLDFTGDGHSDLIVREPGTGYLIVASGAGTLVGTPYIDETSSYDVGFNYYRYLDKSHNYEAYSKLFRVTNWNADGNESIFGRDRNGTLWQWKGDGRGDLVSTTPTKIGSGWNMFTDIVVTNNWNGDGRSNLLGRKADGTLVIYNSDGAGGWENPQGTVIGSGWNQFNTVLTPGSWLGDGHQSLIGRNAAGELWLYNSNGHGGWINPRGTKLGTGWNGMPTFMSPGDFDGDNLVDLIGVRTNGDLYLYPTNGKGAWKNGRGKLLGYSWDYYKAVF

SEQ ID NO: 11106 - protein, 46 aa, Actinoplanes utahensis
MVTVNPYRRWRRAFYYATAAVVCVLTLAALLLLVSVLIDLLHSFTK

SEQ ID NO: 11107 - protein, 494 aa, Actinoplanes utahensis
MPLLFTIAWYLLVGAAFLILGIPLIIITSGVILVRCAGAYLKASGQALGVRRPDASVPVPEPRDVPAHVHYLSGPAGRDLQQVALLTAQETKRQADLTRSWLKREFFQFSMSSYRKAVGVLVTVGTVGGAAISGLVMIFVALGALLVWGLLFVLGKSLLYLLRGVDSALSHLRGIKLTCPSCHHRVVYPAYDCPNPECTHRHEDVRPGRYGLLRRTCACGYRMPTLLVLGSHRMTAYCPHCHAAMASGAGTAREIVMPMLGATSAGKTRMMLALAETLLPRATPADVPTGNALAEMREALQVRGATRKTIAEDAVRAYSFNLTANRVRRLVHIYDPPGEDFSDSARLQARRFLRGAHAFVLVIDPFAIPDVWNSLDPATQQRYRAIRSAQPPSYIFEQVLDNLTGMGVRTADKALAVAVTKSDLTAGLPIGDGIDDDVRGWLRDRVGMANMVRSIEKSFGEVRYFHTTAVFDPGATDPNVHELLGWTLRRYGVN

SEQ ID NO: 11108 - protein, 740 aa, Actinoplanes utahensis
MGVPQMYYTSCLSGLSGFPGFQFNAVTPGISEAVLRRVEQATAYQPPRSLGWEPTAEQIADAPVNLCYLPGEPAVLARTVFVGTDYSHRLGNYFVHALSLPAGFEGARPIDFWAADFWVHTESDSRELPELTPVPAGRPDPSPEIGRLPRMLTAVARAVVAEGRPVIVVAERSADVARCIGALCDLLPPGMVRRFAFATYQYQPGRGREHLIGTVPGSGFEVTEPVLRSFAVFDLTGGPESAADEHPLAELLTAAGPENARILWDLAGDYAAAEDFDGWYPAVAAAALCERLPVTDGDLAAVLDWLPGNAARLGPRAVAPIAEACLDHEALTLPQCLTLVEVAAGDPDLRAAAEVSAFDMLLRDPSQAPAPRLETPEARRYARQQVLTRLDGAVPGADTAAVLDLAVRAGVELTDQELTAYGRELILPLILVDPRPLGDVPALRRGVLQGLARVAGDPGVLPALEQLGAPDAELQAYPALQRLLQLSRAATDPAKRVPALRLLGPDRAVLAALWAGGWGLEEAAEVIREAPDEFWESAALVELLDRVLARTQVPPGGWPHYVAAADFAAVRELTGRMSPAARTHVEQLRAAREMIRSASPARAVVDYFGHVGQPARAWLGSQLPALLVTQDARALAELLPAVPPEIRRHYRDQLSRTLDRRPADLAVAATTFELLHTHPKRYAELDEVLTATVARWKTRDLDDLERFLAKSTIKGLPGYVRQWRETRVPGRFSRFLPRKR

SEQ ID NO: 11109 - protein, 396 aa, Actinoplanes utahensis
MARLTCPYCYRQFAERDMLFRCSGLRAADGKFCRPAPDPVRVELGDRDEVPPVVVANGRKLSAVCPQCGNTATIQLCPHCHAQLPVHYGKLDTRMVAMIGAKFSGKSVFTTVLMHELIHRVGRRFDAAVLGADERTRREFGAEEHALYTDRVLPATTRPARADEQGRQPFVFKFSLGERKRFRSTLRHTVLSFFDTAGEDLESARGVAQNVGYLSSADGIIVLLDPLTVPGLPATLGLDPSLLPGPAAAGDTPLNILTRVTEVLQNLPGTGPHRMIDVPVAIAFSKVDVLWEALPADSPLRQPAPDEPFFPERDSVALHDHVQALLQEWEGGQIDQLLHKHYRTYRYFALSALGAVPSVGIASRQRVAESGIQPHRVADPFLWLLSRLKVIETGRD

SEQ ID NO: 11110 - protein, 866 aa, Actinoplanes utahensis
MFDAERYRDEVLDPARRNGNTPPADLCRRYALDPARLPRGAAFDAHVTTVVKYWQALGAQRIAYRKIVDALNAAHQRLREQDRLTAEHFRTERERTARETGRQLDEIVKELAGDPVVSAAALASAAAPLGGAAVEAQLRELLGRRRVRVADELWPLPETPPARARTVLSSVRTLGLPLSLHVLADEKPLTGFTLRRGLRVDGRPLTVAQLDAARRRAERRRQDERKTAADNLLTALAAALGDGTLDQLVLWELTEAVRPAAGLGKLRVVAREVARLGLQREEAEDFALAVLNRGSRAPARRDVAGEIEELLAAGALRAAERLLSTLPAGDGAEVRDRVLAAVARVGELAARAQREIAAGRPESAAEVLATAVREAADDTDLADRLRTLAPPPASAVRAGSAAGDRVTIGWTPGPARTGGVTYQVVRTRQRPAGSATDGDVVGRTGGNELSDPDAPAGDDLFYTVFATRADGVWSPGAAAGPVSLLPEVTGVQVAADETSVRVTWSARPDLTGCTVVREPGGVAVTAGRTGFSDDGLRPDVEYRYRIRAGYPALSAGITVAATPQAAPTAVPGLTAEPLPGPGPARLRLTWTPPESGDVTVRASAHRPRWSRGAEISGAELSTYGREMPGKADRASLTVPMPAGRVFVTAFSTGAGRVVVGPTVTVTNVAPVSGLRARRVGPLVRLSWTWPEGVSLARVRWWHDDAPEQARQVDCWLRAYRDDGGVEIGPGIGAVTVAVSTVSRDDEGETVGTPVTARVAGGGVPVHYRFVQAGTFRRRTRLELTAEQPCPLPDLVVVQSPGRIVPLRADQGTAVVRIPAQRLEPGHPVSVEVPVQSARGPYRLGCFVDDPAGGGSDVVLKGIPGGG

SEQ ID NO: 11111 - protein, 606 aa, Actinoplanes utahensis
MRCSPRWRASRSSPGGTRRPAPACRPRIRRGTGPWPSRSPPAWSRSRPAGCAGPPGPASTATKSSPKASDPPMATFGIDLGTTYSCVAHIDDTGRPAIVKNRPGDDTTPSVVYFESPDNVVVGKEAKAVAKIHPDQVVSLIKRQMGRPFEITVHGQTHTPESISALILRELADAATESLGEPVRDVVITVPAYFGVAERDATRKAGEIAGLNVLSMVDEPVAAALHYDAINTGGTKTLFVYDLGGGTFDTTVIRVSPDEIQVVCTDGDHHLGGADWDDRLAEYLLERFLAEHPGSEAADDEEFLQGLAAGAEDIKKQLSRMQSRRFNARFGGDTAQIEVSREKFEELTSDLLERTVTITRRTLETAAGRGVTDFDDVLLVGGSSRMPAVSAALESLGLTPRMHDPDLAVAKGAARYALIESVKVHLPASGGEAPAEVVDEVAERLNIPAEKVRALAGKRVATVVPRAFGVKVVDLSGGREHFTVTHVLRANTPLPAETEPHRFGTAYPNQVEVAVEIWEQSGAVESDAVEDNEHIAEGLISGLPPLPVGSPIDISFQMAADGLLRVHAVELKTGKDLDIEVQIRGGLTDEQVSAARNAVARYHVSA

SEQ ID NO: 11112 - protein, 230 aa, Actinoplanes utahensis
MPPPSRSPRCPPPSRPPPPSSAPSTTPSAPDQPPATRPAGRVAGWAAMDLTVILGPMKGGKSLEMISLLSPLQHTGIPHRIYQSARHGRDSAVMSRVGGSLDTLKVHTLAGAAEGGVEVIGVDEIHMFTVDDIAELGVAVRRGIKVVVAGIDLDHRGELFAPVRALFELAPEKVIYRRAVCDVCRSLDATHTQVLEHGKPFIRELAPSTPLPDDGTYTYEARCRRCVVLP

SEQ ID NO: 11113 - protein, 359 aa, Actinoplanes utahensis
MLKIVAAVLAATLLTAQPAVAATRDPVRKDLANLVADGFPGALAVVRDEHGRIRRPVAGTGDTATGRPVPADGQVRLGSNTKTFVAVVVLQLVAEHRVRLDDPVERYLPGLLHGRRVTVRQILQHTSGLANYTEYLALDDLSLRYRHFAPRELLDLALAHPDTFPAGTSWAYSNTNYIVAGLLVEKVTGRPLAEQITRRVIRRAGLRHTYFPADGETGIRERHPQGYLTLADGQLFDITDLDPSWGWAAGQMVGTPSDLNTFFSALIHGRLLPDAQLAEMEKTVPAELWPGARYGLGLVSFPLSCGGVAWGHGGDIPGYETRTGVTMDGRAATVAVTTMPATEQAAAAVLGTVDDALCA

SEQ ID NO: 11114 - protein, 730 aa, Actinoplanes utahensis
MADELAAENRAERAGKCPVAHGTASHGGRGNRDWWPNALDLTVLHRNPVVGNPLGGDFDYAEAFSSLDLAAVKADITALLTDSQDWWPADFGHYGPLFIRMAWHSAGTYRTFDGRGGGGAGEQRFAPLNSWPDNGNLDKARLLLWPVKKKYGKNLSWADLMILAGNVALESMGFETFGFGGGRADVYEPEEVNWGSEDTWLGDERYSGDRELASPLGAVQMGLIYVNPEGPNGNPDPLASARDIRDTFGRMAMNDEETVALIAGGHTFGKTHGAGPASHVGPEPEAAPIEQLGSGWKSSYGTGVGGDAITSGLEGIWTPTPTRWDNTFFETLFKYEWTLSESPAGAKQWVPTSPDAEGTVPDAHDPAKRHVPTMLTSDLALRFDPIYEPISRRFYENPEEFRLAFAKAWFKLTHRDMGPIARYLGPEVPAEPQIWQDPVPAVDHELVGAAQIAEIKAAVLASGLTVADLVFTAWASASTFRGTDKRGGANGARIRLAPQNGWAANEPDRLARVLGTLETLRSQLSAPISLADLIVLAGSAAVEKAAADAGVTVEVPFTPGRTDATAEQTDVASFAVLEPTHDGFRNYLGKGHRRPTEQLLVDRAELLTLTAPELTVLVGGLRVLGANHQDTGHGVFTATPGALTNDFFVNVLDFGTVWTPVDSDGELFEGRDRATGAVKWTGTRADLIFGSNSILRAQSEVYAADDAKEKFVQDFAKAWVKVMELDRFDI

SEQ ID NO: 11115 - protein, 60 aa, Actinoplanes utahensis
MPVTTAGRLVAGAAAVFIGAALVILSGSLPADVGNAVYFVLPVTWLAICCGLAGMALSRV

SEQ ID NO: 11116 - protein, 1307 aa, Actinoplanes utahensis
MAADVTQVRTVCGYCGVGCGMVLDVARDAAGHRRVLKVTGDKDHPANRGRLCTKGATSADMLAAEGRLGYALVRAERGAEPAKQPLDRAIAETARRLREIVDEHGPDAFAMYVSGQLTLEAQYLANKLVKGFIGTNNIESNSRLCMASAGTGYKLSLGADGPPGSYDDLDHADVFLVIGANMADCHPILFLRMMDRVKAGARLIVVDPRRTATADRADLFLQIRPGTDLALLNGLLHLVDKDEEFIAAHTEGWAAMPDLLADYPPERVAELTGIPEADIRTAAAWIDGAANWVTLWTMGLNQSTHGTWNTNAICNLHLATGAISRTGSGPFSLTGQPNAMGGREMGYMGPGLPGQRSVLVPADREFTERIWGLPGGTLRTEVGKGTVEMFERMAAGRIRACWIICTNPVASVGNRRTVIAGLEAAELVITQDAFADTETNAYADIALPAAMWSETDGIMINSERNLTLVHPVVDAPGEAMPDWMIIARVAAAMGYAEAFSYADAAQIFEEIKLFANPQTGYDLSGVSYERLASGPVQWPAAPGGPDRNPVRYADFTFATAGGRAVFHARPHLDPAELPDDDYPFVLNTGRLQHQWHTLTKTGKVAKLNKLNPGPFVEINPVDAAAYGIAEGDQVEIASRRGRAVLPAVLTDRVLPGTCFAPFHWNDLFGEYVSVNAVTSDAVDPLSFQPELKVCAVALTRVAAPAPADIPAGLGLDLTPPALSEGQRRYLAGFLAGLPPGRVGAPVLPGNAPFDPDTTMWVNGFLAGMFTDVPDKGLDLPQPAAGPRLQVLWASQTGNAEDFARGLSERLAATGHQITVRGMDAAAAELLDPGADLLVVTSTFGDGDAPDNGAAFWQSIAGDGAPRLDGRRYAVLAFGDSNYDDFCGHGRRLDERLAELGGTRLAPRADCEPDFEDTAAGWLESVITALTAKAVKQPTKAAPLPSVLVGNRLLSGPGSAKEVRRFTFDTGGLLDYRVGDALGVWPVNDPDLVQEWLTVTGLSPDTAVELDRIGMVPLAEALTRHLDITKITGDLLRFTAEVGGDPHLKTLLRPDNKGELAKWAWGRQAVDLIAEQGVRAPAQEWAGVLKRLQPRLYSISSTPLTEPDRVSLTVSVVRFDSLSGRPRKGVCSTHLADAAGDREVPLFVQKAPHFRPPADPATSMIMVGPGTGVAPFLGFLQERQATGASGANWLFFGEQRRETDFYYREELAALSAAGTLSRLDLAFSRDQRAKIYVQDRMREQGAQLWAWLAEGAHFYVCGDASRMAKDVDKALHEIAVNHGRLSPEAATAYLKQLAADKRYVRDVY

SEQ ID NO: 11117 - protein, 383 aa, Actinoplanes utahensis
MAARRSIGIVVNGVTGRMGYRQHLVRSLLAIREQGGVPLPGGGHIWPEPILVGRDPDRLAAIAARHGLAEWTTDLAAALARPDAEIYFDAQVTQQREKAIRQAIAAGRHVYTEKPLAESSEAAEELAELATAAGIRHGVVQDKLFLPGLRKLKRLIDGGFFGRILSVRGEFGYWVFEGDWQPAQRPSWNYRLADGGGIVMDMFPHWNYVLEELFGTVRGVQTTIATHVTRRVDERGEEYTADADDAAYAIFELAGGIVAQINSSWAVRVNRDELVEFQVDGTHGSAVAGLRGCKIQHRATTPKPVWNPDLPLTGRSFRDEWAEVPDNDEFDNGFKVQWEAFLRHVVAGESFPWDFASGARGVRLAEAGLRSAREGRRITLGDA

SEQ ID NO: 11118 - protein, 268 aa, Actinoplanes utahensis
MSRFSFNQITARSWDLPDLVAGCVEAGVGQVALWREPVAEYGLERSAALVREAGLTVTTLCRSGFFQEPDWFDDNRRAIDEAAALGTTVLVLVSGGLPDGSRDLAGARRHVGDAIARLVPHAAAAGVTLAIEPLHPMYAADRCVINTWDQAVAIAEQHPAGQVGVAVDTYHLWWDDTVLDKIAEAGERIAIYQLADWITPLPAGVLTGRGLPGDGCVDMRAFHEAVDRAGYAGPIEVEVMNADLWERPGREVLWAALTAYESVFQRSL

SEQ ID NO: 11119 - protein, 133 aa, Actinoplanes utahensis
MAFDEVLAERIRDQLGDVDGVTGKRMFGGITFLVHGNMAAGVMGDDLIVRLGAPAVAPALAEPGTRVFDFTGRPMRNWIVVDGARLDDEDLARWLRAGVDFAGSLPPKQHEEKGGRDRPGHRRPHRSRLHKDL

SEQ ID NO: 11120 - protein, 181 aa, Actinoplanes utahensis
MKRSLDAVDEAELVRRTAAGDRHAFDELYRRTSPWLAVRLRRRCSDQDVIADVMQETYLAVWRAAGDFAGTTVAGSAAGWLWTIAANRLVDAFRRRARQQQAPTFVPEPAPAAEDEVMAGRVGQELEQALLTLPAEVRQVLRAMVLDGLSVRETSVLLGVPEGTVKSRARRARIALREALS

SEQ ID NO: 11121 - protein, 266 aa, Actinoplanes utahensis
MTGHPSPSVISRYADGDLSLDEATVWTVEVHLEECADCRTRLSGAVPADVLILLDRVSNGVDQGIASGPPPIPLRRRRWSAARHRWLVWHLLPWLGMTAAALGCAVVLQALAPTLPSLVLLLAPIAPLPGVAVAWSRGADPAWELIASTPAAGLPLLLRRTATVLAVIVPVLALISNGVGVSLALTLLPCLAFTTTAIALGAVLGVRLAAISLASAWVAIVAVPAVFVMHLPAILLPGSVAIWVSTIVVAAAFTLSPAIRSRRFSR

SEQ ID NO: 11122 - protein, 266 aa, Actinoplanes utahensis
MRTVSAAETAPTLHPWVVQAEGLRVRAGRHLAVNGLDLALGGGVHGLLGPNGAGKTTLMRALATVIEPAGGQLTLLGESVDGRADLRRVRRGLGYLPQAFGFYPRFTVREFVEYMAWLKEMPKPAVPGAVQRAIERVGLADRADRRMKTLSGGMLRRAGIAQAIVNDPAVLLLDEPTVGLDPEQRLDFRELLRDLGTDSCVLVSTHLVEDVVAACTDVVMISEGRLVFQGTPESLIAQGGPDDAGDSPAERGYSALLRRHRSEAAR

SEQ ID NO: 11123 - protein, 428 aa, Actinoplanes utahensis
MTRILGIELRRSAALGSVLILTAIGVALMFYFEEADWTTGWVQMVMSERLYLALLWPLSLAAGAWQGRRESQSNVAELFASTPRPRAQRAAPTLAVMALAVVTSYLLIALAAGTTLIGRAGYFPAAVPAIAAVGALSMLAGAWFGLAVGRLLPWLITAPALAVAGLGLLLGLPSTSRHRGWLATIFSPIFDMNMPDKYSTVPGRASVSQAIWMITFAVTGALLFAAAGWRTRVAALLPVALGAAVAIAVIPHQDRLIVDSVDPVAKELVCARNEPRVCVSRVHAGLLPELLPQAREALTTLAKLPGTPTRVHEDNSTYVPDVPAPKSPDVALIRIDVNKSGHLDTDLAPRIVAAAFSGRPDCDGSPRQAETLAAAYWLIGRAPAMLADFQDEQDTANAAAEWQRLHALPADKATAQVIAIRAAATRCE

SEQ ID NO: 11124 - protein, 228 aa, Actinoplanes utahensis
MPRASSPLTAGSPARRRLMPSLGAAGLSSRWLMLYLRSRRAPLALALVGAGTVLLWILWVTTSKTRDVDCRMVQVAVLLAVAALTATLGAPDDALERTGAVNWPLRRTVHLLVALLIVVGLLTVTLLTPARFGPASFVLRDAAGLLGLTALGAASIGPARSWFAPLGWTLTAVMFPLGDGTIQQIVTWQAQPSGNAPATVTALLLALGGLVAYANAGPSRRAPAEVPV

SEQ ID NO: 11125 - protein, 342 aa, Actinoplanes utahensis
MTSYAAAAARYDAMEYRRCGRSGLKLPAISLGLWHNFGDDKPIETQRAVLRRAFDLGVTHFDLANNYGPPYGSAEINFGRLLAEDFRSYRDELIISTKAGYDMWPGPYGDRGSRKYLTASLDQSLRRMGLDYVDIFYSHRFDPETPLEETMGALDAAVRAGKALYVGISSYSPGKTAEAAAILRELGTPLLIHQPSYSMLNRWVEEDLLGVLEREGAGCIGFSPLAQGMLTDRYLNGVPEGSRAGEQKSLTTDWLNDENLGKIRALNAIAERRGQSLAQLAIAWALRDPRMTSVVLGASSVAQLENNLAALGNTAFAADELAEIDKYATESGINLWARSSDY

SEQ ID NO: 11126 - protein, 160 aa, Actinoplanes utahensis
MMSGLDSRLPAMLFLAAGQLKISATSKLHKARNRAASPALVGVNDWRGPAVSVPLYQAKAEMFRTLGHPVRIRVLELLQDGPRPVRDLLAEIDVEASNLSQQLAVLRRAGIVASFREGALVMYALSTPDVADLLAAGRRILGAVLTDRDGLLVELRSQKR

SEQ ID NO: 11127 - protein, 123 aa, Actinoplanes utahensis
MPDMDVALKDAMQIDGAIGVALVDRSSGMALGVAGGDRNFDLTVAAAANTEVVRAKLRTMEMLGLRENIEDVLITLESQYHLIRPLTGRSGQGLFLYLALHKERANLALARHQLKRIETNLDI

SEQ ID NO: 11128 - protein, 237 aa, Actinoplanes utahensis
MSPRCSATRTPAAEPTGCAHSLWITRTCVRTAARGWQDVRVSPNELRPAYPITTERLLLRPLTEADTEALLSYRSRPDVCRYLPFEPMTPEVIADRLATYWAATVLTDEGQSLTLGIEHAETGRLVGDVILFWHSRRHRGGEVGYVLSPDAVGQGYATEAAQAMLRLGFEELGLHRIIGRIDERNEPSARVLRRLGMRQEARLVHNELFKGEWSTEVDFAILSDEWFAKYPDSSRSV

SEQ ID NO: 11129 - protein, 338 aa, Actinoplanes utahensis
MRLTMLRRLYERPGPWASVYLDTSRDTADAARLIEQRWHAAREILAEAGCDPLTVHALEDAVLDHPARPGRHGLALFATAGEVILRQALHAPPATTISAYEPLPDAMPMVAQLAGEIHYLRVAVAPSGTAIDAAATGRLIPGGGWSPPLTDLTWRAGAGDPADAVTELADRTGPELILVAGAPQARPRLVTQLPDRWRERVVETENAVPVQAMTDCAEALRRDTLARLHAQLAHDGSAGNGLSEVVSYLSRGQVDTLLMIDDPSSTERLWIGPDPHQLSDDPEELRSAGAAHPPLVRADAAMLRALAATDASILLCDPDEHDLRGGVAALLRYADARR

SEQ ID NO: 11130 - protein, 199 aa, Actinoplanes utahensis
MTDVFGAVVPGRPTGVLADVWGRSAVRDLLLIVGAAGAVGAAAQIAVPVPGSPVPITGQTFAVLLAGAVLGPGRGAAGMVLYALAGVLGVPWFAGGTSGWPVATGGYLIGFIVAAALVGQLAALGADRRPAYTIGLMLIGNLLIYLFGVPWLALMTTMDVPGAFCHGLVPYLMGDALKIALATALLPGAWALLNRKRPG

SEQ ID NO: 11131 - protein, 647 aa, Actinoplanes utahensis
MKSRTPVVVAAVAATAVASVAVAVAGPATAQPNVAASPAAAAASAASSLFAARPAALHAAADEAFVQHDVISTDHLQYVPFDKTYKGLPVIGGDGVVVTDLAGQVKFTSTAQSSPLGAVNTTPALTAAASLKVAKGQLKTVTTVEGTRLVVLATTGTPALAWESTIRGTNAGGPSRLTVDVDAATGRVLRTHEHVTDVTGTGNGWINGTVSLDTTLSGSTYSMTDPTMTTLKCQDAASNTTFTGSDNVWGNGTGTNRETGCADALYVAQREKAMLSTWLGRNGFNGSGGGWPLRVGLNDQNAYYDGSQVQIGKNTAGQWIASADVVGHELGHGIDDNTPGGISNGNTQEFVADTFGASTEWFANNPNDPPDFQVGEEVNLVGSGPIRYMYNPSLAGDDNCYSSSIPSEEVHAAAGPGNHWFYLLAEGTNPTDGQPTSTRCSGSGAISGVGIQNAIKIMYNAMLMKTSSSSYLKYRTWTLTAAKALDSSCGLFNTTKAAWDAVNVPAQSADPTCSGGGTGSPSPSTSTTTPPGGCSATNDTDVSIPDAGAAVYSNIVISGCARSASATSTIAVNIVHTYRGDLRVDLVAPDGTVYNLKATSGSDSADNVITTYTKNLSSEAANGTWRLRVQDVYSQDTGYINSWTLTV

SEQ ID NO: 11132 - protein, 191 aa, Actinoplanes utahensis
MGVVRSSRWVPVAGWFVATATSIVLSWVALLPVLNAARADAGALPEIDQVPAADVRTPLPSPAVTPTTPAPAPTSPSAKPSRKPSKSPAAVPTGKPSTTNENGWTVTTDGAGVRTYVRSFSLKGGQAVIRMTSEGVVSLVTATPADGYAVEKTQSSPGDMAVYFNETAHSFIIHAIWYNNAPYAQVDEIGS

SEQ ID NO: 11133 - protein, 260 aa, Actinoplanes utahensis
MLVAVATNQPATGTHREDRTTPILSPGPMVYAMALILLVEDDRNIAAALTRALTDAGHVVRAVGQAAQALKIVTQERPDLVILDLGLPDIDGTDALRMMRTVSDVPVIVATARRSEADIIALLSAGADDYVTKPFSGGHILARISAVLRRARTTTEQAPNAITVGELVIKPRQRRAELRGEPLQLTRREFDVLAYLAERVGQVISRRELMNQVWNQARIGEEQTIDVHISWLRRKLGETAAKPRFLHTVRGVGVMMVDPQ

SEQ ID NO: 11134 - protein, 472 aa, Actinoplanes utahensis
MEPGPDRRGADHRRAHLLAAPQARGDRRQTAVPAHRPRCRRDDGRPAVRWALNRLALAITSMVALAFLVPLAVAIWQIAHDKAVSEARQQATSMVTVLGVNADPTALTNAVASTSAGSAGLLAVHLPGLDPIGTSHLTATTVESAAKQRRSGTVAAAGGVAYLQPTVLTDGRTVVVEVFVTDDEMRRGVWSAWLALGGLAVLLVGGSTLLADRLGAQLVRATRQLAASTRRLGAGELGERIEPTGPRELRDAGQAFNTMAGDLRRLLDRERELAADLSHRLRTPLTALRLDAEAIPPGPIADRMRDACDLLDEELDAIINGARLGVEERGKEQCDLVEVLADRLAFWSVLAEDQERPWEVVGGHEPVPIPLSMSDVILVVDAMLGNVFSHTDEGVAFRVSVSSTGLLVDDAGPGIDDPEAAVRRGHSGAGSTGLGLDIVRRAADNVRGQLIVGRSPLGGARVGLLLTSPAGS

SEQ ID NO: 11135 - protein, 280 aa, Actinoplanes utahensis
MAALPNVSPGKRARTKCLETDMRRKIAYPLAILGMAGSTLVITSPALAHGYVSSPPSRQAQCAAGTVADCGAIRFEPQSVEAPKGSRECNGGKADYTVLTDDSRGWAATSVGTSVKFSWVLTARHRTASWVYYVDGTAVATFDDGNAIPEATVSHTVNLGRFPGRHTVLAVWNIADTANAFYNCVDLNIGGGAPSTPAPTPTAAPTPTAAPTTAAPTTAPTATSAPASSAGSGTKWAPGVSYKAGDVVTYQGVSYRCRQPHTSIHSWEPSGFTLALWLPL

SEQ ID NO: 11136 - protein, 216 aa, Actinoplanes utahensis
MPPAAHVDPQLGAVRVHSRPLAAAVRRHVVAGALLLSLAACGTAPSAPAPSTPSASAAAAGATFNARDVMFLQMMVDHQQQGLRLAAIGAGRASRPDVANLARAVDLTETDELTMMKSWLTGWGRSTQVDKRVSVHADHGGLPSTTDAEIESLKTVKKADFETAFLNLFLAHQHNAVEMAQLELDTGANEQTRQFAERVKESRADQVQQMLRLLNG

SEQ ID NO: 11137 - protein, 356 aa, Actinoplanes utahensis
MQVMAGLLVGALLVAPTWDHPGYDAEDSYFNPSAIAVRQLTPTWSASLRQVDESCSGFSAPIVGDDQVYVTDREGVSSYGLDFGDLRIRFTWDYAYDNSTPRMALAGGLLILADDDCNSASAPHGRLTALDPATGRPRWDHTVGPIVSALVDKNVILVSGSSPSDEQSVAAYRVSDGHLLWSRVDYASSGVSANGVVPLEKGDTTIAVGVSTGTVRWSRPSPARVQAASPHADRFYATDGSGALLALDAATGRTVWTAAGRASTLVAADGTRVYLASGSTVTALSAATGRVVWSRKLSAAAGQPVVAAGVVYTGSRILNAATGVPTGRTLAGLVTPAGDRLYQVDGARLTAYGPVA

SEQ ID NO: 11138 - protein, 278 aa, Actinoplanes utahensis
MELLHSGKVRDVYADGGDLILVASDRISIYDVILPTPIPDKGKILTQLSLWWFDQLSDIVPNHVISSTDVPQEWAGRAIRCRRLDMVAVECIARGYLAGSGLKDYQRDAAVSGVPLPPGLVEGSRLPEPIFTPSTKEAVGAGHDQPMTFEQVVEQVGKDQAEELRRITLEIYRRGSEIAAGKGILIADTKIELGLADGELILGDEVLTPDSSRFWATEEWAPGDVQRYLDKQVLRDWATRETDWDRTEPGPDLPEHVVQATRGRYVEVYERLTGDRWS

SEQ ID NO: 11139 - protein, 98 aa, Actinoplanes utahensis
MLEPREEREFDGMVARLRDADPGFTRRVDRIHPRQRRRWLILTILLWTIAPICLLYGGWTGALEAVLAAAYGGWLLRKRRRAADAPSWPSSTDRRPTV

SEQ ID NO: 11140 - protein, 203 aa, Actinoplanes utahensis
MDTLSEARSSLTPEGRSLLFTDARTASFFAPTPVTDEELREIWELAKWPPTQANTQPLRVLFVRTADGRERLIKHLAEGNRAKSQSAPVVAVLALDTEFHEHVPQVFPHNPGLKNLFEGNVDKRIADGTFSAALQAGYFIIAARAVGLHAGPMTGFDKAGVDAEFFPDGRFRSLAVVNLGHPAENAYRDRLPRLDHETTLHWA

SEQ ID NO: 11141 - protein, 106 aa, Actinoplanes utahensis
MTAVEETPAAGLARAFEFLGRRWNAEVLGVLEGGPAGFRELSRAIDGISDSVLSNRLSCLTKAGLIARDVEAGPPVTVSYSLTAASRALMPALGQIARWADQHLPG

SEQ ID NO: 11142 - protein, 60 aa, Actinoplanes utahensis
MTGAVTVAAIVGLLSLFSGVALGWYLRRTNDWCPTCGEQLTCGDCKMSVHWPEQATASQH

SEQ ID NO: 11143 - protein, 99 aa, Actinoplanes utahensis
MSSWMTSTPTVTPPQRDPADVAPAESYRPADPVWVYRDGWRAGVIEAASPRAVTVTYHPGTHRGTGVDTFTAPYVTSREDDDPMLDNRGLRLVRRRPLA

SEQ ID NO: 11144 - protein, 296 aa, Actinoplanes utahensis
MSEATQEDAAGGGPTVLRILLGSQLRKLRESKGITRDKAGYEIRASGSKISRMELGRVSFKERDVADLLTLYGVESPAEREMLLSLARQANSPGWWQQLNDVLPSWFQAYLGLEAAASLIRTYEIQFVPGLLQTPEYARAVIMLGHAGASAEEIDRRVEVRRQRQQILTRPGGPQLWAVIDEAVLRRPIGGVAVMRAQIEALIEASKLPSVRLQVIPFTAGGHAAAGGPFSILRFPEPELPDVVYVEQLTSAIYLDKREDLDQYAMAMERVCIDADPPNDTPEILGKLLHEVGRPL

SEQ ID NO: 11145 - protein, 78 aa, Actinoplanes utahensis
MTYVVNGMPAGQLQGVTWQKSRRSNPSGNCVECAVLPGGDVAVRNSRDPEGAALIYTRAEIEAFLGGVRDGDFDNLVA

SEQ ID NO: 11146 - protein, 129 aa, Actinoplanes utahensis
MSPTRVSELVRCHGHRSVAHPHARSRWMASAPRVRDDRLRPSRPRWPVHEFAEADYCYGIGPIRLRVVRVDRHRPIPHEGEVWLAVQGIVVDPDGREGAVREVLIRAGCVPVPPVGKRTRLRVLRDTPV

SEQ ID NO: 11147 - protein, 317 aa, Actinoplanes utahensis
MIGWSPAPASWAASTTSRPPNDQASGLGWTDCRRSTVRRKEAVVQDGDNSAPHEVAPPGVNINVPHSARIYDYWLGGKDNFAVDRAVGEAMIQAIPGMRYMAGENRKFVHRAARDLVAKEGIRQFLDVGTGIPTRPNLHEIAQKIAPETRVVYVDNDPIVLVHARALMLSSPEGRSEYISADIRDPRSILDDKVLTDTLDLSKPVGLTLIAILMLLADDDDPWGKVAALRDAMPSGSCLAITHPTADFNPDEVGRAVAAATGAGMTLVARTRDAVARLFGDWELLEPGLVPVSSWRPDIEADDPQAAYYWAGVARKP

SEQ ID NO: 11148 - protein, 524 aa, Actinoplanes utahensis
MDAETLSAVLLTIEDRRSWDATAELARTIDLERIAVGLGDELLAARARLCQINMRMRCGDVARAAEEIWHVHQWAVDHDARRLLARTHLVWVTIHLHLGDAEQGLEHAVLAVELLDDSATEHMQVWHRTKLADALYFAGDLDAARERYTQAEQMAQHLQSPALTSVLNNFAYVEASTGNRERAEALADRLQQLSAESGIPLEPAFLDTIGSIQVSNGNYAAAAETMRICIARHAEGKWDDANDMAQYLVTLAQAQRGLEELAPAQASLDEARRLCIERDLGESLVRVLQEQAELFAAAGDFAAAFHAHKNFFEMHHQQQSLQKEARARTRQAMFETTEARQEAERFREQARRDPLTGLHNRRYVDERLPGLIETDRSLAVALVDLDHFKQINDLLSHDVGDRVLVQVAQVLAGEVAAACPDGFVARMGGEEFLVVLPDTPVRRAATVLDAIRRAVRGQHWAPITSHLPVTVSIGIAGVGEPATPGQAPLLSIADGRLYAAKRGGRDRVVSGAGLLGCVDHFSAA

SEQ ID NO: 11149 - protein, 524 aa, Actinoplanes utahensis
MSASRSEPGAMTHREILEALSGLLLVLFVAMSSSTIVSTALPTIIGKLNGTQTQYTWVVTATLLTATASTPIWGKLADLYSKKLLVQISIVVYVLGSIVAGLTQNTEQLIAARAFQGLGMGGVQALVQVAIAAMIPPRERGRYNGYLGGVIGLATVAGPLLGGIIVDTDWLGWRWCFFIGIPIAIVALIVLQRTLHLPVVRRADVKIDYLGATLIAAGVSVILVWVSFVDNSFGWLSWQTFAMVGAGLVLLALATLVESRAAEPVVPLPIVRQRTTALAILGSLAVGMAMFGGAVFLGQYFQIGRGYSPTKAGLLTIPMMFGLALASTIAGRLITRSGNIKPYVVTGTLVLVAGFGGLSVLDHDTPLWYVGIAMFLVGAGVGMSMQNLVLAVQNTVALRDIGAASSTVAFFRSLGGTIGVSVLGAVLARRVADSMTDQLSALGVPAGQSSSGVSALNLGSLPPAIQHIVRVSYGDATGHIFLISMAIAVVGVIAAVAMKPTKLRSTVDLAAPAATPEPAALGAK

SEQ ID NO: 11150 - protein, 206 aa, Actinoplanes utahensis
MQVAGRLPRMSDDGGLRERKKAATRQALHEASLRLAFEHGPDRITVEAIADEAGVSRRTFSNYFANKEEALFYGDLQRMRLLAGKVREQPAGTSPWEALSSAAEAFYGELGDLDPEWIARSRLVRRHPSLAATQVQTFAALEQGLADELAARLGAADPIGMRSRLIAATFLTVLRVSLNVWLERRPDLTFWDLARDAIADAGRGFA

SEQ ID NO: 11151 - protein, 479 aa, Actinoplanes utahensis
MQRSRMRLAIYSSAALLAVGGGIGAAFAATDGGTGSLTASFAKDSDWGTGYQAHYTIKNGTDAPVNGWQLVFGLPSTAKLGSVWDAAVTTSGNVETVTNAAWNPTIPAGGEISFGFVVAGKGDPASCTINGASCTAGGATAAPTVTATATATATAKPTATPTRTATSPAPTRTATATPTATGGTGSASGVLVAPYVDMGVLSNGGTLSALAGGGNVKSFSLAFVTASGCKASWFGAFDPRARQFADQIGAIRSAGGDVKVSFGGATGVELAQACTSTSALQAEYQAVVDAYDLKYIDLDIEGAASADTASINRRSTALAGLQKANPGLKISLTLPVLPEGLTADGLNVVKSAKNAGVDLDLVNIMAMDYGRSGQDYGDLAIQAVKSTKDQIRSIYGNSDAAAFKMVGVTPMIGKNDDSGTFSQSDARDLVAFANANHVGFVSFWEMQRDKNACQGALFQCTNISQTAFEFSKIFAGFKG

SEQ ID NO: 11152 - protein, 185 aa, Actinoplanes utahensis
MATRLRADARRNRAALLTAAREVFAEQGLDASLDEIARRAGVGNATLYRRFPSRRHLIAEVFAGHMTAAVRLADQALEHPDPWAAFIGYLSRVCELQATDRGLAELLVTDAFDDDERLSALRAAAQQRAVDVLTRAQRAGRLRADFTRHDLWLVMMANAGVNRHATEPHAWRRQLALLIGGLATR

SEQ ID NO: 11153 - protein, 248 aa, Actinoplanes utahensis
MQQTSIDIPAADGPADGYFVKPDGPGPYPGILIFMDGFGVRPRLREMADRIAERGYAVLLPNLLYRDQRSPLVDPAELADPEKRGAAFGRLMPMMQNLTAPRLVADVTAYLDFLAAQEGVAPGPVGAVGYCMGGRNGLIAMSALPDRIKVLGSFHAGRVVTGDEHSPHLGVGAITGEVYFGHADNDASMTPDQIKTLEAALDEAGVTYTSELYEGAPHGYTMSDTAMHHPAGEQRHWAALFDLLDRNF

SEQ ID NO: 11154 - protein, 116 aa, Actinoplanes utahensis
MDVVDFWVRSWTSDDLAAARRVLSPHVEVEWNLDAPVDDEELLQVLHRIAVFADHVALTARTDALDGAALIYDLTAPFGSARLAEFLAVEDEKIVEIRHVYDVTAIDRYFPGLYAN

SEQ ID NO: 11155 - protein, 543 aa, Actinoplanes utahensis
MRAKKVTRRTLIAGGGAAAVAVATGVGINAVQADAASTAPATGSVITKSGRGGPGAGAAKTLVLYDTTGDYGWLGEVYATQTANLSSRFGSWTAAPVARYKAGDLSAYTAVIYLGSTYDEPLPAAFLTDVMATTKQVLWVYDNIWQLAAKDGFAAKYGFASGTFDFADVTEVDYKGRKLTRGTENKSGIMNLSIGDSAKVTTLATAVRADGTGFPWAVRSGNLTYVGEIPFAYVTHDDRYLAFADLLFDTLGGGTTERHRALIRIEDVGPDADPEQLTAVADFLFAEKVPFSVAVYPRFRDPKGVGTGKAQDYTLLNKPKVVAALKYMQARGGTLVMHGYTHQYGSVANPYDGVSANDFEFYKAHVDAGDNVVYDGPVAEDSAAWATGRMMSSGAVFLAAGLGSPRLFEFPHYAASAPDYEVVNALFGKRYDRGLYFPGVLTGARFDYSRQFGQFFPYPVRDVYGSLVVPENIGNVETEAFNNHPVRLPADIVASAQRNLVVRDGVASCFYHAYLGTDHLKDLIGGIKAAGYTFVSAESTLSA

SEQ ID NO: 11156 - protein, 562 aa, Actinoplanes utahensis
MRPLPGLAVRLRQHRPDRAGRDPALPGLAVGERGGRDAAHADRHGRRAGPADRAPGADPAQLVRPGREPRHLGGGHHVPRPGLGAGAPGQARRRGTPPDAARRPGLPGVPAARPDRDLSRAGPPADRQAGLGQDRAARRGAARPEDRLISRRRPTIPHRQQVKEGSPRMSLREVHLIGGTRPEAVKLAPVALAFREAGLLKPILLASGQHPTMVTQALAAFDLEPDITLTVERSTGTQAELLTAMIQQLDELWSVRTPAAVIVQGDTTTSLAGALAAFWRRIPVVHLEAGLRSGDLESPFPEEGNRRLVAQVAALHLAPTPLAAMNLLDEKIAASDVLITGNTVVDATLAVAARRLPYENPAVAAARAESTKRLVLVTAHRRESWGEPLDRILGAVNELLAKYPDIEVVLPSHPNPAVRAQVDAALAGAERVTVTDPLPYPDLARLLSEAYLVLTDSGGIQEEAPSFGVPALVLRDVTERVESLHAGCAKLVGSDPAVIVAEASALLDSRDRRDAMTAGGNPYGDGLAARRTAQATAALLGLATAPDAMPVRPSATEIGATA

SEQ ID NO: 11157 - protein, 31 aa, Actinoplanes utahensis
MRRTIPGCGRKVEVAVTHGAFPATEKAATVR

SEQ ID NO: 11158 - protein, 190 aa, Actinoplanes utahensis
MRGGLDDALDKLARRDELRRRAAAGEAPGTPPAVTELVEAIAGVIARFPHLGVTVGVEGAGDPVLLHFGFADGTVQVTADRTVVERTAAEPARAHADIEIDLDDPEPPPRGSHDDQDRFGPTYDEPPTAERPFVTPPAPAYPPPPAAYAPPVEPAPQPKPFHAERAAEETEQAARRLAALLRDNPSLLDD

SEQ ID NO: 11159 - protein, 209 aa, Actinoplanes utahensis
MDFDPSANRVVATARIPGGAAPAKKAPVPVKIIVAGGFGVGKTTTVGAISEIAPLTTEAEMTSESIGIDNVGQATTKTTTTIAMDFGVLTIDQTLKLYIFGTPGQTRFAFMWDDLVKGALGALVVVDTNRIDDCYPAVDYFERAGLPFVVGVNTFNGNMAYSLDEVRWALAVREDVPVISYDARFRASVRDALLVVLDQALDKAIKMKS

SEQ ID NO: 11160 - protein, 148 aa, Actinoplanes utahensis
MTSPYPTAQSQLSAEAKTFNWLLDSFTSGTAGVIEAIAVSSDGLLMAMSAIKDRPNAERLAAVVSGLTSLAGGAASWYRLGALNRVIIDMADGYLLVTAISAGSVLGVIADRSANLGTLAYEMTLFATRAGGALSPRLIAELKNAVQQ

SEQ ID NO: 11161 - protein, 1176 aa, Actinoplanes utahensis
MTCRSGRVPRCRPATRRAARTTRSRTTATLRTTAAGGSVPVLFGKFRILGKLALLVLVPLLGVLALTVPIIYNRVQAANEAQDTSDSVQLATAVSSAVLELQEERLLSVGYTLHLVDEPTLVVQSAEAGEKVAELLDSKDRVLPADLRRAVLLATKLNSTRQNVLNGQTNATSIVTDFTSVITPMIDGLGLSNHSDLTTKTGQQVFALERSMRSDDLISQASCYLAYAAVLNQAPNRKLRSFAPQVLTLFNNSFAQIQSVITQSKGYFTDAQYKLYLNTQDAFQSRVGSGFVDGLATNPAQALNKLPSITSLFPSLQSVMVLGGFVEKRVAKDVDVAVTASRNSAIQQALYVGGGAFVLLILVVTLSIFMARAVARPLRRLTASADRIARAAEAELERVADDESEAQVRPIRLDPVDVEAQDEIGDLARAFDRVQTTAARLVERQVLGRRNVAQMFGHVGRRTQNLVGRQLSLIDGLERRETDSDRLRELYRLDHMSSRLRRNASALVVLSGGAGANEHMAPLPLSDVVRLALGEIEDYTRVEVDVPEEIVVVPAILADLTLLLAELLENATTFSPPHTSVTVSADELRGGARLAIIDHGLGLQPERLAEENARLTRRERLDLAPTEVLGLFVVGRLARRHGIEVTLTDTPDGGVTAWIDLSPQHLIARVENLAAPGIPAPAAVPQIPMQREPVAQQSYPQQPFEQQYGQPEYAVPVSGALRGNTAEVAIASTAIRTVPGSQQPFDPNKLSRATQTLESVPSWNAFGGSVPAQPAVEDPYAGQPVYDAEPVYSPGVAYQEPSAPYRQVEASQGYNSGIPVAGRNPAALPELPAAGQPAWGSDPALPAGPSWSGTPAPSETSWSVPESPASGWNTPAPASPSPAWNTPAPASPAPAWNTPAAASAEPAWNTPAPAETHWNSPQQPAEPAWNTPAPAVEAPMAPASNSGHPAPAPEPTAPEPVVSSPAGGLKPLRRRVPGSQLPMDSGPKQHAAAPSQDDALAARAAFDAFEQGVSRAHETSTSLPAPEFAGGQWAMPASLPEMPAPQWNVPAPAPEAAPQWSTPAPAPEAAPQWSTPAPVQEAAPQWNTPEPAQQWNAPAPAAPPAPAAPAPPLGGGGLTRRVPGATLPRDEPHQPILPPAPTLMDPEQARALMDQFEYGVALALNETQPQPEGQPR

SEQ ID NO: 11162 - protein, 387 aa, Actinoplanes utahensis
MSVSVNSRRTRLRSALAVLLTALVLLPAAGLFLRVLQENSQQRDTVQLEQDGVEYLTVLGPLVSALAESQASALQGVAAEPASVTAAVARVQGVDGRLGDALETHSRWSDLKDKIAKLPKVTGTSEQIFTAHVEAADLAVELFDVVRENSRLNRDPEADVSFLQEVVGQLMPEAVTFVSRMSDYANMVPAARTKADKAKLTVQFGYQALKVQETVAKLTDSLQEAVESTKSTTLSGNLVSNLDSFRRGIEAANRGANIGGAPNVSTLVTAQSTLQTALSALSGVVLKEMSGRLDDRSSSLTYKRIEAFGLLGIAIVLIVVATLWTRGRARQVQATLVEPGQGSRDVSVRAGTSVPAGNPTGSPYDSIPNYGDTPNYGGGRERSGALR

SEQ ID NO: 11163 - protein, 556 aa, Actinoplanes utahensis
MGRIDELANRYVDEWAALNPTGATAAGITGHDDQTDDLSPEGFAARAELVRRTLNDLDVNEPEHETEQVAKEAMQERLGLELARLDSGIAATEVNVITSALHELRMVLDLMPAEGEQAVANIVTRLAAFPQALRQYRRTLLEGADRGVVSPSVQLAAVADQCAAWADPDRDGFFHGLAGRLQASGGLAEDLRRGAAAATAATADFGRFLREELAPRGRAKEAAGLERYTLASQYFLGAKVDLLETYHWGFEELHRLTREMQAVAAVIAGPGASVDEAVAALNADPARIIPDKERFRDWMQALSDRAVSELNGTHFDIEPPAQKLECCLTPTSDGGIYYTGPSEDFARPGRMWWAVPAGQQVFSTWQEVTTVYHEGVPGHHLQVSQTLLRADQLNRWRRLLAWCSGHGEGWALYAERLMDELGYLTDPGDRLGMLDSQALRATRVIIDIGMHLELEIPRDNPFGFHPGSRWTPELGWEFLRAHSRMQEDVLRFEWKRYLGWPGQAPSYKIGERIWLQARAEAKQRKGADFDLKAFHRDALDLGPLGLDPLRRALGRI

SEQ ID NO: 11164 - protein, 352 aa, Actinoplanes utahensis
MASRDPVTDLRRIAFLLERANEATYRVKAFRSAAAAVARTPGDELTERAAAGTLAKLAGVGEVTARCVTESLAGEEPVYLRRLLSIEGADLPAAAAALREALRGDLHVHSDWSDGGSPIEEMALAAADLGHEYFVLTDHSPRLTVAHGLTAERLRRQLDHVAALNAQLPDGFRILTGIEVDILEDGSLDQEDELLARLDVVVASVHSRLRDDTARMTRRMLTAIANPHLDVLGHMTGRKVAAAGAGDAAHRTARTRPPSTFDLEKVLAACVEHDKAVEINSRPDRLDPPKRMLTVAVEAGCRFSIDTDAHAPGQLDWLGNGCERAALCGVPADRVVNTWPAERLLAWAAAHG

SEQ ID NO: 11165 - protein, 617 aa, Actinoplanes utahensis
MPTALRAAVSVVMLAGFYLLGLAQLVLVGWLIFEIWQHLHGAGAVKLSYLLLAAVGAVLAGLWRAIRAKPGHPHGLIVTPDQTPELWHQVRQLAAEAGTRAPDEIRLVPEVNAAVDEETRLLGLIGGTRRLYIGMPLVQTFTVDQLRSVLAHELGHYSGSHTRLSAVTYRGRLAMHETLSNVGSFNVFGWVFKAYAWLYQLVSSAVARRQELEADLASVRVAGVDAAVSAMRELPVVDAAWDFYFGRYIGYGWELGYAPDDVFGGFAQLYQARADELAEMREAEPDDETSRWDSHPALSERIAAMRAAPRTSHVTDGRPAAVLVPAVELAGMALQREVVDFGTRTVLPWADFTAASMAMRSQNRADRVFRSTARHAGVPEAGLPEVFGLVEAGRLADLATEFFPQATRREAVAEFADVMETLLGLAAVRSGTARWQHSWSGPARLVDQTGQVLDLGEIAKLAVVPETLAEARARLAERGVHVEAARVVEAKATGQGADVLGAVPNVKLDGGEHADLIVLDRGLIFVPAPKSTDDGDKRVGVLVAQNSAADLAARYRYVAYEEVSTVRIEKETPIGATLLLHDGRTVTFQERWSSDRMGRSVDVLRKILGELQERADR

SEQ ID NO: 11166 - protein, 320 aa, Actinoplanes utahensis
MRTIDWVDGAVEIIDQTALPGELRVLRLHTVGELIAAIQSLAVRGAPALGVAGALGVALAAQVHADDPGALANAVRRIETARPTAVNLARGAQRAAARLPFGPAAVLAEACVLRDEEIAASAAQASRGADLVAELCGDRPRLLTHCNTGGLAAVTVGTALGVIGELHRRGTLGGVIASETRPLLQGARLTAWELGQWGVEHRVAVDSAGPFLMARGEVDAVILGADRICANGDVINKIGTYAHALGARRAGLPFLVVAPETTVDTGTPSGADVEIEDRGAAEVTAWSDAVNPAFDVTPHDLVTAIVTDRRVIRLDRGEKP

SEQ ID NO: 11167 - protein, 189 aa, Actinoplanes utahensis
MPGQVGPISGEQDGLLSFLTQARYTLKLTAYGLTPEQLRATASASSLSIGGLIKHCVSTEEGWIATATGASQKPDFAAYHENFVLTGDETVEELFARYDRAAERTEKAVAELGLDHRIPVDHSVPWNRPDLDHFTTRWILLHLIQETARHAGHADIIRESIDGATAFPLMAAAEGWPETPWLKPWKKDS

SEQ ID NO: 11168 - protein, 313 aa, Actinoplanes utahensis
MRIAVVGLGLIGGSLARALRDAGHEVSGFDTDPATRELARAAGLTVPGSVAATVAGTEVTVLAAPLPVLPGLVAELAGYDGVLTDVTSVKGPVQALAERHGVRRFVGGHPMAGTEASGFAAADPKLFEGCVWVLCVEPDGTDPADWLILAGLFTGLGARVLPITAVEHDNAVAAVSHVPHLLAAALATTLAGSPLRQALAAGSFRDGTRVAATRAELINAMCAGNATEVLRELQQVISDLVQLRDDLAGGDLIPFLAAAGELRRAWPPTPGSPGRTTADVRALLALGRGGGWVTAVVGTELNTMRPETGRNGF

SEQ ID NO: 11169 - protein, 212 aa, Actinoplanes utahensis
MRKALTMIVALGLAVAGATTASAAVTPRPAPAPAPRVVPAWMFTSKYTFPVAASNVAWHDTHSAYPATDIFAACGSTVVATDNGRVLEISLVDRFRKGMPDGPYNGGLFVSILGNDGVRYYGSHLSSVTKGIVPGALVKSGQQIGRVGHTGNANGVCHLHYAISPPCAQTGDWKVRRGVVWPYSFLASWRGNGQKSPVDTVAAWNKSHHCKA

SEQ ID NO: 11170 - protein, 109 aa, Actinoplanes utahensis
MRVHGLYAGLPPRPIYREPHPIGAGPVLSGLAAGALWLLLFGSLGQDLTSYAWWTIGAAAAAWLVALVLTRLGDRGVALGVACSSGIGLSVAMGFVAFRWIETFNFPLW

SEQ ID NO: 11171 - protein, 67 aa, Actinoplanes utahensis
MTNAARLGTLGTMATSPQRLDADRCRRRLELLAALAHAKSVRESAPPRRARGMRLRELIATRRRTTN

SEQ ID NO: 11172 - protein, 172 aa, Actinoplanes utahensis
MSIFAAAVARGKNGWTASELDLSGLADIDEVVDALRDAEPDAGLALLFVESDDEYLAILRLDEGEDLRVFGSDSAFAEESRIGSVLLGEVETPALGADDLTAGDTAEDEDDRPAADPDADPIGDADLLNDLGVGAQRLLALCGQEGMLPSDITAEICQKIGCGDEMEELREA

SEQ ID NO: 11173 - protein, 148 aa, Actinoplanes utahensis
MIRRERHERWMRRALSVASSSPADVPVGALVLDPDGAELAAAGNERELTGDPTAHAEVLALRRAAAARGAWRLDGCTLVVTLEPCTMCAGALILARIGTVVFGAWEPKTGAVGSLWDVVRDPRLTHRAEVYGGVLEPECAELMRGFFR

SEQ ID NO: 11174 - protein, 235 aa, Actinoplanes utahensis
MSVHIGAKPGEIAERVLLPGDPMRAKWIAETFLEDAVCYTQVRGMLGFTGTWQGQRVSVQGSGMGMPSASIYTHELVNEYGVKSVIRIGSCGALALDLNLGDVIAAIGSATDSNMNRTRFDGLVDYAPVADFGLLRTAVDTAAAQGVPIRVGPILAADAFYTDRPDLYDSLAQYGVLAVEMESAAIYTIAARYGAKALTILTVSDHIKRGEAMDSAQREQGFSNMVRIGLDTIIA

SEQ ID NO: 11175 - protein, 139 aa, Actinoplanes utahensis
MLLLGSAILTLGVAACDDGSVEGPYLKSIEIRGHERATIYYSQAVYVGPSTPGLLAAVSAPEMTTSAGPASLSIDPWEFVGSGSGKAADGTDCRVHFERLVKGGDPNVPHWEPTAEQRRKQATGELEIVRVSAGCPFKP

SEQ ID NO: 11176 - protein, 113 aa, Actinoplanes utahensis
MRATITEHRPDVAVLHLRGELDADTSNELRVVLAELLERPVPRIVVDLTELKFCDSIGLSTFIISKEVIVARGGWLSFASADPFLTKLLRTVGLSRYFAIFPEVDDAIAAGQL

SEQ ID NO: 11177 - protein, 1175 aa, Actinoplanes utahensis
MALALYRKYRPRTFAEVIGQEHVTEPLSQALRSGRLNHAYLFSGPRGCGKTSSARILARSLNCEQGPTPEPCGVCASCRSLANDGTGSIDVIEIDAASHGGVDDARELREKAFFAPASSRYKIYVIDEAHMVSSAGFNALLKLVEEPPEYVKFIFATTEPDKVLGTIRSRTHHYPFRLIPPATLRPYLQQLTEAEGVTVEPAVFPLVVRAGGGSARDTLSVLDQLIAGAGPDGVSYARAVALLGVTDVALIDEMCDALAAGDGAAAYETIDRVAEAGHDPRRFASDLLERLRDLIVLQQVPDAAAKGLIDGPADQLEAMHAQASRLGAATLSRSADIVHNGLVEMRGTTAPRLLLELITARMLLPGADDSTGALLQRLERLERRGPLDAAGPAGAQAAPAEVRGDDAAVATGSAAGGGPVLDGPGGAKAAALALARGARGKAGGAARPVSPAPASPAAAPAAAAPAPAAAAPAPAAAAPAPAAAAPVPAAVPASVSPAEADWNRVADGPADVEDYDDAPPWDEEPPPPVDHEPVVASAPLPAEPSGSQQPAAGPTPAVAPRELPGLPQVRTVWQAFGPKHDKIQAMQNSGIGIHDVDGSRVVFLAPSQRYADRFLTYREVIIAEFTTELGGDWDIDCQVGTPTPETAPRNSPPRTAAAPARGSATPARDQSATAPRDQSAIPPRDQSAARRAAPERNAGRTESRPSRPQRTPADADDDGPPADAFPPEPTDDPYAEPAYTSAVGGTVPPAPGLREPAPTRPAGAPGDATVPALAVPGGSGVRSTTAPTAPPAMPAASAAAPTASTVAPANAAAASHAAPVSGAPASPAAQPDSGGSSTGVTSAASDWPEPARPGSRPSPPPADDDWPEPVKPGSRAPAGNSGPSGSATTVEGQPTAPASAEHSAVGTPSHHVAGQVHHVDSSGAASGGPAVDAAVGGSASGAVVGGSVSGAAVGGSHSGAVPADSDDEPADTGSPWPRPAAPGLPVTIAAPAVPDVARAAADLSMTASAQAAGPDRRTPSATATAVSASAAASPPAVARAAAAVETPAVARSAAMEAARAAAARSGNATPSSGLAAARAAAARGGGGAPVRTAAGPGPGGVGGGSAWSDGTPIGEAPYDPEYDGPPGGGAGYEGFDPGDEPLDEVIDEKTARQSSEEQAMQLLRDAFGAEKIGEM

SEQ ID NO: 11178 - protein, 107 aa, Actinoplanes utahensis
MRPGAQPNMQQLMKQAQKMQQQVAQAQAELAEAELTGTAGGGLVTVTVTGLGEFKAVKIDPKAVDADDVETLEDLLLAAIHNAAEAQRELAEQKMGPATGGFSLPGF

SEQ ID NO: 11179 - protein, 197 aa, Actinoplanes utahensis
MYEGAIQDLIDELGRLPGVGPKSAQRIAFHVLSADPVDINRLSTALRKVKELVRFCTTCFNVAESEQCRVCRDPRRTNEVLCVVEEPKDVVAIERTGEFRGRYHVLGGAINPLEGVGPDNLKIRELLLRLGTGEVRELILATDPNTEGEATATYLALLIKPMGIAVTRLASGLPVGGDLEYADEITLGRAFEGRRAL

SEQ ID NO: 11180 - protein, 336 aa, Actinoplanes utahensis
MSLGPEASISDDAPPPPAVDAAETRGPAEKAIVGRSLKQIAWRRLKRDKVAVAGGVFVLFLIAVAFLAPLLAKWFGHPFDEFHGDQVDQTFQTPLKPWGGISKDFILGVEPVNGRDVFSRIVYGAQTSLSVAFLAAFFSTILGSVFGLAAGYLGGWVDSVISRVMDFLLAFPQLLFAIALVSVLPQSFLGFGNRWSRVLVLVLVIGFFGWPYVGRIVRGQTLSLREREFVEAARSIGARSPRILFRELLPNLAAPILVYTTLIIPTNILTEAALSFLGVGIPPPNPSWGGMLSDALPFYADDPLFMIIPGGMIFITVLAFNLFGDGLRDALDPKAR

SEQ ID NO: 11181 - protein, 592 aa, Actinoplanes utahensis
MANKTKVMVAAAAALTLGVTAACGGSSKSDDKKGSSAEGAGFNAAVTGVVNPSDKAGGTLNMWTSQAPDSFDPAISYYGWTINMARFFNRTLLAYDAKPGKDGLKLVPDLASAEPEITEGGKVYTFKLRSGLKFDDGTPITSKDVKYGIERIFAQDVVPGGPLYLQQLLDQGQKYPGPYKDTDPNKLGLKTVQTPDDSTIVFHLAKADSSFPYMLALPGGGPVPQKRDTGAKYALNPASSGPYMFAPGAIQPGKSATLTRNPNWDKSTDPIRKALPDKVVLTITTNAADMDDRLIAGTADIDAGQSGVQTKARADILRDPKLKANADAPNTGFIRYAAMSTNVAPFDNVACRKAVMYAADPTTLQAARGGPVAGGDIGTNMLPPNILGSDVKYDPYNRAQGKAQVEEAKKALTECGKPSGFATKIAVRNNKPAEIATATALQAALKAVNIDASIEQYDGSLISSVIGAPNNVHKKGYGIMIAGWGADYPNGSGYLQPLVDSRFLVPNGNYNLPEVKDPSIDGLFDQAAAETDPTKAADLYSQINHKIMDGAFYLPFVFDKALNYRNPRLTNVYEHSALAMVDFQALGVSDGK

SEQ ID NO: 11182 - protein, 333 aa, Actinoplanes utahensis
MLAYLIRRLINAVLTLLAVTLVTFGVFFMVPKLTGSDPALLYIGKQADPVAVQGIREKLGLNDPVLVQYGKFVKGLVAGRDYTTGVEVTHCPAPCLGYSFKTDEEVWPKLLGDLPVTVSLAIGAAILWVLMGVMFGVISALRRGTLLDRTVMGVALAGVSLPIYFTGLVALSVFTYKLGWLKDADYTPFLDSPVDWARGLILPWVTLAFLFAATYARLTRANMLETLGEDYVRTARAKGLGERTVIGKHALRSSLTPLVTVFGLDLGALLGGAVLTEAVFNLRGLGYEALNGIRTSDLPIILGVTLFAAFFIVLANLIVDLVYGIIDPRVRLG

SEQ ID NO: 11183 - protein, 340 aa, Actinoplanes utahensis
MSRPFLEVKDLTVRFETDDGIVQAVSGSTFSLEAGKTLGIVGESGSGKSVTSLALLGLHRTRSNAKVAGEIWLDDKELVSASNEEVRALRGGKMAMIFQDPLSAMHPYFTIGSQIVEAYRVHHPGVNKKVARERAIDMLARVGIPQPARRFHDYAHQFSGGMRQRAMIAMALVNDPKLLIADEPTTALDVTVQAQILDLIRDLQEEFGSAVIMITHDLGVVAELADEVLVMYGGKVIEKGPAVDLFQRPQHPYTWGLLGSMPRLDREVRDRLTPVKGTPPSLINLPSGCAFHPRCPYAGRNGDRSFTETPVLTGGAHAVACHLPPEAREKIFQEEVAPNL

SEQ ID NO: 11184 - protein, 345 aa, Actinoplanes utahensis
MSENLLEVTGLQKHFPITKGLLKRQVGAVRAVDGIDLTVQAGETLGLVGESGCGKSTTGRLFSRILEPTAGKIVFEGQDITHKSVGQMRPLRRDVQMIFQDPYSSLNPRHTVGSIISAPLQIQDIPTPQGLKKAVQELLELVGLNPEHYNRYPHEFSGGQRQRIGIARALALRPKLIIADEPVSALDVSIQAQVVNLLEDLQNEFDLTYVFIAHDLSVVRHISDRVAVMYLGKVMEIAPRDELYKNPRHPYTVALMSAVPVPDPVRRDRAQRTRVLLTGDVPSPINPPSGCRFRTRCWKAQDICATQEPPLVARLDDPEGHLTACHFPIAQDEAVAGRTPAATQA

SEQ ID NO: 11185 - protein, 74 aa, Actinoplanes utahensis
MPGPGGVMTDEVGVVTGDLTLRTELKDGEVTLRVQYKDADEWYVVTGGRSKLADPTDLDAVHCIAVGLLNRPEG

SEQ ID NO: 11186 - protein, 220 aa, Actinoplanes utahensis
MPPRNTLLPLLLTVTLVAGCQTVDAGSPGGSTTTTTHATTGSGASAGSVVKQLDGLTVVDKAGSMAGYSREKFPHWKSTGKNCDVRDSVLERDGTKVKKSGCNVVAGTWKSVYDDKSLTAPGQADIDHVVPLANAWRSGAAKWTTDQREAFANDLDRPQLVAVSAASNRSKGDQDPSTWKPPAKAEWCTYATDWVTVKAYYKLTVLQKEKDALKEMLETC

SEQ ID NO: 11187 - protein, 575 aa, Actinoplanes utahensis
MSTFAENSQRSSSMPFQRYESYQKQFAIDLPDRRWPGRVVEQTPRWCAVDLRDGNQALIDPMSPERKRRMFMLLVKMGYKEIEVGFPAASQTDFDFVRQLIEQDLIPDDVTIQVLVQCREHLIDRTFESIRGAKRAIVHFYNSTSVLQRRVVFGLDRDGITDIATQGARLCQKYAEIHTPDTEIFYEYSPESYTGTELEYALEVCSAVIDVIDPTPARPLIINLPATVEMATPNVYADSIEWMHRHLPRRDSVILSLHPHNDRGTAVAAAELGLLAGADRIEGCLFGNGERTGNVDLVTLGLNLFSQGIDPQIDFADIDEVKRTVEYCNQLPVHERHPYAGDLVYTAFSGSHQDAIKKGFAALQADADAAGTPIDDFTWGVPYLPIDPKDVGRTYEAVIRVNSQSGKGGVAYIMKEEHKLDMPRRLQIEFSGVVQHHTDEEGGEVSPQQMWDIFAQEYLVEHQLGSAFKIESYSTATVDGKVEIDVEVIHRGMRRPLVGVGNGPIDAFTQAVAPLGIKARVLDYQEHALTSGGDAQAAAYVEVEVGDRAFWGVGIDANIVSASIKAVNSAINRAR

SEQ ID NO: 11188 - protein, 263 aa, Actinoplanes utahensis
MRLPSGSVRGLSALTAALLAFGLAGCGGGDTPDAAPTGSASPSASTDPNPDARNQLAGMAALAMDRRYAALYSFTGGDGVARNVVATVANDGTWRVDIANGALGGSADVSIVHNPNGVYQCTVSMSGAPINAGCVHVASKGEKVPAPYDPRVQRLLRQWLPVFTDRNAALAVSVAQPLDGTQGSACYSVDSNAASGDAPVDVGVYCYAPDGMLTAARVGFGVLRLVRQVAAPPTVQFPGPEVGGAAMGMSAADPVQAPSAAAG

SEQ ID NO: 11189 - protein, 421 aa, Actinoplanes utahensis
MALVVQKYGGSSVANAERIKRVAERIVAARKAGHDVVVVVSAMGDTTDELLDLANQVSPLPPGRELDMLLTSGERISMALLAMAIHNLGYEARSYTGSQAGVLTTSVHGKARIIDVTPGRLRTALDEGAIAIVAGFQGVSQDTKDITTLGRGGSDTTAVALAAALHADVCEIYTDVDGVFTADPRIVPDAQHIKQITYEEMLELAAGGAKVLMLRCVEYARRFKVPIHVRSSYSNKEGTLVTGSMEDPDVEQALITGVAHDRSEAKITIVGVPDEPGSAGRIFETVASAEINIDMIVQNVSTEGTGRTDISFTLPKADGPTAMTALDRIKDQIKFKSLLFDDHVGKVSLIGAGMRSHPGVAASFFACIGEAGVNIEMISTSEIRVSVVCRDTDLDTAVRAVHDQFELGGSEEAVVYGGTGR

SEQ ID NO: 11190 - protein, 351 aa, Actinoplanes utahensis
MGRPTLAVVGATGSVGTVMLDLLSSRRDVWGEIRLIASTRSAGRTLTCRGESLQVLPPSPEVFDGVDVAMFDVPDDAAAHWAPIAVSRGAVVVDNSAVFRMEADVPLVVPEVNREALAHRPRGIVSSANCTVAAMIMSVAPLHDEYGLRELVLASYQAASGVGQVGVDTLHDQLTKVAGDRLLGSRPGNVRQAVGDDLGPFPAPLALNVVPWSGDLGPLGWSSEELKLRNESRKILSLPALKVSATCVRVPVVTGHSVAVHAVFAAEVTADGARQVLRNAPGVILVDDPEAGEFPMPIDAVGTDPSWVGRIRRAMDDPRALDFFVTGDNMRKGAALNTVQTAELLAAELTT

SEQ ID NO: 11191 - protein, 176 aa, Actinoplanes utahensis
MTDSIDLARQVRSVSRLTGEFTLRSGRTATEYFDKYQFEADPVLLDKLAERLAVLIPEGTEVLAGLEMGGIAVVTALARHAQLPTAFVRKEAKKYGTARLAEGAEVAGRRVLVVEDVVTSGGQVVISTGELRKLGAHVDHAVCVIDRQEGGSQALADAGITLRALLTRADLDAAAS

SEQ ID NO: 11192 - protein, 98 aa, Actinoplanes utahensis
MTPFALLFLLALAGSTCFALGRAFGRGERYERGYREGFRDGETGSLARATRLMQLGERQTIAPVVETMLGPYCVPQQMAPRPVGPAVAGVPVRPQFAV

SEQ ID NO: 11193 - protein, 306 aa, Actinoplanes utahensis
MDGETTLAVMRKRSLISAAAALAAVGGATFAYAALVERNMFTLRRFDVPVLEPDAEPLRILHLSDLHMMPDQRRKQEWVAGLSGTDPDLVIVTGDNMASPYAVPGVLRALEPLLDVPGAFVFGSNDYTGPVWKNPLQYVLPEREYVEGADLPYDDLRAAFTDAGWADLNNARTILKAGGRSIELAGVDDPHVDRDDYPAVAGPISAGADLHLGVTHTPASRVLDPMAADGFELLLAGHTHGGQVCVPGYGALTTNCDLPTRLAKGLHRWPGSDAWLHVSAGLGTHPTAPIRFACRPEASILTLIPR

SEQ ID NO: 11194 - protein, 159 aa, Actinoplanes utahensis
MTARVVSPSMGTLKDRLNDDLHAAMKSRDELTTSTLRMALSAVRTAEVAGDEARELSDDEVLAVLTKEAKKRREAATAFDGAGRADQAAKETAEGEVLDRYLPKQLTDAEIAEIVGGALAAGGFTGKAQMGPAMKAAQAAVAGRAEGGRVAAEVRRRLG

SEQ ID NO: 11195 - protein, 792 aa, Actinoplanes utahensis
MRRRDHNIFTNATSLLVCGLLAGVVVAAAAFPAAAMSGLAAKAGGAGFASLPSEIKEFSSPQITRIYASDGRTLISQFYDEFRSDVPLKDISKNMQTAIVAAEDRKFYEHNGVDLKGVARAFVSNSQGDSQQGASTLTMQLVRMSLAYSATNPQEVIDATKDTPKRKITEMKYALQIEKQLSKEQILERYLNIAPFGNQAYGIYAASQVYYNKKPKDLTIGEASMLAGMVKAPTSFNPTVKSGHDQIQARRDNYIIPGMVAMNAISPADADKAKKEPIPTKVKPVSNGCVSVAKNSWGFFCDYFYRWWMSQEAFGATSYDRERRLKSGGYTVITSMDLNGTASARAEIAQREADSSQDALLLAGVEPGTGKVRLLATNRKYSLDDPDHPTNKISPDPAKKRKKIRGSFPKTTNPLITGGGDIVGYQAGSVFKMFTMVAALENSIPLSYQINAPVRFHSKYPAGYGEKSACPGTDDWCPGNSSTKEAGVYNMWTGFGKSVNTFFVPLEQKVGADKVVAVAKRFGIQFRSTQDIKNANNAANWGAFTLGVMDSTPLEMANAYATIAGDGKYCEPTPVEQITTKDGEKIDVGKPHCIQATTKDVARAALDAARCPVGDSAQLGSCGGNSTAGNTHDIVGHPVFGKTGTTDASKTASLIVGTTSLVVAGYMADPDWPDHNNTMSHPEINATVQYTLKDYMKGKPSVQFKTPGNDKISIGDLKSVPDVTCDPLSTAKDKIELAGFDPVEGPSVDSDCPAGTAAGTDEDRTIKGGAVTIQISKGNQGNPKPGTTKPGR

SEQ ID NO: 11196 - protein, 100 aa, Actinoplanes utahensis
MGMISDWPSMAACQSGDPDALFVQGAEQNVAKRICRSCPVRYECLADALDNRIEFGVWGGMTERERRALLRRHPHVASWRKMFEAALKEKGADKVLVSTR

SEQ ID NO: 11197 - protein, 369 aa, Actinoplanes utahensis
MTAPRLDIDGLLADPAIRIVVCCGSGGVGKTTTAAALGVRAAEVHGRRTVVLTIDPARRLAQSMGLTELNNTPRQVKDIEGGGLYAMMLDMKRTFDEVVEQHTKPERAAEIFANPFYQAMSSTFAGTQEYMAMEKLGQLRAGDEWDLIIVDTPPSRSALDFLDAPARLSRFLDGRMLRMLLAPARGGRSMFSLVTASFGLFSRAVQKILGAQLLTDLSGFVAALDSMFGGFRQRADQTYRILQDPQTAFLLVAAPERDAIREAAYFAERLVAERMPLSGLVLNRMHRTEPAGLSAEASLAAAQQLSADAPLAADVLRIHAGLLRQSEREVRVAAGFTEAFPEVPTTSVAAQPADVHDVDGLRTIGALLA

SEQ ID NO: 11198 - protein, 320 aa, Actinoplanes utahensis
MGEHHGNWPERLHIVTGKGGTGKTSVAAALALGLAAGGRRTLLVEVEGRQGIAQLFGLQPLPYAERRIATTTGGGEVRALPVDPEEALLEYLDMFYKLGAAGRALRKVGAIDFATTIAPGLRDVLLTGKVKEATTRSQDGRRVYDAVVLDAPPTGRIGRFLNVTAETARLAKMGPIKTQSDGVSSLLRSPMTAVHVVTLLEEMPVQETLDAVDELTGLGIPVGRIILNGARPPLLAAGRVTKAEIKRGLVAAGLPATPATVNQLAAEAQAHLTRRELEESLRHDLTDRRRPMIELPQLPDGVDRAGLDVLAGRLMTDALL

SEQ ID NO: 11199 - protein, 197 aa, Actinoplanes utahensis
MARPARETRRMAAPPPEHLAWEHSPPAEVPPPEPEPIWVSTPPAPIARTPRSRRSTIFLSVALAATLALCGGGAVSAYVMFRDADLPGSPDPATAVNRFLTAVYTQHDATAAEDLVCRRSRDRAKLAERVQQIRDYADAYEGAGFRWDDPAVTAGTGSEAEVGVRVVMSTEDEKTAAQDLQFTVVHKSGWLVCDVSG

SEQ ID NO: 11200 - protein, 303 aa, Actinoplanes utahensis
MLGRGCRHSPGFSCRACHGPSGGGWCQPPTTGCSIVAASGRACRPRSGSGSVTSLPALARVLSVAFPAQPNQPVGSPGPKLCRYPTKECPSHAEVGVRDRAPAGTRDQADPRQLGRGRLGAGPGGTGAEPGAVDRLHEAGEIVTTPIAGDGGVDAYAKLAELGLTLPTVVPPLASYVPAVQSGNHVYVSGQLPMVDGKLPRTGKVGDEVTVEQAAELAQICALNALAAIEALVGLGRLVKIVKVTGFVASAPGFTGQPAVINGASNLFGEVLGEQGRHARSAVGVTELPLGAPVEVEVIAEVA

SEQ ID NO: 11201 - protein, 269 aa, Actinoplanes utahensis
MGGAEPASAEVDRLPGWVSLLRAPNPGPMTLDGTNTWILRAPGADLATVIDPGPLDEGHLRRIAERGPYRSILITHGHHDHVEGAARLAGMLGGVPVRAADPEHGAGFDPRGSLDGNGLEIQVLQTPGHTGDSVCFLVGYGGERVMFTGDTILGRGTTVVAAPDGDLGSYLASLELLTAYESVPMLPGHGPARSDTAALARDYLQHRRERLAQVRAAMAAGARTPEAVVDLVYPDIDPRVRFAAEWSAAAQIDHLIRESAAGADGLDRL

SEQ ID NO: 11202 - protein, 1188 aa, Actinoplanes utahensis
MCGTVAVPGARFCHHCGAALPAAAAMPAAERRIVTVLFGDLSDFTSWSEDLDPERVGAVTDRVLAALAGAVKTFGGHVDKLTGDGIMAVFGAPVAHEDDAERAVRAALSMQRAVRRVLDDERGGGAPLGLRVGLNTGEVVAGMQAGIEYTVIGDTVNTAARLADAAAVGTVYAGERTSNGTRHVASWRQLRPLRLKGKREPVPTYELLGLHDAPGTRSGLGDEAPFVGREAELGRVSGRLAEAIDAGAPRVLVMTAEAGIGKSRFAGEVKRLAAGFEAGGVRVLRVRCRAFGERRRYAPLADLVRKAAGLPKDVVATVGRTVVEERLRKVAQRLGVTLDIDRLLVLLGYGEAPVNPGGPAAPADWPPSAKRIDAEAISVAVADLLNAMATSSPLMVIVDDLHDATATTVDALGSTLSQLEGPVVVLLLGRPELVRTGALSRVADAEVHNLPPLRGADASRLLTSYLNGGKLPQPDTDRLLATAQGNPFYLAEMVTLLMERGALTPAVGANAAGKWQLAAGSLGSQLLSRDLAAVLAARIDALPAEPRSVLRDASVAGTTVPTGVLEALQERRAPGEDLEPAIDELLQRRMIHRSRGGFQFTTPLMREAAYAGIGKADLAERHAHLATWAAPETVGRHADGATRLPLTDNERDAFVAAHAEAAIELADAVRLRPDATAREVAALGRAALGRMARRALANIEPAAAIEYAERATALTGTDLPLPDQLVLARAMLRLGRAEEALAYGEKITKSAAEDPVCRAEAMIVVGRAHEALGDGGRAVAAWQEALEVATEAQLLPERANAMRRLGMADFLNGRLSQASSRFAAAYQVTLAAGDRHGQAWALQNLAWVTTTRGDFAGTDAVLGRAARLFAELGDPVGRSWLRGTTAFARLLAGRLQEARRLARIFLPFGDRVGEGWAVGTLRVVEAYAAAELGDLGAADSQARRAYREFQEVSDDWGCGLAMVVRGAIARGLGEFDHAADLLGDALWFADRTGHPLLLGMAGTLHGFVALQQGDLATAEADARRVMTAVEPHNSLAPAQVGPRVLLAEARTRAGDPQTAIGLLAPIASDTSSPSLLFSRRHALASYASALLADGRVESALTWIERAREVPAEDVRSGVIAAMVRARVLAAADRCGEARTAAEDAVRLSRSTEQTSERAAAAELRDTLAITEVEATPAETVAYASDVPG

SEQ ID NO: 11203 - protein, 326 aa, Actinoplanes utahensis
MTETPPGALPVPYVPGMSGLSVMARGGYATVYRATQDSVGREVAIKMENRTLDNARDQARFLREARAAGRMSSHPHVVDLFDVGVTVDQHPYLIMELCDGSYLDRMRVRPLTAGEARDVGVKIADALVHTHANGVLHRDVKPANILYSQFNAAVLADFGLAVLGEMRDSSVTLEVLTPAYAPPEMFRHEQPSGAADVYSLCATLYAVMYGRPARWPSDRSPSLISLMNLFDEPIPELPGVPRALTALLRRGMHNDPRGRPSAQELLQELSNLQLEPGAPQQNVYRSTSTYVPPPRPRPIPPTTPTLDETPTVATDRKGFFAKWFSR

SEQ ID NO: 11204 - protein, 667 aa, Actinoplanes utahensis
MIRRLLVADRGEIARRVFATCRLVGIETVAVYSDVDSDAPHVNEADYAVHLEGSTPAATYLEQHALIAAAKRAGANAVHPGNGMLAEDPEFAAAVSDAGMIWVGPPAATLRTLHRKTETKKLVAEAKVPVLPSFTDPETVPGFPVLIKPDTGLGGAGMRVVRDAATLAEAVASTRREVDGDVFCEPYVPNVRHIEVPILADAMGAVVPFGERECSVQRRYQKIVEETPSPAVDAALREDLCRAAIVAVRALGFVGAGAVEFLLDADGDFWFLELTPTLQTEHAVTECTSGYDLVRLQLLVAEGGSLPMPGPPPIRGHAIEVRICAEDPAYAWLPSSGTLHRFAVPDVAGAFRPLPQPGLRLDSGVADGSVTGQHHEPMLAKLVAWAPSRQEAARMLASALARAQLHGVVTNRDLLVRTLRHHSFRAGEIDTGFLDRHPEVFAPLLSSVDAVRLSCLASALAGAADRRASAPVLGTLPSGWRNVPSGSQTAVYDGPTGPVEVGYRMNRHGELAGWWVRPVDPEELDLAGIGQAPVDEHPPIVVVSASRDRVVLNVQGIRLAVLVHRVGDVSYVDSPEGSVTLREISRFPLPAPEAGESSLIAPLPGAVRRVLVVPGQRVRAGELLLTLEAMKLEHPVHAPSAGVVASLPVHPGAEVATGELLAVLDPE

SEQ ID NO: 11205 - protein, 455 aa, Actinoplanes utahensis
MTVLDTTLDPRDPAYLEGRGTTLQWLAALEVALDEARAGGGEKWVTRHHARGKLLPRERIEMLLDQDSPFLELSPVAAWGSEFPVGASVVTGIGAVEGVECVVVANDPTVDGGAVNPYTAEKIRRAARIASENRLPLVNLVESAGDAAPAGSIARELSRLTADRVPTVCVVFGTTSGDAAYLPALSDYTIVVRGHAKVLTIHPQRSGVEVRATPVVPSGPAGPADQLAEDERDGLRLARQCVRRFNWRKQGPAPRNRQPREPRYSSEALLSLAAAGSNFEPREVLARILDDSDFDEFKPGQGSVLVAGWGELHGYPVGVLASPGIWLSPTESQKAVHFLQLANATATPVIFLRHPGETKGSDDADVRNDAPLVHAIAKSTVPHLVLTVGPEPGGTPARADQPRFQFSWPRPPADRAAADDGVIDPRDTRTVLGLCLSAVHSAAVAGAEHVGVFRP

SEQ ID NO: 11206 - protein, 225 aa, Actinoplanes utahensis
MDEVLARSGIFQGVDPEAAEALAKEMDTIEVRKGDVVFNEGEAGDSLYIVLSGKIKLGRRAADGRQNLVSIMGPSDMLGELSLFDPGPRTATATAVTDSRLARLKKSSLRPWLNNRPEIAEQLLRVLARRLRRTNDALADLIFTDVPGRVAKNLLQMAGRFGTRDGGVLRVTHDLTQEELAQLVGASRETVNKALADFASRAWLRLDGKSVIILDPERLARRARV

SEQ ID NO: 11207 - protein, 392 aa, Actinoplanes utahensis
MNSHPPTHRDSGSGRYALYITLVGVVVAGAAIGGYALVNRGTEADASWQSPAPTRAAAARTESTRAAAAATAVTFSATGDIMMANAPGGLPPNNGKGFFDPVRRSLAADLVMGNLEQPLTEDTGTSKCGTPARANCFAFRSPPSYAQVLKAGGFQLLNTANNHAKDFGPTGNRNTFQALDGAGLRYTGAQDQITVVPVKGLKVAVVGFAPYAGVNNLTDLTHARSLVAKARSQADLVVVQAHMGAEGPAMNHVKPGSEIYFGENRGDPIRFSHAMIDAGADLVIGHGPHVVRGMEFYKGKLIAYSLGNFAGGGHTLSKDGILKYAGILRVTLNADGSYAGGTFLSTCLNADGLPTRDATAEHGRRLITQLTATDFPTTGATIGGDGTIKPSA

SEQ ID NO: 11208 - protein, 267 aa, Actinoplanes utahensis
MLARSTKRFAGETPIGRKRRAHRMARVLADTHPDAHCELDFTTPLQLAVATILSAQTTDVRVNQVTPLLFQKYRTAADYAGADRAEMETILRPTGFFRAKTNSLISLGEELLATHGGELPRKLDELVKLPGIGRKTANVILGNAFDVPGITVDTHFRRLTNRFGWVDEEDPVKIEFLVAELIEKRDWTMLSHRVIFHGRRVCHARKPACGACTLAASCPSYGLGPTEAAPAAKLLKGPRARDLAVAAGVDPDLVPVGAAVEPDSEAL

SEQ ID NO: 11209 - protein, 176 aa, Actinoplanes utahensis
MRLLAPVAIAALLLSGCTAAAVKESQAPSPFAACAPATGGSTLPDITLDCLTGDSPVRLADLRGPAVLNIWGSYCGPCRAELPVIQKLADTGKLTVLGVDTGDTRAAAISFGTDHGVSMPTLFDPDRKLVAQLGVISLPSTIFVDATGKIFIYRYAMDAPALTEQVAKHAGVTVTL

SEQ ID NO: 11210 - protein, 236 aa, Actinoplanes utahensis
MSRGELLDRPDDLPEWFEPLLTRVSEIRAEDFSTLRRPSGSGGRSSAVLVLLGAGESGPDLLILQRAASMRNHAGQPAFPGGATDPSDADAVATALREANEEVGLDPASATALALLPELWIPVSRFSVTPVLAWWRRPHPVLSRQPEEVDHVARLPISELADPANRIRVRHPSGWIGPAFQVRGLLVWGFTAGVISVLLDMAGWAQPWEPGRIVELPDAAAPVPAARGGAPDEVVP

SEQ ID NO: 11211 - protein, 390 aa, Actinoplanes utahensis
MVDVILIVLMLLFAISGYRQGFVIGALSLGGFFSGVLIGLQLGPLLAKQFADGTVRMIVALAVILALAVLGQTLAGWLGTSLRKAIFNRPLQHLDDAGGAVVSVVAVLMAAWLVAVPMGSTPFPALNRAVRSSAILGGINGLMPEQAQALSSALRETLDTNGFPDVFGGLARTQAKEVAEPDPALKNSKIVQSSKQSVLKVLGAAPSCSRRIEGTGFVYADERVMTNAHVVAGTRDVVVETARGQLTGTVVVYDPKRDLAVIRVPGLKAPVMPFVSKKAGSGASAIVLGYPQDGPYNAQSARVRDVGDITGPDIYESGDVTREIYTIKSLVRSGNSGGPLISPDGRVLGIIFAAAADDKNVGFALTAAEAAPIAKLGLESTEGVKTGGCA

SEQ ID NO: 11212 - protein, 537 aa, Actinoplanes utahensis
MATPTRDQSERNHPAAAAAVSCTLRRCALLTVRHLGAAALAGFLVMTPAAAPAFAAVRPAVFAAPVPGGGSGAGSAISLTVSGRPAAARSLAASAVSARSAAVRSLAVPAISARSAAARSLAVPAVSRRAVTRRPLAEPGFADEVVEGRPLAEPGTAVEDTVRADEWQLQTLDLHDAWTYADGSGVTVAVIDSGVDAHHPDLDGQVLPGLDLVNPKDDGDTDPVGHGTTVSGIIAGRSDDNTGVVGIAPKAKILPVRVLDEANRYDDALIVAKGLRWAVDHGARVVNLSLGGSANSPALAAALDYAFAKDVVVVACTGNVSATSSAHSVWYPAREPGVLAVAGMERNGTDLWSGSITGPETVVTAPATELVGARPGGYWRVQGTSFAAPMVAGTAALIRSRWPDMSAGDVINRIIRTAKDRGTPGRDDVFGFGLIDPTGALTASVPSVLGNPLDTTPPVGVGRLGSAPASGEAQSAPTDDPSSQPLAAAPGTNAGGWAAKATAQPAPHRGRWIAISLFALSTAVGALTIRRFALTTG

SEQ ID NO: 11213 - protein, 1306 aa, Actinoplanes utahensis
MGTVVIKRSERRPAPAIPDGELLVEPPPERARPAAGRWQQALMVLPMLGGTVAMAMMMGQGHGGMYSYVIGGLFGISSIAMLATSFGSATGPRRAETAAAHRDYLRHLAVLRRRVRETARRQRAGQLYRHPDPDRLWSTAASHRVWERRPDDPDFGVVRVGLGPQALATPLLAPATRPLHELEPVTAGALRRFLDAYSVVPDLPVAMSLRGFARVHLRGGEAARDLVRAAIIQLAVFHAPDDLLVAVCAGPARRADWEWVKWLPHALHPARSDPLGPLRLVAGDAGELDRLLHDVLADRPRFQPGAASAAGPHVVIVRDGGEPLPPGDGIDGVTVLDLDAPPPRLLDRATLALEVDRTGTLLTATMEVETVAGRADGLPATTAEAIARRLTPLRTAGVADPDGPPVPAETGFAELLGIGDPESFRPARGWRPRPARDRLRAPIGVTADGLPVELDLKESAQGGMGPHGLLIGATGSGKSELLRTLVLALAGTHSPESLNLVLIDFKGGATFASLDRLPHTAALITNLRDELPLVDRMAEAIDGELLRRQELLRKAGNFAGLPDYERARADGAALPPLPSLLVVVDEFAELLVHKPDFIEMFLQIGRVGRSLGVHLLLASQRLEEGRLRGLDTHLSYRIGLKTFNSVESRVVLGVPDAADLPSAPGHAYLKVGNGPLTRFRGSYVSGPLRRTGSPGDPAGTTELRVLPYTTRAMAAPARPAAIAAPEPASGSPTLLGVLVDRMAGQGPPAHRVWLPPLDSPATLDDLLGPPIVAAGRGLTCVSPELHGALQVPIALVDKPREQVRDTLWLQLAGAAGHVAVVGGTLSGKSTALRSLICGLALTHTPAEAQAYCLDFGGGSLGALRGLPHVGGVFGRLEAEGVRRTVGEMVTLLAARERSFAELGVGSMGEFRRSRGGPDVFLVVDGWSTVRADFEELEPVLTDLATRGLSYGIHLVAAASRWMDFRPAVRDLFGSRVELRLGDTTDSSVSRRAAGTVPEQQPGRGVIEHPGVREQWLHLLTARPEVSSLGDTAELVKAVAAAWPGPAAPQVRLLPAVVAQAGIADAGDGLRLPIGLAETDLEPVTVDFATDPHFLLFGDAECGKSTFLRVVAGTVTARFAPEQARIILVDYRRSLMDLPETEHRIGYGMQAQPTLDLMRSVAGYMAKRLPGPEVTARQLRDRSWWTGPELFVLVDDYDLVAAGPVNPLTPLLEYLPQARDIGLHLILTRRAGGAGRALYEPVIQRLRELSAPGLVMSGAPEEGALIGSVRPGPLPPGRGRLITRREGIRLIQLALPESGPGTDSQCD

SEQ ID NO: 11214 - protein, 211 aa, Actinoplanes utahensis
MRTGLARVTISTPRRRVDVALPERVPLAELLPEVLRHAGEDLADTGERHGGWVLRRVDGATLEVGRGLHAQGVRDGEVLHLSPALDDWPELEYDDVVEAVAEGARRRGGVWTASTTRAAALGAAGIALSAGLLTLLAGPVRGGGPARGGGGAGWTGLGLAVVLLLAATVASRAYRMRPAAVVLGGFAMAYAFIGAAALVVGAHPAGPLPAL

SEQ ID NO: 11215 - protein, 104 aa, Actinoplanes utahensis
MLRSRLFRARRLRLPLIAGGLAALAALGADLLGRVGSDVLPVAAAACVLLALAVVPAGTIWSQRPAGPLSARVAHLFELLVTAAVIPVACAVAGLYTAVSGISL

SEQ ID NO: 11216 - protein, 166 aa, Actinoplanes utahensis
MDFDVLVEIPKGQRNKYEVDHKTGRIRLDRTLFTATQYPADYGYIEGTLGQDGDPLDALVLIQEPTFPGCLVRARAIGMYRMTDEKGRDDKVLCVPFEDPRQEHLRDIHHLGEFDRMEIQHFFTVYKDLEPGKSVEGATWVGRVEAEAEIRASFKRAEAAEAEGEH

SEQ ID NO: 11217 - protein, 581 aa, Actinoplanes utahensis
MSLVSPKSDATGEEGRVTRQDSQNGPEYNGVSNGTDRPDAGKWQPAAPDPATTAQIPAPGAYPPSGLPPAPPAASTGDAYGKASVPLNTARPAVPAPAPPPQPAAAPEPDAEPAAPDFFSNPKMASIVLAAVVLLAVVVVGVVEKPGPIAGWFGDSASPAGVTTTPDPKPTPVLAAAAAQGTAPNPTAVKAVLDPLIRSAALGGKVHVSVMDVASQQVLYAQNADIPTTPASTAKLLTAVTVLAARGPAYRLTTRVVAGAKPGEVVLVGGGDPTLAVNAKAEFPGAARLDQLAAQVKKAMGATPITRVTVDTSLFTGPETGLGWSPDDVSPDGQVARIQALMTNAGRITPVHHENGGDPRFADPALAAGRAFANFLGVPSEKVAKGRAPDAGTELGKVDSPPLVQILDWMLQESDNTLAETMARQVAIAAHKEASFDGASEAMIAKLRELGLPGDEADLYDGSGLSRHDGLSPTLLVQALALAAGGTRPELSAMFDGLPVAGWSGTLRTRFVTPSPNRAAQGVVRAKTGTLSGVNTLAGVLVTKDGRVLSFAIMATGTSNAASAKTALDRVAAKLVACGCS

SEQ ID NO: 11218 - protein, 352 aa, Actinoplanes utahensis
MAQFVDWDLAAATAGALSKSGPAVSYDEAAQVVAELRVLTEQAAGHVAAYTGLSAQVDAPPVRVVDRRDWAKANIAGLRQVINPLVTKLSGDRPPGAFADAIGSRVTGVQAGTILAYLSGRVLGQYEVFSDDPGQLLLNAPNIVEVERKIGADPRDFRLWVCLHEVTHRTQFTAVPWMRGYFLGQVQAFVDASQGGDHLLERLRRGVAGLSDALRDPESRVSVLDIVQTPGQKAVLDRLTALMTLLEGHAEFVMDGVGPEVIPSVESIRAKFNRRREGGNPLDKTVRRLLGIEVKMRQYAEGHKFVHGVVERVGMEGFNKIFESPLTLPLLEELGDPDAWVARVHGPRPVLD

SEQ ID NO: 11219 - protein, 224 aa, Actinoplanes utahensis
MARIPAPVAAVRTAVRRGLADLPPAALVLVACSGGADSLSLAAAARFVAARVGLVTVDHGLQEGSDRRARSVAAWARAADFDPVRVCPVTVTGLPGGPEAAARTARYEALEAAAAETGAAAVLLGHTRDDQAETVLLALARGAGPRGLSGMPARRGVFRRPLLDVSRSDTRKACAALGLAAWEDPHNTDPAYARARVRATALPTLVAELGPAVVGNLARTATLL

SEQ ID NO: 11220 - protein, 61 aa, Actinoplanes utahensis
MLHRWALELGAPGSALAYSHVTSLDALVTGWRGQGPAHLPGGIAVGRQGSDLVRVVPAIIK

SEQ ID NO: 11221 - protein, 197 aa, Actinoplanes utahensis
MRQARAMADGSWYDADIDHVIISEEQIREKIDELAKQVSVDHADAADGILLVCVLKGAVMFMADFARSLGRHGPSTEMEFMAVSSYGQGTTSSGVVRILKDLDRDIAGRHVLVVEDIVDSGLTLSWLMKYLESRQPASVEVVALFRKPDAVKVQVPVRYVGFDIPNEFVVGYGLDFAERYRELPYVGVLRPEVYARS

SEQ ID NO: 11222 - protein, 676 aa, Actinoplanes utahensis
MAPDNSMERTRFFRRPVVWIILVIIGVVALSSFFTSGPSYQRVDTSVALDRLNQPGIEKVVQKDKEQTLQIDLKNPEQFNGKSTSKIETQYPYEVTSDVWKAVQQAKDAQRISGTINATVSGDNILLSLLINLLPIAILVVLLLLFMSQMQGGGSRVLNFGKSKAKMITKDTPKTTFADVAGADEAVEELHEIKDFLQNPAKYQALGAKIPKGVLLFGSPGTGKTLLARAVAGEAGVPFYSISGSDFVEMFVGVGASRVRDLFEQAKSNAPAIVFVDEIDAVGRHRGAGMGGGHDEREQTLNQLLVEMDGFDTKGGVILIAATNRPDILDPALLRPGRFDRQIPVDNPDMEGRKAILRVHAKGKPFTPDVDLDSVARRTPGFSGADLANVINEAALLTARHEKRAISNEYLEEAIDRVIAGPERRTRAMSDKEKKITAYHEGGHALVAYALPHSAPVHKVTILPRGRSLGHTLVLPTEDKYTQTRAEMIDTLAYALGGRAAEELVFHEPTTGAGNDIEKASGLARAMVTQYGMSSKLGAVKYGTSGDEPFMGRNMGHEKDYSDAVAADIDSEVRALIELAHDEAWEILVEYRDVLDNMVLELMEKETITQDDMNRICARVQKRPPMSPFNGFGKRLPSEAPPVLTPAEREKLKAQAEADGQFAVGPNANGAVEGSI

SEQ ID NO: 11223 - protein, 191 aa, Actinoplanes utahensis
MEQAVDLGRIEKAVREILIAIGEDPDRDGLARTPARVARAYAELFAGLRVDPAEVLTTTFEADHEELVLVRDIEVQSMCEHHLLPFKGVAHIGYIPGVDGRITGLSKLARLVEVFGRRPQVQERLTSQIADLLMAKLGARGVIVVLECEHLCMEMRGIRKVGARTVTSAVRGAFQTDGKVRAEAMALINAR

SEQ ID NO: 11224 - protein, 86 aa, Actinoplanes utahensis
MASVEEIKMNIAVSVSGADRAIAGIQMAGDQLDQSLAMLRLTTVGSFHPAATAAIAHLEQARARLDEATQLTRAAMDSANQFRGGI

SEQ ID NO: 11225 - protein, 231 aa, Actinoplanes utahensis
MTEQAEQSGLVPAQAGAPPESPWAAYLAAAQQLDVVRRAASTSAGEQAATIAAARQELTAVRARLAPQRARLMRDFGVPEIDLLPLEGERATAQAATIGGPDAVLAALQQARITADAADHAFIGPIPLGPGRPWARNLLVYGPFAAAVLFVQIILYLVAPSGSLPTYTLLCGLSMPLLAFGLGWATIGFVWGPDAAKGGPPVDRTPVVGIVACLTPVLLTCMGVGLQQLLN

SEQ ID NO: 11226 - protein, 925 aa, Actinoplanes utahensis
MADSALRVRQAAALHRQAVAAADAAAAALEAFAPSAADPREQQRLAERLREAAAQVAPGWLGAPLDALTSRMPLDGSGTQVAAGGTEPGRFVRVGVAHLSGAGQSQSVGPGQPPPVGPGQSQPVGSGQRQPVGLGQPQPVDLGQVRPADEVRFPAIVPLLGAGHLTIDASATDPRVFGLIRALLLRLFAAAPAGSLLVRAVDGIGGGAVFQPFEELADAGLMSPPAVDRQGLRDVLAEAEKWLRPARGVGSDSVRQTRRAKRDRMLLLVIASLPELTEGEELRRIAALAQQGPESGLHLIVAGWPPPPLTAETTQAPLPRTTAISVRNPFAVVGDPPGGSFGSTPEAPWLNAPVLLDDEPPAHLVDAVCQELAARSAAASRVTLADLLPEPSEELWSADASAGVETVVGHHGDVPLVLRFNDLTPHWMVGGRSGAGKTAFLINVLYGLGTRYSPDELALYLLDFKEGVSFAEFVPTHRDRTWLPHARAVGVESDREYGLAVLRELDAEMGRRSMAYKRAGVSRFADLRAVAAEEGRGRPLPRVLCVIDEFQVLLAGNDPTASEAVGLLESLARKGRSYGIHLVLASQTVLGVEALYAKRDSIFGQFPVRIALPGGGDVLEPTNDAAAGLPLGSAVVNTAGGLGGPRGATRGHERVVRFPDPHADQESLSNLRHRLWGARDPEAVPPRIFAGYAHQHLVDDPTYRAALAGRASRPTALIGRMIDVSLSTAAFPLDSSPGRHLAILGSQAAGSEVLDAAARSVAACHPPRTARFVICSLVAEGDALAAALAAEISHRQEVVVTDAAGLAAELADDQPGYRVVFGMDAAPPGALTGLRQLLREGPSRGAHLLSWWRGVRRFSEETGGSMGREDVAGLLFLNVPQADVSLMLGRAVDWQPRPNRALLHDRHTDRTVTVVPFVQPEGEHP

SEQ ID NO: 11227 - protein, 655 aa, Actinoplanes utahensis
MLRRGVAFLSVLVVIVAASIAWAVATPASAYAVPSKAPSGACSIEEWKNDLKGCVDRLEKVAGNRVDCLDPPTPSTPDSGLAGWFAERPQSSTKDGPQGIYSEYGYAGYSYNTYDLDGGCAAGAVNADTGIENTMANGELMVATAVIGASNALRERAWDPATMWGWADPLVDQATKAVYEKVFSVFGVITLAIVGLYLIWRSRQADMGAATTTAGWAILVMVAVTAIAAWPVRSANLADQTLVTTLGVVHDAVGPRPQSGGNGCRLKPTSCEDQRPPAVRASDTATETMLYRNWLRGVLGSADSDTAKKYGAALYDARSLTWDEAQRIRDNPGTRDGILNGKKEQWKKVAEQISKEDPEAYEYLQGKNGMERVGAGFIAVLAAVMFAMFDLTASILVLLGFLIFRWAVIAAPILGTVGLLRPASAGIRRLGNAVVAAVFNVAIFGTGAAIYLFAVDLIMNTASLAGWLQVVLVWLCGVVGWLLLRPYRRITQLGGKDNAAAIASGGSWHRRFFRDMREAAKLEAAEGAGSPANFGKNSRVVRAETRDLRPEARLEDSTHTAINTAHSNVVERGLPAHPPMQIRPDGSEVVHGEAAASAHSIAGTSQPSQSRNRPRRTEWAEPEATETPASYTIYRPSTGATIQEPATPRVRSEAR

SEQ ID NO: 11228 - protein, 880 aa, Actinoplanes utahensis
MPATVTDKAPARRRTKEPKAAKPAALRPQKLKFNDRDPAIELAISEIAGHLTFTQSTVTAWYHLPEVRWAFRPDAEREALLSAISEQYAGLAGFRLHLRRTTRPFPADEWARTVDSFTTRPLPDVPGATSWSDHLVAAQRHLLSVNHAEGQTYLGVTFARRSLGDTFSERILRAFGRGTSENERRKLGRTVEQFDEVLNAFGMRGRRVTPQELEWLLFRSVALGMAPPGLLSPVSNGHWETGDLLALTEQVERYRTPYGSTVKLVNRMTGEERHVAVLSVGRMEPLEIPERHEPWMHFHERLPWPMELSSRIDILGSNSSFRNLEHRLRMIRSQQLDYAEHGIDAPPELERLAKRALVIGDEMTTGLPTDSARAHGWHRIAVSGANREECLERARRLIQLYSRELRISLQHPKNQDQLAREFIPGEPIANTGYVRRMPVKLLAAALPQAASTVGDRRGDLIGRTAGTCRRPVFLDLHFPMEVRERSGLGVFVAEPGGGKSTLMGALGYLNARRGVQVTLLDPSGPLARLCQMPELRPYSRVLNLTGSEQGTLAPYALIPTPIRSEFPTGATGDREFEIAVSNARAERRMLVQDICSMLVPPQVAKEASTATLLRHAVRQVPAEETSTLDDVVTTLQGLGDDEGRELANLLLDTAEMPLALLFFGRPPQHLLGADAALTVITMAGLRLPDLKIEREYWSAEESLALPMLHTAHRLAVRRCYGGSMSTRKMVGLDEAHFMEGWRSGRSFLVRLARDSRKWNLAALVASQNPRDILGLDVQNLVSTVFVGRIAEDQEIASEALRLLRVPVHDGYEATLASLSQVDTSSQHRLGFREFVMRDVDGRVQKVRVDVSYVEGLLEHLDTTPGPAQPQLAPLPSDLEA

SEQ ID NO: 11229 - protein, 193 aa, Actinoplanes utahensis
MTTNLPPGHPRAGASTADRQSNGVRPNDYSSPEAVEQPDELVAAPGHGGVGVFQAPNAVRPLSTPVDTTMDIDSPFLDLFGGTAGPAPTRPGDPPAKPAGTNGHRANGSGPARNGFPHGTVTALPAAAPPPSPAITSTPFVVEDEDDWSEYDEWPPRGPEQSRPAPHGPEDSRPAPRRLPAPAPELAAPALAS

SEQ ID NO: 11230 - protein, 120 aa, Actinoplanes utahensis
MRLRTDDDIYRARLVYLGPPGYTLPVHLPYAQYGMFVVLVPLFMVIHYLITFTFDPFPAWEIALAMVSTSYVFRHVDPDRPARVVIRTALTDWRRTRESAVERRDPRLVATRIRVREELV

SEQ ID NO: 11231 - protein, 98 aa, Actinoplanes utahensis
MIATEVAGHVMTALQSSVLAAPAEPTGINTSGIVTFFAKNIAPILLAVLGVIFIGRASRGEVSKVLTSSAIAIVGLAFIAGAATLFFVGDALIKLIFN

SEQ ID NO: 11232 - protein, 316 aa, Actinoplanes utahensis
MHECASPGHRTPVRTTLAPYARRVLTPPTEAQLIGADLMHRDHPVVMGVLNVTPDSFSDGGRYTDLDAAVEHGISLYAQGADIIDVGGESTRPGAERVDAATEAARVVPVIAALTAAGVPLSIDTTRAAVAEAALAAGAAVINDVSGGLADPGMAAVAAAAGCPWILMHWRGHSRDMQRLATYQDVVTEVRDELRARADAAVTAGVDPARIVLDPGLGFAKNAEHNWALSARLDVLVALGFPVLFAASRKTYLGRLLAGPDGTPRPVDGREAATLATSLLAVAAGAWGVRVHEVRETADALAVWRATGAPRLALEK

SEQ ID NO: 11233 - protein, 136 aa, Actinoplanes utahensis
MGQITLTGLRAHGRHGVYDFEREQGQDFVVDVRLDLDLSRAAATDDVADTVHYGELATALVAVLTGEPVNLLERLADRLLDVCLADPRVSAAEVTVHKPQAPIPHEFADVAVTLRRESRESREDGERGRGSERGRG

SEQ ID NO: 11234 - protein, 173 aa, Actinoplanes utahensis
MSRAVLSLGANLGDRLAHLRAAVALLGPAVRAVSPVYETPPWGDAEQPAYLNAVLIVEDPAATPHDWLERARACEAAEGRERDPDRRFGPRTLDVDVIAVWDADGRPVHRDDPELILPHPRAHLRAFVLTPWRDVQPDGELPGHGPLTGLLATPELAADVAGVTPRPDLSLES

SEQ ID NO: 11235 - protein, 174 aa, Actinoplanes utahensis
MSANPDGSPTGRRTDPSLQPTSVSALVLAALVGAALGWLLLGYNELFYRLTPLPWTGAIVLLALAVVEGYLAQNTSARIQRKPGAPRVDPLAVARYVALAKASSLVGSLTAGFSAGILIWLVTQPTDSAKSDLPTVATTLIAGVALIGAALWLERSCRVPDGPDRDDDDPDRRR

SEQ ID NO: 11236 - protein, 400 aa, Actinoplanes utahensis
MAYDEATTDPAAYRRRVQLDDTAGGGNTLDQSLSAPVPAPPVADDGRDRLGIHLGWEVVLLVVAAVLGFLLWRESSAAFQRPALDGLLVTASAIGLVTLGAGLSLRAGVPNLAIGPIVLAAEFQFAENGDKGLLESLVPALLIAAAGGLIVGVLILVLHVPGWAATLAAALGVITFDQLRVDAVAVQGTWEPTDRAFLLFGGFAILAVLGAGLGAIGPIRRFFGRMRPVGDPAGRRGAAVVLPVLVALIVSTVFAAGAGVIMAGQSAGPIRPGTGLEWTGIGLGLALLGGTSAFGRRGGIFGSLFAVVALTLFLDYQARRELHISLYATAGVIFLAGLIATRVVESYGRLASAARTTDWNAAPSGGLGTNWSPTAPETWNTPATPVGTDRWDDGPWGATR

SEQ ID NO: 11237 - protein, 97 aa, Actinoplanes utahensis
MLSVMTTHGFAELDALPTEELRERAFAKAREKHDVRFFWSVLKHLPDADDAAGLDGAPNSIGPTVDEAVALWRELEGRDLGEREPLLRAAFIDYLSR

SEQ ID NO: 11238 - protein, 164 aa, Actinoplanes utahensis
MALESRYKTATGAGTLAAFLLVLIFGSPWYGDWVTDAVDGRTGAGWWLHLLHWPAWKFDSSDSLRGVIVGDLRAILAVVLTLVFLVLLPGTQLARARGTIAQLLAGWAAYVFAGAFAALIAVLFVADPTLMSIFQNSGAGAEYGMFVGWIVGLATLGGRRGTAG

SEQ ID NO: 11239 - protein, 322 aa, Actinoplanes utahensis
MDATAASITLADVGKVYPDGTVAVDRFSLEVRAGELAVLIGASGSGKSTILRMINRLIEPTRGTITIDGRDVLGEDPVRLRRQIGYVIQNVGLFPHQTVRANVGTVAKLLGWDRRRITARADELLDLVGLDPARYAKRYPHELSGGQRQRVGVARALAADPLVLLMDEPFSAVDPIVRARLQEEFLRLQATVRKTIVLVTHDIDEAVRMGDRIAVLAEGGRLLQYAPPAELLSRPASAEVRDFVGADRGIRRLAVTPVREVMSAPVGAVDGLPAVDAAATLHDALAVMLTENASTVLVTENGQPVGQVTRTAVFEAPAQSAV

SEQ ID NO: 11240 - protein, 239 aa, Actinoplanes utahensis
MSFLSWVPASPALAAPADDGPGNPWFSWRYVHENADAIGTALRFHAGLTAQTVLVALVVAVPLAVVAYWIKPLTAPILALSGVLYTIPSLALLSLLAPLVGTTSTTSVLIALVLYALLVLVRNALAGLTQVPPEVIDAATGMGYGRFGRLLRVELPLALPGILTGLRLATVSTVALVTVGSLIGQGGLGDLILGGFRNNFYKAEILTGTILCVGLALVLDLLLAGLGRLLTPWTRGRAA

SEQ ID NO: 11241 - protein, 238 aa, Actinoplanes utahensis
MSYFNEGIVWLNDPLNWTNPGGMVDRLTEHLVISFWAVLLGCAVGWPLGIWLGHRGRGGGPVITAANLTLAVPTLALLTILPLTPLGFGKPPVVVALAVFAVPPLLANAYTGLRSIDPETREAARGMGLSGGQLLRQVELPLAVPYLAAGLRTAAVQVVATAALAALVNGGGLGQIISAGFGIGMSNGGGGQIVAGGLAVALLALLVEGLLALLQRLVTPPALRTRKRRRSAVTVTTP

SEQ ID NO: 11242 - protein, 334 aa, Actinoplanes utahensis
MRNNIFRTAGVLAAAVVVLAGCGKAGSSGTEAPPSAAAAAGAGCAPVAGDKLVVLTDDKKLQNTDNVIPAINKKAATPELIAALDKVSTALDTTKLVQLNKAVDIDRKSSKAAAQDFATANNLTAGITKGKGGNITVGAANFSENATLGELYGIALTAAGYTVKVQQIGNRELYEPALEKGDITVVPEYAATLATFLSGKIDGKAAKDPSSPELETTVTNLKALGDKAGLSFGQASTAQDQNAFAVTTAFAQKYNLTTLSDLATKCSGAATVLGGPAECPQRPKCQQGLVATYSFQAGRFDTLDAGGPLTKNGLKQGTISVGLVFSSDGALAAG

SEQ ID NO: 11243 - protein, 254 aa, Actinoplanes utahensis
MCHPAFGRFVPDALSVTSAPMPERDSPAGHSARLLRGLLWAGVILAPVAGAVVLLGGTGNSVRFGILLTAVSVVLVGASVLIRSDPVLLRIDVEDRVAEEVDRLRRGLITELAGHASAAPDPNRPPLTEHRAPGRPLAIDRDQQPGHDGEHTMGFGPNGRGRQGNFVEQPGFETPPAPQNVPAPQGFAGPHDFAGPQGFDEPTTYGPGPQGFDSGFDEQPSGFFDDYAQPDDGPQHAPEPPLPPRPAGGRAVAS

SEQ ID NO: 11244 - protein, 99 aa, Actinoplanes utahensis
MNGDFGYAPHDNGYDYGPDDGNGYGPKYGTGYGPDDGNRYGPKSGTGFEPGTGGFRPTPDDPAQYQARRHRPSANDTNVGSLADFANMPGYRDEAPGNW

SEQ ID NO: 11245 - protein, 361 aa, Actinoplanes utahensis
MVLNIGPQHPSTHGVLRLKLTLDGERVVTCEPIVGYMHRGAEKLFEVRDYRQIIMLANRHDWLSAFSNELGVVLAVERLMGIEVPERAIWLRMALAELNRVLNHLMFLGSYPLEIGAITPMFYAFRERETLQAVMEEVSGGRIHYMFNRVGGLKEEVPAGWTKRARQAVAAVRKRMPDLDNVIRRNDIFLARTVGVGVLPAADAAAYGASGPVARASGLDFDVRRDEPYLLYDQLDVPVVTRTAGDCHARFEVLLDQVYASLDLVDQCLDRVERIGGPVNVRLPKVVKAPEGHTYAWTENPLGVNGYYLVSRGDKTPWRLKLRTASYANVQALATLIPGCLVPDLIAILGSMFFVVGDIDK

SEQ ID NO: 11246 - protein, 315 aa, Actinoplanes utahensis
MESALYGPDGFFVHPRTGPADHFRTSVHASPLFAGALVRLIERVDAALGHPDRLDLVDVGAGRGELLTTIGLMLPAGLAARVRPVAVERAPRPDSLDPGIRWRHDLPEDITGLLVATEWLDNVPLDVVETDEQGRLRKVLVDRRTGAETLGGPADPAEVFWASRWWPGPGRIEVGAPRDAAWAGAVERVRRGAALCVDYGHRRAERPVLGTITGFRGGRQIPPVPDGSCDVTAHVAVDAAAAATGTPYEMVSQRRALGPLGVSGGRPPLTLASSDPVGYLRALSAAGEAAELRSPTGLGAHWWLWHPIGVDLPLG

SEQ ID NO: 11247 - protein, 301 aa, Actinoplanes utahensis
MNVLTVGVIGAGRVGAVLGAALQRAGHRVAATAAVSAASRERAGLLLPGAAILPADEVARAATDLLLIAVPDDALAAVVAGLRSTGALRPDQVVAHTSGAHGLDVFGDVNGMALHPAMTFTGTAADLARLPGIAWGVTTRDRAFATRLVADLGGAPEWIAEDARPVYHAALAHGANHLVTLVNEAADTLRAAGVREPGRVLTPLLTAALDNALRMGDAALTGPVSRGDAGTVTKHLERLPAAVVPAYLALARRTADRALASGRLRLQDAAALLEVLHPANETANETANETANLTANEAAKV

SEQ ID NO: 11248 - protein, 276 aa, Actinoplanes utahensis
MTQVVHTRDALAAALAGADEIAVVMTMGALHEGHRQLIRVARERAPFVVVTIFVNPLQFGPNEDFEKYPRTLEEDLAACRAEGAAVVFAPGRDDVYPDGPPSITMNPGPLGEILEGASRPGHFSGMLTVVEKLLRLTRADVAFFGEKDFQQLALIRRMVADLELDVEIVGVPTVREIDGLALSSRNRYLGAADRTAALALSRALREGAAHHEAGAVLAAAHKILQDEPAVRVDYLELTGADLGPVPADGPARLLVAARVGATRLIDNVPIVLRKDA

SEQ ID NO: 11249 - protein, 142 aa, Actinoplanes utahensis
MLRTMLKSKIHRATVTQADLHYVGSVTIDEDLLEAADLLPGEQVAIVDVTNGARLETYVIPGERGSGVIGINGAAAHLVHPGDLVILISYGQMDDAEAREYRPRVVHVDAQNRVIELGADPAEAVPGMAGDLVRGDLTLATR

SEQ ID NO: 11250 - protein, 316 aa, Actinoplanes utahensis
MRDWRARLRRARSGPGLGFDLAATLGVMLLAAAGCGNPGTVDGDLTNNWGAMAPATGFEPIADTCHLANFAATGPRATYEEVDCAVRHRTETVYVGTYSGAAADAEQPPSESSAGARAAYHTCDEKTTAYVGAPWRTARLWIGVTHPSPAAWAGGSRWFRCDVVELDSIEDDGALVQRAGSLRSVLSAPSDLLLGCYAIKLSDSGAIDTMPPAPCTAAHNAEFAGVWDAPADATYPQGNTAWKRFHDGCRTVVATFAGVPDDKNLEYRTGVVSLPGNADVWAQGDRGVRCYLWLDGARLTTSMRAKGTKALPVQYQ

SEQ ID NO: 11251 - protein, 548 aa, Actinoplanes utahensis
MSPLADLPALPRRLAAAEPGWTETTDVVVVGSGVAGLTAALHLREQGLHVTVVTKVNIDDGSTRWAQGGIAGVLDPLDTPQAHAYDTEIAGVGLCDPDAVRVLVEEGPARIRELIRRGAEFDRNPDGSLMLTREGGHRADRIVHAGGDATGAEVQRALHAAVRRDPWIRLVEHALVLDLLRAADGRACGITLHVLGEGSEDGVGAILARAVVLATGGMGQIYASTTNPSVSTGDGVALALRAGAAVTDVEFVQFHPTSFVTADLSSVQRPLISEALRGEGAHLVDEAGTRFMVGQHEQAELAPRDVVAKGIYRVLRATGADHVYLDARHLGREFLESRFPTIMASTRAAGVDPATELIPVAPAAHYASGGVRTDLHGRTSIAGLYACGEVACTGVHGANRLASNSLLEGLVFAKRIADDIGRDLPAQADPVRVNMTPAWVADASVRAEVQRTMTRGAGVLRTGDSLDTAAKELARLAESRATPNTAAWEATNLLTVATALVASARTRRETRGCHWREDYPTAADEWRGHLLDSIASDGSMTQDFQEMA

SEQ ID NO: 11252 - protein, 285 aa, Actinoplanes utahensis
MIDFGLDFAEVQRIVLTALAEDLGDPPRDVTSEATIPADQVDTAELVARADGVVAGLPVAAEVFAVTSQGRAEFRQITAEGDRVTRGDVLAVVTGPTRALLTAERTALNLISRMSGVATHTRRWADELRGTRATVLDTRKTTPGLRSLEKYAVRVGGGTNKRMGLYDVAMIKDNHKLAAGSITAAYRLVRETFPDVAVQVEVTTLAEAQEAVAAGAGFLLCDNMSPELLAEVVAAIGGRAELEATGNLTLATAAAYAATGVDYLSVGGLTHSSPILDIALDLRPR

SEQ ID NO: 11253 - protein, 252 aa, Actinoplanes utahensis
MLLCIDIGNTNTVLATFDGDKLVHNWRIKTDAASTADELGLMFRGLLAGDAVEITGVAACSTVPAALRNLRTMLKRYYGDVPSVIVEPGVKTGVQLAIDNPKEVGADRVVNTLAAHALYGGPSIVVDFGTTTNFDLISAKGEFLGGAFAPGIEISFDALAARAAQLRKVEPAKPRSVIGKNTVECLQSGLYYGFGGQVDRIVERMIEEIGPVSAVIATGGLAWLVKDECRTLTAHEPMITLIGLRMVYERNV

SEQ ID NO: 11254 - protein, 502 aa, Actinoplanes utahensis
MTEQNVPVTDPADDLPEQMKVRRAKRDRMLADGVAPYPVTVARTISLAEIRTRYAELPTDTATGDQVSVTGRVIFIRNGGKLCFVTLREGDGTELQAMLSLDRVGAERLEDWKRLVDLGDLVAVTGEVITSRRGELSVLADSWAMSAKALRPLPVAHKPLSEETRVRQRYVDLIVRQQARDTVRTRATVIRSLRESLFRRNYLEVETPMLQLLHGGAAARPFVTHSNALDTDLYLRIAPELFLKRAVVGGIDRVFEINRNFRNEGMDSTHSPEFAMLEAYQAYADYNVMQIQTREWIQEAAQAVAGSHVVTHFDGTELDLGGEWRQITLFGAISDALGEEVTIATDLAQLQRYAEKVQLGVDPKWSAGKLAEELFEHLVQHTLQQPTFVRDYPEETAPLTAPHRETPGLTEKWDLYVGGFELATAYSELVDPVIQRDRLHAQSLLAAGGDAEAMQLDEDFLRAMEYGMPPSGGMGMGIDRLLMALTGLGIRETILFPLVRAE

SEQ ID NO: 11255 - protein, 118 aa, Actinoplanes utahensis
MAKQIIHKLVDDIDGGDADETVKFALDGIQYEIDLSEKNAAELREVFAQYVGAGTKVARGGVVVGGRAARGRGGAAADREQNKAIREWAKKAGYDISDRGRIPQEIVDEYHAKGPGRA

SEQ ID NO: 11256 - protein, 923 aa, Actinoplanes utahensis
MSTGCGPCGFRCPRTRSGGGTAAERAKLAKSTSRIVSRGCEGPADPPGGDRVTARVSPVPVRWPRQLLRQAQHWRTAREEHEGMFERFTDRARRVVVLAQEEARMLNHNYIGTEHILLGLIHEGEGVAAKALESLGISLEGVRQQVEEIIGQGQQAPSGHIPFTPRAKKVLELSLREALQLGHNYIGTEHILLGLIREGEGVAAQVLVKLGADLNRVRQQVIQLLSGYQGKEPAAAGTATGEAAPSTSLVLDQFGRNLTQAAREGKLDPVIGREKEIERVMQVLSRRTKNNPVLIGEPGVGKTAVVEGLSQSIVKGEVPETLKDKQLYTLDLGALVAGSRYRGDFEERLKKVLKEIRTRGDIILFIDEIHTLVGAGAAEGAIDAASILKPMLARGELQTIGATTLDEYRKHLEKDAALERRFQPIQVGEPSLAHTIEILKGLRDRYEAHHRISITDAALVAAATLADRYISDRFLPDKAIDLIDEAGARMRIRRMTAPPDLRDFDERIAQVRRDKESAIDAQDFERAAQLRDKEKQLLGQKAQREKEWKAGDLDVVSEVDDEQIAEVLGNWTGIPVYKLTEEETSRLLRMEDELHKRVIGQEDAVKAVSKAIRRTRAGLKDPKRPSGSFIFAGPSGVGKTELSKALAEFLFGSEDALIQLDMSEFHDRYTVSRLVGAPPGYVGYDEGGQLTEKVRRKPFSVVLFDEIEKAHPDVFNTLLQILEDGRLTDGQGRIVDFKNTVIILTTNLGTRDVAKAVSLGFQASEDTESNYDRMKVKVNDELKQHFRPEFLNRIDDTIVFHQLREQEILQIVDIFTARIEGQLKNKDMGLELTDNAKKYLAKKGFDPVLGARPLRRTIQRELEDTLSEQILFNELRPGQIVVVDCEGDPANVEKSKLVFRGAEKAGAVPDAVPADLGATTSEE

SEQ ID NO: 11257 - protein, 174 aa, Actinoplanes utahensis
MRARRIGQAVFYSAGLGPVSAASLGLAVSGRSAAAEHLSTGWQSRLGPPPALRGRPGPVVANALLGLLLGLLALIPLALEADFVARGILYGWVDRGPYDTSWGGPGRGGAWAVHFLVGVPIAVAGIAALIGLAAMHRRWTARLAGEPGGAWVLPVALLGTAAEVAFVIAFLRQI

SEQ ID NO: 11258 - protein, 195 aa, Actinoplanes utahensis
MHEIRAVYDEHTITVYQAYSPAIAVPAVRAGRFVPPFKRERMTWIKPSFLWMMYRCGWATKEGQEHVLAVSITREGFEWALTNAVHSSYVRGEYPSRDDWQRELRRAPARVQWDPERDLRLRALPYRSLQLGLGGEAAIRYADEWITGISDVTDRVREIRGLLDAGQDARAAELLPPEHPYPVVSRTPTDPRTGS

SEQ ID NO: 11259 - protein, 289 aa, Actinoplanes utahensis
MNDDFTVLRETMDQLSAHGGNADLHDRMLTTSRRITRRNRIVASAAVAVAVVAIATPFTLVATRDSAPGPVVATQPSVATTSPSPAPSSGEPLTPHHHTMVPASPAGGCPVTQQQLIDTVKAYDSRWYQPGDKWRDLECHDGWASAWYVQKVKNSDPGATVFKYDTATRKWVVIGSGSGDYCTSYLPRGEWSKFRIACNGVDPAQPCPTGNTETIDAIEAGQYADKVASDDVVQELACGGKYAVQRLIDGAKTTFIMQWNPAQHRWHPIAAGPCRTVVRSPYADPSVCG

SEQ ID NO: 11260 - protein, 173 aa, Actinoplanes utahensis
MSETTGFTDFVRSRTPALLRTAFLLTGDRHLAEDLVQDALARTHRAVRRLGDDGHYEAYTRTAMYHLQVSRWRRRRVAESLPGELTERADPDSDHAGRVSLQIALHKALAQLTARQRAVLVLRFFEDRSETEAAEMLGCSVGTVKSQTSKALTRMRQVAPDLINAGTMKGADR

SEQ ID NO: 11261 - protein, 298 aa, Actinoplanes utahensis
MTLADESIAWYDANARDLPWRQPETTPWGVLVSEVMLQQTPVVRVEPAWRSWMTRWPTPAALAADPQSEAIRMWGRLGYPRRAMRLHACAQAIVERHGGRVPDQLDQLLALPGVGTYTGRAVATFAYGQRHPVVDTNVRRVVSRVVEGKPDAGPATTTADLVAMEELLPEDSARAARASIAFMELGAIVCTARAPRCADCPFHEVCAWRLSGEPLPEGPSRKPQRYAGTDRQVRGLLLEVLRHATGPVPRQRLDVVWADEVQRARALAGLVEDGLVEPLGHEDFVLAGDAPKVDRQIL

SEQ ID NO: 11262 - protein, 75 aa, Actinoplanes utahensis
MDELGTIAAVTEALTAAGGDVTGLTMQLTGPLQLTAELPPGRADELAQLLAVAAAELGVEVTLRPAEPGGAAVTA

SEQ ID NO: 11263 - protein, 259 aa, Actinoplanes utahensis
MRTTVGPLSPAVYWRRRAVVLGALLLGIIVWFVACSHDDTKPDTKNAASSYPTPAPASATPKSSVSGKPGDSDNGLLASAPAGNPVYPDPVQSQGNNGDSGLLPANGGGQNGGGQNGSGQNTNVNQPAGNACADNEIQVTPVPAATSIKRGANLAITLRIRNVGNRTCTRDVGADPQELYVEAGAQKIWSSDKCSGVHGNDVQTFKPGDQREFNITWNGHQSTACNGATATGPAPAAGQYSLRGRLDGLVSQPVVLTLS

SEQ ID NO: 11264 - protein, 169 aa, Actinoplanes utahensis
MVAALELYLDVDATRRVRTLWRALEAEGIPTLGSLHPRHRPHVSLAAARTIEPYAAAAALDGLNVGRGLSVRMDFAGQFVGRVLWLGITMTPELMDHHRAVHERLAAGGVEVWEHYRPGLWVPHCTVSLRVPNPMMAAAIRRCLEILPLSGTITGAAIADHANDILHPL

SEQ ID NO: 11265 - protein, 358 aa, Actinoplanes utahensis
MRRVMSVLSGAAIATAAFAGLSPAAEAHGAGSCVSAADATYQHTFDGPGGTATITALMPLCDGESQDFSLVSYTAPKKSYAVPQFAYDAQTARIDAGTRSVSLHVAVPGCFTQVDTVFGAAVLNEITGNDTRYGNAKLGSSSGLGSHSSGRAAWYNGGDGVCSPSPAVSFSTDCDGVLHIHLTNAANAGVDAVFVTGGERIRVKAGQAADRTDHSGRPVTVRDNSFRTSIGTPSKPADCPTPTTPTTTPTTAPATAPTTAPTSVPTSAPTSAPTSAPTTAPVSSPSAGAAPTGPAPVSPSASGGVLVTPTAGATTPGGDLALTGSNAGTLGLYATGLLLVGGGLVVAGRQARKRRFTA

SEQ ID NO: 11266 - protein, 393 aa, Actinoplanes utahensis
MPLDRDGSKSAASSSPRPGVNGAGHRAVTPATGSGLTGGASDPLRANLALMAPGTALRDGLERILRGRTGALIVLGHDAVVEAICTGGFPLDVEFSATRLRELCKMDGAVVLSSDGTRIVRAAVHLMPDPGIPSEESGTRHRTAERVAKQSGFPVISVSQSMRIIGLYVNGQRHVLDDSAAILSRANQALATLERYKLRLDEVSGTLSALEIEDLVTVRDAVAVVQRLEMVRRIADEISGYVVELGTDGRLLALQLDELMAGVDSDRTLVIRDYLPTGRKARTLDEALVELDLLTATEMIDLVAVAKAIGYPGASDALDAAVSPRGFRLLAKVPRLPAQIVDRLVDHFGSLQRLLGATVEDLQAVEGVGDARARGVREGLSRLAEASILERYV

SEQ ID NO: 11267 - protein, 472 aa, Actinoplanes utahensis
MTTSRTSSKAARPAYVCDACGHQPPKWLGRCPECGEWGSVIESTVTVGVSGRVVSSRMPSEPAKPISQISAAPAKAVPTGVGELDRVLGGGLVPGAVVLLAGEPGVGKSTLLLDVAQQWAAGAGSPSLVVSGEESVSQVRLRAERLGALHERLFLAAENDLGTVIGHLDAVRPGLLVLDSVQTVSAPGTEGVPGGVTQVRAVTAALVSIAKERGIATVLVGHVTKDGQVAGPRVLEHLVDVVLHFEGDKHSSLRLVRGVKNRFGAADEVGCFEMHEGGISSLPDPSGLFLTRYLEPVPGTCVTVAMEGRRALVTEVQALIGAEVQGSPRRTVSGLDSARLAMVLAVLERRTKQLKLYNREVFAATVGGIRLTEPSADLAMALAVASGGLDLAMAPTLVAIGEVGLTGEIRRVSAVGRRLAEAARLGFRVALVPPGSTAGEGGTPRGMEVIEVGDLRSALQSAARASADHSTR

SEQ ID NO: 11268 - protein, 84 aa, Actinoplanes utahensis
MPAAPTVTTAQITIKPLGSALFHSTDADKLQVVNLSDALRPGESVNLVFHFSNGTPDLTIQAPVAVPLSPASRAPGLENENTEG

SEQ ID NO: 11269 - protein, 128 aa, Actinoplanes utahensis
MRSLVTRRAALVAGVATVGAIALAGCSAGQVAETAILNTPIEGVNADALATDGTVSVAVRNAQVAYNGVKGYAKGENAPLDLNLYNRTASPVTVSISSTPANRPQVVSGTQVGFVKAAAPTTAAAVPS

SEQ ID NO: 11270 - protein, 423 aa, Actinoplanes utahensis
MLQDLAGHHHVGRAVGERQRGHVPGDRDDALPGGPGQPGAAQVDPDVVIAEVADVRREQATTAAGVEQHPARPGRPRDQLGAGGGQPVQQLEAAAGTPPLAGQFVVLARIVAPHRHHVIETRTVAPRPPPGGPGLWTTRAGGQWPFMDRRRSLALLRAAHPEPGAAVTVAMTLLAVGAGHRAGRLLCVFLAVAATQLAVGWVNDWLDADRDRRAGRRDKPIADGAVSRRTVGVAGLVAALAAPVAALPLGAAATVTIAVAAVFGLLYDWPLKSTAFSVLPYLIAFGLLPAFVVVGLPGHPSPPVWLVAAAGLLGAGAHFANVLPDLDDDAATGVRGLPHRIGAGGSRLAAAALLLGATATLVLGPPGAPSWSGWAAGAAAVVVLPIGGYAAARARGRPVALFRAVMVVALIDVLLLIFSGPVV

SEQ ID NO: 11271 - protein, 347 aa, Actinoplanes utahensis
MGVALPPSTVQNDLWDGFFAQHYANGRRGLARRIFANSGVVTRQAAVSPLKEDVSGWSTERRMRRYQDEAVPLGRAAAERALADAGLAAADVGLFAVCSCTGYATPGLDILLARDLAMSPGVQRLFVGHMGCYAALPGLGAVSDHVVARGRPALLLCTELTSLHMQPVGAGAPDVQQIVSHALFSDAAAATVLTPASAGLPGYAVRELAAVTDSTTTGHMTWEVTDLGFRMGLSPEVPAVLSVHVRAMVAELLGRHGLEIADVDGWAVHPGGPRILDVVQERLGLDDGALEASRGVLSAYGNCSSPTVLLVLNALRNRASPPRRVVMLAFGPGLTLYGALLELSPRG

SEQ ID NO: 11272 - protein, 147 aa, Actinoplanes utahensis
MSERGRGAILHGLAALVLAAGGTWWWRAAPRDASDPRLLTWRLTAEQLLPETGDQEAAETVALAPRQDYEKVSDLDGGTFQVSVICAGPDGSRARVSFGGPESGLGLNCSGTRTPQVFSVGVGTELRLRVTAEGEGPVVFRYTLQRA

SEQ ID NO: 11273 - protein, 256 aa, Actinoplanes utahensis
MAGASDNGGWPPDGGWPDELPDLPEEWGVIVIPDDLSELSDEVEAVRAELHLTTAATRWQRLARRPSMRRLRRVGTLMLRAPVLIVSMAILVTVASLFASAWPGPVRQPSVQRTSGTTPAPSNTLPALELVAADGKTVPLRGRLPAVVLITDGCDCAALVAATAAAVRSDIAVLAVSSARPSAPTPTGLTTAQAPPSDGKAVRYLQDPTGALREQMGLTGQDGTAAAILVNETGTILRKFPHVVAVESIQPDLQRL

SEQ ID NO: 11274 - protein, 161 aa, Actinoplanes utahensis
MVFSVGETVVYPHHGAALIEAIETRVIKGVERQYLVLRVAQGDLTVRVPAENAEEVGVREVVGEEGLGKVFDVLRAPHTEEPTNWSRRYKANLEKLASGNPLKVAEVVRDLWRRERERGLSAGEKRMLAKARDILVGEVALAEKSTKDEAEVLLDKVLTEA

SEQ ID NO: 11275 - protein, 243 aa, Actinoplanes utahensis
MIADRDVTAQLNARGDVAVVVPAAGAGLRLGPGGPKALRLLDGEPLLVHAVRRLAAAAPVRMIVVAAPPAEVDAVSALLAPVAPVTVVPGGAERQESVAAALAVVPPDVPIVLVHDAARCLTPPSVTERVAAAVRDGADAVIPVLPVVDTIKEVAADATVLGTVDRSVLRAVQTPQGFRASVLRAAHRAAADSHTDDAGAVEKLGIPVLCVPGSDLALKITRPIDLALATHLLALPDPDAPTA

SEQ ID NO: 11276 - protein, 162 aa, Actinoplanes utahensis
MIIPRVGIGTDVHAFDADRACWVAGLEWPGEPGLAGHSDADVVAHAACDALLSAAGLGDLGGNFGTSRPEWAGAAGVTLLAETARLVRAAGFAIGNVSVQVIGNRPKIGKRRAEAEKVLSAAVGAPVTVSGTTSDGLGLTGRGEGLAGVAVAMVYTENALPA

SEQ ID NO: 11277 - protein, 434 aa, Actinoplanes utahensis
MEPDPTPEEHRQRALLLADLGRYDEAADEIAAGLSVAPGGTAGGVGDAASGAASGAPGGVDDLPGGGIGGLGDQASGAPGGADDAVSGAAGGRVGGAGNRSGAADSASGADTAELLATLARIHLVAEQPVEALAAADRAAAARPVSLTAHVVRAMALADNRRYAEAAQVAGEILRAWPEDAYAQRTGAALLSESRNGQEALNAAWNGVRVAPGEAEAHLVLAVVAARLRLFDLAQRAYGEALDLDPAIGDAGQDVGIVRLERRRWARALEELAEEASLTDADGFPEERAPARAGVVEPPAVSLPRRAVLDVSADSMAAVVETIRYGANGTLVAAVVTAAMTVVSSGISRVWAGLIGFLVFVAVVLWFRSRLTEPAGPVLARLRSTARPLAAAWHLSLAGPLFLLAYAVVGGLPTLIAGMLVAGMADLIVLIRRR

SEQ ID NO: 11278 - protein, 285 aa, Actinoplanes utahensis
MSTIVPPLYAGLVDDASLLPPSPTGLADAEAKYREHATAWYADLIGTLLVPASVVGAEPVPRVPAALVGDIPAGALPATVEKLRAAGMVIEHVEAAVARRGEDPQPGLSLLRTIAAGELGATGSARVWAEIPLSWGLIGALDTVAEARREGLPIAPKFRVGGLAAELFPTPVELAAVICACRDRELEFKLAAGLRHATRHTDPETGFTHHGFLNVLVATLLAVDGGEVAEVAEALAATHPVPLVEPARAHRDDPRPLFAGFGAASVVEPLTELIRLGLVNGGYEG

SEQ ID NO: 11279 - protein, 380 aa, Actinoplanes utahensis
MLLRASVAVLLLLATILVGWRILRPAEVLATAKSPYPPLVVSAPGVVGRLNVAPLLVEDRLRVYAAKHQLRADEPVDSKGVNTAHWSLRRWPAQLSGVVAAGSTVVSRWSDGAIVALDARTGKIAWRAGGPQAPDYAGHRTGAATVWSPPGLRVAAGAVLVLQDQRLTAYDMGTGAVRWQVSTPAACADGFTTAGGAFVCGSGAFDGATGAVLPGWPAGKFAPVGCAVASSGCAGLRDGAGHGWLTGRVAPVRSVALDDPDATVAGGIVVSTANGVVTGHRPDGSAAWGWSGAGRVLGGVPGRILVLTDDHFLVGLDSADGRERYRFHLAFRKENDQWSLGGQMIGDHYLALERLNPKPPADRESPTYYFTTDTVLMVGL

SEQ ID NO: 11280 - protein, 372 aa, Actinoplanes utahensis
MTTRSTELLRVVHRTPGVTRADAARLLGVGTGAATELVARLSRAALLTQAPAAPSGSRGRPTTLLLPHPDGPLTLAVAITHEGWRVEAVELGGAIAGSRTGGHAGAAWPEVRSAVRGALQELRSAYGHRPRAVGVSVPGTVSRDLRLEAVGTGWHDVDLTELGAAGEVFVAGNDATLAAAAESHRGAAAGASVALHLRIESGLGGAVVDGGRPVIGAHGAAGEFGHMPFGDPAVRCPCGARGCWGIAVDGHELARLLGDPEPPDPITYARRVIAAAAAGGRTVTAVRAVAATLGRGIAGLVNGLDADLITLGGLGADLLAVAPDEIGAAYRDGLMSIHRESPPPIVAAVLGDRGPIAGAAEEAWTALLPTLA

SEQ ID NO: 11281 - protein, 441 aa, Actinoplanes utahensis
MERVVTSVPFLMLFGRAYSVGVSFHRPALVVLGASAFFYVTAETLPVGLLPQISAGLHVTEAQVGLLLTSYAVVAALSTIPLTALTMRFPRHTLIAATVAIFAVSQAAATFAPTFVVLAAARLICALAHGVFWSVIGPIIARLAPPHQVGRATALTFLGNSLAIVLGVPAGTALGQWLGWRVAVGLMAVGGAVCVALLLAVLPKLPPMPRDLAAGSREQLRNAVRILRNPRVVRLCAVTGVLVIGHFAAYTYIAPLVRRDAGLDGAGLSALLLGYGAVGLLTTFLVGRFVDRHPGPLLLGLLAVQAVSVALLAPVPGTVPTIVATLLWGGAFTAIPVFLGAAPLRVAPTARDAASAVYVVAFQIGIGGGAFVGERFVTAGRLGALPLLAGVLAVMAGVLVATSRTVFPARMSAADHDRVSAEADSFEGIAARSGHHERAAS

SEQ ID NO: 11282 - protein, 358 aa, Actinoplanes utahensis
MTRLTRADLDALPAYVPGRNVADLARELGVAEAIKLASNEVPYGPLPGVVEAVTEAAQQMHRYPDMGVLALRDALAERFGVAAERVVTGCGSVALAEILVKATCLPGDEVIYSWRSFEAYPIIAAGAGATSVRVPNRPDHGHDLTAMAEAITDRTRLVFVCNPNNPTGTALHRAELDRFLAAVPSDVLVVLDEAYRELVTDPAVPDGLETYGDRANVVVLRTMSKAWGLAGMRMGYLVAPPAVAAVLRKVLTPFSTSLVAQAAALAALRQETEVVRRCALVTAERTRVTEALRKLGVDVPDSQANFVWLPLGDRSAAFGAACESRGVIVRPFQPDGVRVTIGTPEENDAFLAAAEATW

SEQ ID NO: 11283 - protein, 191 aa, Actinoplanes utahensis
MALAGLGQRLVARLIDIAVVLVLNIVVNGWFAYQWWRDFHPILTRYMDQVQAGAKPDYPVGTERMATLQMTIILISTLLWLLYEAPAIAGRGQTLGKMMMGIRVVGLDSTEPIGFRRAFGRWAQLGLWSLFWWCLVGFVVQLLDSLSPTFDSRLRQAWHDKAARTVVVAVPDGAQPTVEATPGGDLPGGPR

SEQ ID NO: 11284 - protein, 54 aa, Actinoplanes utahensis
MSSLPAGWYKDPADTSTQRYWDGEGWLGKAIPADAVPPDGPPPVEVEPAPVPPV

SEQ ID NO: 11285 - protein, 375 aa, Actinoplanes utahensis
MTSLPENPENKDVFPVKGVDHLRFLVGNARQAAHFYSTAFGMKCVAYRGPEQGYRDHAEYVLVSGGAKFILTGMVHAGAPGAEHVTKHGDGISDIALQVPDVDAAYLHATSTGARGVTEPYDVKDEHGTVRMAAIATYGDTVHTLIDRSGYDGPFLPGFVAREPIVAVRPKRFFQAVDHVVGNVELGKMDEWVEFYRRVMGFTNMAEFIGDDIATDYSALMSKVVADGSRKVKFPLNEPAVSQRKSQIDEYLEYYDGPGAQHVALATNDILTTVDAMRGAGVEFLDTPDSYYDDPELRARIGQVRVPIEELKKRKILVDRDEDGYLLQIFTAPVQDRPTVFFELIERHGSLGFGKGNFKALFEAIEREQERRGNL

SEQ ID NO: 11286 - protein, 162 aa, Actinoplanes utahensis
MATEQGVQLDELDARLIELLAAEPRIGILELSRRLAVARGTVQARLDKLTVRGAIKGFGPEVTPAAIGFGVMSFVTLEISQRYGHDAVAGHLAEIPEVLEAHTITGSGDILCRIVARSNADLQRVIDQIVGYEGISRAHTIIALAELIPYRTVPLTRAAART

SEQ ID NO: 11287 - protein, 425 aa, Actinoplanes utahensis
MASGTWKGFTLVAAVTVTVLAATGVWNPFPRLWEWVNTSGPVAPGTRWQQRLTGTPQSVAVIGDAVVVEYRTSVEAYGLTAAVKLWESDADWAAVAGQGSDAVVVTGRLLTKGYQVLDPRTGTVRRADTTAGAVWTYDNGIVDLHCAGGNDCRLTAWDPKSGDQLWSVATGGIGFVLHAANPDLPDTHRLGTGDVDDQAAGPAQMPGLLGLPDGDRVRVIDTANGRLVQTVQPGPDQRIAVTGDRVLTITGTARDGTCYYGVVATSPPGNRAVWRRDGLNLRTAQSDCKQDRDPAGGYDVLLGVDPYGRQELINAADGRILWYGDKSAEVLTVDDRYAVIRDGDTLRGWSFARGKAVWRQGGRAKAGATVTPNAVIVVSSGRVTALNPANGAVRADVRTDAKVFTAAPGGLILVSGRDMAYLPYS

SEQ ID NO: 11288 - protein, 555 aa, Actinoplanes utahensis
MSRGAAFTYSPLLPTGDDTTEYRLVTDEGVDVVEGPGGRRFLTVEPAALTVLTAEAMHDIAHYLRPAHLAQLRAIIDDPKASPNDRFVALDLLRNANIAAGGVLPMCQDTGTAIVMGKRGRHVLTDGRDEEAVALGVYQAYTRLNLRYSQLAPITMWDERNTGSNLPAQIELYAEDPNGHPDAYKFLFMAKGGGSANKSYLYQETKALLNPQRMMQFLDEKLRLIGTSACPPYHLAVVIGGTSAEHALKTAKLASAKYLDNLPTAGSMAAHGFRDLELEAAVLELTRDFGIGAQFGGRYFCHDVRVVRLPRHGASCPVAIAVSCSADRQAVAKITPSGVWLERLETDPARFLPEVTDDHLESEQVVKIDLNRPMSEIRAELSKYPVKTRLSLTGSLVVARDIAHAKIAERLDAGEPMPQYLRDHAVYYAGPAKTPEGYASGSFGPTTAGRMDSYVEKFQAAGGSMVMLAKGNRSQQVTNACKTYGGFYLGSIGGPAARLAQDCIRHVEVLEFPELGMEAVWKIEVEDFPAFIIVDDKGNDFFEAVTKPVLSIGKR

SEQ ID NO: 11289 - protein, 167 aa, Actinoplanes utahensis
MRPAILAVIAGSVLLTGAACDSDDAKVSTAGAPTPAAPVTIASPDYSADTAQVCGKLDKVFTGQLDDFGAAIGKMIAYKEAKQADNATKAEKAAADELQSAGEQIRTETAGAQNPELKEAGEESARKFEASAKDHAYLKKIKSTADLDKTLKPQLAEWMSPVAGFCG

SEQ ID NO: 11290 - protein, 1001 aa, Actinoplanes utahensis
MERPRRRLCRTVLSFHCRSTLTRGLLSITGTGNEVATVRYRILGPLSVTVDGQSVAVTAGRDRVVLAMLLLRPHRIVGAGELIGALWDGDPPATARGQLQSCISRLRRILPPDVIVTDRAGYGIRVGPGELDAEVFTHALEQARTNADRVAFRAVLALRRGPVCAELDAPAIRQAAAVLDERYALAVEDWAELELAAGNERELAGELTAYVERFPLRERLRGQLMLALARSGRQADALAEFRRARDLLADELGIEPGEELQKRHREILQGDLGEVVHAEAVRCLPRTVGDFTGRREQIERLMSGIGAATGGPVVAVIDGMAGSGKTTLALHLASLLGDCYPDAHLFLDLQGHSERDPVEPAAALLVLLRQLGLAAGEIPLEAGRRVDVWRTETARRRVLVVLDNAASSAQLADLLPTAPGSLALVTSRRRLTGLDGVRVESLPVLTQDEAVSLLAQIAGARVDAEPEAAAEVVRRCGLLPLAVRLAGARLAHRARWRVADLLHRLGEAALPELAAEDRSVAGALTLTYRQLPEPLQRVFRLLGVYPGTEFDALAVAALTDLARDTAEDVLDALVDVNLVEEPDPGIFRMHDLVREFAATLAADLPAVDRQAALTGALDFQMHAAAAATSVNKRVILWRDIGSPHPARPDLTVPDPIARLEWERPQLAAHITAAIAAGRLDDAWKLARAAWHFLYFRGYMDDVRELNTLALPAAEASGDRAAVATVANYLASAYARAGQAGEAEGYLRLCLRLRIELGQHAAAGTSMANLASVYLHQGRLTEAVGAVQGALRYWVSSRVKVNVGSELGVLIDALDLLGRAAEALHHTRMRMFSAIDQRAEAELAASLLYLARIRYRAGWLRAEAAHRYLDACLRLADRSGHRSIVADAHNERAVLHRDAGRLADAVAEHRRAVEMSVRMSDARHQAEFRNEWAVTLRRFDDLAGARELHEHARRIAQAAGNPYSIARAHAGLADCLDPADPAAERHRVQAREIFDRIGVPHV

SEQ ID NO: 11291 - protein, 465 aa, Actinoplanes utahensis
MTSDQSGYRIERDTMGEVRVPADALWRAQTQRAVENFPISGRGLEPAHLRALARIKGAAAQVNARLGVLDKDLAEAIAAAAAHVADGGYDDQFPIDVFQTGSGTSSNMNANEVIATLAARALDRPVHPNDHVNASQSSNDVFPSSIHLAATEAVSADLIPALEHLAGALRERATAWAEVVKSGRTHLMDATPVTLGQEFSGYARQVLNGAERLTATLPRLGELPLGGTAVGTGVNTPPGFAPAVIELLREQTGLPLSEARDHFEAQGARDALVETSGQLRVVAVSLYKIANDIRWMGSGPRAGLRELRLPDLQPGSSIMPGKVNPVVPEAVRQVCAQVIGNDATVAFAGTQGDFELNVMLPVMARNLLESIRLLAAVARLFADRCVAGLTANEEVARGYAEGSPSIVTPLNRVLGYDEAAAIAKQALATGRTIREVVIERGHVSAGTLTEEQLDEALDVLKMTRP

SEQ ID NO: 11292 - protein, 550 aa, Actinoplanes utahensis
MRRRLTAGAVVTVTGLAFLTGAPGSAVAEPAASVDYTVVAADGVSAADATAAIQAAGGTVVSGNDAVGVYRVTSADTTFESRASASAALIGATVRKAIGYAPNGVEKVEAGLAARGGKGHGPAKADPLDDKLWGLSMIKADKARRIEKGDRGVTVGVLDTGLDASNPDLAEHFSSRLSRNFAPDLVDIDGACEVPSCLDPVGTDDGGHGTHVAGTIGAALNGVGVSGVAPDVTLVELKGGQDSGFFFLDPVVNALTYAGDRGIDVVNMSFYVDPWLYNCTANPADSPADQAGQQAIITGMRRALNYAHAHGVTLFGALGNNHEDLGKPRTDASSPDHGGTPYPRPIDNASCWDLPVEGPHVIGVSSLGPSGRKSDFSNYGTEQISVAAPGGWYRDGYGTDTFQTVGNEILSTYPLKVLQEKGLVDADGNVTAAGAGSVVKDCAGDGRCGYYTYLQGTSMASPHAAGVGALIVSRYGLPDLRHGGRFLPPDLVEQILYRTAAKHACPEPRLQSYVQEGRSTEFDALCEGGTNFNGFYGYGIVDAYAAVGGR

SEQ ID NO: 11293 - protein, 472 aa, Actinoplanes utahensis
MVTLRLYDTATRSVRDFVPMTPGQVGIYLCGVTVQSSPHIGHLRSAVNYDVLRRWLLHEGLDVTFIRNVTDVDDKILQKSLEQSRPYWAIAFENRLLLEHDYRTLNVLPPTYEPLATGHITEMHDLIAELIERGHAYAAAAANGDVYFDVRSYEPYGALSGQKPDDMRSADDAPERDKRDPRDFALWKGVKADEPQDAYWPSPWGRGRPGWHIECSAMARRYLGDEFDIHGGGLDLTFPHHENEVAQSQAAGLGFARFWVHHALLNLGKSKMSKSLGNVIDLAAVTAAGIRPVELRYYLGSPHYRSRIDYSDEALREAAVAYQRIEGFVHRAAEIVGPGRPKAVPPAFADAMNDDLNTSAALAVVHDTIREGNTALAAGDEPVIRGALTAVRAMLGVLGIDPLDTAWDGGESANNLKPVVDGLVALALEQRAQARARKDWAAADQVRDQLKNAGIQVEDTPAGPRWTVGEQH

SEQ ID NO: 11294 - protein, 375 aa, Actinoplanes utahensis
MPGNSQNASKRVTSKKGAAAGSGGKNRSSLKGRGKTLPADERPWHKGYSGTEKLPEKTARKQDKERRAAAAEGRTPKVGQPGTKDTTWGRGGGRAPGITRAQASRGGGRVTGPRGPRVAPGRRSNPTKEGPELLLGRNPVVEALRAQVSATALYVVQGIDIDERVAEIVRTAGDRGIPILEISRNELDRMTGGVLHQGIGLQVPPFAYEDFDDLVAASLEQTAPLLVALDGVTDPRNVGAVIRSVAAFGGHGVFMTERRAAGITATAWRTSAGAAARVPVSQVVNLTRAIKSAQKQGFTAIGLDADGETDLYQLEAAIGPLIVVVGSEGRGLSRLVGETCDLRVSIPMASDVESLNASVAAAVTLAEVARRRVHG

SEQ ID NO: 11295 - protein, 642 aa, Actinoplanes utahensis
MASHMGESVSNKRRAAHLLLAGLTATTVWSTGLAAPAHAAGTATTAAAGTVADPTNVATDEDKVKAAAAIGVNPGIDLLVLNDQAFVFALYQRDEAGPYVKAEALRTYLSSDPHAAYDFIVNGIFVAADDDAHAKIVEETAKARRRSVAVTVGLDPSETALIERNDRDFIFAVWQRVTAGSHVWTAAQAAIADGTGQAEWDAFLNTGAAAAAEQDLRDIIVDGDEAQAAKLRAAQLVAAKKSLLQLLLLPVTDELVNAPDRQFVLHIHNNAKGDEVSLASQVALNTPDDKLAQALTDFIFTGGAAANKRDEDAAAAKELAGYKTRVTAIRDAAKTDGWLPNLLAAANQALTTGTLVALQAFLLKGQDEARAKDQKSWGNVALAGDRVGILTNNSVAYVKEGTPAATSWVNEYPGGVKQLVLAGNRIGVLLTNGDAYVKEGGLSTGWVLEQSNVKQLTLAGTRIGVVLTNGIAYVKEGGLSAAWVMEYQGVQQLALTTNRIGVVLTNGIAYVKEGGLSTGWSTQRSGIKDITLTTTRIGLLGTDGTAYVKEGAITGTTWITELTGVKQYVLNGTRIAALTTGGIAWVKEGGVSTAWVNEEDNVAKLALDGDRIAVLFTDGTTALKDGGLSALWTSQKSVGPLS

SEQ ID NO: 11296 - protein, 640 aa, Actinoplanes utahensis
MTFPVKRLRRRLLAGVAVGVASVLVTPQIAVATPYVRAPLAAAPQELTVQQALERLLGGQERASSPANDPVDDAELDRMLVQDLADYDADPEVRAAAAAALATGDAAKIRDFLDNGLPVYRKDAEQHKKDEAERNRAQIDEWLETGGPLVRKNGQAALDSGSDAKIADFVATGHAAAELADQQDVLSAAQKAQMIQARVEQMVAQGGYEVQELGQAALDSEDPAIIEDFYLNGYQLAAQQDAAAQQQITDALAARAKAVADLTDLAQRAAQAADAQQKIIQASVTATTALTDVSATMGLANRNAKQADAVYAADLPLRTAGKPTHTADLTSLRTVACQDAANAAHSADQATAQAGVAATAAATLEKTGLTHGITWSEVTQAQSDAAAAGRLAAETACHAAEATEAAGKALDADHSATVDANNAVKYRQAAEREQAAAEKLADKAEKLAAAAQAAAADAKAQRLRAESDAASARQHADNAAAYYEDARQKRAVARAAAAAAIQHSLNAYDAAKRAIDQQNIVVAKGAVAKQKQDEALAAGARFKDKADRAQALITKASKDNENTKSKEFEAQAAEARQLAAETACKNPQTANGCPGTADMQKIRADAAQMRTVANQAKTASDASKAASDTAAGESSAAAAD

SEQ ID NO: 11297 - protein, 601 aa, Actinoplanes utahensis
MAAQAGSDAGAAQQAANNAAGFAKKAKQASDNASALSKKITGVSDTISSISEAMWSVAQSMGTMAHTLQDIAWQAYNAEQAAAEKKLNDWIDDKAKWLNDHIGGSDVTKGFIDGAAGMVKGIIQTSNCVTGTFLGTDAATDEYTVPDVSYLPNSDKSCKMLVKGVKDLLSDPKQLLHWDDWKKNWKYALGETLFDATFFLVTDGTGLITKIAESGIAATAKQAIKDIAKLSAKDMAAGVVKFGTEKLVNAIKELGATATARIIELGESLGEKLKITFNPDELKAMSNAIGLKGIDAVEGALRDLKDSPLIKGLEDFAEECFEGKNSFAPGTLVLLADGRTEPISEIGIGDRVLATDPITGATRAEPVTALHRNYDTALVDLAVADRAGHRSVVHTTEEHPFWDATTRSWTDAAALKPGDRLRGLAGANARVASVRSFTGGRIMHNLTVAELHTYYILVGGAPVLVHNCADLIADDGKFQGQAHTLDEHVDPDLAASQKLAIEKTAKLGYEVKNSVFTDLQTAQSVVDYAIAFNKDRIGKWLSNKDAPQELAWQGKFGAKNSLGVATDVRGLQTACGNGFRIVLKKAPGHKSGFYVFTAFPI

SEQ ID NO: 11298 - protein, 200 aa, Actinoplanes utahensis
MPLSPFDRGITALAGTFFGPEWLHHGDRFDVLRLAYGAEADPGAVAATRQEALLMLGGLATTAVQALWQAGTRAWVGIKHAPDAGHQWMREIVAFCDEWSARHPGPSSGAEPADDGRELLTSVLALIAEVRIPDREVTDALADCARNCTPDLALRWLLQVLSVADHPLLTASQYDVVTQLAEHLKYGEYVLPDRGVIVAD

SEQ ID NO: 11299 - protein, 629 aa, Actinoplanes utahensis
MSTKRQAAHLLLAGLTATTVWSTVLTAPVYAAGSTTAAAASVVADPTNLATDEDKVKAAGAIGVNPGIDMFVLNDQAFVFAIYQRDEAGPAVKAEALRVYLSSDSHAAYDFIVRGIFVAAGDDAQAKIAETAARARRSSVAVTVGLDSSEIALIEKNDRDFIFAVWQRVTAGSHVWTAARDAIADGTGQAEWDTFLNTGAAAAADLDIREAIAKADAEQAAKLRAKQLADAKTSLLQLLLLPVTDEEVNAPNRQYVLFVHNNAKGSEVSLASQVALNAPDDQLDKALSDFIFTGGAAANKRDEDAAAAKELAGYKTRVTAIRDAAKADAWQPNLAAAADAALNTGTVVSLQTFLLKGQDVARQQDNEYAATFVRDFNGDGKRDIAGIDANGDLKVYVGDGAGKLAEGGAMWPVGGSWKNHKFITSADFNGDQKTDVVAIDARGDLKLYTGNGAGKVAEGGAMWPTGGAFTNYKAIIAGDFNGDRKTDIAGIDAAGAMRLYLGDGAGKVTDGGTMGGSWGGFKAVVAGDFNGDRKTDIAGIDANSDMKLYPGDGAGKITAGTAMWALGGKWAGFKAIVAGDFNGDKKTDIAGIDANSDMRLYVGDGAGKLSGGTAMWATGGKWAGFKRIG

SEQ ID NO: 11300 - protein, 398 aa, Actinoplanes utahensis
MRSPSWQVVGKQIRWRGSSFYSDRPARSCRWKGSRFTMATVTYEKASRIYPGSERPAVNELNLEIGDGEFLVLVGPSGCGKSTSLRMLAGLEDVDRGRILINDKDVTHLPPKSRDIAMVFQNYALYPHMTVYENMAFALKLRKTPKSEIDRAVKEAAALLQLEEYLTRKPKALSGGQRQRVAMGRAIVRQPQVFLMDEPLSNLDAKLRVQTRSQIATLQAKLGVTTVYVTHDQVEAMTMGHRVAVMLDGVLQQVDTPRALYDTPGNVFVAGFMGSPAMNIKTVPLTEAGASFGALTIPLTREQVAAAQSGDGKVTVGFRPEAADIVTEQVGALPIVVDLVEDLGSDANVYGHADLAGGSERFVVRTERRTMPHMGETVYIKPQTNSLHVFHAGSGARI

SEQ ID NO: 11301 - protein, 618 aa, Actinoplanes utahensis
MPAPGDGSEDTAAHGHEQDQDQLPDPLVYATGTAAAATPTPTPPTAPHEPPVRTDTRMDDPLPPRPASTEDPSIRYTAPVDPWADSAAHPAEAAQMAQAAQVAEAAQMAQAAHVAEAAQMAEAAPPVRAGHDAEPPTTVTPPVAPSSPAGPPAGGTSGSTYAAHQPRAGTTSYKKGFWVLGGAAVAAAVALGIAATILLGPGFRALDYHELDRVAHFPPVAAISSTWAATQVRGDRAYFASVDEQGTAGVVAADTGTRKELWRSTEAGTAHSWHSMTALPDAVALVADPDYSTSQSTGRLVVLDGRTGHKRWEHAFGSSDTMLFRAGILLLVDRTDGNLIGLDLTTGTERWRDANPDGSANSTVLDVTTPDGLTGPATNDGFPVADDAGDGRIVQVAGDRSARIVDLATGKVGKTRSNVAYSSDKMVAHHGRLFVEESATDRLVAYDLKNFDTAEPAVLHTARNGAEVTDLTPCGDDRICFVETAGYQRDKAEAVAYDLTAHKETWRRPAPQAETLVPVGDAVLVTTGKSTTLLGADGKAQWTDEPGDAVRLDAGNVLRFSDTLSPSVDDRILTGVHLGDQPALIGRLRDVRSSTCSWNRSVIACAGDKDYLIARFAG

SEQ ID NO: 11302 - protein, 158 aa, Actinoplanes utahensis
MQTFLPYPDFLASARVLDQKRLGKQRVETIQVLRGLTRHDYGWRHHPAVLMWRGYEEALVRYGLAMCEVWTASGHADTCADTLLADLGAAKGISTVRTQPELARIVGLPPWLGDPDLHRSHQSALLRKDPATYRPVFGDVPDDLPYLWPVSRTTAVSR

SEQ ID NO: 11303 - protein, 263 aa, Actinoplanes utahensis
MRKLWYAGAIAGGLLFILGATGPALADPASPVGGPVDDVLSRTNGLRLSSPIGSDPLGRAPLLTLSQDNQQLFQVKPGQNSIGRSPEEKAGGALPAADVIGGGIHNHPGDRFGGSLKGVPLTDTNTGAVRLPLLGGGRLPIISGILPDGSHTVESASRQYPLLDDLDGDLSVRGLPRRLPTTNRANLAGLPLGGSPVAPADLLPESSRPKHPASVAPSASPEPTMSASVDPSMSPSVIPSGSLASNVDDPRLLQEPIDIPSAD

SEQ ID NO: 11304 - protein, 564 aa, Actinoplanes utahensis
MNVSTEIHPDAENLPHLVVCGADALVWTLAEELANSRHRIRLTVITPHHIRSDVPDLKILKKVGVELRHADRLDEQAFEDAGLAGATALALVMPDDMVNLHAALCAREVEPRLRVVARMFTTGLAGSLARIFPDSEVLSDAEMAAPAFVAAALGEVAPTHFSYGDRTLYVAQRADVPARNVVLTLRSGVLLPAEPAPGAAGPDDLVLAQAVGLPAGDDVTRRVLARAGRSRRPLGGLGRALRAALNRKLGIAVLITLGTTMLAGAVLNIWDGTRHNLWQSIYVTLMTAVGASDVQDKRNPVAQAAQLVLTIGGLALLPLVTAAVVDGMVNARLALAQGRLTGELRDHVVLVGLGNVGTQVLRQLHALGVRVVAIDRHADARGVKSAQRRGLPVIIGDAAREETLRSVSIETCRALVVLSTNDSVNLQAALHARAIRDDLRVVLRLFDDDFAQRIGAAFDINTSRSVSRLCAPVFAAALLEHNVSVSIPVDRQVLVVGTVTVREGSDLDGALLTAVDKPGQTRVIGMSSAGQGWIDWRPDPRRLLVTGDRILVVARQRALRALAR

SEQ ID NO: 11305 - protein, 403 aa, Actinoplanes utahensis
MRITSALIDPALLDLPWHVPLEDWPADHLVALPQGISRHVVRFVKLNGVVYAMKETRERIAEKEYDLLRALERIDFPAVQAIAIATDRQTPEGEPLETVLVTRHLQFSLPYRALFSRVLRPETMNRLLDALAALIVRMHLTGFSWGDCSLSNTLFRRDAGAFAAYLVDAETGNLYPRLSEGQRSEDIEILRLNIFGECLDLQAAELLHESIDPETVVDDIVARYERLWHEVTYEQEVAKDARHHIERRIRRLNEMGFDVAEVSMSTVDGGYRVRPKVVDAGYHTRRLMRLTGLDAEENQARQLLNDLDAYRAESALTDEQQAAHRWLTEVFEPVVRAVPATMRRKLEPQEIFSQIIQHKWLLSERAGRDVGMGPAVQSYLTEVLVNKPDEQAVLGVEAEELVS

SEQ ID NO: 11306 - protein, 450 aa, Actinoplanes utahensis
MRRKTVFVVGACAALVLAGVAGAVTATRGDDHPARVWHSAPGVPKVRVAAEATLRAVPSPTSRAAKKVDEAPVVKAPDDLRHAPIVESAQVPDEPGRQQVGELLSVGRLLGYLAGPPRETFRYPGASYVKLHFARMAMLPGDYVTVSNPAGTESYRYQPGSTGRWAMSITGDTAVVQVHRALDPLGLRSALDGLGVTVDRAARGFSRTEQARVPEETTVRPGRTGREESICGPDTSADAVCYQSADPVAYVKSKAIARLLINGTELCTGWRVGPKNRMLTNNHCLTTSEEAYDTEVWFNYQCAKCGGYDVFKPTKVWGDRVFSTDHVLDYTLFSVDAFETIQQFGYLTLDPARPAKGTELYVPQHPAGEPTRIAGAKGDKAGNCAVEDADYTGYVAHSDVSYLCDTAGGSSGSPVLSRKTNRVVALHHFGGCPNSGVRGDLLAAKLRAYL

SEQ ID NO: 11307 - protein, 237 aa, Actinoplanes utahensis
MIRRRILSWWPDLLLLAAFAALTGALITGHLLTLDQRVADWAFDHQPAVPYWTARVFNYLGQGGKVLTPVALILTGLLAHRTRSVRALLPFIAAYVVTYVTIGPMKLYFDRAAPSYPGPFKTEMFNPVASGQDARSFPSGHVGNSLVWYAVFAILIAELLRRRLTRRESFAIRVLPVAAVFVTTVYTGFHWLTDSLAGLLLGLVLARLIERIPWDDIPLPAAGGWSRPAFRDSAVRG

SEQ ID NO: 11308 - protein, 273 aa, Actinoplanes utahensis
MVSACVRGSESACARVVRTSRPIDWRNCSAMSARFGSVGMVLMYNSVVQQCCTKRREFDMELTKFGHACVVLEHDNRRLVIDPGALTPEDAFAGADAVLVTHEHFDHFSAEKLSAALAANPALRLWTNTAVAEAFDGDPARVHVVGEGDAFQANGFEIRAYGEWHAELHPDIPRVPNIGFLIDDAVFHPGDALTVPDVPVTTLLLPMHGPWSRVADLIDWVREIKPARAVGVHDGALNPLGQAMIGNFLGDRSPAPTGVPFVHLAPGAALPLG

SEQ ID NO: 11309 - protein, 282 aa, Actinoplanes utahensis
MTGHRTPPALGADASRAAPALDADDRRPTPALDADDRRPTPTLGGDSRHAAPAVGAGDRDLSPGAGGSVRVVIAEDAVLFRAGLTRLIEDHGHRVCAAVGDGDALLDAVTEHRPDIVVADIRMPPTYTDEGLRAALEIRRRHPEVGVLVLSQYIETRYTARLLEGNATGAGYLLKERVADVAEFVGTLVRVATGGTALDPEVVGQLLRATRRADGLAALTPRERDVLALMAEGRSNAGIADALTVSGGTVEKHVAAIFDKLALPPADADNRRVLAVLRYLGT

SEQ ID NO: 11310 - protein, 374 aa, Actinoplanes utahensis
MDPSPTTSHRRPGRELMFCLSGLPFALISPPVLFVALVDLLWWVVDDGRRNPSPAEIVAAAVSLAVLIGLVVRTGAAARLGGLHRRLAARWLGVRVATPPDGASGWRVIAYQMIKLPVALLQGYAVFFWVGGLVNLGYPLWWGAFRNHAPGVHLSPLPVYTPFGLFGQGTFRVATLPGTFAAAAAGAAMLLAAPWVTRAAVTADAHLIGRLLGPGRLAQRVHDLEVSRALAVDDAAALLRRVERDLHDGAQIRLATLAMNLGMAREKLGATGPVPDPQAARELLDAALRGTREALADLRGLIRGIHPPVLDNGLADALASLAADRAMPIDLNVDIPVRPTPAIESIAYFCAAELLANAAKHSSANRLAVRAAGR

SEQ ID NO: 11311 - protein, 256 aa, Actinoplanes utahensis
MTTRGYGPVQAARMEWIKLRTLRSTWWTLAVTIAATVGIGLAVGHNTRDGSGDVVNNALAGVVPGLLLTGVLGVLTATGEYSSGTIRATLAAVPRRPLMLAAKAAVFGAVTLLTGEIAAFLAYVAVRATLRAGVPAPTLGDPGVLRAVVLSGAAFSLIGLLGLGLGAIVRHSPAAIGVLVAGVYVVAQFLGIMAHAVAAYMPLLILENSLSTTRPVNCGGEACPHFLSAWAGIGMMSLYAAVALTIGGWLLARRDA

SEQ ID NO: 11312 - protein, 240 aa, Actinoplanes utahensis
MIEARELTRRYGRTVAVDALSFDVRPGAVTGFLGPNGSGKSTTMRMILGLDRPDAGQATIGGRRYRELRWPLREVGAMLEAKAFHPGRTARGHLAALAASNAVPRSRVDEVLDMVGLTGAAGRRAGKFSLGMGQRLGVAAALLGDPGVLLLDEPVNGLDPEGVRWIRTLLRSLAAQGRTVFVSSHLISEMALTAERLVVIGRGRLLADTTVAAMSAEAASLEDAFFQLTSGSVEYRGATS

SEQ ID NO: 11313 - protein, 365 aa, Actinoplanes utahensis
MTRISGRIVTPGGVVTGHLDIEDATIAAIVADDTAGDDVIVPGFIDLHCHGGGGHTFTTGDPAAARAAAAFHLGHGTTTMLASLVSSPFELMREATLAYRPLVDDGVIAGIHFEGPYLSSARCGAQNPAFLRDPVLAEIEELVTIGAGGVRMMTVAPELDGALAAIACLREAGVLAAIGHTDASYEQTLAGVAAGASVATHLFNGMRPVHHREPGPVVGLLSSTATVELIGDGIHLHPGMLAFAATSAPGRSILVTDAMAATGMPDGEYDLGGQAVVVADRVARLARDGAIAGSTLTMDVAVRNAVAAGLPLETAVAMSSTTPARLLGLADRGALAVGLRADVVVLDADLAPRRVLRAGVGVFPQ

SEQ ID NO: 11314 - protein, 313 aa, Actinoplanes utahensis
MTRFAVPDSVVIALDVGGTGMKCALVRPGGVVHHEERHPTLAGRGPQAVTEDILGVAEGLAGKARADGLTPIAAGIAVPGVVDETTGVAVWSANIGFRDVPLKDLAERRLGLPAALGHDVRVGALAEARLGAGRGRRHVLFVAIGTGIAGGLVVNGTGYSGAHGAAGEIGHVTVRPGGVPCGCGLRGCLEAEASARAVGRRYAELSGQAGATAFDVATRAAAGEELAGRVWQDAVEALADGLLAAQALYDVSVVVLGGGLAEARDDLLVPVREAFARRVTFHRTPEIVRAELGDTAGCLGAALLALDSLGTPQ

SEQ ID NO: 11315 - protein, 310 aa, Actinoplanes utahensis
MTHVKAEIASQPDCWRQAAKLADAPGLPARGERVAVVGCGTSWFMAKSYAVLREQAGHGETDAFQASDFPYGRRYDRLIAITRSGTTTETLEVMRAVGESTPVTVLTADPAQPAVDIAGNAVVLDFADEKSVVQTRFATSVLALLRAHLGHDIDAAAMDAEVAVRLPLPVHPALTDQITFLGRGWTVGLAEEAALKCRETAGFWTESYPAMDYRHGPISIAGPRRVVWAFGDVPPGLADEVEARGAAFVHSRHHGGYASLGRWVGGRAPLDPMADLVLAQRVAVLLATTQGLDPDNPSGLTRSIVLPDSL

SEQ ID NO: 11316 - protein, 261 aa, Actinoplanes utahensis
MDRYARWNALLELLTDSGRVSVEEAAERLDVSQATIRRDFDQLAQQQMITRTRGGAVANGVSYDLPLRYKSAKHSAEKQRIGEAAARLVTPGTVVGLNGGTTITEVARALAVRPDLNAGGEGSQLTVVTNALNIANELLVRSRMKIVVAGGVVRPQSFEVVGPLGGALLKEVTLDIALLGVDALDVELGAASHHEGEAAMNSLMVARAKRVVVIADSSKLGSHAFARICPITQIETLVTDSGASSATVAAFRDAGVDVIVA

SEQ ID NO: 11317 - protein, 326 aa, Actinoplanes utahensis
MTAVLEISGLRKTYRSRKGVRKALDGFDMVVEAGQVHGFLGPNGSGKTTTLRTLLGLIKPNDGRMAILGQEVPRHLPQVAGSVGAIVESPQFFGNFTAETTLSLLADAGGVAQARVPAVLELVGLRDRARERVKTYSLGMKQRLAVASALLKEPKLLILDEPANGLDPGGIREMRTLMRDLSDSGMTVLLSSHILGEIQLICDSVTIISAGRRVATGSVGEVLAKHSSTGVRVRLEPGVDLAGAAAILRAAGAALTVERDHLVVGNAGNPAQITKLLAEKQIYVSELSPIEAGLEDVFLELTGTAPVDGANRQVDQVTATQGGWGQ

SEQ ID NO: 11318 - protein, 330 aa, Actinoplanes utahensis
MSLFRAERRRLTKRRFTRLFVALGLLVLVLVAAGVAATNQKATPATVAAAQAEAETGYRQAVQQFAEDKKHCQQDPSQFGGNCDNLGEPQREDYKAEYYMPSTFDFHEQFPNMVITFAALMALVAFVVGASFVGAEWNSGGMMNLLLWRPQRLRVLSTKLAALLVWLTGLTVVTGAAWTGICWLIATQRGITARMTPGVWQSFGLMGLRGLGLVVVAGALGFGAASIGRHTAAALGAAIGTLVVLQYGLAIVLSLAKARFYELYLLPTWISAWMNQSYKVVDDNAPCVLAGGCEPPSYTVTWQMAGGLFAAVAIIIVGAAMWTMRKRDIT

SEQ ID NO: 11319 - protein, 107 aa, Actinoplanes utahensis
MQPAAEPTGDQQHIPAPRTAEPSGQPEVAEQPALSEREEQILAFEAKWWKHAGAKEQAIRDTFDLSSTRYYQLLNGLLDNPAALERDPVLIGRLRRLRSTRARTRRR

SEQ ID NO: 11320 - protein, 727 aa, Actinoplanes utahensis
MADDLTLTMTWRSPADEGRRALVRMHPTAMKALELEPGQAARLSGSRSTVVRVIADETTGQKQLHADDLTFGNAGVPDGGPVTVTPIPLTAASRVILSGPPGVHGTIPPEMLRQALFGKTVSPGDDVSLLSQEVFPDRKPPVSPSTRSSLSSRFPWWTNQLLTVESVDDGVLVTTKTVVGWQDGPATATAREAAPETPAAGTPAEVPPPSLEDLVGLRAQAKELQELLDLGFNHREVLAKLHTRVALGILVSGPSGSGKGGMVRAVAATVGAEVRLIWAPELAALTNDAAARRLREAAAAIRGDKPAVLLVSDVEALAPRDEPGPIATVFRQVLAELVAGGAAVVCTTGRPESVDPELRAPDLLAVQLTVPLPDAAMRREQLTVLTRGMPLAADVRLDDVAGRTPGYVAADLGALVREAGVRAALRQKTSDEPSVTMADFEAALDVVRPTSMAESTLEVATVTLDDVGDMAEVKQVLTESVLWPLTYPDTFARLGVTPPRGVLLYGPPGCGKTYLVKAIAGTGKANVLSVKGAELLSKWVGDSEKAVRELFRRAREAAPTLVFLDEVDALAPARGQGSDGGVTDRVVAALLTELDGVEDLRNVVVIGATNRPDLIDPALLRPGRLERLVYVPPPDGPARAAILRASAKSVPLDESVDLTALGEELTGFSAADCSALIREAALAAMRGSLEASTVTAANVSTARERVRASLDAAQVAWLESYAEKRNA

SEQ ID NO: 11321 - protein, 901 aa, Actinoplanes utahensis
MSALPRVTRRRAVTAAVVLVLLAAATVWAVLPARAAWTAQDLRIPVRTGPAGDQQVELDARFLLPRDRSGTVPAVLLAHGFGGSRDSVRSDAESLAARGYAVLTWTAQGFGRSTGEIHLDSPDYEVKDARQLLDWLAARPEVRTDAPGDPRVGVVGGSYGGALALLLAGQDPRVDAIVPSITWNDLDHAFLPQSAATDATGVFKKGWAGVFFGSSAGGDNPACGRFAADVCAAYLSMATSGTPDAAALALLRRSSPATVLDRIKAPTLLIQGAVDTLFPLSEADANAKGIAATGTPVRVAWFTGGHDGGAGPRSDQDRVEYLTGQWLDHYLKGRGAAPGDDFTFSRVAGFSAMDRDLVTNGYSTDSYPGTTGTGSTRVAVTGAAQPIANPPNGNPAALSALPGLGSRLSSLLSGNLSADIPGQHATFASAPLTAAVDVAGAPTIRLRAASPTGSATLFVKLYDVDQSGAPTLSAGLVAPVRLTGLPTGIEQAQPVTVTLPAIVRRMEAGHTLQVVVATSDQAFLSPPGPATYTVAVDGQLTLPTLVGTPIATPAALWWYALAALIAVILIALAVLSVIRRARRRRRVTAVRDDLADTPLVVTGLRKAYKDGFVAVEEIGFTVERGQVVGLLGPNGAGKTTTLRVLMGLTTPTAGEIHVFGHRLVPGAQVLSRVGALVEGPGFLPHLTGEQNLRAYWQATGRPWADARFEEALEIAGLGASIHRRTKNYSHGMRQRLAIAQAMLGLPELLVLDEPTDGLDPPQIAEMRRVLQRYATDGRAVLVSSHLLAEVEQTCTHAVVVNKGRIVASGPVGDIVGESPSVAFEVSDVPAATAILSGLGVRSVTPDGATGLIVEMNGTPRADLVASLVKAGVGVDRVVPRRRLEDAFLALVGDNSRGSGDR

SEQ ID NO: 11322 - protein, 291 aa, Actinoplanes utahensis
MSIDVSPDAAAGYRPSRTLPIVAEIRRQASRRRTQLALGFMVLLPLIILVAFEFGSDNRGDDDNGGGAFSSLVDLATSGGLNFALFCLAVSAGFLLVVVFALFAGDTVASEASWGSLRYLLAIPVPRARLLAVKLVVALGYAFLALFLLAGTGLLVGTLRYGWHPLGSTIAARIPPGQGVLRLLAILAYLAVILLVVAGLAFLLSVLTDAALGAVGGAVLLWILSSILDQITALGSIRTGLPTHYSDAWLGLLSTPVQTEDLAKGAISAIIYATLFWGTAFLRFTRKDVTS

SEQ ID NO: 11323 - protein, 427 aa, Actinoplanes utahensis
MTSTVSAPAAISTSPARGLVCRACGAQYPLAAQHACYECFGPLEVAYDEAALARVTRAEIEAGPQNIWRYAALLPAGQDPATRVTLDPGLTPLVSAPQLAAELGITAPLWVKDDSQNPTHSFKDRVVSVALTAAKELGFTRFSCASTGNLANSVAAHAARAGVPSIVFIPGDLEQGKVVMSAIYGGDLVAIDGSYDDVNRLCSELVETDEFEDTAFVNVNVRPFYAEGSKTLGYEVAEQLGWRIPAQVVIPMASGELLTKVDKAFSELVEIGLAEAPEGGWRVFGAQSQGCNPIAVALHGDTDVITPVKPTGIAKSLNIGDPAAGPYAIEAVRRTGGWMDYADDDEIRAGISLLARTTGVFAETAGGTTVAVLKKLVESGRLDPTRETVVYNTGEGLKTLDAIVGTAGPTHRIKPSLRGAREAGLLG

SEQ ID NO: 11324 - protein, 147 aa, Actinoplanes utahensis
MAGRWHVARTLLTAVNGTTGAGLLLALITRTRVRRGRDGVLIAEGWRLPMPPASCFTVGSVIITRRSAEWLLAEERAALLAHESRHAGQYAVLGPLFWPAYWVACGWSFTATGSYGVRNFFERHAGLKDGGYPEDLPLRPWLQRLKR

SEQ ID NO: 11325 - protein, 164 aa, Actinoplanes utahensis
MVRRITARDAGRMRALRLEMLADSPLAFLETLAQAAARSHEGYRRRLDMAADGPELAQFVTDPGDGPLLGHAGGTAIPDDPLVTVVFSVYLTPAARGGKMLASLIEAIADWSTAAGRHELMLEVVTGNDRAVRAYEKLGFQDTGVRLPHPTVPVLTELQMRRRL

SEQ ID NO: 11326 - protein, 540 aa, Actinoplanes utahensis
MAKIIAFDEEARRGLERGMNQLADAVKVTLGPKGRNVVLEKKWGAPTITNDGVSIAKEIELEDTFEKIGAELVKEVAKKTDDVAGDGTTTATVLAQALVREGLRNVAAGANPMALKRGIEAAVASVSEGLQQLAKDVETKEQIASTASISAGDSTVGEIIAEAMDKVGKEGVITVEESNTFGLELELTEGMRFDKGYISAYFMTDAERMEAVFDDPYILIANSKISNVKDLLPILEKVMQSGKPLVIIAEDVEGEALATLVVNKVRGTFKSVAVKAPGFGDRRKAMLEDIAILTGGAVISEEVGLKLDAADLSLLGQARKVVITKDETTVVDGAGNGEQIQGRVNQIRAEIERSDSDYDREKLQERLAKLAGGVAVIKVGAATEVELKERKHRIEDAVRNAKAAVEEGIVPGGGVALVQAGKTAFDKLDLVGDEATGANIVKVALDAPLRQIAVNAGLEGGVVVEKVRNLEAGHGLNAATGEYVDLLAAGIIDPAKVTRSALQNAASIAALFLTTEAVVADKPEKNPAPAGAPGGGDMDF

SEQ ID NO: 11327 - protein, 150 aa, Actinoplanes utahensis
MHAPKISFPGAFAPESHGYPPRWAEIPGTRGCTLEALTYAGRADRFAAAGARIRGVSTQRADQLRAFAAHAALPYELLSDADGRLATALRLPTFRAGGGDRLKRLTMLIDPAGTIRDVRFPVTDPAASVDEMLDLLGGYSSGAGHIPPPG

SEQ ID NO: 11328 - protein, 686 aa, Actinoplanes utahensis
MTPGRANLGRVRDPSVSRYTAGRLSPIRRTADLRRLRDEQFDVLVIGGGVTGAGAAVDAASRGLKVALVEARDFAAGTSSRSSKLIHGGLRYLEQLELHLVHEALTERGLLATRLAPHLVRPVPILVPLPAANPVKRVWQRGYYGLGVAAYDVFAGVLGGGRGMPLHRHLSRDGARHLFPSLRADKITGAIRYYDGQMDDARLVVNLARTAAAQGAAVVTSARVTGFVREAREVVGVRVKDLESPGSPEFEVRAKTVVAATGVWSDDMAEMLRDVGVRPGLRVRASKGVHLVVPRSAITGEAGLILRTATSVLFVLPWGGHWIIGTTDTDWELDRSHPAASARDISYLLDQVNTILDRPLTTDDIEGVYAGLRPLLSGEADSTSKLSREHAVVEPMLGLLLVAGGKYTTYRVMAADVIDQAVRRLGGAFRPSRTDQLPLLGADGYAAAWRDRQDTARRHGVTTGVIEHLLERYGTLTVHLLAMMAADPALAVPLEGAPEYLAVEVAYAALAEGALHLDDVLTRRTRISFETAHRGVESAAHTARIMGAVLGWNETVRDREVEHYLARVTAERQSQTMPDDLTADAARVGAPDVRGLAGDRAHPPAAASHLEAAASPHPETAASHPETAASHPETAASHPETAASHPETAASHPETAASQLEAGGSPRPEAGGSAHPDRTGLLEAER

SEQ ID NO: 11329 - protein, 95 aa, Actinoplanes utahensis
MILVDEPRWPGRGHLWSHLVSDVSYAELHAFAEMLGSPRRAFDRDHYDIPAARFRAALWLGATLVPPRELTARLRAANLRRPKHLAGGSLRTASR

SEQ ID NO: 11330 - protein, 440 aa, Actinoplanes utahensis
MGRAHYRDGRVTRIRRGGRRLNRLQRVRENLRKAYDTGREAARVTRIDRPRPEPEPEEDDFVAVPAEPAVVHGSTTSLDDVDVPHSLRIAAAWSWRLIVVGLVGYAGLRFISQVDVVVIPLAIALLLTALLGPAVGWLRKLHLPRSLATFLVLVGGLGAVAGTLTLVVNQFIDGLPQLTEKATAGVRQIQDWAKTGPLHLSDKQVDRAIDSAQSWVNDNTSSLTSTGISTAATVFELLTGLLLVLFSTFFFLRDGHKIWRFIVRLFPVSARWSLADAGDASWATLGAYVRATVLVAFIDAVGIGLALLILDVQFPFPLAALVFLGAFVPIVGAGVSGAVAVLVALVGQGWVVALITLGAVILVQQLEGHVLQPLIMGRAVAIHPLAVIIGIACGVVLAGITGALVAVPLIAVLNTGIRRLSRRRPEIPPDAIVVTAGHPS

SEQ ID NO: 11331 - protein, 113 aa, Actinoplanes utahensis
MSADTARTETGLPIRMLHDRVLVRQDGGEGERRSTAGIVIPATASMGRRLSWAVAVGVGPNVRSIVVGDRVLFDPDDRSEVELHGKGYVLLRERDVHAVAATRVESDGTGLYL

SEQ ID NO: 11332 - protein, 647 aa, Actinoplanes utahensis
MADVPTGSPDPAPTSLPAPSPGAPDPGAPPGALPAAFPVTSPGAADPGASPVSAPGAPDPGTSPAASPATFPAPPVYAPGRVTAEEVPADAVPPFPTEMVQTVAPIPGRRAGWRRWVPVTGVIVLIAAAAIGMLIFLGYSIGIAGLAVGLTAAILPVPLLASAFAWLDRYEPEPVKYLIFCFAWGAAVATAVALAVNTGASWLFDKIGLPDALVAVLVAPFIEESMKALGPVLLFWRRRAEWSGITDGIVYCGLSALGFAMVENVLYLGGHGYAAGAQQYGPATGLTNVFLIFIVRILFTGFAHPLFTSMTGIGLGISSRSADKHVRWLAPVGGWLLAMILHGTFNLLPTLSAATGKSLIMLYGYLGFMVPFFFAVVGFAIALRSWEGRLAERVLHHYVHTGWFAPPEVAALGSLGRRHSARQWAKRVAGPAGNRAMRSFQFAATRLAIIRDGMQRGLNGDQKEMTKAVLEERELLAAIVGYRAVFAGRDPQTPPAWWDGQAYRITFPDGVVRTVTAPAEPVMPVPVRLPPPMPAYAGGWGQPSPGYPGGPGYPGGPGHPGAQGPYGTPGYGAPGHGAPGYGAPGYGAPGYGAPGYGPPPFAPPPSGYGPPAAYGPPSSAPPHSAPPHSAPPASGPPQYPGQYPPYR

SEQ ID NO: 11333 - protein, 381 aa, Actinoplanes utahensis
MIGIATEGMRAATARARAGLMLAVQAGLAAGLAWYVAHHLIGRPAPFFAPVAAVITLASSVGQRVRRTAELVAGVAVGIGVGDGIILLIGTGPVQIGLIVILAVLVATAAGGGSPLIVQSASSAVLVATLTVQTGHPWTRFFDALVGGGIGLTVMTVLLPLNPLSVVRRAADPALRAFTAGLHEAALGLAEGDPDVIEAALSRLRAAEATFANFRTAIDAARENVAFAPARWRNRGALAQYVDGAAQLTYALRNVRVMIRRAQTALNDRERVPEVLPASVRHLGDAVDLLRQEWARGVPPVAARERALRAAAESGRAYDTGVGYSGGVVVAQIRTAVADLLRATGVEYAEATLQVRAAVGWSGRAQGARNRTGRSRHPGLG

SEQ ID NO: 11334 - protein, 209 aa, Actinoplanes utahensis
MPDRFRAAARGAGATAADADLDSAANYLLTRWTEPQRHYHDVTHLAAVLEVIDEFAGLAPHPDRVRLAAWMHDAVYDPRALGDANERDSAEFAAGLLVTLGAPEEVAAEVARLVGLTAGHATEENDPDGELLCDADLAILAADEERYARYCAAIRREYAHVPDGDFRAGRSRVLTELLKLPSIYRLAPIRDAWEARAQANLKAELEALA

SEQ ID NO: 11335 - protein, 111 aa, Actinoplanes utahensis
MTSPVANAAASCAAPDQSAPLPASVDLEKETVITGIVRTAEGEAVGGAYVRLLDGSGEFTAEVVTSPEGVFRFFAAPGSWTLRALSRFGNGELAVDATRGVNEVSFSVATA

SEQ ID NO: 11336 - protein, 282 aa, Actinoplanes utahensis
MSRDNALVSADWAEKNLDTPGIVFVEVDEDTTAYDGGHIPGAIKIDWKQDLQDPVRRDFVNQEQFSALLSERGISNDDTVILYGGNNNWFAAYAFWYFKLYGHESVKLLDGGRKKWELDARVYTKDAPSRAQTSYQAKAPNLEIRAFRDEVVQAIGVKNLVDVRSPDEFAGRLLAPAHLPQEQSQRAGHIPTAISVPWSKAANEDGTFKSDEELAKIYGDAGLDGSKDTIAYCRIGERSSHTWFVLKELLGQQNVKNYDGSWTEYGSLIGVPIALGDEPGKA

SEQ ID NO: 11337 - protein, 262 aa, Actinoplanes utahensis
MAEVYETAPRRRRRGRGVLIILVILLVIVLGVAFVVDRFGRSFAEGVISDKVAGQIRAQKASSDTPDVTIEGFPFVTQVLDGHYQEIHIEVPHLTAPVDKTRKINLALLDIHAQDVKASLDTLRNGSGDVVVGTVTGVSTIDYPQLVELIGQKGVKLSAKDGKLIGAATVTALGQQVDLTGAAKLTVVDGGIRVRFSDVRATNLPNVPLIQNLIDAQAQRMSLDLAVPKLPLQLRVQSVAAGDDGLKVQFGAQNVNLNAGGL

SEQ ID NO: 11338 - protein, 348 aa, Actinoplanes utahensis
MGRGPDSGTIAVVFPSMPQDDPWDADASRDVARLNPGRPKAGMYGAVPDDEPDERPTSEPGDDFDDEFEEIEVVPVRRKLSVAIGGFAALLALALILGTLTTGPGVRTPYAIVLFGIQLLGLLAWTMALSPPAASLTAAASGLTGLVACYLAATADTAGLTPLLYVTGGGFVAALAAQAVRAEDRHRIGDSWRTTLLIVAGVVAYAIPIVLSRQSLGSQAILVCCAGAGLAVLVARLADAVFPKPRIAPQVPRGAAGVVLGAMAGTFFTAWLGSQLVYPFNPAKGAVTGLVAAVAAILVDLAVNFGEAGRRLAGEAPTLWLARHMTGPLGGFALTFVATYLLVHLYLT

SEQ ID NO: 11339 - protein, 240 aa, Actinoplanes utahensis
MSVEILLLVTARAGEPSAVLPALDLLPHSVRTAPRDVRTLVSGPSPDAVLVDARSELSEARATCRMLHATGIGVPLIAVVTEAGLIALNADWGVDDVILASAGPAEVEARLRLSVGRLTNATAGAGGSIRAGELNIDPDTYAAKLKGRPLDLTYKEFELLKFLAQHPGRVFTRDQLLREVWGYDYFGGTRTVDVHVRRLRAKLGSEYESMIGTVRQVGYKFVVPPSGRQLPDNAPVSLPV

SEQ ID NO: 11340 - protein, 277 aa, Actinoplanes utahensis
MQRLPAAEIDAVLALTEAAGYPLSEDVELRLRNGGGDHLLAHAADGSLAGYAFLEDGAGELVVHPAHRRQGHGSRLLDAAGPGELRFWAHGDDPAARAFAERRGFLRDRVLWQMRRSLLEPLPDIPLPAGVTVRGFRPGSDEQAWLEVNARAFAHHPEQGRWTLDDLLLREGEPWFDPAGFLLAVDVTDRLLGFHWTKVHTDTDPPLGEIYVLGVDPAGHRRGLGAALSVAGLKHLAGRGLEVSNLYVDESNTAAVRLYRYLGFEVHHADINYRRPA

SEQ ID NO: 11341 - protein, 366 aa, Actinoplanes utahensis
MKFQRSGLVAGIALTATIALTACGSDNTDTKGDTGAAAPSAGTCVGGTLAAQGSSAQKNAMAEWIKAYTASCSAAKIDYQPTGSGAGVKALISGLADFAGSDSALKDDEQPQADAKCASPALNLPMVVGPIAVVYNIQGADGLQLSPSLIAKIFSGKITKWNDPAIAAENSGAKLPDATIEAVHRSDESGTTDNFTKYLSKTAEGDWTYDHAKAWAAPGGTGAKGSDGIAAKLKSTPNTISYVELSFAENSDLQKAKIKNGAGEYVELTGDAAGKTIEGAKVTGKGNDLKLDIDYKTATAGAYPIVLATYEIVCSKYADAAKGKAVQGFLKYTSSAEGQKKLADLGYAPLPESVRTKVATSVAALS

SEQ ID NO: 11342 - protein, 356 aa, Actinoplanes utahensis
MGDYPSRSANATAGDLGVTPRHARGAGSGVSPSSYEEPPVGGGGALPKKSRFSMETGFRGLSLAAGTMVLVIIVAIAVFLISKAVPAIRADKENFLTYNFWRPNEAEPAFGVAVLAFGTLLTSVIALIVAVPIALGIALFLSHYAPRRLATPLGFVIDLLAAVPSVVFGLWGRDVLQEPVRDFSAWLNHYFGWLPIFGGDGPFGQSIMLGGLVLAIMVLPIVTSLSREVFQQTPGMNEEAALALGATKWEMVRTAVLPYGKPGVIAAVMLGLGRALGETIALALTLGITWQISFNLIQTGGNSIAANIANAFGEANDTGRGALIASGLVLFAITLVVNMTARAIIYRRREFRDSAA

SEQ ID NO: 11343 - protein, 353 aa, Actinoplanes utahensis
MSIVMTPDNIRSRKFPVAANLAVAVAALIVSAVVVLGTGIGNWVLVAFLGVVFYLVGLNLAASRVEGRRAARNRMWQTLIYTACVLAVLPLASVVWTLLAKGVDRLDGDFFGSSMANIGARDANGGAYHAIVGTLEQVGIATLFAVPLGVLGAVYLVEYGRGRFATTVRFFVDVMTGIPSIVAGLFILSFWVLIVSPWFNNGEPEYSGFAAALALTVLMLPTIVRSTEEMLRLVPGPLREGAYALGVPQWKTILSVVLPTAAPGIVTGVMLAIARAAGETAPVLLVAGGLARINFDPFAGGQSSLALYVFQQAGDASKYSPARAWTAALTLVALVLIFTIGAKLLARRNKLTR

SEQ ID NO: 11344 - protein, 258 aa, Actinoplanes utahensis
MAKRIEASNVSSYYGSFKAIDNVSMIVEPKTITALIGPSGCGKSTFLRSINRMHEVLPNARIEGRLTIDDQNIYDPDVDITAVRRMIGMVFQRPNPFPTMSIYENAVAGLKLNGVKKKSILDDAAEKSLRSANLWDEVKDRLDRPGAGLSGGQQQRLCIARTIAVEPQVVLMDEPCSALDPISTLAIEDLMFKLKDRFTIIIVTHNMQQAARVSDKTGFFSIDKTGEPGRLIEYDDTQKIFSNPSQKKTEDYITGRFG

SEQ ID NO: 11345 - protein, 597 aa, Actinoplanes utahensis
MHRGGHHAVDRAARHDLVQGVPGRRQHRQIRRIRRIDPRRAVRLPGDVPGLLGLRQQSHEEPGVESFRLELRGDPPGPRQQQVVAQPQTPAGQQIRHRQLPAQHRRPIGLPGGIVGVGDRAIRLGGRAGQHHAGLLEQLAGRRTDDGAGLLLGHAEPPGPVVAQRLRPVGGVDRAARERVDPAERHRGHPAQHVHLEAVPGGRAEQHHRRGRPRRNRWAGEIAGALHHRGRQGHRLGHPSILAPSPASRQPAGQSRRRRRGTGSGGGDTVLIMTGQNVRWGILGLGGIAATFAADLPLVPGAELAAVGSRDQKTADAFAQRYGFARAHGSYAALAADDEVDVIYVATPHAYHHAAALQCIEAGKAVLVEKPITLDLPTAAQLVEAARSRGVFLMEAMWMRCNPAIRRAAELVEEGAIGWVSSIHADFGLQGPFAAEHRLRAPELGGGALLDLGVYPVHLAHLFLGLPSSVQAWAHLTPERVDEHTGILLGWQSGAVGALTCSINGASRNAASITGTDGRIDIPPGFMVPRSFTLSRPDKAPETFEFDFPGSGYQFEAAEVQRCLAAGERESPLVSQTTTLEVMNLLDSIREQIGVIY

SEQ ID NO: 11346 - protein, 335 aa, Actinoplanes utahensis
MSPELVAVLAVIVAAMVFDYTNGFHDAANAIATSVSTRALTPRVALGMAAVGNFIGAHFGTEVAKTVGDGLVSLPLGIPSLGVVFAGVLGAIAWNLITWFFGLPSSSSHALFGGLVGATMIAGIGSVQWANIVGKVLLPMILSPVVGLILGFAAMIALMWTFRRGHPGRLNRGFRHAQTVSAAMMAIGHGTQDAAKTMGIVVLALYTGGYQDSAAHIPEWVFWASATMLAAGTYTGGWRIIRTLGRKIIDLGPAEGFAAETVASAVLYFNAWVLHAPISTTHTITSAIMGVGATKRLSAVRWNVAGNIIIAWLTTFPGAALIACLAYAIVRPAFS

SEQ ID NO: 11347 - protein, 312 aa, Actinoplanes utahensis
MDPPVRLGRPGADHRRGASPAARAGTRGPRRGAGGADERAAAGAAAGPGRGLVRADRGRGGRGRRRRSHRSGPAPAPRVRWVNPDRPIECVRRSNESPSIEVRAVKFSFRPVEGVFYDLFTKASYNLVKGTELLNELALPGVDVQSVSERLSDVEHDSDALTHELYKKINSTFITPFDRADIYSLGSQLDDVMDHLEAVGNLLYLYGLTELPSLPREMHELITVLDQQAKITAEAMPRLRSMKGLEEYWIEINRLENDGDRAYRMLLVRLFSGEYDALTVLKMKEVADELEAACDAFEHVANTVETIAVKES

SEQ ID NO: 11348 - protein, 294 aa, Actinoplanes utahensis
MPSVTADEFETHRAYLTAVAFRMLGNRAEAEDAVQEAWLRCAQQDDIRDPRGWLTTVTGRICLDQLNSARVRRTSYPGEWLPAFAVDPDADPALYAERADQVSVALLVVLERLSPEQRVAFVLHDAFGLPFEEVAAVLDTTPATARQHASRGRRAAADGQIRHNAGLAEQRRVLQAFLLAAQSGDMRMLAAVLAPDVVSISDGGGVARSALRPVLGWEKVGRLFHGILTRRAHEVSDLKVDPVLVEGGAAMMLRGRWPDGSPLLSVITVAVQDGRITGVFTQQNPAKLRLDDLL

SEQ ID NO: 11349 - protein, 167 aa, Actinoplanes utahensis
MPSEMVRVIYTKYDGSAHRDYPARRLAEDDLGIWVGVTQGTASVYHGRPSVEQIPFVLLVPHHAWWTGMFNPPPRTSEVYCDITTPARWEGDTVHIVDLDLDVVRRRESGLVELRDEDEFDEHRTLFGYPDDLVMNANAAARLLMGRLGDGSEPFATHYRKHLQEVV

SEQ ID NO: 11350 - protein, 665 aa, Actinoplanes utahensis
MPAATKKKATAGQLLAAAVGAVPGGSARPGQEAMVAAIEKAITDREHLLVQAGTGTGKSLGYLTPALLVEGPVVVSTATLALQNQLVEHDLPRLAAAVEPLLGRKPSFAVLKGRHHYLCMAKLEHADEQAPTDTLFDDAPAPKAGQWLGEAGRLGKQVVRIRKWADKTQTGDRDELDPGVDDTAWRSVSMPARDCVGAARCPYGQECFAEASRVRAREADIVVTNHSLLAVDMLSERHIIPPHKLLVVDEAHELAERVSSASQAELTPEAVERAGRRARTLIPPATADALAEAADALTVGLADVPPGRLTDGLPDGLRQAVTLLESATRAGLTAIGDVKSDDPDPVRKQQAKAVLDELSGTAQRLLEEDEFDVAWVEKSEIGAGRKALVVAPLSVHGTLSQALYADRTVVAASATLTLGGRFDTVARSLGLPVAAAEDTSGDGWTSLDVGSPFDYPKQGILYVAAHLPRPMASGLPDAAADELLKLVQALGGRTLGLFSSRRAAAQAAELLRAKTDLPILLQGDETLPILVRKFREERNSCLFGVMSLWQGVDVPGDACQLVVIDRLPFPRPDEPLAAARAAAADAARPGSGFSSVSVPIAAVRLAQGVGRLIRSTGDKGVVAVLDSRLETARGYGSFLRRSLPPFWYTTRSEVAIGALERLAKS

SEQ ID NO: 11351 - protein, 137 aa, Actinoplanes utahensis
MKQIACTLLVAADGSLLLQLRDDKAPYFPNVWGLPGGAVEPGETPAEAAARELREEASLQADEPLRLFERQELPAEGRVKYYFHGHTAATQADVVLGEGAAMLFVPAAEVLDRPFTPGSAEVIARFLGSAEHRAAAG

SEQ ID NO: 11352 - protein, 194 aa, Actinoplanes utahensis
MAAVTGPGGKRRRWVVAMVAAWILGLTGLSWWSIRNDPATVPEQRDLGQAVPALRKATGTLLAAADGPWAIRLDALRTEKCRLTPVRDGLDAKRDLVLYVGEGQTRAALDRVAGGLPDGFKAGVTPSRAGSRLSFFADAGDFIAIEGEAGAADQILTLTLDTGCRPGPATLGADPAAGAAPAVFGKTVAALGAS

SEQ ID NO: 11353 - protein, 60 aa, Actinoplanes utahensis
MTLAGAGGASGDRPRGIPEGTTPLWSGPDGWAYRDGAASVVVDATGQNLTVSVTTGCGGQ

SEQ ID NO: 11354 - protein, 319 aa, Actinoplanes utahensis
MIRPASSSRSIRSGNGAACGRTNSAARPGRANQVDSPVSHSDTPTPAVAAVAATLNAWLQRSGASAPAVALTTSKRAIAASIRWSGHGYGDRVREPAGRRDGRAGGRFRLSGDSDFEGALVSGETENPLGPPPWLNAPPVDAYPYEDTHDLRVGPDLHPSLLGLLPFIGLWRGRGQGGFPAEEDYNFAQEIRISHDGRDFLRFESRSWLLDDDSQPLGQSLTESGFWRPVLVDGRPGDEMEATMIRPDGVAELYLGKAATTRLEMGTDAVAYTPSGLHVTGGHRLFGIVEGALLYAHEISIDNSALTPHMSARLLRIGG

SEQ ID NO: 11355 - protein, 194 aa, Actinoplanes utahensis
MDIPDPLRQAAVMVPRWATSEAGTTVADAVDYLEHNEYEIALDILTELGDAYAADQAFWNLLADAATEMNLHRATAWCHWRAAEALHGIIRADLHLFGPEQPGARKAAIPGDGILRPLWNLGFVMPEGHLDLHAARIRVEGEPRLEPGACGSIRLAPLVPDRWRHLRPGDEITMHEQAPPAGTATITQTLFPAR

SEQ ID NO: 11356 - protein, 244 aa, Actinoplanes utahensis
MSEQILVSPADLMGDGVFETMHLRPSGPWLLAEHLDRLGRSAALLDLPVPPSPDLSSSAGRTGALRIIYTRSLLHVSVSDIPATVLRERRDGVRVLSAGLGVSVTNRPPWALSAAKSLSYATNFAARRWAARHQADDVIGVSTEGYVMEAPTSSVVWLAGDELCTVPAAEAGILPGITAAHLLSVAGEVGLRGVERMVTLPELAAADAIWLASSLRGLAEVVTFDGVVRERSRWTPRLLELLGF

SEQ ID NO: 11357 - protein, 149 aa, Actinoplanes utahensis
MKLANYARGVSATSLAAMLRERGLRLTPQRQLILEAVHELGHATPESVHNAVRERVAGVNITTVYRTLELLEELGLVSHTHLSHGSPTYHPAGEGQHVHLVCRSCGSIEEVEPSVLSPVCDRLRDERHFRVDVGHVSLFGVCGNCKESE

SEQ ID NO: 11358 - protein, 341 aa, Actinoplanes utahensis
MVEDLDPSSADAGVPAHFGDPMKEQRLLETGVGLVDRSHRDVLAVPGPERAGWLHTLTTQHLSELSANQGSELLVLSPHGHVEQHAFVTEDGTTAWLDTEPGAGAGLLRYLEMMRFFTRVEPRDATSEIAVLSLVGPAAADLFPDLAEPRVGAVPGPKFTAGTVPAEATAIYDVRPFEGGLVRRVPLGVDLLVPRHAKTSVIEKLGVARAGLWAYEAIRVAARVPRLRHETDHRTIPAEAGFMATAVHLDKGCYRGQETVARVHHLGRPPRRLALLHLDGIATDHPPAQGTPVELDGRAVGFVGTAVRHHELGLVALAVLKRTVADDARLTVGESAAAIDA

SEQ ID NO: 11359 - protein, 280 aa, Actinoplanes utahensis
MTGMTGTLITVAPTGAESSKADVPALPVTLDELVSTAKECEALGASIIHVHIRDADARPTLDQGRLRATVAALRESTGLIVQLSSGGAVTDPETDRLAVLDAGPEMASCTMGTVNFGDGVFLNRWSFIVDLHTRMQERGIVPEYEIFDLGQLTTLQRLLGKYGLPAGGHVHLDLVMGVPGGMPGTAAALVACEQAIRDLPAGTTFSATGIGRGTIPVMLASLSAGGHLRVGMEDTITYAKGRPVESNMQLVARAVGFAQLAQRPPLTPAQARELLGVPAR

SEQ ID NO: 11360 - protein, 303 aa, Actinoplanes utahensis
MTVVAEVVRSGFVESVHHGIVAFADRPGVGDTTGPFFPRSSNKPLQTVGMLRSGLVPREETDLAMISASHDGEPFHVDRVLGILAAAGLDPAALGCPAQLPMGEPAREAWLRGGGDPERILMNCSGKHAGMLATCVVNGWPLDSYLDPKHPLQVAFAAAVSDLTGEPIAATGVDGCGAPVLAVSPQALARSFQRLVEAAPGTPERRVADAMRAHPELVAGTGSPDTVLMAAVPGLLMKSGADGVVAAAVPGAGAVTVKIADGSARARVPVLLAALRRLGVEPPELAEPVLGGGVPVGEVRSVW

SEQ ID NO: 11361 - protein, 133 aa, Actinoplanes utahensis
MATSKDLPQDIGTFIRDLRQTAKISLRQLADKAGVSNPYLSQIERGLRKPSAEVLQQIASALRVSTPAMYLRAGLLDGEGQQGVLAAIAVDPELTIAQKQSLSQIYETFRNENARNAAPAESAPPTDPAEETK

SEQ ID NO: 11362 - protein, 157 aa, Actinoplanes utahensis
MTEQTKTRIPTPLYAAAGAGDLAYQQLRKLPTVLTELSDRAVASLRTANEQAAELQKKASGTDFAALRTNATTVATTFAQVAQERAVAAYTALVARGEKVVGTGIIESAEVVNADIEATEQPKAVEAAVQQAQAVESAETPKPRKRAKATPAPKAAE

SEQ ID NO: 11363 - protein, 121 aa, Actinoplanes utahensis
MIRGPRHCRGPRHRLPGMGSSAPLFIYDVQFWTETVILILALLLELVAFVHCLTQRGAAFQALGTLPKGAWAAIIGVCGLFTWWGQGALGIFGLIGIAAALIYLLDVRPGLRDIADGKGFW

SEQ ID NO: 11364 - protein, 311 aa, Actinoplanes utahensis
MRGRFGPPPPDGGPRLQRGDRTGPRSGRPTLPGPETELVTLDPGVRRPSPRPPAPVHGSSPLRLEQLVTGLGDPVTVFAHGLAGDISGTRPLGSAVTGRRVFFHFRGHGRSDAPPGPWSFGDLAGDLRGVADLAGATRAVGVSMGAGALCRLLAETPDRFERIVLYLPAPLDGSRPEAALRRLDRLLASVESGEAAMIADAVEAEIPAAVRNTPAGWGFLRQRVDQLQRDGLAAELSTLWSAPPLPDESLLKAFRGRALVIGCQGDEIHPVAGAERVAGLLDADLHVYDRPSILWTDRADLRERISAFLNA

SEQ ID NO: 11365 - protein, 143 aa, Actinoplanes utahensis
MRLSPKSVFIGVLAIGLPFAVVVGWALGTPVTQTTAAPGTGGAGGSDGLGRAPSRPHYASGGYGNHPAAPAGAASPTTAASTVITKTVIVPASAAPATAPATSPPPVLNEPPVPTPTTITGPPEPMPSDSASASAAIPAPSAS

SEQ ID NO: 11366 - protein, 304 aa, Actinoplanes utahensis
MRPSRRPAPPDARRPLPAGRGRRCFEWRTGQARLSSRIVKEDPNRPVAAVRQFVTGAGLLGRGLGLVLRSPRMLGLGLLPALISGVVYTIGLVVLVRFLPQLSEHATWFAAHWSGFWRDFVEVLAGAGLLGLALLLGVLTFTAVTLLIGDPFYERISELVENRYGGVPDAVDVGFWSSLRRSLADSVRLIGLSVLAGIPLFLLGFLPVVGQTVIPVLAGAVGGWLLALELTGVPFQRRGQRLRHRRVALAKNVPLTLGFGAAVFGAFLIPLGAIFLMPAAIAGATLLSRRVLGRPIDITTVGSL

SEQ ID NO: 11367 - protein, 174 aa, Actinoplanes utahensis
MRIELVEGDITTRQVDAIVNAANSSLLGGGGVDGAIHRRGGPEILAETRALRAARYGRGLPVGQAVATTAGRLPARWVVHTVGPVFSATEDRSELLRACYTNALRVADELGAETVAFPLISAGVYRWPVDDAVRQALTALRSARPERVTTAYLVLFGAGTAATARAVAEGSAEL

SEQ ID NO: 11368 - protein, 339 aa, Actinoplanes utahensis
MTTRERPTLEAVARRAGVSRATVSRVVNGSTTVAATIREAVNRAVDELGYVPNQAARSLVTQRTDSVALILPETANRVFSDDLFFPAIIRGVGMELEAADKQLVLMMTGSEAGHHRVERYAVAGHVDGVMFASIHGADPLPGALARRGIPVICSGRPMTAGSDPAVPYVDVDHAGGVAAAVHHLIRTGRRRIATIAGPQDMVAGIERLAGYHATLQAAGLPELAVTGDFTRESGITGMRELLARDPELDAVFVASDLMAHGALTALREAGRRVPADVAVIGFDDFDISRYSDPPLTTVRQPIGEIGQTLARQMLLLIAGEQDVPNSVVLPTELIVRDSA

SEQ ID NO: 11369 - protein, 482 aa, Actinoplanes utahensis
MMNRLSSADQGSGEDMTATVTSTSAQPARAGITFPDGFIWGAATASYQIEGAAREDGRGPSIWDTFSRTPGKVHKGHTGDVACDHYHRYVEDVALMADLGLASYRFSVAWPRVRPDGTGPVNARGLDFYDRLTDELLGKGIDPVVTLYHWDLPQTLEDRGGWADRETAEAFGEYAEVVYRKLGDRVGTWTTLNEPWCSAYLGYGSGIHAPGVQDPAKALAAVHHLLLGHGLAAQALRAAGAQRVSITLNPCEVYPVDPESPADRAAAHLIDGLANRIFFDPLLRGEYPADVLEHIARLTDLSYLRDGDLATIQQPLDVLGINFYNPAYVSAKPGAPGAKDYPGSEGIAFRPPVGPVTDMNWPIEPASLTRLLTRIHRDYPGTPLMITENGAAFPEGPIADGTVPDRRRIEYVDGHLRACHDALAAGVDLRGYFLWSLMDNFEWAEGYAKRFGIVHVDYTTQQRVLKDSAKWYREVIKRNGLS

SEQ ID NO: 11370 - protein, 253 aa, Actinoplanes utahensis
MNRLHATKDFWLAALRADGPALWEAVAETGPGVPVPAIPDWTTADLAFHVLDLLRWVRATIARGVTDRPSAPPGSDSRPEWDEALDQLRRELTGTIETLEALDPDLPAWNWAPQPKRAVFWDRRMAHEISVHRWDAEAAAGRPTPIETKLATDGVAEILDTWLPAGKRQGPTDLHGVVHLVGTDAETEWFVRLRGAGIALLDTGTILDTDDHHARAKATGTASDLQLALMGRKRTDQLALSGDPRLIQALRTG

SEQ ID NO: 11371 - protein, 358 aa, Actinoplanes utahensis
MPDAFADHLTDPTPAADRVLAAYTTLRLGGPAGTVTTAVETDEAVATVRKATAEGRPVLVLAGGSNVVIGDAGFAGEVLLLRTRGIEVVSESAGEAVVRVAAGEPWDDFVAYAVGNGLSGVECLSGIPGSAGATPIQNVGAYGQEVAHTIVAVHAYDRVADEQLMMSPADCAFGYRSSVFKHNDRYLVTAVDFRLARADRSAPIRYAELARQLGVEAGDRVPLEHARQTVLKLRAGKGMVLDPADRDTWSVGSFFTNPVVSAAFFAELTAARGEMPHWPGADGTVKVPAAWLIEHAGFPKGFAGAGVAISTKHTLALTHRGAGDTGALLDLARTIRDGVRDRFGITLHPEPVLVNCAL

SEQ ID NO: 11372 - protein, 213 aa, Actinoplanes utahensis
MFDKVVRRASALAAAPALLALPVALFALPHAVHAQGPVVPPRPPGMPTPAPERLGSPDPATSTVIPAAPITPQIAAAPAVDPVKARARTLMHQVIRLTNREREANGCARLTVDHELIVASVAQSYYMARTRLFSHVWRDGSTFAMRAERAGYRAPAGENIAWGYPTAAEVMQAWMNSPGHRANILNCGAKSIGAAIVYAADGTPYYTQTFGWS

SEQ ID NO: 11373 - protein, 232 aa, Actinoplanes utahensis
MSRLLVVEDDPDIALALRLLFSRAGYEVAHAADGRSGLKEAYAEHPDLVVLDVGLPEMDGWQVLERLRDVSDVPVLVLTAHGQEAEKVRGLRGGADDYLTKPFANNELLARVEALLRRSSSGQNSWASQIYDDGLVHLDPTKRRVYVKGDEKRLTPTEFRLLNALVRHAGAVLSPNQLLTQAWDDPTGIGQERVKFAVLRLRRKLGWSDPDESPIESVRGFGYRYRRPGGEA

SEQ ID NO: 11374 - protein, 140 aa, Actinoplanes utahensis
MEDLGEIVGEFLMESHENLDQIDRDLVSLEQEPGSRDLISRIFRAIHTIKGTSGFLAFSRLEKLAHAGESLLSRLRDGVQPVTPETITVLLLCIDGVRSLLSSIEEKGTEDEVDIDSMIVRIKAQMDAPTDGAPAAALAS

SEQ ID NO: 11375 - protein, 536 aa, Actinoplanes utahensis
MNMVGELVLARNQLVRGVMEIGDSGLVRSAQRLGMITSELQEGIMKTRMQPIEHIWSKLPRVIRDLSNSLGKQVQLVMEGKETELDRSLLEAVKDPLTHLVRNAVDHGIEDPERRLAAGKGPEGTLTLRAYHEGGHVAVEVADDGAGLNVERIAQKAVENGLLRPEQVPNMDKRDIMAMVFQPGFSTAAKVTNVSGRGVGMDVVKTNIENIGGAVSVDSTPGEGTVWRLTIPLTLAIIQALTVDCGDQRYVVPQVAVLELVFVDGQTTKVEYASGAPVYRLRGKLLPLVRLDRALGLEVGGDQGVYIMVLQADGRRFGLVVDRVLNTEEVVVKALNTRFKDIGLYAGATILGDGKVGLILDVSSLARRSHLAVDSERENVAEKRGPAGGGTERLLVTAVGERRVAIPLDTVTRLEEFPRDRIEHAGSREVVQYRGQILPLVRLSHLLGAYGEELEGDTVSVVVYSEGGRSVALVVDRIVDIAENSTTARREAEEDGLVGTAVIQQRVTELLDVRRAILAADPNFYSDASDEMLVEA

SEQ ID NO: 11376 - protein, 145 aa, Actinoplanes utahensis
MASRQFATFEVDGQLFGVEVHTVQEVLSYNEYTPVPLAPPAVGGLFNLRGQVIAAVDLRVQLGLARQALQGPVMNVILRGDGEPVSLLVDKIGEVVDLDEETFEPPPDTLSGPTRELVVGTFKLDGRLMLALDVNQAVDTYRATN

SEQ ID NO: 11377 - protein, 290 aa, Actinoplanes utahensis
MYSLVSAPVLGFDLTRLPGGSAAADVLLRGLRLQAADLPVLAERLPDEGVRGPLWVEVESAARRMPNLKGMSKDDPAGNLALVERAPIGSVDALLTCLRYDVMSWTWEGTGRDARQTEEAAAATALLCDAAVGCYLREVLDDDARRRLGAGWVAAMKKVPAGAPIDLGPHHYTVSALLDKLRTLRPEDRTRVVTAADDARRNTAGWSPAVHSASWAAYLSDRVRTAAAAQMLLVQAVDTAGIPLADRAGGVWNMLSGAVQALVVRDLLDTATAHRLLAPVVAALGPAWLG

SEQ ID NO: 11378 - protein, 147 aa, Actinoplanes utahensis
MISVLVVDDSVVVRRLIVDALGEAPGIQVVGTAANGLLAQAKIDQLKPDVVTMDIEMPQMDGIEAVRELRKRHAALPVIMFSTLSAAGATATLEALSAGATDYVTKPSNVGSVKESIEAVREQLVPKIQALGGRRRPPPGAPPRLAS

SEQ ID NO: 11379 - protein, 31 aa, Actinoplanes utahensis
MQHLGQRVRAAGGRADRQDVDPALRATALAS

SEQ ID NO: 11380 - protein, 175 aa, Actinoplanes utahensis
MPADLPVPVVITQHMPPVFTKMFAERLDRSIPLKVVEAGDGMELAPGTVYIAPGDRHLIFNRRGTSTLTQLSNAPQENSCRPAVDVMFRSVAALYGGTAFATVLTGMGQDGRGGAKVLRDAGCEILAQDEASSVVWGMPGAVVGAGLADEVLPLDRIAAALLNRVRVGRSAAVAR

SEQ ID NO: 11381 - protein, 281 aa, Actinoplanes utahensis
MTLSQAEFTFVANLVRREASIVLAPGKEYLVEARLIPVARVVGAPNVNDFIADLQKRPNPQHQRKIIDALTTNETSFFRDREPFSALTDVVLPELVKSRASTRKLRFWSAASSSGQEAYSLAITLQESLPAGWSFEIQGTDISTAMVERAQKAEYSQVEVNRGLPATQLVQYFERAGAHWRVIPALRRNVSFKHMSLTAPFPPMQPFDVIFLRNVLIYFDVATKRQVLQNAAKILRPDGWLFLGAAETTIGIDDNYERVAAGRTSAYRIRNAVPAGAGRRG

SEQ ID NO: 11382 - protein, 131 aa, Actinoplanes utahensis
MTPMRAMVIDDSRAMRMILKRIVTKLSFEAVEAGDGKEALDLLADMTEVPELALIDWNMPNMNGLEFVMKVRADPRLREMTLVMVTTESEQSQIVRALAAGAHEYVIKPFTEGAMIEKLALLGLVPTGANS

SEQ ID NO: 11383 - protein, 161 aa, Actinoplanes utahensis
MSVEVDVDENDLAEMVEQVWESYLDPEGVSPLMQTYDENQPSEVHSSVSITGSWTGHIVYASSRAAAQRAAAAFLAMELDEVSEEDISDTLGELANIVGGNVKAMLPPGSQLSLPQVVLAPESSARYPNTERISGVYGLWEGEPVSISMWQSSTDTKEEGA

SEQ ID NO: 11384 - protein, 120 aa, Actinoplanes utahensis
MKILIADDSRVMRQIVVRTLRQAGFGDHDLIEAADGQEAFDMASKQQPDLVISDWNMPQMTGIEVLRQLRAAGNNVKFGFVTSECTPEMKTAAESAGSAFFIVKPFTAERFDEVFAPILG

SEQ ID NO: 11385 - protein, 162 aa, Actinoplanes utahensis
MSDVSVLPGSLAVRNLFEDLLGREVTVSPGDPLSADEIRTATVAIFTDNSQKIYAAMGLQLSLAANAGAALGLLPPGAAEDSIDEKQLFPNLAENVGELCNIFTSLLNKEGAPHTKLYQVIYPGMELPADARAILLALGRRLDLMVEVSRYGKGKMSLSLAP

SEQ ID NO: 11386 - protein, 148 aa, Actinoplanes utahensis
MTSPTSGMGATGASSDAAQAAAALKAEAAKRQAKDKDLGDKDTFMKLLVAQLKYQDPSKPADSTQFLAQTAQFTQVEKLEDMIGMMKSQRMTSASMLVGKTVTYMDANGQSQTGVVSAAKLNGDSDPTLKVGNTDVDLSKVTEIQQTA

SEQ ID NO: 11387 - protein, 424 aa, Actinoplanes utahensis
MLRSLYSGISGLHAHQQMMDVTGNNIANVNTVGYKSEAVQFQDTLSQMVGAAGSPQNGMGGTNPSQVGLGVKVAGISKNFSQGSAETTGKSGDMMIQGDGFFITRTGNEQMYTRAGSFFFDANGTLVTTSGQPVQGWTAVDGKVNAGGQPSDIKMPLGATIPPAATTQITLKGNLTSDFPENKLATEDTVTIPVKVFDKDGATHTVTAKFTRAIDPNRVAGDTPDTTWDIALYGEDGTAISGATGEIDMTSGKAIVSATDTPATGELDKDGNMQIGDYKVNMADLTMYSGLSDARVFSTDGQTAGALTSLAYTVSDTGEIVGVYSNGLKETLGQVAMATFKNPDGLEKVGNSTFRSTVNSGYAQVGQPGSAGMGQVISGALEMSNVDLAQEFTNLVVAQRGFQANSKIITTSDELLQELVSMKR

SEQ ID NO: 11388 - protein, 92 aa, Actinoplanes utahensis
MILVTRINGAVFALNPDLVERVDCTPDTVVTLVDGTKYVIAESVPEFIDSVRHYRASLIAQASRMEPEPTAALSSSDDELDAKVLPLHRKDR

SEQ ID NO: 11389 - protein, 263 aa, Actinoplanes utahensis
MDISTVVGVLAGLAIVFTVQILDGGSPSSILLIPSMLLVFGGAFAAAMAGGVFKDVTGFGKQLQKAFTAKVTPPTQLLDNVVKLAERARREGLLALEDAVKTVEHPFLKRGLQLAIDGTDPDELHDILHAEVAAKKKADKAGKKFFENMGGYAPTIGIIGTVMGLVHVLENLDKPTTLGPAISSAFVATLWGVLSANIIWLPMAARLDRLSAVESEEMELVIDGVLAIQAGSNPRLVAQKLRSLLPPDEMKKAEAAASSKKAA

SEQ ID NO: 11390 - protein, 352 aa, Actinoplanes utahensis
MSSGGGGAKRKKKAHEEHEEHVNHERWLVSYADMLTLLFVLFVVLFSMSDINQKKFAQLAQGLSASFGSKSAAFTGNYAPLDGSANNAQVVQIDPGANPGDGSSGTEGLNQKQQEAVSRAVMAEDRKKASANADKAAKEAENMKAIENKISDALAAAKLLDNVKFTIDQRGLVVTVVTNEVVFAGDRADLRPTGEKILGAIAPTLAKLPNNVEVDGNTNQLNAKTRYYPSGWELSAARASTTVRYFTGHGIAKKRLSAVGFSDTKPLIDPKDPRSITMNRRVDVVVLTMLTADQAALLPSAAGSDAKLHAGQTTAEAKALEKAVESANSSSTTTGTTGTTNHSTLITAETRN

SEQ ID NO: 11391 - protein, 149 aa, Actinoplanes utahensis
MADEKDAAAEAPKKSKKMMMMVIALALVVLGGGGAGAFFMLRSSSASAAPVKGIVTAAENTITVNLADGHYLKLGFALQQTDASAEAVDLSEAYQLAIEEYTGRTIAELSTDAGRAKLKEELKGKLIAAYTEKKKKLVMDVYFTSFVTQ

SEQ ID NO: 11392 - protein, 316 aa, Actinoplanes utahensis
MTTTARTPGKMSRRGQGGGPTAYDFRRPIKLSREHVRTLQIAFETYARSCGTLLTTRLRAVSNVSLISIEQLNYDEYVASLANPTIIGVVALDPLPGTVLIEIAQSAVMTAIDHMLGGPGGSQPERPLTEVEMPLLRGLIERMLGELRYGFESLVDIQPHLKEIEYNAQFLRAHAPGDAVVVASFETKIGAEECISTICLPFNTILPVLSRQEAVVLSAAERQVKDKALRNLTAGLSAAPIDVAVRFQPIRMRTDDIVDLRPGDVVPLGHPTSRPLEVTVNDIVFAHAVPGNQGARLACLVVPSPTENESKESGRS

SEQ ID NO: 11393 - protein, 255 aa, Actinoplanes utahensis
MTAPAITAPQLILARNAADAALAVLPTSRALVAGEPMTPDGTTAIEGQAVTARFSGPATGEVVVVVGQDLADALKESPLGELDLTAAVRPALEAAARVFGPVVLDPGQVMEPQVALSALAAKEGAVAIPLRDDEDIRAMLALSLSPWPDDDPLVAAATGGGVAQRAPEAPAVGRRGGLDMLHDVEMEVSAELGRTRMSVRELLSLTPGAIVELDRAAGSPADLLVNGRLIARGEVVVVDENFGIRITEIVSPGAE

SEQ ID NO: 11394 - protein, 142 aa, Actinoplanes utahensis
MFRLLIQVAFSLFIVLFMMWGLARALRRPFGGRGHGPLTVLTRQQLGRSSAVAVVRVADRALVLGVTEQQISYLGEAELDVFEHEKVEHRDHLVLEPTELIDPGGTALPGRHPAAPVEHGSILSPKTWSSTVEFLRERTTRK

SEQ ID NO: 11395 - protein, 239 aa, Actinoplanes utahensis
MPPPRLVPQAPRTSPPSINLNINGTNPDGSRPASSLVIVLGLTLLSVAPALLLLCTCFTKVFMVLGITRNALGLTTLPPNQVIAGLALFLSLFIMGPTVSEMNKVGVQPYLKGDKTQSQAFDDGIKPLREFMWKTTREDELALLIKVSGEKQPANRDAVPLTTLVPAFVLSELRAAFIIGFVIFIPFLIIDLVVSASLMSLGMMMLPPVTVALPFKLLLFVLVNGWGLIITALVGSYRT

SEQ ID NO: 11396 - protein, 254 aa, Actinoplanes utahensis
MNYDVPIAQMLAILLGACRTGAWMVICPPFNTRLIPGPVKALLSVGLALPMAPYLTGTLPSLETSALLFSVLMQIFIGVALGFITMLLFAALQAAGDLLDLFGGFTLATAYDPLGFNQSSIFGRFYNLVAMTLLFAGDGHQLILRGFMQSFRTLPLNVSFSPETFSRLLLSGVGEMFVSALQIAGPLVCVLFLADVSLGLLNRVAPALNAFQLGFPVKIFLVVTLAGLAIAALPSVLHTLVERAVTAVIRLSGG

SEQ ID NO: 11397 - protein, 359 aa, Actinoplanes utahensis
MSGEKTEQPTQQRLKKAKQEGQIGRTPDLGAWLGMLAASVLLPRTLTQAMQHAEEAIAKLPDTIQNPDPAKGLALLREGLFGAAWAVAPLALTMMAVGVAAAGAQGGIRVATKLFIPKFNRLNPFSGLKRMFGPHALWELTKSLFKTAVLAAVLYMTVKNIVPQLMSAGRLPLTALLGTVTNAVISLIRAAAVAGIAMAGADYLVVRRRTQKQLRMTKEEVKQENKNSEGDPLIKAQIRARQMAMARNRQMADVPTADVVVVNPVHVAVALRYEPEKGAPRVVAKGKGPVAAKIRQLATDNRVPMVQDIALARALNSGCEVGQEIPAEFFGAVARVLAFVMSLKARGSAAGLHRSPAMT

SEQ ID NO: 11398 - protein, 680 aa, Actinoplanes utahensis
MKGRNLGKLAVPVGVIGIIIMMVVPLPTFLLDLFIAMNITMALLVLLISMFVEKPLDFAVFPALLLVMTLFRLALNISATRLVLRDGDAGKVIHAFGSFVVGGNLVIGLVIFSILVIVQLIVVTKGAERVAEVGARFTLDAMPGKQMAIDADLNAGLIDEDGAKRRRAEVAAEAEFYGAMDGGSKFVKGDAIAAIIITLINLIGGFAVGILQHGLAPADAMNQYSMLSIGDGLVSQVPALLLSVATGLIVTRSATSGDMGQTVTAQLSQNKLALRIGGAAALALCVIPGLPKVPFLVVGVTVLAIAQRVKEQIPEETAPIAEAVEMPAADSPEQLLGEMRIDPLELALAPDLVDLVDASSGDLLDRVRALRRKMALELGVIMPPVRTRDDLDLPLSSYAIRISGVDAGAGQAPPGTVLAIGEGLQALPGRAGVEPVFGLAGKWVPAEMHYQAELSGATVVDRASVIITHLAEIVRNNASRLLGREDVRALTEMVKRTHPVVVEELTPGLLSLGQIQKVLQAMLDEGVPIRDLVRIFEALSLRAKTSADHDGLVEAARAALGPAIAAQYASGGRLTVITLDPMLEQSLLESLRPSDTGAFMAIDGMRAEAIVSEASRLAEAAEQQGLNPVLACSPQLRLPLMRLLRAGSRRVQVLSYSEISGSTAQIETIGVVNGAYAGAA

SEQ ID NO: 11399 - protein, 197 aa, Actinoplanes utahensis
MPTRVLLEGPAIEPLLAQVRDEYGSRVRIISADKVRSGGIGGFFAKQHYELSVEVPDAHEDSEDMAQQTVAENGANPLERLLEQAESRDRNAFDGPPPGRPPTPKLGAGPGLGERFERQGGRDAGIGDTGAAFAELMAGLDMAGHLGETQRGGHRVRQTADAGVRPFTPATVTEPPVNGGGRLGLPAALPGRPALAS

SEQ ID NO: 11400 - protein, 280 aa, Actinoplanes utahensis
MPTGAPIRSAAEVYGLSGDDEPAPVSPTAATPPPPPAPKPAPIRVSGDLDPVQRNLMTVGMPEDMARQITGGDTYAGVLSVLASRPAAPGIPDGPGEILVIAGEVHTAVPIAKHLLEQVHVDQNHLLLAALSTSGTGLHSSRLISSPAAAESRADKLQTSDHPWIVVIDAPVGGTDEFWVNEMCDALGATALWAVVDATRKTADTARHLRNLGEVEALVVHSVELTSDPASVLGLDVPIFSLDGKPATPHAWAAMLCARIAAEVMPAAASPRRATRAARR

SEQ ID NO: 11401 - protein, 133 aa, Actinoplanes utahensis
MRIAPLRLDADGVHRLTVQLHPVDLGPVQVVAEIRNGDISVQLTGGTEAGTEALRAGIEDLRRELQDSGFGNCSLDLRQGTPQDQARQQFEAGGGFGRRGGGGESGRPNADLPAEPAPTATRRATPGRLDIHA

SEQ ID NO: 11402 - protein, 165 aa, Actinoplanes utahensis
MIMPSSVTGPDHRPVTETSRRAGSRREDGADFGSALSAELGDDQDEVAEQTADRRDAATRSAELRDAATRSAELRDVATRSAAMRDATARSTELRNAARDADLRGAAIRGTGSRDVTRAATDRTATERAATERALADRTATDRAAGDRDATRAATDRATQRAAAS

SEQ ID NO: 11403 - protein, 329 aa, Actinoplanes utahensis
MSLGVTGVLGRIAELQEQLGLNPPQATVDPTASSGDKFASALARATGAGQAPGAASGPSGNDVVAAAKKYLGTPYVFGGTDPSKGLDCSGLVRQVYEDLGIKLPRNSWQQATAGRPVASLSDARPGDVLAFGSPVHHVGIYLGDNKMIAAPKPGDHVKIESVYEKPSGIRRIIDDVPAAAVQDMSSLRPAGLRGSVAGGSLAGVPYADLFLKAGARYDVSPKLLAAVAKVESGYNPKAVSKVGAQGLMQLMPGTAKGLGVDDAFDPEQAVNGAAKMLKGLLNEFKSVPLALAAYNAGGGAVHRYGGIPPFSETQAYVPKVQKALAALGG

SEQ ID NO: 11404 - protein, 156 aa, Actinoplanes utahensis
MNRTFRLVPVLRARKAQEDAARGELIQSRAEIREAQALVKRRQLDLIGADAPSEGSARAMVAALVARQSLAAGVFGAQRMVTDAEEVEREKMAALTDAAKRRRAVEMLSERHAAMVKANDLRVDQANLDELAVTAKARNAARGVETPSAEENGSNA

SEQ ID NO: 11405 - protein, 435 aa, Actinoplanes utahensis
MTDVFHHRLRSAVEAARPSVSGRVTGAVGLRVTVSGLEARVGELLRIGTGPDAVLAEVAALDGQQLNCLPLGPIAGIGAGTPAVSTGGPLRIPVGPDLRGRILDGLGRPMDGGPPLRGELVGIEQAPPSAMERQLVDRPMSLGVRVLDTLVPCGRGQRIGIFAGSGVGKSTLMSMITRGTSAELNVVALVGERGREVREFIEHDLGPEGLARSVVVIATSDTPPLVRLRAGSVATRIAEYYRDEGADVLLMMDSVTRAAMAQREVGLSVGEPPATRGYPPSVFAMLASLLERAGPGARGSITGLYTVLVEGDDHNEPIADAARSILDGHIVLDRKLATAGHFPSIQALDSISRVANKITTREQRADATELRRLMAAHRDVRELVEIGAYVPGTNPEADRANAAWPRISAFLRQDIDERITADDAWAALRALLATT

SEQ ID NO: 11406 - protein, 222 aa, Actinoplanes utahensis
MSSSPDRSVIRGAVAENATAARFATNLRMPEPNDPKQLEEERLQARTTGYAEGWAQGKRDALAAAEEAAARARAAEEHHEHRRAAALAHAVNALGRAVTELENQLMPTFTELQDLVLSSAFELAEAVIGRTLRDDPERGRDALRRAMTAAPEHGDVRVRLHPEDYAHLVGDDPGTFDYQGRQIHLHADPGLRPGDAIAETGTATVDATIEAAVARAREALRL

SEQ ID NO: 11407 - protein, 341 aa, Actinoplanes utahensis
MTTPALTTLSMTGVRKAAIMLIQFGKEQSAQVLANMTEKEVEAISAEVARLGKLDPVQVDDVMDEFYAMATTRFAGAGGMDYARELLEASLGKERAALILDRLEASMNDIPFNFLSNADPRQLLSYVQYEHPQTIALVLAHIPAGLASSILAGLPLEVQTEVAHRIAIMDRTSPDIIRQVESALQRKLSSVLQPDELSTVGGLQPLVEIINRADRTTERLILEALDARSPELAEEIRRRMFMFEDIVNLEDRAVQLILRQVEPADLATALKGVPEGVRDKVTKNLSERGRENLLEEMDLLGPVKVKMVEESQAKIVGVIRTLEDSGQIEIQRGGEADELIA

SEQ ID NO: 11408 - protein, 539 aa, Actinoplanes utahensis
MTDRLPAPVRRITDTFKSFTPGQKAVTIFAIIALVVGGYFFATWAAKPSYAILFNNLSTKDASAIVESLQKSNTSYELANDGQTIMVPRDQVNALRLQLSGQGLPNDEGTGYSLLDQQGITTSDFMQHANYQRALEGELAKTIKSIDGVEAATVHLVLPQKDVFADNAAKPTASVLVASKSTTPLSTDQVQAIVHLVASSVEGLDPTQVTVAGADGKILSTGGGAAVATGGDSGSDAQTVEFQNRMNASLQAMLDRLVGSGHSVVTTTADLDFDQTTTQSKTYSSDPSLPSLSETSSSETYSGSGGNNGGVLGPDNIQVPNGAGSNGQYANKNDARQNALNEVQEVRRKAPGSIRRLNVAVLLDSTTAASIDPTQVQQLVSSAAGIDATRGDSIAVSAMPFDNSAQQAAKDELAAAAAADRQNKQLTLVKTGALAFVVLMLFFLAWRASRRAKRRQQLTAEEKAHLEEMQAALDAQRQAELEATQAMHAAAMIEGGVAVEERDEAREERTREIEEMVKEKPDEMATLLRGWMSADATHR

SEQ ID NO: 11409 - protein, 111 aa, Actinoplanes utahensis
MINPIGAVSGFSGISGISGMSGISDDLNLDEAAKTSSPNTDFARMLSKGLQSVQASQEKANDLGVQVANGTLQDPAQYTMAATEASLGLQMTLAIRNKAVEAFQEIMRMQA

SEQ ID NO: 11410 - protein, 130 aa, Actinoplanes utahensis
MSIFNAIGVAGTGVTVYRKWLDAVSDNIANMNNTSRTSENAFQARYVQARAAQDGNGAEVAGIQLGNPEGIVTYEPDNPLADAQGNVRRPDIDMGSQMAQMIMAQRSYQANLSVVDRARDAYAAAINLGK

SEQ ID NO: 11411 - protein, 115 aa, Actinoplanes utahensis
MFDDLSTNALRVAVSGLSARQNAIADNIANVETPGFRARKVKFEEALQGAVARGQSPLGITPSVQESLEPTRLNGNNVNLDEETLAHIDTTMRYQLTLRAIDSKYGLLRDAIKGA

SEQ ID NO: 11412 - protein, 106 aa, Actinoplanes utahensis
MTDNWRSAWTAALDELEMDVAAVEAMLADEHRHAETPPADIWKPPTDLGALPLELKPRADEILTRQLAAAQELARRLVANRQQQTVTSRIETGEVIKRPVYVDCAM

SEQ ID NO: 11413 - protein, 124 aa, Actinoplanes utahensis
MTAAHLRDRYLQDSINTASPARLLVMLYDRLILDLTQGEEALREGDRDAAHERITHAQEIVLELRVTLDLEAWDGAPGLANLYGFILTELIGANIAKSPERVAGCRTLLEPLRDAWREAAVAAK

SEQ ID NO: 11414 - protein, 463 aa, Actinoplanes utahensis
MSTSSVDGLVSGMQTSSMIAQLMQVEAAPQTKLKTKVQTAQTAVASYQSVNAKLAATKSAAGDVVSLASWRSLNATSTSQTVTAKATGGLAGMAGSINFDVSSVARAQTSTLNVDTTSTGFPSSFQVETGTWSTDSNGADVFTGSGSFTTVNVGKPYDADAVTTAVNDAGLGIRAYTVKTGDTAGVMQFVQNKSGAANGFRITGLTGSDGNPPADTSARDATLTLNPGTSTEYKVSSSTNTFSTLMPGVSITASKVEQNVTVGATTDVNAIAGKFQAMVDAANAALGEIKDQTKYDASTKSSSPLTGDFTVRQMTQQTLSLVSNGLTYDKTTKNPDGTTSTAAVGFGSLSQFGIGLDSTGQLTFDAAAFTKAYNEDPAKVQEAGTAFAKQVKDLATTQTNTVTKVVQGRNNEIDALNDQIENWDVRLATRKEALQKQYAGLEAALGKLKDQGTWLSGQLAGLH

SEQ ID NO: 11415 - protein, 396 aa, Actinoplanes utahensis
MGLRINQNIAAQNAYRNLSVTDNQMQKSLEKLSSGFRINRAADDAAGLSISEGLRAQTGGLKVATRNAQDAISVVQTAEGALNETTSMLQRMRDLSVQASNASLDSDAKQAAQDEFSQLSSEIDRVSTTTAFGKSKLLDGSFGNTNHLVTTTPAVMPAGGTAMTLSIDTVGGTTLNTPIAASFTTAATGTASTPQDVADNINTQLQTALKANGRDPNEISVTAKADETGKVTFEVNSSSTFNVTASNLVTAGASQTNASAASGDFQIGANSGEKLGVHINEVSSKSLGLNNLNLTTAAVGTTPSGASQAIDAVDKAIKSVSATRAQLGAHQNRFEHTINNLNVAVENLSASESRIRDTDMAQEMVSFTRNQILTQAGTSMLSQANQSAQNVLSLLR

SEQ ID NO: 11416 - protein, 197 aa, Actinoplanes utahensis
MPIGGNHSAVRRTCRPVRMSGLPKGCSPTREPTEDRVSLTDLASVLWRSRELLEMLLFKLEEEQLLLAANRSRWLSHATREVEVVLDQIRQTEVIRAAYAQDVAAELGLPVEASLGELADAAPDPWSDLLHQHRKAFLLLTSEIRALADVNRDLLTAGQRAARETMLVFAETVETYGPQGQTVTGGVRRPTLVDEAI

SEQ ID NO: 11417 - protein, 486 aa, Actinoplanes utahensis
MGSTFSGLNTALTSLYAQRRGLDVTGQNIANANTEGYTRQRVNLQSQNGNVVPGVYATTSAVGGGVTVSSVDRLRNAALDQRSYSEHSASAYHNARAGQFNLVEDVFAEPSDTALQGRLADMWEGWNAVAANPSDLSAKSAMLEQSSTVAATLNDAASALNNQYQAARTGLNTYVDDVNKAADSVAKLNNQIVIATQAGLSANELQDQRGQQILKLSELIGASATEQPNGAINVFVGSAPLVSGFNTRQIEIEPGSATRIEDLATSEVNLRWSDTKAAVGAGGTMGASMELLAKGGTLDAMTKRLDTVADKLATTVNAIYKKGYAVDGTQGESFFVRNDTGADTGVTAAQIKVAITNPAKVAISSGDPTGAPTAASPGGTPKVLDGNQADAIAELADSRTGADAEYKSMIGELGVSAQSAIRRRDVQNAVTDQVDAARDSEAGVNLDEEMTHMLTYQRGYEAASRVLTTIDSMLDQLINRTGMVGR

SEQ ID NO: 11418 - protein, 310 aa, Actinoplanes utahensis
MTSPRVTESSVRTRVMASLQRNLSRSQEATDRISSGKQLTRPSDSPTGTVTALQLRGEVRANKRYSSNADDAVGRLGVVQDNLQQTQELITVARNLTLEATSAGGGGTPEANKARAAQLEQIKGNLIQFANSKYLDRPVFGGSTPDHEAYDSTGNYIGEGSGETLRAIGPNAKVRVDVRGPEVYGADKITDANGNQVDNPEQLFHVLDSVIGAMRSGDSKALDDGLKNLDKSADLLESTLSDVGARYNRVTQMKQSAEDRLSSVSSQLSDIEDVDLPKAIMEMQLQQTSYQAALAATAKVIQPSLIEFLR

SEQ ID NO: 11419 - protein, 145 aa, Actinoplanes utahensis
MTTRTMSRPIEATMTDPSLGLPTISMAIPMPGFPGHREFVLVRLNDDGLLYALTSVDDPELRFLVAPPEPFFPEYAPEIDESVFAALNTKDPDRVLLLTVITASKEETTANLLAPIVVDRDSMRAMQTILTGSGYPVRAIMNRAF

SEQ ID NO: 11420 - protein, 79 aa, Actinoplanes utahensis
MLVLTRRAGESVMIGDDVVITVLEARGDVIRLGIQAPRDVQVHREEVYRELQEANRAAASPTDEAVDAISRMVREKPAG

SEQ ID NO: 11421 - protein, 249 aa, Actinoplanes utahensis
MGAERESVIGGSAVGTVCALDLTVDAHVHTGFAAGRDAVGVVVSAADRAGLTALTFADQAGPDTTWLTAYADAVRRARHRTEMTLRVAAEVEVVRPDGWLALPADLAQLDALSVAVSALPLGDELLDARAVRARLAGGTLTAERVAGQLITAIVQGLARASRYVPTQLARPLALLAQAGIDDAAVSAEMLAELAAACRATGTVVEVSEAWRSPSPRLLALLRDAGVTLVPASDARYAAEVGGWQYLRRI

SEQ ID NO: 11422 - protein, 242 aa, Actinoplanes utahensis
MSMVQQAIEVSAPLHTVYEQLAAFENYPRFMTGVRQVTTTGGDQTHWIMEVDGKRREFDAQIIERSPDERVSWSTMEGPLLAETLTLRPMGETKTQIVAQLEADIAFLMPSDRHGQESLNRRLKADLTTFKGLVESGVLGGRPMPTGASVKRLPGPSHTLFSPARDYASPASVATRVHKHPPAAAPHPGAGWDNGAAGVELQDEPGGRATGSAAGTAPMGGRTARADMWGNGMINEEDRGIG

SEQ ID NO: 11423 - protein, 451 aa, Actinoplanes utahensis
MGGYVRIAVRGVGRNRLIAGSAGVTVTVLGLLHTHATDLTPPEGLRLPPAAALFPAGLALLIYAAPRGGRVRTGAVALCVLAAVALASASTLVVVATAALLVAAAAIRPGDPGRPGDARPEYAETLWQSMDEAVMVLDVNYRVIDVNRRWRELTGYDSAAEAPPPPLPGAGGDWLLSRADGTEVPVLATVAAIPDEAGAPRGYVATYVDIAERKRAEDALSDHAAELERGNAQLAAALAFKNDLTSMLTHDVAQPISSIASLAELLCADWADLPEDIRLELATKIDKNTRRLIKMMNDLQLLFRLDTGTVTARRVPVPLLEVVRAACAETAGAGQVEVTIDEDLSALADRGHLTIVVENLLRNAIAHGAAPVQVRAGRDGPETVRLEVRDSGPGIPDDLLPDLFGRFIRGAGLGLFIARHLVEANGGSMRYEHADPRGARLLVILETAPRG

SEQ ID NO: 11424 - protein, 70 aa, Actinoplanes utahensis
MTTLLSPEIDTVGELTERCDRCGAAAKLEVTLSSGGDLAFCGHHANRMHAEIARVASKIRLEEGFAWAGK

SEQ ID NO: 11425 - protein, 409 aa, Actinoplanes utahensis
MLGSDARRLAVRFAAVASAATASLYGFTGAASAAPAPVAPATGTVLEAGVAGAIPDSYIVVLKAGASASPDLVAGYGGQVLNKYQATVRGFHARMSAEQAARLAADPAVQYVEQDAVIGASSVQSNATWGLDRIDQRDRTLDRKYTYGSAKDVTAYVIDTGIRTSHKDFGGRASSGWDFVDGDKTADDCNGHGTHVAGTIGGATYGVAKDIKLVGVKVLDCDGSGSYSDFIAGIDWVTAHAKLPAVANMSIGGPQSKALDDAVDRSIAKGVVYAIAAGNDNKNACRFSPSDTSNAITVGAIDNADKRASFSNYGSCVDIFAPGVNIKSASSDSNSGTEIMSGTSMASPHVAGAAALVLGAHPTWTPQQVRDDLVAHADAGLIRNPGTGSPNRSLYTGYLYETGSAAKKH

SEQ ID NO: 11426 - protein, 140 aa, Actinoplanes utahensis
MSEAPVADTPTVLVVDDEEDLRDIMRRMLERKGYAALTAGDPDEAISVCRDHPGVIDVLVTDLTLPGGKSGGELAGTVIKMRPGTGVVFISGLPKDIAVTKGLVGDDALLVKKPFTADALLEALKRVLRDEAERDDPPPN

SEQ ID NO: 11427 - protein, 250 aa, Actinoplanes utahensis
MKPVGAITRGTTNPNRLRRVDNYLAFRCAAALSEAAAPLVVDLGYGASPVTAVELRGRLAAAVRPDVTVVGLEIDPVRVADAQPFAEPPFLQFRRGGFELAGLSPVVVRAFNVLRQYAEDEVTAAWRQMTGTGATLIEGTCDELGRIATWAVVEGGVASTLTLSARLPVLEHPAVFAERLPKALIHHNVPGHPVHELLRALGRAWETEATPFGPRQRWLATVRRMRADGWPVLDGPARWRRGELSMPWPG

SEQ ID NO: 11428 - protein, 251 aa, Actinoplanes utahensis
MQRIAVVTGASSGIGAATARRLAGEGFHVVAAARRADRLESLVKEIGAGATAVACDVTSDESVAGLAAAVQALGAPLALLVNNAGGAIGLDPVASGAVEDWQAMFDVNVLGTLRVTKALLPALEASGAGTIVTVGSTAAFTPYEGGGGYVAAKHAQTALVGTLRLEIVGRPVRVVEIDPGMVRTDEFSLNRFGGDRARADAIYAGVAEPLVAEDIADVIAFAATRPQHVNIDRLVVRPIAQAAQHKVHREL

SEQ ID NO: 11429 - protein, 429 aa, Actinoplanes utahensis
MAEVSWPTPRRIATVSVHTSPLEQPGTGDAGGMNVYIVEVSKRLAAAGVQVEIFTRATSSDLPPVVEMLPGVHVRHVTAGPYEGLNKEELSSQLCAFTTGVLRAEAAHPPGHYDLIHSHYWLSGQVGWLARERWGVPHVHTAHTLAKVKNMLIAAGDRPEPKARVIGEEQVVAESDRLVANTRFEAHDLITHYQADPARVGVVQPGVDLDRFRPGAADRARFGLPESGRIVAFVGRIQPLKAPDVLVSALAEMRARGAGEVTLVICGGPSGSGLDRPSALIELAASLGVSDSVVFLPPQTGADLAALYRAADLVAVPSYNESFGLVALEAQACGTPVVAAAVGGLVTAVRDGESGVLIDGHDPADWARVLDRLLAAPAYRRRLSAGAVAHAAHFSWDRTVEALLRVYRDAMSEHRALITARVEGATCAW

SEQ ID NO: 11430 - protein, 161 aa, Actinoplanes utahensis
MVKKLIERVLTDRELEWESTGESSYVVTLPGTHKLKTACNLIVGEHALRIEAFVMRQPDERREDLWAWLLRRNARMYGVAFSIDAAGDIYLTGRVSLTGLDEDELDRLLGAVLTYADESFDTMLEIGFGSSIRREWEWRVKRGESLANLQAFQHFAAPTES

SEQ ID NO: 11431 - protein, 421 aa, Actinoplanes utahensis
MRGWLRAAVGGLPTAYWYLWTGLLINRVGGFAVLYLSLYLTAARGAGAALAGLVVGAHGIGGVLGTLAGGVLTDRWGRRATLLWSHLACSAVLVALAVSTPLPLIAGLCLLLGLTQAMPGPAFVAAITDTVPGEHRLRAFNLQFWAFNLGTAGASLLAGLLARWSYPGLFLLDAASTLITAVIIARKVPETLGRAGRGGAPGGLRTVLADRIFLAFVGLTVLQALLSSQANTIVPLAMHADGLGPGDYGLVTALGGALIVLGQLFVPGLIDGRRKARVLALAMLVTAAGFGTLTVADSLPAYLGAAAVWTVGGMLAAPPNAAINSELAPPLLRGRYQAVFYLSFPFASFVAPALGGAGLEHLGPGLWPIVAGVGIVAAALHLAAGPARERRTARTAAAPGPAHRRPTAANRVDPQATDGRH

SEQ ID NO: 11432 - protein, 411 aa, Actinoplanes utahensis
MRGWLREAAGGLPRQFWFLWTGTLINRIGSFVVPFLSIYLTSERHFTQSQAGLVIGLYGVGGAVGTMTGGMLTDRWGRRPTMLTAQFGAAALMLTLGLTHPYPGILIVTTLLGAFAEGVRPAFGAMMVDIVPERDRVRAFSLNYWAVNLGFALAAIVAGLAAEANFTVLFVADAASTVLTGLITVLLLRETRPAHRPAASGVAPAAGLATALRDRTFLAFMLVNLLTVLVMLQHLSTLPITMLTDGLSAATYGWVIAVNGFLIVAGQLFVPRLIAGRRPHRVLAVAALIMGTGFGLVTFAHAAWMYAVTVVIWTLGEMLQSPSNAATVAALSPAPLRGRYQGLNSLSWSAGGTLAPILGGLVLQDRGTTALWTGCFGLCAVAAAGHLATGPARVRRAALLTRETDTPSGVR

SEQ ID NO: 11433 - protein, 248 aa, Actinoplanes utahensis
MTGTLVLLRHGNSEWNAKNLFTGWVDVDLDAKGEDEARRGGELLKEQNVLPDVVHTSLLRRAIRTSEIALHITDRHWIPVKRSWRLNERHYGALQGKDKKQTLDTYGEEQFMLWRRSYDVPPPPIEDDSEFSQANDARYADLPPEIKPKAECLKDVLDRALPYWYDAIVPDLRAGKTVLVAAHGNSLRAIVKHLDAISDEAIAKLNIPTGIPLRYDLDENLRPITAGGTYLDPQAAKEAAAAVANQGR

SEQ ID NO: 11434 - protein, 217 aa, Actinoplanes utahensis
MREEFQAELTEVNRLLVTMAESVREALRKATTALLTADLQAAEAVIKRDADVDAIFQQVEAKVADIIVRQAPVAIDLRRAITALHISADLERMGDLAEHVAKTAARRHPSPAVPAELRPVFKGMAEIADQMAEKITTVLTHSDAGLAAELEKDDDAIDDLERQLFKIMLADDWPYGAETAIDGALLGRFYERYADHAVNISEHTIYLVTGEPVAGQG

SEQ ID NO: 11435 - protein, 421 aa, Actinoplanes utahensis
MDWGYAVGSVSAALAVGVGAGLALARVRQPSPVDVARDGSPEGRAAIEPDDDRPAGKHGLKGLGRKSLDSLRVGVVVLDADDYPVLVNPAARAMGLLRSGGAPGTIAAHPILRTLAGQVRRTGVRREVELDLPRGRAGGAQAPLGLHLRAVALNASHVAVEAADVTESHRLARVRRDFVANVSHELKTPIGALQLLAEALLDATQLPETAPGAQSEDLQAARRFAERIHHESARMGRLVSELLELSRLQGAEPLPTPEPVSLDWVIAEVLDRTRTTSSAKSIEVTSSGPKGLMAYGSDSQFATAVTNLVENAIAYSGPDTRVEVTVRQESEWIEIDVRDQGIGISPQDVDRIFERFYRADQARSRATGGTGLGLAIVKHIATNHGGRVDVTSALGEGSTFTLRLPARPPESPSLSPTATEI

SEQ ID NO: 11436 - protein, 239 aa, Actinoplanes utahensis
MSTRSPTTEGTALARVLVVEDEESFSDALSYMLRKEGFEVSVAATGTSALTQFDRTGADIVLLDLMLPEMSGTEVCRQLRQRSAVPIIMVTARDSEIDKVVGLEIGADDYVTKPYSPRELVARIRAVLRRQSGEAIEVSTPTLAAGPVRMDVERHVVTVDGSGVQLPLKEFELLELLLRNAGRVLTRGQLIDRVWGADYVGDTKTLDVHVKRLRSKVEPEPGAPRYIVTVRGLGYKFEP

SEQ ID NO: 11437 - protein, 275 aa, Actinoplanes utahensis
MSRARRPVEVKLDFPREWIEFLDPADQQHLIRADLTWLLSRWTCVFGSACHGILPGRAEDGCCSHGAFFTDADDENRVKAAAAKLTPQTWQHHRRGFKNWTEMDTVDGTKPARRTATRSGDGPCVFLNDADFAGGGGCALHAQALRDGEHPLKYKPDVCWQLPVRREQDWITRPDGTKLLQSTLTEFDRRGWGPGGHDLAWWCTSSPEAHVGTEPMYVSYGPELTELIGEPAYRRLAELCAARLATGLLAVHPATTAAGGPKRKGGREPASPRSA

SEQ ID NO: 11438 - protein, 272 aa, Actinoplanes utahensis
MTSRVPVLLSSSSVFPEPTAAAFEMAATVGYDGLEVMVWTDAVSQDAGALKGLSDHYGVPVLSVHAPCLLVTQRVWSPDPWERLTRAAQLAESLGAPTVVVHPPFTWQRDYAKNFAAGLARVCDRHPDLTFAVENMFPVKMAGRWFVPYTPGWDPTETGFDAYTLDLSHCAASRIDSLDMAAKMGSALRHVHLGDGTGAGRDEHLVPGRGNQPCAELLRSLAGRGFTGSVACEINTRKAASRTVREADLRESLEFARRHLAPADSSRPALQA

SEQ ID NO: 11439 - protein, 60 aa, Actinoplanes utahensis
MTDRRSRRFRARRFRPLRVQDESPHPTTRGWSPQAHCPRVPPEPRPRDQAGVSVAVLSGV

SEQ ID NO: 11440 - protein, 185 aa, Actinoplanes utahensis
MNFDAYARTAVDLVNAGLDDLAGLRALFAGDLEYMRDQVVEKDLAVFRRAQRRLREVFEYGTAERDADAVRELNTLLEAYPVQPRISGHDAGDWHMHVTSRGSSVSAEYLAGAVWGLAVWLCEYGSARFGICADERCGNVYLDTSSNNCRRFCSERCATRSHVAAHRARKRAAQTPESTATLTPA

SEQ ID NO: 11441 - protein, 303 aa, Actinoplanes utahensis
MFRSLFLAAAGSARLARLVESTPVSASMVRRFVAGRDAGEVVRTSRGLADDGLAVSVDFLGDQPDTPELARAVRDEYVSLLARLGEAGLAPVAEVSVKLSALGRRFDEKAAFEHARAICVAAAAAGTAVTFDAEDHGSTDATLEAVLELRRDFPSTGAVLQAYLRRTEADCRELATAGSRVRLCKGAYTEPESVAFPSPLEVDKAYVRCLNILMSGAGYPMVATHDPRLIAIAEDRARWFDRSTGEYEFQLLFGMRPEEQARLADDGHTVRVYLPYGPQWYAYLLRRLVERPAFLVAAVSSRK

SEQ ID NO: 11442 - protein, 70 aa, Actinoplanes utahensis
MTGPAQTEERLSEVRFLTVAEVATLMRVSKMTVYRLVHGGDLTAVRVGRSFRVPEHAVHEYLRGAFSQTA

SEQ ID NO: 11443 - protein, 33 aa, Actinoplanes utahensis
MGSVVKKRRKRMAKKKHRKLLRKTRVQRRRLGK

SEQ ID NO: 11444 - protein, 343 aa, Actinoplanes utahensis
MSQDEFRDMLPGHADFRLPEPPPVRKVNGRRPIPEKPDEQVAKLESTAEPRPDDAGSAAEPAAPVDVWDQRIAAGLAFLRRRLAGAYEVDEFGFDPELTEAVFHPMLRVLYRDWFRTEVFGAENVPVDGGGLVVGNHSGTLALDALMLTVALRDSPQRRHLRLLGADLVFRMPGLSDLARAAGATVACNPDAERLMTGGQLVGVFPEGFKGIGKRFADRYKLQRFGRGGFVSAALRTGTPIIPVAIVGAEEIYPILADLKPLARLLGVPYFPVTPTFPLLGPLGLIPLPSKWLIQFCEPIPTAHLTEFADDPLVVYNLADQVRETIQATLHELLQKRPDPFAR

SEQ ID NO: 11445 - protein, 379 aa, Actinoplanes utahensis
MKFPFPSSRSAERFAEQVDDPGGDHRHLRGHADDELTELLALSRRLSAARPAGQVDPEFRVGLRAMLVATAERDGIGRTAAEAEPEPATELPARGHRAIFGRRLRTRGAIVLGVAAGAMAVSGISAASENATPGDALYGVKRSTERAQLAIAGSDASRGQLSLDFARNRLREATTMTGDADSFRGVLDDMDADTRKGVKLITTSAVSRKDPAQLATLDTFVAAQRKVFEPAMQNLSSVNRERALTSLGLLQDVSQRTGQLREGLDCEKVVQTGADGLGPKLRDCGEDPSDKTPPGGTRAGGDRSTSKPNNTTTKPVVPGSSAQPGASTGVPGHRSGLTPSTPVNGRTTTSPTPAGTPTLDDGHESGDEGTLGGLLGNVF

SEQ ID NO: 11446 - protein, 314 aa, Actinoplanes utahensis
MTHVYAEGPYHRDVLAGRQAITDGLNVIRESVDGMITNAIRGDSPRRTGNRRPLNNSPSVPAPGANGKFGGNRLGARPPAQPTAGQRSNLPESETPGTDHTVVLPTQSKTGPPTETQPPKARPDRGDPAAEVWALVERAQAGEAEAFGLIYDRYVDTVFRFVYFRVGNRQLAEDLTSDTFLRALKRIGSFTWQGRDLGAWLVTIARNLVADHFKSGRYRLEVTTGDVLDADREDRGPEGSPESAVVDHITNVALLTAVKQLNPEQQECIVLRFLQGFSVAETAQTMGKNEGAIKALQYRAVRALNRLLPEGFQS

SEQ ID NO: 11447 - protein, 546 aa, Actinoplanes utahensis
MCATRKAANPSEIGIRYQGHPGPSRTPGNGPAVRYPGRVTFVRDSGVVEEPARDPVAHAAARRPDSPALIAGETVLTWADLDVKVTAAARFVAARTAPGDRVASVLGNTVDFVVTWFGTLRAGRVAVPFNPGCTVDEATHALSDAGCALIVIGQADRLRLGLGESCVGPDFDNAPAAELPPVAASDLAALLYTSGTGGRPKAAMLTHAALAANHDQLDAIEPPVVGPDDVVLLAVPFFHAYGLNTGLGSVAHHAATGVLAERFDPAETAALIARHRVTVVVGVPGMYQAWVRVPGALEALAGLRTAVCGAAPLDRATAARFRAVTGRSIMIGYGLTESAPVLTTTAVSDRDKTGSIGRPLPGVELILRTRAGLELWRDGSASPEEDLAELDLAPAVSAGTDPGEIVVRGPNLFAGYWPDGRDGPDAAGWWPTGDVAYADGDGDLILVDRIGELILVNGFNVYPAEIERVLHAHPRVTEAAVVGRPDRETGQRPHAYVVVAGDPPPSVTDLQVHCAVRLARYKLPTIELVGTLPRSASGKVRKRELS

SEQ ID NO: 11448 - protein, 82 aa, Actinoplanes utahensis
MTRITLISRGGCHLCEVAEQTLDRIAPGDWTRVDVDSSVELQRDYDDRVPVILLDGREHGYWRVEEARLLRDLARQPGEPHL

SEQ ID NO: 11449 - protein, 213 aa, Actinoplanes utahensis
MTAKHLVWDWNGTLLDDLHLVVSSTNEAFATVGGRAVGADEHRRLFRRPVAEFYAEMLGRAVEAEEFGRLDRIFHDAYRLGLTDVGLAADALAAIKSWPGSQSLLSMWFHSELVPAVETYGLAGIFTRIDGLRTEVGGDLKAGLLARHLDGLGVAGADVVLIGDSLDDAAAADSVGAASVLYTGGFTDPVRLRESGRPVADSLVDAVKMALSL

SEQ ID NO: 11450 - protein, 245 aa, Actinoplanes utahensis
MSQQRHGSTPGEAGGVPAFPDLPEATIARLPEYLRALHHLAEAGAETVSSEGLAAAAGVNSAKLRKDLSHLGSYGTRGVGYDVALLVDQIEYILGLDKNRAVCLVGVGNLGHALAGYAGFASRGFRVVALFDADRKKVGEVINGMAVRHIDDLARLAAEESIAIGVIATPPTAAQTVADLLVAAGVTSILNFAPCVLSVPPNVDVRKVDLAIELQILSFHEHRKASLTALPGGGEPAGDQEAVGS

SEQ ID NO: 11451 - protein, 437 aa, Actinoplanes utahensis
MNLLSIGASYRTADVSVLERLTIASAQIPEILQKLVAQPYVSEAVLVSTCNRVEVYAAVSGFHGGLGDICNVLSQTSGIPATELAGHLYVHYGEAAVRHSFRVSSGLESMVVGEAQILGQLRDAYHAATESDSAGRLLHELMQQALRVGKRAHAETGIDKAGQSVVTAALEVAADHLGGPLAGRSALVVGAGAMGSLSVATLTRTGVGPLRITNRSASRADRLAELYGATAVPLSALHDELRTVDLVVSATASTEPLLTRDVLSAALAARTQADPLVVLDLAVPRDVAPDAAGLPGLFVVDIDSLATSRRSAPAAAETAAVEQIVSGEVDNFLGWMRGAEVAPTVAALRTRAEEVVTAEMRRLLGRRPEFTEEQRADVSRTLHRVVQQILHQPTVRVRQLAAEPGGDQYAALLRELFDLDVPLATHADAVPEIGGKP

SEQ ID NO: 11452 - protein, 321 aa, Actinoplanes utahensis
MTSVKPLRLGTRGSKLALTQSQMVADELTLATGRAVELVRIVTPGDTSSAPVAQLGVGVFVSALRDALVAGEIDFAVHSYKDLPTAEHPRLTIPAIPRREDPHDVLVARDGRGLADLPPGSLVGTGAVRRIAQLRALGLELQVTPIRGNIDTRIARVLGPDADLDAVILARAGIARIGRTADITQTLDPMLMLPAPAQGALAVECRSGDADLVELLATLDHAPTRAAVVAERALLATLEAGCAAPVAAYARLVRGRHAGSAPEDGRGEEMIHLRGAVISPDGVRAIRLSRTGTPAGAAEIGKALAADLLDAGADTLMGSTE

SEQ ID NO: 11453 - protein, 528 aa, Actinoplanes utahensis
MTTRTARKPAGRIAFIGAGPGDPELLTRRAYAALTDADQVVHDRGVPESLLAAVRADAKPDAQFSPAEGAPGDVAKVLLSAAKSGLSAVHLVAGDPFGHESVVKEVQAVARTAVHFEVIPGIGQAEGVAAYAGVPLPGVRIAADVDDVTSLDFDALAGAAQKGSFAVAVDAGDLAAVRDGLLAAGVEPGVPVAVTGDGTGETQYTTTSTVDSFVAAALGFTGRVVLTVGAEVAERDAMSWWENRPLYGWKVLVPRTKEQAGAMSARLRAYGAIPCEVPTIAVEPPRTPAQMERAVKGLVDGRYAWVVFTSVNAVRAVWEKFAEHGLDARHFGGVKIACIGEATAEAVRDFGIQPELIPAGEQSSEGLLAEFSPHDEILDPVGRVLLPRADIATETLAAGLIERGWEVDDVTAYRTVRAAPPPAEIRDAIKSGGFDAVLFTSSSTVRNLVGIAGKPHARTVVAVIGPKTAETAVEFGLRVDTQPQNASVPDLVEALAEYALELREKLAAMPAKQRRGSKVQGPTALRFR

SEQ ID NO: 11454 - protein, 326 aa, Actinoplanes utahensis
MSFPDIRPRRLRRTPAIRRLVAETRLAPSELILPLFLKDGINEPKPISSLPGVVQHSRESLLKAAHEAVSAGVGGLMLFGVPDNADKDETGAAGLDPDGILNVGLRDLRAEFGDATVIMGDLCLDEFTSHGHCGVLAPDGSVDNDATLEIYGRMAVAQAEAGAHMVGPSGMMDGQIGVVRRALDAAGHQDVSILAYSAKYAGAFYGPFREAVESTLQGDRRQYQQDPPNLREALREVDLDVAEGADIVMVKPALPYLDVIAAIRERVTVPVAAYQVSGEYSMVEAAAANGWIDRERTILETLTSIKRAGAQITLTYWATEVAKMLR

SEQ ID NO: 11455 - protein, 329 aa, Actinoplanes utahensis
MLFVGDDWAEDHHDVELMDGSGRRLAKARLPEGVAGIARLHAMIGEHLGEADSESAQVKIGIETDRGLWVQALIAAGYTVFAVNPLQASRYRERLAVSGAKSDAADAHMLADMVRTDSHQLRAMAGDSPDAEAIKVVSRMHKTMIWERDRAVLRLRHALRDYFPAALAAFDDLDAADSLELLGKAPEPAAAARLSLTQISAALKRARRRGDLTAKATAIQTVLRTGHLGQPAVVATAYAATTRSLVALLLTLNEQIAVLQQEVEAHFGRHPDAEIILSQPGLGAVLGARVLAEFGDYHARYASAKARKNYAATSPLTRASGKKKIVMAR

SEQ ID NO: 11456 - protein, 77 aa, Actinoplanes utahensis
MHNDRLADALQGQAFTALRASPGARAYYDRQRTRGIGHRPALRQLANRLVGILHGCLKTSTPYNETTAWAHHLDQAA

SEQ ID NO: 11457 - protein, 360 aa, Actinoplanes utahensis
MRTFAWSALPCESAARHDVRVRVREWDPRSASAAEVHSLVETVNAVLATDLPDDPPWRDVQVRDYLAETMPGERRICWVAEDDRLPEGESEIYALVSILLLGDIGVLEILVKPQLRRRGLGRELLGVAARRAYLEGFSSIGVEAIGGTPAIAFYESLGFEREYVETRSVLSLDTVDWATLGTMASGISSGYRVEYHPGGPPAPLLEAYARAKAQAQTDDDDLDLTPRSSDPERLRESLDTLHRRGLKPYIVLAIHESTGSVAGLTEVVVPAQHPERADQYDTIVVREHRGYGIDRAIKARMLFELRAAESGLRQVQTWNAQHNESMLKVNAELGYQSDRDWYEYIADVGDLVRRLGPADQ

SEQ ID NO: 11458 - protein, 318 aa, Actinoplanes utahensis
MGAWARRPSGRVIIPSVIALLLIGLAGSAGVYLVPRALEADPAPSASAALGGAGAVPAPSASDPYGIPGGGFSAPPAGIPGFPGAPATGFGLPTTGTPGLGTGLGTGTGPGTGTGINNGVGTGARPADALAGWAQATADKVGIPVVAVQAYGYAELVTTQTTPTCRLNWTTLAAIGKVASGHGSANGAVLGVDGVAQPTIYGLPLDGQGGRPLVRDTDQGTIDQDPAFDREVGPMKMIPSAWRANAVDADRNGVADINDIDDAALAAASSLCRDAHGSIRNLARADAWWDAVLNYGALRPSAQKIFDAANQYGQKSRS

SEQ ID NO: 11459 - protein, 69 aa, Actinoplanes utahensis
MPRYDYRCRACGATFELNRPMREAGDPATCPHGHGDTVKLLSTVAVTGRGGAAPAGGGGGGCCGGGCGC

SEQ ID NO: 11460 - protein, 861 aa, Actinoplanes utahensis
MFTDIEGSTRLARMLGDTYRAVLNAHRSVLRAALSDFGGVELLTEGDSFFVAFDNADAALAACVEAQRRLAAHPWPREDAVPRVRMGLHTGRATPIGTEYASAEVHRAARVAAAAHGGQVLCSEATALAVTATYATSGHGRVATAAAATLATVDLLDLGAFRLRGFDDAERIFQVVAPGLDREFPRPRTAEAPRHNLPAAHSSFVGRQAECAELAELVGRHRLVSVVGPGGAGKTRLSLAVGEQVVDAYPGGVWTIDAVSAAGGLPAALVAALGLRPEPGRQAIETVLEQCGERRMLVILQTCDAAPGLTAALAHRLLSRCPRMDVLTTGRAPLGLAGETVWRIPPMAPADAFALLKERATAARGGRRSDDDTALAELAARLEGSPLAIELAAARLRLLPAELLARRLDDPIGALDGDACGEGRHASLHNNLEWSYRSLGSRAAELLHRLAVFAGPVDLATVDWCGEGALSALSELAEKSLIEVVPGPRYRMSGHVRSYALRRLAATGDETSVRDRHLAWSLEMLSAVAVDTDGQPRTVSLTDLGPFVPEWQAALRWAARCGDVSAGLRLAAALSPWWREHGGAGEGRDLLSRLGERDGAEADPTELARSYLIHADLTGDRAERDDLLRRAEQAARRAGNAALLVRALGGRRIPLDERADEAAESGCRAVIAEAERTGVVTESLPAVLALAELYWRRGALTEAAELLGGARQLEAGRPEDRGRRAVDWLLGMVALRRGDLVAAHDHLVVALRSRLRHGFRGAAADAVAAIAARCALGGDPVTATVLFGGAEAARGARRTESFGSFWSERQAALRLALGDAAFDAAYADGANLGFDRIVAMALAVEHPDLEDGAARFAQIVR

SEQ ID NO: 11461 - protein, 333 aa, Actinoplanes utahensis
MVRQGPLKALAVRLAMALALVLSAVAVVYADRGGYRDVNGDGLSLLDCFYYAVVSLSTTGYGDITPSTQGARLVNVLFITPARVLFLIILVGTTLEVLTDQYRRGLRISRWRRKLKDHVVICGYGTKGRAAVDALLETGYDKSRIVIVENREAAVRQATANGFVVIEGNATRSSVLLEADIKNCKSVIIATDQDEASVLITLTVRQLTAGQVRIIAAVREQENAALLKQSGAHHVIVSSSTAGRLLGLTTTAPPLIDVVEDLLTPGQGMALAMRSAERAEVGRNPRELPTLVVALIRRGKVLPLGGEQAVTIETGDLLVYIRDDASTAAGVTV

SEQ ID NO: 11462 - protein, 334 aa, Actinoplanes utahensis
MGEPLTLTAKDFKSDQEVRWCPGCGDYAILAAVQGFMPELGIPRENIVFVSGIGCSSRFPYYMNTYGMHSIHGRAPAIATGLSASRPDLSVWVVTGDGDALSIGGNHLIHALRRNVNLKILLFNNRIYGLTKGQYSPTSELGKITKSTPAGSADSPFNPLSLALGAEATFVARTIDSDRKHLQSVLRAAAAHEGSAFVEIYQNCNIFNDGAFDLIKDADTRDEHLIRLEQGQPITFGDYSVVHPEGSFGLCVQQGGTPIVHDATVEDPAYAFALTRLSGSDLNTTPIGVFRDVRRPSYDEIVRKQLIDAQAQATGTPEEMLADLLNAADTWTII

SEQ ID NO: 11463 - protein, 617 aa, Actinoplanes utahensis
MAAPPKRVEQLDRVVIRFAGDSGDGMQLTGDRFTSETAQLGNDISTLPNFPAEIRAPAGTLPGVSSFQVHFADYDILTPGDAPNVLVAMNPAALKANLSELPAGADVIVNTDEFTKRNLAKVGYATSPLEDGSLAGFAVHPVALTSMTVGALAGLGIPKKDAERAKNMFALGLLSWMYSRPFESTLRFLERKFAKRPELVEANKTAFRAGWNYGETTEAFAVRYEVKPARMPPGTYRNITGNQALALGLVAAAVRSKLPLFLGAYPITPASDILHELSKHKRFGVTTMQAEDEIAAVGAALGAAYGGALGVTTTSGPGVALKGETISLAIALELPLVIVDVQRAGPSTGMPTKTEQADLNMALYGRHGEAPLAVVAPKSPSDCFHAALEAARIALTYRTPVILLSDNYVANGSEPWLLPSIDELPDLTVEFTTTPNAPDGRFLPYLRDPETLARPWAVPGTPGLEHRIGGLEKADRTGDISYDPANHEFMVRTRAARIEAIPVPDVDVEDPSEAARVLVLGWGSTYGPIGAACRALRQRGLTIAQAHLRHLSPLPDNLGEVLKSYDKVVIPEMNLGQLAHVIRARYLVDAVPFNQVSGLPFTAATLESMLEDVVKNG

SEQ ID NO: 11464 - protein, 145 aa, Actinoplanes utahensis
MPTVAIHRCRGPGSWVGCPFVDGYLGSYAVLGLVLAAGVLLFVAAFGANRLLRPARPAEPAGKRIPYESGIDPVGGDWAQAQIRYYVYAYLYVLFAVEAVFLFPWAVIFDRPGFGGAAIAEMGVFVAVLALGILYAWRKKILTWT

SEQ ID NO: 11465 - protein, 158 aa, Actinoplanes utahensis
MSQLLLFIVVALVVGTIVFGVTVLLSGGDSGLTAVEPDGQSVPLPGDRPLGEDDIAATRFDTAWRGYRMAQVDQALQRAAYDIGYKSELIGVLEAEVTALREGRLDDADSLRAAREAAVAPAGVPAEPAVPAETLAEAEAGDADAEPATSDEEPAESR

SEQ ID NO: 11466 - protein, 234 aa, Actinoplanes utahensis
MVPAAARLGRQAGLAGALARLETRLHRRAEEVRPPGRAGPAAVTGDLVIGDDAKARCFWGGSSPEYAAYHDDEWGKPVRGDDALFERLTLEAFQSGLSWITILRKRPAFRAAFDDFAIAKVAAYREADATRLMADPGIVRNRMKVDAALHNARVAAELAPGELTDLLWSFAPPARTRPSTRADVPATTPESTAMAKALKKRGFKFVGPTTAYALMQATGMVDDHLTGCWVPVLR

SEQ ID NO: 11467 - protein, 168 aa, Actinoplanes utahensis
MAQWSVVLDPEQWATERLFQQDVVVVRGAPAGLAAGDEALLLADGHVVAVTRVEKAGEYAALAYQRRAFDEPIPAAGLAAGPLAGAEFHRFAARFDRAPRKRSWLVSVALPIEAATPAEAVRQYWSHVSDLGPRELPTYVWPAGDELAMQAFVLGAEANQDPEEEGED

SEQ ID NO: 11468 - protein, 262 aa, Actinoplanes utahensis
MTDVLLVDRTDAVVTLTLNRPESMNSFTVDLKVALRDTLAALETDRSCRAIVLAGAGGAFCGGQDLREHATLLEQGHTDLNTVQVHYNPIAQRLASMPKPVVAAVRGMAAGAGASLALLADFRIGGPKTSFLMAFANVALAGDSGISWSLPRIVGHARAVELLLLAEPVRAQRAYEIGLLSRLTEDDEHVLPAAQELAARLAAGPTVAYGAIKRELSIGDAGTLSDALAAEAQAQAICGATADHRNAVKSFLNKQKPAYEGR

SEQ ID NO: 11469 - protein, 265 aa, Actinoplanes utahensis
MQARSALFDLYGDYLRTRGSRAPVAALVRLLAPLGIAAPAVRTAVSRMVRQGWLHPLRMTAGPGYLLTPKAARRLDEAAARVYRTGRGGWDGRFDLIMLHDPPLARPEAERLAFLGYGSLSDQVWVAPRASDELDAVLDEAGAAYDRFSAAHTAGSPGTAGIVGRAWDLDRIGRSYREFQDELRPVVKAVTGRSPDEEAYAARFRLVHAWRSFLFQDPQLPAALLPAGWPGVRAALFFDKHAARLRPAADRYVERCLHDKGRFGQ

SEQ ID NO: 11470 - protein, 55 aa, Actinoplanes utahensis
MAAMKPRTGDGPLEVTKEGRGIVMRVPLEGGGRLVVEMTPDEASALGDALKSIAG

SEQ ID NO: 11471 - protein, 465 aa, Actinoplanes utahensis
MFAIGFTEAFDQERTWVVPAGHVPPGEVGDEIAALAGVLPDEIVVLPRPLRRPARVLLAGVGDGDEAGWRAAGAGIVRALGDDEPVQILLPDNLPAAALRGLAEGLWLGGYRYRDGVKAPRSGAVDLVVQKPTAAYAAALAQASATATATWLARDLTNTPASTKNPEWFADQIVALADGRPGLSVTVRAGDDLARFGGLLAVGGGSVSPPRFVELSWAPEGATTHVVLVGKGITFDTGGISIKPRDGMKLMKKDMGGAAAVLAATLGAAELNLPVRVTALAPLAENAVSGSAFRPGDVITHYDGSTTENTNSDAEGRIVLADALSYAADRLDPDLVLNLATLTGANAVALGKRTAALYSPDDDLAAALTAAGEAAGERMWRLPLAGEYTENLRSDIADRISAPSGPGSVMAALFLRDFFPRVPWAHLDMSAPSWAEAHDGELTKGATGWGARTLLRYLSALDGGQ

SEQ ID NO: 11472 - protein, 333 aa, Actinoplanes utahensis
MGAGAGSTTAAGAYGSRQGSCSASLHHGEPGPGGGRCQFPPSVTSDPPTHRSPGSASRMTRIPGGAASSADREAPTGRFIHRQRRASRVSIALLSYPMCAVPIGHRHVARPARRFVIIGPARSFGQPSGHAVPFAETYATEDPILQTARSLANELGLPCVSPGAGSVLRLLAAAGNAKAVVEIGTGTGVSGIWLLRGMRPDGVLTTIDVEHEHQRIARRVFAEAGFAPSRTRIISGRSLDVLPRLADGAYDLIFVDADTTEFAACTEAALRLLRPGGVLIVNGVHAGGRINDPAARDVDTLMVRETVKVVRESEEWIPAVISAGAGLLTAVKR

SEQ ID NO: 11473 - protein, 411 aa, Actinoplanes utahensis
MTDGGNWHRPPPGPGSPWWSDALHDPWRDPYAPAAVVLPAPAPTGGPALDPVPDPDAPRRSYAPVLLICLLTALLAGGVGGTLGFVFAVRGGYVGAGGTRLGAAGQQSPVSAARDPQSLAGVAKKLQPSVVTVHVTGAIGSGFVVSADGYVITNDHVVDGAGPTMSVSFSDGSTAAAKLVGRDPESDIAVIKIAKGNLPAVPFGDSDAIAVGDPVLAFGSPLALENTVTYGIVSALDRTIEAGESGGTTRYYAAIQTDAAVNQGNSGGPLVNAAGQVIGVNSVIRSVGGSETEAGNIGLAFAIPINQAKRIAQDIIDTGKARRTVIGAEVTSGGTGTSGAKLRSVEPAGPAAAAGLKAGDVITKLDGRPLQDGTDLIALVRKHAPGAVVAVEYRRGSKTVSASVTLSSSTN

SEQ ID NO: 11474 - protein, 146 aa, Actinoplanes utahensis
MFENLNWWEIGALLMLALLIFGERLPKVLGDGLKMLRGLRAMAQNATSDLSKELGTDIQLEDLHPKAFIRKHLLSEEDEQALRKPLQSLFDDVKQDLNGVKTELNGVKTHLSETAADIRGAASTSRQTTAPVEAPRPAQRYDLDAT

SEQ ID NO: 11475 - protein, 382 aa, Actinoplanes utahensis
MSAPAPTLEDAIQAALATVDDPEIRRPITDLGMVQGFTVQDGLVKVDLLLTVAGCPLRDKLNADITAAVTKVPGITGAEINFGVMNEEQRKALQTTLRGGGAAEPEIPFAQPGSRTRVYAVASGKGGVGKSSVTVNLAAALAKRGLSVGVVDADIYGHSVPRMLGVESRPTRVEDMIMPPQSHGVKVISIGMFTAGNAAVVWRGPMLHRALQQFLADVYWGDLDVLLLDLPPGTGDVAISLAQLLPNAEILVVTTPQMAAAEVAERAGAIALQTHQRLVGVVENMSWLELPDGSRMEVFGAGGGQTVAESLTQTVGARVPLLGQVPLDTRVREAGDAGTPIVLADPEAPAAKALDAVADKLAVRRESLVGKPLGLMVNAKKG

SEQ ID NO: 11476 - protein, 173 aa, Actinoplanes utahensis
MSEPRRDRLDQPREPGRVQLPKFDPEAFGRWSESIARYMGTAKFIVYMTVVIGAWFLWNRLMPIWKFDPYPFGFLTLVLSLQASYAAPLILLAQNRQADRDRIAMDEDRRRAQLQKADTEYLTREIASLRIALGDVATRDFIRSELARLAAELDDAALRREKRARIEWEEDHP

SEQ ID NO: 11477 - protein, 422 aa, Actinoplanes utahensis
MGTRVYLARLAGLPVFDPNGDRVGRVRDAVVRLRTTNRPPQVVGLVAEMALRRRIFLPIGRITSMDAEAVALGTGSLNLRRFEKRPNELLALEDLLDRRVFVAPEQQGAEEHQGTVVDIGMDLNRNTEWVITRVAVREHTGRLARRGHVYQVEYDRVRGLVGPTDTQGTSNLLALLDQMRPADMANALQDLPDARRNEVAAALSDRKLADVLEELPEHDQVEILARLDRERAADVLERMDPDDAADLLAELPKAEQAVLLDLMEPEEAAPVRQLMSYRPGTAGSVMTSEPVIMTPDATVAEALARIREPDLSPVVAAQVFVARAPSATPTGKYLGMVHFQRLLREPPSSIVGGLVDSGIEPLRPDIGLAEITRRMATYDLVAMPVVDGTHRLVGAVTVDDVLDHSLPRDWRDRDAHEDEEPL

SEQ ID NO: 11478 - protein, 293 aa, Actinoplanes utahensis
MSTVAYEIVDVFTDRPFSGNPLAVVSGADHLATDQLQTLAREFNLSETTFVLPPTSAEATYRVRIFTTDEELPFAGHPSVGTAVTLMRQGHFGPGRVVQECGAGLLPIEVTAAGAATLTGAAPRLGVPVPVEALLEISGLTAEDHACSGSAVAREAGCGLDWTFLPVRRSALARVVIDARAAARHGVTDLGIFAWDPESATAHARMFVAGSTVWEDAATGSAALGLGVWLVGAGWLPADGLSTYHVSQGSEMKRPSRLDCTVTAVGGAATSATVTGHVVPVATGRIAVPPFIG

SEQ ID NO: 11479 - protein, 165 aa, Actinoplanes utahensis
MTGVNGVLDEAIKKAAVAWISVGDGPAFALWCMPVESSLAVITGPGEQHADGLAEATRATVRLRGDHGGLIVTTEATVTRLDPAGERWSEIAPQLAGKRLNAAGTADEVTARWAAGCALLLITPVEGGLVSAPGLPDASGAAAPRETPARVPTRKPFRLHRVVKR

SEQ ID NO: 11480 - protein, 232 aa, Actinoplanes utahensis
MPAYRAVVFDFFGTLTRSVQRGPQHADIARALGADPEAVLGVLNRTFRARACGRYGSAEATLRWVIEQAGGRPGPAAIRAAMPARVDALRADTRLRPDAVSALTEIRRRGVRTALISDCTHELPAFLPGLPVAPLLDAQIFSVEQGVCKPDPRIYLAACRELDVEPRDCLYVGDGGSQELTGAAAVGMTPVRLAAHDLADHLVFDADTTFAGRTVRSLSEVVALLDRTPALV

SEQ ID NO: 11481 - protein, 454 aa, Actinoplanes utahensis
MRSSGHPISALTGLALAVAVCAVSSSAPLIAFAAASAPALAVAFWRNGLASVALSPIALGPRRAEVHDAVRGRRRRAGLFCVLAGVALAAHFGTWMPSVQLGTVATSTALVATQPVWQGLIAAWQGHRPTAAGWAGIALAVAGAAWATGADVGVSGRAVLADGLAVLGAIFAAVYTALGEQARAALSTTTYTWICYGVCALILLVVCLAGGVPLTGYTPRAWAAILALVAGAQLLGHSMFNYALQHTSATTVSVLVLLEVPGAALLAWLWLGQVPRSGALPGLGLLVAGVAVVILGAARASRRGPVTPALADEPPSPDRPRHPTTGPGRSVTAPPRRRAAAPPHRRAAAPRHGDPITTSRRRTTASPHHRTAAPRHGDPITTSRHRSTSPSGFPWSGARRALGSWATRGPGRRLSGRGLRRTPSSCVLPEAAEEWRVDRERHLQRPNFQKCRRM

SEQ ID NO: 11482 - protein, 214 aa, Actinoplanes utahensis
MHRVRLGRLLLAGVLMIGGCGEYETADQPEQIGATGEWRTPGCEFSREPEFSERGGLRMPLTPAPLRDAMERIEQAGRHRFPDSFAGLEVDQYRVRAIVYRVPRLSTEFDDFIRQTAANTCIVVRDAAHAVAELTTWHDRVAADLAFWQVRGVRIVTIGSRHDGAGVEVGVREVAKARADMPAYYGADAPLIFVEQGPATPFTDGWVVLPEHDD

SEQ ID NO: 11483 - protein, 324 aa, Actinoplanes utahensis
MFAPGSRSRQDRRMVFDARSTGGTPTRRDATRPADGRPPRSGVPGTDPDRPVEITPEVVEAEFEEASAEAAVTLRLDGKVALVTGAGSPDGIGYATARRLRDLGARVAIVSTTRRIHERATELGITGFVADLTDESEVGALADAITDQLGDVEVLVNNAGLASRASPEVLRPVAQLTLDEWKAEIDRNLSTAFLCSRAFVSGMAERGWGRIVNLAATAGPVNALPTEAAYAAAKAGVVGLTRALAMELVADGVNVNCVAPGTIYTAASTVTEIKQGLGTPIGRPGTPDEVAAAVAFLCSPAASYITGQMLVVDGGNSVREAQFR

SEQ ID NO: 11484 - protein, 135 aa, Actinoplanes utahensis
MRSAQQILADANVIAVVGASRDSFKPAHTVPLQMLRYGWRIIPVNPFVDEVFGIRTVPTLADLEEPVDLVDIFRPARDAVDVVRQAVAIGAPAVWLQSGIVSAEARQIATDAGIDYVEDRCLAVERAVGNLSKLT

SEQ ID NO: 11485 - protein, 643 aa, Actinoplanes utahensis
MRWSHLSAGAGDDSLPDRAAPAASPLPLALPGATVRTFDTPGFAGMTFYEIRAKSLINRVPGASQVPFQWTVNPYRGCSHACTYCLAGDTPILLADGSTRRLAEIRPGDPVMGTMGAGPHRRYVPTTVLDHWATSKPAFRVTLTDGTRLVSSGDHRFLTDRGWRHVSPAEPHQPALAIGDLMCGVGHFAEPPKESPDYQAGYLCGLLRGDAASRAAREGDAWIRADGYLDDVSLPDALRWPELPSGEWYRGFLGGAFGAVGRAERLALSFESTDRIYLRWVTEALTHLGLTSRTPVRCRADRPGRVETGRDLWAALRFRHLTGALDAPLDASGVGVRADRRLAVADIEDLGLTLPLLDISTGTGDFIADGVVSHNCFARGTHRYLDMDPGHDFDTRVVVKVNAGELIRRELAEPGWSGAPIAMGTNVDVYQRAEGRYRLMPQILAALRDHANPFSILTKGTLILRDLDLLRQAAEVTQVGLAFSVGFVDERIWRSAEPGTPSPQRRLDAVRRLTDAGFPVGVLLAPILPGLTDTEESIDATVAAIAAAGATSVTPIPLHLRPGAREWYASWIAREHPHLIPRHRSLFANGAYSPRSYQDELTARVRMAARRHGLHRPTPGQFRTLPTSEEVPSTPKSDQLTLL

SEQ ID NO: 11486 - protein, 137 aa, Actinoplanes utahensis
MATVALTTANFDEVTSSDGIVLVDFWASWCGPCVRFAPTYERSSEKHPEITFGKVDTEAEQELAAKFDIRSIPTIMAVRDGIVVFAQPGALPESALESLIEKVEQLDMDEVREQVAAHKKAHEPKAQSTGEPARAAS

SEQ ID NO: 11487 - protein, 210 aa, Actinoplanes utahensis
MTAGEDQSTEVGVGPWPGDRPDGAHYDPELLEHGDRRNVVDRYRYWTREAVIADLDTRRHDFHIAIENWQHDLNIGTVVRNANAFLAAEVHIVGLRKWNRRGAMVTDRYQHVRHHPTIEDFVGWATAAGLPVIGIDNLPGSRPMETVTLPRRCVLLFGQEGPGLSDVARHACTQLFSIAQYGSTRSINAGVASGIAMHAWIRAHAGPPPA

SEQ ID NO: 11488 - protein, 220 aa, Actinoplanes utahensis
MSCPRCADQVRKPDLMHSNWRCDNCGDVPPFHVAEHISAEIVGTVLRESASGAERMPLWGPWPLPAGWTVTGVGWAGDDRSGVRATALACSGPEPLGGGPADLVFIAEQPGVGLGTRFAGIPGIDPGYLLSETLSDCGVNGGPHAKIKVGGHPTPLWCVKSPEDRSAYVSEAKGIWLYAVAWPASAGYLLAEHVVLHDLSDGVPAELVFGAPSPYLHGRV

SEQ ID NO: 11489 - protein, 52 aa, Actinoplanes utahensis
MIKKVLTWLGIAFLIFFIAFNPRSAAAVFESLGGTIADIARGFGTFFTDLVA

SEQ ID NO: 11490 - protein, 271 aa, Actinoplanes utahensis
MDPGEPRDPRGEGAQRPPDDDDAFRYRDPAFEDTDPGQTRAETYPDDERFAHQARRADEYDDPDQYEAPVFTEEELEGLDRGGGPRRFLPLEDEPTTLVARYLFPTERYRGEWKRHWIHLSLPLSVGAGATLLLGYLAGFLTRQNVDGMVTVAVLIWLGVISWVAWKVFDWYFDRFILTNKRVMVVNGIVTRKVAMMPLLRVTDMKYEQSALGRMLSYGTFVLESAGQDQALREVKHLPNPNELYLRVVEEMYEPQAVEARLGKDDEGDDA

SEQ ID NO: 11491 - protein, 251 aa, Actinoplanes utahensis
MMAITDHDTTGGWAEAAAARPDGLRLVRGAELSCRWHGVQPGISLHLLAYLFDPDDPALTAGMLRMRADREQRAEQIVDLLRADGVPITWAEVHGYAAGGSVGRPHIAQALIRAGLVDTTTEAFASAWLGARYFVPKLDLDVFEAVEAVRAAGGVAVFAHPRATKRGRVVPDELIVALADAGLFGLEADHEDHSPEEREQIRALADRLGLVVTGSSDFHGTHKTVRLGAFQTAVEVYDKIAAAATGVPVLG

SEQ ID NO: 11492 - protein, 205 aa, Actinoplanes utahensis
MNVKLFGEFYVTLLVIVDPPGMVPVFLALTGALPAKARNRAGTHAVLLALGVIVGFAVAGQTLLDYLHVRLPALQAAGGLLLVLVALQLLTGKTDEPEEQAGTSNVALVPLGTPLLAGPGAIVATMLFVQRYKSLDGYLILGAAILAVMATVWLVLRFSGLIVRLLRPAGIEVLTRIAGLLLAAIAVQLIADAIFAFVQLYAPRL

SEQ ID NO: 11493 - protein, 293 aa, Actinoplanes utahensis
MPPTRNRAAVPEQLGFAGMPERLFVCTPSKLGAYLDCPRRYRYSYVDRPSPPKGPPWAHNSLGASVHTALKNWYALPAERREPDVLPTLLKSTWVREGYRDTELERAAYRKALTWLESYVATLDPEDEPLGVERVVAAKTAVLALNGRADRIDARAGEQGPEAVIVDYKTGRTGLDADDARGSQALALYAYAAQRVFRRPCYRVELHHLPTGTIAAHEHTDESLARQVRRAEETAQDIMTAEKAVAAGADPDEVFPTNPGSLCGWCDFRKVCPAGAQVAAKEPWAAVEHLGAA

SEQ ID NO: 11494 - protein, 298 aa, Actinoplanes utahensis
MSRSRDARVPGDRDDRTPGDMGLFGPDSVTWKLHREPILMLGGLRSLYMQALHPRAVAGVAQNSGYRTDMWGRLIRTSGYVATVIYGSTAEVTEASARLRRLHAGMRGVDPRTGESFRIDDPDLLRWVHVAEVESFLTTALRAGVRLTPDEIDAYYTEQLRAAALVGLDPATVPGTAAEVADFYAAIRPELGLTRDGAEAAMLLTVPPIPDSWGNRAVRLGLTLGPTRWAYLSLASTAIGLLPPWARRLYGAPGWPVTDLAAGLSARGLRTLLAGVLAVLPDEYRISPAQRAALQRVG

SEQ ID NO: 11495 - protein, 143 aa, Actinoplanes utahensis
MSTGEELLRTHGLRVTRPRLAVLEVLTGGGHLEVDDIARQVRTRLDSVSTQAVYDVLGALSRAGLARRIEPAGSPARYEARAGDNHHHIVCRGCGAIADVDCAVGERPCLTPSDNHGFSLDEAEVTFWGLCPDCQARRLAETA

SEQ ID NO: 11496 - protein, 157 aa, Actinoplanes utahensis
MFDQVNGLPVHALVLHAAVVFVPLLALGAVVYALAAAWRPRLGWAVAILAVVAPLSTFVAKESGEKLYDRLASHGLKGKGLEILNDHMDYGSMTLWFALGLGVVSLVLVGLTYRGGRRLPLVANAAFAVVILALAVGSGYYIFKTGDSGATAVWGSY

SEQ ID NO: 11497 - protein, 130 aa, Actinoplanes utahensis
MSTSRRVSRHRFGRRPPPAVPSVNVSSPDDDAFWQRPDPGAPSLSGPPQQRPATPAEPDYPGPPRADPPPPHWRPPTIATPPPPRAMPAQDMDAIDEAEGAARTVTYGVGLVAGAIALILMCLLCGRALL

SEQ ID NO: 11498 - protein, 59 aa, Actinoplanes utahensis
MDILDGPERDGDAERVVDFESEEAPLLPDQTRDDTERGWGERDYSNDDRLLDDRPPHWD

SEQ ID NO: 11499 - protein, 168 aa, Actinoplanes utahensis
MGRSRERLDPVRWRAPGRGSLLRLTVITALLATAAAAVLVWSRSPGTSCTTAGPAPAKRSSSPRAPVRPSASPAPQGRPPIPDGTVGVPVRLADPTALALVHPGNRVDLIRLGDRADGTPIASAALVLDVTGADDPASGGLLLALGPAQAQRALTPPGSGFAILIRPG

SEQ ID NO: 11500 - protein, 128 aa, Actinoplanes utahensis
MPAADRSGGAVPTYQYACTECGEQLEAVQSFSDPALTECPNCHGKLRKVFNSVGIVFKGSGFYRNDSRSGSVSAEKSGGSGDTAKDTSTKSESTSTAAAPATTTTSSAPSTSSSTTSSSSGAKAAAAS

SEQ ID NO: 11501 - protein, 204 aa, Actinoplanes utahensis
MSDLAGPAEKSPFDKITLRTQLLTARRSRSAADRAVAATQLHDHILALVRRATPRTIAAYVPSGPEPGGPTLPDLLRAALPPGGRLLLPVLLPDNDLDWAEYTGSLTPASRGLHEPTGPRLGVTALTSADLILVPALAVGRDGIRMGRGGGSYDRALSRLPSPGPLVVALLHDGEILDRVPSEPHDRPVHGVLTPSAGFIACPA

SEQ ID NO: 11502 - protein, 790 aa, Actinoplanes utahensis
MTLRGRLTSAFLVVVLGPVLLGSIFVALTVSAVGRERTNERLDHAVTTVRAAVGAICGQLQAAADAVAVVPAESRSTVADQLIDRGLAGDIRVDDTRPAASGTGDPTGVEGPGGPSATARGAGGPIGLARRSGVAAAPEAAAPPVVIAQDGAGLANPVGWQDCAAPRGGTITALAASARAGEITVVAAQRVDAELLRRLGESAGVTVALKLPETDSRQSDGELPASGDPQAGPTNGSGDPQAGLPAGGSPGAAAGRTGDSGQPGAGTTGTVGEAASRRVEPAAGQPLPLLLSAPVGRSGFRYAVLPLIVLVTAVLAVIAARWLARSTTRPLGELAWAADRVANGDLDTRVPIPRPDELGRLAGTFNRMTRELQSYVQALTASRDQLRRHLAILGDTLSSTHDLDRILPVILRTAMTTTGARAGLVLLVDPADGSLTARCGAGLTGDWDLPPAELVKRRLAPARGVLGVVAASGVALRGASGGPSRAADAADAPSGGASHVAGGVVPDGPVAVVAEEPVCESYLAVPICAPPVGDMLLDEAEAGPGTLGVLALYDRLGSSSFDDADLRTLRTFAGQAGVAVRNVRVHEEAQRLSLTDPLTGLWNYRYLREVLRREVERASRFGRMLTVLALDLDHFKEVNDTYGHPAGDQVLGEFARRIRMGLREVDVAFRQGGEEFVVLLPETDAYGGVIVAERLGALVRDRPVVVDPRRPGQADRIPISVSIGIAVFPEHADTAQGVLDAADEALYAAKNAGRDTYRLAESVSSRTVEGNFAPAPAGSGPQPPRHGSGR

SEQ ID NO: 11503 - protein, 303 aa, Actinoplanes utahensis
MTTNAQGSGKRAVKAVIPAAGLATRFLPATKAVPKELLPVVDRPVLQYIVEEAAAAGITDVLLVTGRGKTSMVDHFDRRPDVEQRLEEKGDTERLAAVRRTSELADIYTCRQGEPLGLGHAVGTAASHVGDNPFAVLLGDEFVEEGSPLLPDMLDLQARTGGIVLAFIEVTPEETSRYGIASVRESDLGEGVVEVTGLVEKPSPEEAPSNLAVVGRYVLPGRIFETIAGTKPGSGGEIQLTDAMATLLAEGTPVHGIVYRGVRYDTGQPLGYLQTVVQLAAQRPDLGAEFRAWLTDFVGGQKG

SEQ ID NO: 11504 - protein, 436 aa, Actinoplanes utahensis
MTATADAEAAANELMPLAEYLGSVLRRLRTLPPLDLDLTQAHGNVLAADVIAPHPFPAFDQAAIDGYAARWEDLAGAGRLGAHPAFGQPEHPARGVRLNVVGDLGAASWRPVRLTAGTCFSVAAGAPLPIGADVVVPVHWTDQGMAAVEILHAPKRGSGVRRAGEELAVGQVLAAAGAYVTPPMVATFAAAGIGHVLVRPSPRVVVVATGDELVDVGRPSQPGQVVDANSHALTAAAVEAGALAYRIGICDDDPEGLRGLLEDQTLRADLIITTGGTGTGPGDMLRRVLSRPGTGRGVVEFTDVALCPGTALGFGTVGGEEVPVVCLPGEPGAALIGFEVLARPAIQLLAGAEPVFRPSVKAHLLETVSSPGGLREFRPAHVAERRGGGYTVQPLAGGPYTLSGLAEANGLLVLGERVTTAAAGSTVDVLLLDRRR

SEQ ID NO: 11505 - protein, 211 aa, Actinoplanes utahensis
MLGATPGWPAVLADGPVLLRPYQRSDARAWSEVRIANQTWLAPWESAPPGPWAEMNSTRAYAYVYRDMRRAARRGDSMPFAVCLLEGGRERLVGHVNLGSIVRRAFASAYAGYWVDHRVAGRGVIPTALALAVDHAFGPGGLHRIEVNIRPENGPSRRVVEKLGFREEAYHQRYMHIDGGWRDHLGYAMTSEEVAAEGGLLSRWKRVRSSK

SEQ ID NO: 11506 - protein, 87 aa, Actinoplanes utahensis
MPTSVLLAVLAAAGLLALAPALVRRYDATERLAAERASSTARVLQRQRRRRTVPGRRPINPGRRVTVTLPAPSGEKPPAPPRRLRLV

SEQ ID NO: 11507 - protein, 41 aa, Actinoplanes utahensis
MGLDREPSDLPVAANGGSVSYRRRGGLRGRPYEAGGRHHTA

SEQ ID NO: 11508 - protein, 201 aa, Actinoplanes utahensis
MGYLATAQEGASGSEAGVPPLFQIAEVRQQLQFHSPVYVGFYLKPPKAGSVGDVDLDDQVAIVIAEHIRKHPPVNVQLPDITEGAPDQGRPPTRRAVPLLFTSEQGLPIHDKAWAKLWTQWRKAAEGPAAGTFHSLRHFFATTLIDQAVEPTEVQKALRHASLKLTLETYVHWWPKQDRRRSVISTMLKRFAETNRKAVGG

SEQ ID NO: 11509 - protein, 169 aa, Actinoplanes utahensis
MNTDEFACGTCGSTHGGPPLSFAAPAPDSWSPDMADTEGCLLDSDLCVISGERFFIRGLIEIPVWDSGDVFTYSMWVSLSHPNFTRAVDVWEQPGRETERPYFGWLANAIPGYDPTTLNLKTMVHTRPVGQPPYIELEPTSHPLAIEQRAGIFRSRVEEIASYHLHNAA

SEQ ID NO: 11510 - protein, 414 aa, Actinoplanes utahensis
MKAPLPDNEIERLAALYSLDILDSPPEKDFDDIVALAAGVCETPVSMVSLVDADRQWAKAKTGPDLTETARDLSFCAHAILGRDLLMVPDASADPRFADIPAVTAPDGIRFYAGAPLMTTDGFALGTLCVMDTEPRRLATEQQQALRALARQVTAQLELRRYAYALANTTARLQELERRKDDLAGLVGGELRSSLRLMSTYLENLGDTGYHDMELADLVGRAAAAHCRGFRELIDHLTQMAEAGLGGDSLHMRQVDLTRVTQRAVEAVRPIAASKHIWILNQAGGPSLPIIADPVRLEQVLTHLLFAAVKYTPEGGRVRVGTEMESGPTVRLDDMDLPDGMRPDLFPHLYYGAIANPADVPGPDRGLAVAKRILDAHHATVALSDRPGDGTSLHVVFPYADLTPDELIRDLAVA

SEQ ID NO: 11511 - protein, 777 aa, Actinoplanes utahensis
MSGTRRRILPRPRVMLGTLLLGLFVAVLVVQAYINSEFTADHKETEVGDQSGVPLAIRGGGPIVNTTGGQESTSRLPDRTIALTFDDGPDPTWTPKVLQVLRDNDAHGTFFVVGSQVARHPELTKHIVDDGNELGLHTFTHPNLQLLAPWRRHLELSQNQVAIAEATGVHTNLARFPYSSKTEAIDEDNWKIVKEAGQSGYLVILNDLDSEDWQRPGIDQIIRNATPLGDTSAIILFHDAGGDRAQTVAALARFIPMMKARGYRFTTVTEGLNLGIEQQAAQVKAGRAAESATVIPTLPENPPAPAGDVWRGAALINTVRLADGLVTVVAALFVVVGALTIGRTALLLLLAGRHARQRRRPGWSWGPPITDPVSVIVPAYNEKEGIEAAVKSLARGDYPEIEVVVVDDGSTDGTADIVERLRIPNVRVIRVPNGGKSNALNTGIALARHDLIVTVDGDTIFEQDSIRRLVQPFADPTVGAVAGNVKVGNRASLVATWQHIEYVIGFNLDRRLYETLGCMPTVPGAIGAFRREALAKVGGVSDETLAEDTDVTMALCRDGWRIVYEEHAKAWTEAPTTLEQLYRQRYRWSYGTMQAMWKHRRALFDNGPSGRFGRVGLPFLALFGVALPMLAPVVDIMLVYGLVFWELQETVIAWLGMLSLQLFTAAIAFRYDREPLKPLWRLPLQQFAYRQLMYLVLIQSATTALTGGRLRWHKLHRAGLTTPSGPPPEPVATTVAPAVESWPPTGPEVPRQQQPNGRAGAPPNGWVGTPPSGRAGT

SEQ ID NO: 11512 - protein, 546 aa, Actinoplanes utahensis
MRHRKSPPHARAPLQSQAAYDRGVTTATAETDLTPADLPAEAEPSRGVPALIKRRLSTLDTRLDPWSWLVTAVITIAAGILRLAGVSNPKGYIFDEVYYPTDAWDMLHHGVEWDEKTNGPAYVVHPPLGKWLIALGEQIFGNKELGWRFTAAIAGTLMILILIRVAYRLFRSTVLAGLAGLLMTLDGFQLVLSRTALLDIFLGLFVLLTFACMVLDRDHYRRRWERALAAGFDPATTHRIPRIVPWWLLAGGVFFGLACGVKWSALFFAPFFAAMVTAWRWQARRSARVRGPFVAGILGDFGYLVLSLILSTVFYLATWTGWFVTDTGYFRHYRQANGLSEPPVLGALLNLMHYHSEAYSFHSGLTEKHVYQSWPWQWLLLGRPVAFYWNGNGNCGASSCAAEILLLGTPILWWSFLPALGALVWLGIARRDWRAYAIFSGAMASLLPWFYFAVKDGRTMFSFYLMPGLPFLILAVVYVLGAIMTPPGGMVSGPARTDRQLVGTVVVATYVVLVALCFAYFYPIFVGKTMPYDDWSVRMWLGNRWI

SEQ ID NO: 11513 - protein, 253 aa, Actinoplanes utahensis
MWWTFPVSHDEAGPGRVVLTGAPLGNIGDASARLREVLATADVIAAEDTRRLARLAKDLGVSVPGRIVSYFEGNDERRTPELIEALAGGATVAVITDGGMPSVSDPGFRLVRAALDAGYPVTAAPGPSAVTTALALSGLPSDRFVFEGFLPRTGANRRSRLRELAAEPRTLVLFEAPHRIAGALADLAATFGADRPGAVCRELTKTYEEIRRGTLAELAAWAEAGDPRGEITLVIGGAPAGPAARPADDELRA

SEQ ID NO: 11514 - protein, 327 aa, Actinoplanes utahensis
MTGNAPQPGKTPAGEPWGAADPPDGWWRGETDREPTSLEWADRAREAGADDATQRLTAPGQGERLATAGELMIVEPGRPGPADDVPEMAILPEPDDRNRPTIVLDQQRPPRGPLPPLPEGGVSPATATRLDRMENSPFWQTDEARIVAEARNDPRPGKRRRPPATHPVGALTALLGLSLLAAFFAWVSAEPFWLAVGHGDPGYATTTHCHGDGLTQHCTGRFASADGRIAVRRVTLLGISGGAREPGAVARARMVNRDSGQAYAGPPGMLLHLRWALGFLLVLICGYGIAGATGARRLESPRARRGALLASVLGPVLLLAGFLAAAY

SEQ ID NO: 11515 - protein, 627 aa, Actinoplanes utahensis
MIGRVGTNRQRGNPFASCLGGSLRLGVMSHVLAAVAWPYANGPRHIGHVSGFGVPSDVFSRYMRMAGHDVLMVSGTDEHGTPIQVQADADGVTPRELADRYNRVIVEDLHGLGLSYDLFTRTTTRNHYAVVQQLFEGLHANGYIVARTTLGAISPSTGRTLPDRYIEGTCPICGYDGARGDQCDNCGNQLDPEQLVNPRSRINGETPKFVETEHFFLDLPAFAEAIGAWLDQRENWRPNVLKFSRNLLDDLQPRAITRDLEWGVPIPLDGWRDRADKRIYVWFDAVIGYLSASIEWARRTGDPQAWRQWWSADAQGKDASGYYFMGKDNIVFHSVIWPALLLGYSGEGDKGGQAGALGKLNLPTEVVSSEYLTMEGKKFSSSRRVVIYVRDFLERYDADALRYFIAAAGPESNDTDFTWAEFVRRNNDELVAGWGNLVNRSISMAAKNFGEIPPALDLTPEDHALLEAARTGFTTVGDLIAKHRQKAAIGEAMKVVAEANKYLSEQAPWKLKADADKPRQGTILHVALQVVSDANTLLTPFLPHSAQKVHELLGGTGVHAPMPEIREVEDLDGGPGYPVLMGDYTVGARWESVPLVAGTPLSAPKPVFRKLEPSVIEEELARLGGDA

SEQ ID NO: 11516 - protein, 344 aa, Actinoplanes utahensis
MTVTGEDSELGADPLDPPLMAPLRRDLTWQQVQSMSQSAVYRDDATLRRIRETAAVRRGTRMTKILSPAQVAGHLGGWLPYGFCYRCCDIAHLTEPEQLNLLRTDGAVDGPVAFGLRWRATDPTDFELPASPAQPGLAALPAHSRVGAMVLGTGFTPSTDDLIPEYVTAGFADLPLPANAQLVAYVPGGDEVVLYTYQPEQHGWLRLAGPRWRGLLDQLPGVSPDREYVPCTASGTAKLVGSIDGTEYEAVADPPGEFRVRALTRAARYPVQTLSRRAEQALWRGVPCWVLQRDETWARLRLLRPDGEALTATGARCYERGVYEAWAPVDELADHHIADLAYQM

SEQ ID NO: 11517 - protein, 320 aa, Actinoplanes utahensis
MNGRLPENATCRMSHMPSSPAPSEKRRHKAARRAGEFPPAPDPLAVPVFDSHTHLDLTIQEAGVPGGPSADPVQALIEAAAKNGVDRLVQVGVDVDSSQWGADLADRHDAVLAAVALHPNEAPRLTDLDEALRRIDDLAARPRVRGIGETGMDTFRTGDDGRAAQETSFRAHIAIAKRHGKALIIHDREAHTDVLRILDDEGAPDTVVMHCFSGDAAFATACVRRGFHLSFAGTITFASAGNLREAAAVTPPELMMVETDAPYLTPAPHRGRPNASYLIPLTVRALAAARGIDTDTLCATISATGDRVFGPWRRPAGPPA

SEQ ID NO: 11518 - protein, 295 aa, Actinoplanes utahensis
MADALLGPAEIRELAARLGVAPTKKLGQNFLHDPNTIRRIVAAAALRPDDVALEVGPGLGSLTLGLAGAVAHVHAVEIDPTLAAALPATVTAAHLTVHPADALKVTGDRFDPAPTMLVANLPYNVAVPVVLHLLAELPTLRGGLVMVQKEVADRLVAGPGSKVYGVPSVKLAWYAEARSAGKVPPAVFWPVPNVDSGLVAFTRREPPAGVPRTDVFTVVDAAFAQRRKTLRAALAGWAGGAATAEQILRRAGINPQARGESLTVGEFAAIAAAAKTSEHGGKLSPSGAQPEEAQA

SEQ ID NO: 11519 - protein, 914 aa, Actinoplanes utahensis
MGSGRRRAAPVQRPGQGPRAGQNQPAPRGRPAATRRLPRAEHRLPRHLAVRRDHRPARRHPHPHHGGRGHRRPRPRRDQPDHPRRPRPGRPRPRPRLRPAAPAQEHPARRRPGRRQRRRRRHPDRLRPALGPRHEPRRARRGRRPTRLRHPLPAARRHRPRHRPRRGGQPHPGPPHHLALDRRHRRRRPGHPRRLPRARHPARRHLATHSARQRRHPDGRPAPAQPGNPRRRPRQRPATGRPRPAPPARRRAQSRHRGRRPRRPRLRLRPHLRLPRRRRHTRPGDRRQPHRSRRLPGRGHRPRTPARRAGNLDPIVANIINLDRVNKGYGAAGQLLTDVSLGLDDDARVGIVGLNGAGKSTLLRMLAKIEEPDSGRVTHRRDLRVAALPQTLTLAADATVRDVVLGTAWLAQGMGAEHEWAGDAGVRTILDGLGMGHLGLDTPVGPMSGGERRRVALAALLVRDSDLLILDEPTNHLDVAGVDWLATHLLTRKGALVVVTHDRWFLDAVCTMTWEVVDEQVHTYEGGYAAWVLARAERQRVAAAVEARRQNLLRKEIAWLRRGPPARTSKPKFRIDAANELIADVPPVRDTVSLQRLATTRLGKQVYDLEQVTLNAGPKPIFKDLTFQVGPGDRIAILGANGAGKTTLLRLLAGVTRPDGGRLVTGSTVRPAFLSQELRELPGHLRLLEAVEEVAKRVKLGDRELSAGQLAEVFGFTDKRIWTPVSDLSGGERRRLQMLRLLATEPNVLLLDEPTNDLDTDTLASLEDLLDSWPGTMIVASHDRYLVERVTDAVYGMFGDGRLVHLPGGIDEYLARVHGTAPATRVPANEPQAATAASGLTASELRQAKKDLARLERQMDKLGEKETRINESLAEHGSDYDRLIELEAQLKAVRQEREQVEQAWLELAEQVPGN

SEQ ID NO: 11520 - protein, 153 aa, Actinoplanes utahensis
MAHIPVNHPLRPMYRLAGFVAGAYLVVFGIIGFAQTAGDNFTGHTGDRVLGQSSNLLWSIISLAVGALVLLGTVVGRNVDVAIDKYLGWGLLVLGSYSLATIRTDANFFGASIATVIVTYLVGLLLITISLYSKTAAPDKAGAPRQVREGRTA

SEQ ID NO: 11521 - protein, 201 aa, Actinoplanes utahensis
MSAAQRREQLIATGRQLFAERGYDATSVEEVAVRAKVSKPVVYEHFGGKEGLYAVVVDREVRALLERITAALTAGDPRELLEQAALALLDYIEEEPHGFQVLSARQAPVLAPANTFASVMNDVAHQVEHILGAEFRSRGLDPRFAELYSQALVGMVALVGQWWREAREPRKELVAAHLVNLAWNGLSHLEPRPSLITRKPC

SEQ ID NO: 11522 - protein, 293 aa, Actinoplanes utahensis
MTTNRFHSEDDRRAEARKLRVDPGLSRSQLMKMFGVGNGTLTAWLQGLESSEWTKRPRAKDNLRELARDLRAQGRTVPEIAAALEVSKSSAYLWTRDMPLDATPEEAAARRSRHSKSVAEKRWGPHRKERDLARDRMRAEVSGWVGDLSEREVILLGSVAYWCEGAKEMPWGPRATSLKFANSDPQLILLFLRYLALMGVSSERVSFRLSIHESADVEGATQWWAKVVGVDAGEFLRPTLKRHNPATVRKNVGDFYRGCLMVSVRKSAQLYWELEGVMEGIALSEDQSEPAIM

SEQ ID NO: 11523 - protein, 480 aa, Actinoplanes utahensis
MSQAPSRTVVVLAAGEGKRMKSATPKVLQPLLGRTLLGHVLAVSAAIRTDRTLVVVGHKADEVGAFLADAAPEATPVLQAEQNGTGHAVRIALAAAPGLTGTVVVLSGDVPLLRPETVEALLATHERAGAAATVLSAEVDLPGGLGRVVRDAKGNLERIVEAKDASPDELAIREINSGIYAFDAVLLREALGKLSTDNAQGEEYLTDVFGILAAEGRPVAVEVAEFAYETLGCNDRAELSRLRVLMRDRVNDAWMRSGVLLLDPATTWIDVTATLEPDAVVDQNCQILGSSSVATGAVVGPDSTLVDSSVAAGATVLRSHVIGAVVGPEATVGPYSYLRPGTRLARKAKVGGFVETKNAELGEGAKVPHLSYVGDAEIGAKANIGAGTIFANYDGVRKSRTVVGEAAFVGSDSVLVAPVEIGPGAYVAAGSAVVKDVPAGSLGVTRAQQRNIEGWVALKRSGTVSAEAAERARDITPGQG

SEQ ID NO: 11524 - protein, 339 aa, Actinoplanes utahensis
MRTHPLSNGSSEPMGSIVAENRKSLMLFTGRGFPELADEIGQVLGVAPTPSDSYEFANGEIFVRFKDSVRGSDAFVVQSVTEGVNRWVMETLIMIDALKRGSAKRITVVLPFYPYSRQDKKHRGREPISARLVADLLKTAGANRILTVDLHTAQIQGFFDGPVDHLFAMDILAEYVEKKFAGRPMTVVAPDSGRVRVAERWTDRLGGCPLAFIHKTRDPLKPNQVVANRVVGEVEGRVCLIVDDMIDTGGTIAKAADILFDEGAADVIVASTHALLSDPATERLKNSRISELVVTNTLPLAPEKRLDKITVLSIAPLLARAIREVFDDGSVTTLFGGLS

SEQ ID NO: 11525 - protein, 203 aa, Actinoplanes utahensis
MSEVKISAEPRTEFGKGGARRTRRAGLVPAVLYGHGEAPQHIALPAREFAAAIRHGGANQVFTIDIAGNSGAVLALPKAIQRDPIKDSYEHIDLLIVKRGEKVQVDVPVTLIGEAAKNTLIVHESNTVAVVAEALHLPSELELSIDGLEAGTQLTAGDVKLPKGVELAVEADTVLAIINAAQSVQTAEEDAADAEAAEAAAAE

SEQ ID NO: 11526 - protein, 203 aa, Actinoplanes utahensis
MCIREAERVTDEAPWLVVGLGNPGREYAGNRHNVGFMVADLLASRLGAKLGRAKRAQAEAGEGRLGFGGPKLVLVKPLTFMNLSGAPVVSLAQFFKVPVAHVIAVHDELDVPFGQVRAKRGGGEGGHNGLRSMSKSLASKDYARVRFGIGRPPGRQDPADYVLADFSSAERKELDFLVDRAADVVEAIVLEGVEWAQNKYHGS

SEQ ID NO: 11527 - protein, 574 aa, Actinoplanes utahensis
MSQDVSESRADALTEPTVDLPTLRADPVNQGPQGPPVRRSGLNTRIPGPVAPLSPPPSGASQNQPPRAVQGAGDPQRNQAMSRHFTTRPNRSSATRPFIRPRGRHAAMSRRQRWEGRYVRNLVLGDLSAGIAAGAAGFGLRFGDQVTAWNEAYLLVSAMLPVVLLAVLAVSRAYERRYLFVGSDEYQRVIRGGGGLIAGVALVSYALDLDLARSYVLAALPAAVVSVLVLRFVLRKRLHWARARGEALRRVIVVGHELSVIGIARQLRRERYHGLEVVGACLPPGADGLEVDLPVYGTFEDVAAAVEQADADTVVVLSCPELDGAAVRRLAWRLERDEVDLVVASALVDVAGARTTIRPFDGLPMLHVEHPRLHGGSRLVKELVDRAGALLLLMLFAPLLLGLALCVRLTSRGPVLFRQVRVGRDGQMFRIFKFRSMYVDAEARLNELRHLNEHDGVLFKMRDDPRVTPIGRWLRRFSLDELPQLLNVLSGRMSLVGPRPPLPTEVAAYADDVRRRLAVKPGMTGLWQVSGRSDLSWEEAVRLDLRYVENWSLSLDLVILLRTMTAVVRSSGAY

SEQ ID NO: 11528 - protein, 280 aa, Actinoplanes utahensis
MGEQIGAEGGTPPVIDAAFARWLADRAGQELLRVRAEVGFHDGKALKTAGDKAAHDLLRAELARWRPADAVLSEEDEHARVAWREGEPDTVRPDRLDASRVWIVDPLDGTREFSEEGRGDWAVHVALWNAGVLAAGAVAMPAQHRTIATDHPPAYPPMPLESATGGAIRIAASRTRPPAFVTALAEELGAELVPMGSAGVKIAAVISGEADAYVHAGGQFEWDSAAPVAVALATGLHASRVDGTPLSYNQADPKLPDLVVCRKDLAPRLLTAISRHLPSQ

SEQ ID NO: 11529 - protein, 303 aa, Actinoplanes utahensis
MSQTKDYRVSHLDALEAESIFVMREVMAEFERPVLLFSGGKDSIVMLRLAEKAFAPGRVPFPVMHVDTGHNFPEVLEYRDRRVAALGLNLVVASVQEAIDTGLVRELPDGTRNRIQTPVLLAAVEKYRFDALFGGARRDEEKARAKERMFSFRDEFGQWDPKNQRPELWALYNGKHHPGESIRVFPLSNWTELDVWHYIAKEHIELPSIYYAHDREVVERGGMFYAVNEFIQVRDGETAEVRRVRYRTVGDASQTAAVLSDADTVEKVIDEVAATRITERGATRGDDKVSEAAMEDRKREGYF

SEQ ID NO: 11530 - protein, 432 aa, Actinoplanes utahensis
MSQSVLEPDAASARNMDLLRFATAGSVDDGKSTLIGRLLYDTKTIFADQLEAVEAASASRGDEYTNLALLTDGLRAEREQGITIDVAYRYFATPRRKFIIADTPGHIQYTRNMVTGASTADLALILVDARKGLVEQSRRHAFLTSLLRVPHLVLCVNKMDLVDWDQEVFERIADEFTAFAAKLDAPDLTIIPISALNGDNIASRSENTPWYEGPSLLHHLEHVHIASDRNLVDVRFPVQYVIRPQSTTVTDYRGYAGQVASGVLKPGDEVMVLPSGLTSTIAGIDTADGPVDQAFPPMSVTVRLTDEIDISRGDMICRPHNAPAVAQDIEAMVCWMDESAPLRVGGKYTIKHTTRTARTVVRGLQYRLDVNTLHRDDCADGLRLNEIGRVKLRTTVPLLADEYRRNRTTGGFILIDEATNRTVAAGMIIEAA

SEQ ID NO: 11531 - protein, 271 aa, Actinoplanes utahensis
MGVYPPYLDDDCAPAVSVRVDFSADAAVSLLTVRGSWGDDLRRSTSASLLRCFTEHPDALIVDLSGLRDPRSESVPTWTTARTVAATLRPPMHLALCVPPDLPLADRMQGLGAGRMRSVPGGRLLPVYARVGQARVAVAGRLPDGERMAVTLAPDADAPSAARNLAGDACLAWGLPRLPHPSRLVMSELVTNAVEHAGTPIRVVVTRRGDGLHLAVADGSSAMPRLLRPTRPRAGQPLDERGRGLRTVHGTAAVWGAVPAAPGKVVWAIVR

SEQ ID NO: 11532 - protein, 80 aa, Actinoplanes utahensis
MTTEQHSPADDAPEDVRGSETAENEPNEYGFSGDPALPESHEVAHLAEGEGERIAVPSGDLTGAITDAIEEASEGHGHQQ

SEQ ID NO: 11533 - protein, 324 aa, Actinoplanes utahensis
MKLLVTGGAGYVGSVTSRLLLDAGHEVVVLDNLATGFREAIAPDATFVEADIADAGSVLTPDAGFDAVLHFAGLIAAGESMVKPELYWHENVVKSLALLDAIRAAAVPRVIFSSTAAVYGNPVELPITEAAVKAPTSTYGSTKLTFDLALTAEAFAHRLAVVSLRYFNVAGAYITDGHEIGERHDPETHLIPITLQVAAGKRDRLQLFGDDYPTADGTCVRDYIHVEDLARAHLLALDAATPGEHRIYNLGNGNGFSNRQVVEAAREVTGAAIPVETAPRRDGDPATLVASADLARAELGWVPRKDTLQAMIGDAWTFYRKHVA

SEQ ID NO: 11534 - protein, 355 aa, Actinoplanes utahensis
MVRGIPSETDTMSLMSDAVRRPRVLSGIQPTADSFHLGNYLGAVRNWVALQETHDAFYCVVDLHAITMGHDPVALRNRTRISAAQLLAVGLDPERCTLFVQSHVPEHAQLAWVLSCITGFGEAGRMVQFKDKSTKAGQDSTTVGLFTYPILQAADILLYQADQVPVGEDQRQHLELTRDLAQRFNSRFGATFTTPAAYIVKDTAKITDLQDPSIKMSKSASSPNGIIELLEDPARSAKKIKSAVTDTGREILYDEVNKPGISNLLTMYAALTARTIDDLLEQYEGHGYGDLKKDLAEVLVEFVKPIQERTKLYLDDKAQLDKVLAVGAEKARAVAAATLASTYRNIGFLSPARGV

SEQ ID NO: 11535 - protein, 176 aa, Actinoplanes utahensis
MGDPARTRIGVAIDIPEPWGSALTRRRAEAGDPQAAWTPAHVTLLGPTEVDTDALPSIEKHLEAVAAAQPPFTIHLRGTGTFRPVTEVVFVSLAMGISECELLAEAITGSAEINRGSRFPYHPHVTVAQDVSPEALDAVFDDLAGFSARFPVASFTLFSHGGEGPWRPRRDFPLGG

SEQ ID NO: 11536 - protein, 306 aa, Actinoplanes utahensis
MNPIDRAYDAVAARIMAGRYRSRYFDHLCRALLRYDGVQGGRLAAASAYYGFFAVFALLLIGYSIFGFLLTSNTQLFAVVHDFLRQNLPFLDVQAILESKNTVGIVGIAGLTFTGIGWVEAIRSSQRHIWQVREQPGYFGVRQALDLMVLVGILILLALTQLAVYGLETLLDYLADGGFQVTLSVVSLVLTLGVNMLLAAALLGAVPRLRMTARRMAPPVLQVGIGLMLLNTVGKSFVATVQRNPAYGLVGSAVGALVYLYVFHQLLLFGAAWAATSPHGRVVDLSADDKTAPVGQNLWIRDARPR

SEQ ID NO: 11537 - protein, 132 aa, Actinoplanes utahensis
MMCRVGTLVTLRLPPGSPLAAVPWVVTIASLGDREDWDPVVCGPYERDHAVALARAVVSDDDLMAVVEPMLPLDSADAIRKEIEAVRQAAEDDSEPIDELLAEPAGSGPPPITPEPDEVRAGWRRLATRLTA

SEQ ID NO: 11538 - protein, 65 aa, Actinoplanes utahensis
MIWPRFGLAIYRDERSFAHGSPTAFLWVHAVLIAASLVIGSTVGVLGVRAWNAVRRPEKAAVTEK

SEQ ID NO: 11539 - protein, 356 aa, Actinoplanes utahensis
MAILAAGGLTLAAAACGKAPESSPSSGGSASAAAAAYKACMVTDTGGIDDKSFNASAWAGIQAAKADASNVDPKYVSSSSEADYEPNLRNFASQKCDYILAVGGLMGPATKKVSGESASSQFAIVDSNSSGPNVYPMQFATQQAAFLAGYLAAGYSKSGKVATFGGLKIPPVTIFMDGFAEGVAYYNQKKGKTVQVLGWDTAKQNGTFADSFIDQNKGKTISQTLVSQGADVILPVAGGTGLGAAQVAKDSGGKISVIWVDQDGCKSAAQYCDVFLSTVVKNVQEAVKESVVKGAKGEKLSATPGYIGTLENDGVSLAPYNKFDSKVDAALKGEIDQLKKDIIAGTVKAESASAPK

SEQ ID NO: 11540 - protein, 523 aa, Actinoplanes utahensis
MDRPPGSVHDVGESPLKLELRGITKRFGDLVANDHIDITVEPGEVHALLGENGAGKSTLMNQLYGLLQPDEGQILVNDEPRVFRSPRDAIAAGIGMVHQHFMLVPVFTVAENIALGAEETRGGPLGWLDRRRARRDVLETSKKFGLPVDPDALVEDLPVGAQQRVEIVKALTRDVDLLILDEPTAVLTPQETDELLAVMRSLTEMGKSIVFITHKLKEVKKIADRITVIRRGQVVGTASPDTSEDELAALMVGRAVSLEVDKQPAEPGRPVLQVSGLVVDDDRGIRAVDGVDLEVRAGEVLGIAGVQGNGQTELVEAIMGLREVRAGRVELDDEDLAGLSTKRILRSGVGYVPEDRSHDGVVKEFSVAENLILDIYDREPFGNAFRLDLAKIGGNARERVAQFDIRCQSPETAVGTLSGGNQQKVVIAREMSRPLKLFIASQPTRGVDVGSIEFIHGQIIHERDQGTAVLVVSSELDEVVGLADRIAVMYRGRILAVVSPDTPREEIGLLMAGITSGSAEEKK

SEQ ID NO: 11541 - protein, 410 aa, Actinoplanes utahensis
MTAPTTTEKPVAKQESFTSAFLRNLWSSNSVTVTVLSIVLAVIIGAVLIVISDSDVLAKFGYFTARPSDALDAGWTLISSAYSDLLKGALGDPDAFQAWFSGTGTWQNALSPISETLTYAAPLVFTGLSVSLAFRGGLFNIGAQGQAVLGCIAAGVAGFTFGLPIVLNLIVALVVGVLGGALWGFLPGLLKARTGAHEVITTIMLNYTAGLLLAWLVIQKGVQQPGRSDAISKVVAESAQLPSFGGVLRVHLGIVLAVLVTAGVAWLLNRSAFGFELRAVGANPHAAQTAGISVAKTYALLMAVAGGLAGLGGATQVLGTAYALTPSVAGNIGFDGLLVALLGRNRPWGTLLAALLFGALRAGGNRMQSFTGISLELVTVLQALIVIFIAAPALVKAIFQLRAARTTAKG

SEQ ID NO: 11542 - protein, 422 aa, Actinoplanes utahensis
MSTTTVEEPAEVTAPEPFWTRHRRFGVALILLGALAAGLFGALAPSKAARFTLTQDAGGAALSINGQVGAVLFGVLTLVAGGLLAAGLLRRWANAFLVIGIVTFVLSFLCWQVAGQFMSLQDTLGGTLDLALPLILGALAGVLGERSGVVNVAIEGQFLMGAFAGALVGTMAGSVWAGLISAAVGGVVIAAILAVLSIRYLVDQTVVGIVLNLFALGITGFLYERLMQPDAAKYNSPPQMPTWRIPGLADIPVLGPVVFDATLLLWVALILVAVIHFALNRTRWGLRTRAVGEHPTAADTVGIRVRGLRYLNVLLGGVVAGLGGAYFTLVATGSFTKNMTAGAGFIALAALIFGRYTPIGAFGAALFFGFAQKLAFYLSAINSPVPNQFLSMLPYLATIIAVAGLVGRVRAPAADGIPYVKS

SEQ ID NO: 11543 - protein, 237 aa, Actinoplanes utahensis
MEIDWAALRAAAIEVMRRAYVPASDFPVGVAGLVDDGRVIVGCNVENASLGMTLCAECGLVSALHASGGGRLVAMSCVDATGAPLMPCGRCRQLLWEHGGPDMLIEALPRPLRMDELLPHAFGWVDMAKVTGPAGGPEVPAELAKWRGRGTVFVHPDLSGGATIWTAYWERSSGAPGTGEEKGILEEGPNFPAASAAVAWGLVRSPRVVVVDAEGGLSWAGEGELPDGIPQRWKDEA

SEQ ID NO: 11544 - protein, 425 aa, Actinoplanes utahensis
MSGITAVDVIRAKRDGRALSDAQIDWVVDAYTRGVVADEQMSALAMAILLRGMTAAEIARWTAAMIASGERLDLSPVSRPTADKHSTGGVGDKITLPLTPLVAACGVAVPQLSGRGLGHTGGTLDKLESIPGWRARLGNDEFIGQLRDIGAVICAAGEGLAPADRKLYALRDVTGTVEAIPLIASSIMSKKIAEGTGALVLDVKVGSGAFMKDLASAQELARTMVQLGKDSGVTTVALLTDMSTPLGLAVGNANEVAESVEVLAGGGPSDVVELTLALAREMLSAAGVDADPEKMLASGAAMDSWRAMIRAQGGDPDAPLPGPRHTEVLRAAADGVVTTMDAYGIGVAAWRLGAGRARKEDPVSFGAGVQLKVKPGDRVKAGDVLLELRTDDEGRIPAARADAQAAIMIGTDAPASAGLLLDRIA

SEQ ID NO: 11545 - protein, 226 aa, Actinoplanes utahensis
MTKAAPDPRAVREASLDELARLDLPLPPPSFPLVWELGDTIELRPVAELEARAAVLHVVVARCFGMPTEAAMSWLLSSHLVDLVTPPEWQFVIGAKGDHRSFVLHHDAVFALAWLLGLGRHLDPTVPPDDNLMSQMPDLPAGEPFGRWRSRSLVAVRDAAEAAVLLDLYYCLDWAFQEAEQAGLPLPGEVDSNAIGQRRWALEWAVIFHGPYHDKPPGWEEVDLSV

SEQ ID NO: 11546 - protein, 282 aa, Actinoplanes utahensis
MIDGALPYLTCPVCRGTLARHDRALRCPLGHSFDMARQGYVDLSAGRLPHTGDSAEMIADRAGFLAAGHYRFIAEALAATTADHRDIHDQDQLGVRREPLILDAGTGTGDYLAHVLDACPTTLGVGLDVSKPALRRAARAHPRAAAVLADLWRPLPVADAAATVILNVFAPRNGSEFHRVLRPDGRLLVVTPAADHLRELVDEHGLLRVDPDKAARVSGSLDDHFRPVGATTHRHTMRLDAAAARTLIGMTPSARHVPVESLPTRDVTVTAAVVLTTYTRKP

SEQ ID NO: 11547 - protein, 373 aa, Actinoplanes utahensis
MAGIAYPEIVKAPKVLLHDHLDGGLRPATIVELAAVAGHELPETDPDRLGEWFAAAADSGSLERYLETFAHTVAVMQTVEGLHRVARECALDLAADGVVYAEVRYAPEQHLERGLSLDEVVEAVDAGFRDGCAEAAAQGTPIRIGTLLTAMRHAARSQEIAELAVRYRDAGVVGFDIAGAEAGFPPTRHLDAFEYLQRENFHFTIHAGEAFGLPSIWEAIQWCGADRLGHGVRLIDDITATVAGPSSVTPTGGTHAAPPVLGRLAAYVRDKRIPLELCPSSNVQTGAAESIATHPIKLLHDLRFRVTVNTDNRLMSGTSMSREMSLLAEAFGWGWAEMQWLTINAMKSAFIPYDERLALINEVIKPAYAKLLG

SEQ ID NO: 11548 - protein, 1191 aa, Actinoplanes utahensis
MPGPNQEDGDVSKRPSEADGVMSRLRRPTGRLRDLPIWSKLGLIMLVPTVATIIVGVNGLVEHIDQADTADNTRTLATLAQAAGGLVDQLQDERAYAMQVVLAPKSPKGNEVLTAATKKFNDEHAKVEAAKDPYAQQRAALDTQPDRVNLLLSRLDHNLADLAAYRSKVTNNTETELSVQGTYNALITDLLAVRDVAAQQATDTGLSDHLRAVAEVARVKEFVSQQRFIGLQVIAGGKFSTALRQAFLTANTGIDLAERNLKAAATDGENEVFLKTTDQNEAQRAATNLTEPLQATPGTDISNLHLTAAGWDSAMAGYDDTFRQVEQQLDKNIVNQATDLRNTTNRTVFVETSVLLGMLLLAILFAWLVARSMARSLRELRQGALAVAQFGLPHAVSRLRDPALSTSLTPAQVADQIAEPLPVRSRDEFGQVTEAFNAVHLEAVRTAAEQAALRASVATMFVNLARRSQILVDRLIGHLDRLERGEEDPDRLAELFQLDHLATRMRRNDENLLVLAGADSTRVQREPAALIDVLRAAQSEVEHYTRIEFGVIDREIEVAAHAVNDMVHLVAELFDNATAFSPPNSNVLVEARRVGETAVLTVEDHGIGISREQLRDLNERLANPPTVDVAVSRMMGLVVVARLANRHSVRVELRPADRERGTVAEVGLPVTVLAAAVSGRMGGYDAPPAAMPSFGEPLALESGRGGYPGVNGSANGSTNGGVPAWSDLTGAAPSNGFGGTNGFNGGPTGFGSANGFGATPSGFSPPANGFGGQNGSGPNGFGGQNGFGGAPNGFGPRSNEPMPPLPSGPTSSGPQGFAGLDELVQRRNGNDYQRPDGETGGFGATIPRQLPANPESQGRSSFMPPVSAPPVPSAPPVTSAPPVPSAPPVSAAPISAEPTSFASAPPAWPPVAGDRETATPHVPENLAAALDMTAEIPRYRPDTAEQRPEVARPIDPPLASLPASAPPAYEAIAPVSGPAADQATAAAQISSAREGAVPFADETMELPIFRELESAWFTTTQATAAKPSVAGTGEEAVISQRIPTGEPTTRTAGVPQQAASPEARELDTASVGAAPAAPAAVAAGSYAGTPSNPWQTAADEGWQAARKASEVSIDTTTTAGLPKRTPMAQLVPGGVDRGGNSVQRRTPEGVRGLLSAYHRGVQRGRTKEQSTNLEETPGGQQPSQAGKEHEA

SEQ ID NO: 11549 - protein, 134 aa, Actinoplanes utahensis
MTSTQDLGWLLANFADRVPGVAHAIAVSADGLLLAASRDLPRDRADQLAAIASGLVSLTQGAARCFEGGAVLQTVVEMDNGFLFLMSISDGSSFAVLAARSCDVGQVGYEMALLVDRVGEALTPAPRSAAGVLG

SEQ ID NO: 11550 - protein, 126 aa, Actinoplanes utahensis
MPERDEPTGSLVRPYAVTRGRTRPKLEIALEALVETTVRGRSGMIRSGQGGSEHQYIAAMCDNGRVQSLAEIAARMQLPLGVARVIVADMASDGLLAVYEPTSLEDETDAVGTELLERVLSGLRRL

SEQ ID NO: 11551 - protein, 203 aa, Actinoplanes utahensis
MDFAGSDMSQRPAAGGRVTSAKIVIAGGFGVGKTTLVGSVSEITPLTTEAIMTSAGVGVDDNRQVPGKMTTTVAMDFGRISIDRDLILYLFGTPGQTRFWFMWDELVRGAIGAVVMVDTRRLADCFAAIDFFEHRRLPYLVAINCFDGMQYHNPQDVRDALAISSDVPVVSCDARNRESTKNVLISLVEYVLTMRRTRAVAPA

SEQ ID NO: 11552 - protein, 392 aa, Actinoplanes utahensis
MPGSRTPGLASTSGLAGTSGLSGTSSLSGTSGGLSPAARSPLSPAPSSAPLSPAARNPVSPAARNPVSPGGTPTPAEAGEPFRPTLTNAELNRARAERQRTVIPARPSTRSAAPSPATNGAAAGPTDFALPMPAQRPGAESAEPGSRANWPLLNNGGDDAALPAASVSGAGADGRIRPPWQDMPKEPPALRLVESQLNGGGRAKLPGLDQLGDPPSLRVVDGGARGVDSLPPKVTALDRSSTPPVPSDGSDGDLLIFAAARSAWFTGGTSTGDSGNVDWANPNDSGWRAAEKAATPAVAAETSAGLPKRVPQANLVPGATVRDERPLRIVRDAASIAAHTTGYFRGWRRGQEIGGFAMGGRPGREAAGGWDFTRDREGADEYRNGAGYGGGR

SEQ ID NO: 11553 - protein, 301 aa, Actinoplanes utahensis
MALVRVYCGLASADDAVRSATAAPLTIAVVDDAGRLLGVHEISDDPAGYALLGTLLVERTTGFSDAAVAADSDDHVVTSLLTAAGRPLVVVDDDDADDFAERFSDDDSPEEINAPAAARRAVGLARALQAGAIAAVTLPAPRELVSYKPVLAAHVAMLVGRNAAAAALREVLRELYPAALRAYPDPAHPIAMAVLEAIPEPGRLTGRGGDPEHAAQEVAAELTRAGVGSEDQIFSFITALQVAISESPRRGGVNKSLAPAAAEAVRHAIAAVRTCDAGCAALVGTLAARSGGPAAEPNVAS

SEQ ID NO: 11554 - protein, 288 aa, Actinoplanes utahensis
MTSQSDEPEASAPVAEKSQAEGLNGRELWDEVRVEPVEIALPGGVGLTLRAYRSVSELTPTEIEAEEEDPFDTRKRAALDEDGEEGVIVDEEYEALLAEGDDEDETASDEKAESDDEAAEASTQPDDEEVPMFLSHKGRLLAFKNAESLVSFIRSGAPHDLAQLDTWGALAERVQSSDIDPLPEERYELDLVVENLRGGHDTWDLPLLIAAGEVARDLGYALRLKPVILALSPGSPLDDLDESLRTAQNGGMGGFFGRRRLKKIGAQQASLGWRSVIGKISAAVDWRD

SEQ ID NO: 11555 - protein, 279 aa, Actinoplanes utahensis
MPKSAKLVEPAATPRLTVRKTYKLYIGGKFPRSESGRTFVADGDNVALASRKDARDAVVAARAAQPGWAGATAYNRGQILYRIAEMVEARRAEFTGLGVPAAEVDAAIDRWIWYAGWSDKIAQVAGGANPVAGPFFNISAPEPTGVVAVVAPAGLLGLVSVLAPAIVTGNTTVVLAADPQIAITLAEVLATSDVPGGVVNILTGAYAETAPWLAAHADVNAVDLTGAAPSVAAELERTAAGTLKRVIRPAEQPDFLADPGLKPMTSLLETKTVWHPKGY

SEQ ID NO: 11556 - protein, 472 aa, Actinoplanes utahensis
MFAYAPAPESRSIVSLEPSYGLFIDGEFQGSGSVFKTVNPATEEVLAEVAMAGPEDVNRAVAAARRAFTGWSALPGAERAKYLFRIARIIQERSRELAVLESLDNGKPIREARDVDLPLVAAHFFYYAGWADKLPYAGFGADPRPLGVAAQVVPWNFPLLMLAWKVAPALATGNTVVLKPAETTPLSALFFADVCRQAELPPGVVNIVTGAGDTGAYLVAHPDVDKVAFTGSTEVGREIARTVAGTGKRLTLELGGKAANIVFDDAPIDQAVEGIVNGIFFNQGHVCCAGSRLLVQESIFEELLESLKRRMGTLRVGDPLDKNTDIGAINSAAQLARISELSEIGAQEGAARWSPACDLPDRGFWFPPTIFTGVTQAHRIAREEIFGPVLSVLTFRTPAEAVEKANNTPYGLSAGIWSEKGSRILAVADKLRAGVVWANTFNKFDPASPFGGYKESGYGREGGRHGLEAYLA

SEQ ID NO: 11557 - protein, 337 aa, Actinoplanes utahensis
MIYDKDVHGDQPTVHSRSTDLGSHRISLMTATASIGLSDLRALLHGLPGVDKVGVEARAAALGTRSVKTSSKARAIDLAIRMVDLTTLEGADTPGKVRALCAKGRRPDPADPSCPAVGAICVYPAMVPVAAEALAGSGVHLASVATAFPSGQAPLEVKLADTRAAVAAGADEIDMVISRGAFLAGDYTRVFDEIVAVKEACGGAHLKVILETGELATYDNVRRASWLAMLAGADFIKTSTGKVSVNATLPITLVMLEAVRDFRARHGRQVGVKPAGGIKNTKDAIKYLVLINETVGDDWLSPDWFRFGASSLLNDLLMQRTKLATGHYSGPDYFTLD

SEQ ID NO: 11558 - protein, 210 aa, Actinoplanes utahensis
MDVLVVDHPLAQTRLTAMRRSETESGVFRASLHELTTMVVYEAARLFAVEKFPIQTPVAATEGTRLANPPLIVPVLRAGLGMADAALALLPESSMGFVGLARDEETHEPRAYMESLPADLAGQPVLVLDPMLATGGSLLHCCRLLADRGCTDIIICCVLAAPEGVDRLAASDLPLRLVTASIDQGLNEKAYIVPGLGDAGDRQFGGMRRF

SEQ ID NO: 11559 - protein, 189 aa, Actinoplanes utahensis
MVQHSPLLPISQRGAREAGRAVLRCPVMRSILATLGYVLSPGGDRILMIRRDTRPDDLHYGYYNGLGGKLHPDEDVVAGMRREIAEEAGLECHRVDLAGTVSWPGFGRDGENWFGFLFRIPEWSGTPLTGNPEGSLHWMAVADVLAGRVPMWESDRHFLPLVFAEQPRVFHGVMPFAGGKAQSWGYTTG

SEQ ID NO: 11560 - protein, 369 aa, Actinoplanes utahensis
MTGSQPAIPAARPVIGEEEIEAAVRVMRSGMVIQGPEVAGFEREFGELVEGRHCVAVNSGTSALQLSLLALDLKPGDEVIVPSFSFAASANAVRLAGATPVFADIDPVTFCIDPDAVAAAITPRTVAIMPVHLYGHPAAMDRIMPLAEAHGLQVIEDAAQAHAAGLNGTPAGAFGLAGCFSFYPTKNMHSLEGGMITTADAEFARKLRLLRNQGMEQRYQNEIVGANMRLTDVAAAIGRVQLGKLGGWTRKRQENAAYLSANLTGVTVPAVGEGVEHVFHQYTIRFAGDRDAFQAALTERGIGNAVYYPIPIHRLRPYLTEDGQVGPWKLPETEKAAAEVVSLPVFPSLTQEDLDRIVVAVNEAAAVAA

SEQ ID NO: 11561 - protein, 333 aa, Actinoplanes utahensis
MSGLRAVLIGLGAMGRNHARVLSLLDGVDLVGILDPAPGATGPHGVPVVAELDELLALKPDYAVVACPTGLHEEIGLRLAADGVHALIEKPLAPSVEAAERLVAAFEAKGLVGAVGHIERYNPALQSLRTRLEAGELGDIYQIVTRRQGPFPGRIADVGVVMDLATHDIDLTAWVTGKPYEQVAAQTVSRSGRPHEDMVSVVAGLSGGVVANHLVNWLSPFKERSTVITGERGSFVADTLTADLTFYANGAFGTEWEALRAFRGVAEGDMVRYAIPKREPLLVEHERFRDAVEGKQSDIVSLRQGMRTVQVAAAVLKSAREGITVPVLPAQGE

SEQ ID NO: 11562 - protein, 446 aa, Actinoplanes utahensis
MTGKFSESRPPRVLYLSFYFPPSRASGVFRARATANHLAQAGWDVTVLTAPREFFEYHLEGAADPALEATVDPRIHVERPPMNTYNYEHDVRRFSTFRRMFPSVASRLYQESQKRIFGEHYIGWVPGVMRTAVARHRKARFDLVLATGNPFVSFAAAHYLGKLFRIPYVVDFRDAWTFNQFTEEIRFPEGGLMMNWEERVLRDAGEIVFVNDGMRRWYQDRYKFAADRMEVVPNGWEPELLGRPDYRPSDPNRPLHFSYLGTVTPYLPLEVLVNGWKLARQHPLLADANLDIHGHLGFFPHEAAAIRPRLGESPDTGVVYRGAFSKTEAAEVYAKTDGLVFCVPGAKFVTSGKVFEYMATGKPIVSVHEPDIAAADVLTGYPLWFHGRKLDADNVAQSFIAAAKAARDLDRPTFETALQHADRYTREATLTPWEHRLRALAEGGRR

SEQ ID NO: 11563 - protein, 690 aa, Actinoplanes utahensis
MSDGHRSVVYVALGEFRIRAAVTLTAEYAAAGAKVTLFAGRIPEWKDVKAPAGVTLKRVGDKAWPEIREALAGADLLIAGDPPAMPIVDLARKEFPRLTVRTDPQGDPERRPAPADLAIVTPWYPSPNDTFAGSFVKAAAETVQGQVGRVSILATDHWFYPPWRMVGNMIDITMQRELKRFGGVTVQDTPEGELTRVIAPQPRKQPYATWANEQIRRLRAALPTGRIEAPLVHAHSGHFGGVMAAALARPDARIIVTEHATFLRQVFAQPKARQQYLDMLARAETLLCVSSSLRDQVAEEFPYYAHKLRVVPNPVDFEHFAVRPGMPEAPRRWVYAGRMVEHKGVMTLVDGFALIAAEDPSVTLTLVGEGKLEDDLRKRITELKLTDRIQLRPAVPPEQMVALLHEHDLLVHASQLETFGMTMVEAVATGTPVLVAASQGPAETLEGLDGIAGRLFPVTKKPEVLAEAWRELRDEWSKLDLPRARAELHARYGFEAVGEQLLDIYRNPAPAEAAAPVPVPAEDPAERIIVVAVLPSRPARTRDFVKRARAKGYGVDLIVPDPAKWAREAEDPGIVVHGIGTEEDPPGVVIRPAPMTGSAAALALTRTVQGKARTLRTKVAAKVGKPTAAVFRPHTKWLATRSILPAIDFTRVKRVVVNGVQGERIGWQIARRHPGLEVTTALRLPGDKHG

SEQ ID NO: 11564 - protein, 553 aa, Actinoplanes utahensis
MTEVLKSAVTSAKRFTKKAGNRVVGKALSMPRGRQAGQALLTAPGLSDRQRRALGRRIAGKLSTLGLPAEAAATRLRVAKLLREPRSRAEWMMAAAKDELDAGRIPDFLTEAVTAELAVADQLLLRKDFDAATRSVFQVLQLLFHRAVHFDGMTSPMAPQPAEFLAPLHLSLVGRTMATAHGRLTPAVPPPAGRPHRILFVTRGNENFLGEIRDRYAASPDHEVRTLSLLADEEKAKLVRIPFMIKHLLGGDPAYGEKIREWIQPDLEWADTVFVEWSVAQAALVSMVDPGTTRIIVRLHLFEAFTMFPHLIDYSRIDDYVFVSDPLLDYTRDVAPRITEPGGPRLHVLTNAARLDRFARPKTPEARFTLAQIGQSRIAKDPRWTFAILRELRRHDDRYNLLLVGADLDGSPSPQAAAYHREYVRELAEFEAQGAVRRLGQTDDVAGALTGIGVILSASVRESFHLGVIEGAASGAVPVVRDWPFFAGRAHSARSIFPADWMVETVDEAVQRILAHTATEEIWQETGAAATRHALSTWDWSVVQQQYDRLFDN

SEQ ID NO: 11565 - protein, 512 aa, Actinoplanes utahensis
MGSDEARRIVMLVDNGVNGDSRVQKEARSAAEAGWDVTLLGRSPDDKEHTWMLGPAQVRLVPVPFHLDKRPHEFRRRWVMAPLAYPQNGVAEQRGQWVKAWRANLTMDRLVSPGGAREISRKVQWQASRVVNKWVSVRQRQTKKAARARKTLDTPSDKLYTWFWSTVQGPRAWRRLEPQLWDWELAFGPVLDRVKPDLIHANDFRMLGVGARAKIRAKTRGRDVKLVWDAHEFLPGVRPWTNHARWRTAQMLHEAEYVPYVDAAMTVSDDLAGMLQEAHRLPERPAVVLNTPAAEHAPADAAGTPLPDLRELCGIGPDTPLIVYSGAASIQRGLAVMVEGLARQPGVHLALVTNNHSSGYMGGLRKRATALGISDRVHFLPYVPHWQVVPFLAAATVGVIPIFHFPNHEIALITKFFEYSHARLPLVVSDVRTMASTVRATGQGEVFTSTGTPETQAPPADVDAYVQAVQKVLDDPERYRAAYDKPGLLDGWTWDAQARVMNDVYRRLLPEA

SEQ ID NO: 11566 - protein, 163 aa, Actinoplanes utahensis
MLIKELPALAGGGPAVFYTGGSEELFAALFPFEKPERADPPAALTVVFAGPASPFPGVPALPPGGRLLLLLGWPIAELPYHLLLDPLVAAGCQVLQAVPVDRAHRHGVHCAVVAARVDRLAPLRSYLDDSPITLDGESPGLPALLRLTGEYTFTDLVSRTQRS

SEQ ID NO: 11567 - protein, 213 aa, Actinoplanes utahensis
MTLLSGSEASAYWDDRHERESDLRSGGHMAFDEATNRMFYMRRLALLMDLIGLQSSPVAPLFLLDAGCGKGWFSRELVRFGHRVDAIDGSLTALQHAEAEGGGPRFHRSSLSGWRNPWLYDVVFSIDVLFHILDEDEWERSVRNLASLVRLGGRLVLSDWDAGHDQAFGNYQVLRGPGRYRPLLEGLGLRYDGWQPYDFRASVIGFHAFTRVG

SEQ ID NO: 11568 - protein, 427 aa, Actinoplanes utahensis
MKICVVALGKIGLPLAVQFASKGHTVIGADVSEPTVRKVNAGEVPFPGEADLDVKLKEAVSAGLLTATTDTAAAVAESEAVVVVVPLFVDADGKPDFGWMESATRDIARGLRPGTLVSYETTLPVGTTRNRWAPLLQEGSGLVAGEDFHLVFSPERVLTGRVFADLRKYPKLVGGVNEASAAHGVTFYEAVLDFDERADLPRGNGVWDLGNAEAAELAKLAETTYRDVNIGLANQFARYADTLGIDVNLVIDACNTQPYSHIHRPGIAVGGHCIPVYPRLYLWNDPTATVVRAAREANAAMPSYAVDLLAAAVGDLAGRSVLVLGAAYRGGVKETAFSGVFPTVEELKRRGATAYVSDPMYTAEELEAHGLPAWGGEAVDSAIVQADHAEYRTLGPAELPGVEVVVDGRRVTDPERLGSIRRVVIGG

SEQ ID NO: 11569 - protein, 174 aa, Actinoplanes utahensis
MNTNTNEPFIHPSADVEDGARIGAGTKVWHIAHIRSSATVGDDTVIGRNVYLDANAVVGSRVKIQNNVSVYQGVTIEDEVFVGPCVVFTNDLRPRAQNPDWTITPTLIRRGASIGANATLVCGIEVGEFAMIAAGSVVTKDVAPYQLVRGNPARPAGWVDEKGEIVSRDPERRP

SEQ ID NO: 11570 - protein, 227 aa, Actinoplanes utahensis
MTSIPLAEELLLLAYDDQTGKATGSRIGLDLGMAAAVLIDLALAGRVAYVDGYLQVKDETPTGDTIADAVLTKVAGDPPHTPAQWLQRLRHRLRTRVLEDLCARGVVKDVDETQLDYIHVHRYPTTDPAFEAEIRGRLAEALTSDKTPSERTAALCTLLCAARMEPALKLPADQAEQAHRRLEEISAGAGFAAGANLEDSIVRPSVALVVATLGKAISAALGAPKAV

SEQ ID NO: 11571 - protein, 542 aa, Actinoplanes utahensis
MAPEVDIELRAAAEAWLADDPDPSSRAELRALIDALPATAGELRDRFAGPLTFGTAGLRGRLRAGPNGMNLAVVTRAAAGLVAWLAQQGGEGPLVIGFDARHGSRAFAEQTARVATAAGRAAFLMPRVLPTPVLAYAVRALGAVAGVMVTASHNPPQDNGYKVYLGDGAQIVPPADAGIEAAIRAVPSAAAVPLGDAGTVLGEDIIAAYVANAAAVLTSGGPRDLAIAYTPLHGVGGTTLAAAFDAAGFAAPAVVADQAEPDPEFPTVAFPNPEEPGAMDHLVALAGATGADLAIANDPDADRCAVAIPGPDGAWRPLRGDELGVLLADHLIRRGTPGVYATTIVSSTLLGRLCAARGVPYAETLTGFKWIVRAADDLAFGYEEALGYCVAPAMVRDKDGITAALTAAELAAGLKARGRTLADRLDELAVEFGVHATDQLSMRVDDLAEIGAAMTRARRRPPATLLGEPIGSVTDLLPENDVLTFRTDAVRVVIRPSGTEPKLKAYLEVVEPVGDGDVAAARERAAGGLRALRAEIAAVLGI

SEQ ID NO: 11572 - protein, 624 aa, Actinoplanes utahensis
MTQIPTWSSGDAASLNGRAAPGTLIGGRYTLRAAVGHGGMGTVWRAADTLLRRDVAIKEVILPPGLAPSDRDAMYERTMREARAAAALQHPAVVQVYDVVHENGRPWIVMELLDARSLADMVIEDGPVAPRVVAKIGIALLGALEVAHAHGVLHRDVKPANVLICNDGRCVLTDFGVARMPTDVQLTTPGMVLGSPHFISPERAMGQDFGPPSDLFSLGVTLYTAIEGRPPFDKGDPIETMHAVVEDPPAPVMRAGSLTPVLMGLLEKNPAQRMDVQTARTLLRQQLAGPLASKSPPHMMTDPYSVVPSPRPVSPPPAATQQIPPQPSGQIGGRAMLAPGESLTDHLTKLEQQNSTGGGRRRAPEPADAGFPTGTMPAHQLPQATRPGTVVTSPAAKRRMAVQNATQTVKDATARARATFLGWPRNKRLAVGGGAAAAVLALILIVSLTGGGDGGAAVQTPVAGPQTGAAAPGGGVAAGTQDYKGSKAISVKVPAGWTRAAGGTYVDYVDPADKLRKVRVLAESGKSTPEHFVTEIAPNGLKKSANCPKPFKAVGTDTNLQISGHPAAQLEYTCGTGDAMRHGIWRMTQVNGTMYSFFLTTPAAEFDGSRKYFDAMADSFQLNL

SEQ ID NO: 11573 - protein, 521 aa, Actinoplanes utahensis
MNAESGFTIKPVYGPDDVPSAAGSDQPGEFPYTRGVYPTMYTKRPWTMRQYAGFGTAAESNARYHQLLKAGTMGLSVAFDLPTQMGYDSDEPIAHGEVGKVGVAVDSIDDMRQLFAGIPLDQVSTSMTINAPGSVLLLLYQLVAEEQGVPGAALQGTIQNDILKEYVARGTYIFPPKPSLRLVADTFAYCRTEIPKWNTISISGYHMAEAGATPVQEIAFTLANGIEYVRAAIAAGLAVDDFAPRLSFFFVARTTLLEEIAKFRAARRMWARIMRDEFGAKDPKSMMLRFHTQTAGVQLTAQQPEVNLIRVAIQALGAIAGGTQSLHTNSYDEAIALPTEKSARLALRTQQVLAYESGLTGTVDPFAGSYAVEALTDQVEREATALIERVFEYGSAVDAIEQGFQKSEIEQSAYRIANEIDGGERVVVGVNRFTAEAEEKYEPLRVDPAIEAAQAARLATLRAERDDPAVQAALADLAKAAAGTANVLPSMKEALRLRATVGEVCHTLRGVWGVYRPVERF

SEQ ID NO: 11574 - protein, 497 aa, Actinoplanes utahensis
MRSATPSVGCGAYIDRSSVSRRTHGVSRHPRDSLPVGGLAGLLPPPGTFTRPLHSVTKNGLSCRASQNPTNLESDLEPDVTTALTAPDGADTAWPEPLPGADPLPGQLDRWLAARGAELVAIRRHIHAHPERSHSEFETAALIARELTLAGLSPRLMPRGNGVICDIGEGDRVVAFRADLDALPLHDLKDVPYRSTVEKVAHACGHDVHTTILLGLGLALAQLHEQGELPGRVRLLFQPAEEHIPSGAPEVIAAGGLKDVAAIYALHCYPQLPAGLVGVRSGPFTAAADTIRVKLSGPGGHTARPHLTADLVHALGRVIVDVPALLDRRVDPRAGVSLVWGSVHAGQAFNAIPGTGEASGTVRILNRDAWREAPEMITKLIHDVVAATGAGVEVEYRRGVPPVINDRMATAVIAGAAGAALGADRVVEAEISMGGEDFSFYLEHVPGAMIRLGTGVPGSDVRHDLHQGDFDVDEACIGHGIRVMAHTALAALSTGAF

SEQ ID NO: 11575 - protein, 318 aa, Actinoplanes utahensis
MRKRGYTLAGAVLLCGALLAGCGSGDSSDSSASSDRAAAPAGGNAAPAEAAAGGKADSGTAQDSVGAGQRSTAQGKDTPAESPNLSVDQRSIIYTGSITVQVKDVNAAAAQATGIAAGTGGFVGGDDRQSGNSGAATATLTLRIPAAKFSAALQQIAGLGVEKNRAINTQDVTEEVVDLDARLAVQQARVDSGRKLLAQAKSLSDLVMLEKEVATRESDLASLQAKKRRLADLTALSTVTVVLLGPDAAVAAPAAASPGFLSGLRNGWHALVASLSVLLTVLGALLPWFLVLGVPAWALWYFTRRYRRARSTPQLPTP

SEQ ID NO: 11576 - protein, 211 aa, Actinoplanes utahensis
MRVTKLTHACLRIEGAGVLVVDPGEFSEKSALDGADAVVITHEHFDHLDVAALTEAVRRRPELRIFSHAAVLAQLGEIAEATTEVRPGDEFRAAGFTLRAYGGQHAVIHPYIPRIANLGYLIDDGAGSLYHPGDSFVAPDGAPVDTLCVPLNAPWMKVSEAIEFARAVKPGRAIAIHDGLLNDRGAAISDGHLERFSETRYQHVAPGTTLT

SEQ ID NO: 11577 - protein, 357 aa, Actinoplanes utahensis
MPEVIDDVVRRLYEEPPEGFVATRAAAIEAARAAGDRDAAKRLAALKKPTVAAWVVNLLARRRPDLIGDLVELSAALRAAQRELQGDQLRELSQQRRAFVSALVAEARKLAVAAGAGAGKLPLGEVETTLTAALSDPEVAEQVRTGRLIRSAAYAGFGEVPRPRLRLISGGEDADVTEDDEDADASDPVDEPAATGRSSRGDASDPADGPAATWRSSRGDAGRKGAGPDESDPDEAARREAARNEAAREAEARERAARERRRREEERRRRDLERDLAAAEAAERRADEHLNRAEEAERDAQHLVDDLDAELAELERRRTEAVADVARRKQARRTAERESAAARRRVGDVQAALDDLP

SEQ ID NO: 11578 - protein, 323 aa, Actinoplanes utahensis
MSRPCPPSDVALAGRALWTRSGQPGPQGSRREQRSVIGRSARHLLHEFDLDLGARRIQPGDCGYGGFCKSVRRGRIGRVTPEQAAANAKASLAAIVGAFAESPQTLRRARLLGLSGWAYHVSARAGALGDVRPETVAAAVAFIAPEAVTEGWEATAKSSQPSEVATWHLRELCTWGAEQVGGFPRLTRLLELAERVVGAVDPAGLPLFAAWRAMPVPSQEPGARAAMLLHLLHEHRQGVYVIAVRAGGLTPLEAIMAGPEGETGAVALGWQAPYPSAGPLVRRLMWAEAVANSLAGQAYGTLDRPERVEFAGLLESLGHRLVR

SEQ ID NO: 11579 - protein, 324 aa, Actinoplanes utahensis
MPAMTALPDGWTTRRPTLDDVPLILELVHASDIAAVGEPDFSADEVRDELTGPHTDMSRDSWLAFDDAGRLAGWAYPRNPTGQARDFLEVYVWPGRGVPAQRPLLDLMMGRMAERAAELGHDPYTVRAGAIPTETEYIEALTAAGFTFLKQHARMRMSLDGIGAEAPRPPAGVTIRPVRHDDEAELRRFHAVIEEAFLDSDHPAMSFDDWRRQAATGGPVPYDEWFVAEADGELAGVLQSTEPEDRDEGWVRYLGVLRPYRKRGVGEALLRRAFAAYAGKGRSAAGLGVDMANPTEAARLYRKVGMTPLYRANVYQTTVPAARA

SEQ ID NO: 11580 - protein, 175 aa, Actinoplanes utahensis
MHLCRHALLIFSPTVVTTIVVAVRHYAAYGSNLDPARMLAYCPHSPMVGVGWIEGWRLTFAGEGEMGWEGAVTTIVESPGDRVFVSLYDVHPWDAAQLDEVEGVPAGTYQKLTVRVSTLDGEVPAWVYVFAGYEGGLPTAWYLSEIATAAEKAGAPDDYVSDLRHRPTGTASPES

SEQ ID NO: 11581 - protein, 466 aa, Actinoplanes utahensis
MSRIVIIGGGPGGYEAALVAAQLDADVTLVEADGPGGACVLTDCVPSKTFIASSEVMTGYRHNDRFGIRSRGLDGVSVDATAVNERVKKLALAQSGDIQTKLVKAGVDVVHGRARLGEDRLGHTHQVLITPHEGRPYAVEADTVLLATGATPRVLPTARPDGERILDWRQVYDLTELPEHLVVIGSGVTGAEFASAYLAMGVQVTLVSSRERVMPHEDADAAMAIERVFRERGMTILSQARGDSVVNTGTGVRVTLADGRVVDASHALIAVGAIPNTRDLGLAEYGVAVGQGGYVTVDRVSRTNVPGIYAAGDCTGVLPLASVAAMQGRIAIWHAMGEAVAPLRLRTVSANVFTDPELATVGVSQNEVDSGRTPARQVMLPLTGNARAKMADLRDGFVKLFCRPATGQIVGGVVVAPKASELILPITMAIENNLTVDQLAHTITIYPSLSGSIAEAARQLMQHEIQ

SEQ ID NO: 11582 - protein, 225 aa, Actinoplanes utahensis
MTELLTMVASPVLVYLALFGFLAVDALIPVVPIQAIMITTGALTVYGHLHLGVVIAIGALGMFTGDLIAFLLGRSTGHRLSALHARFAPRTTDSRTRQAAERFTRGLRKPGPLVVLLCRFVPGGRMASGYHAGRTGYPMRLFVAYDLGAALCWAGYGGLVGHLGGTAVTQSAWRLFAIAAGAALIFGTAGWILALFGGRESATGSRAASADEPLPRSNPTATDRS

SEQ ID NO: 11583 - protein, 254 aa, Actinoplanes utahensis
MAVPAGSDLPGSVPRPRAAGRSRIGGPSQRPPGILSLPSYPGPVTRPSYHHGDLRRALLKAAADSITETGVTALSMRDLARRAGVSHAAPGHHFADRAGLLTALATDGFEQLAKALATSRLASNSLLELGVTYLRFALANRATFEVMFRTDLYHADDPALLAARRQAADALYAGMTDLPDAPLAGPDVATHARAAREGTADLVSDEVREVGLAAWSMVHGFATLWLSGAFPDSTQEDPVEAARVILGRVRAMGR

SEQ ID NO: 11584 - protein, 584 aa, Actinoplanes utahensis
MRKILIANRGEIALRVIRACKDAGLTSVAVYADGDRDAPHARLADEAYALDGESAADTYLRIDKLIAIAERAGADAVHPGYGFLSENAEFAEAVLAAGLTWIGPSPQSIRDLGDKVTARHIAQRAGAPLVPGTPEPVADAAEIVAFAEAHGLPVAIKAAFGGGGRGLKVARTIEEIPALFESATREAVAAFGRGECFVERYLDRPRHVEAQVIADTHGNVVVVGTRDCSLQRRHQKLVEEAPAPFLSDEQRASIHESAKAICREAGYYGAGTVEYLVGQDGTISFLEVNTRLQVEHPVSEETTGIDLVREQFRIAAGEPLAITEDPVPRGHAIEFRINGEDAGRNFLPAPGTVSTLVWPSGPGVRVDAGVEAGSVIGGNFDSMLAKIIVVGATREQALERSRRVLDETVIEGIATVLPFHRAVVRDAAFVSEPFTVHTRWIETEWDNRVPAFSAPAPGGGEAADRETVVVEVSGRRVEVRLPKSLLAGTPGPAAAPQKRAGRPRGGASTAVASGDSLTAPMQGTVVKVAAQNGDQVNEGDVIVVVEAMKMEQPLTAHRAGTVAGLSLEVGATVTAGAVICTIEG

SEQ ID NO: 11585 - protein, 221 aa, Actinoplanes utahensis
MGLAWGFGARRLVVSPFVQSDNAYRLILASASPARRALLTGAGIDAEIIVSGVDESVVEAEDAYTLSLALARMKARTVAAELPADPAVLVLGCDSVLAFEGEIFGKPADAHEAVQRWKAMRGKSGVLHTGHHLTGLVSGRQAEAVGTTAVHFADVTDSEIEAYVASGEPLQVAGAFTLDGRGGAFVERIEGDPGNVIGLSLPLLRTLLRDMDVPIIDLWRR

SEQ ID NO: 11586 - protein, 445 aa, Actinoplanes utahensis
MVVATVNQGSHLMFANSDNGGGTDWSQRSVPEMWSMLAPHDGTTHKTLLVTWKKSADLLIDHLSRVKRYRDNLAEAWPPNKSTAAAKYLDRLDDLIQHLTNTHEATIENHRALGAATSSLVSARQKLESIHQEYLANQQQLATYDAKVQQNAQPLSKYRGIILPPNTATPARQLELERQAQSIMSTLSTELIQAQLNITTPPLYEIAKNFDDSRPFGQPGPNTTSKPSNKATLPAIDFSRHKLQSAQPGGDNTGESGSRSPVSNSLPPPSGHAPSASRPGESEPAVPASEVIVPEKIPPMGATRAPAAGSTAGIPGRYIESNSNSEIVRPKIGLPPEDTHSPTRGFQPLPAGGVIGSPIIPGSARPASNSNRAQRINPAGGILGQPGIASPSTPTRRSSRSRDESASGRWDPENPWETDKGVAPILLPAEKAVIDPGPVIGLKND

SEQ ID NO: 11587 - protein, 250 aa, Actinoplanes utahensis
MVPNDDLVRADAQISADITAMEDFARKLLAEVDNNYAPHADQLSNQLLTRLPPADARFHELSAFATVLESAQDTCQQNIYNFANGTHGFAKAAEQVSEQYRGSDAFARARLKDVEAALSVAGLIPPTSGGPLPAASSSGSTDAAAFSASPPDPSPPAGAVGSPASSAASSPAPAAASSLAPAAATSPAPAAATSLAPAAASSPAPADGAATSSGTSSSAPAVPPLDPSPAAPAFPESSPWSSPPSTKGAT

SEQ ID NO: 11588 - protein, 360 aa, Actinoplanes utahensis
MSSSPPLVVADRYRLVAPLGQGGMGRVWRATDVVLHREVAIKELVPPPGLTPGERQEMRERSLREARAIARLNNINVVRVFDVLRTDADPWIVMEYVPSRSLQDTLAADGPYNPVRTAEIGLGVLNALKAAHRAGVVHRDIKPGNVLIGGDGRVVLTDFGLATVPGDPNVTRTGLVLGSPAYIAPERARDGTAGPAADLWSLGATLYAAVEGQSPFARPSAIATLAALATENVPQARNAGPLKPVLNGLLRKDPAHRIDAEEAERLLARAAGRKSKISFPMSPTMRRPGAGRERPSLPSGPGGPPVLPGSGFVTATGSAPVVPTPRPPVTGRPDQPNRPHGTPGAPGSPGMGTAAWATAA

SEQ ID NO: 11589 - protein, 1006 aa, Actinoplanes utahensis
MTGPSAGRGGFTPGRATVGRATPGQKPLDATKVDGPAITDDQPGTRGPSNLAGPSGPAATRGPSDPAGSDPAGSGGRRGLAGSSGRPDLAGSGGRSDQAGTGRSADLAGGRPGSPARPVPSELPATQVNTARVGFTAADVAANRRKKAAPEHEASLAAATGSYPVVSGAEQDPDNSSRQQDSGAAAATPGDASTVPPAKASGSKAATRDARPGQSSGTPTAGTPTAGTPTAGTSDARTAGTSGPNTVNAPGTDTSDPVGRAGRAVSAGAATAAAGRSLSDSAQAESDKIRATPQSDEIGARPAAVTENRIAPYAAELPDSEPGRTASTESERVSAPAANIQPSVSSGARDADGTGDAEPADSSVSTGADRKAASDSRKPDSGDQQPVVDSRKPESAGAQPVAGSRTPQSNGQQSIAGSRKPGSDSRTPLDRQSLGSDSGGQRSGSEAPESGFTSEADGQRSGSGSGSGSGSDDHGSGAGGQGSGSGGRTSKSSGQGSKPGGPGSEPGDRASGSDDRRQTASDRKSGSGSEKRGSGSLKPGSAKESSRQDGGLDTAGATAAGVVADASRASASTASAPTTSATKATSGGPGADAETADGSVAAADSEADRAATSKAGEVAATSKAGEVAASSGATATTGAKAAGEAATDTVPAEAKGRSQDTAESNAKAQRANDSERAAGPRLGVESGPGPAGKRNAESGGAAERAATPLTPGQRPGGTPEQDQDRTSVVDFTAIVPQSPAVSAAEHDGATRVVNQLPGFRPSSRPAWTPISTRPVVRRVNGITIFGTTLTRRQATIAAAIVLTFVLLIGIILVQAFGSDDDKKATSTKPGAVGTGKVAPPGKPAASTGADKPASMPPSAAPSSAAPSGGVPAGWSKADFSGFSLALPQGYQIGRSDAGQTEIKLDGNRLLIVLRGTDTQDPAAQLNSVSRSGFQRVGSIRPLQYQGRPAADLEYYYYTSHGNKQHVVRRAFSVGGASYQICWYTSPDDWDSAAAEREAVFAGFQAG

SEQ ID NO: 11590 - protein, 69 aa, Actinoplanes utahensis
MNCRRHGSKPTLALWMLVACADIAIVAAAAGPITVLLVLAGLLVAAGGVYAARSLGNRAPADSAARRRA

SEQ ID NO: 11591 - protein, 255 aa, Actinoplanes utahensis
MPGVLSIEGFSGLHDVNGLSDLWDRLMSAQPDPPGILVLVTALIGFAAVFRPAWRVTRNAVTIAHEGGHALFALLTGRRLRGIRLEFDTSGLTLSSGRPTGVGMILTLVGGYIAPSLVGLGGAWLLNANRITLLLWLTVLLLLVMLINVRNLFGVLSLLVTGAIVFAVSWYAAPDTQAAFAWTGVWFLLFAGVRPVFELQSLRRRGRMRDSDPDQLARLTHLPALFWVGFFLVVNVAVLVTGAFMLAGQYLPAST

SEQ ID NO: 11592 - protein, 523 aa, Actinoplanes utahensis
MTTQPDIHTTAGKLADLANRSDEAVHAGSARAVEKQHARGKKTARERIELLLDKDSFVELDELARHRSTAFGLDRNRPYGDGVVTGHGTVDGRQVCVFSQDFTVFGGSLGEVFGEKIVKVLDLAMKIGCPIIGINDSGGARIQEGVVALGLYADIFFRNVRASGVIPQISLIMGPCAGGAVYSPAITDFTVMVDQTSHMFITGPDVIKTVTGEEVGMEELGGARTHNTRSGNAHYLASDEEDAIDYVRALLSYLPSNNLDEPVVYEEAADLSAADADLALDTLVPDSPNQPYDIKTVVETVVEDFLEVQPLYAQNIVVGFGRIEGRPVGVVANQPTHFAGTLDIAASEKAARFVRTCDAFNIPVLTFVDVPGFLPGTGQEWDGIIRRGAKLIYAYAEATVPKVTVITRKAYGGAYDVMGSKHIGADMNFAWPTAQIAVMGAQGAVNILYRGDLAAADDPAARRAELVQEYEDTLANPYIAAERGYVDAVIRPSETRAQVTRALRMLRTKRETLPPKKHGNIPL

SEQ ID NO: 11593 - protein, 65 aa, Actinoplanes utahensis
MEPSERVRFIPVVPFVTPHVTNWMTAAGLAFIAGGLATLISFRAVLFGGETEPERPRQRGRRQPS

SEQ ID NO: 11594 - protein, 388 aa, Actinoplanes utahensis
MHADEGPAFPDLAPPDLAFPDLAPPDPAFLRHADDLGAGPFGDESGAYPAMPWGDEEMAGDEPAGEASRYIDNTAWRTDPAAADPPQAGDDVRYDRSYAPPRQAIDRSDRAYGDRIDGWVRPRYRDLDDRPPAGDYWTPVPDDRYADPEPSARAYGWPVPVERLPSVPDYEPATGFDLTPMQAAEPTTLVPTWPPPSPDHRIRLPRSWSDRDRNLRDAADRDRDARDAAGRDLNARDAADRDRDPRDAAGRDLNARGAAERDWDARDAAERGWEARDAAERGWDARDAAERGWDARDAAERDWNARDAAERDSWAPWEQPSVSRARIVSRDGRSGPRAVPAVNRDEPSWNDPSRRSRRSAGDPRPRPRPRPAAVDQDYVSRHSAGPHR

SEQ ID NO: 11595 - protein, 281 aa, Actinoplanes utahensis
MAYTDLDRPPLSERALTRALVQPGALWSRIEVRPETGSTNADATEAARAGAAEGLVVVAERQVAGRGRRDRQWLSPARAGLTLSVLLRPGTADQERGWPAAGPGAFGWLPLLAGVALADAVSRVTTVDATLKWPNDLLAGDRKCAGILAEMAGDAIVVGIGLNVSTRAEELPATTGVPATSLRLAGAENPDRDPLLRALLRSVERWYAGWREAGGDAEMCGLLGEYRRRCATIGRDVRVLLPGGGELLGEATTVDRDGQLVIRSVDGAEHRVSAGDVLHVR

SEQ ID NO: 11596 - protein, 175 aa, Actinoplanes utahensis
MLHLRPHGKSVVGPALVLVLTVAGTVMAGVLLPGNQGGRIGFGLVAAIMIYHAARYGIAPLARWRCTHYVLTNERLLLQQGVFARERRDLPLNRVNDHALRQSLLDRIFGTGTLVIDSIGEQSARLSGVPQAQRVQTRLYELIELSPADDEDAEEELSSSAWRPAPPRSPGRRSR

SEQ ID NO: 11597 - protein, 182 aa, Actinoplanes utahensis
MPSGPTLTDRLRRLAPEAVAFGVIGAGNTLLYMAICWVALPIGAVKANVIATLITTTLAYLANRFWTYRHHTRTALRREYLLFFGFNLVGMVIQSGLVAIGKYGFHLNEKDDKIHFMLVTMIGIGIATVFRFWAYRTFVFLKPPVDGHEGAITGMDATAGLAELSAIDVPGSAAELDATLKS

SEQ ID NO: 11598 - protein, 178 aa, Actinoplanes utahensis
MPAPPVEIVQRDRRRRCRAGTLERVRLRKLAREAGRFGTVGGIAFGVDLLLFNMLRNSGVEPLTAKTGSTIVATTLAFLGNRYWTWRDGAHPNLARQYTTFFVLNAVGLGISLACLAISHYGLGHYWPVFRGKAADNVAGLLIGTAIGTIFRFWSYRRFVFRAETRTTGVTTSSPTLP

SEQ ID NO: 11599 - protein, 254 aa, Actinoplanes utahensis
MTTPGNDVDSDTDLLAAVRAGDTAAYGTLYERHRAAARLFAFGLARDPADADDLVAETFAKVFASLRAGRGPLVAFRAYLHTTMRHVCYQRARSDRRLEFTDDLSRYDEGQPFTDPALDRLERSFAAAAFRQLPPRWRDVLWQTEVEGSTPAELAPRMGLTPNAVAVLAHRAREGLRSLYLQQHVTAAEHPECRWAGERLGPQVRGRLAPRDAHRMRTHLGRCADCRGRLAEIREIDGFRHSPYRQRDHAGTAG

SEQ ID NO: 11600 - protein, 601 aa, Actinoplanes utahensis
MSHPHTSHPRLLAWIDEVAALTTPDRIVWCDGSDAEWTRLTDELVESGALVRLDPEKKPNSFWARTDPSDVARVEERTFICSADEADAGPTNNWMAPAEMKTLMTELYRGSMKGRTMYVVPFCMGPLDAENPMFGVELTDSPYVVSSMRIMTRMGAEVLSAMGDDADFVPCLHSIGAPLEPGQDDVAWPCNETKYISHFPETREIWSFGSGYGGNSLLGKKCYALRIASVAARDEGWLAEHMLIMKLTSPEGVVRYIAGAFPSACGKTNLAMLEPTLPGWKVETVGDDIAWMRFGEDGRLWATNPEFGLFGVAPGTDFHTNPNAMRTLAKGNSVFTNVALTDDGDIWWEGMGEPPAHLTDWKGQDWTPESEAPSSHPNSRFCTPIEQCPILADEYHDPRGVPIDAILFGGRRKTTVPLVTEARDWVHGVYLGATLSSETTAAAVGQVGVVRRDPMAMLPFIGYHAGDYFQHWIDMAKGASGDASKLPKVFYVNWFRRDADGGFLWPGFGENSRVLKWVMERLDGKADAVETPIGHVATPQSLDLTGLDIDQAALEAVLRVDRDEWLAELPQVTEWFEKFGDKLPAVLWAELDALRARLADA

SEQ ID NO: 11601 - protein, 259 aa, Actinoplanes utahensis
MPVMSVRSLVYSLYERRLAGKLVGKPVPRHVGVMCDGNRRWAREMGFVDPNDGHRVGAVRVKDLLTWCDLAGIEHVTLYLLATDNLQRPAAELDPLVKIIEDLATELAEEGNPWRLRMVGALDILPAATAATLKAAQEKTQDRSGGVEVNMAVGYGGRREITDAVRSLLQQHAASGGTLEELAEILDVEHIAEHLYTRGQPDPDLVIRTSGEQRLSGFLLWQSAHSEFYFHDANWPDFRRIDFLRALRSYGSRQRRYGA

SEQ ID NO: 11602 - protein, 268 aa, Actinoplanes utahensis
MAETERPTHPASADDAWARTARHASRTTFFFDFDGVLSPITEQPEESRPVAGIPEVLDRLAARVARVAIVSARPVTFLRTHFASLAHVDLFGLYGLEVWHEGQVVTKPAALDYEEPMKELAAAARGALERPVEVEYKRLAVALHYRKDPARAAQVEKWALEQAEQHGLLIQRGRMVVELKPPVDQDKGMVITEAVRDAGCAWYFGDDMSDVKAFDALRAREAVDPGFFGMAIAVANDETGAEVSNAADLTLASPEAVARFLDAGLQTF

SEQ ID NO: 11603 - protein, 472 aa, Actinoplanes utahensis
MTSRRTDAGVASSSDPADKVTKTRATPARRKVRDRHADAEPAPAGKVFVLDTSVLLSDPAAFRRFTDHEVVVPLVVISELEGKRHHPELGWFARQSLRMLDELRIKFGRLDQPVLCNDEGGTLRVELNHADQSALPQGFRNDSNDTRILSVALGLAAEGRDVTLVSKDMPLRVKAASVGLTADEYRHGQASDPTWTGMADLELGEDQVKALYAGDELEVEEADNLPCHTGLVIHSSRGSALGRVTPDKTVKLVRGDRDAFGLRGRSAEQRIALDILLDESIGIVSLGGKAGTGKSALALCAGLEATMERNRHKKVVVFRPLYAVGGQELGYLPGSESEKMSPWAQAVFDTLGAVVHANVVEEVLARGMLEVLPLTHIRGRSLHDAFVIVDEAQSLERNVLLTVLSRIGQNSRVILTHDVAQRDNLRVGRHDGVTAVIEALKGHPIFAHVTLTRSERSPIAEVVTDLLEDIPL

SEQ ID NO: 11604 - protein, 232 aa, Actinoplanes utahensis
MNRLWSRLGVRALSVGLLAAGLGGGLYLGHGQDDQQQSSQATLVAQANAEEIALLKQREADHAAARAYRRTAEDAAAEKAAGEARQAAANARKLEVKVIADAAATKKAADAKKAASGGAVPYAGHIPSSCNDFSGSRQIGCALMLDAGFKIDQFPCLDKLWKRESGWNYSALNKSSQAYGIPQALPGRKMAKFGADWESNPATQIKWGLDYIEGRYSSPCGAWGHSQEVGWY

SEQ ID NO: 11605 - protein, 261 aa, Actinoplanes utahensis
MVRNVASFLAIVVTVLAAGDVPAQAGAGGRPILEVVGGNVAKTGEFPWVVRLSMGCGGALTAPRVVLTAGHCVGPTGPDKRIVVTAGVADLKARNAVVAHSVEVVRAPAFTTETRGNDWAVVKLDRVLDLPALPLVPDATGDTGDVTVMGWGQTREGSLRQERRLHYATVPTIPDATCAKAYAVAKVTLVQSDSICAGRHGVDTCQGDSGGPMVRRGADGQWAQVGIVSWGLGCARDAYPGVYTQISKFRAAILAATRKLS

SEQ ID NO: 11606 - protein, 245 aa, Actinoplanes utahensis
MRATPTPGCTRRSPSSGRRSWRPPANFPEWPGVRGPATISAMSYGVTPTRVDAPAKFGTEAFYASLGRAFLTMCAVIPGLFLIEALDVALGQGTLDMAGGIIPHHLDGLDGVLFSPFLHSGWDHLYGNAVPLILVGTFAMAGGGRRFLWSTLVIMLISGIGVWFVGDPSTVVVGASGVIFGYLGLLLGRGLFERSWWNLAVAAFVGLLYWYQVYNILPTDRAVSWQGHLLGLIGGLVAAVLFRRR

SEQ ID NO: 11607 - protein, 379 aa, Actinoplanes utahensis
MLIVNHVAEPGLGTSSDARISGSTAPQRREEADMPARVPQDLDRNIALDLVRVTEAAAMAAGRWVGRGDKNGGDGAAVDAMRKLINSIQMQGVVVIGEGEKDEAPMLYNGERVGDGTGPEVDVAVDPIDGTTLMSKGMPGSVSVLAVAERGAMFDPSAVFYMDKIAVGPDCADVIDINAGTAENLRRIARAKRSSVSDVTVCILDRPRHARLVEEVRQAGATIKFISDGDIAGAISAARAESDVDVLMGIGGTPEGITAACAIKCLGGMIQAKLWPRDDAERQKAVDGGHDLDRVLTTDDLVTGDNCFFVATGVTSGDLLKGVRYRSGGAHTQSIVMRSKSGTIRVIDSYHRLEKLALYSAVDFDGHLPTVPIGEEPII

SEQ ID NO: 11608 - protein, 299 aa, Actinoplanes utahensis
MVNNEHVEPAAPETAPTPPPTPVTSPPASAAAPSPAAGPTSAAEPAGAPSPSAPGPSAPCAPSGSASASSGSASVSPGSASASSGSASASSGSAELPASSASGVAAESSAAPVPAGATSSAAPAASASPRLTRREGRAPRDMALSLAVLMIPIVLLLVFYRVVLNGDKPLTVDPSSSFDLASRHFTVLKPAGLGKDWRVTAATFKDEKGGAILRIGYVDPDDNPVQLIESTTPADTLVPAEVGKDGKRAGAYRTDARTWMVYTGRPGETALIFSDTGRTVLLVGKTGQPNLEALANSLK

SEQ ID NO: 11609 - protein, 67 aa, Actinoplanes utahensis
MSDDNLSYEQARTELADVVTRLEQGGGSLEESLALWERGEKLADICQRWLDSARTRIDAARAARDAG

SEQ ID NO: 11610 - protein, 414 aa, Actinoplanes utahensis
MSEAQAATAPAKSTADEPWPVRVVTQKISAWIAKLGWVWVDGQVAQISRRAGSGVVFLTLRDPAADLSLSVTVHRDVLETGAPDLSEGARVTLHAKPEFYQARGSLSLRADEIRQVGLGELLARLERLKKLLAAEGLFARERKRRLPFLPGRIGLITGQNTAAERDVLTNVHRRWPGADFRVAHVAVQGPNAVPQIINALKVLDDDETVDVIVIARGGGSVEDLLPFSDEALCRQVFAARTPVVSAIGHETDTPLLDYVADLRASTPTDAAKRIVPDLADEIRLIDHARQRLDRAVLTRIDRERQRVEALRSRPVLARPETLIDQRAAEVVALRDRAGRSLEHRVRRADDELRHTLARLRALSPLATLQRGYAIVQRGDGHVLRAAGEVDEGDPVRVRLAEGELTAVVTSGENA

SEQ ID NO: 11611 - protein, 442 aa, Actinoplanes utahensis
MSAATSQAARLGAIRCRASRIIPPRVTTAWNTTYTGPSVPLTRSSRPTPNRNQPAITRSTVETAGHRSSRSALMNPIIPADTIRTGRNGSTAVPAGVVALIAGGWRPDGGTYHCRVTEARKRVLLAKPRGYCAGVDRAVQTVEEALKLYGAPVYVRKQIVHNKHVVSTLEARGAIFVEENYEVPEGATVVFSAHGVAPEVHDQARERRLKAIDATCPLVTKVHHEAKRFAAEDYDILLIGHEGHEEVIGTSGEAPAHIQLVDGPDDVANVVVRDPAKVVWLSQTTLSVDETMETVARLKTRLPLLQSPPSDDICYATSNRQHVIKEIAPECDVVIVVGSTNSSNSVRLVEVALGAGARAGHLVDYAAEIQDEWLAGATTVGVSSGASVPDELVMEVLAHLAERGFGEVTEFTTAEERLTFSLPQELRKDMKAAEAARAAAAG

SEQ ID NO: 11612 - protein, 657 aa, Actinoplanes utahensis
MGSEVAAAAEIAAAEVTAAPVAAAEVTADVVAAQVAEAVRVAEVVARQQAVLISVGVPDVAEGRREQRVEDQHAAEHPGAGAERGLPDRCRIPTGRDRTALHPATRVVVRGFRARLRPRPVSVALHADLALLGELPGAPRGGQRRQVGARVEAHRDAGGPHIGQTLQRGLAGQLELPHRGGLLQLAAGRVVALAGVGQGLPRGRLVGVQVHHLAAEPLVPPLRVGTGIRELGLLISCPATLGGDDDQGDDRDDGQDEQHAVHVFQSTRGGLVVPFWQSAVVTYSTLAVILICLAAGGALGWLAARARAATDIARLEATVAAARDGEQRLEQSMRALSYEATAQSQEAVARAVAPLQDTLRRYEQRVADLERERVDAYAELREQVRAMGVVSTELRGETRQLVSALRTPQVRGRWGEHQLRRIVEAAGLLEHCDFAEQVTAETDRQGVRPDLVVRLHGGRTVVVDAKAPLEGYLSAMEARDERDRDLHLDQHARHLRAHVDALSAKEYWSAFPSTPDFVVLFVPADPFLDAALQRDPVLMEYAFRRDVVLATPATLIAMLRTVAFSWRQETLTGNAVAVHTLARELYGRLSTLGDHVSRLGVSLNGAVSAYNKAIGSLESRVLVSARKLAEMGVSDEDLPQPPQIEVAPRQPQAPELS

SEQ ID NO: 11613 - protein, 200 aa, Actinoplanes utahensis
MVRSTIGSMPIAPEQVEAPAEDAVLFRSSPARTFLAVFAVLMLSYLVVSPIVGRIARGGGDPWWVTTLQAVVVGAAVAGFYALSARSALTTWVRVSAGGLELAAQGSDPVLLAWEDIAAVTVRRSGLRTVLEVTPVDMDAVHPVQGSGAGWPQQTVTARGPAFAADLTQIWPSPRALRHELTRRLHPYPRPAPLHPEQPW

SEQ ID NO: 11614 - protein, 417 aa, Actinoplanes utahensis
MTESVSVAVVGAGSRGGMYARVAADSGRARVVAVAEPDDERRERFAAEFGLPADRVHRDWTGLLAGPRVADAVIVATQDRLHEAPAVALLGHGYDVLLEKPMAPSEASARRIADAALASGRIFGVCHVLRYTPYTAMIRELIRDGALGDVINVQHLEPVGWWHQAHAYVRGNWRSEAGSGPMLLTKACHDVDWIMHVVGDGVARVSSFGGLAHFRPDRQPAGAADRCVDCAVERECPYSAKRLYLGCLGDPKTERWPLGPVTSDATEAGVLHALRTGPYGRCVYRCDNDVVDHQVVNFEFAGGATATLTMTAFSPSDGYRRTRIFGSHGSLEGDGRTLTLTDFRDGSERVIPVPAGAGGTAAGGHGGGDAGLVAAFLTAVRTRDESYLGSGAAASLDSHRVVWAAERARHTGTVITL

SEQ ID NO: 11615 - protein, 844 aa, Actinoplanes utahensis
MTDTGTGRPGLPERPSLDGLEDRWAPRWQEEGTYTFDRSRERSDVFAIDTPPPTVSGALHVGHVFSFTHTDTVARFQRMRGKTVFYPMGWDDNGLPTERRVQHRYGVRCDPALPYDPAWQPPEAPADPPVAISRRNFVELCSRMTAADEQAYEAIWRRLGLSVDWGLTYTTIGDRARAVSQRAFLAALARGQAYAAQAPTLWDAGFQTAVAQAELEDRERPGAFHTLRFAGPDGPIEVDTTRPELLPACVALVHHPGDQRFAHLTAARSPLFGVEVPVLAHPLAEPERGTGIAMICTFGDLTDVTWWRDLGLGTRVVVGRDGRFLRDAPSGVPAGVYAALAGRTVEAARRETVRLLRASGDLLGEPRPITHPVKFYERGDRPLEIVTSRQWFLRNGGRDPLLRERMLARGRELRWVPEHMRHRYEHWVTGLTGDWLISRQRFFGVPFPLWYRLDDAGEPDYDQLLIPDDSALPVDPTSDCPPGFDESARGRPGGFTADPDVMDTWATSSLTPQIAGGWSVDDDLYSRVFPMDLRPQGQEIIRTWLFGTVLRAEQQDGVLPWHTAVLSGWVLDPDHKKMSSSRGRAVPAGPPLAEFGADAMRYWAASGRPGADIAYEPGQLRIGRRLATKLLNASKFALRLGASDALRQPVTEPLDRAMLGRLAEVVIAATEAFDRFQHSEALQAVETFFWTFCDDYIELVKSRAYGSGPAAGSAHAALATGLSVQLRLFAPFLPYVTEEVWSWWRYGSVHRSTWPTRYELTRVAPDSEPALLDLAGDALRQVRKAKSDRRLSMRADVPLAEALGPAALLDRLELIGGDVRAAGRIAKLDLLRDRTPELVIACAF

SEQ ID NO: 11616 - protein, 186 aa, Actinoplanes utahensis
MPGGADDDPAAVRAVRRLDQPARKARATADLLLAHLSTQLTGGVELTAAVRWSVELHTGADDLVPLVVSCRASSSAGFSRASSSLAAKASGGCQSGVCGCLPKPRDCPSPGHCPHRPPVPRIRVVEDVAPGDVADHDILGMLHRVRRGHRPDQTQPRRQIHRRQTRPRRRHFVCGGAIEYDTLTNR

SEQ ID NO: 11617 - protein, 236 aa, Actinoplanes utahensis
MAPGPHTDGVGLPRCAVCGRLMTLTGFVTPNGELICHRHAHEQPSTCCGLPADPTLAAERPLCPRCAATAVRTQQDVRRVLPPIAARLRALSIWTTKPVRVRLVPVAELQADWHGSGALLGGTVCVGSEVVDLMVVRDLPLVRFGAVVAHEVMHAYLVQHGFGELPPPVEEGLCELLAHAWLKGEPGAPAEWERRRIMDNPDPVYGNGFRAARQAALRVGGVSRMLAHVRRYGDLP

SEQ ID NO: 11618 - protein, 165 aa, Actinoplanes utahensis
MLRFSTMDTPPGPFTLVVADSGAVRAAGFTVDVPALIRLIDPALVEPAEPADDVGPAQAAVRAYFAGDLPALDTVAVEQRTGGVFLAHAWRVMRDIKPGDPVTYADYAVLAGRPAAIRAAAAACARNAVALIVPCHRVLRTDGSLGGYRWGLPVKSWLLEHESSA

SEQ ID NO: 11619 - protein, 514 aa, Actinoplanes utahensis
MSESRQPKPRRTEQTRGMELDFERCYRAVDSRDQRFDGCFYTAVRTTGIYCRPSCPAVTPKRENVTFFVSAAAAQRGGFRACRRCRPDAAPGSPDWDVRADTVGRAMRLIGDGVVDREGVGGLATRLGYTERHLNRMLTAELGAGPLALARAQRAQTARILVETTDLGLADIAFAAGFGSVRQFNDTMLEVYAQSPSRIREKRPVARGEAGVINLRLAYRAPLHSASLLAFLGARTLPGVDEIVDGGYRRGLTLPHGTGDVVLRPGDRWVFATLRLGDVRDLAPAVARCRRLFDLDADPDAVDGMLAADPGLEQVVREEPGVRVPRAVDGFEMAVRAVVGQQVSVAGARGILGRLVRAAAGGSGGSGSSGGLGDSGPSGPAPAPAATTDLTGFPTPATIAALPDAAFGMPAARRATLRALATAVASGHLDLNPTADRDETTARLLAIPGIGPWTAGYIAMRALGDPDVFLPTDLAARRGAAALHLPDSAGSLSVHAERWRPWRSYALIRLWRAA

SEQ ID NO: 11620 - protein, 257 aa, Actinoplanes utahensis
MSTDIRWRTFGDGGPKVVLLHGGLQTSANFTKLAGALAGDFTVYVPDRRGRALSGPAVAGHGLRAEIDDLGAVLGETGARNVFGLSSGAVVALRAALELPIERLALYEPPLKHGGHDPVAWLSRYEAELARGRTAAAFTTVVKGTGGARYVPRAAMLPLAGLAVRNPDIAALVPTMRLDAAVVEDAAGPLSTYSAVPADTLLLGGDRSPAYLRSVLNGLEPVLPRVCRVTLTGVGHFAADNSGRPALVAAELRKFFR

SEQ ID NO: 11621 - protein, 394 aa, Actinoplanes utahensis
MSGISPPTTAAGPRWWLPNCGSSSDEACVDWRSVSLTIGIVGLPNVGKSTLFNALTKNDVLAANYPFATIEPNVGVVGLPDERLGKLAELFGSEKILPAPVSFVDIAGLVRGASKGQGRGNAFLANIRDASAICQVVRAFSDPNVLHVDGKVSPADDIETINTELILADLQTVEKALPRLQKEAKLKKEKAAAVAAAEAAFQLLNDGVTLYQGATAAGIDLDLLGELHLLTTKPFLYVFNVDEAELGNESFLDELRALVAPAEAVFMDAKIESELIELDEAEALELLQSTGQSEPGLNRLIRVGFETLGLQTYLTAGPKEARAWTVPVGATAPEAAGVIHSDFQRGFIKAEIVSYDDLMAAGSMSAAKAAGKVRMEGKDYIMKDGDVVEFRFNV

SEQ ID NO: 11622 - protein, 101 aa, Actinoplanes utahensis
MEWVFDGEIFEWRGPAPFFFVAMPESDSAELKDEARSLIYWGQIPVHVVIGDTAFRTALFPKNGRYLVPLKDAVRSAAGIGEGDLITVALRPAWPSDDAPG

SEQ ID NO: 11623 - protein, 212 aa, Actinoplanes utahensis
MQGGIRRHAPAGRTCYGGDMSTVPEWMRPPRPEGWLADDLDHLPEVPRHTELIDGALVFMMSPQRIWHARLITALVNVLSDQTPAGIGAEREITIRLDELNRPEPDILITTGPYDWNSTFLTPDQVLLVGEVVSPESAYRDRTVKLRKYAEAGIAHYWLVEEEDGSPVVYAYDRDNATGLYALTEVHRHKLHTMAPFPITLDLDRLVAGRSS

SEQ ID NO: 11624 - protein, 195 aa, Actinoplanes utahensis
MINAGERVARIVSEVLAPAVLVAALLMVVGWHAGQTPGVSRWWGLPGAIFAAVIPLGYVLHGVRTGRLTDHHIPDRADRRVPLLFGIVSLGVGLIVLVLLGAPREVLALLMAGAAGLVVFALVTHWWKMSIHAGVAAGALATLTAVYGPVVLAGAPLVLLGGWARVRLAAHTPAQVMVGALAGAVVAGTIFPALR

SEQ ID NO: 11625 - protein, 150 aa, Actinoplanes utahensis
MGWTIEERAWDDPAGAALRLAQRAELDARYGSDDHEPGGAPAADEIDVFLVAVDGDAAVGCGALRRLDEHSVEVKRMYVAPGSRGSGVATAILRALEDAARRRGWTTVRLETGTEQPDAIRFYQREGYREIPLYGRYVGSTISRCFERLI

SEQ ID NO: 11626 - protein, 195 aa, Actinoplanes utahensis
MTVPRKADPQCPSRSWRVPPTGRCLHTGRKVNGMRHRRTITGMPATTGHLVPLSPAEEAAMRALGRFLLVVPRALDADLMREQRMSASEYSVLRHLSETDDQRMRMSELAAACDMSLSGMTRLAAKLESLGYVKRIRCEEDARGANAVLTPAGLARLREAWPTHLASVRRHIFDHLGDLDLTKLAAAFSAMATEI

SEQ ID NO: 11627 - protein, 89 aa, Actinoplanes utahensis
MPRKSWWARLPFGVRMIAGTSALLALVSGGLAGAAVLNGNDGQSAESAEQTLAGDPGAAHLQDDPEVVSREAAAAEPLPLRRTHLPAPP

SEQ ID NO: 11628 - protein, 174 aa, Actinoplanes utahensis
MAPTATQLPVATGAELQRARAEDPADRTGTRSPRVAPKPTVTGRAKPVVTTRTDTEIRPVPFRTRVVRDDTLPQGFHRLQSPGAPGEEKVRYLVTLTDGRPTGRRLLDTTVTRQPQPRVVVLGTQDCSGAFDLCVPLGRSACPSAAPVPPEPDVPPVAEDSALLDVRLEPATAC

SEQ ID NO: 11629 - protein, 277 aa, Actinoplanes utahensis
MALTDAELTEMAQRLTTVPGVVGVVLGGSRARQTHSPESDTDLGLYYRAPFDTVRLGELAVEVAGDRARVTAPGEWGPWVDGGGWLRIGDHPVDWIYRDLDRVHACWAEAEQGRYEFHAQGGHPLGVPDHAYAGELALGRILADPTGELAALRRRVSVFPRPLAEALVAGLWEADFLVGLARKGVGRLDTSYVAGCLFRLVGVCAHALHGAAGQWLINEKGAVAAAGRLPGAPAQFADRVDAAFAAINNDPLHLTLAIDIAADLVLETTEACAMMLR

SEQ ID NO: 11630 - protein, 257 aa, Actinoplanes utahensis
MRDDVAVTADVPTILATSAGFERGPLGGFDIRPGRVHHFAAELANAGADPRICVLAQALGDPEARIGAFYSAFASTAFTMSHLQLFPMPNVEDIRAHLLAQDVIWVDGGSVANLVALWRVHGLDEILYEAWQAGVVLSGSSAGSICWHTGGTTDSFGLRLRAFTDGLGWLPYSNGVHYDAEGERRPKMHELIADGTLPDGFATDEGAGLVYRGTSLQEVVADRAGPRGYAVQRTAAGTVTETPLPTRVLPEYRHRSA

SEQ ID NO: 11631 - protein, 68 aa, Actinoplanes utahensis
MLAHLQKPLTRTPSGMLLGADLAPAPAGGGGEGGQPHRLALLLGANAVYAVALLLSAVLVGLATVALS

SEQ ID NO: 11632 - protein, 297 aa, Actinoplanes utahensis
MPAKYRTVFGGTWGLLCALLGAASGVAQLAGISGRTGRWALTAVFLACLLYFVVWFWQIAFVLKIRQLRAELLDATQALTLQRAGHQHYLDAIQRISEREKPLFLETLEVLVAVGADDDSDRIVEKRVTTPEPLVTHRTMRPIVPTDEERMIRLDDIAFKASRETFGTITALPLEQTRTLRVWMIFDPAMTTPTEWQVEYRPRGLWRPLRERGWDQLTWEDRLPTASGTPSAFTRFAITFTFPDNDQPPSVKERQGYGVLSEPVRDPSGRWEVVWRDERPAGRRYVWDLTQAVGRPS

SEQ ID NO: 11633 - protein, 120 aa, Actinoplanes utahensis
MADVIYDNKSQLEQVQSGLLEGETIIAVYDAIGVGTGFLGLTTRRIILQDKSFVGKKFAITSIPYSKVSSVSVVSNKSWAGQFFSSGEIAITVGQHVYEVEFRGSDKAHHAHNLILSLAS

SEQ ID NO: 11634 - protein, 104 aa, Actinoplanes utahensis
MRARKRRTSTGSDYLSDALALLGGWTRDGVQLRRDLACDDSEHAALTERIKVAADTLAIRPRIRRVDGHTQICLGDRDGEALTDGEVTLAARIEDFYRTVVGHA

SEQ ID NO: 11635 - protein, 143 aa, Actinoplanes utahensis
MDLMPSEQYVKSPPSPRVIVAAVIIVGGRVLACQRRSPPEAAGKWEFPGGKVERGETDEAALARECREELGITVEVGARVGPDVPLAHGRAVLRVFAAEVLDGGVPEALEHADLRWLTVDELGSVPWLPADVPIVAELPALMD

SEQ ID NO: 11636 - protein, 552 aa, Actinoplanes utahensis
MATPWKSGINTGRAKTYAASLCASCDLHHSEAICMTTLSLATVLAESARRYPEKVAIVDAGARITYRELWDQTRAYAAGLRELGVGAGSTVAVMIPNVADFPRVYYAALAVGARVVPVSLLLQPAEVAYVLSDSQADLLVTHSAFLQVGAAAAQLSGTRLANVGPLPAELPTLPERLEEVSARVPALHTYVTRQAEDVAVILYTSGTTGKPKGALLSHLNLVMNATVNVFDVHPITGDDVVLGCLPLFHTFGQTVGMNATFRLGGTLVLLPRFTGEAAIELMLRENVAIFHGVPTMYIGLLEAAAKAERLPKLKLCVSGGASLPVAVLERFAETFGSHIFEGYGLSETSPTATTNQPAYGAKAGTVGHPIWGVEVEIARPEVPERIEFLPTGELGEIVIRGHNVFAGYLNRPEATAEAIVDGWFRTGDLGTRDEDGFISIVDRTKDLIIRGGFNVYPREVEEVLARHPAIQQVAVIGVADDTHGEEICAVVVREDGGLTEQELIDWSRERLGKHKYPRQVRFAESLPLGPSMKVLKRELRKQYSHKQQGNAV

SEQ ID NO: 11637 - protein, 209 aa, Actinoplanes utahensis
MARPRQALLTRERIVEAAAALIDAEGLEALSMRRLATELGVQGPSLYNHFATKAEIVDAVAEAVVAQVDIGVFAGCDWRDGLRLWAKSYHAVLTAHPNIVPVLATGPGRRPHGLAMAEAVYGALLDAGWSRSRATHIGALMRYLITGSALGSFAMGFAVDPALYDHYPHLHRAHELAAHRAVVDEGAFELGLDVLIAGLSDHYDQGVRR

SEQ ID NO: 11638 - protein, 469 aa, Actinoplanes utahensis
MTSEFREQLYIGGAWVPPAAGDRIEVENPYTEQVIGHVPAGTAADVDLAVAAARRAFDGWAGLPMTERGAALDRLHRALAARAGEIARTVGLELGTPLKIAQAVQAGLPLTVLRGYADAASRPVEPETIGNSLILREAAGVVGAITPWNYPLHQVVAKVGAALAAGCTVVLKPSELTPLVAYLLFDAAHEAGLPAGVLNLVTGTGPVVGAAIAGHPDVDMISFTGSTATGRAISHAAADRIAKVSLELGGKSANVILEDADLVKAVKVGVGNALLNSGQTCTAWTRMLVHRAHYDEAVALAAKTAVGYVTGDPFDPATRLGPLVSAAQKDRVRGFIDRADARLVAGGPAAPVPGTGHFVAPTVFADVDPDSELAQEEIFGPVLSIIPFDSDDQAVAIANNSKYGLAGGVWGSDERALAVARRIRTGAVDVNGGSFNPLAPFGGYKQSGVGRELGRFGLEEFQQVKAVQR

SEQ ID NO: 11639 - protein, 362 aa, Actinoplanes utahensis
MSHHISGLVVTAAGAPASVAELRLPEIGPGQVRVRVRAAGVCHSDLSMINGTLRPPHPLVLGHEAAGEVVEVGEHVTRAAVGDHVVLNWQPPCRTCWFCAHGQPWLCATSSGVAALENGITLDGAPVHVCLGLGAFAEQVVAPENAVIRVPPQLDFEVAALLGCSVLTGSGAVRNTANVQPGESVLVIGLGGVGLSVVAAARAAGAAQVIAVDVTEAKKGLAEAAGATDFVVSSDALSKDIRVRTEGRGADHAIECVGRASTIRAAWRATRRGGQVTVVGMGAADDMVQLAALDIFSSARTLRASVYGQADPDIAVPALARDVLNGRLSLDHLITDRIGLADVPAAFDRMARGEGARSVVHL

SEQ ID NO: 11640 - protein, 868 aa, Actinoplanes utahensis
MGEFTGGSGLLERSGQLGALHQAYDSVRRGRGGVLVLLGGEAGGGKTALVRRFRDEARPGRPVLWGGCDPLWTPRPLGPFLEIAHDAADSGPVRELINRGAKPYELATGLIGDARERPGLILVLEDLHWADEATLDVLSLLGRRIDGIPALVVATYRADEAGRGHPLRRLLGELQGAAIRRMGVPPLSPAAVEELARPHGRDGRALHRATRGNPFFVTEVLARDDGDVPLTVRDAVLARAARLSPAAAAVLDEVAVTPPHTELRLLSDTAGVDEAVRAGMLECVPGGVAFRHELARITVEESLSPHRRLDLHRRVLAALLAEPDAADPSRVAHHADAAGDTAVVLEWAPRAAEQAADSGAHREAAAQYSRALRFAAGLGPIERAGLLERRSYECYLTEQTDESIDALREAIRQRRLAGDRVSEGTALSHLSRRLWCGGYIEEAADAGRAALRLLGDLPSGPEYAMACTNQASIALNIEEYPDAIELGTRALRLGERHGLPEVVVHSLNNLGTMQLLAGEPQGIGKLERSLALAEQERLEEHIGRAYIHVGWAMTRVRSYHLSSWLDRGVTACADLGLEAWKHYVLAYRARYHLDLGRWPEAVADAEQVLREAKPVPLLRVIALSVIGLVQARGGETDPWPVLDEARSLAATRPELQYVAPVATARAEAAWPAGAPVEPELAETWELAQRRRAVWVLGELAWLRHLAGEPHPEPPAAPLVEPYALQLAGHIEAATERWRKRDCAYDAALALSGAPAETSLRAALAEFQRLGARPAAAVVTRRLRARGIRDIPRGPQRWTRGNPAELTRREVEVLGLVQQGLSNVEIAERLFLSTKTVHHHVSAILRKLGVARRGQAAAEASRLGLTPAD

SEQ ID NO: 11641 - protein, 195 aa, Actinoplanes utahensis
MTTPPRVDGRTARSERTRNAIVDAHLQLIRDGDLRPTADRIAKLAGVSLRALWSHFADMEALMAASGQRVLEQRDASYRKIPSDLPLAERIDAFCRQRARMLEEIGPAARASALKEPFSSALQRYRRLHVARVRDELTDAFPAEIGTDEDLLNALTAISLWPAWATWREAMELPVEAATAALARSLRSLLSGGPR

SEQ ID NO: 11642 - protein, 401 aa, Actinoplanes utahensis
MDFEFDATTEDYRKRLLAFMDEHVYPAEAGYHAGGDGWEPPAALKVLQAKAKEAGLWNLFLPGEHGAGLTNLQYAPLAEITGRSPAIAPAALNCAAPDTGNMEVLAEFGTPEQQERWLKPLLAGEIRSAFAMTEPQVASSDATNIGTRIERDGDEYVINGRKFYITGAMNPNCRIFIVMGKTDPDADRHVQQSQILVPRDTPGLTVHRGMTVFGYTDGDHGGHAELIFDNVRVPAGNLIGVEGGGFAISQARLGPGRIHHCMRLIGMAERALELMCRRALTRTPFGKPLAEQGVVQDWIAESRVRIEQARLLVLKAAWLMDTVGNRGAHTEIQAIKIVVPQAVEWILDKAIQAHGAVGTSQDTPLAQLWVAARTLRLADGPDEVHKRSLARRELNRYRSRP

SEQ ID NO: 11643 - protein, 326 aa, Actinoplanes utahensis
MKGLDLAKLQSYLDSPPLTGTMFAGGRSNLTYAVTDGTHRWVLRRPPLGHVLPTAHDMAREHRVLAALSQAGFPVPAPVLLCTDPEVIGAPFYLMQQVDGTIYRDAAQFTGVDLRQLTLTLVDTLADLHALDPEKIGLGDFGRPEGFNARQVRRWKQQLDASRSRELSGIDELHARLAADIPAGGPGAVVHGDYRLDNVLIGDDLRVNAVLDWEMSTLGDPLSDLALMLVYAGRPLLVKDGKPYAPIDLPGHPSLAEMSARYAERSGRDVGDLHWYVGFAAFKLAVILEGVHYRFTKGQTVGAGFDTVGAMVPTLIEQGHRALEGN

SEQ ID NO: 11644 - protein, 257 aa, Actinoplanes utahensis
MKRVVITGAGGGIGAALARRFAADGDRVVVSDINPDAASAVAREIGAVAVAADAAIEADVRGLIDRAYDELGGIDLFCSNAGVLTAGDENTPDELWERDFAVNVKSHVHVTRALLPRWLDTDEPKRLLITVSAAGLLTLLGSASYSVTKHAALAYAEWLRATYAHRGLIVQALCPQGVRTDMLTGGNARGSGSAALLAEGALEPSAVAGVVAEGLTDNRFLILPHPEVADYYRLRATDPDRWLGGMNRMQRGFEAGA

SEQ ID NO: 11645 - protein, 249 aa, Actinoplanes utahensis
MADQVAIVTGASRGIGFAIAQRFVAQGAKVVITGRDDDALQAAVKELGGPAVALGISGKGDDADHRTAVVDAVTATFGPVTTLVNNIGINPAYGPLAALDLNAARKMAEVNLIGTLGWVQEALRGGLGQSEGGSIVNISSVSGVRPAPGIAFYGTTKAALIHLTEELAVELAPRIRVNAVAPAVVKTRFAAALFEGREEQVTATYPLKRLGAPEDVAGTVAFLCSNDASWITGQTIVLDGGVTLTGVVE

SEQ ID NO: 11646 - protein, 420 aa, Actinoplanes utahensis
MKRTTAVFLAVLLFATACDGSSTRSGSGGGTVPGVTDSEVVIGTHMPLTGPAAAGYSKIAPASKAYFDFVNAAGGVNGRKITYKVKDDGYNPATTQQVVRELVLQDKVFAIMGGLGTPTHSGVLDFLKTNRVPDLFVASGSRSWNQPDKYPGTFGFNPDYTVEGKILGTYVKQNLAGKKVCFLGQDDDFGRDSLAGVEKVLGAVAAKQTYVTSNPNVGPQMGALKQAGCEVVVLATIPGFTALAVGTAAKIGFKPQFVVSNVGADPGTVGKALGPAAPLLEGVVSANYLPINTDDASPWIQLFKKVNAQYNGNAEFDNNVVYGMAAAYLFVQSLLAAGKNLTRDGILAAVTKNGFQGPGLVPLRFADKDHSGYGGEQLTRIEGGKAVFLGQAYTTDDADGAVQPVAPLTVTPPPNGIPAA

SEQ ID NO: 11647 - protein, 336 aa, Actinoplanes utahensis
MTDVREKPATATAPIRVTRRIPPLGYAVTGALIILALTYVLPPFRNYQLATVGAYFTVTAGLTVLTGLNGQLSLGHGALMATGAYTFALTQNRWLHLPLSFLAAVLVTTLAGTVIGLAAARLRGPYLAGLTLAVAVVVPSVTSTFDTTFNSDQGLPVALDPPPEVIPMEQWQAWLCWAGALLTAALLATLVRGRFGRDLRAVRDDETAARLAGVHIARTQVIAFVVSAACAGLSGALFAYLAQSVSPGAFPLTLSLFLVMAIVIGGLGRLIGALLGAVLLVLLPALAQSAAESSGSQHLEGNLALVIFGVVLVVVMLAAPGGLASLRFSTIFRRKR

SEQ ID NO: 11648 - protein, 292 aa, Actinoplanes utahensis
MDRFIYLTFDGLSRGAVYAAFALALVLIWRAARIVNFAQGAMAVAAVYVAYSVTDATGSYWLGFAAALLFGLLLGVAVEKAVMRFVDHASPLNGVVVALGLVLIVQGALGMLYGNEFRPVPTPFRRDAFEVGGVALLSRYDVFVFVAVGAVVAGLTILFTRTPVGLRMRAAAFAPDVSRLLGVPVGGMLTLGWALAAAAGSLAGMLVVPTELGLHPTAMDVVFVSAFTAAVVGGLDSPIGAVTGGLIVGLLLSYVSGYLGATVAPMAVLLLLVVVLLGRPGGLFSSAKARLA

SEQ ID NO: 11649 - protein, 251 aa, Actinoplanes utahensis
MSAAGTLDERYQKQRTLLRVDGLTAGYGAAPVLHDVRLRVRAGEIVAVLGANGAGKTTLLRTLSGLVRADRGSVVFDGEDLAGVRVEQMVRRGIAHVPEGRGVVTELTVEENLRLGGLWRRDRADAARALDEVYGLFPALAQRRASAGHQLSGGERQMLALGRALIGRPRLLLLDEPSLGLAPKVTAQIMALLRDLRDRTGLAVLLVEQNVRSALSIADEGIVLSLGRVATRNRATELRDDADLRHAYLGF

SEQ ID NO: 11650 - protein, 304 aa, Actinoplanes utahensis
MSTHAELELDHITVRFGGLTALDDVSLRVPAGRVVGVIGPNGAGKTTLFNVICGFVTPTAGALALDGRAWRPRPHHLNRLGIARTLQGVGQFSGLTVLENVQVGARGHRPERPDRGRAEGPGRLTQGPDRGRAEGPGRLTQEPDPGHTGGSGRLMREPDRGRGGEGGRLGRGGRFGGWERRSVREAFAALERCGVAPYADQLPGALPYAIRKRIELARALAARPRILMLDEPAGGLDTDEIQWLAGLIRDVGTTVLLVEHHMDLVMSVCDEILVLDFGKPIALGSPAEISADERVTEAYLGAAA

SEQ ID NO: 11651 - protein, 307 aa, Actinoplanes utahensis
MTQPPPRPEDRDPATPASPRPTPPPTDPLTANLIPPVDPWPAAAPPQEPYPPAAPLGGYPPASAQGGYPPASAQGGYPPVPPQVAHPQAAPGEAHPSAAYPAAYQAAHPAASQPAHPPPPYRYPAAFGGPAQVKSLRVPAVMATVGLILTILYIVILYTADPVSITLGDAPRLVLYVGIFATVIYTVVTFLVWLHRASANLWNTGHQLTWGPGWTIGAWCIPIANLIIPMMIIREVDRESRDHGPGLFAAYAVSWTVSVLLERSSRTASSGNTVHVVETVATIAAAITAILLIRRVTADQEQRFRTV

SEQ ID NO: 11652 - protein, 210 aa, Actinoplanes utahensis
MSSAYQPSMLDLMGSAEPSLEPLSGAVRHRLSAGAWVDVLPGWLHGSDAVFETLLGIDWRAERRRMYDDVVDVPRLLRWFGAGEPLPHPALAAARAALNAHYATELGEEFVTAGMCLYRDGRDSVAWHGDTIGRSATEDTMVAIVSVGSPRNLVLRPRAGERETLRFPLGHGDLIVMGGSCQRTWEHAIPKTARPVGPRISVQFRPRGVA

SEQ ID NO: 11653 - protein, 189 aa, Actinoplanes utahensis
MPSLVTPALPAGSMSERDQPMIGGDGVALRVWREADRDSVVTAYADPAIQRWHCDSMTPAEAEAWIAGWAGRWQAETGASWAIVDDDRVAGQIGLRRIDLAEATAHISYWVLPAFRGRRIAPRALHALTDWAFGGLGLHRLELNHSTANAASCRVAEQAGYPAEGIKRSEARHADGWHDMHQHARLATD

SEQ ID NO: 11654 - protein, 330 aa, Actinoplanes utahensis
MNRHFRVWRGDSSGGDLEDFDVEVNDGEVVLDIIHRLQATQAPDLACRWNCKAGKCGSCSMEINGMPRLGCMTRMSTFTADEMITVTPLRTFPVIRDLVTDVSFNYAKARETPAFAPPAGVAPGQYRMQQIDVERSQEFRKCIECYLCQNTCHVVRDHEENKEAFSGPRFFIRAAELDMHPLDDRTDRKQYAQQSQGLGFCNITKCCTEVCPEHIKITDNAIIPMKERVVDRRYDPLVRLGRRIFRRDQLEATAGSPLPAPRRAPATAETPSGQRLPEGPPVGVDGRLEIAELAAPLQGGLSPFGEDMTFPLPLERVTYHHPEEDPAKPD

SEQ ID NO: 11655 - protein, 629 aa, Actinoplanes utahensis
MTTTPERHLYDVVVIGAGGAGLRAAIEARLAGKRTAIISKSLFGKAHTVMAEGGAAAAMGNVNSRDNWMVHFRDTMRGGKFLNNFRMAELHAKEAPERIWELETYGALFDRTKDGRISQRNFGGHEYPRLAHVGDRTGLELIRTLQQKIVSLQQEDFAETGSYDSRIRVFQETTITELLLDGDRVAGAFGYYRDSGDLLLFEAPAVVLATGGVGRSYKVTSNSWEYTGDGHALALRAGATLINMEFLQFHPTGMVWPPSVKGILVTESVRGDGGVLRNSEGKRFMFDYVPDVFRKQYAETEDEADRWYDDPDNNRRPPELLPRDEVARAINSEVKAGRGSPAGGVFLDVSTRLPAEQIIKRLPSMHHQFKELADVDITKEPMEVGPTCHYVMGGVEVDPDTGAAAGTVLGLFAAGEVSGGMHGSNRLGGNSLSDLLVFGKRAGEHAAAYVDTLAKRPRPARVDVAAATEVALAPLVRTDGENPYRLQQDLQAVMGDLVGIIRREGELTEALKRLHELRARVANVGAGGGGRHYNPGWHLALDLRNMLIVSECTAKAALEREESRGGHTREDHPQMSAQWRRINLVCSLDEAGEVHLERKPVPTMRPELRDLFERSELAKYMTDEELGDE

SEQ ID NO: 11656 - protein, 263 aa, Actinoplanes utahensis
MTTTAARPGGGRARAAITARTLRTDRWWLAPLVTFLGLTAWVAYATVRVFLHRWFYVDEYHYLTPFYSPCLTDRCGAAAEFGTPLPSFWLIPEAALTLPFLLLFRLTCYYYRKAYYRAFWMSPPACAVPDGHKTYSGETRFPLVFQNAHRYAFYAAFLISIINTWDAIRAQTTGLGLGNLVLWVNVIMLWAYTASCHSCRHIVGGRLKHFSRHPVRYRLWTTVSKLNARHMQLAWITLGTLAVTDFYIMAVSAGWFSDLRLIG

SEQ ID NO: 11657 - protein, 477 aa, Actinoplanes utahensis
MSSELQIAAKVVELVRELAGRSAEAEVNVRHHALALTRFANSAIHQNVAETTTGVRLRLHLDGRTASGSTTLTGADGLRALVERTVAAARVTPPDPGWAGLTRPAALHISAGHPGSGEHSGLEFGFDEATARATPAERAERVRAFVDAAGGLETAGFCRTQYVSAAFANTAGQAVEGRTAEAAMDGIARNNGADGVARLAAARLSDLDGAALGARATAKARALAEPAELPPGQYEVVLEPTATADLLENLAVFGFNGKSYAQRQSFAEFGAEQFDPSVTIVDDPLGSRGEPAPGLPFDDEGTPARSVVLVREGITLAVAHDRTSAAEAGAESTGHASGTSRSWGPFPAHLRLEAALPGGGGTPDGPPQVAVSARPLVARMRRGLLVTDLWYTRVLDPKTLVVTGLTRNGVWLVEDGEITRPVSNLRFTQSYPQALGPGRVLGIGAESVLLPTSWGDARYASPALHLASWNVTGNASG

SEQ ID NO: 11658 - protein, 376 aa, Actinoplanes utahensis
MPAAAVTASWASDCRIDPLSVPLADKGDLLVRATAAAKAAGADQAQANYAIWDTRKWFVSSEGHRIDQHIRECGGGVTAHAIGDGEVQRRSLPGQYGTRGWELIEELDLAGNAPRLAQEARELLTAPLCPAGETTLILGGSQLALQIHESVGHAIELDRILGWEAAFAGTSWLDLSRLGELRYGSDLMNITIDPTFPGSLGSFGFDDEGTPAVKRHAVRDGVWVGVLAGRDSAAVAGLDYAGSVRSDGWARLPMVRMTNVGLEPGPHTLDEIIAATDDGVFMDVNRSWSIDDRRLNFQFGCEIGYEIKNGRRGRMLRNPTYTGIGPRFWQSMDMLSSEIVAWGTPNCGKGQPGQIGHTGHPAAPARFTNVRVGVRG

SEQ ID NO: 11659 - protein, 72 aa, Actinoplanes utahensis
MSHFDEAGAAVQAALDAGARYADARVMVCRTESMTARNGAVEDLSSDENAGLGVRALVGSSWGFSAVPDLSD

SEQ ID NO: 11660 - protein, 604 aa, Actinoplanes utahensis
MLRGVDYPGLAGRTGGFRHGAPHAVTVGADGARIVFLRSPGPADPAAALWALDLADTTERLVAPGPIDAYAIDRDARVAAFARGGRLYRADLTTGAVTALQTTEAVYDPRPDPQGVRIGYVTDPLGSATLRVTGPDGDRLLAGEQGFAWREHGGSIAWGVAGAGAPQFGRTRGWWWSPDGRQVLAVRTAGGTSLHLLDLDDGWVDVHWDRETYPHLAQVRWAGGGPLITVLRRMQQHGLVLSVDPRTGETQVHAELADARWVEPIPGTPRHLPDGRVLVGGELAHDGFDARCLFADGSLLTPPGLYVRRVAGTLPRPDGPAGAPDLIVEGSLGDPAVREVFRVRTSVGGGGPEVTRLAPAGGEVVTGGDVLVAGGRVWQGTTPAGTLRSLAAELPYHPEPVLERVTDRRLPTAVLYPGGFVGGSLPVLLDLGAGPGEQQVRAEAAAWQERQWWADAGFAVVSIDYRGTPGVAPSFEKAIHRRLADLILADLADGLGALTGKHPDLDLTRVAARGHRLGGWVALLAALRLPGTVRCAAAREPVLDWTAAPRPIAERYLGDPNDAAHVYRHHDLRDEMAGAGAVLVADAGLGLADELAWIQRELGT

SEQ ID NO: 11661 - protein, 302 aa, Actinoplanes utahensis
MVARTVSAVIARDSLPARRLLLVHAHPDDEVIGTGATMAHYASTGAHVTLVTCTLGEEGEIHVPELAQLAAGQADQLGGWRLVEWERACDALGVADRRMLGGPGRYRDSGMMGLATNGHPRAFWGADLDEAAAHLVEVMREIRPQVMITYDENGFYGHPDHIQAHRVAMRAAELAGADGPAKIYWTAQPLSVLRDGMEAFRESESNPFADVDSVEDLPFGTPDEEIAARIDGTEHYARKTAAMRAHATQIPDNSWLYGMAGDFGGEFMGVEYYTLVKGERGPGGGPHRWESDLFAGLDVAGE

SEQ ID NO: 11662 - protein, 162 aa, Actinoplanes utahensis
MGERPVRRPRRGRRMTLRVTGVVVSVAATLVVTVIELVLSVLRVGGVTGLFHGEFDVWTGTGQLIGLAIPVTVAANLALAWFAVTTVERPWAIGVPWALWTLLVLGAAGTRTAEGDYLLGGDNWVALVMILAGSLAFAVYAYRMIMKPVKEPVRPESEPTDS

SEQ ID NO: 11663 - protein, 155 aa, Actinoplanes utahensis
MRQQRWFRITVLAIALFAINAVTRLVVRFGADGTDTAQNRGSIVMFAALAVLLGGLVFVWCQRRRPSDWLPDVGFGALAGMLLTVLLGPFLSGSEPFANGGGDFFAQIWLYSGCAIAGAVVGYWVAVTLARDYRSRSLQAYSRQRTVKPRRVVRR

SEQ ID NO: 11664 - protein, 320 aa, Actinoplanes utahensis
MLRQQDVGHRVVVRRIVGVSGDRPLYTDALGELVDLTETEITLATDKGTLRVPLREVHRAKRVPPARRPHAAAVIALELAADAAWPAPVRGRLGNWLLRAADNWTGRANSALAVGDPDRPLEAAIDAVEQWYSDRGQRPLINTPLPLAAPVTAMLDERGWGSRPLTLVQTAALAPILAAPAGDGLPPVGLADSAGDDWYAMVAEHKGRLPEAALRILNGVPDRVFAHVRDADGELLAVARGAVTGPERWLGVSLVQTAPAARRRGLGRHVVRGLAQWAVQRGATRAYLQVEERNTAAVALYGRLGFSTHHTYLTREAPAA

SEQ ID NO: 11665 - protein, 409 aa, Actinoplanes utahensis
MEGLHQRELRVLRGSRFARWRLQGRQDRQGHPVRAGPAAARGRTLSALASALPDFPWDLLEPAKSRAAAHPGGLVDLSIGTPVDPVPQVIRQALTDAADTPGYPLTAGTPQLRAAIAGWLARACGASGELGVLPTIGSKELVAWLPTLLGVGPGDAVVIPQVCYPTYEVGVRLAGAEVIRSDSLTAAGPRRVKLVWINSPSNPTGRVLPVDHLRKVVAWARERGAVVASDECYHALGWESEPVSVLADEVTGGDYTGVLAVHSLSKRSNLAGYRGGFVGGDPALVADLLAVRKHAGMIPPAPVQAAMVAALTDEEHVVVQRERYAARREILRAALLKAGFEITHSEAGLYLWVTRGEDCWQTVDRLAGLGILVAPGAFYGPSAAQHVRVALTGTDERVATAADRLAEGL

SEQ ID NO: 11666 - protein, 213 aa, Actinoplanes utahensis
MAERLPTVVATGEAVREVPPELATVHVHTVARGRDREAVLQRLTERSAAVAVVLDRFAAAIERRETAGVQVHPQTRRRGEGIAEYHGSIGTQVLITDFTVLGDLLLRLAGEELTSVSGPYWQLRPGSRAGAEARRAAVTDALARAAEYAAAVGSRIDRLIDISDVPTAEGTPMMVAGARAMSETAGLELEPALQTVHARVRVTVTISEPALPI

SEQ ID NO: 11667 - protein, 428 aa, Actinoplanes utahensis
MFRARGTPRSARLDRMRTGLGHLLLRVANVNPRSVTTHSDRVLYRSIGVFILLYAVYATLGGAAFIDAGSGYRHPWFQWLVGPLVAIGVVAYDRAVVGRVPISFDQLDSTDPEHLLRRPHLGLYLGRIALALLFALLVTEPLMLARYRGEIDARLAETHSAQLGRLDAGGAVADYRARLTELRSDTENDDAAVRALADRAAGKRRDARDTYRQALADSAGSGVTHSPGCPRKGFCDHLVHRSRSLDEQAAALDRQAAGLQRDQRPERAARAAEQSRLTALLDAERTANADAVRGDAGFGARTAAMWHLVRADFWGVGVYYLGIALLMVALDCAAIGLKFASRGNAYERNEARAGRLWEHEAALIFEREVHDARTYGDATAKVIADGIEAASRDVEIAQAATRRARAVLHSAVIVDPSDIEHFRPRADA

SEQ ID NO: 11668 - protein, 376 aa, Actinoplanes utahensis
MADRRRRRACFGVADRRRRRRVSGWRIAGVGGRVSGWRIPVIHSGMTRISVVTGASGGIGRAVARRLAARGDTVALLARGEEGLEGAAEDVRRAGGKALTIPVDVADYQAVDAAAERVEKELGPIGLWVNDAFSSVFAPFVEIEMPEFVRTTEVSYLGYVYGTRAALSRMRTRDQGVIVQVGSALAYRGIPLQSAYCGAKHAIQGFTESLRVELLHEKSNVHVTMVQMPAVNTPQFGWVLSRLPRKAQPVPPIYQPEVAARAVEYAADHPKRREYWVGGSTALTLAANAVAPGILDRYLARTGFKGQQTDQKRSPDQPVNLWEPADENRDAGAHGAFDDRSSDRSAQLWASQHHGLLAAVGGGLLAAGAAWALGRR

SEQ ID NO: 11669 - protein, 199 aa, Actinoplanes utahensis
MIRRDVLTSQGGTPPEGRIELSAADTEEPTWEVRAPRKRRFDRRSRTILGVAALAAILANAGAAWAYWKITQPRQVAGAGPVVVDMVLRGRTDLNQILRPGTTGNLMVTVTNDKTVPIRITSITVGPGAVLADPDHRGAGCTGVAVQVNQAAFRVSWEVARNTIGAFTLDDALTMPRDVPKACAGATFTVPLRAKGVQR

SEQ ID NO: 11670 - protein, 204 aa, Actinoplanes utahensis
MRRRTALALMATIVGGAIAAGSGLTAWATWAVSATPATGTVRAERMPVVRNLTVMFTGGKLTFAWDRTTFASGAAVGGYRVYASGGSVPVCSTTALSCGFAPQGKPQGTFVVRAWAGGWVGDDSAPVTYVPGKKTVTGAAGVAAQPPVTGGTPGAPAPQATAEAAATTSPAAAPVAKAPATAPDSSAPVAAGTPATVESAASPQ

SEQ ID NO: 11671 - protein, 162 aa, Actinoplanes utahensis
MRPERIRSLPFRNGRLRSGQWWAAAAGVVFVCAGVAAAVRAPEPEPVSRDTPVFGIRADSVSGLYPGAVRRSRVTLLNPYPYPIVVRSVDAQVASTSRRRCRASARNLRVERFHGRLPVTVPARGRAVAGEFEVHMPGTVDDACRRATFRLTVTGTARTVGR

SEQ ID NO: 11672 - protein, 164 aa, Actinoplanes utahensis
MFGSSLRARPVIVVAVVAGLIVTGGVAWAQWRLSGSGKASATAGTVTNLQMTAQPLPNAPLYPGKRTALSVTVHNGNSFPVLVTLIQAGSGPVTADAAHRTAGCLTTGVSLITPALAVSWPIPARADETFRVSNAVTMTNASDSACRGATFTIPLAATGRSNAA

SEQ ID NO: 11673 - protein, 164 aa, Actinoplanes utahensis
MRKMTKRSAVVASAVAVAVVGAGAAWAAWTLTGTGSATARAGDVQTLTVSGVSSTPLVPGGNADVKFHVVNPNAFPVLINGIHFSNITASGDCNAGSVTAVSTAPLPTAAGALELAAKDTVGGGDKKDITYAGSLHMSNAATDDCVGATFTFDVLLDAKSNAAA

SEQ ID NO: 11674 - protein, 267 aa, Actinoplanes utahensis
MNAETIATLSARSGYRRRVRSSPPDDDLNTAAAGSSLTGWEFAWLDGLAVAAEPSWSYVEIARPLVRPARSLLDLDTGGGELLAELAPLPACTVAVESWARNTPIARERLAPFGVEVLTELPAGEDEFDVVLSRHGRLPAADIARLLKPGGVLLTQQVGSDDLAELNDALGAPPPHPRRWDAEVAAAALTAAGLRVTDVREEHPALAFRDIRAVVHHLRTVPWQVRNFSPQRYERELARLTAVIRARGEFTARAHRFLLQAQRPTEA

SEQ ID NO: 11675 - protein, 346 aa, Actinoplanes utahensis
MRTIGAAARASGLTVSALRFYDSAGVLVPAVVDPDTGYRRYSAEQIRAARLIAGLRRVGMPVAEISRAVADLGHPDRVRDRLDAHLARLEAGLADARTELLRLHTLLDLEEHLMTRITLSAADLRATLAAVRFATTDPIPGTPFPGGVLLEAADGTLTLVATDRYRLAVAATPAAVEGSPARHYLPLDFVDRLLGLTTGTVTLDVDDDSLRATAGDLDLRAAPVAADFPDYRRLVPGPGRRIGVDPAELRELLADAPEVHREHDGATYPVTILAEDPDGGLRLAAESEWSTDAGRHVAVNREFLLQAADAGGPGQLLLELDGPVRPLIIRSAADESRFSLLMPVRG

SEQ ID NO: 11676 - protein, 200 aa, Actinoplanes utahensis
MLTSAVAGFAASAVLIIAIGAQNAFVLRQGLRREHVLPIVLTCALSDVLLISAGIAGLGAIIAAQPRLVSAIRWIGAIFLLAYAVLAARRALRPTGSLDPTGRAPATLRATLLTCLAFTYLNPHVYLDTVLLLGSVAQQHAHRWWFGVGAALASLTWFTALGLGARRLAPLLARPNAWRVLDGAIALVMAALGGTLLLQA

SEQ ID NO: 11677 - protein, 275 aa, Actinoplanes utahensis
MDQVQLQTFQAVVEQGSFEAAARVLHVTPSAVSQRIKALERAVGQVLVRRAKPCTATEAGQALVRFAGQVALLEREALAQARGGTRVSIVVNADSLNTWFMPVLTRVPGATFEIHTDDQDYTADLLRSGTVMAAVTAENVAVQGCRVEELGAMRYLAVAAPGVDFATAPMIIYNRKDRLQHRFLELAGLTPRDPVVHYVPAAAAFNEAIRLGLGWGTVPEQNARALLDSGEYVQMFPDRFLDVPLYWQYWRIESALLNTLTAAVREAAVSSLRTG

SEQ ID NO: 11678 - protein, 363 aa, Actinoplanes utahensis
MSTRARVNSTGSTSTSGVSGLAMCAPYKAVPSTGRTRSGASPPSRVHAVDTAISTSPAWGIGLATVTADGQVLDTWFPAGFLGLGEEPAEAPALPAGLTGPKLLPGLATVEVRATVKSLAEPIADTAEAYLRLHLLSHRLIRPNELNLDGIFGLLANVAWTSAGPCPPDRVDELRFLERAAGRHLAVYGIDKFPRMTDYVSPSGVRIADADRVRLGAHLAPGTTIMQEGFVNFNAGTLGTSMVEGRIVQGVVVGDGSDIGGGSSIMGTLSGGGKEKVRIGERSLLGANAGVGISLGDDCVVEAGVYITASSKVSLPDGRVVKAIELSGVSNLLFWRNSVSGALEARPRKGTGIELNSALHAND

SEQ ID NO: 11679 - protein, 369 aa, Actinoplanes utahensis
MRPVLGTALYGAHMANPLTPDVLVDPVELTRALVDIASVSRDEKVIADCVQDVLREAGHLTVDRVGNTVLARTDLGRAQRVVLAGHLDTVPINGNFPSTVVDDLIYGCGTADMKSGVAVALHLAATLPDPAYDVTYLFYEAEEIEHEFNGLNLVAAGKPEWLRADFAVLLEPTYGVVEAGCQGTMRALVRTHGRRAHTARAWRGVNAIHAAGEVLRRLEAYHPRTVTIDGCTYREGLNAVGITGGVAGNVVPDECAVEVNLRFAPDRSQAQALDHLNEVFAGFDLAVTDSAPGALPGLDATAAREFLTAVGVAPAAKLGWTDVARFAALGIPALNYGPGDPSLAHAPDEHVEIGQIRDSAATLHRWLAG

SEQ ID NO: 11680 - protein, 255 aa, Actinoplanes utahensis
MTESTNERPPAAPQRHRGAVTLRRDAVPPSTADEKLLDSHHRGEWKTKDAWRALRILSEFVEGFDTLADLPPAVSVFGSARSRPDSPECELATRLGAALAEAGYAVITGGGPGVMEAANRGATEAGGMSVGLGIELPFEQGLNDWVDIGIDFRYFFVRKTMFVKYAQAFVVLPGGFGTLDELFEAITLVQTRKVTRFPVILMGVDYWSGLLDWIKRRMLDDGKISEADLGLIQVTDDVTEAVRIIVAAGAAQAAD

SEQ ID NO: 11681 - protein, 185 aa, Actinoplanes utahensis
MAAIGVFCGSADTVEQRWLDLAAETGRALGERGHTLVSGGGRVGMMGTVADGARAGGAHTLGVIPQCLVDGEVADTASDELLVTDDMGARKNLMIERSDAFLTLPGGLGTLDELFEVWTTATLRVHRKPIVVLDPDGFYDGLLGWLTGLVATRFVRPGAMETVRVARSVPEALDVIETLLVAPAE

SEQ ID NO: 11682 - protein, 1000 aa, Actinoplanes utahensis
MSTPAPHSPVRRPDYRLVRRPRPAAPELRADPVQTRVAAHTRGPLLVVGGPGTGKTTALVEAVAARIAEGVDPERILVLTFGRRGAATLRDRIEARVADVPGRIVHEPLVRTFHAYAFGLLRRAAAERGEPAPRLLTGPEQDLIIRELLAVVEDEDAADTIGWPESLRPALPTRAFAQQLRDLMQRAAERGLGPLELAGYATRLGRDDWSAAARFLREYVEVLSLRDATTRGSVAYDPAELVRAASGLLTDEPDLLAAERRRLAHVFVDELAETDPAQIDLLAQVAGGGKPLVAFADPDSSIFGFRGADPEVVAHFPDRFRGPDGSPAPTVALHTNYRAAPALLSATSGVARRMRGPIAHRPMFPPPPAAPAPVSGSAAPAPVSGSAAPGPVVAASDSAAVGSGAVSGPVVAVSESAAVGSGSVSGPVPAASEPAAAGSAPVDGVPAARVPAAGPGPVPEAGISADGPVAGAVVRTFRSPAAETAFIAHALREAHLLYGVPWSRMAVLMRSATLQQPSVQRALAASGVPTVIHAEDLPLHLQPAVAPFLLLLRCALDPERLDEEAAVALLHSPLGGADPLAERRLRQGLRALALAAGDRRPSGELLVDAVRDPAGLDLVERRWARPAQTIARLLTVARTAAAAPAASAEDVLWTVWRASGLADRWYAMSTGNRRPSDAAQSGRARQWRAEAADRDLDAMVVLFDAAARFVDRLPGAGVGVFLEHVLGQDLPADTIAPSADRGDAVRLLTAHAAKGLEWDVVVIAGVQEGIWPDLRLRGSLLGSERLVDAAAGRPATGSEAIVAQTSALLDEERRLFYVAATRARRRLVVTAVASASSGGAAIEEQPSRFLTELAAPGPRPGDPGAGPPLPPGSTNPDDPGPPLPPEPTDPDDPGPADDDFPPDPDTVPGESNGADGDDRNAMRDGGAARDGGATRDVGTAGDGGAARDGGAGESGAARDGDAAQQHAAAPGGEAGQDGSAGQDGDGAAGQDGAAGQDGDG

SEQ ID NO: 11683 - protein, 310 aa, Actinoplanes utahensis
MVASGETPSRRRAAAAELARLAAAGVPGAHPDEWWGLRPLSDDRPLVDDGEPVKVTPSAMESALRCSLRWLLERHGGAPPAGPAQGIGNLVHAAAMLAEDAHADRERLVEYVSARFDSIELAARWMAGPEQERAEAMVDKLLRWLAANPRRLLAIEHEFTVRLADERRPVQLTGRVDRLEIDEAGRLVVIDLKTGKSTALSADVAENPQLAGYQAAVDAGAFADYGTDSGGAALVQLGPGKDAREQMQVPITEATDPQWAYQMVRRTADTMAAATFSAVANSRCRVCPVRTSCPVSGKGRQVVEPPKDQS

SEQ ID NO: 11684 - protein, 1221 aa, Actinoplanes utahensis
MRAAAGPRFTPADLAGLLRLPPPTPEQTSIVAYPMKPLLVVAGAGSGKTETMASRVVWLVANGYVHPGEILGLTFTRKAAGELAHRVRTRLGQLIRRIGRDDGFAGEATISTYHSYAARIVTEHGLRGGFEPSARLLTEAARWQIVDSLVRAYTGEMTGLNRAPGTVTDDVLSLSAELAEHLRSPDDLAAWTGRFFAELQSFPGRMYKDVSEVLRRQQHRLTLLPLVRLYEQRKLDLEAMDFGDQMSRAAIVARDHPEVGEIERGRYRVVLLDEYQDTSHAQVVMLNNLFGGGHPVTAVGDPCQSIYGWRGASAGTLERFPTEFPDSGGHPAWVHSLTRSWRNRPEILRVANTLSAPLRAQVGVLQPAERVAEAVGGRTVTCALLPTYAREASWIADQMLTAWRIAAGMPKALPEEIPLERRPTSAVLVRVRSQIPVLEEELRARGLPVEVVGLGGLLDTPEVRDVVCTLRVLADPTDGASLLRLLTGARWRIGPRDLVALHRRSRAIAAARTPVDEPEGVLADRLDDATLIEAMADLGTPHQYSTEGFLRLAAFSRELSALRQRLDQPLPDLLADIERTSGLDVEVAVRGWAAGDAGLARAHLDALGEAATRYVNENEAGTLTGFLAFLAAAEEEERGLEPGQVDVVEGAVQILTAHAAKGLEWDVVSVAGLCKGVWPGLVRASDHYLGGIGVLPFPLRGDASGLPELDLEEAVEQKDVNNALGGFARSWREHDEREERRLAYVAVTRPRRLLLCSGYWWGDGVKRPRGPSVFLDEVRATCADGAGVIAEWAPEPAPGETNPSEEVVATAEWPADPLGVRRPAMAAAADLIRRMIADPDASAAAAFADLATENPEVAARAGLAADLVGIAGPGSLPVRSSQDHQLAVRHEPPAVPPGSAVPPGSAVPPGSAVPPGSAVPAGSAESLASGDGPGSVGPAGSPEAGVPAVSSAPSAAAFQAADGSGTVSASRDRAGLLAAAAAADRVAAAADPDIARWRNEARLLLAERDERTRHGGPIEVALPPHLSVSQLVVLRRDPQSLARSLRRPLPQRPAPHARRGTAFHVWLEQRFGAARLIDIDELPGAADDQAAGDEELAELQEAFLTGEWADRTPIDVEVPFATTIGGVVIRGRMDAVFADPGDRFDVIDWKTGRRPTGAEAEAAAVQLSAYRIAWATLAGVPITRVRAGFHYVREQVTVRPTDLLDVATLTALITEIPEEAL

SEQ ID NO: 11685 - protein, 140 aa, Actinoplanes utahensis
MLGIDMARQLQAAGLTWKPRLGDRFAIPDRDLDDEVFVLSNMTIQVHDRPEGRILGFNGTTEWALDDVAIDETIWLPREDQLRELLGGTFRSLDRDGGHYRVSIDLLGEALTFAGPTAEAAYATALRHLLTAAGAAQPLP

SEQ ID NO: 11686 - protein, 118 aa, Actinoplanes utahensis
MGKSAPGALCRNPGFSGTGDQYGDTSPAECGSYYLVHAHNGRERSTVEETIMVTGVVKWFNADKGFGFITPDDGGADVFAHFSAIQMSGYRSLEENQRVEFEVTQGQKGPQAANIRSV

SEQ ID NO: 11687 - protein, 278 aa, Actinoplanes utahensis
MTTSQHHHRVRRRPGVHGETRWTKCHPAQSVPRNVRYRAAMELVYPPVVALAKTMFRVLDLKIEVEGGEHIPTTGGAVLASNHSSYLDFIFCGFGAQPAKRLVRFMAKKSVFDHKVSGPLMRGMRHIPVDRKAGLGAFREATTALENGEIVGVFPEATISESFTVKELKTGAARMAQEAGVPLIPMAVWGPHRLWTKGRKKELTKRHVPVLIKIGEAISMPEGATAEAVTVILKQRLTSLLDAVQRAYPEKPADDGDRWWLPAHLGGTAPLPRPAAAV

SEQ ID NO: 11688 - protein, 295 aa, Actinoplanes utahensis
MSEPFPQQSAWSRPGGAWSSGTVTGIGVPPQSPPPPPASPEPSRRSGPERQRRQLLIFGGVAGLILSGGLIVLLVIVFSGDDPFGHRAHAPTDVRPPLAQACPAPTDPPGAAPAPAPSAPPAATGARTVDREAGISYRQYGAPWRVWNQVWRAGTLKVNYKVGQHFVTETYSAGDYHASILSAAVPAADNDAVTLDLQCVGRQVAADVRANYYPQPNTLEPLRDEVTTLGGRPAYVSEFRLHFHAAGLTATSELSAVAVIDVGKPSAAVLYVSIPGTHRQFDYVIDDVLSSVRPL

SEQ ID NO: 11689 - protein, 313 aa, Actinoplanes utahensis
MPTEPLSSARAALEGTFAPDDGYGPLPQKIKTLSEQEVSGLDALDLEPERDRGNLGLRIWKSAWPKLAAIGIVLLAWEIAYVSGWKPSYVFPSPTDVFPQLWDLVTTADFWDGVRLTMTRAITGFALAVAIGTVIGAAVSRFAPLRAAIGSLITGLQTMPSIMWFPLAILLFQLGEKAILFVVVIGAAPSVANGLISGIDYVPRTWLRVGQVMGMSGFDRYRHLILPASLPSFVSGLKQGWAFSWRSLMAGELLVIVPGTVSIGVRMQNARDLADTPLVICYILVVLIIGICIDQLFNAADNALRKRWGLTGS

SEQ ID NO: 11690 - protein, 247 aa, Actinoplanes utahensis
MNILEIDNVSKQYGSGSTALLALDRVSLDVQQGEFVCLLGASGCGKSTLLSLVAGLDKISGGTLNTGGRKVALMFQEAALFPWLSVAGNVELPLKLQGIDKAERRKRAAELLEIVRLGGFGDKRPHELSGGMRQRVALARALAQNADVLLMDEPFGALDAMTRDILHDELERIWREQELTVLFVTHNVREAVRLGDRVILLSSRPGRVIEDFKIGHPRPRRIDSPEVSGQAAEITDRLRAEVARHAH

SEQ ID NO: 11691 - protein, 360 aa, Actinoplanes utahensis
MRSRTLRALALATAALAATTALAACGSDDDSSKKADTPAGTPAEAKTIKLGYFPNITHAPALVGVNKGLFKDALTGTELQTQTFNAGPAALEALLSGAIDATYIGPNPAINGWAKSNGQALKIIAGSTSGGAGLVVKPTINGPADLKGKKIATPQLGNTQDVALRAWLKQNGLNADTNGGGDVSILPQDNATAVQAFAQGAIDGAWVPEPNLSKMVLEGKGKLLVDEATLWPNQQFVTTHLIVSQKFLKDYPGTVKKLLQGHIAAVKYINDNNADAQKAANAQIQALTGKALKDDILAAAFKNLKFTNDPIASSLYTSAQHAEDVGLLKKVDLKGIYDLGPLNDLLKAAGQPAVSDAAGA

SEQ ID NO: 11692 - protein, 137 aa, Actinoplanes utahensis
MYVSARTDYAVRAMLAVTAAHPRLVKAAGLAAAQDIPLSFLQGILLDLRRAGLLHSHRGVDGGYALARAAEEITVGDVVRAVGGALTTVRGLPTATATYHGAAIALHDVWIAVEAAIEGVVDHRTLAELSTTSIKKN

SEQ ID NO: 11693 - protein, 435 aa, Actinoplanes utahensis
MASRIQIPATKYPVERFTLANGLRVVLSPDRSAPVVGVAVVYDVGIRSEPEGRTGFAHLFEHLMFQGSANLEKLAHFRHVQGAGGSFNGSTHLDYTDYFEVLPAGALERALFLEADRMRGPRLTEENLRNQVDVVKEEIRVNVLNRPYGGFPWLKLPPVMFRTFPNAHDGYGSFEDLESATVDDAQGFFDRYYACGNAVLSVAGDFDVAEATAMIEKHFGDVPARPAPVLPAFDEPGLDGERRESYVDRLAPLPAVAAGYRVPDPIAAFDAYLPFSVLAEVLTDGDASRLVERLVQRDRTVTNIGGYLGFMGDEYQVRNPTALLLQAHLPPGGDAGKVLRTVDEELDRLAADGLKPGELERTQARMAARALQSTDEVLGRALPMAVLELQRGRPELLNELPKLISEVTAEQIVDAAATLRPERRATVEAIPGATS

SEQ ID NO: 11694 - protein, 438 aa, Actinoplanes utahensis
MTEILPDLIPDTELTLPPQAERKLPNGLTVIAIRRAAVPLVEVRLRVPFGRAPLAPATLLSQALFTGTETMTMLDIAAEVQAVGGSLAAGLDPDRLMISGNALADGLGRTLEILAGVLTGATYPADEVLTERERLCDNLQVMLSQPAHLARVALLKRVYADHPYAVQTPAPEEVRAVEPDALRELHADRVRPAGSILVLVGDIDPDQAIDLAEKTLGGWTGAARDGDLPPAPALRPGALLLVDRPGAVQSSLRVALPGLPRTDPGYAALALANMLFGGYFSSRWTENIREDKGYTYGPHSAIEHFTAGSVLVAAAEVATGVTGPALLETTYELGRLASLAPGEEELEQARRYALGTLRLGMSTQAGLAGLASVYAGFGLRLDYLRQHSAALAAVTREQVAEVAARHLAPSRAVTVVLGDAEQIEPQLAALSTVERDPR

SEQ ID NO: 11695 - protein, 328 aa, Actinoplanes utahensis
MTTPEQPDFGGEQPGTPPLARTTLDRAADRRKDDAWLAEAWTRGLVLVVDLAQGGRALVTDRGDGGVTLVLVPSAAAPDAEHWFLGVDPDGTPLWTMDATPPPAEGARPATLREIGHLLDDRDAGLFTAAAALTNWHAGHRFSPRTGKPTVAVEAGWARADPDGKLMWPRTDPAMIVVVHDGVPGPAGRCLLGHNSAWGRAADGLTRFSCLAGYVEPGESAEAAVAREVREEVGIGIGALRYEGSQSWPYPGSLMLGFLAVADPAQPLRLDPEEIDEAHWFSRDDIAKMIAGGYVHPDSGVPMSLPMRSSIAFYLIEKWLTAGAGDHG

SEQ ID NO: 11696 - protein, 293 aa, Actinoplanes utahensis
MTQVEAPAWTPMSAEEREAFDRDGYIVVPSVLSESEIEAGRAAILGYYEKAKETGELSATGALHRLSPVNYVPELAFLLDHPKAFKYIWSLLGWNVHVYHSHIDVHPQLHEQQKQWWHWHQDGGRQNREIETDPRPMLSVKLAYWFSDVSETGRGNFTVLPGSHKTNWLPGPPSRGVPWPAPEGAVQITANPGDLVVFDRRIWHARSDNYSDITRVGAFFGYTPRWIAIRDEVADLPNKPEWATMTEVQKQLLGGFGNGDGDHQWGHYPATTPLYGELKERGLLDSSIPALIP

SEQ ID NO: 11697 - protein, 104 aa, Actinoplanes utahensis
MTPPRDVVRDGVVPCDPYPKEPSPMLTMYSTSWCGYCHRLKSQLDREGIAYEVVDIEQDETSAAFVRSVNGGNQTVPTLKFDDGSALTNPSIVQVKQHLATLSA

SEQ ID NO: 11698 - protein, 713 aa, Actinoplanes utahensis
MRTETVLAGLDPEQRTAVTAPAGPVCILAGAGTGKTRAITHRIAHRTLSGEINPRHVLAVTFTARAAAEMRSRLTALGAGGVQARTFHAAALRQVRYFASRLLAGRGMPELMESKVRVVGLAAARAGVRADRAVARDLAGEIEWAKSSLVEPSEYAVAAAKALREPPFEPARVAEVFAAYESLKRRQGVIDFEDLLRAAVWGIEDHPDVADQIRAQYRHFVVDEYQDVNPLQQRLLEAWLGDRDDLTVVGDASQTIYSFTGATSSYLIDFPRRWRSAVVVRLVRDYRSTPQVVGLANAVIRQARGTEARLRLELEGQRPPGPEPELKVFPDEPGEAAAVARRCRELIGSGTPASEIAVLFRTNAQSEAYEEALAEAEVPYVVRGAERFFERAEVRQAMVALRAAVRSIPGETPLVEAVVEGLAATGWRRGQPPPGGAAREQWEALAALVALAEEYAAEPAVLPIGEGGRVQREVSLAAFNEELARRSEQQHAPTVAGVTLASLHAAKGLEWDAVFLVGLADGTLPTTYAKTNEQLEEERRLLYVGVTRARQLLWLSFGQSRSPGGRARRPCRFLPQPERATAGAGRPSAERSRKADRRPPKVSSCRICGATLLAGADRKLGRCPTCPSDMDEDLYERLQRWRASTAAELKVPAYVVFTDATLVAVAERRPTDPAQLLAIAGIGPRKLGQYGEAVFALVAGAGPDDLGRKNFEN

SEQ ID NO: 11699 - protein, 101 aa, Actinoplanes utahensis
MRINTMLMRPSMLPSAVCAPSALLPVAAPSALLAAERVLAPQAHQVFSQSQAELGKWAVERVLASGVKGSTGINGTTGFKGNDSVKRYTDGNGVPPRGRPV

SEQ ID NO: 11700 - protein, 120 aa, Actinoplanes utahensis
MSLALAPIDITVDIEANLPCRKFDPDLWFSDSPAQLELAKSLCGDCPLRVECLAGAVERSEPWGVWGGEIFERGAVVPRKRPRGRPRKADVARDAELAVEVEERLAANGLDSRNSVRLAA

SEQ ID NO: 11701 - protein, 448 aa, Actinoplanes utahensis
MTDIPRRAASRTAKLAALPLGFAGRTALGLGKRAVGIAADVISADIQQRTAEQLFSVLGQLKGGAMKFGQALSVFEAALPEEMAGPYRQALTKLQEAAPPMPVANVHKALAEQLGPDWRESFAEFDDSPAAAASIGQVHRAVWKLPPARKNGKPKLLPVAVKVQYPGAGEALVADLKQLSRLAGMFKIIQPGIDIKPLLAELHERVVEELDYEMEAETQRAFAAAFHDDPDIFVPRVVASAPRVLVTEWVEGTPLSSVIAGGTVAERDEAGRLMAILHFSAPARAGLLHADPHPGNFRVLPDGRLGVIDFGAVARLPEGHPEPIGRLVRLALDGDAEGVADGLRDEGFIKRDEPIDAEAVLAFLRPMIEPVAVERFRFTRTWLRGEATRLANPRSPAYQLGRKLNLPPSYLMIHRVTLGSIGVLCQLEAEAAYQEILEEWLPGFAPIA

SEQ ID NO: 11702 - protein, 213 aa, Actinoplanes utahensis
MGPADLPGSPLIGTDLGSPLHTAVAAAVRRAVPGTQVCEVRRAPASLVVQLAHDQPVALLAAAHSTRRQPHLAVHIRDGAAVIGPFVPAAGRPCLHCLDLHRRERDPEWPGLPGTGGVGGPGGTEPCAVATVLAAAGFATAEALTFLDGGTPDTLGAAVEISAPGRTRRRTWPPHPECACGARARRSPIHLRPSAATQTGLPKRAECGGSVDP

SEQ ID NO: 11703 - protein, 125 aa, Actinoplanes utahensis
MDNKSAPQPGSDNLSPMTHPPLPRAPLARPTLIPGLARIWRAPDELQLGLDPARAVRLELPDPRLARVLDLLDGNRPERQVLLHAADLGVAPAETPPAARPAAPGRPGAAAVRTAPGRPAQRRAS

SEQ ID NO: 11704 - protein, 52 aa, Actinoplanes utahensis
MAETTYNGYCVKCKEKRDFQGNVEVSKTGMNMAKGKCPVCGTTMNRILGKAK

SEQ ID NO: 11705 - protein, 176 aa, Actinoplanes utahensis
MARVRKPVVEVRRSQRRRRTVSAYRDGERVVVLIPDRFSRAEETEWVERMLARLAAREERLRHTDDELLARARRLTGRYLAEYAGLVAPASVRWVTNQNGRWGSCTPDDATIRISHRIQEMPDWVVDYVLLHELAHLVVPSHNARFWELVNRFPKAERARGYLEGVAAAGSLVMAE

SEQ ID NO: 11706 - protein, 198 aa, Actinoplanes utahensis
MTRRVVVAMLVPVPWSPPGVDPAAWRGALAEDVADLLARLAQAEAAIAATAQDRALAEEIAWPGMRIYEIPQPTVLPVLRAAAADGFEQAAVIAADAPDVPGMILGKLLRPLESRAVAVSPGGPGGGLLGVAASLPAPDWLPDHDLDTASAQSLRRSAPSPGEVTSTPPWRRLRGPADLATLDVALEGWDNTRALLDT

SEQ ID NO: 11707 - protein, 431 aa, Actinoplanes utahensis
MPDIPFGFSLPGAQPPDPSDPQQMQQFMAQLQQMFAAPGSGPVNWDLARQVAASQLSASGDPAVNMFERHQVEEALRLADLWLDPVCALPSGIHKAVAWNRNEWIYNTLDVWKKLCEPIAGRMVGAMGDLVPEEARAQLGPMQSMVATLGGALFGGQLGQAFGQLAAEVLSAGDIGLPLGPAGTAALVPANIKAYGEGLELPEDQVRLYVALREAAHQRLFGHVPWLRAHVLSAVETYANGITVNREAIEEAMGRVDPSDPESMQAMALEGIFTPEDTPQQKASLARLETALALVEGWVGHVVDQAAGDRLPSVAALGEAFRRRRAAGGPAEQTFAALVGLELRPRRLREAGALWTAVAEARGAAGRDALWDHPDLLPTDEDFADPEAFARTQSDWDISELEGLAGNPEPGPDAPEPGTDTPHSGPDDTEK

SEQ ID NO: 11708 - protein, 343 aa, Actinoplanes utahensis
MRRRGVTVILGALITALLAAGVMVAPLPYVVLKPGPTVNTLGSAEGTEVIQVTGAKTSSSAGELRLTTVNVQSHVELVWAVQGWLSHQDAVVPRDLIYPPDQSEKQVQEQNAQEWKQSQTSAETVALRELGYPVQTYVRKVTAGGAAAGVLQENDVITSVNGTAVTGPGQLTSLVTAQPAGSRLAVGYTRAGRAGTAEVTTKAADDEKKTPRLGIEIGTQQPHPFTIKIDLDKIGGPSAGLMFTLGIIDKLRDDDLTGGKVIAGTGTIDDDGNVGPIGGIPQKLVGASKAGAKIFLVPKDNCAEALRNAVPGLPMAKVATVDDALTALKTFTSGGTPTPCSAS

SEQ ID NO: 11709 - protein, 1007 aa, Actinoplanes utahensis
MRNSPLPRMSRRGRVTVGVLVGVFILFTLLGWGIDAYTDYLWFSEVDFANVFSGVLVTRLLLFLTVGAVLALIVGANLYLAYRLRPLLRPHSAEQATLERYRMVLTPRLGTWITVLSVIIGFFAGLSAQSRWADWMLFRNAQPFGQTDPQFHVDIGFYIFDYPLLRYLLGLGFTAVVLSVLGALAVHYIFGGVRLQGVGDRMTTAARAHLTTLVAVFVLLKAVAYVLDRRALLLEQHVSPGLYGAGYTDVNALLPAKEILAYISIVVAVAIIVFSNAVMRNLVWPGVSLALLGISAVAIGGIYPLAVQNFQVKPSLSDKERPYIAKAIEATRDAFDLNATKVTDYTPVTAANGSTPPPANLADDTSAQNVRLIDPQLVSQAFTQSQQSRSFYDFGEKLDVDRYTIDNKTQDFVVGAREINDEKLSAQQRNWLNRHTVYTHGYGLVAAPANKVCEGAGLPYFVSGFLGSNTSANCSAPTDELEATQPRIYYGEQSTEYAIVGQTDKSRSVEFDRPKERDKNAQGQDEDKEASDPFTYDGKGGVAIGSFFRRLVFAIKNTESNFLLSDAVNANSKVMYIRTPRERVEKVAPFLTIDGDPYPAVVDGKIVWILDGYTTAQTYPYAQKINLANETRDETTGAGAFPLARDDVNYMRNSVKATVDAYDGTVKLYEFDTKDPVLKAWNQAFGGHLIIPKGDTPADLIKHFRYPADLFKVQRNLLTRFHVQDPQTFFTGDDFWQVPNAPDAPQAGVKQPPFYLNVKLPVQSATTFQLTSGVTPNGRDNMAALISASYDTTGAPQLQVLKLPNNSVTPGPVQVHRLMTNNAGISQQLFALNRNGQTVLYGNLISLPLQQGILYVEPVYVRTTAAGAAPLLQKVLMSYGDGSNVVLENNLQDGLKALAAAGKNNNGGTGTGGNTGTTPPASGTGPPVLSGDLASAAAAVDQAIENLRNAQKSGDFVAQGNALKALDDAMSRFQQASQAKGGTTTGTGPSVTPSTAANPAPSASAGG

SEQ ID NO: 11710 - protein, 694 aa, Actinoplanes utahensis
MRLRRGLIISGLFSALLLAGTSGVHPAAGQADAGHLHGDEADEIREHMALDLADTPISEIERRTAVNAARIQRDTGHRPGTPVSRVAVSADPGRSGSWSPVVGTPVVPVFDAVLPNGKVLIWDSVGDNAAESYPDHDFTRVMVWNPADNTYKRVDLQGANIFCAGFAHLPDGDILVAGGNADSALDGTVWTHIFHWQTETWTRGENMAVGRWYPAVAETANGEEVIVGGGPKTAEVYQSDGALRPLTAGPTYAARVYPFLGSRPDSQLQLFGPPTTSYTVTTSGNGVITATGTRDAVARDYGGFATYDVGRTLVTGGGNLTEGGVAQVPTRTSVVLNTTGAGATVTTTGSLSTGRRQLNTTLLADGSVLATGGLTSTRKSPLVDLDSAATAAERWDPATGAWTVLAGAGRIRQYHSTAALLPDGRVLTGGGGVCGICTTVGYLEKNIEYFSPPYLYRQDGSGRLADRPVISAAPAGVDIATPFAVTSPQASSIRKVALVGLADVTHGIDQGQRYIPLRFSAAGTTLTVTGPPSGGVAPPGYYMLFVVDAAGVPSVAKVVKVARQPNPLMSPIRSVNGGDRCVDVPAAAVAIRTYLQFYDCNGSKAQALTRVPADDTLRVMGNCLDVPGGNFASGQRIWTYTCNGSASQAWELGPGGVIRPVGHPTLCLRPVTADNQAEIQIISCSRSLLQKWRW

SEQ ID NO: 11711 - protein, 227 aa, Actinoplanes utahensis
MQQTARTSRRRVISFTPPIVAATTRRFPGNLRRPQTVGMDPELTTLLDGIGSRLRRIRQDRGLTLADLAAATGLSVSTLSRLESGGRRPTLDLLIPLARTYRMALDHLIGAPPTGDPRAHLTPHRTEPRTGNPSVVVPLTAYPGRLQVFKQILGPGQRPPTPVTHPGHAWFYVLSGTVRLLRGPVESVLQPGDVADFDTGEPHWFGPAGDGPAEILHLYGPHGDRPA

SEQ ID NO: 11712 - protein, 457 aa, Actinoplanes utahensis
MTRRRLVLAVCCTSIFLVGLDTTAVNVALPAIGRDLRLGLPELEWAVDAYTLVLAGLLIGSGALADRIGRRRVFRLGLILFGLGSVGCALAPGLGALIAARVVQGVGASMLSPVALAIVVSVITDPRERARAIGVWAAVFGLSMAAGPVLGGALVTGLGWRPIFWANLPIIVAVLAYPLPESRSPRPRRLDLPGQALLIVLTSTVVAVLIEGPRAGWWSGFAMAAYAMIPAAAATLARVESRRAEPLLDLSLFRRPPFAAAVGGAVVVFVALNVTLLLGTLYLQRARGLSPIEAGLVTLPMAVAATICAPLSGRLVGRVGPGLPLRLAGAGILLSGVLLAGVDRDTGLPVLLVAYLCAGIGIGFANAPITNTAVSGLPPERSGVAGGIASTARQVGAALGIAVAGGLAGSPRAGWALVAGCGVLILLLSAIRPGSGARPARTVASSAPRPSVAGPMR

SEQ ID NO: 11713 - protein, 482 aa, Actinoplanes utahensis
MTISETVTPTPTAAGGAEHRWTPRLWGVLAVLCAVLFLDGLDVSMVGVALPSIGAELGLTTTSLQWIVNGYVLGYGGLLLLGGRTADLLGRRRVFLIALGVFTVASLIGGLVDDGGLLIATRFIKGLAAAFTAPTAMSILTTTFAEGPARNRALSIFTVFGASGYSSGLILGGVLTSLGWRWTFLVPVPLSLGALIAGLFLIPRDEPATGGGHDLIGAVTLVGGMLSAVYAVVTAPQRGFDPRTAAVSILAVVLLAAFVVAETRVRHPLVRLSIFRIGSIVRANASMVALMGSYVSFQFMMTLYLQDVLHWAPLRMALALLPAGLLVAFSSPFMGRLIDRYGTAPLIVAAMISLSAGYLWFLATSGSHPGYLTTVLPTMLLLGGGFAFGFSSIMAQATDGIDDAEQGLASGLVQSSGQVGTALVLAVVTGLVASATSTAAGDFTPFRPGVNLVTGVAVAGLLLNVAALAVARLRTRTPARAA

SEQ ID NO: 11714 - protein, 458 aa, Actinoplanes utahensis
MLRRDPAAAGTVKDPDVVGPLWRMKCREQRHTSQRRRYRSNVAINRTRTDTCGDRLRVRGSFAVALAGLLSLSAVAIPQSSAAAPPAPVAHQITGVAARPRAAVPGVDGRVAMRPDGKVFATVSDAAVRQWSTATGRRVGTPITGLTGQVHAIEFSEDGKLLAVADDGGVALWDATTGQRSGSPLIGHAGPVRSVAFNAGGRLLATAGDDGTARLWDLADRRLLHALTGQAGAVSSVVFSRDGKRLATTAADSTVRLWQADSGRPIGKALIVSPGPVYATSFSPDGKLLAASGGGDVVRLWNPATGEPAGEPIVAGPGPVYALTFSRGTRLLATSSGGDDTVRLWDTATRHPVAAPLAGHTGPVRAMRFGPDGKLLATGSDDGTVRLWDAVTGRAHGAPLAGHQGPVWALRISRNGKRLVTAGADGKVRLWRLPSRKAASPRHGQKAARPGSIPLGAA

SEQ ID NO: 11715 - protein, 49 aa, Actinoplanes utahensis
MAWGSKALPSGELSAVAFRDRERRLSEVGEPSLIDGGELGLSESLSWPE

SEQ ID NO: 11716 - protein, 394 aa, Actinoplanes utahensis
MLKRSRVKVEGSPRRKWPLWLKIVVPLGVVLVLGSGGAFAAVKVAENKVNAAIPDHQLGGSAAAPVQHADIKGAKNILLASLDTRPSWTKTHQPSHTDSIIILHVTADHKSAYMLSIPRDLLVDIPKYNNGKYLNREHHDKINAAFAFGSMGLDGDDATTQGMTLLAETVQKQFGIKPDAAAVVNYDGFVDILKQIKKVCLYVDENVTSIHIGHTKDGKLAVPFKTTAAGTNPRHLYVDGEQVIPNTYKIGNQCLDPTQALDFARQRDLLSPLHDGDYGRQRHQQQLLKAILKTAVSQGLDSPTKLPGLLTAVGKAMTVFRQGISLEDWVFGMRNLNPDDIVTLKTNGGKFHEVPSGVGSSEGLTADSVAMFKAAKDDTLEAFVQTHPTWVAKT

SEQ ID NO: 11717 - protein, 273 aa, Actinoplanes utahensis
MESPPLPVHYSRRAALRHRAAHPRGLPPGALTPATGAATGTIPVILVHGTNGRSASDWFTLAPLLANAGRAVYPFDWRRARPGPDVTATHRHALDLAAFIDEVRATTGADRVDVVGHSWGAVLAGYLTRCLPGEPAAGTVRTLVGLAPTYGGTTLHGLLNRPHRLPAGLRRWLDAKIPTWREQLPGSPVLTALRTAPPPPSTRYTTIVTRYDQMVTPYTASLAAVPDATPVLLQDHARRAVVGHLGILHHPAALAQVLTALHGRSGATIADPQ

SEQ ID NO: 11718 - protein, 425 aa, Actinoplanes utahensis
MTNQNAAKIRQAGISGRNTALSAEQPSPPVNRPARDAPAGKPARLATLDALRLIAALAVAAYHLTASWRVDGRHTPAYFLPHLAHVTVYGFLGVELFFLISGFVIGMSSWNRSLGDFFTSRVSRLYPAYWAGVLITTAVVTLAPINGGVPVSGTPDLRQVAANLTMLQEPLGVGSVDTVYWTLFVELRFYLLFAALVAVGLTYRRVVLFCAVWMTVAALGPMTGSRWVQVLAVPDYAPYFIAGIAAFLIHRFGRSWLLFGIVGFAWLVSVQRVIDRVNSLHPGFTVPTWPGAVIITVAYAVMLAIALGWTDRIRWAWLSTAGALTYPFYLLHQRLGYTFIRHTYQATHLPVWLLVAIAIGLLLGLSWLVHRLIEKPLAARLRSGLRQSLTELRVASAADAAAGALPRQTREGRLVRAARELGGDR

SEQ ID NO: 11719 - protein, 253 aa, Actinoplanes utahensis
MRHLAADCTKCAALCCVAPAFAKSSDFAVTKPAGQACRNLGDDFRCTIHEVLPERGFRGCVVFDCFGAGQRITQETFGGRDWRGAPELAGAMFATLPVMRRLHELLWLLTEALKLGEARRLHPKLAAARDEIEMVAARSADELRGLDVEPYRQRAVPLLRRASELARAGIGGRRPDHGGAQLIGRGFRGADLRGASFRGALLIGADLRGADLRRADFTGADLRGADLRGADLTGALFLAASQLRAAMTDDDPL

SEQ ID NO: 11720 - protein, 403 aa, Actinoplanes utahensis
MRHVSGLVWLSTVLGIVGLLLFDFFVHVRRAHVPRLREAALWTGVYVSIALLFGAGIWVVGGSGMGQEYFAGYVTEEALSVDNLFVFLLLLGSFRVPRADQQKVLLVGIAVSLVARTAFILVGAALIDSFAWVFYLFGLILLLTAGNLVRGKAGGEQTPPDNVVIRLARRVLRTTDTYDGDKLVTYRDGKRMLTPMLLVMIAIGGTDILFALDSIPAIFGLTQNVYLVFTATAFSLLGLRQLYFLIDGLLDRLVYLSYGLSAILALIGVKLILHALHRNNVPFINAGEHIGVTEIPTGASLAIIVGVLLVTVVASLLSPRGRAQTYSAAARRRATEFLEIEKDPAYCDEVYHLLLDEERNLQSLPARYRQHGDLTDLLRRAHRVHAERVAAGRCYVRPEPSAA

SEQ ID NO: 11721 - protein, 318 aa, Actinoplanes utahensis
MFHQHFLSAPGTDLGPLDSGERVLWKGRCAAAEYAFDEASSLPRWTLPEETEVLVTDRRVRYTYADESTVRNGELFWLWPQHLRVQPGNRDAGRTATVTQIQLVCNGPEGSFPALVFAGGDLATVGDADRLANVLRQAIARFRVENATEIGVAPAHARMLSRQVIGPEFTNYQGGAGQTVTLLGAVPVPAPEPAYPEPIYAEAVYDEPAYEEPVYREPVYEEPVRQEPAYQQPVSGMPISASRGYGERPGLAADAERAEQALRAEQDSRQAQPDLASRASSLAARIAGLVAGTDEDPFGRTANLSSYLNRPDDAASGR

SEQ ID NO: 11722 - protein, 283 aa, Actinoplanes utahensis
MAQRRASRRRVETVASGVAELVPDPDRDTAFTLLLDGAPQSHVDLADPAYLQFEYVRRIAAAIDLVAAPGRPLRALHLGGGALTLPRYLAATRPGSAQRVVEIDGPLVELVRRELPLPAQANIRVRVGDAREAVEGMRDGGYDVIVLDVFAGARTPAHLASAEFAAQVARVLATDGWLIANIADGPPLRHARAQVATIRSVLPQACLVADASVLRGRRFGNLVVLAGRTPPPVAELTRRAAGDWFPGRVETDLERFAAGAVPVPDATATASPLPPAGLFDNRK

SEQ ID NO: 11723 - protein, 544 aa, Actinoplanes utahensis
MVARETSDCSSVTVAEQTLNRRTAIGGAVAAGAAAALTTGTPALASSTAGPGLRTAVEPGVVIEDPGVAGLLPADPLLHLLRRATFGPGPESIAEIRRLGATAWLDRQLDPGSIDDPVADELISRLPLCGLSITDIHARVTAGQLKLHDWTPMWQLSFAAPIRAIWSRRQLFEVMVDFWSNHLNVTCPSGDVWDSRTDYDRAVIRRYALGSFADLLKASARHPAMLTYLDNRFSTRQAPNENYGRELLELHTVGLGYTEADVKDAAKLLSGMTVDNTTGAYRYDAANHVTGPVRILGFSHANATTTGGEAATLAFLDYLALHPSTARRIVTKLCVRFVADEPSPDLVTKLVKVYLDSRSAIAPVLRALFTAPEFAAAIGAKTRTPLEDLAATVRILGYGPPPSGTKSFESIYWMARNAGHAPLLWGPPNGYPDVAAAWASPSGLLVRWNFHLSLAAGYWPTDLVKPADLLTAMIGARPATYQALIDATAERLLGVRLGPDQTAALAAFYGKTPASPLKYNDPAVGWMYPYLMTMLLNSPNFALR

SEQ ID NO: 11724 - protein, 419 aa, Actinoplanes utahensis
MRTTVTCRETLSRRRLLAAGAAGAFAGLAGSQLDTQLAFAADPAYSGDVLVLLSLRGGFDGLSAVVPAGDPAYYTARPTIGVPKSQLIGAGSFFGLHPALAPLLPFWNSGRLAAIQAVGQPAPNRSHFSAMEELERAAPGTSLRTGWLNRMLGTLHAGDPFDAIAMGTARPARVLAGPAPYLGVTSVDGLALSGDDATKPLAATMAALYRGAPAGLTGPVNQLTGALARAKALKAAGYTPANGAVYPATDLGGALRDVARLIKARAGLMTATVDSGDWDMHENLGIAQTGRRMHDQLAQLAAAIAAFATDLGADGLRRVTLITISEFGRRVAQNGSAGLDHGYGNAMFVLGGGVRGGQVYGTWPGLSPAQLCDGDLAVTTDYRAVIGEILRTRCGVGDVASVFPGVTPSSLGLVSGITG

SEQ ID NO: 11725 - protein, 126 aa, Actinoplanes utahensis
MTVTSNLLAELIGGQRRPPGPPPAIAMPAILHAAKHRAGPPLKIRRHTSEEGLPFWRWDCDSCGEYGGGRHHPDAVSRAMRHCSEHPQHRSSLLPPASCRKPDTFLPLHPMLYALDDDPPPEPLNI

SEQ ID NO: 11726 - protein, 59 aa, Actinoplanes utahensis
MSFLDKAKEFADQHDEQVDQGLEKAGEQIDQRTGDKYSEQIDRGVNEAQKRTGAGDTQP

SEQ ID NO: 11727 - protein, 638 aa, Actinoplanes utahensis
MDARLEALAAAHGVATWYENYQRKRTEVAPESVIGVLGLLGVDAGDPAAVPEVTAPEVPGTIVLREGQSRDLPAAAELTLEDGTTRTVDRLAGLPLGWHRLGDRTTVVVVPAELPKAPVTWGWMLQLYALHSAESWGIGDLGDLRAFVSQCGDAGLVLLNPLHAITPVPPVPASPYSPSSRRFANSLYLRIADTREYQRADVDVQKRIDALKPETGELIDYTAVWTAKLAALELLWPLAEPVDLDADPGLTDFARFCALAEQHGPNWQTWPEELRHPGSPAVRAFRSDRIAFHAWVQHLVEEQLDRAREAAAGMPVGIVHDLAVGIDPTGADGWLLQDSLAPGVRAGAPPDAFNQLGQDWGLAAWRPDRLIATGYAAYRDMLRRIFRHAGGLRVDHVAGLWRLWWVPPGMGPAEGTYVHYDPEAMLGILALEAQRAGAVVIGEDLGTVLPEMTETLERMNMLGSSVLWFTRDWDTGEFRPAADYRRNALASISTHDLPTAAGFLAGEQVEVRARLGQLAGTVEQEWATWKADKAALLELLRAEGLTGTDPTSEEVVLAMHEFLARTPCRLVTASLYDVLLERRQPNLPGTFDEYPNWRIPLGPDLSEVVKDPIFRKVAGILGKRKAETGQRLTEGTTP

SEQ ID NO: 11728 - protein, 126 aa, Actinoplanes utahensis
MPRPAPRVARPCVSLPSVPGQYPADRWLLRVRSLLPSASMGHMAHMVKWWTRLAAVVSGAMLTLVIPVHAWAAGNGTSEVAVEAARRRYRTRGGFGFLFGGGLCCLFVIAAIVLVIVLISRNRKRR

SEQ ID NO: 11729 - protein, 408 aa, Actinoplanes utahensis
MAVGCGIAAVLSIPPAISVAANASADVLLSIGRPALASSTLSVAWLASAGVDRGVGTRWASGATDGTEWLRVDLGAAQEVTRVRLHWAQAYARGYRVQLSDDGATWTDMYRTEAGDGGVDDLRGLHGHGRYLRVLATRQGTPNGYSLWDVRAYGPGPYARVPESGATPGAGVPPAAAALTAHAKKETAFQLVSSAENSTLNWRGEYGYLEDLGDGRGYTGGIIGFCSGTDDMLAVVADYVRRKPSNVLAPYLPALRGVDGTDSHRGLDPGFPAAWRAAAKDPVFQKTQQDARDRMYFTPAVHLAESDGLRALGQFAYYDAAVMHGISGLRAIRERAVRARSTPSQGGDEISYLEAFLDSRDVEMRQEAAHSDTTRVDTAQRVFLKGSNLDLDTPLTWKVYGDSYKISS

SEQ ID NO: 11730 - protein, 412 aa, Actinoplanes utahensis
MRKLRMLLGAAIVATTLASSLYVSSRNDNADAAVVWNEDFNGAAGTGVDTSRWNFDTGGSGFGNQELEYYTSGTGNVAMDGQGHLVITARKGSGGHNDCWNGTCQFTSGRIQTAGKFTQQYGHVEARIQVPNGSGLWPAFWMLGGNNWPTDGEIDIMEVVGRDPNRLFGTLHGPGYSGGSSYGGQLLAGAPWYQAFHNYAVDWSPNLIVWTVDGQEYFRATPDSLHAAKGNVNWVYEHPFFVILNLAVGGNFGQGNPAGLPAESRMLIDYVHVSTSTTPTTPPATTGNALRSNLNGRCIDIPGSNPVDGARLQMYDCNGTGAQKWTFNSDGTLRALGKCMDPAGGALTNGTPIQLVACNGNPVQRFTLSGAGDLVDVSANRCVDIKDNNRANGAQLQLWDCAGTANQKWVKS

SEQ ID NO: 11731 - protein, 240 aa, Actinoplanes utahensis
MGHGVRWLRPLLAAVVAAGGLTVPGVAHASTVSSTVFSDGFGGDRFAPVDAGRWVGDTRDAWLDGDGHAVVGSWLLTAATFGQSGGHASARIRTGRWGAAWQALGVLGPDGGGISGQAESLGDRDTADGDFHTYAIDWTRTSFVWSIDGAQVLRLTPDDAGQPFRLALNLGGGGRYSDAIVVDSVSVSVRVTLKPGWKPFTTYRIGDQVSYRGANYRVKAQHTALPGWQPGLVPALFEKV

SEQ ID NO: 11732 - protein, 183 aa, Actinoplanes utahensis
MRDNDYPTEVSDPEASGLPDTADDDSTAYDEVDSGRWADGPDPAALAGVGPGGSNRFGDTAEEALQGEGLDRRLRQEEPDFGAGDTGGADRDPIDETVDDPEQRRLDRDVWGESPTSDPDSPVSLYDDGQLDDDSPGRVGRLVAPDGGSGFDDEADSVAWDAGAAGGGASAEELAMHETHELD

SEQ ID NO: 11733 - protein, 242 aa, Actinoplanes utahensis
MHNGAIMPSEVRQLVDRGQSYPLVRLTGVLDARTSGSVRSTLLDVLAGQPEAVVVDVTGLQPPREEALDTLRALREETRDWPAARLALCGAQSPLWQPAGWPVWPDPESAFAALGTPGAGLRVSLDLEPVSGAARRARELITETCLRWSRAELAGDACIVATEMVNNVVAHVRTPMRVLLARLGETVSIAVRDGSPVLPAFTGPVAPTAYGGRGLLLIDAVAVRWGRLALPDGKVVWAHLNA

SEQ ID NO: 11734 - protein, 244 aa, Actinoplanes utahensis
MARFRALDLKVEAKPDLTPVSDADTAVEKAIRATLARARPRDSVLGEEFGRSEAAAGPGTRHWVIDPIDGTKNYVRGVPIWATLIALMEGDTPVVGLVSAPALGRRWWAARGLGAFAGRHQHAATRIGVSQVRRLADASVCYASLNGWQANGRLPQMLDVLLGVWRSRAYGDFYGYMLLAEGALDAMAEPELSLWDMAALIPIITEAGGKVTDLDGRVCSDKSSVIATNGLLHESLLTALTPRG

SEQ ID NO: 11735 - protein, 375 aa, Actinoplanes utahensis
MYVEDVARVPGTLGGTHDRELVLPGRKREYDEDDVRVRPGRSSRPRTRTRPKHDDAVDALVITVDRGRYGCVQEDTGADPEVITAMRARELGRKSVVVGDRVALVGDTSGDAGSLARIVRIGERTSVLRRTADDDDTTPEGRLERVVVANADQLVIVSALADPPPRTGFIDRCLVAAYDADIEPLLCLTKADLSGPEQVLDYYAELDLPHVLVRPGSDLAELRERLAGRISVLVGHSGVGKSTLVNRLVPDALRAVGAVSAVGKGRHTSTSAVALRLPAVGRSRKDPGWIIDTPGIRSFGLAHVSAESLLHGFPDLVEGTLEDQPNCGHTAADTDCRLDAWVGEGRADRRRLDSYRRLLSSRAGDLDSRDHPADE

SEQ ID NO: 11736 - protein, 480 aa, Actinoplanes utahensis
MRRSVRRWKRWPRTRNAVEMVESQRSPGENRSPRPGRRERAPEMSAGGGRMASMAAELRPWLAPSAAGPVTTTVRLPGSKSMTARALVLAALADGPSVIEAPLRARDTTLMATALGALGVAVDTSGGDSWRVEPGPLTGPARIDVGLAGTIMRFLPPVAALAEGTVEFDGDPHARNRPMGPILDALRALGVRLDASPTGGLPLTVHGAGLIEGGAAVVDASGSSQFVSGLLLSAARFTKGLTLRHEGPPVPSAPHLRMTTHMLRAAGAVVDESVPDVWVVEPGPLHGRTWVIEPDLSGALPFFAAALVTGGTVTLAGWPAQSWQPVGQLTDLLTAFGGEVTRSADGLTVRGTGTLHGITADLSEVAEMTPVLSALAVLADGPSELRGVEHIRGHETDRIAALATELGRVGAGVTEFPDGLRIEPRPLHGASFETYADHRMAHAAAVIGLSVPGVQLTDVGCTSKTLPEFPELWAGLTTGS

SEQ ID NO: 11737 - protein, 271 aa, Actinoplanes utahensis
MPGLGTTGRRLPRRLGRHHAPRAAGHAGRLARAGPAGRRAGRRRRHGRRGPPVPDVGTRQPLTESELVSSSEHIVETPRGPARVRITGPAGPARAQLFLGHGAGGGVDAPDLVAVHDAAVAAGVRVLLVTQPYRVAGRRAPAPAGHLDEGWAAVVRAHGVPGIPLIVGGRSSGARVASRTAADLGAAGVLALAFPLHPPGRPEKSRAAELPAGIPTLVVNGDRDPFGVPGPGGAVEVVVRPGAVHDLRKDLPGTVAAVLGWLARHGWAAEF

SEQ ID NO: 11738 - protein, 248 aa, Actinoplanes utahensis
MRELLDAPEWPATEPAPAAAPVSVSTPVFESVTGALPVSSAGRSRGESRVAQKERVDERRERFERDALPFVDQLYAAGLRMTRNPADAEDLVQETFLKAFSAFHQFEEGTNLKAWLYRILTNTYINSYRRKQRQPLQSPTEEITDWQLASSESHTSTGLRSAETEALDRLPDSDIKEALQSLPEDFRLAVYLADVEGFSYKEIADIMGTPIGTVMSRLHRGRRNLRQLLVGYAADRGITRAASEPQEA

SEQ ID NO: 11739 - protein, 94 aa, Actinoplanes utahensis
MPSDETEHETDCSIVLSEVYLYLDLECSEDRRRLIQKHLDECSGCLREFGIEHEVKALVGRCCGDERAPAELRDRLRVKLVQLEAQTETREYLP

SEQ ID NO: 11740 - protein, 24 aa, Actinoplanes utahensis
MAKKARKKKARKKSGANHGKRPNS

SEQ ID NO: 11741 - protein, 71 aa, Actinoplanes utahensis
MAEEVRAEMVANVWKVVAGVGQAVAEGDTLVILESMKMEIPVVAESDGTVGELAVHEGDVVQEGDLIAVIN

SEQ ID NO: 11742 - protein, 513 aa, Actinoplanes utahensis
MDAHPPVPHDLTLARAALDAGEMSQAARHLAGALPHAPTLPEIHELLSRLAARADGALDLFPLEPHAPAGRVAAHAHLLAAAGRPEDGLALLAAASGHTPDVDWAGVPWVSDPVLGGRIDPDALARTVMRLCTAVGDPAPAAAAEPLRPYLTVVRHTVAAHGEHAMLLGAGSALARRLGEARLAIDWATRGARSRPSKLGEIWLGYAFRSAGRIPEALAALRRAVMYDPDDLSVYADVAATLADLGRLDEALSWTDRALERDPRFDCVVHTAQRLRFRADGEVAHLIALADFVRDHPDDTHEHTDLDDCCRDVPWLSGLPASMSRLAPGRPTVNGDPSPDARDRLLRVASTGWPHPPAAYDRALGLVLVEPWELLALLGHPAVTGAADPGAAEVWACLGLLHHGSEEAWLDSTRRRLLLGLLDGEVDRVTQAALFALVTYAWVDPEARADVAAVVAGRFAEVAGGPHARAVAELALATPELARPARELAAATVRTPVIPRQRSRSYLLRWLKK

SEQ ID NO: 11743 - protein, 345 aa, Actinoplanes utahensis
MTERGHGMAADIAEQPEGFARLLDGPHADAIAGVAAEIAARRPRNVLFVGRGTSDHAALYGAYLTEIRLGLPVASASPSAITLYGARPDFTGTLVIGVSQSGGSPDLTGVLSAARETGALTLAVTNNPESPLARAAELAVDVAAGHERAVAATKTYTAELLAMLLLVEGIRAGDGRLPAEERAALAGLPALAAGVLADHTAEDVAQRYRFAPHMVTTGRGYAYPTAREAALKLMETSYVPTLAFSGADLLHGPLAMTDTDVPVLAVVGGGPGGRSMADVLARLEERKADVLTVGPAGRLAVPPVDERYSPLLDILPLQKLALALALAKGEDPDAPRGLKKVTSTL

SEQ ID NO: 11744 - protein, 512 aa, Actinoplanes utahensis
MSTLRDLVEEHSSLGSADIDHLHRLAGDWQLLSDLSFADLLLWVPVKGDKPREFVCVAQVRPTTAPTAYQDDQVGRRFGGPEVAHLEVAFTQERIWREGDPVWYGDTPARHEAIPVRRRDENDHEEGYSEVIAVIGRDTNLSTARTPSQLELNYLTTADDLAQMVADGTFPPARQPGEMTTSAPRVGDGLIRLDASGKVTYASPNAQSAYRRLGFNAHLVGEELAGLSSRLAADPLEGNDVAERIRSSLRGEFPPRMEFEARGATVLTRSLPLLPAGVPIGALVLVRDVTEVRRRDRALMTKDATIREIHHRVKNNLQTVAALLRLQARRVDAPEARMALEESVRRVASIALVHETLSMSSDEAVEFDGIVDRVATAATEVSATSFPVHMRREGTFGILPAEIATSLVMVLNELLINAVEHGFPAGEDDEPAPAPEQPAEVVVAAHRFRKQLHVTVADNGQGLPEGFRPDAGRLGLQIVRALATGELRGSIELRNRAGGGTEAVLVVPLGKR

SEQ ID NO: 11745 - protein, 563 aa, Actinoplanes utahensis
MAPSNTPATPAARPRKARGEGQWALGHREPLNPNERSKKDDNPLNVRARIENIYAHRGFASIDPADLRGRFRWWGLYTQRKAGIDGGRTAVLEPEELEDEYFMLRVRIDGGALSVAQLRTIADISTEFARDSADITDRQNIQLHWVRVEDVPEIWRRLEAVGLQTTEACGDCPRVVLGSPVAGISVDEVIDGTPAIDEILKRYIGDPAYSNLPRKFKSQISWLADGPYQANDVSFVGVEHPDHGPGFDLWVGGGLSTNPRLAERLGVWVPLAEIPDVWEGVVGIFRDYGYRRLRHRARLKFLLADWGVARFREVLEKEYLGRALIDGPAPDLPEKPIDHIGVHRQRDGKNYVGAAPVVGRSSGTQLGKLADLAERHGSDRVRLTAYQKLLVLDIADEKVETVVGELREIGLEARPSTWRRGTMACTGIEYCKLAIVETKARGEELVARLEERLPGFDADISVHLNGCPNACARTQVADIGLKGQLVMNAHGEQVEGFQIHLGGALGMAKGETAGFGRKLRGLKATAEELPAYVERVARNYRDGRTDGETFANWVMRAEEELLK

SEQ ID NO: 11746 - protein, 254 aa, Actinoplanes utahensis
MSILNATGLGLINLGAPSAPADPARRSADDLRALALQAAQDLEGRTAEEIAKWATDTFGARFCVTSSMADAVVAHLFSRVAPGVDVVFLDTGLHFPETLKVRDTVARTMNVNVRSIRPRMTVGQQDGEYGPRLFSRSPDECCFMRKVEPLERALTEYDAWATGLRRDESPTRANTPVVAFDAKKGKVKVNPIAAWTQADVDRYISRWNVPVNELFKKGYGSIGCWPCTRRTKAGEDPRAGRWAMFEKTECGLHV

SEQ ID NO: 11747 - protein, 84 aa, Actinoplanes utahensis
MDWRHDAICRDEDPELFFPIGTSGPALLQVEQAKAVCRRCPVTEECLSWALESGQDAGVWGGMSEDERRAVKRRGGLRVSAPTA

SEQ ID NO: 11748 - protein, 316 aa, Actinoplanes utahensis
MRALLVVNPRATTTTERGRDVLVRALRSATDLTVRYTERRGHATVLARTAAEAGVDVVVTLGGDGTVNEAVNGLLTAPGALAGLPGPAAYRLPALAVVPGGSTNVFARALGLPRDWADGTSVILDGLRDGRHRVINLGRADDRYFTFAAGLGLDAAVVRRVEQARLRGRTSTPGLYLRAMVGQLLTETDRSDPPMTLERPGEEADTGLGTVIVQNTAPWTYAGNRPVDPNPDASFDLGLDVLALRKLKVSATTRTVTQLAWRSGDPHGKQVLRLHDLPEFTVISSRPQAFQLDGDYLGERQKVHFVSVPSALRVIC

SEQ ID NO: 11749 - protein, 32 aa, Actinoplanes utahensis
MVVVARGLTTSKARMAAPYRPEPDPAVGMVQP

SEQ ID NO: 11750 - protein, 131 aa, Actinoplanes utahensis
MNAEKPVTTAAASLEWGVRLLYLQCAGLAGLTAYLIVLDLTRTGADVGVAAALTVLAALAAVAVFLVARALGRRRVRARGPAVVVQLFLLATGGFLVQVGPLWLGVVLLVVAAVTAVLVLLPASSRALGVD

SEQ ID NO: 11751 - protein, 229 aa, Actinoplanes utahensis
MRPPAYQQLADDLRADITSGRLQPGERLPPEPELCVKIGVSRSTVREALRLLASQHLIVTTRGVTGGSFVAHPDAGQLAEGLSTGFALLAHSAGVGLADLLELRRALEVPAAGLAAMRRTDAHLAEMRAALFDPALDDLDTMLAAHSVFHRALAKATGNPLFELVGRPLYQASYGEEVVSDLPEQYWPRIDADHRELLDHLVARDAEAARQTASRHLDYIALTATVPRP

SEQ ID NO: 11752 - protein, 135 aa, Actinoplanes utahensis
MSQLTQAEPEVGDDVVLLTVPADGGYLGVLRTATAGLAARLHFALDEIEDLRIAVDEACAMLLAIATRGAELECRFAVTDDALTVEVTVATVRGARLPSESSFAWKVLTALTTSAAAEANGQHATIRLLTRRTEY

SEQ ID NO: 11753 - protein, 134 aa, Actinoplanes utahensis
MRLPRFLMPRTVVSAHCDLPCGVYDPAQARIEAESIKAIAEKYAANTDPEFRTRAILIKEQRAELVKHHLWVLWTDYFKAPHFEKYPNLHQLFNEATKLAGASGAKGSVDVAVADQLLGKIEEISKIFWETKQA

SEQ ID NO: 11754 - protein, 102 aa, Actinoplanes utahensis
MKWQLPLFAVLVHGPSMAPALRHGDALLVRRGARVRTGDIVVARFRSRPGLLVVKRAVREQAGGWWIEGDNALVQDDSRAYGVADLIGRVVFRYYPRPGRLR

SEQ ID NO: 11755 - protein, 437 aa, Actinoplanes utahensis
MHRRLAHTRDQHVSGATYQCRCRVEFTVSFFSFELDPALAADPVFDLHRRGKMTMSATVPLASRDDLSLAYTPGVARVCEAIAADESLYPDYTWTSNTVAVVTDGSAVLGLGNIGPKAAMPVMEGKSVLFKQFGGVDSIPICLDTQDVEGIIAAVKAMAPSFGGINLEDISAPRCFEIERRLDAELDIPVFHDDQHGTAVVTLAALRNAAALLGRSFADLRVVISGAGAAGVAITNTLIAAGVQGANVIVVDSRGIIHADRTDLTATKADLAAATNVSGRTGGIAEALIGADVLVGVSGGSIPEEALSGMAPGAIIFALANPTPEVPPATAHKYAAIVATGRSDFPNQINNVLAFPGIFRGALDVRATTITDAMKVAAADAIAAIVADDLRPEAIVPSPLDPRVAPAVAAAVAAAAVRDGVARRTPALAPVQACQTV

SEQ ID NO: 11756 - protein, 313 aa, Actinoplanes utahensis
MRAAYVSQLQPDEPLSGLTVGDLPFTPPAGWVPVEVRASSLNQHDVWSLRGVGLPADRLPMILGCDAAGVTPDGAAVLVYPVVEDKADPRGYSLFSERHPGTLAERVAAPRENLLPIPEGVSFAEAACLPTAWLTAYHMLVTRGRADRAGAILVQGAGGGVATAAVALGVALGKRVYATSRHQAKRDRIAELGAVAVEPGARLPERVDVVIESVGEPTFDHSMKCAAPGARIVVCGATAGHLARIDLRRVFAMQLEILGSSMGTPAELAELLQMCATGRIHPVIDSTHPFDATPDAFARLLSPDLFGKVVITH

SEQ ID NO: 11757 - protein, 371 aa, Actinoplanes utahensis
MTRVLVLNCGSSSVRYRLFDGADVQAKGLIQRIGEPGGDATDHLSALRDLMDRLDLSDLAAVGHRVVHGGERFTEATVITDEVVAAVEELVPLAPLHNPGALTGIRVARELLPEVPQVAVFDTAFHSTIPPEGVIWAVDRTLAERFGLRRYGFHGTSHAYVSRRTAHVLDRPVEDTRVITLHLGNGASAAAVDGGVCVATSMGMTPLSGLVMGTRSGDIDPSLIFHLHRAGGLSLDEIEDSLTRHGGLLGLTGANDMREVLDRVTAGDPEAELAFLTYTRRLREYVGAYLAVLGGAHAITFTAGVGENSSRVRAAALAGLEPLGIIVDEARNSRNDLIISPDGAPVTVCVIPTEEELEIADESRRALALPV

SEQ ID NO: 11758 - protein, 690 aa, Actinoplanes utahensis
MARSVYVAGLGPAVGKGTVALGIVELLSRQVAGVAVFRPLVPAVDRDPLLAALRERYPSPVPAAESFGVTLAEAAALIADGRREELIGRIVERYRAVERQSTSVVIIGSDFADQGDEGHDELPRELAFNARLATEFGSVVVPVVSGAGRGGESLAAAARSAYHSVTDLGATVAAVIANRVPAAAGGGPAPSLPVPFWTIPEVPAIAAPTVGEVADALDATVLSGTPGALDRDVLDYVVGAAHVPTVLEHLTDGALLITPGDRADLLVAASAAHAAGTVTLAGLVLTLGEPPDPRVVRVIERLGTGLAMLVTKADSFHTIALSDRVRARLSTPRKVQAALGAFETHVDTAELSKVLDVARSARVTPLMFENDLIDRARADRRHLVLPEGAEERILRAAETLLRRGVAELTLLGDPAEITRRAREIGVEIGDAHLIDPATSSWRDDFAARYAEIRKGRAVTLDLAYDVVRDVNYFGTMMVAAGYADGMVSGSVHTTAATIRPAFEIIKTVPEVSVASSVFFMLLADRVLVYGDCAVNPDPDAAQLADIALSSATTAAAFGIEPRVAMLSYSTGSSGAGADVEKVAAATALVRERRPDLPVEGPIQYDAAIDPAVAAAKLPGSAVAGQATVFVFPDLNTGNNTYKAVQRSANAVAVGPVMQGLRRPVNDLSRGATVKDIINTVAITAIQAGAR

SEQ ID NO: 11759 - protein, 58 aa, Actinoplanes utahensis
MYFTDRGIEELVQRRGEETVTLEWLGEQLRTFVDLNPEFETPIERFATWLARDDDDED

SEQ ID NO: 11760 - protein, 1235 aa, Actinoplanes utahensis
MSTQQTSQDNPLADFGPNEWIVDEMYQRYLADPTSVDPAWHDFFADYKPATASGSIVTPDEATAANATKSAAKAGTDAPAAATVAPAKPVTPPAPAAKKAEPVKAAPKPAAAAQPAPAGAKTTVLRGVAGKIVQNMEASLQVPTATSVRAVPAKLMIDNRIVINNHLSRGRGGKVSFTHLIGWALVRAVVAHPEMNNIYAEVDGKPTLVQPEHINLGIAIDLAKKDGSRTLVVPSIKNCEQMDFRQFWQAYEDVVRRARRNELTMDDYAGTTISLTNPGGIGTVHSIPRLMNGQSAIIGVGALEYPAPYAGMSDETLTDHGVSKVTTLTSTYDHRVIQGAQSGEFLKVMHELLLGGRDFYDEIFTSLRIPYEPVRWVRDVAHTSEGQIDKAARVIELIHAYRVRGHLMADTDPLEFTIRKHPDLDVLQHGLTLWDLDRTFPVGGFAGKQKMKLRDVLGVLRDSYCRRIGIEYMHIQDPEERRWVQERIEVKYAKPDTDEQKQILLRLNRAEAFETFLQTKYVGQKRFSLEGGESLIPLLDAVLQSSAEAGLDEMVIGMAHRGRLNVLTNIVGKPYEKLFNEFEGWMDPKSAHGSGDVKYHLGQTGKYTTPDGRHSTTVSVVANPSHLEAVDPVLEGIVRAKQDRLDLGLHGYTVLPVLVHGDAAFAGQGVVAETLNLSQLRGYRTGGTVHVVVNNQVGFTTAPEYSRSSMYSTDVARMVEAPIFHVNGDDPEAVVRVAKLAFEYRQTFNKDVVIDMICYRRRGHNEGDDPSMTNPRMYQIIDTKRSVRKLYTEELIGRGDITVQDAEEQLRDYQSRLEEVFKATRDAAGSPPRPHIIAEEPEPQVATAVEADTVRAVGQAHIELPEGFTPHKRVQQLLDRRAKMSTDGGIDWGFGELIAFGSLLAQGVTVRLAGQDSRRGTFTSRHASIVDSRTGKDFLPIASLATGTARFFVHDSLLSEYAAMGFEYGYSVENPDALVLWEAQFGDFVNGAQSIVDEFLSSGEVKWGQQSSLVLLLPHGMEGQGPDHSSGRPERFLQLCAQDNMRVANPTTPANYFHLLRRQALSSKRKPLVVMSPKSLLRHKLAVSSVADFTQGTFQPVLGDAGVNGQPLDAGSVKRVLFCSGKVYYDLFQARADRGITDTAIIRMEQIYPLPVDELKAVLAQYPNAEDFAWVQEEPANQGAWSFVALNLLEHLEGVRLRRISRPAAAAPAVGSAKMHEAEQQALIEASLPRP

SEQ ID NO: 11761 - protein, 132 aa, Actinoplanes utahensis
MSPDIDRVRHTVAIQVARATASRRPSGPCTAESTRALRPASSDTAPVITHRAPGSGSATAATANRPSTYGRPSRIAAQPPGQSSAAHSSGRSTSAGTVHGAAVRPSGRRPGKIRRPSPSARSGPHTKQVGKG

SEQ ID NO: 11762 - protein, 320 aa, Actinoplanes utahensis
MGGAVRRRAGGDGEGAGAPAAVAGAGRTVETCGNSHPATFAQAVHQPDTHRHLTRHSIGSCHPYTGHMAVLMTAAAPTGTSGYTLLIADRAAQIEAAQRLRHDVFAGELGATLTTAADGRDVDALDEFCDHLIVRDDATGAVVGTYRMLPPRAAGRAGRRYADGEFDLSALRPLRDQLVEIGRSCVHPDHRTGAVMNLMWTGIARYLHLNDLRWLGGCASVPLADGGGLAAGVRERINAGHLAPPALRIRPRTPWTPPADLVADPKVTVPPLLKGYLRLGSWVCGEPAYDPDFDCADFYVLFSLDRLDPRYRRHFLGGDR

SEQ ID NO: 11763 - protein, 255 aa, Actinoplanes utahensis
MSTLWQPASGCGDACRTGGGPRARGWTAGFRLTGMLLVLLLGLLPAALIRGAALRTLARTMLAVMGVRLIRRGPAPRPGSLLVANHISWMDILALVAVTPVRLVAKHDVRAWPGIGATAGRSGTIFIDRTRPRELPVTVGEVARALRGGRSVAAFPEGTTYCGAEQGDFRPALFQAAIDAGAPVVPTSIIYDTAEASFIGDDTLLESLLRVARVRRTTVTVITAPALRPMPGADRRALARAAQRSMAGHGYRLAA

SEQ ID NO: 11764 - protein, 55 aa, Actinoplanes utahensis
MLRCAARASARRSAPGIGRSAGAVITVTVVRRTRATRSSDSSSVSSPMNDASAVS

SEQ ID NO: 11765 - protein, 242 aa, Actinoplanes utahensis
MAAQTQRNDTQPKQSEAKLLVVEDDANILELLSASLRFAGFDVTTATSGSAAVSAARSAAPDLVVLDVMLPDLDGFEVIRLMREGGQRTPVVFLTARDGTDDKIRGLTLGGDDYVTKPFSLEELTARIRAVLRRTTAGEEQPSRLVFADLELDEETHEVYRAGSRVQLSPTEFKLLRYLMLNANRVLSKAQILDHVWKYDFRGDDNIVESYISYLRRKVDNVQPRLIHTLRGVGYVLRKPAV

SEQ ID NO: 11766 - protein, 522 aa, Actinoplanes utahensis
MMSISERVRQAFPPQPTLRKISLRTKLVASVLVLVFAALTLISSASTIALRTYLMSRLDAQLTEFSEDAAVLIQDDSGIRVYTPRDYLVVLTSVGGVGVGVGSKSRLTSGNSLPTLITGAEKVAEYDGKLYTSRSADGLYTWRVRVKVLDNGDVLTVGEQMGNVQGVIGRLVWVDVLVGTGVLLALAIVGAALVRQSLIPLLQIERTAGRIAAGDYSQRVPDPEVDGGEPTTELGRLSTAVNAMLAQIEAAFYARATSERQAMEAAEAAQLSEGRAVRSEEKMRQFVADASHELRTPLTTIRGFAELYRQGAVSDPEAVARLVRRIEDEAARMGLLVEDLLLLARLDRERPLNLAPVELPVLAVDAVGAARATHPDRTIELDVRDDHERLIALGDDARLRQVIGNLVTNALVHTPPEATVALRLYAAGPDRAVVEVADTGPGLSEEQRSRVFERFYRADGARTRNTQREATGTGLGLAIVAAIVRSHNGTVDVLSEPGQGATFRVTLPTINVEKRFTENIQD

SEQ ID NO: 11767 - protein, 510 aa, Actinoplanes utahensis
MNENETNPQPADAGAEQFSTERVESEQPTAAQPPAAPQNAAHPSAAPQYPQQPPAPQHPQQPQHPQPPHNPWAQPVPGGYQQPAPQPPHPPQSPWQQPVSAAPTSGYPQYGQHPGYGQQPGWQHTTNPEGVVPVWAQPVDQPPRNPGRGRKFVLAGAAAVLIALLSGGVGAATALAVHDDNAPATVKSGNTSVSRVVDRSSLAQIASAVQDSVVSITTQSGEGSGVILSADGYIVTNNHVVATATGDTVNIIFADGKKTTATIVGTDPRTDLAVVKATGVSNLKAATFGDSSQMQVGDTVLALGSPLGLEGSVTAGIISAKDRTIQSSSEQDQQGQGQNPFGQSQQQQGGSGSTTMTGLLQTDAPINPGNSGGALVNVNGEVIGINSAIATSGSGSGNIGLGFAIPSDKAKTVAESLMSGKKVSHPALGVSVTTGENGGALVSQVVSKSAADKAGLQKGDVITKVDGKDISESDDLVAAVQSGTVGQQMTITFTRNGAEKQVTVTLAESQ

SEQ ID NO: 11768 - protein, 562 aa, Actinoplanes utahensis
MTYVETRTSVWEALAGRAPKAESGPADSGLWHAVADRLNPARARPELRGGIEVRHRTTVRGGRYVMLRSPEEGGRSCYLRLSPEEYQLALMMDGSCTVARLVAEFARIAGRLAPDQVRRVVADLAGNRMLQELPRDAFRPLREMRPEPLPQRVGGSLLAAVRGRRVLSVNVDGTLTGLYNGAGRLLFTRPAFWLGALLSMAGAVLFLFSWERGNHPLFLSGDSYLLGAISLLLLNVVAMGLHELGHALAAKRVGREVPAAGLLLHFGLPTVFVDTSDVWMAGRRARIAVTAAGPATGLALAGLFQLIGLGVPLLGGLAFKLAFLFYLHTFFNLSPLLPLDGQYLLMDWLEIPDLRARGLAWLGGRLRRRGPRWSVLDREGRLIALYGMLALFWLGAAVALGYRLWTDRVSGLVLGLWYEGLGARLLLAVMLGGLLAPPLYFLLGRLGSGWRRWRRRSAERDQEADMPHRMAALHASDLGGLPEPALQSLAARARWEHPRIGRQLVLAGAEQAAVYVVVEGALHGRRPGDPGGSIRHHAGPGSVVGLAAALTGRSAALDWHAA

SEQ ID NO: 11769 - protein, 476 aa, Actinoplanes utahensis
MLLAVPTSTVATVIGPLPGPPPHERAEAEALFADTPALAGLEEDQQLALIAAAHPVDLEPGAPVMLHGPTHAVVVESGVIAMPDGVELRRGTLVGPVGDGTPGMVAQTRTPVRLWIIPDASDLPPLIGTEARPGAPMPALRPGSPLAVRPGAVHPPLAVPPGPPDSGDEFDVDRHFEKRMWAFVSVLVVVVLGGLGLDLSAGPAWAEMPAEKVLLTVDRGSATARNETLAVGDRRYLGAGASVEAPGKSRVRLTFPGGGALLICPGARVTLTAAAVGGGRQAIPSGRVTLESGRVLADTAGTSGGYRPLALTVGRDQGDVTSAGRAWFSVDLAAVTVATGTVSAGGVPAPAIGGDLSCGDGQKVSRPAAPEGGEPSEAPFPSDTASPSASASPSGSASPSASASAGADPSPSASRSPSASPSAKPSVKPSTRPTVRPTVPTVPTTVPTTVPTTVPTTVPTTVPTTAQTTTPDTGGN

SEQ ID NO: 11770 - protein, 286 aa, Actinoplanes utahensis
MGRMVDGPVAFVLGGGGVLGAVEVGMLRALFRAGFRPDVVVGTSIGAVNGALVAAEPGEAVTDRLVRLWASPEAAAVYGDSIGRQLRRFAARTHLHSPLPLRRLLAGELGEAATFADLKVPFHCCAASIERAAEHWFDSGPLVDAVLASSAVPGLLPPTEIDGEHFVDGGIVNSIPISEAVRLGARLIFVLQVGRVERQLSVPRRPWEVAQVAFEIARRHRFARDMASLPDGVRVHVLPSGGGEVGDDSPWAYRDMARVGRRISRAYTASRRYLAANVHPLPDGER

SEQ ID NO: 11771 - protein, 384 aa, Actinoplanes utahensis
MGLPRHGAGRPADQPGLHGLPALPGGECAPAAGRRAVSLPPVWARRLVIAPAIVLLAAGLLTTLPVWLLLALAVSPLVPGRLRVPRLVFLLIVYVVWDAAALIVLAALWIAAGAGRWIRGPVFQRAHYVVTGAFLRTLFWFARWSLHLAIDVVGTDPDTAQPGRPEIVVSRHAGPGDSFTLIHALVNWFAREPRIVLKAALQWDPAVDVLLNRLPNRFITPGRTATDRLADQIGELATGLDDNDAFVIFPEGGNFTPRRRVKAIARLRASGLDEMAVKAEGLRNLLPPKPGGLLAAIDAAPDAGVIFVAHTGLDRMITIGDVWRELPMDKRLVMRFWSVPPEEVPAGERERIDWLYAWWARIDAWIEENRPAPRPLWIDRGTAR

SEQ ID NO: 11772 - protein, 265 aa, Actinoplanes utahensis
MRTTRLALTVATAAFAVAGCTADGTPATSATSAPAASAAAAPSASADPAAVQALSGAASTLGNSSFKMTMTQGSGFQLTADIDAPHGNGTAEMNAKGGNTALTVKTLLFGKDLYAQIPGVTQGQNWTHLDMARLPDGSNIGLKPGQIDPANTAQLLSSTTDVHRAGEGSYAGTVDLTKAAGVAGISKVTLDGYGADAKQVPFEATLDQQDRLESLTLRLPSVDSRETAPLQVKYSDYGQTVTAQRPPAGQISEAPDSVYQALGGK

SEQ ID NO: 11773 - protein, 382 aa, Actinoplanes utahensis
MRFEVSKVLDAIEARLTTDPALARAVVDLSEVVRYADLDGGRPASLVRLGLLVDALGRYVAEENVPVYVIAPRGLLSDTDLTSNERMVVRRWADDGKVEVVPQMDDRVLEVAEMLGLPVLTRDREDRFRQTRPWVAEPGRLLALVSQQGGPTLVARVGRGEAIPPTPRSPLGERLLARIWKCPDFNCTTFGTGGDSDSPFADMRTFTSPVAQPPPALRAGVPTCPRHGERLKDAGPRPHTEVLSVRIDGVIRQRFTVAEDQPVVVGRAPEGGGGVMLGQWLTADARKWISRGHVRFALRAGEITVKDISTNGTGVRPGGSQDDEERITLHRDESRVLAADDVVELYAGVHVGRAKLWANGGVIQPQSVMAEAPTMAIRPVGR

SEQ ID NO: 11774 - protein, 404 aa, Actinoplanes utahensis
MTTVEFRTAEALAEAERWTAHNYHPLPVVVAEAEGAWVTDVDGRRYLDMLAGYSALNFGHRHPGLIAAAHAQLDRLTLTSRAFVHDQFAAFCRGLAELCGKDLVLPMNTGAEAVETAVKVARKWGYQVKGVPAGRAEIIVADGNFHGRTTTIVSFSTDPEARADFGPYTPGFVVVPYGDAEALAQAITPDTVAVLLEPIQGEGGVLIPPAGYFAAVRETCTANNVLMIADEIQSGLGRTGKTFAIEHEGVVPDMYVLGKALGGGIVPVSAVAANTDVLGVLKPGEHGSTFGGNALACAVGSAVVGLLGTGEFQERSARLGERLRAGLEGLIGKGLVAVRCRGLWAGVDIDPALMTGRQACERLAALGVLAKDTHGSTIRLAPPLVITEEDLDHAVAQLAAVLAG

SEQ ID NO: 11775 - protein, 311 aa, Actinoplanes utahensis
MKTPLPAPVWGARNDSPPGAVITQRSAAGRMIGPGCAKVIRTYRFCMTAMRRYLMCRPTHFAVTYRINPWMDPTAPYDNALAVSQWENLRRTFLELGHTVDLVDPLPGLPDMVFAANGGTIVDGRALGVQFRDAERADEAPAYAAWFRAAGFETEMPKHTNEGEGDILLAGDLLLAGTGFRTSHASHAETQEFLRRPVVTLQLVDPAYYHLDTALCVLDETNIAYLPSAFSPGSQSVLRQLFPNAIIATAEDAAVLGLNAVSDGRNVVLPVQATHLTEELRKAGYHPIGVDVSELRKAGGGPKCCTLEVRS

SEQ ID NO: 11776 - protein, 183 aa, Actinoplanes utahensis
MPTFSRTATTDTDETARVPVRPRRGDDEPTTQAVTKPVPATTVTAPTAAERKPITVGRPVTPVSPAAPATPVAPVRRARGSMMATLGLIVSVAGMALVLSGPLAGYGVGVAGLGLLLSLIGLNATRRQHVAGKTDALLGLLISLGAIVLGVLALNGQLSWLGTDTQPPARLREWLDAQFANRF

SEQ ID NO: 11777 - protein, 201 aa, Actinoplanes utahensis
MSVEPTMRGGGASFDDQVFERLLRERIIFLGSEVNDEVTNRICAQMLLLASEDPERDIALYINSPGGSISAGMAVYDTMQYIKNDVATIAMGMAASMGQFLLCAGTPGKRYALPHARVMMHQLSGGIGGTAADIAIQAESMLHIKTVMNDRIAFHTGHTAEEIERDSDRDRWFTAQQAKDYGIVDHVIAKASDVNAVSSLV

SEQ ID NO: 11778 - protein, 285 aa, Actinoplanes utahensis
MAIITSGRVGPGGYLWRVPEGHTIHRLATRHRELFAGAPVGVTSPQGRFAAGAALLDGRVLADTEAYGKHLLHHYEGDRTLHVHLGLYGKFTEGEPPLPDPVGQVRMRMTGPSHWLDLRGPTACEVLDPPSVQRLRARLGADPLRDDADPARAYQKVRASTKPLFALLLDQSIVAGCGLIYANEVLFRAGLSPLTPGTAVGRELWAALWDDLRALMKEGVARGRIDTVHTEHTPEAMRRAPRVDRHGGEVYVYRRTAQPCLVCATPVAIGPLAGRNLYWCPACQR

SEQ ID NO: 11779 - protein, 438 aa, Actinoplanes utahensis
MPPHTSPHLTSPGDAAATGGRHRRPDLAVGPALRSTVDAPSPVPAPRAARHRAGDTGSYSTVRSAAGAPRHSAAPGRSRPRRPATGTHRAPGTLPLETWLEAAKNRPTTVLGTLVVAGLLITAVPLAQPGHSDPGSLAAAAQAEASARAAGQHDRTNDSGNRPGGPQAQPAAGAKPTPSAAVTGKPIESQQLPPAAGAGPGRSLLTTGSQTVALTFDDGPDPEQTPKILAMLEQYHVKATFCLVGSQVARHPEMVRQIVAAGHTLCNHTYDHDLTIAKKTPAKIRADLEKTNAAIRAAVPDAAIPFFRAPGGNFNDRLVQTAHADGMSSLYWAVDPRDWEHLTGESDAAHVKRVVASIRKQIKPGAIVLSHDFNQPDTIAAYRELLPWLTENYQLGVPSGTGETPATAKPATPAPSTPAPAPSTSADPVVTPSAAPTE

SEQ ID NO: 11780 - protein, 386 aa, Actinoplanes utahensis
MEAAAEGTTTISARLAERAEKRDLLTLGVEEEYLLVDAVEPRGVETVEAVLEQIPEQFRGGVQHEYLRSQIEVASPPQLELMSLYEAMTGLRETVATAAERAGSRLLAVGAGPAAGPNTRLFDDPRYHRMRERFGDLSPGQGLCGTHVHVSIPDAETGVQVLNHLRPWLPVLQAATANSPLFGGRETGYASWRSMLWERWPTVGPTPYLTSHEHYLTLIADLEASGAMLDEGMLYWYARLSARYPTVEIRMGDVMPTVDDAILLAALARGLVSTLLNEVRDGVPAPDVPHPLLMAAHWRAAKDGLEGLGLDFATREPRPAWRLLRQLVDFVRPELERHGDLEMVTMLLERLRTRGTGAARQRALLAKGVPVAGVVDWLARATRGGE

SEQ ID NO: 11781 - protein, 227 aa, Actinoplanes utahensis
MSISGLFHAVVDAAHTGITVLSGHLEPLTGGLAAAVAIVLFTLLVRAALTPLTYLQIRTERRRAALAPQMAKLRAEHRDPMELATATLALQREHGIGPFAGLLPGLAQAPFFMVMYRVALHPPAGAIAGVPLTAHLSAGLPVFAVLLAISGGIAWWSSRRAAAPQPVPVPGDDQQAAALTAGMLRYLPWLTVLAVAWLPLAGGLYLVTSAAWTAGEQVVRRRLVAAA

SEQ ID NO: 11782 - protein, 38 aa, Actinoplanes utahensis
MSRSSGAGWSPPPDREVRRPELVAGRKYRQIDNFSKQA

SEQ ID NO: 11783 - protein, 467 aa, Actinoplanes utahensis
MSPMAASRRVLAVGAAVLTVAASVAFVSQAEAAVPAPPAGMSLVFSDDFTGAAGTGLNRSNWLYDLGTGYPGGAGNWGTGEVESMTDSTANVYQDGGGNLVIKPIRDASGQWTSGRVETQRTDFAAPAGGRVRIEARLQQPNVSGAAAAGYWPAFWALGAAARPVGATNWPSIGEWDIMEDINGRSSVFSTLHCGTPSGGPCNETTGLGSGERACAGCQTGFHTYAVEYDRSTSPEQLRWYLDGANFFTLNSSQLDATTWNNATHHGMFVILNVAMGGGFPAAFGGGPTAATASGVPMLVDYVAVYQSAGGTTPPTSTPPTSTPPTTTPPSGSRDAYAQIQAESYDAAAGVQVETCAEGGQDVGYLTNGDWMQFDNVDFGTGGVKDFVARVASGAAGGVSGLVEVRVDSRNNAPIGTFAVANTGGWQSWTSVPGNVANVSGSHTVYLTFTSGQPADFVNVNWVQFRR

SEQ ID NO: 11784 - protein, 425 aa, Actinoplanes utahensis
MKRSRSVLLATVAVVAAAGTATWFAGDASAAAACATAWSSSATYVKDNVAAQNGHNYTAKWWTQNESPATHSGQWDVWLDGGACGGTTTPSSSPSASPTTSKPTTPPASPSSSPTGSPTVQPTGTGSLPAHFLTGYWQNFVNGATPLKLAAVPSSYDLIAVAFADATATPGAVSFTLDPGLAGAVGGYTDAQFKADIATLHSRGKKVIISVGGEKGSVSVSSDAAAANFADSVYALIRAYGFDGVDIDLENGLNATYMASALRTLRGKAGSNLIITMAPQTIDMQSTGSSYFALALSIKDILTVVHTQFYNSGAMLGCDQMSAYGQGTENFLVALTCIQTQGGLRPDQVALGLPATTQAAGGGYVAPSVVNAALDCLARGTNCGTFKPPATYPGIRGAMTWSINWDVSNGTNWAGTIAPHLATLP

SEQ ID NO: 11785 - protein, 398 aa, Actinoplanes utahensis
MRTSRKIALVSAVLAAGTGAAVLPMTFANAAAACAPAWSAGATYVKDNVASQSGHNYTAKWWTQNESPATHSGQWDVWIDNGTCGGTTTPPTTTPPTGPTTQPPTTGTRMASAPYVYPGWGNPPAPATVVNATGIKSFTMAFVLASGGCNPAWDGESGLTGGVHASYLSQIKAAGADVVPSIGGWSGNKLGPNCTTVDALAGAYQKVISAFGLKAIDIDIENTDEFENTAVQDRILGALKIVKANNPSVKTIVTFGTTPTGPSYYGTRLVQQAKALGANIDVFTQMPFDFGGGSDMYAATVGATEGLKNTVKSTFGYTDAQAYSHIGISGMNGLSDQQETTTVDTWTRIRDYARNNGLARFTFWSVNRDRGCAGGGVVSDCSGIAQSDWAFTKVSAGF

SEQ ID NO: 11786 - protein, 115 aa, Actinoplanes utahensis
MSNVPLREPTFLVLTALAAEPRHGYAVIEDVAQMTGGRLRLRAGTLYTALDRLRQDGLIEVDREEVVQSRLRRYYRLTGAGERTLAAETARLREQATIAERRLKVRRTNLGGATA

SEQ ID NO: 11787 - protein, 322 aa, Actinoplanes utahensis
MTTLESRYRRLLRIYPATHRAAYEDEMLGVLMAGSPPDRRFPGPADAVDLIRGGLTARLGRALQGRHGTGWREAAAVTGLFTALVMVSDNAGTLISGLLEINLYGDPMRAHGLNDALLADPALRLLAWLALAVAALSGRGRAAALLSRVVVAAELTAVLWWAGMDTAVAIRLSWAPVVAIVTALLFGIVRPARPVREVLPRRSGLLVAAALPVMALAEGVLTIPELAWRFPYGLRTVWADLPLVLLVVAVALIGAPVRGRVVVLGLAVCVGPAVFLGVGESPALPPLVLVLAPAVVLAAGVVALSRAERFAARRRGEQGGHE

SEQ ID NO: 11788 - protein, 563 aa, Actinoplanes utahensis
MPNVLRPAGAENKGAMSDRWYQKAVVYCLDIDTFADSNGDGCGDIPGLIGRLDYLARLGITCIWLNPIHPSPDRDDGYDVADFYNVDPRFGTLGDFAELLHQAGNRGIKVIIDLVVNHTSDKHPWFVSARSSPDSPYRDWYVWSETAPPDRKQGMVFPGEQSETWSFDRTAKLWYYHRFYKFQPDLNIRNPAVREEIKKICAFWLQLGVAGFRMDAVPFIIEETVPGNPNPAKNFEFLTELRQHVQWRRSDAVLLAEANVEPAQLVTYFGDEGGSGNRIHMLFDFMLNAKMVLALAREDPEPIIDGLRETPKLPPGGQWATFLRNHDEIDLSRLTAEQRQDVFDRFGPDENMQLYGRGIRRRLAPMLGNDRRRLELAYALQFSLRGTPVLRYGEEIGMGDDLALEGRDAIRTPMQWSGMPNAGFSTADPADLIRPVVIDDGYGYEKLNVTLQRHDSKSLLAWFERMIRTLREAPEIGSGACTHVDVPAPKGLLIHRADDGTGTMVFLHNLGPDAVTADLSSLAAESELPNDVLSDTEYPDPGKLTELPVSGYGYRWIRLRRTA

SEQ ID NO: 11789 - protein, 254 aa, Actinoplanes utahensis
MSQSASSRVAIVTGAARGIGEAIALRLAADGLAVAVVDLDEGACANTVTAIHDAGGTAVAIGADVAYPAQVTAAVERVVAELGPPAVLVNNAGVLRDNLLFKMSEDDWDTVMSVHLKGSFLFSKAVQKHMVDAGYGRIVSLSSTSALGNRGQANYAAAKAGLQGFVKTLAIELGKFGITANAVAPGFIVTDMTRATAARMGVDFADFEKAMIGQIPVARAGRPEDVANTVSFLVSEGAGFVSGQVIYVAGGPRD

SEQ ID NO: 11790 - protein, 132 aa, Actinoplanes utahensis
MSSRSVSLTSTFLMLAAGGASACSNDRYHDEGFYCADENGVIVDEDYCDDHNGIYHGGGPYYIYHSPSYRSGYRVGSKLPSGGSRFPYNDSGSRSTYGLPSTGRVGNGTVKSGVVGKGGGGSHSSGHGSSGS

SEQ ID NO: 11791 - protein, 485 aa, Actinoplanes utahensis
MRRIPYGPVRDGWRLTNFSLGLTYNDDLLPDGTMYSYWQEGPYYDFSADEIEELESATATLYDMCLRAGDWMAGQCPRRTVEGRRRGFMTSICTAEACFLTRIGIPEYTHEQILRTWFDGDAETWTHQDKDPDMRLPMQTPDFSPTVYGRFDLWYNGAGSTPRLLEFNAQTPTSLVEAAVIQWHWMDQTGVSRHPWRQWNSIHDRLVGWEATPDGEPADPGAWRRNIAKLREARPWLPEKPKIYFAYETSETSGEDRMNVAYLMSTAEEAGFPVELIAMSQIGWDVAGDRVVHVPAPGRENESQPIDVIFMLYPWEWFWHEEGGKAFFRNMADPSKRGTVWIEPPYKAALLGNKALLPVLWKLFGDDPERAKYLLPAYFSGSKGAATLTSYAKKPVWGREGGSVTLVRDGTPITDNPSEYGSDGLYVVQELCELPSFDGLEGTVHPVIGSWLIDGEPAGMGIREGLGVEGLVTKNTCNFLPHAVS

SEQ ID NO: 11792 - protein, 329 aa, Actinoplanes utahensis
MDLAPQARSGRVTNLATPPLFAALASARRILIAGAGGGFDVYAGLPLAFALRAVGAEVHLANLSFSELELVDRESWIADHVVAVTPESTSPDWYFPEGTLARWLAAHDMPSTVYAFPPLGVQTLRAAYRFLVEHLNLDAIVLVDGGTDILCRGDEHSLGTPVEDLTSVAAVTALDVPVKLVTCLGFGIDAYHGVNHVQVLENLAALDREGGYLGALSIPGTSREAVLYREAVADAAKNTPDRPSIVNGQIAAALAGQCGDIQFTRRTSGSALFVNPLMAMYFTVDLDRLAARCLYLDRIENTVGRRQVITRIEAFRDGVTTRIPRVFPH

SEQ ID NO: 11793 - protein, 144 aa, Actinoplanes utahensis
MSDETPVKTRPGDAALGTGLGRVLLLVYGTFALSASARALVQISTKFGEAPLAYLLSALAGAVYLAATVGLARGGARGRLIALVSCTIELLGVLIVGTLSIADKVAFPDDTVWSRYGSGYGYVPLVLPFIGLWWIWRHKPGPAA

SEQ ID NO: 11794 - protein, 163 aa, Actinoplanes utahensis
MHHVRPGARTEQSETHDLPTRPLQDLRGRKLPAHRHVSNLCRVNGPLSVATIVVALLLAAWYFLRSALDRAPSRLDLLAMTGFSALVAVLVVVAVIGLFDGSRPADTTTFAGYLVTTICFAPAATWLAKLEPTRWGSLILGVGAVILPVLVLRLQQIASVTGV

SEQ ID NO: 11795 - protein, 297 aa, Actinoplanes utahensis
MRFGLFGTGPWAHMVHAEALAQHPEVEFAGVWGRDPARAAELAGKHHTRAYAEVDALLADVDAVAIALPPDVQAPIALRAARAGRHLLLDKPVSLRTAEAVELTAAAADRDVASVVFFTRRFVPETERFLAEAVAAGGWTEARIDHLGSIFTPGNPFGASPWRRDRGGLWDVGPHALALVLPVLGAVAEVTGLSGPRDLTVLVLRHESGAISRLTLSVDAPAGATRQAAEFAGEAGVWPVPAVEFAAVDCFRAALDQLLAAAAGGPAAAVDVRFGAQVTAVLAAADQALEQGRVVRL

SEQ ID NO: 11796 - protein, 153 aa, Actinoplanes utahensis
MPAGPVRPSRARVRRAAVRCVMQICPLTSRLPRRPRGSRLSGRSAPGKRDRRKSIRPATLRPSVTRRFCPVSACFGRQSLLPRETGAAVRPGIQNEGMHETETPPVWRTGAEQPWDPEDLAVAQGRYPTPENIARARAELERDGAAAIERTVP

SEQ ID NO: 11797 - protein, 114 aa, Actinoplanes utahensis
MTGLWDAERDAGEVMRALHGLAALLGRDPDEDTLRLMRQLAENGVSSAARVRDYLHEQRGPGDGDAAVVASVLAPWREWTPSRGHLFGAHRGSGPVGARRINEVPQPRRCDPGE

SEQ ID NO: 11798 - protein, 331 aa, Actinoplanes utahensis
MPDAAPGAVSPPAPGIVHFAGGAAEDAADVLHRFYHPVSLGMPENADTKIGMEVIQLGPLTVGHLTFTGRVTLAAPAADAYHVTLPVAGRVLARRGGREVTAGPATAVAFRPGDPVYLRPEAPSTEIDLRIEHWALESELAALLGHPIEGTIDLPATFALTGGPAHSWARLIHLVHTELEHRSSLIFQPLIAEHLCSSVLSGLLLSVPHRYHDELVAPAAAGPPRSIRRVLDVIHDEPDRAFTVADLAAIARTSVRSLQEGFRRHVGCTPMAYLQQTRLTRAHEALRVADPAVVTVAAVAHRWGFAHLGRFASAYRTRFGVSPSETLRRAG

SEQ ID NO: 11799 - protein, 155 aa, Actinoplanes utahensis
MASPSERRVRATSISGRRMVSRGKSASDLPTPEERAAVYLPITTRQLADGTVEIAPSGEIDLDNAHVMRDAVNDVLTTMTPSRICLDLQRVMLIDSIGIGILVACFHTAAASGIKLVVSHPSATVYRQLWVSGLVGLLGCAEPPSPRTSVGLRPS

SEQ ID NO: 11800 - protein, 264 aa, Actinoplanes utahensis
MTFFSEGLRLEGVLRTAPGSRAAVLTGPFTGVKEQVVADYAERLTAAGITTLTFDHRGFGASEGRRGHEDSQGKLADLRAAVGVLDGYDRSVVGVCLGAGYAMRAAATDPRVRAVVGIAGAYNSPAWFAERMGLPSYRSALAGMLERYDEEIPAVALEGEAAMPGEEPWSYYSKWIGSDGWRNRVTRGSLHSLMTLDVLGVRPLLPPSLVVHGRVDDYCSPELAEAMRADETVWLDCTRHVDLYDVDAYVSRAVEVTAEFLGKH

SEQ ID NO: 11801 - protein, 154 aa, Actinoplanes utahensis
MEFFVPDVLDEGCATRQALERLAVKWRVLLIYALSDGPQRPARLRRRIPGITPKMLTETLRGMQTDGLILRRVHKADPPQHVEYELTPLGRTLREPLTAICAWARDHSTPAPPPASAGPAFTAPQPSAPPQDAVPTRVTRRAPVSRSAGSAGSR

SEQ ID NO: 11802 - protein, 152 aa, Actinoplanes utahensis
MTGSWRHLPSPARPVAVAASAAVDAVQGNLAVAFDAAVAELAGLEQAHAGLILGTTVRLLLEDGHPDGLAADDVREALASCVRAHPEADPQVVLWLLAGALGVLDEDGAPGPKPDALARNAMLLITDLLAGRDLRDWLTAALTEIQRTQLND

SEQ ID NO: 11803 - protein, 122 aa, Actinoplanes utahensis
MTSLDAVAAWIAKYRKAWESNDPDDIRDLFTDDAAYFTAPYSSPWRGREAIVAGWLKHRDGPGTTTFSWQPLIVTEELAVIEGRTCYPDREYRNLWVLRLDHTGQARQFTEWWMQAPQPPEQ

SEQ ID NO: 11804 - protein, 546 aa, Actinoplanes utahensis
MAISGRQRLTDAALSRLFGRAPALHGYSVEQVRTPMRDGVRLLGDHFTPVTDRPRGTVLIRTPYGRGLPTSALNGRLFAARGYHVLLQSVRGTFGSEGTFTPMAQETEDGQDTVAWLREQPWFDGRLATLGASYLGWTQWTLLQDPPPELHTAVIYVGPHDFREAVYGTGAFTLGDFLGWSDQIVHQEDGGLRRVLSMATAPRRLRPALAGLPLPEAAEPVLRGRAPWYRQWLAHPDGDDPWWAPYRAGAALDKVTVPVLLIGGWQDLFLDQTLQQYTALRNRGVDVALTVGPWTHLQVGLHAAGLVARESLAWLDQHLAGGPAARKSPVRVHRTGERAWHDLPAWPPPTEPATFHLRSGRRLTTTAPGPDEGVAAFTYDPADPTPSVGGRTLTGSMGVKDNRALEARPDVLTFTTDPLPTAVDVIGGPTLTLTVTVDNPHADIFARLCDVDPHGRSLNFTDQHRRLDPGHPAGEPHRLELTLDPCFHRLLAGHRLRLQLSGGAFPRFARNPGRVGGGLAASHHTIDVAGCRLTIPVATAPPLTIR

SEQ ID NO: 11805 - protein, 367 aa, Actinoplanes utahensis
MRIGEHFGKLRRVDEGRKLGGRYRLLDELGRGGMAVVWRATDEVLNRLVAVKVLAGRYAGDERFRSRILHEARAAATLSHPNIAQIYDFGEDDSENPVPYVVMELINGPTLQQRIEDAPLPPRRVFRICGEVAAALAAAHEDGLVHRDIKMANVMVTPAGAKVVDFGIAAAAGPAEPEEGLLGTPAYLAPERLTGGAIEPASDVYALGVLLYRLLADESPWTVETTTQMLSAHIYAEPAPLPDLPGVPEAVADLVDRCLAKEPADRPSAAEVSEVLGDAAEAVSPPPAPPAPMLMPTRFDEQTEAIAEARLPVSVVRPVAADRRTRVLAGVVLALLLVTVGAIWVTRSDDSGPGGLGAGPPASAGAS

SEQ ID NO: 11806 - protein, 59 aa, Actinoplanes utahensis
MHEAALGVQPGAGRRRVLGAGLPPPPGPGTADGTAGPEGRTCALDGTSLTTAAGRCDAS

SEQ ID NO: 11807 - protein, 63 aa, Actinoplanes utahensis
MHAACAAGNVRLLDWTPADGYSVERVDPGPGLTASVTFASDVTRDRMSVTCFAGRPSAVVLPL

SEQ ID NO: 11808 - protein, 349 aa, Actinoplanes utahensis
MQGSEVGHGTESTRPVRSGGNHLAQTESMVAIALPPDAATRIRFGVSCLWEVVTSLRVLHGRGDHPVHRRWADRNRPGPGGLLARLVPPAGGYAPDFLTPPPAGLTADLDAELSVLRQTDHDVVRAHLALLAGDPAPGLAEDPDRGLARLCDEIAAYWASSIAPDWPRMHGLLDADVRRRAHRLATDGAAAVLNDLHDRVRWTGGTLLVDQRHCTASDVPDGSGLVLIPSVFAWPAVLTVSAWGTPQLAYPAAGVATLTETPAAPPDALSALLGAGRARILSELHVPRSTTGLARRTGLTAGGVSQHLRVLRAAGLVTTHREGRSLLNSRTAAAETLLAAAPSPVRRLL

SEQ ID NO: 11809 - protein, 249 aa, Actinoplanes utahensis
MTDFTALHQPGSPLVLVNVWDVASARIVAAAGAAAVATTSAGVAWSLGVPDGDALGREAAVAAARRIVAAVSVPVSVDVEAGYGDPARTLREMAAAGVAGVNLEDGRRSIAEQTERLAAARAAAPAVFLNARIDTLLFGLGDVTEAIERGRAYRDAGADGIFVPGATDPAVVGALVAGIPGPVNVMAGPGAPSIGELAKLGVARISLGSAVAQAAYGLVDRAAREAFTGGGYAELAGAADYGRLNELSR

SEQ ID NO: 11810 - protein, 384 aa, Actinoplanes utahensis
MILSSDTGGAYINSHRGAGTSRRLRAATHPLPIPNTSDLSGQRRWNSAGVALQRSARAVAVTALLLGGCSSTHEAAPPPSPGPEPRVTAEAVGGRPETLRVAPYIDVTAGPVAIDDLAATGQTDFTLAYLQAPPQGACDPAWGGRTPLADATVTGEADRITGRGGNVVVATGGPTGTYLESVCSEEQLAGAYRKALDAVGANRLDVDLEQQVTVEPVIRALTELQEDRDTAITLTLPVAGVTGFGSDAITMLKAAADAGLKVTVNALTMNFNAAGGGWGRAMTLAAGAARAALAGVWPDKSVEELWEMFGVTPMIGVNGTGGTTKPADAAYLLKWAKSKGVGFVRFWSVNRDTGACGNGTVAANCSGIIQTAYQFTIQFQKFSD

SEQ ID NO: 11811 - protein, 210 aa, Actinoplanes utahensis
MYAPPVSEDKINDRPFYRSKGFELLVLIVVGVLVAAGVRAYLLQTFYIPSGSMENTLLLNDKVLVNKVLYRFRDPHRGEVIVFQPPQAWGEGAADQEYIKRIIGVGGDRVVCCDPQKRLTVNGQALDEPYLFPGDAPSDDKFDVTVPAGRLFVMGDHRSDSADSRAHLDADQGTVPVDRVAGRAFAIYWPASRWSSLSVPDTFKSVPDKG

SEQ ID NO: 11812 - protein, 392 aa, Actinoplanes utahensis
MSAEAVFADVTGGASASQWAALAGGHLYSTEPWLTFCATDIGGETRTGALHVGTGDTAAAVTVTAVTTENNSFYQWQDQLVARGLPAPGPVGLLVGQRRGYQTHLLARPGAGDHAGPLLESLRKLRAEVPGTEVLPTAPRGPAPLVGVFLGTSDVAALRSAGADALPVLIATDAWIPVAGGWPDYLRSLPSKGRRDSVKQEVKAFAAAGYELVEDTLPNSYVTAAGLLARTQERYGHPYDLDVLTESFRRQAAAMGDKARVLYCRLPGQPPVGYSLFYIHGDTLFVRAVGFAYDRLIPGAAEYFNLVYYASVRIAAEHGLSWIHPGIESADAKALRGARLRPLWLLDLAEDSVLRDSGDLIRAHNAAVVRRLGESSPAVAKAFDADQCLPYC

SEQ ID NO: 11813 - protein, 427 aa, Actinoplanes utahensis
MPTSALLFMGDLVVLARQARLISDAARRGLAPVAVVGLGTDLGRLDALRADATHPLSALAEVVQVPDASIATVLQAVQPLLRRYEVRGVVSVGEVFVEPVGVLADCLGLPGAGTTASVICRNKLLQRTTVPEFSPEYEAVPADRRATFTVEAGRFPLVVKPAGRYYSSGVRLVTDQAELTAALTALGDDEIALVESRVVGPEFSVEAIVQGGVVLWSGVTGKESNEHETSYFTELAHTSPAVLDPDDHHALVAANTEIIRRVGLRDGITHAEYRLSSAGPVLMEIAARLPGDAITFLWELATGQPTEITIIDLALGVPAAYPAPRRRARQHFLSHPHGVLGDVTADGVEVVWPGVDDRWPAFTPRAAADDPHTHAVIVGRLPGDVLGDQIDSGHRSASVIVDAPLDADIEHATKTAAGRVTLTVRPA

SEQ ID NO: 11814 - protein, 288 aa, Actinoplanes utahensis
MSHEVLLTVTMLRPEEKLLARALRDRGIEVRTALFGDLAEVVSGPAAPPPLAIIRNVSHREAIDAARRLEHLGVTVLNRPSAIEICNDKGLQALVFDRNGIAHPKTLHVFGFDQVRAAVEEVGWPAVVKPVSGSWGRGVTRLTDEAGVAAWIGGRESVDAAGKAFPVLIQAYIDKPGHDLRVLVVGDQPLVAFRRVSQDWRTNTHLGATVERVEVTPEIAKLCRLVADALGDGFYGVDLVEDRSTGELLVLEVNASPDFARSSQVHGVDVAGHLADYAARRLEAGVPA

SEQ ID NO: 11815 - protein, 439 aa, Actinoplanes utahensis
MITDFPSAPLTLPDPEELTAELAALGGPAIIPPTARRTIFPVITKEDVFNLLLAQRADPQQVVADFAEAYRSYVGARYALPTASGTSSLHLALIGAGVQPGDEVIVPAFTFIATAQAVVAAHAVPVFVDIDPRTYCLDPAAAEAAITGRTRAIMPVHVHGLPADVPALRALADRHGLALVEDASHAHSARIGDAVAGSFGDAAGQSLMADKNFPLGGEGGIAFFDSEAGWRRAVDYVARHGIDYRMSWVAAAFGASQLKRLPYYDEIRARNSRVLADALDGTGLFAPPFVPPGHTHAYNMYRITLHPAAAGLDDLPGYAVKEAVHELLVAEGVPAREWQNTPIPCHLPFQRRTGFGGGYPFTLNPAAARDHRPEDFPVTLGMLDSTLVLCRELRSPVEYERILRYADAFRKVARRPDAIRKLVADRDYRRPYEKAARLG

SEQ ID NO: 11816 - protein, 347 aa, Actinoplanes utahensis
MAEQRIRVAIAGASGYTGGELARLLLDHPAVELAFLSSERHAGLPVAAQHPALRNHPGVAGLKFRPLDELPETDVAFACLPTGALPARLGLLAERAKRVLNLAGDYRLADPAEIRTHYPATAEHPAPAPFRYVVPELTVPLPDSRFVNLPGCMAVASVYALYPALRHDLVQPGVVVDAKTGSTGGGRNSTEQHADRAGNFRVHKLHGHRHGPEIRQALADLAGSAPDLQFSAHSLDVPRGILVTGYARLRSGVTSLEVKRAYAQAYIGKPFVRVRPAPKAPQDFPMLKAVVGSNVAEVAIAVQGDRLVAVAALDNLIKGASGQAIQVMNLQHGLPETTGLPLTAAAP

SEQ ID NO: 11817 - protein, 615 aa, Actinoplanes utahensis
MTRPLYVVKVGSSTLDRDGIHDELDELVARGARVLLVAGGAAGIERHYRAIGRAAPQLRLPNGDVVRHCPAEEMPHLVDAYEKVTLPAVEGGLRRRGRTAYTAVAARGGLVTGRPNRPLKVVTGAGRTGVVRDHRVGVPDRVDVTRIGALLDAFDVVCLSPPVLDPDDGLPLNVDADVLAAALARALGADHLRLVTGTAGLLTDPAEPGSTLRHAYPGEAMAYAGGRMRQKVRAAELALDSGADVAVTGPHTLREASGWTRFWPTREPAADLELLTHAVSVPSVSGDERELAGYLLDWCAARGIDAAIDEVGNLVATKGDGDRTLLLLGHLDTVPHHWPARWAGTELSGRGSVDAKGSLAAFLEVLSTVTVPAGSRVRVVGAVEEEISSSKGAFHVRDHYPAQAVVVGEPSGSQTLTLGYFGLFKLGVTASTPSGHSAGMDAVSAPDALAAVLLRIREAVGKLAPEALSAVIDLRTESHPGGHRAAGVLNFRVPPDADPEELREAALAVRGPDVEVEVLRNTPGYAGKRSGPLVKAFNRAFAGAGVRPRYVVKKGTSDMNTLATTWRDVPMVAYGPGDSALDHTDVERIGADEYRAGRAILTAAVEQWLTLGGDR

SEQ ID NO: 11818 - protein, 421 aa, Actinoplanes utahensis
MGGRPGRRGPPAGQSGDRGGPQRRSERRPGRGHLAAARPGRPVPRVRLRDGRGGRARRGRAVRGPGTRPGRPGPAAGGDRRHRQGQGRAAGRGPGELALRDHRRRPGGQVEGTGPMTLSGRDAYRDELTRLAGSDGSILCLEADLGGKGHPFQKAHPDRFFNLGIAEATMVDMAAGLAVAGFRPFVSTFAPFAALRAAESLKLTLGYLGAGVTVVAPYAGVSGAWFGTTHHCLEDLAVLRSIPGVTIAAPYGEQEMRAVIRAAARSGRPHYIRTGRGAAYDSLPFDGDDRPPVQWQTGPDPAKVCLVSVGEEGTRLSLEARAARPAADHAHLCYLDHEGLRAAAAELARRHSRFVVVEEHRAEGGIAEALALLLPGRTVTGVNAGHGWPSEGGDHHQVMGGLGLDLPAVLAALDDHLSDGV

SEQ ID NO: 11819 - protein, 542 aa, Actinoplanes utahensis
MSELHIDFRGETPTPAPNAPGARPGGRLILLADAEPEHMDPAQTYIGTTLAVATALFHRTLTGYLEDPAGGPRRLVGDLATDAGRTDDGGRTWTYTLREGLKYADGRPIRAQDVAYAVARSFSPYGVYGPQFLQQALAPDGGYDGPYADGAPAPGVETPDDRTIVFRLPAPEPLFPLLATTTTTTPVPADRDTRERYETDWVATGPYRVREFVPGSHYLFERNPHWDPATDPIRSRNADEIRWEFGVDRDEQTRRLLHPAGDDVRAIATFDVAQDRVDEVLGDPELSRRVVAGPSVYLQYIYINTRRVTDVDVRRALNFAIDRETLVALAGGPAAAEPATTVLAPNIPGYRPYDAYPAGASGDPLRAKELLAGKQLRPLVFAYPDTLPNVPVAPAVKAALERAGFEIVPRAVDKAAFYSLMGDAENDCDLIYGVWGPDFPDASGVFDVLFRGDRLTAAGNMNLSYFDDPEITARLAVLSREPDRGALADAYAELDRDLMARHAPVVPVYYKRQLTLYGPAVGGLSLSAQYFVPNLTRAYVAG

SEQ ID NO: 11820 - protein, 416 aa, Actinoplanes utahensis
MDTSPGAGRLRSAVSARFGGLPRSFWIVFSGMIANRIGTMVVPFLVFFLGARGFSTELTGTIVIVLGFGGMFGPALGGLLADRIGPRLTVIVGLALTPFSLGALYGAPNLVTLAIAAGLLGLTGTIYRPASSALVAETVGPDGRVKAFSLLHWGFNIGTAVATGMAGFLAVRGYWLLFLVDGLTCLVYAVIVLVGIPPDRRAPAAERVHGIGYGVVFSDRLMVGYLVLSAVGITVYTQTEFTLPLAIRLDGLSPSVYGAVGALNAVLVVLLQPLLFGWLSKVDRIRVLAASWVLIGAGVAGTGLADHLWQYAITVVVWSIGEVVNGIVAGSIVADLAPPGARGRYQGAFTWVWALARLAAPATAVGLFGTVGPAVLWWGCAVGGLLAGVASIALGPAFARRFAGNLESTPKQEATA

SEQ ID NO: 11821 - protein, 441 aa, Actinoplanes utahensis
MTDQRTEAYNALARDDFSPLRRVMDDVEKHPSLSNWTGSYLPRPLFADRRQLDAFAADVLTLFDVITSLPDRLFDGDLDRYTAALGVEPRRAKLIRSLGGITPPRYGRADMYHDGTSFKLLEIGIASEVGGADRAGEIPRALLENEAFAGFAAEHGLDYVHTGERVARTLRAAGASIGAAEPVVVLLEAPGGLANYASHWNTFRDVQRRAGLDFHVAEIGDITDRDGKLHLGDVAVDVILRCFTVEELIAEPDGEALVEPILRAHRAGSVVLFTPLESNLFANKGALALLSDPRRRAAFTAAEQAVIDRVLPWTRSLTDADELGLIDLGRERRETLILKPNGYYGGVGVIAGWETPEADWERALREGVADGAIIQERVVPRSEPVVDPGTGEVQPWQAAWGLFYTPEGFAGAYGRAVPAFESAVIGVTAYKNTRTAGVFHY

SEQ ID NO: 11822 - protein, 900 aa, Actinoplanes utahensis
MAGGLGAVLHPGGLRRGVRAGGAGLRERGDRCDRVQEHPYRRRFPLLRITEGMVVAGNLSRIEAEERGRLLQVLSYAVELDLTGDATSFGTTTVVRFGCTRPGATTFVDLAVPGLRRAVLNGVPLPATAYDADRGRITLPDLPADNELRIEAVGAYSRTGEGLHRFTDPVDDGVYLYTQLAPADAHRVFACFDQPDLKAPVTLTVLAPAGWQVAGNTAGTASPAGGDTARWEFPPTPPLPTYAVAVVAGDYHVVADEYPSIPLRLWCRRSLAGSLDAAELFAITKAGFGFFRDAFEVPYPFGKYDQVFVPDFNLGAMENAGCVTVHEKYVFRSRVTGLMYERRAETLLHEMAHMWFGDLVTMAWWDDLWLNESFATFAGVLALVEATRWTDGWTTFANLRKAEAYRQDQLPSTHPVAADIADIRAIEVSFDAITYLKGASVLKQLVAYVGQEEFLAGVRTYFRAHAWGNTTLPDLLQALEKSSGRDLRPWAEQWLENPGVNVLRPVATVDAAGRYTAFAVRQERGPRCPVLRSHRLAIGLYRLGPGGLVRTDRLELDVAGELTEITELTGAEQPDLLLINDDDLTYAKIRFDDRSLATVLTRITELTDPLARALCWAALWDLVRDGELPADRFAYTVAAALPVLIDGTLLQTLLDQARTALHRFVAPARRAELLARLAEATAAELTAAEPGSDRQLVLAQQFAATAVTGAQLDLLEDLRAGVRVPQGLVLDPDLRWALLRRLVVHGRAGDPEIDAELACEPTAVTARSAATCRAARPTPQAKAAAWYALTGGELTNLELRAVLEGFAEPEHAALLEPYAAQYFQQIDRVWREWSSGMAQRFVTGAYPAWSVTPDTIARTDAHLARPDVPAAQARLLREARDEIVRARRLLDLEDWTETPR

SEQ ID NO: 11823 - protein, 190 aa, Actinoplanes utahensis
MDGNSPMTTRAFLFLLASARPDGNTELLARHAAAELPPGATQRWIRLADTPLDTYADIRHREPPQERIPTGAERLLLDATLEATDIVIASPLYWYSLSAAAKLYLDYWSGWLRVGAPGSFRARMTEKTLWGISVYSGDNPADADPLLGALQKSAEYFPMRWGGLLLGQGNRPADILQDTPTLTRAKTFFS

SEQ ID NO: 11824 - protein, 269 aa, Actinoplanes utahensis
MSMSTPGPERVPSTVKVGKTTGQGKPPTGKPAGNRPPAGKGGKGGKGRKAVTPVKVSGGRNWGPIAVGTAVALVAIGIIGYGVYASFQSTRDWTEKMADISGVVNYRAQKNPQLDDRTHKDGALTYLTSPPVGGAHNQAWQNCMGDVYNAPIANEHAVHSLEHGAVWITYKQGLPADQVAVLQKKVEGKDYMFMSPYTGLDKNVSVQVWGYQFKTDDVKDKRIDDFVAAGRIKASMEPGAPCSSGNTTTGPVTAGSNGSTMNPAPTASS

SEQ ID NO: 11825 - protein, 553 aa, Actinoplanes utahensis
MTPANLADTVLSAARAVFETRGLDPAALPATTSLERPRNPEHGDYASTLALQLGKKVGVAPRELAAALAAELGSRAGIKSVEIAGPGFLNIRLDAAVTGTIARTVVEAGPAYGRNTQLAGQRINLEFVSANPTGPIHLGHTRWAAVGDSLRRILAAAGAEVTSEYYINDAGAQVDRFARSLFAAANGQPTPEDGYVGDYITEIAQRITGADPALVGRPAEAVLPVFLERGYELMLAEIRASLERFGVHFDVWFSEKSLHDGGAVEHAIAELRKQGHIFEEGGAIWLRTTDFTDDKDRVLIRSNGEKTYFAADAAYYINKRERGFDRCVYLLGADHHGYIGRLKAIAACAGDDPDDNIEILIGQLVNLVRAGQPVRLSKRAGNIITLDELLEAVGADAARYSLARSSTDSMLTLDIEEITKHSNDNPVHYVQYAHARICSILRNADERGMSKGEGYDPALLSHERENNLLKTLGQFPAVVATAAELREPHRIAIYLEERVATDFHRFFDACQVVPKGEAPVEDVNVARRWLAEATRTVIANGLALLGVSAPERM

SEQ ID NO: 11826 - protein, 461 aa, Actinoplanes utahensis
MRAHEAGALHGDLGNRGPAWLRTPEDVNALVPQLWPRTVTRTDAGSLQIGGVSVTDLAADYGTPAYLLDEDDLRARCRDFAAAFAGADVYYAGKSFLCKAVVRVVEEEGLFLDVCSGGELAVALAAGFPPERIGFHGNNKSAAELARALDAGVGRIVVDSFHEIRRLTELSRETGKRPAVLVRVTVGVEAHTHEFIATAHEDQKFGFSLAGGAAFAACAQILDENVLDLRGLHSHIGSQIFDTSGFEVAARRILELQAQVRDARGVELPELDLGGGFGIAYTTQDDPSAPGDLAKRINKIVESECEMAALRVPHLSIEPGRAIVGPAVLTLYEVGTVKDVDGIRTYVSVDGGMSDNIRTALYDASYSATLANRRSDAEPLLARVVGKHCESGDIVVKDEFLPADVQPGDLVAVPGTGAYCRSMASNYNHVPRPPVVAVRDGAARVIVRRETEDDLLALDVG

SEQ ID NO: 11827 - protein, 432 aa, Actinoplanes utahensis
MSQGKPVRLALLGCGTVGTEVIRLLHEQADDLTARIGAPLEVAGIAVRRLGRERGDLPVDPDLFTSDALGLIKRDDVDVVIEVVGGIEPARTWLVEALRAGKSVVTANKALLAEDGGTLHDAAAEGNADLYYEAAVAGAIPLLRPLRESLHGDRVTAVTGIVNGTTNFILSSMFSTGAGFHEALEEATELGYAEADPTADVEGFDAAAKAAILASLAFHTRVTAADVFREGMTAVTAGDMASAKEMGCTIKLLCIAQRSADAVSVRVHPAMIPLSHPLAGVGDAYNAVFVEADGAGPLMFYGRGAGGRPTASAVLGDIVAAARNKLTGTRAPSESNYAQLAVRPIGESMTRYHISLDVAERPGVLATVAGVFAQHEVSIATVRQSGRADDAKLVIVTHSAPDAALAATVAALAELDIVRSIASVLRVEGGAG

SEQ ID NO: 11828 - protein, 122 aa, Actinoplanes utahensis
MLDHVGFQCADLAASAAFYDAVLAPLGASRQMDFQVAIGYGNGHPDFWISTLTEGDGFRESHIAFGAADRAAVDAFFAAAVASGAEVLHEPRLHPEYHEHYYGAFVRDPDGNNVEAVCHRPE

SEQ ID NO: 11829 - protein, 349 aa, Actinoplanes utahensis
MWRGLIEAYRERLPVTEATPVVTLHEGNTPLVPAPVLSQRVGADVYLKVEGANPTGSFKDRGMTMAVSKAVEDGAKTIICASTGNTSASAAAYAARAGISCAVLVPQGKIALGKLSQALVHGAKLLQIEGNFDDCLALASKLSQDFPVALVNSVNIFRLHGQKTASFEIVEALGDAPDIHCLPVGNAGNISAYWMGYQEDKEAGNSTKLPKMYGFQASGAAPIVTGKVVEQPSTIATAIRIGNPASWTKALDARDSSGGLIAAVTDRDILNAYRLLAREVGVFVELGSAASVAGLLQQAAAGQIPAGSRVVCTVTGHGLKDPEWAISTAPSPIVVPNEALAAAKALDLA

SEQ ID NO: 11830 - protein, 175 aa, Actinoplanes utahensis
MIFRGGALVPSVIRSMCGGHQQVTKERALSANEKLIADIMGAQIRLQHLFADDRSHPLFSSHLTMSQLKILLLLSRHGTLPGGELARMVGVGAAALSGMIDRLVVQDLVTRTEDLNDRRIRRIGLTKAGAELIEGIITAGMTKQRELLSRLSAEELAVVLHATEILVREAASGQV

SEQ ID NO: 11831 - protein, 1072 aa, Actinoplanes utahensis
MSALTRLSLANRGLVALIAIVISGFGLYAIPSLKQQLFPSIELPAAFVSAVLPGASPEAVETEITKPIEDAVKGIDGIDTVTSTSRENVSSVVVSFAYGTDIQSAVNQVTTSINRIQSQLPDNVDPQIFAGGTDDIPAIVLAASGGTDESDLFNKLNQIVVPELNGITGVRDTQVTGARSKQVVITPDLARMGANGIAPTALTSVLQANGISIPAGAVTDGTRSLTVQVGTPITTVQQLQDVYLTGSRGPVRLGDVAKVESRLPVADSYTRTDGADSLGIAVTARPDGNPVEISHQVRDMLDRLQKDSGAKLTVITDQAPYVQRSIKSLATEGLLGLAMAVVVILVFLLSVRSTLVTAVSIPLSVLIALIALWTGDYTLNLLTLGALTIAVGRVVDDSIVVLENIKRHLEYGEEKVHAILAAVREVSGAVTASTLTTVAVFAPIALVGGLVGQIFASFAITVTVALLASLFVALTVVPVLAYWFLKPPAADVDTEAIRRAAEEKELRSPLQRGYLPVIRFATTRRWATVLIGIAVLIGTFALSTRLETNFLDQSGQDSISVTQTMPVGTSLAATDEAAKKVEAIVSGRKDVKTYQVTVGGNSANPFAGGGGAGTATFQVGLTDDADADVVSDQLRDEFAKLSGAGEIKVGEQSSGLGSNQLSVEVTAADNDTLTSATEQVKAAMAGIGGVADVDTSLAASVPRLDVVVNRKAAAAAGLTEAQIGQTVAGMFRSAPAGKLTIDGASQDVVISFGAAPGNPDALRSLPLTTARGPVPLSQVAEIKQVNGPEQVTRTDGNRTATVTGTVTGSNLSKVNQDLTKKLDALTLPPGASYSVGGVSADQADAFKQLGLAVLAAIAIVFIIMVATFRSIVQPIILLVSIPFAATGAIGLLLATGTPLGVPALIGVLMLVGIVVTNAIVLMDLINHYRAAGMGVQEAVIEGGRHRLRPILMTAIATIFALIPMALGLTGEGGFISQPLAIVVIGGLVSSTLLTLVLVPALYTMVENRKEKRRAKRAAKRARKAGVVPVPADEPVADDAAPAMEPAASGALRGYTDQFEVLKMPKGPAETQE

SEQ ID NO: 11832 - protein, 416 aa, Actinoplanes utahensis
MSATLSVLTRNRDFRRLFAAELVVFGADWFVMVPLLVLLPRLTGHGFWGGLVLAADTGINALLLPYTGTVADRRDRRRILIAANLASFLAVLLLFAVRSAATAPLALVAIGAMAVAKAFYQPASSAALPNVVDPADLPAANAIAGSAWGTMTVLGASLGGVVASVFGPYASFSVTAVGLLAASLLTALVRRPLQAGPAAAEASPASGPALREALRHIAVRPRLRALVTVKSAVGLGNGVLTVFPLIVAAHGAGELGAGLLFAVRGLGALVGPFVMRPVLARPAWLFTGLALSMGLYGLGYLGVAVTPWFPLVLLLVFVAHFAGGANWVLSNVALQAEVPDGLRGRVFATDLMLATLAIAVSQLGASAVVDRVDQAVVIAGCGLVTLVYAIGWWLATRRLAADSGAGNGIAGARHPS

SEQ ID NO: 11833 - protein, 314 aa, Actinoplanes utahensis
MGLTFVTEPVSVSTPATSANLGPGFDALGLALSLHDDLTARVTEGGFHVEISGQGAGELPADEEHLVVRAMLATFDELGERPPGLAVTCVNRIPQARGLGSSSAAIVGGVQLARGLVAGGLELIDEAAALRIAARIEGHPDNVAPCLLGGFTVAWTEAGGARAVTLTPAEGVRPTVFIPAERGYTATARAALPAEVPHRDAAFNAGRSALLTHALTSDPSLLFPATEDRLHQGYRAAGMPGTSSLVAALRSVGVAAVVSGAGPTVLALTEVPGDFYPGAHWHGEVLGVDGAGAVVKGGMVEHAERGPVAAGRKS

SEQ ID NO: 11834 - protein, 115 aa, Actinoplanes utahensis
MQFRVDSGFSDGRNPLSDTTDVTSGVSDVADGAGTTATATKRRRGGTGLSAMLLPELQSLAASLGISGTARMRKGELITAISERQSGGSAAAEPAPRPRTEAAPAQSAPASAPAS

SEQ ID NO: 11835 - protein, 540 aa, Actinoplanes utahensis
MQAEAAPAVTEPAAVAAPVADTTERAERPERGDRTRDRQRGERTDRGERTDRGERTDRGERPERAERADRGDRANERGERTNDRGDRNDRGDRNNDRVNDRSGDRGPRTDQGHDDDDNDGEGGRRSRRSRFRDRRRGRDRDDSPREDNRRDGGGREPHVSDDEVLVPVAGILDVLDNYAFVRTTGYLSGPNDVYVSMSQVKKYGLRRGDAVTGAVRSAPRDGDGQRRDKYNPLVRLDTINGMEPDEARRRPEFYKLTPLYPQERLRLETEPHILTTRIIDLVMPIGKGQRALIVSPPKAGKTMVLQALANAITRNNPECHLMVVLVDERPEEVTDMQRTVKGEVIAATFDRPPQDHTTVAELAIERAKRLVELGHDVVVLLDSVTRLGRSYNLAAPASGRIMSGGIDSTALYPPKRFLGAARNIENGGSLTILATALVETGSMMDTVIFEEFKGTGNAELKLDRKIADKRVFPAVDVSASSTRKEEILLGKEELAIIHKLRKVLSSLESGAALDLLMDRLKQTRTNIEFLMQIAKSTPGE

SEQ ID NO: 11836 - protein, 389 aa, Actinoplanes utahensis
MIVPGYRDHPTEPWDPDSPADPGEAEDFLRRCYTENPRLGPVEPRLAIIRAQIAATGTYVHTPDELTHGARMAWRNASRCIGRLYWRSLLVLDRRRARTADEIYSLLVRHLQTAGDTQIRPVISVFAPARPGQPYARVWNEQLIRYAGYRTEDGDTVGDPRLREFTTAVRAFGWRGKGEAFDVLPLVVETPSDGIRLYELPEQTICEVPISHPEYAWFTELGLRWHAVPAIANMRLTIGGVHYPLAPFNGWYLGTEIGARNLADADRYNLLPVLAARMGLDTSRESTLWRDRALVELNRAVLHSFERAGVKMSDHHTESRRFLQHLNNEERAGRPVPADWTWIVPPMSGGITPVFHRYYREMDLRPAFYLDDEAAALAREGMRGCPHPH

SEQ ID NO: 11837 - protein, 206 aa, Actinoplanes utahensis
MRKYPRTCHLPGSPGASADDRIQTDLSWLDGELVVTEKMDGGNLTFTRDAMYARSPDSGTHPWDRPAKALWAMTSYRIPDGWRVCGESMWARRSVAYTDLPGVFLVFGIWDETDTLLGWDDTVDWARRLELPMVPLLYRGGSLSEACAAWAAQRSEETSEGYVVRVTGRIPAADFPLKLLKWVRAEHVRTDAAWRHRDDFAVNEFA

SEQ ID NO: 11838 - protein, 298 aa, Actinoplanes utahensis
MTRLLITRGLPASGKTTFARKLQPGVVRVNRDDLRRMLHGERLFTQWSESQVTHAQRAAVEALLRARASVIVDDTNLRARVVREWAELAVRYGASFEVHDFTDVPLAECVRRDAGRPEQDRVGADVIRRMHERYLAGRNVPLPVPFVDPGGPGVVYAPDPELPPVVLVDIDGTVALMTGRSPFEWHRVGEDEPNPAVITAVRAMHAAGHAIVFCSGRDEVCRAETEAWLELFVDVPYEGLFLRPEGDSRKDAVVKREIFDTEIRDRWRVVGVFDDRQQVVRMWRALGLTVFQVAEGDF

SEQ ID NO: 11839 - protein, 356 aa, Actinoplanes utahensis
MTLLHDVFDPVTLTEAVQNGLVRTQRHPHLPLTIYNYTEACQYSGAWTPVTLACRGLIVDASGRIVARPLTKFFNHTEAQAPALDAAAPVAVTDKVDGSLGIIYHDGSGYAVATRGSFASDQAIHATTLLRTRYGSFTPPDGLTVLVEIIFPANRIVVDYQGLDDLVLLGAVEIATGRSHGPAAVPDWPGPVVETFGYATLAEALAAAPRAGREGLVVHFTEADQRVKIKYADYVRLHRLVTGLTPRSVWEILATGGDLDALLEPLPDEFHVWARGVAAELTAEVEARAAAVEAAYAGIVAALPDGWGRKEFALAAVRSPHRGELFQRLDGHDYRPGLWQRVRPSADRAAAGGTEE

SEQ ID NO: 11840 - protein, 132 aa, Actinoplanes utahensis
MTGRPLTLWLAKPVAPPDFRPVREAWQTGTSASKGSGSRSHSSQSDPAARIIERDREDMKSGIHPEYTTTEVICSCGSTFSTRSTAKGGEIRVETCSACHPFYTGKQRVLDTAGRVAKFQAKYAKVNAAKKK

SEQ ID NO: 11841 - protein, 362 aa, Actinoplanes utahensis
MSNDRLSTLLAEYADLEKRMEDPSIHADQALVRRVGRRFAELAPLYAAHAELEAARADLAAARELAAEDPAFAGEVEAVAAVLPALEEKLGEMLIPRDPSDAKDVIIEIKAGEGGQESALFAGDLLRMYTRYAERRGWVVEVIDSQESDLGGVKDISVAVKTKGVPEGGHGVWSRMKWEGGVHRVQRVPVTESQGRIHTSAAGVLVLPEAEDVDVQIEPGDLRIDVYRSSGPGGQSVNTTDSAVRITHLPTGTVVSCQNEKSQLQNKESAMRILRSRLLAQAQEAADAAAGDARKAQVRTVDRSERVRTYNFPQNRITDHRIGYTAYNLDLVLGGELDAVLDALAEADRQARLAGDTELSRR

SEQ ID NO: 11842 - protein, 442 aa, Actinoplanes utahensis
MTVIELGQVGPPDAEPEPGPEFRFRRHTVSRAVAAGLAVLCAVGLGGAARPAPPTLAESWSATVPVDSYPYAVQDIVLINSGDPGRPEVRALDAATGATRWAATHGEFPNGLSWSPENGRLYSALHTRTVQLTDGVAYFGTGTMAVDGHTGRTIWQRDGDQVGATAGEVLLGDRDDTGLITRLHLVRATDATELWQRPITPVENAVVDNGRIVFDTTGGEITTLRLSDGVPLATRRIDPPQAGTPGSSWQPQVLNGLFYDIRRTPADTAVTAYRVDTLTETWRATASGAVYVQDCGPVVCVSDTHLTIALDPATGARRWQLAESSIERIDDGHLLVGSRDEQSAWTVVDSRTGATVATAPPGGAVLTVTGKRYLVVLRDVTAPVNHVAVARWDPATGRQALLGSLPGRTDTCSMTGPRLLCYGGGRLGVTDLVAAAGLTTAG

SEQ ID NO: 11843 - protein, 1049 aa, Actinoplanes utahensis
MLPMQMCRTVNGATSGLPLDDLRNDVAQFFHRDRADPQDPGHVTGHVDHRARPRVGRRARLQVDARCILQLVAGLLGGQRGGRADLVRGGDRHRADLAQHLQGDRVQRHPDGDHAAGLPQVPLQARRMLHQDGQRARPERVGQVPGGPGQRVDQPVQGVPGADQHRRRHPAVRAAGVVQLGDRVRGERVGADPVHRVGGQHHELTAPGRLDGRRDATITIGDGGAVVEHHDVQSAMPSPAAGGGVSGPAGEIVVRGHLGEPAVRAQQAGHRRTVHVVVFDADPAARPEQRRGVRDDRPDHRQPVGPAEDRLGRVVIGHLGGHRGAVGDVRRIAEQHIDLTVQVGQQTRIGHVGLDHLQVADARAVAPQPGQGVRRPLHGEHPAGARLGGHRHRDRSAAAAQVDHQRARRGPLDAPAGQQLGLRAGHEDPGPDRELQVPERGRAEQVLQRDPLGPRGDQLAQPGRLVRADRVDQYQPPAGHIQHVGGEQLGVDPRRGHTGRGEFGGRRCEFGCQTGPAGVFVRRCHGIIMRRRARRGPAGSPSAAPSPGRRLVGWLDQLAEHADDLRRAGGLQQNGRSAQALPILDAVLSTATDPTTRAYALIQRFGALINLGRVAELAVAMAAAAEAVREVPDPYLRGQMHAFAALGAHLQSNLDRGVTHLVQAARSLAAVPEADEETAWGWHDLAMAYSYLGFHGQALTAIEQAREVGASAGLTPEVFAAPGIRLRNAVSLDHQGDTDGCLRVLRDIDAELSRYVATDQLRPGSRAVYGYALARRAALGEPTEDGAARWLTGGGDSVRTRDLQHLGAVCLTIAAGKPERALTMLETVPVSAEVLGAPEPARLRSICHASAGDHAAAHAADRYAFRLAAQRIDQLRDGYLDGVAARLDAQETQRDPHRYGDETLTDPLTGLPNRRQLEHYVDALLARGERAAIGVCDIVGFTTVNMRHGRHCGDLVLQRIAGVLARVMRRGDFVARFAGDEFVLVLPGAGPHQAAEVSRRISAAAAAENWQVLVPGTPIGLAAGWSEVGTNGRGLGAALAAAAASRKPT

SEQ ID NO: 11844 - protein, 468 aa, Actinoplanes utahensis
MARGRGDESAGRPAGSRPAWLRRRLPGAQAARRLHRRGRPDPHRDRRPVRLRGGAAPGRRRPDIRARRVRPAARRGRRRRAAPGQTRGGVGPPARGGHRRGGGPAARRRGAAAHRRPGRPVGPRRPDLPAGGRRDRGHHRPVRHVAAPVSRLAPPDAAGIDRAVAILRADSVVAFPTETVYGLGANAFSKQAIGEVYRLKNRPAWNPLIVHVATVEAARALAAEWPAAADALAARFWPGPLTLVVRRAAHLAGVGADNDTIAVRIPAHEVALRLLEASGLPLAAPSANRSESISPTTAGHVLRSLPDVPLVLDGGPCSWGIESTVLDLTTGVPTLLRPGALSLRALREVTGTIALRDTETADGTARPSPGMSRRHYAPRARTIMLPALREADRSGLAGPVAILSYEGCPTPSYDLIEILSADPREYAADLYAALHRLDDAGAGTILVQEPPRTEDWLAVRDRLSRAAA

SEQ ID NO: 11845 - protein, 926 aa, Actinoplanes utahensis
MIFARQRGMAAFIVALMVLAFGPPGGRAEAATARSVRVLSFNVCGSYQADCRPLEAADTWADRVAQQVRAWDSDVAVFQEMCAGQRELLAHRLPANYRIAWWTNRSGDNGCDKWLVPGVTADDDFGDAVLVRTDSPATTYSHELTELWDQGRTATAASEEKREVLCMGTVVQGRDSLACTVHLDTVSVDQGMPEAAAQMTSWAAGRPIILAGDFNADPFDPNLGAFYSGGGGTGAFREVDEQDRAYFTDGCRQLAFCRSGETTTFAGTDEAGRPKPARKFDYMFGSAAQVRWVRGDTVDPGFSRRDHKILRGEAVWADDRQPPAVPVVQPAADQLVPDSRSGWSGATDMVTGKFTADAIDDLVVRWYDGAVDLYPGLPGGRLGRPVVVRSTQGSGWSDAAGIAAGDFDGDHLADLAVRWSRNSLFVYYGKDGLRVSTPVLPVWSLNGVTEITAGDVDGDPAKNRDDLIIRRDDGSLAAITITGATAAPARQLMPAGSLTDARHIAFGDAYGPRPGAADHYDDLFVRWNSGSLYAYPGGSSGFQPFAQVQAAAADGRNVVAATALGDFDGDGVDDLVTRGRRQRAAPADDGRLHRYRIGADGTREQPALADAEFGFAGATHLTAGLFTDPEAPAVVARWDTGTVTPAMAPDGGYLRWDDVRDMAPLNLGDRLDDVVIRQGTDAVSVVPVPFRAGQSPAHPGQPVAAPSGGWCDGRGIAELTAGDVLGDGRDDLVLRCADGRVLGCPVLGSPASGDLTAGVPVVIRPAGDTGTVGMYADTIDGHRAVVLRTADGAATARVADDAGGFTTRDGVFPVGAWTGAADMIRDPRGDLLVRWDSGGVRRYPATVPDSGAPAALTVGSFDESGIDHFRYAVDAPADSDAAGWVDVRFGRGVIPLDGLSPGPHTVHVIAVDRAGNRSGELVRPVG

SEQ ID NO: 11846 - protein, 124 aa, Actinoplanes utahensis
MRIFSGSPFEEEFAYARAVADGDRVFVSGTTGFDYASMTISDDPGEQAAQCLRNIAAALAEAGSSLADVVRVRYLLTDAADFPACGPALREAFGDVRPAATMLVCGLLDERMKIEIEVDAIRRA

SEQ ID NO: 11847 - protein, 495 aa, Actinoplanes utahensis
MAEAPPFGAQSGVMRCLVTGATGYIGGRLAPRLVEAGHRVRCLSRSAGRLRDVPWAGQVEIVEGDLADPATLAPAFDGIEVAYFLVHSLGQGDFERRDREAAANFAAAARAAGVRRIIYLGGPEPPPGDVPSPHLRSRAEVARILLAGGVPTAVLRAAVIIGSGSASFEMLRYLTERLPVMVAPRWVDNRIQPIAVRDVLRYLIDAADLPPDVHRGFDIGGADVLTYAEMMRRYAVVAGLPRRVLLPTRVLSPWLSAHWVGLVTPVPNAIARPLVASLVHEAVARENDLATLLPGPPPLGFDESVRLALGRIRDADVETRWTGASGRDFAAEPLPSDPEWSGGSIYTDERAREVHAPADRLWRVIEGVGGENGWYSFPLAWSVRGWLDRMAGGVGLRRGRRDQEHLRVGEALDWWRVEEIVPGRLLRLRAEMRVPGRAWLEMRAEPDGDGGSVYRQRAVFLPHGLAGHLYWASVWPFHGIVFNGMARNIARGAEN

SEQ ID NO: 11848 - protein, 429 aa, Actinoplanes utahensis
METFWGPDFAALERDDPEIADVLLDELTRQRETLTLIASESFASPAVLAALGSTLANKYAEGYPGNRYYGGCEHADRAEELAVGRAVELFGADHANVQPHSGASANLAAYAALAEPGDPVLALGLPHGGHLTHGSRANFSGKWFHPIAYRVDPATELIDYDEVRDLALAHRPKLIICGAVSYPRLIDFGRFREIADEVGAYLMVDAAHLIGLVAGHAVPSPVPYADVVTCTTHKALRGPRGGMILCRADLARRVDKAVFPFAQNGPMMHAVAGKAVALREAGTAAFRRYASQTVRNAQALASWLTAEGMRPVTGGTDTHLAVLDLRELGVSGRDAEARCAAAGIAVNKNAIPYDPEKPAVASGIRVGSPSVTSQGMGEAQMRRIAELVGMAVRCDPETATGTTRLAAVGEEVTDLVRRFPFYLKQEVLA

SEQ ID NO: 11849 - protein, 154 aa, Actinoplanes utahensis
MSGVIPAAVEKDVDDDLPLPDLPPLPADPRWKVEHLGFLTAVSVALLLCAASAGFLSGGPAYALAAAGGVLIVTVSHTLTTLIVAWADTVRPALVMPLGMLTYVVKYSLFGIILAFGVSSDWPAKTALGLGVVAGVMVWTGVQAWQVTRATLRR

SEQ ID NO: 11850 - protein, 77 aa, Actinoplanes utahensis
MTGQEPPHDKRGDEGPTPPDSGAGMTAVTYLIAGMLVWGGIGWLVDHYVGTEGIFAGIGAVLGIGLGVYLIVRRLGA

SEQ ID NO: 11851 - protein, 263 aa, Actinoplanes utahensis
MVIVQSAVLAAEFPPSVEDFYLPSILPWGAESNYWFTKITVLVWIAVAAIIVFFLAAYRKPQLVPTKKQWLAESIYGFVRNNVAIDMIGPRGVNFAPYLTTLFMFIIVNNFFGILPFVQLSPNSHIAFPAFLAVISYVMFIYVGARKHGFFKYLKHALIPPAPWFILPLLIPIEFFSNFLVRPFSLAVRLFANMFAGHMLLLVFTLGGFAMISANGFLAPVSILSWALSIALTFLEFLVICLQAYVFTVLTASYVQGALADGH

SEQ ID NO: 11852 - protein, 75 aa, Actinoplanes utahensis
MLLSEVVGSTAAIGYGLAAIGPGIGVGLVFSAYIQSTARQPESSRLTLPYVWIGFAVVEALALLGIAFGFIWAGK

SEQ ID NO: 11853 - protein, 182 aa, Actinoplanes utahensis
MLTYLAEGAAKTPNPILPAWQEIVVGTVAFIVLCFVLMKFVFPQMEKTFRARVDAIEGGIKRAEAAQAEANELLEQYRAQLAEARTEAARIRDEARADAEGIRQDVLAKAREESDRIIAAGNEQLANQRESIVRELRAEVGTLAVDLAGKIVGEALADEARTRGTVERFIADLDAAGTAGGR

SEQ ID NO: 11854 - protein, 273 aa, Actinoplanes utahensis
MASGVTNQAYADAAERLHAATATSTGAQLATVADEILSVAGLLRGQPRLRRALTDPSRPGEDRGDLLHSLLSGKVTKVTVDALAALVAGRFSKPGDLLDATERLGVDTLLGAAQKDGKLAEVEDELFRFGQIVAGSPQLVATLSDIGAPVAPRAKLVRDLLDGKAQPITVWLVRVALEGFGGRGFEASLTRLVELTAARRDREVAYVTVAKPITDAEESALGAKLAAIYGREVSLKVDVNPAIIGGVSVRVGSDLYDGTILRRLNAAKQAFAK

SEQ ID NO: 11855 - protein, 521 aa, Actinoplanes utahensis
MAELTISSDEIRGALERYVSSYSPEVSREEVGIVSDAGDGIAHVEGLPSTMANELLEFADGTLGVASNLDVREIGAVILGDYANIEEGQPVKRTGRVLSVPVGDAFLGRVVDALGQPIDGLGEIANEGFRELELQAPNVMARQPVKQPLQTGIKAIDAMTPIGRGQRQLIIGDRKTGKTTVALDTIINQKANWESGDPAKQVRCIYVAIGQKASTVASIRGTLEAQGALEYTTIVSAPASDPAGFKYIAPYTGSSIGQHWMYNGKHVLIVFDDLTKQAEAYRAVSLLLRRPPGREAYPGDVFYLHSRLLERCAKLSDELGGGSMTGLPIIETKANDISAFIPTNVISITDGQIFLETDLFASGVRPAINVGTSVSRVGGSAQVKAMRTVSGRLRLDLAQFRELEAFSAFASDLDRASRAQLEKGVRLVELLKQPQYSPYSTVDQVIAIWAGTTGQLDDIPVADVRRFEQEFLQWFKSHQSDVYTAIESTNLLTDDNLESLKSGVTEFKKSFQSSAPAESGN

SEQ ID NO: 11856 - protein, 310 aa, Actinoplanes utahensis
MAGQVQALRRRIKTVKSTKKIAKAQELVATSRIAKAQERVNASRPYSVAITKVLAALASNASVDNPLLVARERVQRAGVLLITSDRGLAGAYNANAIRTAEQLITQLRSEGKEVALYVVGRKGASYYRFRNREIAASWTGFSERPTFADAKKIGDGLIEAFAAGSETAGTFGPEGIAGVDELHIVSTEFKSLMTQTANAKPLAPVQVEDETEGQSDGLRPAYEFEPDADELLDALLPKYLNTRIYAALLDSAASESASRRRAMKSASDNADDLLKRYTREMNSARQAAITQEISEIVGGANALAAAGSDV

SEQ ID NO: 11857 - protein, 485 aa, Actinoplanes utahensis
MTVLATSGASEPTKAETAVGRVVRVIGPVVDVEFPRDAMPPIFNALHVEVTLSEGTKKLTLEVAQHLGDNLLRAISMQPTDGLVRGKEVTDTGAPISVPVGDVTKGHVFNALGEVLNVDPSTLDIQERWSIHRKPPAFADLEPKTEMLETGIKVLDLLAPYVRGGKIGLFGGAGVGKTVLIQEMIIRVARNFGGTSVFAGVGERTREGNDLILEMDEGGVLDKTALVFGQMDEPPGTRLRVALTALTMAEYFRDVQNQEVLLFIDNIFRFTQAGSEVSTLLGRMPSAVGYQPTLADEMGELQERITSVRGKAITSLQAIYVPADDYTDPAPATTFAHLDATTNLERSISDKGIYPAVDPLASSSRILAPEFVGAEHYTVAREVQRILQKYKDLQDIIAILGMDELSEVDKVTVARARRIERFLSQNTYAAEQFTGVPGSTVPLKETIEAFKKISEGEYDNYPEQAFFMCGGLEDLEKNAHELMKG

SEQ ID NO: 11858 - protein, 373 aa, Actinoplanes utahensis
MLGVKGVLGTRNVPRWARLAAVFGSVLMMISGGVLVGGRALISRYTAGLDADGSLIGAGTGAAEIRGPINILLAGIDPRDDHTAPLSDSIIVAHIPASMDQVYLFSIPRDLYAAIPPFPPTGFAGTRSKINAAMSYGSQVAGGRHDVRQGFRLLAQTVSGLTGIRDFQAGAIINFGGFKQVVEAMGGVTMTVDMPVRSEHLRPDGRPRPRRPECADNSCPHPYIGPQKTYRPGTYHLQAWEALDYCRQRYGLPHSDYDRQRHQQQFLKAMAKQALSRGMVTNPARMLRVLDAAGDALTFDGNGHSLLDWGLALRNLNTDDMVSIKLPGGALVENGTYLGEQLAPGTGDFFAAVREDHIQEFLLAHPEFVNRNS

SEQ ID NO: 11859 - protein, 93 aa, Actinoplanes utahensis
MANQLHVEVVAVEEKVWAGEAEMLVARTTEGEIGVLPGHSPLLGLLKEPSQVRVKLAGGEQLTYDVAGGFLSIDANGVTVLAESATPATPEQH

SEQ ID NO: 11860 - protein, 155 aa, Actinoplanes utahensis
MRVLEVFGICLVALLALLFAIFFRRRLLMLGGGTIRLQVRTSTMVPGRGWSPGLGQFVGDELRFHKMFSLAFRPKRVLDRRTLAIAERRLPTGPERLTMPGHWVVLRCATAGVDLEIAMAETTVTGFLSWLEAGPPRDPGSVPGRSIFGPRSLES

SEQ ID NO: 11861 - protein, 273 aa, Actinoplanes utahensis
MRIRIVDAFTDRPFAGNPAGVLILDGDGFPAADWMQRVAAEVNLSETAFLHRLPAGSDAGWALRWFTPGAEVALCGHATLGTTHVLHRAGLLDGAAVRYATRSGILAATVAADGLITMDFPAAPLSPVEVAPELAAALGVDATAGFWTGPNTDDILIELADEAAVRGLTPDFGALARHTRRGVAVTARSAEHDFVSRFFAPAVGVNEDPVTGSAHTALTPYWAGRLGRTELTGYQASARGGVVRVALRGDRVDLAGHAVTTIDGELQVAISAS

SEQ ID NO: 11862 - protein, 190 aa, Actinoplanes utahensis
MAVHLTRIYTRTGDAGQTRLVNNEVAAKTDPRIAAYADADECNAALGTALALGSLPDDVRVVLGRIQNDLFDLGADLGNPLDENPPYPPLRITEEYVTRLEGWCDEFNERLAALDSFILPGGTPGAALLHVARTVARRAERSAWALIEADPERTGVLPAKYLNRLSDLLFILSRVANPDGDVKWVPGGSR

SEQ ID NO: 11863 - protein, 439 aa, Actinoplanes utahensis
MQSRRAPAHTMARVDVIRVKGGAPLTGDVTVGGAKNSALKLMAVALLGEGRSVVANVPRITDIAIMAEVLRRLGCDVTLEGTDAVIDVPLEPGAEADYDLVRRLRASICVLGPLLARRGYVRVALPGGDMIGSRGLDMHVSGLARMGAEISNEHGFVIASAPAGLRGTKIWLDFPSVGATENLLMAAVLAKGVTEIDNAAREPEIVDICDMLTAMGARIAGAGSSTLVIEGVDGPLRPVRHTTIGDRIVGGTWAYGAAMTRGDVTVHGVRPEFLDIALDKLVTAGATVEPGDNRFRVRMAERPRHVDIVTLPYPGFATDLLPMALGLAAVADGPSLITENIFDGRFMFVNEMVRLGAEIRTDGHHAVVNGRERLSGAPVRATDIRAGAGLVIAGLCADGVTEVGEVHHIDRGYPDFVADLARLGVEVERTDVPEPSFDF

SEQ ID NO: 11864 - protein, 111 aa, Actinoplanes utahensis
MATSDGWYLIGPLIAVGLVGFLGAVFWRMGLQPTVGADGYADGLAIFGEQEDYGLLSPAAVTDEPEIADEIRRLLSAAGIRATSATRRDGRVCVLVFAEEVEEARRLVGSS

SEQ ID NO: 11865 - protein, 282 aa, Actinoplanes utahensis
MAGRLAVIGSGLMGSGIAQVSAQAGWQVTMRDVDDASLKRGLGAIRDSLSRFAAKGRIAEGDVEATLQRITPTTDLEAVAEADIVIEAIFEKVEAKHDVFKQLDKICKAGAVLGTNTSAIPITQIAAITSRPESVVGIHFFSPVPMMKLVELVRGYQTSDATVAAARDFAEGVGKTCVEVKRDVAGFVSNRLFSALLVEAIKLVESGVVSAADLDTVMKLGFGHAMGPLATVDLTGLDVMLNAAGNIYRDTQDEKFFPPELLQRMVTAGDLGRKTGKGFYSY

SEQ ID NO: 11866 - protein, 257 aa, Actinoplanes utahensis
MTARDRQPPTRDYQLMVSALAEVTRRRDAELGQAEQAYQDSAARAAGELSRAENDALAADRWAGAAAAQVLDVDREAARLWDQLRRARGMRVRALGEVPEPAPIEALPRVALQRRPAGSADSPDIDGSVVVPGRQSPRALLARAADRIDDRFRPGSRRPLPRWSLPLLPLIGAIASTVAGLIAAGLVTFGHTAVFGGLLIRGLGWLTFLIAPSAGVPAAAVLAHRRLHARLDIGGIGLTLLGGMVAATLLSLSFATH

SEQ ID NO: 11867 - protein, 867 aa, Actinoplanes utahensis
MGSHRNALVAAVRQELAEARGTARAVLAAAESARGEAQGRRRLVRDAYATCLNQLAEAREAARDDIERRFRGEATRLAGHLRGLATSSATGAAGAPWRLWSPSEPDPGSRPGLLRIGAITFEETAALPGLIPLLDAVHLHVSGPSPQVDDLITGVLLRALGSTRAGDVHLTVYDPENLGGTLAPFAPLNPTFVGPGGLGSLLDDLAEHICRVHESLGGQYPTLADMVAARPGPRLEPWKLVVLLADRATSVEMTTAQRAQLGRIVRTGVACGVHLVVRGLELADDPSIERIVVREQIATCGSLGSLEIRLDPPPPPDRIAAFCRTTAERLQAGAGPARLADLEPAKHWTESSVHGLVAPIGDSTDGTLVEVPLGDDPPHALIGGPSGSGKTNLIYTWLGSLATRYGPEELALYLLDFKEGVSFARYAPGPRDPSWLPQVRLAGINVNGDREFGLAMLRHLGEELRTRAQAAKRCDAGKLSELRAEDPAGHWPRIVAVIDEFQVLLAGRDAVADEAVDLLEDLARRGRSQGIHLILASQDVAGIQALWGRPGLIAQFTLRIALPKARRILAEDNLAAAVIPRFHAVVNTESGLSGANRIVRLPDAGDRLVWRALQRTLWRERPAGCAEPRIFDGDAVPRLPGSLRPAGRMPAGDAPIGSSPGAVLGERIDVAAQPARLRLGRMPGRNLAVLGTRVTEACDVLSAAALSLAAQGPAHFSVICLDPSAQAAANRLYTELPSADWYDAGNVHFDLAFTDVPHYVIGFALDAARQPGLRTLLAEGPERRTHTLGWWRSVPRLRDDLGGVGARFDAIGAWVALDVHGADLAPLHPQPGGPAWYPRPRRALFFDRSVHRTPEVIIPYEVTSDRT

SEQ ID NO: 11868 - protein, 609 aa, Actinoplanes utahensis
MAAERLDHRDPGDPARHRGGGRQGAGGGPLQRRGADAGPADRGRPGVRGRLVVGDGHRHRPGAVLRLAPVGADRGRGADRVLRARGEGGVPAGGERHHGRFRCPGGQHRRGHHQCAALGAGDSPAGTGPGGPGPAGLGRGLGVPATEAAQAGAARGCRNASPVWLTLRVLAFAVPAFALSWWLAAYLIGRDPGRPALRWASAGLTAYGVGVAAWTVDPGGRTAQILICLPALAWAGSVVALLPLPPAERRPIDVGALVLGVSFQLLVIALPGAGKLVGLTPLGGALFLLWRGRAQVVPRRLPLALTLMALLYAAAMTALLVPLDAGGPVPALAASGVDLLVFGYLIAVAHAVTGGERLRPDLRRSLAAAAAVLVLVGLPATLTLYVVPADAVVTCLQFVPVGVAAAAAGLTGRMSRLLDRVALAGDVRLRHDRAALFLNADALLRRRERRTLAELGEPEFLRLTRRALADFNDLNRLSRSPLTGLPVVARRIAGRGDDQPRARARELRAVLRESVSALRPTGPFGTTEDWRYYNTLQFCGVLGLDPYARRQRLDGLSREARMAVDWFRRNVPEDTMRQWHREAAMIVAGHLWSEALSDDRSRHAASNPS

SEQ ID NO: 11869 - protein, 219 aa, Actinoplanes utahensis
MRLVIAKCSVDYVGRLSAHLPLATRLLMVKADGSVSIHADDRAYKPLNWMSPPCRLQEAPGVWKVVNKAGEELRITLEEVFQDYSYELGVDPGLQKDGVEAHLQELLAEHPETFGEGYTLVRREFMTAIGPVDLLLKDAGNASVAVEVKRRGEIDGVEQLTRYLELMNRDPLLAPVKGVFAAQEIKPQARVLATDRGIRCVVVDYDKLRGMERDELTLF

SEQ ID NO: 11870 - protein, 160 aa, Actinoplanes utahensis
MDPGPRHRRRNVRIGVVVDAVTPEENALLADGLRRLGGPLSGLVARLMPADVHEVEVALPLPRDEAERIAGAVLHRAGRPAGRLWAVVGSGAMDLNPAVVTVAVVAESGGTHGEGGAGEHRGCETVVRVRGVAKEGLIKQYAGRKAAERIAAGLAAITLE

SEQ ID NO: 11871 - protein, 130 aa, Actinoplanes utahensis
MTVAAVALPLLGLAWLATMARLVIGAIGEGLVVNANAGQGAAETAAAERATADFRRWATIAVIELAAFTVAAFVARIRWVGWVSLAVTVAFGGFAGLSLRDDPAGPQPRPTPTVSQCIERSGGDTRCPGG

SEQ ID NO: 11872 - protein, 267 aa, Actinoplanes utahensis
MSNQIRANSILPAKREDIELQTADGVTLVGELAVPLDREPVATLVCLHPLPTHGGMMDSHVFRKAAWRLPALAGLAVLRFNTRGTGSVRGTSGGSFAAATDERYDVAAAIEFAEFHDLPNIWLLGWSFGTDLTLMYGLDPAVQGAILLSPPLRFSQPAHLAAWAADGKPVTALIPEFDDYLRPDAAAERFAAIPQAEVVPVPGAKHLWVGDAEKVLDEIVRRVAPGTTTTPLPRTWDGPMESGDMNAYADRTVAAFADVEVPGPLRD

SEQ ID NO: 11873 - protein, 106 aa, Actinoplanes utahensis
MSPRRNRPRRDAEPDTGSQRPGITEQRVQQWQDGDWMVRNIFGAAATKTYLCPGCLQDIRPGVAHIVAWPHDGAGDDRRHWHTGCWRARDRRGPGVERSRNAPRYG

SEQ ID NO: 11874 - protein, 497 aa, Actinoplanes utahensis
MTATHVPGLPVIEDGQLISTNPATGEVAGRVPAADEKAVVAAVERARAAAAWWQGLGWDGRRTRLLRWRTLLVERIQELAELTRLESGKPVNDGIIEVTAAVEHLDWAARNAKRVLGPRRMRTRLLLAEHVGHLEYQPYGVVGVIGPWNYPIVTPIGPISGALAAGNAVVFKPSEYTPVVGQWLADTFAEIVPEHPVLQAVHGLGDVGGALCRSGVGKVSFTGSTATGKKVMAACAENLVPVVIEAGGKDALIVDEDADVQAAAEAAVWGAMTNAGQTCIGIERVYAVAPVYDAFVSAVVEKAGRLRTGEEIGPITMPRQLEIIRDHIEDALARGGRAVLGGADAVSPPYVAPTVLVDVPDDSTGIREETFGPTLTITRVRDAEEAISKANDTAYGLGGSVFGKKNAIRIARRLRSGMVAVNGTLTFVGMGNLPFGGVGESGFGRIHGEDGLREFARPKAITVRRARSLLPAMTFERTPAQVQQIVKALRLLYGRKP

SEQ ID NO: 11875 - protein, 212 aa, Actinoplanes utahensis
MTDHPAVEVSDLTVSYGATPVLDGVALTVPAGTAVCVTGENGIGKSTLLRCVSGLQRADAGRIRVFGATPGSSPEFWAAVVTTVEPPTWYPGLTTREHVELVCRAHGQDPDEAGVDEALERFGLAGHADAIPPSLSSGQKQRLTLAIALIRPSSLLILDEPEQRLDPDGRAMVAAMLVDYLATGGSLLMASHDDKFAVASGAELTTMESLTP

SEQ ID NO: 11876 - protein, 496 aa, Actinoplanes utahensis
MTIMVELGPVRRWIHQRQVSHRERGATLGNLYVAALVVAVFGAMTHRQLTRGFWPAHPDLGALPALALGLLGIGFLTMTLRAIGPVTLGRPAAYFLLTAPVSRRRLLLPSLRFAALGAAFAGALITFAITGHAAPHDRVPALILGGALIGIGLLLVAVVAQRVRRWATLTDRLAVLTVATGVALLVIDRVTAADRPASGGWPSAPALLAVAGALTVAVTAGFLVTVRLLPRTPDDRILEASKVTGTLFDTAFGMEPSFVTEMVARRYWANRRLRTTRPPARLPVLTGQDFLLARRRLPRLLWLLAATPIPLLLTAAPPWVAALALLLGAMIAGGTTTATVNTDAGNPVLLRLLSLSSRQALTQRLWVPGVLAFAWSLIALILMETTGHLPAGRWWLLSVPAGVIGGVAAVRRARAGFVRNDLLPLDTPMGTVSTGPVVYAVAGPDALILGIPIVIAFGRGTPLSLDLLLIQTALALLGARAYLAGTTDSARVDLQP

SEQ ID NO: 11877 - protein, 74 aa, Actinoplanes utahensis
MDATTFTCPHCGSAEIICVPSSMNDGYNRSGMTVSAFRTIPFSRVICLQCGLVREWITDRAQLDLLRKKFRPEQ

SEQ ID NO: 11878 - protein, 491 aa, Actinoplanes utahensis
MRQHGGMKRRWLFADQLGPHFLDEPGQPALLIESKAVFRRRAFHRQKAHLVLSALRHRAREGDARLVRAETYREGVGEPVSVCHPTSRAARGLVRRLPDVEMLGPRGFVTSPEDFLAWAGGREHLRLEDFYRYARRRHDVLMDGAEPVGGRWNLDADNREPPPRGAGRLDVPVPPVIREDEIDEEVRADLDRWEREDGITFVGHDGPRMFPATRAEALERLRHFVEHRLPSFGPHEDAMLAGDPLMAHSMLSPAINLGLLDPLEVVECAEDAYRQGAAPLASVEGFVRQILGWRDFIWHLYWYFEPQYRAVNELRARRELPEWFARLDADAVQARCLSDVLAGVRDRGWVHHIPRLMVLGNYAMQRGWRPGAVADWFHRCFVDGYEWVMTANVIGMSQFADAGRMSSKPYAAGGAYLNRMSDYCRGCRYDPKVRVGEQACPYTAGYWGFLARNEEALTGNHRLAQPLRLLHRLTDLDTLVEQEEQRGSRAP

SEQ ID NO: 11879 - protein, 488 aa, Actinoplanes utahensis
MSHGGEIFGLNGDSATEPSFEFAIRGYERKQVERYVARAENEIAALAAEREQAYSQIQAMAAQIERLQQEITQARRNSGMSGEVSFRHLGPRVEQILVLAEEQAEAIKASATDDIAGRLAEAERIRAEAEAHAHDGIRDFEIALAARRAEEEKADAAKRAAADKAVATARQTAEQIRTESEALLARARAEAQHLADKAAAEAQRLRAEVDGYVQSTRVQTEQELKALREKTNQEITARRTEAEREQADLKAAVEHELALRRHAVIEELGQMRSGVEKQCADLRSEADKYAEEVLRRSDEQATATRKELAAHQEKIAQAGRELEAAQAEVTETERRLAAAREQAEAAEQETERVRQRQAEAARELESELQRVADAKRAGEAAERHAADVRRQVQMEAKRVAELAAAAVLAAAASPDDQESAAVGSAPVASGSAPVASGSAPVASGSAPVAAGSAPVASGSAPVDKSSEKVSASAKVTVPQASRVPADAE

SEQ ID NO: 11880 - protein, 431 aa, Actinoplanes utahensis
MPQQQDQNLAFFETANTQHDFTVVLRGYDRHQVDGHIGRLLAALNQSEQARGEAEQRMNDAQRRLRQAEQRLNVLEQKLADSNKLLEENNRPTLSGLGTRVEQILRLAEEQANDHRGEAKRESEGILSAARLEAREITDKARAEAAAMKATAEREAGQVRTHAEREAAETRVQARREADTLRSDADRETKQLRTVTAHEVAELKSTVEREVSSLRATAEREITQARAKAGREAEEKRAEATKMLADARDKRDKDLQALALEIAERREKAESEESQRHAAQVAATQKMVSEAEERARAAEDRAKEIEQRAESRRIESERTAAEAVEKARALADKTVSEARSESTRLLSEARTEAELTTQAARREVEDLTRQKDAVTNQLGQMLSGLSGLVPGVGAAPAAVAAAVQKAAEPAAEAEPAEPAEEAEAEPAKTNS

SEQ ID NO: 11881 - protein, 170 aa, Actinoplanes utahensis
MTDDTSSTGRRENLTLAGDDLPGIGLLRIDHVGIAVPDLDEAIRFYGEKFGLRCVHQETNDEQGVREAMLAVGDGAGPRIQLLAPARPDSAIAKFLDRSGPGLQQLAYTVADVEAAADALRARGMRLLYDTPKRGTAGSRINFVHPKDAGGVLVELVEPAGPVRRPGDSA

SEQ ID NO: 11882 - protein, 393 aa, Actinoplanes utahensis
MTSSVIVSGARTPMGRLLGNLKHLPATALGAHAIAAALARGGVAPDQVQYVIMGQVLQAGAGQIPARQAAVAAGIPMSTPALTINKVCLSGLDAIALADQLIRAGECEIVVAGGMESMTNAPHLLMDQRKGTKFGDTTVRDHMALDGLTDPWAGVSMGESTEVAGGTLNISRAEQDAFAALSHQRAAAAQREGRFAEEIEPLPSGDRRAPGPIDTDEGVRPDTTAEGLAKLRPAFRPDGTITAATSSPISDGAAAVVVMSRAKAEELGLTWLAEITAHGNVAGPDSSLQSQPANAIKHALGKANLTVEDLDLIEINEAFAQVAIQSMRELKVDESKVNVNGGAIALGHPIGMSGARLVLTLALELKRRGGGTGAASLCGGGGQGDALIIKVPA

SEQ ID NO: 11883 - protein, 194 aa, Actinoplanes utahensis
MKRSPTAMLLLALLSEAPMHPYRMQQVIKERGQDQLVNVAQRNSVYQALDRLVRENLARAGETVREAGRPERTVYEITDEGRAMLRRWLLEMLPAPAREFPEFPVALAFLAMLSPAETRELLHRRIEALTERAAGIDAQAPPGLPRLFLLEDEYRSALLRAELDWLRAVVRDLENGTLTWDWTMIQATMAQFGS

SEQ ID NO: 11884 - protein, 400 aa, Actinoplanes utahensis
MYSHYMTKNAAVIGGGVAGTAAAIALHSAGFDPVLYERTAQGVADERGAFLTVAINGLTALAALGLDPAKVLDKGFPTPAMELLGASGRPLARMSLGEGTLTIRRSDLSARLRAEAQARGIPVIHGAALTRAVTGADRVEAEFADGRRVTAELLVGADGLRSRTRQSLDPSAPEPHYLGLLNAGGFTAGPVDPRLAPPPGLMRMAFGRRAFFGWATAPDGSVWWFANPPSKRPIDATAVTPASWRAHLLDLFDGDPSSPAAELIRASDEIVGPWNTEDMGPIRTWHDDRIVLVGDAAHALAPTSGQGASQALEDAVVLGHALRSNPTITTGLRAYESSRRPRVAKVAAHGRRGNSNKVMGPVGAAIRDAMLPTIFRLLNRKGDPQAWIFEHRLPPLPVRP

SEQ ID NO: 11885 - protein, 557 aa, Actinoplanes utahensis
MDAAEIQAGRERWQRRYDAARKRDADFTTLSGNQVDPVYGPPAGATHPGFERIGWPGEFPYTRGLYPTGYRGRTWTIRQFAGFGNAQQTNERYKMILAAGGGGLSVAFDMPTLMGRDSDDAHSLGEVGHCGVAIDSAADMDVLFDGIPLQDVTTSMTISGPAVPIFVMYLVAAERQGADLSKLDGTLQTDIFKEYIAQKEWLFAPEPHLRLIGDLMEYCAAEIPKYKPLSVSGYHIREAGATAAQELAYTLADGFGYVELGLSRGLDVNQFAPGLSFFFDSHLDFFEEIAKFRAARRIWARHLRDEYGATSEKALWLKFHTQTAGVSLTAQQPVNNVVRTAVEALAAVLGGTNSLHTNALDETLALPTDESAEIALRTQQVLMEETGVVNVADPLGGSWYVEALTDRIEAEAEEIFQRIRDLGHDGSVTAGILRGIEDGWFTAHIAEAAFAYQQALEKNDKRIVGVNVHTGTVAKELEILRVSHEVEVEQRRVLGDRRRQRDAARVKAALDELVAVSRTEQNMIPAMLEAARAEATLGEICDALRDEWGVYREPARF

SEQ ID NO: 11886 - protein, 312 aa, Actinoplanes utahensis
MSDPRTTPSIFTRGAVDLSALRTPAPAKPAAPSRSAAADGAPAGGVPGTLPGLAPETIVDVTEANFQSTVLERSLTVPVVLDFWADWCGPCKQLSPVLEKLAVEGQGAWVLGKVDVDANPRLAQAFRVQGIPMVLAVIQGQPVEGFTGVLPEIQVKQYIDAVLKAAGVSTGAAAPEDPRLDAADDALMVGDLDAAEAAYRKILAESPADAAAEAGLAQVELYRRIGGADAESALARAAAAPDDIEAQRLAADIEVLSGQADEAYARLVALVKKTSGEDRDVVRKHLLSLFAVAGPDDPAVAGARRALASALF

SEQ ID NO: 11887 - protein, 700 aa, Actinoplanes utahensis
MTWCASICCRCSPSPGRTTRRWRARGGHWPARCSSHRQTTQAGEGVVRRIAVLDAPSNLGLRPPTPTSVPGCAKAPGALRDQGLLPRLGARDAGCLTPPRYDPGDWRPGDGVAHAAEIAAYSRALADRIGAIIDGGEFPVVLGGDCSILIGSGLAMHRLGEAVGGRIGLVFVDGHSDFRHPGNASYVGAAAGEDLALVTGRGQANLAAIESRRPYFRDIDVVVLGIRAQDEYRLDLQAAGIVTRPVPMLRAEGAARSAQWARDQLVDCAGYWVHVDVDVLDPAVMPAVDAPDPGGIAFPELELLLTGLVESPHCLGVEITVFDPDYDPDGRYAAEITSAVVSGLAPVRTVTPRPDLIAARKDLANQPAAAPAARNESAPAVGSAVGAGVRAESASPAEDAAVVGAPAFAEAVESAPAAELGPASGRAALAEPAGLAALAEPAGLAALAEPAGAAEAEASVIAPSVAERASDGFLAEISDSGAETGAEPERAGTPAEDPIDRDPAESTGEELSDGDPAAPVGGGLSDGDPAGPVGGGLSDGDPAGPVGGGLSDEEPAASVDVGMSSDDAVAPVGGPSGDDAAIPVGEELPGEEPADAIGETLSDEELSEPGAASESESESESELENDKDGPVSVVPAAEKPVRPEIPLLSRPLGSAPLLDSEPLPATRPGMLRPRTPADPPAVGAAAVPRPGFGPAIPPVY

SEQ ID NO: 11888 - protein, 634 aa, Actinoplanes utahensis
MRRATVGLTALFTLATAGLAGCSGDKPQDTVVDFVNGWKNGDLGKVGFVTAGGGKIASADVLAAIKSTYGDLKDQPLAVSVAGDPTESGDVATTPIDLKWTLPGNVIWEYRSSVRMTRRSGDGWQVIWEPAVLQPQLDQGEKFRLHRVPAQRGTVLDAAGKPLVGPQKVVVIGVSPEKITNLPALTKALTAAFKKIKVDVDLAGLKDRVAKADPGAFLDLVTLRRPDYDTIRDQVRPLPGTVFREETRQLAPTRVFARALLGTVDPATKDDLDNRPSELTAGDQVGHGGLQGRYDQQLRGTPGLSVVASAEAADASVQEKPIFTAPPVNGKDIRVSLDTATQNAADRAIGAQKLPSSMVALRISDGSVLAVANGPDAGGVDTALTGQVPPGSTFKMISAYGLLSTGKVTADTVVECPRTRVVDGQTFKNSHDEALGKVPFHVDFAKSCNTAFVGLSSQLGADGLKQAAAALGLGGGWTIGVDAFTGKVSDGASPTELAAATFGQGTTAVSPIAMAVATAAVAKGGFQAPKLVLDPAPPAAPAPAALNPAALPALRSMMREVVTGGTGTALKAVPGKPVYGKTGTAEFATGSDETHSWFIGYQDDIAFAVMVQKGGAGAEAAVPIVNQFLTTLTK

SEQ ID NO: 11889 - protein, 1652 aa, Actinoplanes utahensis
MPVADEAATDSDQKDSRGPGPDLPAPGPGLALTGRLGASTDQGELDEPLPNAERLVAQAVERAGDDHATALLVDRFWRFAPDEELVGYTPEEMFTAAVEHRELARNRLPGELKLDLTEPRGAQSHTVLQVVTDDMPFLVDSVIALLTAHNLQVHLMVHPLIVVRREPLGALSELEADVEPDDAIEGDIVESWIRIEIDPVRRGEARDQLLNEVRRVLTDVREAVEDWPRMRQRALVISDELATARGSDRRLPVPEKDVTDSIELLKWLANDHFTFLGYREYRLDDGVLTAVHGSGLGILRGESRPRRLDTMAPEAYERAMEKRLLVITKANSRATVHRSAYLDYISVKVFDTAGEVVGEKRFLGLFSSSAYRTSVRELPVVKRKVTEVMDRSGLSPRGHSGKDLLQILETYPRDELFQIKTDDLYEAVIGVLRMAGRRQLRLFLRRDGYGRFISCLIYLPRDRFTTGNRLRMQEILLRELNGVGVDYTTRVTERMLARVHFIVRTDPAAPPGNLDPNVLAEQLADATRMWDDDFSLVLERKLGDEPAKELFNRYAHAYPESYKNGHTPYEGMQDLAKLELLEEPGQLEMHLYRRRRLGADGSPEPDDHDIRFKVYRFGEPMMLSAVLPVLHSLGVQVSDERPYEIRRDDGLVYLYDFGLTPPKVHRDLSEVRPQVENAFAATWRGEAEVDGFNELVLRAGLTWRQVVVLRAYAKYLRQAGNVFSQRYVESTFIAYPEIARLLLQLFEARFSPALQIGESDRTRRAGEVAARITELLDQVESLDQDRILRSYLTLIEATLRTSFYQRGPEGRPKSYVAFKLNPEAIPDLPQPRPKYEIFVYSPRFEGVHLRFGAVARGGLRWSDRREDFRTEVLGLVKAQMVKNSVIVPVGAKGGFVLKQKPGDRDEAVECYKRFVTALMDVTDNILSGKIVPPVDVVRHDGDDPYLVVAADKGTATFSDIANEISVGKEFWLGDAFASGGSAGYDHKKMGITARGAWESVKKHFRDLGKDTQSEEFTVVGVGDMSGDVFGNGMLLSEHIRLVAAFDHRHIFLDPAPDAATSYAERRRLFDLPRSSWADYDAGLISEGGGVYPRSAKKIPVSPQVRAALDLAGSVTALSPVELMRAILKAPVDLLFNGGIGTYVKAAGESHAEVGDKGNDAIRVNGSELRVKVVGEGGNLGLTQRGRIEFARAGGRVFTDFIDNSAGVDCSDHEVNIKILLGGAVTDGELGMPERDELLAAMTDEVGALVLRDNYEQATALANARAQAHSLLPVHRRMLIALEHRGELNRELEALPTDRELALRYENGEGLSAPEFAVLLAYVKISLEREVLADELVDEAWTNQVLHRYFPTPLRERYAARMAGHRLRREIISTALVNEVVNRGGTSFVFRAMEESGASAADVIRAYVVIRDVYGLTEIWAAAEALDNKVPTPAQTLVFLETRRLLDRAVRWLVSTRRSPIDVAGEIAKLRPGVATLLPQLPEVIVGAERRSFEERVTTLAGKGVPDDLADKVSRVFYGFGLLDILETATAIERDVTEVAQVYFVLSERFGVDALLSQISRLPRGDRWQTLARMALRYDLYAALAALTAEVLQSTPETASPDDRVSEWEQVNAASIARASNAMGDVGESPADLAALSVLLRQIRTLVKTSSAA

SEQ ID NO: 11890 - protein, 392 aa, Actinoplanes utahensis
MAATRLPGTPRLLRALNDRAALDLLLSRGPLTRAQIGELTGLSKVTASQLVERLEERGLVRRVGEQAGGRGPNAQLYAVTPSSAHVIGVDVGPDSVIAACADITGAVIGRAELSTKDTDDPVGVVHQAVVQAAADAGTDITSVRRVVLGTPGLVDPATGEISFAWDLPRWHRGLLADLRRDLSTPVVFGNDVNLAAIAESSNGAARGVSDFALVWIGRGVGLASVIGGRLHQGATGAAGEIGYLPVGGAEVPHNASKRGVKGAFQTLAAAEAVKAIGKQHGFRGAEAADVVRAAVAAGPAGEPVLDELARRLALGVAATCLVLDPPLVVLAGEVGRAGDAALADRVEREVAAITLVSPKVVVTGVAAEPVLHGALHTALDAVRDEVFGSTTD

SEQ ID NO: 11891 - protein, 312 aa, Actinoplanes utahensis
MPCTPPWTRSATRCSDRPPTDRVSRGTPSPGAVRAHGWMDGVLEAAVTVPPDEDTVIAFDRVSVVRGGSHLINSLSWQVELDERWVVLGPNGAGKTTLLNIASGRLHPTRGQAWVLGDRLGRVDVNELRTRVGITTGRLADRIPPDEKVLDVVVTAAWSVVGRWREEYDPQDVARARELLAQLGMGALADREFGTLSEGERKRTQIARALMTDPELMLLDEPTAGLDLGGRETLIGHLTELALDPDAPAMVLVTHHVEEIPPGFTHGLLLREGSVVAAGPLGEVMTAENLTKTFGLPLLVDRFGDRYTARAA

SEQ ID NO: 11892 - protein, 297 aa, Actinoplanes utahensis
MPPRVVVVGSANMDLVGLAATLPRPGETVLGDDFVMTPGGKGANQAIAAARAGAATTFLGAIGSDAFGVTLGARLAATGVDMAHVRTSYGPSGVAVIMVDRAGENSILVSPGANRTFVDLTEAERACIAGADVLLCQQEIPAGTVAAALAAARAAGTRTILNAAPARELWPSVLDLVDLLVVNETEARALTDITDSSAMSGLLALVPRVVLTLSGNGSRYADRDGTDVHVPAFPVEVADTTAAGDAFTGALAVAWAEGRALVEAVRWANAAGAACVRKVGASNALPERAEIEAIFAG

SEQ ID NO: 11893 - protein, 153 aa, Actinoplanes utahensis
MTTYYRDPDVLITSSGIHMNGRDFRLPEVRRIWHTRGARSWSVIARRGALGLAILSPLAVGALAVVVALLLHTDALHTVAMLIGGVLVGLAVVPVADLLLERVDRSYDAGSRTIEIWGRVPAGDVLLLRTTNAQRFGRIYRALLRALEPAVPR

SEQ ID NO: 11894 - protein, 257 aa, Actinoplanes utahensis
MGEFVRLEIADGIGTIRFDRPPMNALNTQVQEELRAAATAAAGDESVRAVVVWGGAKVFAAGADITEFTTVTYQHMVGRAAALSGAFDAVARIPKPVVAAVTGFALGGGCELALACDWRVVAEDAKLGQPEIKLGIIPGAGGTQRLARLIGPARAKELIFSGRMVEADEALRIGLADRVVPAEKVYETALDLVRPFVTGPALALRAAKQAIDAGLSMDLPAGLALESQLFAGLFATDDRVEGTTAFVEKRKPKFTGQ

SEQ ID NO: 11895 - protein, 673 aa, Actinoplanes utahensis
MAARPGCHPPDQPVAGDAAHTRTASAVRAESGAADDRFRPCRGRPAAGAEAAAQAAAEGQAGTPATAAAATTDRVEAAPQPDAALLPDRAQRADDDLRPARRADPVLRLRQRETAAEGRGRGLPGHRHPAAPVPRPEMTPVEGHGGELALAALRAFGVTEMFTLSGGHVFPLYAAAHESGFGLYDVRHEQSAVFAAEAVAKLTRRPGLAVLTAGPGVTNGISGLTSAYVNGSPVLVLGGRAPAFRWGSGSLQELDHVPLVAPVTRYAATVTGTADIPGAIGAALTAALTPHRGPVFLDVPLDVIFSTGRAAAPGEPAIGVLEPDPDEVATAARLLRDAARPVIVAGSDVWAGDAVAELRTAAEALDVPVFTNGMGRGALPPGHRLAFSRARRTALGQADVVAVIGTPLDFRLGFGDFGSARVVHVVDAPEQRATHVTPAVSPAGDLRRILAALAGTTGGHPEWITTLRAVEDAARARDAEAMAAETDPIRPARVYGELRRVLAPDAVTIGDGGDFVSYAGRFLEPARPGTWLDPGPYGCLGTGLGYAMGARVAHPGRQICVLMGDGAAGFSLMDAESLVRQGLPAVIVVGNNGMWGLEKHPMRALYGFDVAADLQPGLRYDEVVRALGGAGETVARASELGPALRRAFDSGVPYLVNVLTDPADAYPRSANLA

SEQ ID NO: 11896 - protein, 173 aa, Actinoplanes utahensis
MDAEERVRQAYEAYYRRLVIQATGLVGDLAEAEDAVHEAFARVLASPQSFLRADDAERWLRVAALNVARTRYRRRWLFDRLVRSGRVAIAPAAVPGISSDRVALFAALRRLATPTREAVVLHHLADLSVAEVAATLNVPVGTVKARLARGRAALAHHLADDEFHPLPAEVGHA

SEQ ID NO: 11897 - protein, 261 aa, Actinoplanes utahensis
MREPSFDKLRSDVGDAVRQPDFTTVQHRAGRMGRRRHARRWAVTGAAVIAVTGAVLAMPGLGDDRNGAAYASWTASPETLSAGDVQAISRGCVAKIDPLFGYTTAQLAAARKIVSERRGRYGFLSIVTHDWVTTCFRDSTGTVRSPSNMGRPVSDEALGRTGIELQGWGELQAGEGYILIMAGHLGTDVTAVDVNVPDGRTVHATVDDHYFLAWLPQKAGDGAGITFTMTLTDGTTIKDISARKLTDKMGTGELADSSGPS

SEQ ID NO: 11898 - protein, 108 aa, Actinoplanes utahensis
MVRLFIFLTAVALVLLILALIACLSAERVRVLPRPFWVLVVVLVPLAGPIAYFLWGRPVRTAARRPAPRPSAPDDDPDFLRAMDSEQSRRDRELLAQWERELHQDDEP

SEQ ID NO: 11899 - protein, 99 aa, Actinoplanes utahensis
MSDPGAAAQRTRLAWRRTGMSAAAVALLAVRPAFHPAAGPAQWLIAGAAMTGWATLTGLGLHRSPALRARPPRSPARTIRAYALITAAFAVLGGLVVML

SEQ ID NO: 11900 - protein, 149 aa, Actinoplanes utahensis
MTKYAICGITFLTDPVNNRRVFGGLLQWFDPESAHSEGTTPDYRFSLANERTFLAWIRTGLALIAGGLACAQFLPPLPIVRLREIIAIALLILGGVVALRAVDHWARAERAMRLGVDLPRSRFPAILAIVVALGAVLLVSMVLYRIFAA

SEQ ID NO: 11901 - protein, 258 aa, Actinoplanes utahensis
MNIVVLVKQVPDSGAERTLSASDNTVERGPGNVINEMDEYAIEEALKIKEAHGGEVTVLTVGPAGATDSIRKALSMGPDKAVHVQDDALHGSCAVATSKVIAAALGQLNADLILCGAESTDGRVQVLPHMLAERLGVAALTGARKLTVDGSQLTIERQTDEGYEVVTAATPAVVSVWDTINEPRYPSFKGIMAAKKKPLQSLSLADLGVSADEVGFAGATSQVLEFAKRPARSGGAKVIDEGTGGEQLVAYLATEKFV

SEQ ID NO: 11902 - protein, 310 aa, Actinoplanes utahensis
MAEVLVVVEAGVKKVTLEMLTIARGLGEVSAVVFGEADQAKLAEFGAAKIYTASGEDVENHGAAPKATAIAELVKRVQPAAVLLGSTQEGKEIAGRLAVKLDNGLLTDAVELAADGTATQVVFAGSTIVKSKVTRGIPIVTIRPNSTTPVAAPASPSAEALAVTVSDSDKLATITQRVAEQKGSRPELTEAGIVVSGGRGVGNADNFKLVEELADLLGGAVGASRAAVDSGYYPHQFQVGQTGKTVSPQLYVALGISGAIQHRAGMQTSKTIVAVNKDPEAPIFELADFGVVGDLFKIIPQAADEIRKRK

SEQ ID NO: 11903 - protein, 391 aa, Actinoplanes utahensis
MAYLDHAATTPMLPAALDAYAAAARAIGNPSSLHAAGRSARRMVEESRERIAAVIGARPSEVIFTGGGTEADNLATKGVYWARRDADGKRRRVVASSVEHHAVLDAVDWLGRHEGATVSLLPVDGAGRVDPDGFADLVRAHGDEIAVVSVQWANNEVGTVQPVPALAAIAAGAGIPFHTDAVQAVGQVPVDFAAAGVAALTLTGHKLGGPVGVGALVLGRDVSCTPLLHGGGQERDVRSGTLDTPGVVAFAVAVETTVRERLDYAERVAALRDELVRRVLAAVPDAIYNGDPDHRLPGNAHFSFPGCEGDALLLLLDAQGIYCSTGSACSAGVAQPSHVLLAMGADDARARSSLRFSLGHDSGEADLDALLAALPAAVERARRAGSWKTPR

SEQ ID NO: 11904 - protein, 370 aa, Actinoplanes utahensis
MRVLAAMSGGVDSAVAAARAKDAGHDVTGVHLALARNPQTYRTGARGCCTLEDSRDARRAADVIGIPFYVWDMADEFHAGVVDDFVEEYAAGRTPNPCLRCNEKIKFAAVLDRAVALGFDAVVTGHHARLGADGLLRRSVDLPKDQSYVLAVLTREQLDRAIFPLGDSTKEQVRAEAAARGLAVADKPDSHDICFIADGDTRGFLERRLGAAPGDIVDGRTGAKLGTHNGAYGFTIGQRKGLDLRVPAPDGQPRYVLSITPVSNTVTVGPREDLEVDTVTATRPIWHDGSDETECEVQLRAHGEVVAATVAVDSSGFVATLRTPARGVAAGQAIVAYRPDAAGDIVLGSATITAATRSSAATTLPESAHA

SEQ ID NO: 11905 - protein, 331 aa, Actinoplanes utahensis
MPDLPWPAGAATGIGSLPGTDVAEAQRIVLGELPALPHLPELPERGPGADMIGRGAGFLVELPVQLYAGRWQIAARPGRDLRRTADLLERDLDQLTEQADGFTGAVKIQAAGPWTLAASVDLPIGGRLLRDPGAVRDLTDSLAEGLRRHVADVRKRVPGATVLLQLDEPSLPSVLAGRVPTESGLGAYRAVDGPDAAARLRTVVAAVDTPTVLHCCAPDVPWQVIRDASFAAAAFDLSLLKDLDPVGEAIEAGLGLLVGAAPTRPVAERRPDAKQIAERVQTLWRRLGFPAARLPRQVVITPACGLAGAPQPYVRALLKACHEAGRRISEV

SEQ ID NO: 11906 - protein, 813 aa, Actinoplanes utahensis
MTTPSAEPTAVAAARHAELADEIRDHQYRYYVLDAPIISDGRFDTLLRELEALETEFPALRTPESPTQLVGGSFSSDFAPVRHAERMMSLDNVFSFDELSTWAERTVRDAGGPVAFLCELKVDGLAINLTYEKGRLVRGATRGDGRTGDDVTPNVRTIREIPERLAGDDVPDLLEVRGEIYFPAEAFADLNASLVEQGKAPFANPRNAAAGSLRQKDPRVTASRGLRMVVHGIGAREGFHPTSQSHAYEALRAWGLPTSSRWKLVDDMPAVREFIEYYGEHRHDVEHEIDGVVVKVDSVAIQGRLGSTSRAPRWAIAFKYPPEEVTTRLLDIAVNVGRTGRVTPFAVLEPVLVAGSTVAQATLHNAQEVARKGVLIGDTVVLRKAGDVIPEVLGPVIDLRPDDARAFVMPTECPSCGTTLAPAKENDVDIRCPNSESCPAQLLGRLATLASREVLDIEVLGEKSAAALLESGVLHNEGDLFDLTEDDLLRVPFFVNKNGKLGTNAGKMLQSLAEAKGRPFARYLIALSIRHVGPTAATALAREYGSMDRLEEVLAQTAAQPAAVAASAEAASLAQAASAVEAASAAEAASTAEAAGTSASVAGSAASSGSVSSDASGSGAASPGTADPARGSDGADSADPTGEGDGADSADPTGEGDGVDSAGAAVEQAKRKAKAIDPLAAVDGVGPIIADSLREWFTVPWHREIVRKWREAGVTMVDERVEAGPRTLEGLTVVVTGTLAGFTRDQAAEAVTSRGGKVSGSVSKKTGFVVVGENPGGKHDKAVSLKVPVLDEAGFEVLLKDGPEAAREVAELG

SEQ ID NO: 11907 - protein, 717 aa, Actinoplanes utahensis
MPWSELRLWLLLRIPLRVRRWRHLRDLDLWCERSVIEANRGGRMDAVRPRTAASGPRRRRALLVTVGSTAGAELSLWGAAPGMFRGLPAVYWIMAGLAVAADLRPHPLPGRRVSRVVLPSICFTFAIVLAWGLLPALAVQLVAVTVAGARMRQPVPRTVHLALQHVAGLGAAALVIALTGGRISPSPGPRDVALTCAAAGAWIAARYAVASLVRRWTAERRTRNRRRAPADLMATAALLLLSPVLLVAARVSPALLPLALVALHAVHRMVRWAGESERATRVDPLTGLPNRRALQSTMSERGPDRQRALILLDLDRFRTVNDALGHGAGDRLLARVADRLTAAVPRHDLVVRLGGDEFAVLATRVEGAASARRIAEHLTEALSRPFPMDGTPVELTASIGIALQSGRRDGATLLREAETAMYEAKQRGDQVAVHGPDAPHASPERLALLADLRDALRHDPPADGIVLYYQPQIAIATGEVVGVEALLRWRHPRRGLVGPDELLRVAEPTPVMRLLTARVLDEVIAQLARWRSEGMPLRAAVNVSARDLHAGEVADRVGRLLRDHEVPADLLQLEITESALMTDPHRVLDTITRLDRMGVAISLDDFGTGYSSLQHLRRLPLAEVKIDRSFVLGMATDPGDAAIVRSVIGLADSLGLRAVAEGVEDEATWLLLAAAGCHAAQGWFHARPMPADELVEWLSRYRPIRPGVRRGPWIPAK

SEQ ID NO: 11908 - protein, 99 aa, Actinoplanes utahensis
MAAISREEVAHLARLSRLAVTEEELDRFAGQLDVILQSVARVGEVAAEDIPPTSHSVPLTNVYRDDVPQPSLDQDAALSGAPDAYEGRFRVPRILDEED

SEQ ID NO: 11909 - protein, 487 aa, Actinoplanes utahensis
MTDLTKLSAASLSGLIAAREVSAVEVATAHLDRIAAVDDRVHAFLHVDREGALAAAQRVDDGEITGPLAGVPIAVKDVVTTKGIPTTAASKILEGWKPPYDATIVERLKAAGMPILGKTNMDEFAMGSSTEYSAYGPTNNPWDLGRIPGGSGGGSAAALAAYEAPLAIGTDTGGSIRQPGAVTGTVGAKPTYGGTSRYGLIAFSSSLDTPGPCGRTVEDTALLHAAIAGHDPRDSTSIAQPVPDVVAAARRGLQGDLTGVKLGIVKEFAGDGSEPGVLAAFKESLEALVKLGAEIVEVSCPHFQYALPAYYLIAPSECSSNLARFDGVRYGLRSGDDGSRSLEEVMSLTREAGFGPEVKRRIIIGTYALSSGYYDAYYGQAQKVRTLITRDFEAAFEQVDVLVSPTTPFVAFPFGSRTSDPYQMYLADLFTIPTNLYGGPAISVPCGLSEGLPVGFQIMAPTMADDRMYRVAGALESAIGTFTPPTL

SEQ ID NO: 11910 - protein, 508 aa, Actinoplanes utahensis
MTSRRRVCERPFIGSTANIPHDNLRGMHRYLAVVALGATVLCAGCTDKAAPPAVATASQPAAAPAIDYTAWQGGKSVTVADRLYPEHGNAGLDVLHYDLKLDWQPTSKVLTGTATLQIRPVTAASEISLDFANLAVDKVTVDGRPATGTLAKDKLTVPATLTAEQPVTLVVDYHGTPRQVAYPSHRGDAAEGVGLRPTRSGGLWTMQEPWGAMTWYPANELVSDKALYDIAVTVPQGWAAAASGTPGPVEGTTYHYSSAAPTAAYLTTLAVDRFRKTSQTGAHGLKFTYWTVAKTDDRLLTELKKSPQLVSWLEAQLGPYPFDTAGAVLSDSVSAMETQQMLSIGRQATGQKFDPAYFDEILVHEYAHQWFGDAVTPSDWTDLWLNEGFAQYMQYLYEQKVYKLTDAQLETFLRQQDARLRKSVGPPGKPKAANFAESNVYRCTAAMLKQLNDALGDKKFFDLMKAWVAEHKGTNQDRAAFTAFVREKTGTDYSKLIDSWLDSPSTPK

SEQ ID NO: 11911 - protein, 499 aa, Actinoplanes utahensis
MTTIALPSYDDALSRYEPVIGLETHVELGTQTKMFCGCRTEFGAEPNTQVCPVCLALPGALPVMNRAAIEATIRIGLALNCSIASWCRMARKNYFYPDMPKNFQTSQYDEPLCVDGYVDVTVDGKEYRVEIERVHIEEDTGKTLHVGGATGRIHGATESLVDYNRAGIPLVEIVTKPVPGLGALAPEIAKAYVAELRDIVRSLGVSDVRMEQGSMRCDVNTSLNRPGEEWGTRTETKNVNSLRSVERAVRSEIIRQAGLLDEGVRIFQETRHFQETTGDTRPGRSKETATDYRYFPEPDLVPIAPDPAWVEELKASLPEKPSVKRARLREDWGMTEIDMQSAVNAGAIELIEETIAAGASPAGARKWWLGELARRSNELGVELAQVGATPAQVAELQKLVDDGKLNDKLARQVLEGVVGGEGSPAQVMAARGLEVVSDTGALQAAVDEAIAANPDIADKIRDGKVAAAGALVGAVMKTTRGQADAKTVRDLILSRLGVS

SEQ ID NO: 11912 - protein, 546 aa, Actinoplanes utahensis
MSEPTPSWRRRLRSTADSTVRVWRHRWFRGARISAAVGLVSITAAMIGVMLFAHTGINVGPFRAEMSLSPSLAGGTEVDIPPLGSLHLDSHRGALHLKVALGSLDQSRTEALIDNPAAISSAGDRAVEEVTTGVTRLALRAIGLAVLGAILAAALIFRSVRRTAAAGVTALVVGAGSFGVAAATLRPDAISEPRYEGLLVNAPAVVGDARRIADNYGRYAEQLQQIVSNVSRIYTTVSALPVYEPAGNTTRILHVSDLHLNPSSWGLIRTVVQTFDIDAVIDTGDMVDWGSSAETSYVSSIPSLNVPYLYVRGNHDSVAIQSAVARQRNAVVLDDKLTTVDGLTVAGIGDPQFTPDKSETNKAGDTSGSEILTAAGDRLAKTIRDSGKKVDIALIHDPEMAPPLAGVVPLVLAGHRHQRSVAMLPAWKPPAPDPSASAAPSPTPSVSAAAAPPPIATRLMVEGSTGGAGLRGLEGEEPTPLSLSVLYFDENHNLKAYDDIRLGGTGESNVEMQRNVVGLDKEQPAVTPATSVPSGAGRSPAVTPSR

SEQ ID NO: 11913 - protein, 386 aa, Actinoplanes utahensis
MRSRRARAAIATLAVVLALTSGCSFGPPGPDEAGSAPNLPGPSVAATSSADPGEPDVVATVLAKGLDVPWGIAFLPDGSALVTERDTGRILKVGPGSDADGLKVAEAARLPEVRASGDGGLLGIAISPKYASDKTVFVYYSTATDNRIGRLVLGKPLEPILTGIPRSAQQNGGALAFGPDGFLYAGTGDGTTTGTQAPDPKSLGGKILRLTRDGKPAPGNPVKDSPVWSSGHRNVQGITWDKTKRMFATDSTQPKFGELNIVEKGSNYGWPKADGKAGDSKLTDPLAAWPSAESSCGGVAAMESLVATACLLGKRIYLLNVTANGTVLGTPQQLLTDKYGRLRALVAAPDGSLWVSTSNQEDAGEPDPEDDRLIRLVFSDGGAGRS

SEQ ID NO: 11914 - protein, 249 aa, Actinoplanes utahensis
MLLGRAGARGDTATTGPLRSCRGNGSRHAGRNKRSLHPNNEDSPERVTGGLIPDRRPWTDGGQSGRWTTPAPDPVDDGAGRGPEGRKTRVGLVEREWDNGRVSRRPALRVRKSGTALVAAGIAVVSAVPLAGTSWALAPLLLIPLTALVWAWRSGTDVFPDEVLVRALFGGTRVPWSRITGLAPDQRGRVSALLDNGNVIRLTGVTRDNVSLVLDAAGKSATGTDEPADEPATGTDEPVDAADPAEVDR

SEQ ID NO: 11915 - protein, 230 aa, Actinoplanes utahensis
MAVSPLAPARPSNTGRAALLAVCSAAALVLLTGVFGLLPGPLTLAVGVGVAGLCASAYLVHAALDIHHADGTFVACRGAGFVGMGALATALTALIPWWSPPHAVLWLTAGLGVAAGCYVLGAALLPNAARTWPIRLRRGFDGLGLGVSLGYAAYLIPPDGQTRPAALPALLITAGGVSIVTVVVLRARPRPVPTVWCGCGAAVVLAALAALAEVLALGLTGPAVPLLGLA

SEQ ID NO: 11916 - protein, 603 aa, Actinoplanes utahensis
MVGVAAALWHLVTTRHFDAGGIVFGMVMVSVLVLRELLVVRDIRRYAGRLRIAEAHFRSLVAGATDLTLVLDDRLTVRWQSPAAARLFGLHDNEVVGRAFGDLIHPEDAGDALAVIGSVLAGEHEGGPPVLVSARLRDGSQLWRDTESTISDQRAVPEVAALVVHVRDVGERRHLERTLHRMAYLDQLTGLANRRALMRDLLAARRRPGGPGTLLVIDLHGLAEVNDTHGRAVGDAVLTEVARRLRALSGGEDVPARLAGDEFAVLTPESAVPAYALATRLVSALAEPCQLPGAQVRLHTSVGLAELAGAAGPEEVLRQADLARQRAAQLGRDAVEWYDPDVELHLQRRMELERQLPGAAARGELDLVFQPVSDLRDGHPAGVEALLRWRHPALGTIRPEEFLPIAAGLGITDTLNEWALNDACRHLRNWTGGDDDFWVSVNVGPRELLTARFPEQVRTTLRRHAVTPERLVVEVAQTWIAEDVPAVVAALAGLRRLGVRAALDDFGSSQTSLTHLRRLPVDMVKLSAELAGAEAGKPVLDVVVGLAKRIGLDLVAKGLETPEQIERVLAAGCRYGQGTALVPPAPAERIEAYLETHRADRGS

SEQ ID NO: 11917 - protein, 339 aa, Actinoplanes utahensis
MKRPTIADIARRAGVSKGAVSYALNGQPGVSEATRKRILAIAQEIGFNANSAARALSGARARAVGLTLCRPARILGIEPWFMGLISGFEAELGAQSYALTLQVVATPEQEVEVYRRWWGERRIDGVIVTDLRENDVRIPVLQQLQLPAVVIGGSGEPGGVTQIWSDDGGAITEAVRYLVALGHTRIARVSGVPDLLHTQVRTKAFNEVCAALGLGDAVTVPADYTGEEGSRATRRLLIGGGRPTAIIYDNDVMAVAGLAVAQEMGLSVPGDLSIVAWDDSPLCSLVHPPLTALSRDVSGYGAQAARELLTAIDGRRVGNVKAQTAHLTPRGSTAPPRPA

SEQ ID NO: 11918 - protein, 824 aa, Actinoplanes utahensis
MSATGGAPPLSHRQILQVLSGLMLGMFLAALDQTIVASAIRTIGDDLHGLSLQAWVTTAYLITATISTPLYGKLSDIYGRKRFFVTAITIFVVGSAACSFATSMYQLAVFRAVQGLGAGGLFSLALAIIGDLVPPRERARYQGYFLAVFGASSVLGPVIGGFFAGADEILGLSGWRWVFLVNVPIGAVALVVVAKVLHLRHTRRDHRIDWWGAVALCVCLVPLLTAAEQGRTWGWTGSRTVLCYAVGAAGLVAFLVAEARMGAEALIPLRFFRNRTFALTSFAGFVTGMGMFGGLALLPLYLQIVHGASPTRSGLQLLPLTAGIMAGSLISGRAISATGRYRVWPMLGAPLMIGGMGLMHSLAVDTPYWRTGVFMGLFGLGLGFVLQPVTLAVQNAMPPQDMGVATASATFFRQMGATAGTAVFLSLLFSRVGDRIRDALRVAGADPAFQKLMADPANRRVLGGSLDDTSFLRHVDPVLARPFESGFAATIADICLVAGGVLTVALILFAFLPQVPLRGSAPAGPAELSPSSGSATDLSPSPGSATASPASSRSPHSPSPPARSVDALSLSGVVTGLDQRPLTGARLTLADLAGGQAARAVTGPDGRYLLTPEVAGAYLLICAADRHQPAAIRLTVTGADARDVRLAAGGRIEGDVVDQHDRPVAAATVTLTDAAGAVVASAITGPDGGYVLAGLYPAEYTLTGIAPGARPAARTVVLDTGGVSRADLLLAGNGTLTGQVRAAASGHPVPEASVMAVDEAGAVVATTWTDADGRYAFADLVPGAYTVTASGYPPVADRVELIGELTAHDIMLGGPREGSRLISP

SEQ ID NO: 11919 - protein, 709 aa, Actinoplanes utahensis
MKSHLARWSLAAGVTLAVIAPLAGSAAATVIAPPTPRDGRLTQVGPIAEHGFPAWYRDSTGARLEPCTTLDDPLCAVLPTEVPNADLPVSYPDNFPGEFFYQLADATLTLTDGTKATIGLNVEGAWANNAVIPGDQMVFGRVRIRFAAAAGRRFRITHPYGIDDLTADDKGVRMTEDAGAIPGAFGSVLNGRVGPFLKWDPAVAPAAPIGYIGDPGVTHPVVGSPYGTNFVRIEELDPQSGAVLGQVGFTDQFTVQGRYATNAGVDVDQATFTSGPDGSGAVEVYATSEPGQAIEIAANPALGIRGTRLRGSGNGRYYGRFAVAGPLPAGASVEIVNASDRPVARKTRRLVDVVQITEARYDADAQTLTVAATSSDRDAQPGVLSVAGYGPITGQPFTGVLAAPATVTVNSSSGGAATASLLGSGAGFGPARPVAGATTDASPVAGQVVKLDGTGSTGEIDAYSWTQTAGPAVTLTGSATATASFVAATPGTYTFSLTVSGPGGQSLPTAVTVTVVPAAKPVAVAGADQTVLRGKVVALDGSASTGAESYSWKQISGPAVTLAGASSAKPTFTFPAQALPAAPGPNAGFVFDNDPVVLELTATNPNGTATSRITVRPQAETFPGGVTARYRTGNNEWRITGTSSLIAGQRITAVLGDTLTGRVIGTSPVDAAGAYSIRVTGPAPGAVRTISVVTTVGGRQLAVAVTITN

SEQ ID NO: 11920 - protein, 618 aa, Actinoplanes utahensis
MALLRSVSQLRPASGDHHNVWLQVSVLGQLTVVDGDGGVLPAGELPRRARQVLAVLAARHDRIQSKDALADAVWGEDLPGNHAGALEHYVSVIRRRLQPQGGPASWFIVTRSGGYLFDTARAGLDLADLRHLVRRLDSLGPDDLAVHQQILELARHLPFPEDPYADWAEPVRAEVSVAAVNALLRLAAAALAEDAPRSLRLAHEAIELNPFLESGYHAAMTAAVAMGRPDDALRIFERCRQVLNSELGVAPSAELAMIKQSVLAGRETAPVPAPPAATTPVPASVPPVAPTPPPVPPVAPTPQPAPPVARPPQPALRERFLGRLTEIRLMVEPGTPPVVHFVGPSGSGKSAFLAELGRHTPGRIGIGDAGPAVGVLRLSWLRSALTALDAAPEAIGAVDRARPDQPLCQADLELIGQTFDRPETVYLAVDDARDLDAASVAELAWLSGHCPGLRIVLTYDYPSQLSGRPLAGLGTPVVMRLSPLTPAELEPLGDPAVPALTGGIPALVAVARRPAEVAGAVAMQVARRRTEWMPPLAWELLRVCAVLGDLGAAELAGLTGQPVTEVLGCVDALVHAHLLRECPDGKVGHAASLIRDAVAAQVSAATAIYLRKQQAAAS

SEQ ID NO: 11921 - protein, 557 aa, Actinoplanes utahensis
MGRGNLSRRDVLKGALALGGGGLIVMTAGGEVVAASSQLAAKNMPTPFTNMFRRPPVLMPAEEGVDDMGPYQKYRLTQKLGRASIVPGLTTTIAGYNGIFPGPTMRVRQGTRTEVRICNALSDVNKLNGRPFSTVTHMHGSASLPQYDGYANDQTKPGQVKTYKYPNWQQGRTLWYHDHNHGDTAQNVYSGLAAQYHLKDPYETAQLPQDEFDVPLIVSDVAFNADGSVAFVPEGNSGFMGDIIMVNGVPWPKMKVKPRVYRFRVLAATISRSFRFALSTGDPFYIVGNDAGMTPKVNAVQSWRQGGAERYEVLIDFRKYKPGTKVDLQNLSNKNNVDFANTGKVMQFEVVADSGPADTYKIPSTLDLGPQPFANRGAIEVNKLKPEMATARRRLRVERKQGEWTVNGETWADVEASNFTRILGNPKPYDVEIWDLVNESGGWYHSFHIHLIDAQIIGRNTTADGKAHPWEGGGKDVFYLGENETVTALMQFTTGDGNAGGRYMTHCHNLVHEDSDMMIQFAVGDLETNNPIMMDPPRPETEAEMPAVYAPSYPLGT

SEQ ID NO: 11922 - protein, 255 aa, Actinoplanes utahensis
MVAKLRGPALSLLLVLAAFTVAAWSGGWFATRPPGSPAAAAVISDDAGDEIATTTFDGPMVRKRAALAVHPAKGADRAHIAAELRTAATAAGIGELTDATFAVFSADLLRYLVPEVTLVLPEGITVQRAEAFMRDHQPDDVAFYVAQTVLVHDVTFAVVTGGVAPAEAQRREDAEGILSDSLNHYVTTVQPAGLTVRYFGALLSDGQIGAVRTAMARAAGTTADRVSVAASEPGAGVDLSGGLPDLDAQAEHHGH

SEQ ID NO: 11923 - protein, 1744 aa, Actinoplanes utahensis
MLKPKLRSVGVALAVLVAVIITAPAAAVAAPIGQGFTVTPADLAYILQQIKIAEAHVAGTTSATGPCGALAIGPLQPFGLRTVDGSCNHLGKGQELFGAADRSFPRLVPAQLRPGYTGRNATDAAPRQISNLIADQSRANPAAVAAAHGGDPAAGIPNVTPDAGLSAPYNSWFTLFGQFFDHGVDQTVKGGGAVIIPLAADDPLVISEKLPPGLRFMILSRAAGAGDAKNTDTPYVDNSQTYSSHAAHQVFLREYDERAQDTGRLLSGAAGGLPTWDDVRRQARDVLGLQLSDTDVLNVPAVLADAYGDFVPGPARGLPQYVTASGLVEGDTAAPVAVPANVLHFDTPFLADIAHAADPSQPGYDPALLGRHYVAGDGRVNENIGLTAIHQIFQSEHNRLVGDIQRVAAEAGTGAEWTGERLFQGARFINEMEYQHLVFEEFARKIQPAIDPFAGYQEQIDPAITAEFAHAVYRFGHSMLTETIARTTADGGDDSIPLLDGFLNPDAFTDHGTLSPEQAVGELVDGMAAQTGNEIDEFVTDTLRNKLLGLPSDLAAINIARGRSEAMPSLNAFRRGVRLTPYVNWADFGEHLRHPASLVNFIAAYGNDPSIRAADTVPAKRAAAQALLNSPDFLYAPAATTGVDDIDLWIGGLAEAAVPFGGLLGSTFNHVFERQLTALQNGDRLYYLARTAGMNLRTQLEGNTFAELIMRNSTVRGLRADTFATTDCTYDLTRLTFAGSRVLDDPASACDESAQLLRLPDGTVTQRAKSKAQSLWLGGEDTDRVGGGIDDDTVWGAEGDDVLDGGSGNDVLIGGEGDDILTDPAGNDMPRGGPGDDAIDAGPGTDVVLGGDGHDFTDGGANGDETFAGEGDDLIYAGDGADTAQGDAGDDWIEGGDSADTLHGDSANPFPLDDANRAGNDVLLGEGGDDDYDMEGGDDIGVQGPGVDRYRGGTGYDWSVADPADPQPIDADLLRNLAEPVTADTQDRYREVEALSGGAGNDVLRGDDVVPTQSPLLGCDALDAAGIARIPGLDRIVPAPLTPQSVVTNRTGQPCHLQGNVWGAGNILLGGPGDDTLQGRGGDDVIDGDRYLTVRLVVRDADGHEIRSAHSMRDLEADVLTGTIKVKDIAFVREIATAPGVDTAVYSGDRAAYAITPVTGGLQVSGPDGTDLVRNVERLQFGDQTVDVTGLQAYLGVSAFAGAGAATVLITVPEGASVNGLTLERTSSEGVVRTSLAASARSVVVAGLTAGVAYTFRVRAESAAGSGAFSAPSDPVTPDAASADPSGAGAPGTGGPTTAPGTAVPTIAVPTTAPGVGTPTVAVPTVAVPTIAAPTVAPPAPTNPARPVIPVAPDAPRIGLATAGDESATVQWTKPVNDGGSPIYGYEVQALDDQTGIVVGVDAADANATSLTMTGLTNGQPYAFWVRAVNAAGASDFSAISNRVIPGPAGGAGAPSGGSSGGAGSSGGAGSSGGAGSSGGAGSSGGSGSAGGSAGGSSGGSSGGSSGGSSGGGTPGGSGTTPPSTGPGTPAGPADPSTTERTVPGAARIGTPVAGNALAVVRWTAPVSNGGSPILRYEIRVLDSRNRQVGTLRDADATAAAQTVKSLVNGTSYHFRVRAVNELGAGPWSGSSGAVVPRTTPPAPRSLTATPGKAGGAGTTVLRWTPPSSTGGAPITGYRLTVQRLTGKGKPTGASVTFAFSGSVRSATFTAPGGVPAGTRYRFTLRAVNTAGQGQARSVLGSVR

SEQ ID NO: 11924 - protein, 615 aa, Actinoplanes utahensis
MPELRSRTSTHGRTMAGARALWRATGMTDDDFGKPIVAIANSYTQFVPGHVHLKDLGGLVAESIAAAGGVGREFNTIAVDDGIAMGHGGMLYSLPSRELIADAVEYMVNAHCADALVCISNCDKITPGMLIAALRLNIPTVFVSGGPMEAGKTVAIEGIVHEKLDLVDAMSAAANDNVTDAQLDTIERSACPTCGSCSGMFTANSMNCLTEAIGLSLPGNGSTLATHASRKALFTEAGRLIVQIAKEYYEKDDASVLPRSIASRDAFENAVALDVAMGGSTNTVLHLLAAAREAEIDFSVADIDAISRRVPCLSKVAPNSPKYHMEDVHRAGGIPALLGELHRGGSLKTNVRAVHAPSLDAWLTDWDIRGGSPTPEALELFHAAPGGVRTTEPFSTTNRWATLDTDAAAGCIRSVEHAYTVDGGLAILFGNLAPDGCVVKTAGVDESIWKFTGPARVYESQDDAVTGILGKEVVAGDVVIIRYEGPRGGPGMQEMLYPTSFLKGRGLGKACALITDGRFSGGTSGLSIGHVSPEAAGGGLIALVQTGDEITIDIPGRSITLNVDDETLAQRRHQEERRPKPYSPVDRQRPVSAALRAYASMATSASDGAYRRVPE

SEQ ID NO: 11925 - protein, 795 aa, Actinoplanes utahensis
MKIRQSGSVHSPSGMELAGLAGLLAAVPAVALLGRSGRRHTGDARRAHLLLAGGGALITAAALAGMATALLTEHHHGLASRTLATLMAIGMGCGTLTLLAGTVALPGAARGPAAALRHVLDGLVIAAAVWFVGWVLIVRPTHLLGAATPYECVAVILPAGLAVAGLGLTGVLALHAHRPRRHSVWVGAGVSLTAAASAGVSSGVCRRGDELVLSSVLLLSAGLFLIAGAVRAADRPVRVTGDVLERGGAYAVVPMIGVVGALGYHLTRGGTLDAYGYFGLSVEGLALVARQFLALDDVRRYTVQLRQREKHFRDLAHTDPLTGLANRRGLQLALREGDRCRALIGIDMDGFKTVNDLRGHDVGDAVLAEVGARLKRNLLTGDVAARLGGDEFAVLMRAEPEEAVLAAHRLLAVLGEPYEVDGGQIFLSASVGVASTGELLHDADLALRYAKQRGKNRVEQYQAGYDELLRRRGTLTGELRHAIDRDQLRLVFQPVVALPSMRPVGAEALLRWTHPELGPVRPDEFIPVAEESGLINRIGAWVLENACRQLADWLAAGHDIWMSVNLSPKELHNADYAGQVAEILADLGVPPQRLVLEVTEHAVATDMEELVRRLAELRATGVRIALDDFGAGYSSLTQLRTLPVDILKIDHALVAEPESRTGTAAPLVDVVVRLGHRLGLEVLAEGIGTPAQREVVEEAGCRLGQGSLFGWGVPAEHFESRLRTMRPSGPRPLPAPRSGPPKNAAARSQVVRLGPGMRQLRALLPTDPEFAARVADQLDDQNVGSVDSGREMGQG

SEQ ID NO: 11926 - protein, 609 aa, Actinoplanes utahensis
MTRPTPESLAHRATPATVAAAVNTAPASTAPVATTGAGALVRSLEALGVEVAFGIPGGAILPAYDPLFDSKVRHILVRHEQGAGHAATGYAQATGKVGVCIATSGPGATNLVTPIADAYMDSVPIVAITGQVARPSIGTDAFQEADIQGITLPITKHNFLVQTAEELPRIVAEAFHLAATGRPGPVLVDIPKDVLQQQTTFTWPPTLDLPGYRPTLHPHGKQIREAARLIAQAKRPVLYVGGGVLKAGATDGLRKLAELTGMPVVTTLMALGAFPDSHPQHLGMPGMHGTVPAVYALQKADLLVTLGARFDDRVTGKLDSFAPDAKVVHADIDPAEIGKNRHADVPIVGDARHVIDELIAAVSATAGGVEQYPAWWATLNDIRERYPLGYDEPTDGTLAPQYVIERIGALVGPDAIYCAGVGQHQMWASQFIRYEKPGTWLNSGGAGTMGYAVPAAMGAKVAQPDTQVWAIDGDGCFQMTNQELATCALEGIPIKVAVINNGNLGMVRQWQTLFYDGRYSNTELGTHKHRIPDFVKLAEALGCIGLRCESKDDVDKVIQQAMEINDAPVVIDFTVGKDAMVWPMVAAGTSNDEIMFARDVRPTFEEDDL

SEQ ID NO: 11927 - protein, 172 aa, Actinoplanes utahensis
MSNKHTLSVLVENKPGVLARVSGLFSRRSFNIDSLAVGETENPDVSRITIVVDAESSPLEQVTKQLNKLVNVLKIVELDPAQSVQRELLLVKVRADRAQRGQVLETVELFRARVIDVAPDTLTIEATGNPDKLDALLRDLEPYGIKEMVQSGLVAIGRGSRSITTGPALRAA

SEQ ID NO: 11928 - protein, 337 aa, Actinoplanes utahensis
MTAEVFYDDDADLSIIQGKKVAVIGYGSQGHAHSLSLRDSGVEVVVGLQEGSKSRPKAEEQGLTVKTPAEASAWADVIMVLAPDTAQRKIYAESIAPHLTAGKALFFGHGLNIRFELIKPPADVTVAMVAPKGPGHLVRRQYVDGKGVPALIAVEQDPDGNGQALALSYAKAIGGTRAGVIKTTFKEETETDLFGEQAVLCGGTAALVQTGFEVLTEAGYAPEIAYFECLHELKLIVDLMYEGGISRMRYSVSDTAEFGDYVSGPRVINAETKQEMKRILADIQSGEFTRHLIADDEAGGPELKKYREQGAQHPIEVTGKKLRDMMSWVDRPITETA

SEQ ID NO: 11929 - protein, 524 aa, Actinoplanes utahensis
MTSIVLVTEELAPAAIDVLATDFEVRAVDGTDRSVLLDALREAEAVIVRSATRIDAEALEHGPHLRVVARAGVGLDNVDIAAATAHGVMVVNAPTSNIISAAEQAVALLLCTARHTATASAALKAGRWQRAKFTGVEVFGKTVGVVGLGRIGVLVAQRMAAFGTTVIAYDPYVQPARAAQLGVRLVTLEELLRESDFVSVHLPRTPETLGLIGEKELATVKPGVRIVNAARGGLVDERALADAIADGRVAGAGLDVFETEPLTTSPLFGFDSVTVTPHLGASTAEAQDKAGLAVAQSVRLALRGEFVPEAVNVRAGGAVDEDVRPLLPLAEKLGRVFTAVAGGVAARVTVDVRGEVATHDVEVLQLATMKGLFASVVAERVTYVNAPRLAADRGVAVELATSEDAGEHAALIVVRGALADGRTIAVAGAGTKLVGVDGFELDLPADGVLLFVRYRDRPGVVGRIGTGLGAAGLNIAAMQVAREAAGGEALMVLLVDSPVEPELLARVAASVDASSAVSVDLRGT

SEQ ID NO: 11930 - protein, 117 aa, Actinoplanes utahensis
MVWAMDPAAAPEQVRAANARCAEGVHPQRPADPRVVAFYDALTSNYPDRGPRATAPGTPWASAPLHAAADHIQMRLDENCPDQVLETIERLAAELNLDLLDLQDGTVYPPLRATQVR

SEQ ID NO: 11931 - protein, 343 aa, Actinoplanes utahensis
MSVARIAVVAGDGIGTEVTAQARKVIDAVLPGVDYQEYDLGARLYHRTGEVLPRAVEDELAGHDAILLGAIGDPSVPPGVLERGLLLKLRFDFDQYVNLRPSKLWPGTTSPLAGVKAGEIDMVVVREGTEGLYVGAGGVLHRDTPAEIATEESLNTRHGVERVIRDAFQRAQRRERRHLTWVHKTNVLTHAGNLWSRTFAAVAAEYPEITTEYQHIDAASMFMVSNPQRYDVIVTDNLFGDILTDIAAAVTGGIGMAASGSVNPERKYPSTFEPVHGSAPDIAGKGIADPAAAILSAALLLEHLGRHAEAGRVTEAVAAEVASRTPGAPLRTAEVGDRVAAAL

SEQ ID NO: 11932 - protein, 385 aa, Actinoplanes utahensis
MGALRVPLACLFLQKAGPLAMSGGDNLDFEIRPNPAPVGDAERAALLANPGFGRIFTDHMVTVRYADGKGWYEPRVEARAPIPMDPASAVLHYAQEIFEGLKAYTLPDGGVAMFRPEANAARFAQSAERMAMPALPEDLFLKSLHEIISIDRQWIPGGEDGSLYLRPFAYASEVFLGVRPAQEYLFLVIASPVGPYFSGGVKPVSVWVTPDYTRAAPGGTGAAKCGGNYAAGLSAQAEAIEHGCDQVVYLDAVERKYIDELGGMNVFLVLDDGTLVTPPLTGTILPGITRDSVIRLAERAGRRVEERAISLQEWRDGAASGRVREAFACGTAAVITPIGTIRSLDGDFTIADGGPGEITMGLRKELVDIQRGRAEDTFGWVHRVF

SEQ ID NO: 11933 - protein, 294 aa, Actinoplanes utahensis
MPSQTHETLIEMFRGRPALAADVLDRTLRIPVPEFDEALLASAELADVAPTEYRADAVVTLSRAGVAVLAVIIEVQLRVDQRKRLSWPAYVGTLYARVGCPVALLVVCPHPKIATWAATAIAVGPPGSTVAPIALGPEQIPVVTDPDEARSSPELAVMSTLAHLAHITDSERTALLNATFTGLDTIEPSRAALYTDLMLAVMPQAARKLLEDYMITTDNPYQSDFARRYFAAGEARGEARGEAKSVLAVLHARGIETPESFRAKLMACTDEALLARLIQQAATAEQLGDLDPVD

SEQ ID NO: 11934 - protein, 126 aa, Actinoplanes utahensis
MTDPAPDVHPQIPPSTGRPSHGAQSEAELAMIAASHHYRSDFARCHFAEGWINGRAQARAKTRAQGKAESILTVLDVRGIETPESFRERLMACTDEALLGRLIRQASTVEQLDDLDSLDSLDEPEP

SEQ ID NO: 11935 - protein, 157 aa, Actinoplanes utahensis
MPDLPRTRSPAFCERDVMADVLIRPGLAIPEAELSWRFSRSSGPGGQGVNTTDSRVELSWNLLASGLLSPALKERAVERLGSRLVDGVLTITASEHRSQLRNREAAEARLAMRVGEAIAAPPRQRRATKPTRGSVERRIGEKKRRAQIKRNRRGDED

SEQ ID NO: 11936 - protein, 501 aa, Actinoplanes utahensis
MPVIEYAASLAPVRSIPPRGYPRTPGGVAETNAADTGRGRRDGGCGAQEGRNRAIHGMMGRVTSPSAPVATTGYPWPIETTRLANGLRVVVSEDRTAPVVCVNLWYDVGSRHEPPGQTGFAHLFEHLMFEGSQHVKKTEHMRLVQGNGGSLNATTNPDRTNYFESMPSEHLELALWLEADRMGGLVPALTQETLDNQREVVKNERRQRYDNVPYGDAWLRLLPLLYPPGHPYHHATIGSMEDLNAAALETFQAFHAQYYAPNNAVLTVAGDAPPAEVFALAEKYFGGIEPVPGIPPAPNGHLAGPATEPVRETVTAAVPAPRIYLSHRTYPFGTAGYDAITVLATVLGSGRGSRLYQRLADGKRIAQPDYIGSYGVDLAHAPAPLIVTATAKDGVSVDELEAGLDEVLRSLVDEPVTEEELNRAKALLTTGWWRQVSTVGGRADTLGRYATQFGDPATAGYRLPAWLAVTADDVTEAAARTLQKESRVTLTYLPEKAEEAA

SEQ ID NO: 11937 - protein, 446 aa, Actinoplanes utahensis
MSLVTTRPEPGTARPYAFPSVRRVTAHGGTVIAAHLPGQMLATAILLLDASAAREPAGREGTATVLAKSLEEGTSKRDSAAYALALEGLGAELSPSVDWDTFRVGVSAPAPQLTGAVRLAAEAARTPKLDPADVARVRDDEVTALRMDWAQPGPRADAALRGDLFAGEGRYSRPLHGDPASVAAVTVDDVLAFHREWMLRPGVLLVAGDLDGLDLTELAEAAFAGTSGQALAVEAPLGLVVPAKPHVILVDRPGSVQSTLRVGHRAPERATPDYVPMTLMATVLGGAFTSRLNHLIREVKGYTYGIRGSYAMTRRAGRFEVAAGVQTAVTGPAIADTLGEIRRTQVDGVTEAELAVARSWRAGQLSVEMQTPGAIAGALATLVVHGLPDDYFETLRREYLEATVEQVSAAAARHLAVDGLTLVVEGDGEKIRAELAEFGDLTEAAL

SEQ ID NO: 11938 - protein, 343 aa, Actinoplanes utahensis
MTSRSWSRVDSVGPMTITEAPPVTTGRRGATILFWLLLTPGLVWTVIRLSGWEAGRLIQVLPFTPYVAVGSWLPALLALFFRRWAAGAAGVLIAVALAACVLPRALPDLDRGPSHGVTLRVMTANLLLGGADTTEITQLVRDNDVAVLAVQEFSPAAQARLTEAGLDRLLPYHSLAAEPGASGSGLYARFPLADPGQKRNHGGFLQTFGTLQAPGAAPVFVESVHPLAPSAPLTFHAWRVDLREEPRSDGDNPNRILLGDFNSTLDHSALRDLISHGYRDAADTVGDGLIGTWGPYDGDMIPPVIIDHVLVDERIGVREVSVHGVDRSDHRSVIATLTLPAAS

SEQ ID NO: 11939 - protein, 178 aa, Actinoplanes utahensis
MNVTIRPVTLTDVPELTEVIKASREHLAPWEPIRDESFFTVAGQWKILDDLLNAGTGLPHVILVDGAIAGRVNLQTVVRGPFQSCTLGYWVAPAHGGRGVASFAVGEVLRLAFTEYGLHRVEAATLLHNVRSQRVLAKNGFERFGMAPRYLNIAGDWQDHYLFQTVAENWLEQRKAES

SEQ ID NO: 11940 - protein, 402 aa, Actinoplanes utahensis
MIDHRKLGRELDLFDSDPLIGAGLPFWLPAGAAARHEVESYLRELERRAGYQHVYSPAMGKRQMYEMSGHWSHFAADMFPPMPVGDDELVLRPSLCPHHALIFKARRRSYRELPLRIAEMGQMYRQERSGVLGGLSRVRAIALNDAHVLCAPEQAAEEVGGVLRLMREAHDALGLRPASVRLSLRGPGRRYGGPESGWALSERLLRGALADNRMAYVVGPGEAAFYGPKIDVQVADAAGREWTIATVQLDFHQPERFDLSYVSASGARARPVMVHRSLAGSMERLFGQLIEEHQGAFPVWYAPVQVAVLPVGASGTASFAADAVAAGLRAVEVREGSLGARIRAAAKVPYVAVIGAREAAAGLVSLRLRDGRQLDPMPGSAAIALISAVAAARRPGQLLPSP

SEQ ID NO: 11941 - protein, 524 aa, Actinoplanes utahensis
MDYQVFDTTLRDGGQREGISYTVADKLAVARLLDDFGVGFIEGGWPGAMPKDTEFFARARTELNLRHAVLVAFGATRKAGVDVAADPQVRALLEADTPVVCVVAKSDIRHVERALRTTAEENLAMVRDTVRHLVANGRRAFLDCEHFFDGFRFDPEYTASVVRTAIDAGAERVIMCDTNGGMLPSMITKAITEVVERTGVSADRLGIHCQNDTACAVANTVAAVEAGVRHFQCTANGYGERPGNADLFAVVSNLQLKLGLKVLPDGCLEKATRVSSALAEIANIAPDTHQAYVGAAAFAHKAGLHASAIKVDPLLYNHVDPAVVGNDMRILVTEMAGRASIELKSRELGIDLAGHPDTLTSVTQKVKDLEAAGWSFEAADASFELLVRSELPGEDVTRPFTLESYRVLVEHREDGKVISEATVKLRVKGERVIATAEGNGPVNALDEALRTALSHHHPALRSFELNDYKVRILEGSHGTNAITRVLVETGDHNREWTTVGVHENVVEASWTALVDALTYGLGRS

SEQ ID NO: 11942 - protein, 267 aa, Actinoplanes utahensis
MPLSGLRGGAVPLIETSFVTVVAESYSRNLGFSATYNFRDVGGYAGLDGRTVRWRRLFRADSLHRIGDADAAAFTALGIRTVIDLRRPHEVEKFGRVHERYGTDYRNLVLKHVDWEEVEHPDGTVRERWLADRYLNFAEDGREAILDALRLIADPAAAPVVVHCMAGKDRTGTICALTLSLLGVSDSDIATDYGLTTEAMRPLTEYLLRADPEAVEGNEHMFDSPPAAMRLFLDDLRALHGTVEDYVREIGLTSSEIDAMRRHLLEG

SEQ ID NO: 11943 - protein, 506 aa, Actinoplanes utahensis
MHRPSARRLLAGLATATAVALTTATPAFAATPKINVTLDDVAIGAGYAIKVSPVLRADREVELTGAVMTYQLTGTPAGVTLANPDEFGDCASQTPTTLVCKQPFGISIGPYGVMGYLEGALKASRTTPIGSTGKLTATFAADGVAPIKSTANVVVAEGVDLVAGKPDKHKVKVGETFTGTVTVTNKSDKTVHGVGLSGYADYAYEPTAQFSNCSYHEIRMNCRFDQDLEPGATYALEFPFRVRTDTAAPSGGAAEYKWLPVGDYDAQTKALKTTAGTGGMLKLTKVAAATSRARQTDTNPDDNWSLIDVDVTGQQSTDIAAIGDKVSGAAGTVVNATVGVRNNGPATRDTNHAGDAASVLRVTIPAGAKVTTVPDGCAVATDWLQSDKKAVQYVCSTGYLFRVGETVSWTFGLKIDKVVPGASGAVEANPACECDIFSKDTDKSNDKALLVLNPAGGTGGTGGSDGPGLPITGPQGAAIAGAGGLLVAAGAVSFLIARRRRTRFQA

SEQ ID NO: 11944 - protein, 323 aa, Actinoplanes utahensis
MIASARYIGAMGIKQVRALTTTLPSVTWIPLARAHAERADQMTAGHRARRATGEKHAIEDFLYDYYGTRPSMLRRWHPGVGAGLVAAPDGLAEHAGWKFYQTHDDGVVALDQDAFLHARGESVRYIHGLLTATASRPVFSGCFGLHEWAMVYRDPEHRHPLPLRLGQPETDKVVEQHTIRCTHFDAFRFFTPEAVGLNRLQPTRATQVDLDQPGCLHAAMDVHKWAQKLGPAVPGALALDCFALAGEIRLLDMQASPYDLASYGHPPVKIETPEGKAEYVARQRELARRAAALRSRLIRVCEALLGPEAAARNREAVAPFNHR

SEQ ID NO: 11945 - protein, 302 aa, Actinoplanes utahensis
MRSIGGEQSVAEPVIEVRDLRMRYGPREVLDGISFTARPGEVIALLGPNGAGKTTTIEILEGFRRRSAGHVRVLGADPERGDERWRARLGVVLQSWRDHGKWRVRELLQHVGQHYTPFSTGRIVRPWPVDELLAAVGLTAAARTRVSRLSGGQRRRLDVAIGIVGRPELLFLDEPTVGFDPAARREFHDLIHGLTDMADTTVLLTTHDLDEAEKLADRILILAGGRIIASGSADALSRQVAGETEIRWTRDGQRFVHSAADATPFVRELFRQYGERIGDLEVRRSSLEDTYMKLVHEAEGAR

SEQ ID NO: 11946 - protein, 279 aa, Actinoplanes utahensis
MTPIRMGLRRGAIEVRHTLTTPSDLWTYLFPSLLLLGTIYFMRGATVPGTSFSLGARTLPSTFGMGFATTGLMTTAQLLMIDREDGTLLRAKAVPRGMTSYLIGKVVLVGGMAMISFLLVLIPGLFLVDGLDVTGGDWLTMLWLIPLGLVATLPLGAAFGSLFEDPRNMALIVLPIFGSIAISGIFYPISGFPGWLQGVAQSLPLYWLGLGMRSVFLPDSLASAEIAHSWRHLETFGVLTGWSILGLVLAPILLRRMAARESGSAVEARRERALRRVGR

SEQ ID NO: 11947 - protein, 80 aa, Actinoplanes utahensis
MATEITYNRIAMLRAERGISRRQLADALGVHYQTVGYLERGEFSPSLHLALRICQYFEVPVEVVFALEPFPRLGAASQSA

SEQ ID NO: 11948 - protein, 264 aa, Actinoplanes utahensis
MRFARFVHAAGVSFGVVEGDGASGLTVAEISSLPFEKVVRTGQRWALPDVRLLAPIFSSKVIGIGRNYADHAAEMGNEVPKEPLIFIKPSTSVIGPGDAIRIPSVTTQVEEEAELAVVIGATGARRLDRAAAEKAIFGYTCANDVTARDLQRKDPQWTRAKGFDSFCPLGPWIETELDVSDLEVRCEVGRDPANLEVRQIGRTKDMVFDIPSLVSYVSHVMTLLPGDVILTGTPAGVSRIEPGDTVSVSVQGIGELRNSVVALD

SEQ ID NO: 11949 - protein, 45 aa, Actinoplanes utahensis
MALGRLWRWAGCGAGPVVALGRLWRWAGCGAGPVVALGRLWRWAG

SEQ ID NO: 11950 - protein, 228 aa, Actinoplanes utahensis
MSGVGVLDKAVVILAACVDGASLAELVERTKLPRATAHRLAQALEIHRMLVRDTQGRWRPGPRLGELANAAPDVLLTAAEPLLSALRDATGESAQLYLRRADERICVAAAERASGLRDTVPVGSVLPMVAGSAAQILLAWEPPEAVMPLLPRCKFTGRTLAEVRRRGWAQSVAEREPGVASVSAPIRDRTGRVIASISISGPIERLGRRPGERHAMAVVRAGQRLSGL

SEQ ID NO: 11951 - protein, 484 aa, Actinoplanes utahensis
MVGVTPDSGKPRTLAEKVWDDHVVRSAEGEPDLLFIDLHLLHEVTSPQAFDGLRLAGRKVRRTDLTLATEDHNTPTGYADPSFNTRRGELLTIADTVSRTQIETLRKNCAEFGVEIRPLGDVNQGIVHVIGPQLGLTQPGTTIVCGDSHTATHGAFGALAFGIGTSEVEHVLATQTLPQSKPKTMAVTVVGELGPGVSAKDLILALITQTGTGGGNGHIVEYRGEAIRKLSMEGRMTICNMSIEWGAKAGMIAPDETTFAYLKDRRHAPQGADWDAAVAYWKTLVTDEDAEYDTEIILDATRISPFITWGTNPGQGAALNDVVPNPADFPDEVERGAAERALAYMDLTPGTPFREVPVDVVFVGSCTNGRLEDLRAAADVIRGRKVAAGVRMMIVPGSYLVREQAEAEGLDKIFTDAGAEWRFAGCSMCLGMNPDTLSPGQRAASTSNRNFEGRQGKGGRTHLVSPQVAAATAVVGKLAAPADL

SEQ ID NO: 11952 - protein, 196 aa, Actinoplanes utahensis
MDKFVTHSGKVLPLRRSDVDTDQIIPAVYLKRVTRTGFEDGLFSAWREDPSFVLHNPAHAGATILVAGPNFGTGSSRQHAVWALRDWGFKVVIAARFGDIFRGNALKEGLLPVQLDQKIVESLWDLAESEPEKQITVDLAERVVRVDDAAYSFPIDDFSRWRLLEGLDDIGLTLRHEDAISAYEKSRPSFKPVVVL

SEQ ID NO: 11953 - protein, 318 aa, Actinoplanes utahensis
MGANFVGTQRIFATNVCVSRSEGIPCAQNGLRRASSHVREETVNKAELIEALAVKLGDRKTATIALDAFISEVQNAVAKGDKVSLTGFGSWEKRTRNARTARNPRTGEPVKVKKTSVAAFRPGNTFRDLVASGKPAKVASAKKTTSAKAAAPAKTTATKTATAKATATKATATKATATKSAATKATATKTTGTTAAKATGTAAKATGATAKATGSTATKAGKTTVTKATPAKSAAKKTAAPAKSAAKKTVAPAKPTATKAAAKKTTAPAKTTTTKAAAKKTTAAAKKTTARKTAAPAPAPARAKGASTARAASSRKAR

SEQ ID NO: 11954 - protein, 141 aa, Actinoplanes utahensis
MERGPRGLLTRASLAAGLFAVTVVPGWTLGDLAERATGWPALDWLITCGWSGVVVAGYAPWTSYRARDGLAGAVPLYGWYLAGVLSWRVALLPFRDWEPRRDELWRARWLTGDLIGFWRADQAGARPVTSARSRAVARRTR

SEQ ID NO: 11955 - protein, 293 aa, Actinoplanes utahensis
MAAAVRAAGGVLYRPGRAGVPEICLVHRPRYDDWSLPKGTLRRGEPALAAAVREVAEETGVAGIPEMSLPEIAYELPGGRPKTVRYWLMRAGTTGPIQDTAEVDRLAWLPLPDAAARLTYPDERPLLDRVAGLPPITSVVALVRHAHAGDRKDWSGPDSLRPVSVKGGRQAQRVAARLATFQPRRLVAATPLRCTQTLQPLAAATGLPIVSDIAFAEPDDLTAGLPARLKEARGRLDELRRGDRVVICSQGKVIPELLAGLRDAPDPEPFKTRKGDGWLLTWSGERLLAIGRW

SEQ ID NO: 11956 - protein, 756 aa, Actinoplanes utahensis
MQTPPRSSESRRRGPNGRFLTRVVPAGPAVDVAPADPVQEAGIGAEPAAAGGEAAEAELPVEPVDGEYHLPEDRFLNREMSWLDFNARVLALAEDPGTPLLERAKFLAIFASNLDEFYMVRVAGLKRRLNAGLPVRTGDRSTLRQQIETITARTADLVTRHAACFADEVRPKLAAESIELVSWRELDAPEQGRLRTFFREQVFPVLTPLAVDPAHPFPYISSRSLNLAVALRYPDGDNPELFARIKVPNNVPRFVTVQNDSRAVRFLPIEELIANHLDQLFPGMQILEVHAFRVTRNAELEVDEDRDEDLLQALERELAQRRFGPPVRLEVAASISDHVLDLLVRELDMDSHDVLRVPGLLDLSALWQVFGECDRDDLKDRPFVPATHPQLADGEVPRSVFNRLRESDILVHHPYHSFSTSVQRFIEQAAADPNVLAIKQTLYRTSGDSPIVDALVDAAAAGKQVVVLVEVKARFDEVANIAWARTLERAGCHVVYGLVGLKTHCKTALVVRQEGNQLRRYCHIGTGNYHPKTARLYEDFGMLTADPEVGADVTDLFNVLTGYSRQTTYRRLLVAPHGVRRGLLDRLAEQAKIARSGGEALVQFKVNSLVDEETTDALYRASQDGVKIDLIIRGMCTIRPGVPGLSENIRVRSIVGRFLEHSRIFRFGAGDDAEYWMGSADLMHRNLDRRVEALVKVTMPSAREELRNVLELSMADGTEGWDLDGDGDWHRHSGDTAKAQAHLQELLLRRIIGKKA

SEQ ID NO: 11957 - protein, 405 aa, Actinoplanes utahensis
MGYGRKRRVELGRAQRRQVAGEHRAIRGETGHLVGAGAHRGVQPGARIGRHLGPQPSYGVPGDRIVRDDDQPGHRGGAHHSGHGVAEHRQHQLRMPFLGHRAAQPALGRVQPLDRNHRHPLPHRHPASLHDVYRQHPYLVRRAGRGHDFVADAGDMVADRGTGEAVAQHRLGFWQRFAVMLVVPVMTVWTKRTWLRMDRIPQAGGVILVPNHVSHFDPLVVAHYIYKAGRWPRFLGKASLWRVPIVGPLLVKTKQVPVERGSVEAVKSLESLVDALTDGGAVVIYPEGTTTREPDLWPMRGKTGAARLALLTGAPVVPIANWGAQRVFDPRTNKLKLTRAGVTVTTGDPIDLSRWAGAEPTRAVLDEMTDHIMLGIRDLLGTIRDGEAPALYDRPARRVTKSEDA

SEQ ID NO: 11958 - protein, 330 aa, Actinoplanes utahensis
MRAAVIGSGAWGTAFAKVLGEAGSEVTMWARRGSVAAEIRDEHGNEGSLPGVRLSKRITATTDLAEAVDGAELIAIAVPSQTLRGNLADWAGYFPGDATVVSLMKGIELGTLKRMSEVIVETAGVPAERVVVVSGPNVAPEIAAGQPTATVVAGADEDRAKQVQHALATPYFRPYTSDDVIGCELGGATKNVIALAYGMAISIGLGDNTRASLITRGLAETARLGVALGADPLTFAGLAGLGDLVASCSSPLARNRMFGEHLGRGESLEQAQIATRQTAEGVKSCLSIRDLARSHGVEMPIVEQVERVCHEGADPRVAVKLLMTREMKPE

SEQ ID NO: 11959 - protein, 367 aa, Actinoplanes utahensis
MSYSDGTRSVHAGLPAPEVGQPFLPGPVFAAPYHLDPVTGPGRHGYARTEQPTRQALEAAIGELEGGPALAFASGQAAITAALLAVLKAGDRVALPGDGYFPVRAFAHGALTDLGVTSVLVPTAGPYPDFTGLRLVMLETPANPGLDVADIRAVAAAAHAAGALLAVDNTAATPLGQNPLALGADLVVASGTKALTGHSDLLLGYVAATDRELLAKVETWRKLTGGVPGAFDCWLAHRSIATMDLRLARQSENAAAVADLLVSRSEVTGVRWPGLPSDPSYAVASVQMRRVPGIVSFDLGSAERVARFLSAAKLVFAATSFGGVHTTADRRAQFGDDTPPGFVRFSCGIEDTADLIADVTQALDAAR

SEQ ID NO: 11960 - protein, 148 aa, Actinoplanes utahensis
MGPALHVIAGPGPGQLATMAHPGDTPWSPPELAALARAGVHILVCTARHRPPATAGVGIELIDYPDPDETAPRREATEMVALATRLAREVRSGRFVVTQSSAELGRTTLLATMTLALLGIRPGEALRRIGVAPGQPVAQEWLHDFVAR

SEQ ID NO: 11961 - protein, 367 aa, Actinoplanes utahensis
MTTPRKTRVAIVFGGRSTEHAISCVSAGAILGALDPDQYETVPVGITREGRWVLAAGDPAQLAIAGERLPEITAGSGSAVVLPADPTAAELIVRDPADGVAELAELAGVDVVFPVLHGAYGEDGTIQGMLEMAGIPYVGANVFASAAAMDKEFTKKLAAAEGIPVGPYAVLRAGMSLTEADKERLGLPVFVKPSRAGSSTGITKVTDWADLDAAITKAREIDPKVLVEAAIVGSEIECGVLEGEFGGPPQASLLAEIHMDGADWYDFATKYLVGSRYTIPAALPHDLTRQVQEYALRTFTALDCAGLARVDFFVTAAGEVYLNEINTMPGMTPTSMFPQMWAATGLEYPKVVDRLIRTALRRGTGLH

SEQ ID NO: 11962 - protein, 217 aa, Actinoplanes utahensis
MVDVDTPAKPDDSTPDNTTRVAAIWATAIAVPVVLIVGLVAYLQISRSTTPAADPAPSASGPAVVPTTPVRVDAPELDARAAQVCLAVTSQLPARIRNLPARKVSAGPEQNAAYGEPAITVACGVTRPWMCEKADDTSGTCVPLVADLLLMDQVCWYYTEGAGKTVFTTMDREVPVQVTVPATYDKRAQWANEFSDIVLKTDKSITAGVPNGCDPGR

SEQ ID NO: 11963 - protein, 77 aa, Actinoplanes utahensis
MVQAYILIQTEVGKARDVAAAIEKIPGVVRVDAVTGPYDVVVLTEAHNVDELGTLIVSKVQYVPGITRTLTCSVVNL

SEQ ID NO: 11964 - protein, 312 aa, Actinoplanes utahensis
MSIAESGEFGLIGRIVSRLDAGSATLLGPGDDAAVVRAADSRVVASTDVLVEGRHFRRDWCGPQDVGHRAAAANLADIAAMGATPTALLVALCVPAGLDAGWAEGLADGLTAEAALCGAAVVGGDMSASPTLTVAVTALGDLGGLDPVRRSGAQPGDILALSGRIGYAAAGYTVLSRGFRTPKMLVEAYRRPAVRYAAGPEAARLGATSMIDVSDGLLQDAGHLADASVVAIDIRSDAFEVPDQMRDAAKALGVDPYQWILAGGDDHPLAATFPAGTRLPEGWREIGSVHDGSGVTVDRKPWSGPLGWDHFR

SEQ ID NO: 11965 - protein, 138 aa, Actinoplanes utahensis
MELVAENMRDLAERYGGTGDDTPIRAADFLAPDGAFLVAVRADDGALVGSAGWRRHGTDAELKRMFTRAAARGLGVARRMLAAIEESAREAGCERVILETGDRQPEAIALYESAGYVRIEDFGYYKGHEGVLSYGKKI

SEQ ID NO: 11966 - protein, 63 aa, Actinoplanes utahensis
MASVCDVCGKGPGFGHNVSFSHRRTNRRWNPNIQSVRTPAGGGTTKKLNVCTSCIKAGKVARA

SEQ ID NO: 11967 - protein, 524 aa, Actinoplanes utahensis
MLETLDAAAVHRWCDGGLEALRAHQREIDELNVYPVPDGDTGTNLVLTLTAAREAVESALHEEPRTPIGRLMGRMARGALLGARGNSGVIVSQILRGMADAFASAVAVRGAELAHALRQASEAAYAAVARPVEGTVLSVVAAAAEGAGRIGSDSLITVARAAARAAAEALDRTPQQLPELARAGVVDAGGRGLCVLLDALVDTVAETAFSPSPPPVPLPAAPVVEDHCEGHGYEVQYLLEAPPEAVERLRGALAGLGDSLVVVGDPPTWNVHVHVPAEAIGPALEAGVEAGRPYRISVTPLAGKRPGAESRGAVVVAAGDGLTALFEAEGAVVVGRNPSTAEMLAAVRACAAAAVVLLPNDANTLAVATAAAREAEATGLRVSVVPTRSPVQALAALAVRDHSRPFADDVIAMAEAAGACRYGEVCTAQRDALTVAGPCRAGDLLGLVDGEVHVIGADLTDVSHRLLDRMLGGGGELVTLVLGADAPAELADDLRGHVHRIWPFIELQCYAGGQPRYHLLAGVE

SEQ ID NO: 11968 - protein, 726 aa, Actinoplanes utahensis
MTTTDTPLTKVLGAKTAKALAEHLELHTAGDLIYHFPRRYDERGEHTDLRQLEVGEQVTVLAQVQGIGVKPMRQRKGNMLEVTIGDGSGATLTCTFFNQAWRERELTRGRWGLFAGKVTEFRGKRQLNGPAYQLLKVDATQDEAAEEIEEFAGALIPVYPAAQAVPTWVLAKCVRTLLDTFEPPPDPMPAEVRAARNLVGIGTALREIHRPSSDAALYSAKHRLKWDEAFAVQLTLAQRRARAAAAPGTARPRRPGGLLDRFDADLPYELTDGQRSVGEEIAADLARAHPMHRLLQGEVGSGKTLVSVRAMLQVVDAGGQAALLAPTEVLATQHFRGIGAQLGALGRAGELDGDPEGTQLTLVTGSLGAAARRAALAKVADGSAGIVVGTHALLYEGVDFRDLGLIVVDEQHRFGVEQRDALRAKAARPPHVLVMTATPIPRTVAMTVYGDLETSVLSQLPRGRSPIASHVVPALEKPAYLDRAWKRVREEVAAGHQAYVVCPRIGEGPEDESPPSDDEPARRPPLAVTEVLPALRDMYLQGLRIEMLHGKMPPEEKDAVMRRFAAGDVDVLVATTVIEVGVDVPNSTVMIIMDADRFGVSQLHQLRGRVGRGSAPGVCLLHTEAVEGSAARERLDAVAATTDGFKLSEIDLEQRREGDVLGASQSGKHSHLRLLSLLRDEKLIKEARVEAAGLVGDDPDLTRYPALAASVAALVDEDRAEYLEKG

SEQ ID NO: 11969 - protein, 111 aa, Actinoplanes utahensis
MIVHLCPRSVWESVADSYAGDTLESEGFIHCSDPEWVHVPATLRFRGRTDLVLLEIDPARVDVPVIWEEGVPPGPDGRLFPHIYGPLPVTAVVAVRDFPPLPDGSFAPLRP

SEQ ID NO: 11970 - protein, 504 aa, Actinoplanes utahensis
MKIKSSLRRTASLLAGAVIGLTGVAAMAAPASAHDAWVTGSATCGSDGKNVVTWTLTNDFGTDATVNDLKIPAGATKPVDANGHELTEGYVLPRRQNNANGQAVFTQVFDGGTEVQLSFTATWPTDNFTESSPNNTANVQLKQDCTPPAPVCEATATRFHHTFALVDGKWKAVVKLDDDSKLCNDEPVTLVSYFAPKASDKDGDNWPQYEYEHASDTITDQHRTATLDVAAPDCNTQVDLFFGAEKDIINPMTQNGARYGDRKLGSGSGLGGRSKGPQGWYNGGSKACTTPAVAPVSDCTGELTVNLTNNGKLGKYDVTFTVKFGGETKTVTVAAGKSEAVKVPAGAGDVTVSAPGLEEKTYSWSRPEDCPLPAVTIQNDCTNVTVVIDNPKDVTPVTAKVTYGDQTKTVTVKADSEEKATFKLTDVKFALVDFAGIKMEPLKVAVKDIKCGAVGTPSPSPSGGPSLPVTGAAAGSIAGIAALLVGGGVVAFFIARRRKVKFTA

SEQ ID NO: 11971 - protein, 208 aa, Actinoplanes utahensis
MGPYRPGVASWCASQELRRARMTRIIAGDHGGRRLQTLSGAQTRPTSDRVREAFFSALDTMTDLSGARFADLYAGSGAVGLEALSRGAEHVLLVESDSKAARVVRDNVVALKVGPAARLVTGKVLQVLADRPDGGPYDVVFADPPYAVGNDEMDTVQRALLAGGWLAPDAVVVFERSTRTEPLSWVDGLTGDRTRRYGETTLWYGRRS

SEQ ID NO: 11972 - protein, 159 aa, Actinoplanes utahensis
MRRAVCPGSFDPVTNGHLDIIGRASRLFDEVIVGVLINQSKSGLFPVEERLELLSEVTAAYDNVRVMSFHGLLVDFCRDQGAAVVVKGIRAVSDFDYELQMAQMNIGLSGVETLFMPTNPLYSFLSSSLVKDVVKWGGDASAYLPDPVLARLVNRLKQN

SEQ ID NO: 11973 - protein, 165 aa, Actinoplanes utahensis
MDPLDRIDELIEHVQDARSVPMSRTNFMFDRGEMIERLEELRAELPSELRKAAAVLDERDRIVEAGRREADRIISEGEAEHARLVSVNEITVSAEHEGARIIAEARTEAQRLREEVDDYVDTALANFEQFLTRALASIERGRDKMHALREIGTFQGEDAERPLPF

SEQ ID NO: 11974 - protein, 187 aa, Actinoplanes utahensis
MPKSPQSHLDPRKPLVVDTTKLPRQPGATRALKQVVPAPADLGLELISVPEGSDLELDLSMTSVSEGVYVSGAVRGSLNGECGRCLNEIDRSFEVTIGEMFAYADSTTEETTDEDEVGRMQGDLIDLEPAVRDAVVLTLPTNPLCRPDCPGLCPECGVHFDDLPADHSHEEVDPRWAALRNLSSNEE

SEQ ID NO: 11975 - protein, 57 aa, Actinoplanes utahensis
MAVPKRKMSRSNTRSRRANWKATAVSTVACPQCKSPKLPHTACSVCGTYNGRQVLEV

SEQ ID NO: 11976 - protein, 308 aa, Actinoplanes utahensis
MTRPIIGRLVPEQWRSTGAPVPARERGTARIAVDLLGGDHAPAVVVDGALRAVTDDPSLHLTLVGPAEAADAVLAALHPAQRHRITAVPAGTAAEAVAAGLADALVSAGDTGQTVLAAARALGRRPGVRRPPLAAVLPTAAGRLVLLDVGSTVDPDEHTLVMHARLGAAYAAAVHDVPEPRVGLLTIGTEHGKGDRLRRTVAPLLEELPLRYAGLVEGGDVVHGFAADVVVTDGFTGNILLKALEAAHAGKRSDEVRAAVLLGVRGIVVVCHGAATGPDLAQGIAFAADLHRRDANAAMMSYNEVSHE

SEQ ID NO: 11977 - protein, 245 aa, Actinoplanes utahensis
MNDKRRRPPTLPLEEAFGVPFEADLLERALTHRSYAYENGGLPTNERLEFLGDSVLGVVITSALFHNHPDLPEGQLAKLRASVVNMHALADVARGLGDGGLGPHLLLGKGEETTGGRDKASILADTLEALLGAIYLEHGLETAGEVIHRLFDPLMAESAGRGAALDWKTSLQELTAALGLGVPDYVIEDSGPDHAKTFTAWVVVAGVRYGGSDGRSKKQAEQRAAAAAWRMLTERSEADGDDKPE

SEQ ID NO: 11978 - protein, 399 aa, Actinoplanes utahensis
MATTSPSKAAPAVTDTPEPPAAPQTLWEKAGGGPGVAVAVGLLALTRVGQLLMIWWLGGASTSHGGVWQRLLVWDGGWFLRVANNGYPHGYTYDENHVLQANELAFFPLYPSLIRAVSALGVAPGTAAVAVAWLASIGAAVALHLLGTTLYGKRAGWALVAICCSAPVSVVLSMAYSESLFLALVAGMLAAAHRRAWLPAAVLGLGAALTRPTGAAAAIALAVAAVMALRDEPNRIKPLAAAATALAGVPLFLGWVGWRVGDWTAWFKIQTAGWGTSFDYGRSTVRFLHDTFTSGDGWVQVSVGLILLVALAAAGVALAQKPWPPLAVYGVVAMILVYGQAGFYHSKPRLLLPVLLTLLPAVLAAARARPRVAILSITAWAAFGLWYGAYLITVWPYTM

SEQ ID NO: 11979 - protein, 285 aa, Actinoplanes utahensis
MPELPEVETVRMGLAKWVTGRTVSAVEVHHPRAIRRHLPGDTHFIAMLTGRTILDVARRGKYLWLPLDSGDAIIAHLGMSGQLLMQPGTADDEKHLRVRFRFTDDGPELRFVDQRTFGGLSVSEGGADLPAEISHIARDPIDPLFDDDAFSARLRGRHTEVKRALLDQSLISGVGNIYADEALWRARLHGTRPTDKLSRPAVARLLQHVRDVLGEAIVAGGTSFDELYVNVNGESGYFDRSLNAYGREGEPCKRCGAIMRRESFMNRSSFSCPRCQPKPRLTHAA

SEQ ID NO: 11980 - protein, 189 aa, Actinoplanes utahensis
MKTLFPAYAHPGPELQLDADTWIVREHPGDRRTLHQSLGRIDLDWGSRSLADVLSDVDAWRADGVEGLFLDRAPAGSGGVGPVALTVRLAARRGLHRVVLNPGVPTHPLYRDLGVRICTFEGPWSAYQSWDGDGTRPGDGHIVHGVPAGLLTAARRLMGRRGAGFGLATDAGPDLSPAGAPGGGAHSAD

SEQ ID NO: 11981 - protein, 852 aa, Actinoplanes utahensis
MTITPPRGTAGGSRTAARTRRRRAPAPGEPRHGFGGPGPEEMPGARRRPPLPDRYEENADAVRRQHGPAATDGLGARLYEVMSDSERETAVAETLLFVKPAVGDEPPPAPEPGPFPAAGDPVPPAETQLFPAPAPEAAGANPDFEGLPAAETILFTRPAGWNVAAEPDAPPRREVTPLTETFLFGTPARHAQEPRSPIDGAAETLLFAGLARALATQPEETTGEDPAETAGEAHAYRAIGERDHRGAGRGQRAWVERDRNAAQPLPGDTPRPRREWAFPDEFNVGEMPEYDSGRPGRVVPRRRSRAADPEIPNGAWNARYQQWELDQSRDAEAPIVAEPFIPESFAAESFAAEPFAAESFAAESFAAEPFMAESIVAEPFADEPFAADEPFAAEPFAAEPFAAELFAAEPFAAEPFDLPDPEGSRELTPARLAKAAAAEAAWRAFAEGDREPGAEIRTGRRAKRRWAPTFLLPVILRCLLYLGPLSVTVAAAGALSRVAWPVPAVTLLLGWAAAQALTSVGVTVARRAGPEAAVRLIGAGFAAVTALWCALVWIAPAGLLGPDRLLAAAVGAGGLAALATVTAALVTRAESAVILWYIPCWLLAAAVLATAAGAGWTRHVPVETLLPAAVVAVVIRAFRPAVLLGRECRIPRLTAAERRRGLAYLVIGISQAVCVALLWRSGPAVTPAPAALPLLLAVPILEALIGWHTARIEAGLDSAGSVDDLNRHIRNVTAITLAGLLPPLAAGAALAVAAYRLPAGLTGTAGSRDAVLALAAGTLLGGVFAITFLLAARNRTGIAATLAAVPLSTLAMPLLQQRGSGPLAAAVAVLAATHVAGLIIVGLTAADLRRNS

SEQ ID NO: 11982 - protein, 500 aa, Actinoplanes utahensis
MNPTPSRERICLLTGGGYPYRRDALGGWCRSLVEGLHRFRFELLTVTDRELPSAPAYPLPSHVASSRVVALGREPAGAQRRRAHLPGGAGDAVAQLCHGLLDETATDVFAEGLRTIAEMAVNRPSPLPRLPLADKLMDAWRWGPQPVPDTLPKLSVRDARTAAMLLRHALRALAVPFPEVDLVHCVGGTTPLLAALSGRWRTGTPLLLTEARTPVTRQRPAEERLSPAVRLVLRRFRSAVARTGYAEAEIIAPLSAYHHGWALNLGAEPTRLVQVPVGVDPKSFPGAAELEDPPTVVWAGSGGPDSGLTLVLDAFTEVAAALPGAVLHLVGVTAAHEEHCADQIELTGLGRAIRLHPLPADPRERFTVGQVVAHVPGPSDPPYRLVEAMMSGRPVVAVDIGPAAETLGDTGVVVPADDPSELAIAIVELLRATPRRRALGDAARQRALNHFTVDRVVRVYGALYTDLAAPPPAPAFELALAVPAPRTETPATLRWLTRED

SEQ ID NO: 11983 - protein, 64 aa, Actinoplanes utahensis
MAKALYGHVGAAPDRRLLDEVTRLRSRVQSLEFEITRLRAENDRLAAAAAEADDILRLTEPALT

SEQ ID NO: 11984 - protein, 832 aa, Actinoplanes utahensis
MHLKSLTVKGFKSFASATTLRLEPGITCVVGPNGSGKSNVVDAIAWVLGEQGAKALRGGKMEDVIFAGTAGRAPLGRAEVTLTIDNNDGALPIDYTEVSITRRMFRDGASEYEINGNSCRLLDIQELLSDSGIGREMHIIVGQGRLDAMLHAKPEDRRSFIEEAAGVLKHRKRKEKAVRKLDAMQVNLNRLNDLTAELRRQLKPLGRQAEVARRAAGIQADLRDARLRLLADDLFTLRTTLDREIADEAAMKDRRAEVEAENREVQRMLADLEFAHAEDAPLLQAAQDTWYKLSTLQERFRSTEQLATERLRHLAATPDDERPGRDPDMLEAEAERVREQEEELREALTDDQMRLAEAVEHRQDLERQLAAAEGELRAAAKAIADRREGLAKLVGNVNAARARTSSAAEEIERLAAAHEDALMRAEAAQAEVDVVAAESSDADRDNADLDARHDEAVAAHDKAAAVVRELSDAERAAEKDAASLKAREEALALGLKRKDGAGALLAKAGQVPGLLGSLASMLSVRPGYETALSAALDTLADAVALASLDEAVEAVRTLKIADAGRAALVIAAPAGPGMQGSLDALRPALPEGALWAPDVIDCPEQIRPALNRALRDVVLVPDLAAAATLIAGNAELRAVTPEGDVLGAWAAAGGSAKATSYIEVQAAVDEAKAGRAAAEERIAELKEQLSEVRAQVAELKQAVQVAAQAKRAAEGERNAAARRLAELGAAARSARAESERLGASRQKAEAAREADLMRVAELEERLRLAEDTPIDEEPSTEERDRLAALVPQARQNEMEVRLAVRTAEERVSSIAGRADSLLRQANQERLAS

SEQ ID NO: 11985 - protein, 331 aa, Actinoplanes utahensis
MTGSLVAAAETRDRIAHERTSREAELQEVRATAKRLVTELERLTSEVHRDEMARAEQRMRIEQLEVKAAEDFSLDVDTLITEYGPEQPVPPTQAEVAAAERDGKPAPEPVPFHRATQEKRANKAERDLTMLGKVNPLALEEFAALEERFKFLSDQLEDLKATRKDLLTVVKDVDDRILEVFTSAFEDTAREFQQVFQVLFPGGEGRLILTDPEDMLTTGVEVEARPPGKKIKRLSLLSGGERSLTAVAMLCAIFRARPSPFYIMDEVEAALDDVNLGRLITLFQQLREKSQLLIITHQKRTMEVADALYGVTMRAGVTQVISQRLNRDTED

SEQ ID NO: 11986 - protein, 205 aa, Actinoplanes utahensis
MRDRARALLIDLDGVLRRFDPAPMIAVEVRYGLKPAALLETAMSWDIYRPAMAGEITDEEWMRLVADRLPLEPAEAAAAVAEWQPARLGEVDPDALEFVRGVRAAGRPVGLATNATDRLRADLDALGLTAEVDVVLSSWEMKVHKPAPEYFEQACQAIGVPPGQVLFVDDDDRVIRGARSAGLSGYRWAGTEHVPYLRKALDIDS

SEQ ID NO: 11987 - protein, 199 aa, Actinoplanes utahensis
MGRMSAFRGLTAVLLLLGVAACDVAHDGEPLYTAGTPAPAGSGPAPAGFAPVGPGDRIQPGRQLTFATVQSGGRWMLTVGADGVVVLTDHLVDQALFVVTETTPGAGRFLLKTATGEQSCLQVHSPGRGSALRLKTAPCDPAQHDQIFTFPLAHDGKGVLIEVNGLYAFAATDGGPLVVQESGEGDAMTAFSVRDQGPA

SEQ ID NO: 11988 - protein, 173 aa, Actinoplanes utahensis
MTTWTAPEAHRVPEPHTGDERAMLQGWLDYHRQTLLLKCAGLTAEQLKLASAEPSRLTLLGLVRHMTEVERWWFRNRTLQDPTVGDVYCTDDNQDGDFDDVPGANAEANFAAFLAEIEVCDAAVAELPLEHEFPGRRGPISLRWVYTHMIEEYARHNGHADLLRERIDGVTGS

SEQ ID NO: 11989 - protein, 574 aa, Actinoplanes utahensis
MGRMWAPPDHWKAGAVTAQLLIGPVLRRVVADRATIWVETSAPAQVRVETDGGAAGSAPTFSAYGHHYALVVVGGLAPDAAHAYRVLLDDREVWPVAGTPYPPSVIRTRAADDAAQPVSLLYGSCRQATPQATGRQLPPDALDAYARRLMAEPEHRPDLLVLLGDQVYADETSHKVRRFLRRRRAAGHDGPADQVVTFEEYTKLYLESWRDPEVRWLFSTVPSVMIFDDHELIDDWNTSASWRADMARQPWWRERIAGGLGSYWVYQHLGNLSPDQLDADPLFQKVSVAGDATDLLREFGLAVDDPGSAENTDVPYQWSFALDLGRTRLVVLDNRCNRVLTPGARAMLPAAEWDWFLDQAHGDYDHLVIGSSLPWLMPPAIHHLEAWNEAITESWSPRWAAFGEKVRRAFDLEHWAAFGKSFAALGELFRRLGEGGVGAPGHRVGAGGAYAAPASISVLSGDVHHSYVARADFGHAMATPVMQLTCSPIHNEVPLPLRPLMRVSWLPPVARVARGLARSAGAAKPLIRWKRLSGPYFGNAIGTLILDGATARTHIEGTTKDGRLHEVVATTYRP

SEQ ID NO: 11990 - protein, 405 aa, Actinoplanes utahensis
MTTPNRQYVAHATAGRRICQDFGMEYVVTALILLVVLVVGAVGLVVPRMRRKELPPPTVPQVPAEQELPPLIEKPVEPVEPVEVVQEPPAPVVETPEPTAGRLVRLRARLARSQTALGRGLLSVLSRDHLEDDDWEEIEDSLITADVGVEATQVIVARLRERVRVLGTRTVAGVREQLVEELVAALEPDLDRSLRTAPHDGRPAVVMVVGVNGAGKTTTCGKIGRVLIADGRTVLFGAADTFRAAAAEQLATWGERVGAETVRGPEGGDPASVAFDAVKRGIDTGIDTVLVDTAGRLQNKVGLMDELGKVKRVVEKHGPVDETLLVLDATTGQNGLEQARVFTEVVDVTGVVLTKLDGTAKGGIVIAVQRKLGIPVKLVGLGEGPDDLAPFEPAAFVEALLGETA

SEQ ID NO: 11991 - protein, 265 aa, Actinoplanes utahensis
MTQEPLREIPLHGGNVSTVSRVGDTVRRNAGPWTPAVHALLNHLERVGFTGSPSALGMDEKGREVLTYLDGECGEYPLAPHWVTEEALVTVATMLRMFHDAQYGFVPPPGAVWRSFGPPPPDTEVICHHDAAPHNVVWRPDGTLALIDFDLASPGSRIYDVAYAAWTWVPLFSDRDSYTLGWKRPNRPRRLRLFADAYGLIPRDRHRLVRTIRKRIVDHVEGIRRMAAAGDPAFVRIVHKGHLRRPMRDLRLLDYERHTLEYALR

SEQ ID NO: 11992 - protein, 454 aa, Actinoplanes utahensis
MDTGNTAWLLLSSALVLLMTPGLALFYGGLNRSKGTLNMMMMSFSSIGIVSILWALYGFSLSFGASGNARLNNIIGNLTQYGGTDISWAGDLWGTTKIPVYVFMAFQMMFAIITVALISGSLSDRLKFGGWVLFAIGWFTVVYVPVAHWVWGGGWIGAKLHALDFAGGTAVHINAGAAALGVILVLGKRVGWPRDNMRPHNVPFVALGAGLLWFGWFGFNAGSELTVDSVTGVAFVNTQLATAAALVGWVAVEWIRDKKPTLVGASSGAVAGLVAITPACGFIAPLPAVLLGLVAGAVCALAVGLKYRFGYDDSLDVVGVHFVGGWIGSLSIGLFATNKANSAISSALGAKDGLFYGGGFTQLGRQFVGSAAVTVFSLVVAALIAYVLKAIKLLRVSTEAEIGGIDIADHGESAYDFTPAAGSGGGSAFALAGLGAARTVDADGKADTSQKVAG

SEQ ID NO: 11993 - protein, 112 aa, Actinoplanes utahensis
MKLVTAVIKPYQLDAVKEALHALGVAGLTVSEVQGYGRQKGHTEVYRGAEYTVEFLPKIKVEVITDEIDVEKIVDAVVTASRTGKIGDGKVWVTTVDDVIRVRTGERGLDAL

SEQ ID NO: 11994 - protein, 756 aa, Actinoplanes utahensis
MTNPLSEPPAPPARPTAGGSLDKLRDHIGAAARDERAAALDVWLRQLFPSHLPGVSLLAVGGLGRRDCAPYSDLDLVLVHRGVAGIDRIAAALWYPIWDARLGLDHSVRTLPEALSVAHDDVKVALGLLDARHVAGDETLSAELIAATGDQWRRTAVRLMPQLKELTETRWASHGELAFLLEGDLKEAAGGLRDVTLLRGVGRAGIADTMRPAVRAATLRLLDTRDALHLAVGRRVDRLVAQERGAVAGLLEIEDPDALLRRVSGDARTVAHAVDDAWRAIDRLRGTRRRGGIPSAPSRRPVARDVVEQDGELVLARTAIGPVPDPSLSLRVAAAAATVQLPIARATCEWLAAFCPPLPTPWPAAARAALVSLLGAGPGLLPAWETCDRYGLIDAWLPEWARMRSLPQHHPIHRFTLDRHLVQTAYEATRHAREVDRPDLLLIGAFLHDVGKGLPGDHSLVGAPIAADIATRIGLPPADVATVERMVRLHLLLPDIATRRDLSDPKTISTVAEQVGDPATLDLLHALARADSMATGPAAWSDWKGRLMAELVRRVHTALDTGALPEPPEPDPELLSGTLPVVHLDGDRVSVAAADRRGLLAGVAACLAMHRLDVVAANTGTVDGRAIVEFLTQPRYGTPYEPVALAADLRRVASGDVSVTQRVRARAMSARGGTAEPKVIWQRAAATGAVVLELRAADSPGLLYRVTAALDEAGAEIRAARISTLGGDVVDAFYLVGDWSSDSERDRVRDAVLTAV

SEQ ID NO: 11995 - protein, 844 aa, Actinoplanes utahensis
MIGSLLDEQPATLVAAAVRNRAVGLRDELAYAGLRGTGTLSQLLAAARAGRRDWLRERGWAVQPARLAMLAQIIALQDVLPGDRADALALFELLGPRAVPPRQRAVYAQLAGSARMRVDRQVRREIATDLANPFRHPGRSVRRWLRRFTEGLPEPAVRLDDRADLPPFDRLTTAAPAPIERPEKISVVVTAYRPDEGLLTAVRSIVRQSWRNLEILLVDDASGPGFDDVLRRAVALDPRVRLLRQNVNAGTYVARNAGLDAATGDFVTFQDSDDWSHPRRLELQVTPLLADPRLVACTSDGRRVTADLVVTRLGRRGGKLNPSALLLRRTPVLDRVGYLDVVRKGGDSEYIERIVAAFGPRAVRHLPIHLALIRLSGGSLSRAEILPYWIHPARAVYRSGYVAWHRRIAAGATPAHRPRDGANRPFPAPAHLLRSDRIHPSIAAYDVIVAADWRTLGESQRSALAEIDALLAARMRVAVLHLEDWRRPARERIPVHRTIQDRVNAGRLGQVALTDDAECGLLLIRQAELLRFPPAELLSPPSPPSASPTVPGGGLRPGRVLVLVDEEPSGAVRPVPVLGAEPLWCPQGPDLRAALTRLPLTDFDLPTVAVAQSLPGRSPSARPVVGAEITDRRQLALLDRLTGMDVRIRVADGVHLPRQPAGRLVYRTADLRSLDFLAQLDFYLDSVGSRRSVLDAVAMGCVVLTTVPGPVGLRCRPDRVAGAITQIVADPDRAAERLRQDRSTLRTAHDPALFVSRVAALLSATTSEPAPDISGAAASDPGTSGVVDPGAAASDPATSGVVDPGAAASDPATSGVVGAGAAASDAAGAPVLPAEAGAAVRNAP

SEQ ID NO: 11996 - protein, 347 aa, Actinoplanes utahensis
MVRKLRRLAGRARALGPLTIGAVVITSLLVAAVTVAAVYDAARIAVCLLALLLAVAVAGVLRVNLRLAGMRADRREIRDLRVVLDQTQRRVVSAVERQRLNTEDRHRELFDAVARVQRIADRGVRDLRFAVPREVEATVQLFQGLTPRAPMPSSGDFALNPTDLLELLFLVRTRRPRLVLELGSGTSTVWLAYVLEQVGGRLISLDHDPDYAARTRAALRAHGLTGVAEVRDAPLTPVELGERSFPWYDPAALDDLTGVDLLLVDGPPAAVGPDSRYPALPVLEPRLADRATIVFDDANRSDEQAAIENWLAAVDGLAREGELLGRHAVLSYDRSTRLTTATATAPR

SEQ ID NO: 11997 - protein, 33 aa, Actinoplanes utahensis
MGDDQLSAAAHDICCEHSTLLPTVRFRLARPDQ

SEQ ID NO: 11998 - protein, 161 aa, Actinoplanes utahensis
MRSLFRRLAVVAALAPAAALGVTLLATPADAAGVSEATLQADIVKLTNAQRTAHGCAALKVDARLITAARGHSAYMAQGGAFSHTGKGGSDFVAREKAAGYPKPSAENIAWGYRSGKDVVAAWMKSPGHRANILNCQSKTVGVGAIYSKGGAPYFTQDFGY

SEQ ID NO: 11999 - protein, 764 aa, Actinoplanes utahensis
MRTHITPGAYGSALLDRHLRSLRKTGPDGPATAALRARSADARALLAYAAGVTDLDQLLSRARAGRPLPDRADPWDVGELARVIALQDLEPEDRADGLALFDALLRAHGPAAIAPAHQGLHVQLAFPAGRAADLLERYRAVPRPIREALAVDLAAPSTWLTRFNGLLPAPGIALSEGAGPRFDRIRPGIAPTTAGGTLISTIVTTYRPEPALLVTIRSLIAQSWPDQEILIVDDGSPDTAILDRAAALDPRIRVLRMPVNGGTYLARNAALDAAAGEFVTFQDSDDWSHPLRLERQVAPLLADRGLVAVTSAGMRVTGDLVITRPGHPHHRTYNLSSLMIRREPALERLGYLDTVRKGADAEYVERARAVFGRPAVQHLGGETLALIRLSGGSLSSADQAPGWLHPARQAYLSACQAWHTRIVAGREPARRPRTPQSRAFAAPALLTGTARPETYDLILAGDFTAPESAGPLRALTGRAVTMALLHLPTLDAAGRNLDPEVQRMINLAEVRQVFLADRAHTRLLVVRGPAAIAFAAGLPSGISADHVVIEHDPDWSPAAEALTAASIRLFGVEPVTVPLPCTVDPRRWQAVRTRPAGDRPILGRATADGPDHLRTLRRLVRDAPECDVRVLDRSADATTAFGRRTPLNWLVYREPDVTPRGFLHQIDFYLGLGDPPATLLPALAAGCVLLLPPEREAEYGSAAVYCTPDDLHPTMRRMHRSPERWAAQSGRGRDFARRHHHGVYADAVLTQLRPAELPKPRTAG

SEQ ID NO: 12000 - protein, 731 aa, Actinoplanes utahensis
MTATVHDVAILSDFRYPGGNSAAIAAEVRAQAEAGLRTVLVHVPSPHNRDGLPFSPRIAELLRDGSAELATPDAVTQAKLLVIRQPRIFTEDLAVVPRIRAGRTVMVLNQAPGDAADPARYYDFAEVRDRVELYFGPEIEWMPISPQIRQGLSDLSDQDWHEIIDVGEWPNDVPRKRDIPVIGRHGRADLVKWPPTAGELLQAYPDKPDIRVRVLGGGEIATRILGRRPTNWEIIPFGQEEPLAFLRSIDFFVYFHHPDLVEAFGRTILEAMAAGVPAIIGEHFRPIFGDAALYATPAGVEPLVRRLWADPASYRAVAAKAREFVDTRYGVASHLARLADRGAGARPAAHRASGTARHGEPTPRPRPVLMLSDNGAGLGHLSRLMAIGRRLPEQHPAVIATQSYGASVAHREGFLTEYLPSRTVLGLAKQRWAGFLQARLEHLVDLHRPAVVAVDSVPHEGIVAAAAARPDVTWVWVRRPMWRRGTGAEWIARGAAFDRILEPGEFAAAVDRGPTVADRAGVHAVDPIMLLDRADLAAPDEARAALGLEPGRPAALLQLGAGNINDIASPVGRIARQLREAGFQVLLAESMIATEPMPPVPGATVVKVYPISRYLRGLDLVVSASGYNSFHELLAFGVPAVFVPNRETSLDDQVARARFAASSGAALWVEDPDSDELDRVLAEAVRPEVREQLVRRCGEVGFDNGAGAAARWLAELAAETVRRAENVRSGA

SEQ ID NO: 12001 - protein, 86 aa, Actinoplanes utahensis
MSDLSTKPELERLHWEIAALTGRMRSVELERDSWRARCDRLVEQRDREREKSRKLADSGSYRLGRALVSFARDPWHTSPRLVRGLA

SEQ ID NO: 12002 - protein, 123 aa, Actinoplanes utahensis
MPGQAGRPPVAPRRPAHLYVAIGLDHDALRDFLVTVNQRLLVTPDHRPVVLTDDPAFALLRKLGVLMEYLPDRATWERHRPDRAWDDLLAERLAQLCRDHNTERTVVVDRLHPPALADLLNTR

SEQ ID NO: 12003 - protein, 654 aa, Actinoplanes utahensis
MSLSPNFRSDVEGLRAVAVLLVVLGHAGVPFAAGGYVGVDVFFVISGFLITSLLLRERAAGRMSIRRFYARRALRLLPAAALVLVSTLLAARLWLPPIRMGDLARDALSAAGYVANLRFALTGTDYLNADAPPSPFQHFWSLAVEEQFYLIWPLLLMLPRRRPVLIGLVLASFTAGVWETTRSAPWAYFGPHTRAWELGAGALVALFAPKVRNGWLGGAGLAAILGAALWCDDATAYPGFYALLPVAGTTAVLIGGLPLLEARPLQAVGRLSYGWYLWHWPLLLIGPAALGRDPSLPLSLLLAAAGLGLAWVTYHLVENPVRHHPWLRVRTAPALGLGAALSALVAATAVTIALLPHPVPAGAAIRDLRAATAHATDPYAVVTRAVRASRGLRELPANLTPTLARVNQDKARVWADGCHVEAPVLVAPAGCEYGDPGSTTTVVLYGDSHAAQWFPAMDRLAEQHHWRLVSISKSSCSAADLPLWHDGLKREYTECAAFHTSAEARIRALRPALVVIGSSFNYRPVDTRTDEAAQWRAGWQRTFAALGAAKVALIEDTPYLGGERVPVCVARQARLKRINRCGKPATSALRGPAQRSVLPGLTGVTVVDPDPWLCTDFCPPVIGNVLAYRDSNHLTTTFAQTVAPLLDAALPRVQ

SEQ ID NO: 12004 - protein, 552 aa, Actinoplanes utahensis
MSGGRPRRNLVPAALVAFAVTAQTLSAPADPDTGPQRRSGQPTVDPRPLWRGVLLRSALVPLIVLSPLVAAQPSADHRFNVYANGARYLTRPWELVGAAVTSVPQYLNLGNFRPLGRIAEWLLDTLTFALTDVFGLPANISLRLVSFLSAILLTLAAVVLTECVTTRGRAFAGPPSLPVAVLPFAAAGGFVAAGRTSTTILFGGLYFLTAALVLLVAAAAAHLTNNTGLGVRPIVLALTLGLTLAAFNEMAWLALPLATVVVPIRARLILGRSWRDTLTGAGARFTGLLWAGFLPVAVPVRLIIAARCAAGRCYSGSDVALPGAPGALPNRLTAWIPPLMWQRASEGPYGHTLGPALLLALLAMLPLVWKLRRELPGHPAADRRQVLALAATALAVLVPAAAMGALNEQMQHLAAAGWWGLGWRDSALAGAGGALLTVAPIATLRQHRARLAAVLLLAVVAAAGASANRDYRAGTASEKPAFVHDRVAQEIVDFDRSAAGDARRCELRRQFRDSLPPGRRTGYPPELRRFDQAVDEATRELAGRRFCTGAPA

SEQ ID NO: 12005 - protein, 348 aa, Actinoplanes utahensis
MTPGRVSVVAPVYNEGAGVDRFVDRMREVLAGHDYELVLVDDGSADDSWRRIAGHAAHDPRVRGLRLSRNFGKEAALLAGLEHADGDAVIVIDADLQHPPAAIPDMIRRWRAGAQVVEAVKRNRTGQSLSSRLGARVFNHAFTRMTKVDLVNATDFRLLARPALDALLQMPEHSSFFRGTSSWIGFTRETVEVDIDHREGGASRWTARSLFRLAVNGLTSFTSAPLHLVTLVGLAFAAFSAVLGVQTLVRWMQGHSVAGFPTVILLLLVTGTFVLLGLGVIGEYLARIHEEVRGRPRYLLRDLAGPRRMAEHSGGRLGPLDVPVAERAGGGLRSLDVPEQWVERAERR

SEQ ID NO: 12006 - protein, 139 aa, Actinoplanes utahensis
MRSGGEPVRALLPGPRLARVVRYGLSGGASALTHFGIGLCGVHLLHLRPVVASTTGFVASIAVSYALQRWWVFRSTTGHAIAGSRFLIVTAVAFTINTLVLWLGTEVLAAPYPIVQPIALTLIPLVNYFLNSRWTFAHR

SEQ ID NO: 12007 - protein, 420 aa, Actinoplanes utahensis
MSYDVVILGLGYVGLPLAQQAIRAGMSVLGFDVDETVVKSLAAGRSHVDDLSDADVAEMLAGGFRATADETEIATARTAVICVPTPLSEGDGPDLRAVTGATGSVGRNLRAGMLVVLESTTYPGTTDDVVRPLLERLSGLTAGIDFHLAFSPERIDPGNAEYGAHNTPKVVGGYTTACTEAAAGFYGRFIETVVRARGTREAETAKLLENTYRHVNIALVNEMARFCHELDIDLWDVINAASTKPFGFQAFYPGPGVGGHCIPIDPNYLSHNVRSKLGYPFRFVELAQEINATMPAYVARRAQNLLNADGQAVRGATVLLLGITYKPNIADQRESPAAPLARQLAALGATVSYHDPHVGTWDIGGVPVSRTEDLEGAVASADLVILVQNHREYDADHLARLAKRFFDTRGVTTGREAHRL

SEQ ID NO: 12008 - protein, 582 aa, Actinoplanes utahensis
MRNYRHPPIKGIDRNFRLRRGVEARVVRREDDVTLRAMLRRAPWPIRRRIAQAGNRLLPRIAPDRRLRVARTLAPLAGRVVRGARVVTATSPAEVRRANLDRVTAALDAAGVDWFRVPGTDPRRTALGVPETDRDLVDRLLGRLAGGDRGMIRRDRRVVSVCWPVTDPAGGLVLGPEFGCDVEFWRTDRDHLTAPRRNPVADRFPAGEPVVTAPEATFGAFRATDDHSLHRTRRVFTTAVPDRIDFPIDAVYTWVDGGDPAWRRRKAEALAGNPWVAGLHAQAANDSRYASRDELRYSMRALHCFAPWVRHVYLVTDGQAPAWLNRGHPRLTVVGHREIFGGTGTLPTFNSQAIESRLHRIPGLAEHFLYLNDDVFLGRPVTPDLFFTATGLTRFFPSPSLVDLAPRGPGDRPADAAAKNNRRLIEQAFGRVLTRKMMHTPHPARRSVLQEIERRFAEEVRGTAEHQFRHPDDVSMLSSLQQYYAFLTGRAIPGEIRHRYADLADPHTPLRLAALLRARDADTLCLNDVDSGEAAVPEQRALLAEFLPAYLPFPSPFELTHRPTGPRRPAPAPSPQLTRRIP

SEQ ID NO: 12009 - protein, 95 aa, Actinoplanes utahensis
MREVAPARHGGRQSMTGRLGMGKAVMFVLALIGGVVVVSWVFHALFGAFFYLLLVAAVVGGGLWLYGKVKREIAPGTRTQRRIEAATKTYRMRNR

SEQ ID NO: 12010 - protein, 517 aa, Actinoplanes utahensis
MFDTLSDRLSGIFTKLRGKGKLTDADIDATAREIRLALLEADVALPVVKAFIANLKERARGAEVSQALNPAQQIIKIVHEELINTLGGEGRRLVFAKQPPTVIMLAGLQGAGKTTLAGKLSRWLKNQGHQPLLVAADLQRPNAVNQLQVVGGRAGVDVYAPEPGSGVGDPVKVAKDSIEVAKRTAKDIVIVDTAGRLGIDEEMMQQARDIRAAVNPDEVIFVIDAMVGQDAVQTAEAFRDGVGITGVVLSKLDGDARGGAALSVRHVTGQPILFASTGEKLEDFDLFHPDRMASRILGMGDVLTLIEQAEQAFDEDQKEKMASKLLGGEQFTLEDFLDQLIAVRRMGPIANILGMMPGMGQMKDQLAELDDSHFDRVTAIIRSMTPQERTEPKVINASRRLRIANGSGVTVMEVNQLLNRFADAQKMMKQMSGMMGLPGGRRSATKSSKNKRKGKNNNRPRTGGGLPGGMPAGFPGGMPQLPPGLDPNALAGGGMPPGFKLPKLDFNKLNKPKDDER

SEQ ID NO: 12011 - protein, 204 aa, Actinoplanes utahensis
MTAAPHLSEFEMIDYLLGRDDLTVDDIADLPEDLRYELIDGRLVLSPLAMPFHQYLSFQVATAVHEFCPDSVLVNVEQAVLLDRRNELRPDMVLVREEGALRSPVRPEDVPLVVEVISESSKRFDRTGKLKKYAYVGITNYWIIDPLADDVSFTQFALGADGSYRQLLETSDLVTVDQPWQVTLDLPAWTRRRDRIRAVARPDI

SEQ ID NO: 12012 - protein, 358 aa, Actinoplanes utahensis
MALHVRGTVLPDGEVRDIWLVGDRITFEPVGGAETISDGGFIVPGLVDAHCHLGIAYGAKPIESLDQARELAHTDRDAGVLALRDAGSPFPYPELDDEPGIPRLARAGRHVAPPRRYLRDIGVEVPAEEVAAAVTAQAKAGTGWVKLVGDWIDRSVGDLAPSWDAETMAAAVEAAHAAGARAAVHTFSEEGVEIMVKAGVDSVEHGTGLSLELIDEMARRGTALVPTMINIRTFGKIADQAREKFAGYADHMLALRDNFPEVVLAAHEAGVPIYVGTDAGGGIRHGLAAEEMLYLHEAGIPAADVLAAASWKARAWLGFPGLVEGGLADLVVYDADPRADLRVVRAPRRIVLRGAVIR

SEQ ID NO: 12013 - protein, 476 aa, Actinoplanes utahensis
MSTDLDELFTTLGRQADAVPIGTAEQARRRGAQLRTRQRAVLAGAAAVVLVLAGAGVLAVRQHRLTDPVLPATTPSRIRGLAPLGEPLPAPAGETWTAARIAGDRVIGLSKTRAIAIDAGTGRTLWTLPGLDSTYLGVATTAKSVILVRQPAPAVEDIKAPDNRVLEFHDPATGAKRWQLPHTTGDRLVLHRDVVVRLSKTTGRIDAYDLAGGRRLWTAAAGATMISGMLTGADASEDVSGGGAALFSPESEKAFPVTDDRLVSITSGGQVVIRNIRTGKVQSQTRARRDAQELIAYEGMVYTEESTPGGLGIGTPQRILYDRQGSWAMDRYFPCGHDRLCLYETDGSDVRLLLIDAVGGTVLRRTGAVPLSGTSSVRLGHVMTSGGGDKGTALYDENGQARYSDNGIGGFIDDGNVLTLTRDAGDGRFTARGVSNIDYRKVTLGTMPEISGRCDWDTGLLTCPTGQGLYSWRFTR

SEQ ID NO: 12014 - protein, 162 aa, Actinoplanes utahensis
MDFDGFYRDTSRRLLRYAYGLTGDPGEAQDLVQEAYARAWQRWRRVSGYEDPEAWLRLVVNRLSTDRWRRLGIRRARAAAEPPPAPVAPPSEDLVLLVRAMRELPDAQRRALALHYLLDRSVADIATETGVALGTVKSWLSRGRAALAAALGAVEEGANRVH

SEQ ID NO: 12015 - protein, 468 aa, Actinoplanes utahensis
MARVLTPRAEDFPRWYQDLIAKAQLADNGPVRGTMVIRPVGYAIWERMQADMDARIKEQGVQNAYFPLFIPENYLRREADHVEGFSPELAVVTHAGGKELAEPLVVRPTSETVIGEFMAKWVDSYRDLPLLLNQWANVVRWELRPRTFLRTTEFLWQEGHTAHATEQDARDHAREIHKHVYQAFMEELLAIPVVPGRKTKGERFAGATNTMTVEAMMGDGKALQMGTSHELGQNFAKAFDITYSSADRTVEHAWTTSWGTSTRMVGGLIMVHGDDNGLRLPPRLAPIQVQIMVVKAGEGVTEAATQLRDDLKAAGVRVKLDDRADIPFGRRAVDAELQGIPIRVEVGPRDLANGNAVVARRIDGTKSPIALAEVAAAVVAALKADQQRLYDDALAFRVERTVDVKTLGEAIEAAQTGWARVPWSAIGEAGEKEANGKAVTVRCLTREDGSMPESDTEDGLVAYLGRSY

SEQ ID NO: 12016 - protein, 215 aa, Actinoplanes utahensis
MRFTEGRPVLYRNFSADRLVNVRPCRVVSDDDRGLLLWLARGTPVIIDVHRDGRGTRDMPFAEWAVAPRKRIVSTWAGPGVLKFIPPGADHSVWFFRTERDTFKNWYVNLEAHAIRWDDGDVAGVDVMDQDLDIHVDPDRTWRWKDEDEFAERLALPEHYWVPDPEAVWAEGRRVIKQIEAGEFPFDGTWTDFRPDPGWPVPAEIPPGWDRPGAR

SEQ ID NO: 12017 - protein, 175 aa, Actinoplanes utahensis
MAVKIRLLRMGKIRNPQYRIVVADSRTKRDGRAIEYIGIYQPKEHPSLIEVKSDRVQYWLGVGAQPSEPVQRILEKTGDWQKFKGLPAPAPLLVAPSKQSKTEVYEAEAKAAAGLADTKPAATPKKAKGEAKPAAAPEAAEAKPEQTKVADPAEPNREAVAETAEDPAGAGADAS

SEQ ID NO: 12018 - protein, 85 aa, Actinoplanes utahensis
MPAPTRADGALRPALEHLVKGIVDNPDDVRVRLVDSRRGKRLEVRVHPEDLGTVIGRGGRTAKALRQVIGSIGGRGIRVDIVDAY

SEQ ID NO: 12019 - protein, 189 aa, Actinoplanes utahensis
MLLVVGQIGKPHGIRGEVSVVVRTDEPEARFTAGQVFTTEVPRDRRVSTGPAAASAPGALFEVPKQLTLESIRWHQGRGIAVFEGIHDRNLAEAMRGVFLQVDSAELAPPEDPDEFHDHQLIGLRVESLDGTELGTVQRIEHAPSSDLIVLAKSGGGTALIPFVTVMVPTVDIPGGRVVVDLPEGLLDL

SEQ ID NO: 12020 - protein, 254 aa, Actinoplanes utahensis
MKVDIISIFPDYFAPLDLSLIGRARTTGTLDLTVHDLRTWTHDVHRTVDDSPYGGGPGMVMRPEPWGEALDAVGSPEATLVVPSPVGRPFTQADAYELAALPHLIFACGRYEGIDQRVIDDAADRMPVREVSLGDYVLFGGEVAVIVIMEAITRLLPGVLGNADSLTEESHAAGLLEAPVYTKPASWRGRDVPDVLRSGDHGRIARWRRTESFVRTASRRPDLYAAYPPENLDKKDRKALAEAGLELPPPGVAK

SEQ ID NO: 12021 - protein, 118 aa, Actinoplanes utahensis
MNTLDELDAQSQRTDLPDFRAGDTLKVYARVVEGNRSRVQVFQGVVIGRQGSGLRETFKIRKISFGVGVERTYPFNSPAIDKIEVVTRGDVRRAKLYYLRELRGKKAKIKELREKQSV

SEQ ID NO: 12022 - protein, 296 aa, Actinoplanes utahensis
MRSVDPMEGYRPSRRRSLIRRKEMPLWQELPLLLVVAFCLAVLIRTFLVQAFYIPSGSMQTTLELKDRVLVNKVVYDMRDPLRGEIVVFRGTDNWAPEVTEPVSNTFGAKLGRTIGDLVGVSRPGERDFIKRVIGLPGDKVACCDDQGRITVNGIGIDEAYIAPGHNSDLNQPPIAGQCTSRKFAEITVPPGQMFVMGDHRKVSQDARCQGPVPIKNVIGRAFVTVWPTSRFTTLEVPDVWKQFAQQHPTAAAGPPGPRPRQDPRVAGSLFPLLITAVWSARSSMSFRTRRRRLRA

SEQ ID NO: 12023 - protein, 220 aa, Actinoplanes utahensis
MIDEQTEKRRGSFWRELPILLGVAILVAVLVRAFVLQTFYIPSPSMEHTLNVWDRVLVNKLVYDFRDPKRGEIIVFKAPTEWQSGNEGEDFIKRVIGTPGDRVVCCDTQGRLTINGHSLDEPYIYTDADGNRNQVADEKFDITVPAGRLWVMGDHREASGDSLEHYEQSTATDTAGKMADSTITIDSVVGRAFTIFWPAGRATWLTVPDTYDAIPDAAGH

SEQ ID NO: 12024 - protein, 210 aa, Actinoplanes utahensis
MTDSNQPAVVARRAGRVLLVDRAGRALLLRGGDPARPGLHWWFTPGGGLQDAESTVEAAARELAEETGLRVSPGELGGPIRHEHAEFSYNGRDYRQEQDFFLLRVAVWQVDTAGMDAEERLTITEHRWWSAAEIEASAELIYPADLAELLRSQVDGPAAASEGTAGVAASGGVAASGGTAGVAASGGAAGAAAASGAPVHAADGVPEMGF

SEQ ID NO: 12025 - protein, 281 aa, Actinoplanes utahensis
MLAPARTVVRREAGLYALEQALQRRGFAHVAGADEAGRGACAGPLVAAAAVLPAGKRGEVPGLADSKLLTAAARERVYDEVVKRALAWSVMIIPPTEVDARGLHVCNLAAMRRALASLTVRPEYVLTDGFPVDGLGVPGLAVWKGDRVAACVAAASVLAKVTRDRMMVELDGKFPEYGFAVHKGYITDEHSAALLRHGPCAEHRFSYVNVAAASGRGNVPPRARRPAARPADPAPSLFDVSVTEPLLLPRAAEGTVGVASGEQPQPSPSVGEDEAMEGETR

SEQ ID NO: 12026 - protein, 107 aa, Actinoplanes utahensis
MSAEDLEKYETEMELQLYREYRDIVRQFSYVVETERRFYLANQVDLHVRNSDGEVYFEVEMHDAWVWDMYRPARFVKNVRVMTFKDVNVEELEKPDISLPDDAGFGG

SEQ ID NO: 12027 - protein, 172 aa, Actinoplanes utahensis
MRPARLALMSFLLALLLAVGLLGLPHESPPGLRFGWPLLPARVTRPFLAPPEPWLPGHRGADLAGQPGDPVRAAAAGTVVYAAVLAGRGVVSVAHAGGLRSTYEPVDPAVTAGSTVTGGQLLGRLDPGHPGCPVAACLHWGVRRNDLYLDPLILLGIGRVRLLPLPVVQQAG

SEQ ID NO: 12028 - protein, 395 aa, Actinoplanes utahensis
MSAEDPPQPIAGARLLFSLDPAVSYLNHGSFGALPITVQRAQQRLRDEMDLNPMRFFGPGLLDRIIHTRRHLAAFLGADPEGSALTSNTTTAVSLVLQSVRLKESDEVLLTDHAYGAVTMAVRRECRRTGATTRTIAVPFGASGPEVLSRVRAALRPGRTRLLIIDQVTSATATLMPVREVVAAARAQGIPVMVDGAHVPGMLPVRVEEIGADFWVGNLHKWGWAPRGTSLLAVSPDWRRRIDPLVVSWEQDQGFPLSVEFQGTIDYTPWLAAPAGIFAMRTLGPEVVREHNAALAAYGQRVVGAALGHAPADLPEPGGPGVSMRIVPLPAGVATTFPEAHALRGHIADKLGVETQINAWGGRGLLRLSAQIYNRPEEYHHLADRLPSLLHHWQW

SEQ ID NO: 12029 - protein, 406 aa, Actinoplanes utahensis
MTRKHGTLDAVDAYRRRPRAKRVTEMHEALPPALREAVDRFGHHLAVVEDRSAHTVRAYLGDVVSLLAHAAEQGCSAVGDLGIAVLRGWLAARLDEGAARTSQARRAAAVRTFTGWAHRIGLAPADAGSGLASPRTHRDLPHVLRADQAVALVTAPSLPPGSGTGREPNTAGASAADATGPDGSGQEAGETEADRGETEADRAGGDVVAIRDRAVLELLYATGIRVSELCDLDQTDIDHNRQVVRVFGKGGKERAVPYGHPARDALAAWLRLGRPVLAAVGDGQAAAGAGDHRLAVRGPARNPARTGRRAGRSLAADALFLGLKGGRLQPTVVRRIVAGAARRAGLPHTKPHDLRHSAATHLLDGGADLRAVQELLGHSSLASTQIYTHVSTERLRAAFNQAHPRA

SEQ ID NO: 12030 - protein, 134 aa, Actinoplanes utahensis
MIDHSADRAVFRQLADLLRDRITSGELGPGEPLPSELRLAQDYGISRTTVRQAIGQLRTEGLVTVDRPRGTFVRVPEPVQLVTLARGERAGARMPTDAERRKHRLGEGVPVLVVTSADGTETVHPADRVQLTRS

SEQ ID NO: 12031 - protein, 76 aa, Actinoplanes utahensis
MSERPEWNCRACGRPWPCSTARGTLLHEYRAFPSLLRIYLSAQMYDALEDMIIDGAPPLNLYQRFLGWAWTDPPAP

SEQ ID NO: 12032 - protein, 373 aa, Actinoplanes utahensis
MNLHPRLDILGQPDFALSQIRDRLRKVRTAGDLVRPLTAHATQADANLVCAHEADRLHSHMIDRRRGTIRRSASCPETGSRQASTIVAMTRRRTTSGQVPVSPRHRRDWRTMWRRCRCGLPAPCIDRLVPPPVPPFPLRTSTPSRPEPAKFDNVPPDRQKPHLAAAPRQRRPCDELRRPVTHHPAPADDHASRSSPLTGHPAPADGHASRSSPSIPRRPDHPATPTASGGPGGHHPTDGSGGHHLADGSGSHHLTGGSGGHHLAEGPTRRRACFHSDAVRARFPDVVAPEVWQRHPDDRVHAADQQVRTDDRQTDIDEGQPSVAVGRAAVPQPRPRHPEANVGRAGNLTPGQRYRTVCNDPFKNHMHRRRGGR

SEQ ID NO: 12033 - protein, 391 aa, Actinoplanes utahensis
MSGPGSESDRVARAALTWLAEPGNRVVWEMVQQAGAPVVLERLLAGDIPDTSLRSAVAARCGAGDARQIAEENVEAAARIGARLVVPADPEWPARVDALATLEMESRGRINRDTRPPLCFWVRGAPPLGATLERSVAVVGARASTGYGVHVAADLAYGLAEQGWTVVSGGAVGIDLAAHQGTLAAGGVTVAVLACGVDRPYPLSNTTTFTRIAAHGLLVSEWPPGSDPLRHRFLIRNRVIAAATAGTVVVEAAARSGATQTMSRVIALDRPAMVVPGPVTSTMSVGCHELLRGNPQARLVTCAADVLEEVGRIGEFLEPAPRGRERVRDRLDEESALILEALPRRRAATPEEISAEARLDVRTVLRRLSLLEAAGLVVRTEAGITLATRGG

SEQ ID NO: 12034 - protein, 529 aa, Actinoplanes utahensis
MPAAARRHPRHPPEGGVLMSYARVLCVGLIGVAGRLVEVEADLSLGLPAVVLTGLPDTALHEARDRVRAAVVNSGCEWPNRRITVNLLPAALPKHGSGFDLAIAAALLAGAGELPPGPLDRVVLLGELGLDGAVRPVRGVLPMVAAAAQAGITKVIVPLGNAREATVVPGVTVRAVDSLRRLVDFVRGTGRLLEPPPESPPPARTGPDLADVAGQQLGRYALEIAAAGGHHLALFGPPGAGKTMLAERLPSLLPALGDEAALEVTALQSIAGVLPPDSGLIRRPPYQSPHHSSSMASLIGGGSGLARPGALSLAHRGVLFLDEAPEIARATLQALRQPLESGRVILARARGTTEYPAQVQLVLAANPCPCATTDQRCTCSPQIRRRYLGRLSGPLLDRVDIKVDLLPMRAAQLVTQESPVESSETIAERVLRARNAAAERWAGDGWTVNAEVPGPALRRQPWLLPARDTAVLRKALDRGTVSARGFDRVLRLAWTVADLDGRGRPSTDDVSEALQLRTGENLAIREQSA

SEQ ID NO: 12035 - protein, 119 aa, Actinoplanes utahensis
MTTQRQAIGAYGERLAARYLQKHGLEVLFRNWRCADGEVDLILRDGDTLVFCEVKTRRTATFGPPAAAVHPRKVRKLRQLAGRWLAESGEHARQIRFDVVEVCPQRRGATRVTHLRAAF

SEQ ID NO: 12036 - protein, 297 aa, Actinoplanes utahensis
MAVVTMRQLLESGVHFGHQTRRWNPKMKRFIFTERNGIYIIDLRQTLDYIEKAYAYVRDTVAEGGHILFVGTKKQAQEAIAEQATRVGQPYVNHRWLGGMLTNFQTVYKRLQRMKELEALGDLSGTAAGYTKKETLQLSREKEKLTKTLGGLRDMTKVPSAIWVVDTKKEHIAVDEARKLNIPVIAVLDTNCDPDEVDFPIPGNDDAIRSAELLTKVIAAAVADGLIARSGRHRGDADTKPEAGTVAAGEPLPEWERDLYEGGDKKAAEAATEPAAAEPAAAEPAAAEPVVAAVPAE

SEQ ID NO: 12037 - protein, 338 aa, Actinoplanes utahensis
MATRRPPRPPPSRPLLSRPPPSRPLPSRLSPPSPPSKSTDTLPAAAVRAAAADFPTDIERRVMANYTAADVKKLRELTGAGMMDCKKALEESEGDFDKAVEFLRIKGAKDVGKRASRTAANGIVSHAGKALLELNCETDFVAKTPDFVALGQRLVEFGEQNKVADAAALLAATIEDGKTVADLIQDYAAKIGEKIVLNRFVILDGTVAVYLHRKAQDLPPQVGVLVQYTGKDDEAADSDARGIGMQITAMRPKYLTREEVPAEVVESERRIAEQTAREEGKPEQAISKIVDGRVNSFFKDFVLLEQASVVDNKKTVKQIATEAGIELTRFVRYEVGQE

SEQ ID NO: 12038 - protein, 252 aa, Actinoplanes utahensis
MTMVTEQSATVDENPPAMRPRRVVLKLSGEVFGGGAVGVDPDVVQALAKQIATVNRRGIQVAVVVGGGNFFRGAELQKRGMDRNRADYMGMLGTVMNCLALQDFLEKEGIETRVQTAIHMAQVAEPYIPLRAIRHLEKGRVVIFGAGAGMPYFSTDTVTAQRALEIHADMVLMSKNGVDGVYTADPRIDPDARKLENITFQEILQRGLRVADQAAFSLCEENKLPMLVFGADGDDTIVRACAGEKIGTLITA

SEQ ID NO: 12039 - protein, 185 aa, Actinoplanes utahensis
MIEEILFEAEEKMDSAVEHAKEEFAAIRTGRATPAMFSKILVDYYGAPTPVTQMASVGVPEPRMVIVKPYDNTQLGPIERAIRDSDLGVNPNNEGTQLRIHLPQMTEERRRDMIKVARGKAEEGRVAIRNVRRKAKEQIDKLVKDGETGEDEGRRAEKELDDTTHRYVSVVDELVKHKEAELLEV

SEQ ID NO: 12040 - protein, 340 aa, Actinoplanes utahensis
MSYLDPRAGQNSGDTYAEPAYQNPAWHADERAPDPMNHADEKAPDPMNSDDESRRGPGKRRAGRGRKPEGKSRAGRNLPAAIAVGLSLGLVVLASLLVWSPALLGVVVLAAGVGVWETSRALSVTGARPPVIPLIAGTAVMTGLAWYEGADALTVGLVVTIGAAVLWRLADGVAAVRRDFTSIVLIAVYVPFLLSFAAMLVRPEDDGQWRVLATVVAVVLSDTGGYAAGVFLGKHPMAPKISPKKSWEGFAGSITASAIGSGALLFFLMHVPVYYGLLFGAVLSVVAVLGDLAESMLKRDLGIKDMSNLLPGHGGLMDRLDSILFAVPTAYLLFAIIAPN

SEQ ID NO: 12041 - protein, 392 aa, Actinoplanes utahensis
MTILPVIPISPDQPDAVTTRRRPSMPPRHLADLDLAARKSAMADLGEPAFRAKQLSTHYFGRLVRDAAAMTDLPSATRDKLTASLLPTLLHPVREQACDDGATRKTLWRLHDGSLVESVLMGYPDRVTACVSSQAGCGMACPFCATGQQGLTRNLSVAEIVDQVVYLAGVAASGAVTGSPPRLSRVVFMGMGEPLANYPRVIEAVRRLTAPAPEGLGLSQRHITVSTVGLVPAMRRLIAEQLSVTLALSLHAPDDDLRDELVPVNQRWKVAEVLDAAFDYAAQTGRRVSIEYALIRDVNDQPWRADLLGRLLHGKLAHVNLIPLNPTPGSKWDASPKPVEREFVRRLREAGVAATVRDTRGREIDGACGQLAAGELTQAGAVGVAADAEVAQ

SEQ ID NO: 12042 - protein, 427 aa, Actinoplanes utahensis
MTSQGQRFRRRALRRGYKVDEVDAFLDRVEATLAGEQVGPPVGAQEVHDVVFRVRFGGYDEWQVDLHLDRVERQLAEFEERGGRPVDPMRDSMRSGLTADRTGGFDRGEMDRTGGFDRTGGFDRAGAAGQPSGPPAMSGPPSRNGGMAGAGMGGPGPNGPQFGGPGGPGGPGMGQQQYGNPGMNAGMAQTERLPAPIRDDRMMPPPMGGQQLPQRPQMQQPDPYGGRYDEPTSYGGQPQLPQRGAPQGYDQGGYDEPTSYAGFEPGRHGRTDMTAEIRMPDRDPRGGYGGPPMPPGPPMGGGPMQQPPAGMPGSPMSGAPMSGPPGGYGQPQQPQLGPPIGEPGGELYRVDQLRRTFQPRRFGSGYDPMQVDRLFEGILQAMTGRGPMPVNVGELDMLQFGLVPNGYFEAEVDAALREVKDILTRHR

SEQ ID NO: 12043 - protein, 78 aa, Actinoplanes utahensis
MSALEEHEDVYAPDQLKPTNRRRAQRGAIISAVVLLMYFWGNQEGNTEKVWLVVIAVLLILAVIGDAVLRKTGLRAND

SEQ ID NO: 12044 - protein, 520 aa, Actinoplanes utahensis
MRITGTGHASMRIDTAAGSILCDPWVNPAYFASWFPFPDNSQLDWETLGDCDYLYISHLHRDHFDAEHLKRFVSKKATVLLPEYPTSQLEDELRALGFTSFLRTKSDEVHELDGGLKVMIQALISPTDGPIGDSSLWVEYDGVRVLNQNDARPTDLVRFTELGHVHAHMLQFSGAIWYPMVYELPENAKTAFGKQKRERQFDRTWRYIDDLKADHVFPIAGPPCFLDDTLWQFNDIHGDEGNIFPDQAVFLEEYAKVGGTNGIVLLPGSVSEITATGTATTEHPVPVDEFFANKTAHLEEMRARKAPIIEAEKASWRHPEIDVLGAMKKRIEPLLEESLYMANGVGGPVRFDLTDSFGPDGEVVESIVVDFPGKQVRQYADEKVRYRFKTGRALIEHLIHIDEGDWVNSLFLSCRFSAARIGQYNEFVYAFFKCLSEERLQYAEGWYDEHEKAVDAEDIQFGDWTVQRRCPHLKADLSRFGIVEGDVLTCQLHGWKFDLPSGRCLTGVGHKIRAHKTQDQ

SEQ ID NO: 12045 - protein, 647 aa, Actinoplanes utahensis
MVGARRGALLPRRLAAVDAGGGLGLPVRRAGPPAVAADRPDRLVHGREPVRVPARVRAVLLAAAESGHAVRRVRRDRRDGRGRPVALRVPHDRSCRIRGNARRQATFNGRITEGGRHLSEVPSLGMTPIPDRADVVIIGSGHNGLVSAILLARAGLDVVVLEAAGVLGGATRTEHPFPRVPGLGQSTGSYLLGLMPPELLRKLDVDIPMLRRDPHYFLPTPGPAGSPHLLFGRDRDATRQQLETFFSPRDAAADEAMAVEIAALRADLAPSWLEEPGSVEQIADRHIRPQLQSTFLDLVRGSVADYLARFGFKSELLTSMYAVTDGLSGLTAGPDDPGTGHNFLVHNMCRLPGADSTWMIAEGGMGTVARVFADAARAAGARLFTDAAVTSVTIDGGAASGVVLADGREVRARAVLGSCDPYRLMSLVPAGTLPAPLVEHLESVRRPGTTLKVNLALRDLPRFSCLPEGAPSPFGSTIHLLPGAGDSPMAALRDMWAQVQAGRLPDEPTIEWYVHTTVDPSLRDEAGHHSSALFVQSVPFQPAGSSWEAELPGYIDRLLAICDRYAPGTSDLVADVFPLTPPGIEQHFGITGGHIHHLDNTVAFDRRMPYFTGVDGLYAGSAGTHPAGSVIGAAGHNAAVRLLQDLQ

SEQ ID NO: 12046 - protein, 196 aa, Actinoplanes utahensis
MAMPAPEQSFDILGKLNQPWTAQMAVDLLPEANGPKVEVFRGSVVVTPHARYDHQDVQLELAYRMKQAARKAGLWVYAEVNIVSGDDLFIPDLVVLRRSGGGKTTMPIAEAVLLGEIVSTGNRRKDVVDRPREYAAAGVPYFLRIDFRNRVPALVLHELADGEYQPVAAAAAGGTFEMREPFPFAVDPEELLGEQD

SEQ ID NO: 12047 - protein, 399 aa, Actinoplanes utahensis
MRELVLLGSTGSIGTQAIDIVRRNPELFRVVAIGAGGGNVALLAAQALELGVEVVGVARASVVQDLQLAFYAEAQKRGWSSGDFKLPKIVAGPDAMTELARWPCDVVLNGVVGSLGLAPTLAALESGRILALANKESLVAGGPLVRRIAKDGQIVPVDSEHSALAQCLRGGRAAEVRRLVLTASGGAFRGRRRAELTNVTPEEALKHPTWDMGPVVTINSATMVNKALEVIEAHELFGVPYDDIAVMVHPQSVLHSLVEFTDGSTLAQASPPDMRLPIALALAWPDRVPGAAAAVDWTLAHNWELRPLDDEAFPAVELAKAAGRYGRCRPAIFNAANEECVAAFAAGRLPFLGIVDTLERVLAAAPDFAEPSTVDDVLAAESWARAQAQRTIATVAEGA

SEQ ID NO: 12048 - protein, 430 aa, Actinoplanes utahensis
MLFWLGCAAFALTILISVSLHELGHMITGKRFGMKVTQYFVGFGPTIFSFKVGETEYGLKAIPLGGFCKIVGMTPQDDDVAPEDQHRAMWRFPVWKRTIVMSAGSITHFLLALAGAWFMAFFVGLPNIHLPQTRAEQRSWPAYIQVGDCLPVQTELKKLDAAAQKAAASAKCEPGVNGAIVAPAKAAGLQDLDRITKVGNTPVANYGQLTDAIRASTAGPTVFEYVRDGKPASTKVNLISDERAPIEDPKGKVTLVSVAGLDWDTDQPLVNHYTAAGAFRGSGEYSWYLVEGSFKAMAKIPQKIPALWHSITGDERDPDTPISVIGASRLGGEAIEKGVPEVFWQIFISLNVFIGLFNLLPLLPLDGGHIAIAWYERVRSWLYQRLRRPDPGRVDYYKLMPLTYAVILIGGAFTLLTATADIINPITIFK

SEQ ID NO: 12049 - protein, 390 aa, Actinoplanes utahensis
MTAISLGMPAVPPPPLAPRRQSRQINVGGVLVGGGAPVSVQSMTTTLTSDVNATLQQIAELTAAGCQIVRVAVPSQDDVEALPAIAKKSQIPVIADIHFQPKYVFAAIDAGCAAVRVNPGNIRQFDDKVKEIARAASDAGVPIRIGVNAGSLDKRLLEKYGKATAEALVESALWECSLFEEHGFRDIKISVKHNDPVVMIRAYRQLAEQCDYPLHLGVTEAGPAFQGTIKSAVAFGALLAEGIGDTIRVSLSAPPVEEIKVGQQILESLGLRERGLEIVSCPSCGRAQVDVYTLAEQVTAALDGFPVPLRVAVMGCVVNGPGEAREADLGVASGNGKGQIFVKGKVIKTVPEAVIVETLVEEALRLADEMGAELPDELRELLPGPTVTVH

SEQ ID NO: 12050 - protein, 292 aa, Actinoplanes utahensis
MRVKVCGSGNVVAVLTVPIRQLGEPERVSVERILDADPYAGAQIAERVATHGLNWWRSDGRIYGYEPAHRVESIIWSGAHLVPVGATAPAVAAFADLLSTEPRICSSIIGRAEAVLDLWDRLSVHWGRARDVRPHQPLLVTDRAPEVPADPEVRLVRPGEVDQLFPAAVAMYTEEVGVSPLQDDGGRGYRRRIAELVKGRRAYARFIGDQVIFKAELAIITRRTTQVQGVWVHPEYRGRGIATAAMAAVVDDALRRVAPTVSLYVNDYNTAARQVYHRCGFTSAGAFATVLF

SEQ ID NO: 12051 - protein, 206 aa, Actinoplanes utahensis
MRFMHEGHERHHGHGRRMRGFGFPPGFPFGPGGPGGFGPGGPFGPGGPGGDFGGRGGRRGGRGRVNVRPAVLALLLERPMHGYEMIQELDARTNGLWRPSPGSIYPTLQLLEDEGLIEATADGGRKSYRLTEDGRPEAETAAQNPPWARFGDDTLNQVQDFRDAAVGIFGALKQVGFSGTPEQRQKALEVLNETRRKLYAILADSE

SEQ ID NO: 12052 - protein, 240 aa, Actinoplanes utahensis
MTRSDNGRMIDASDLAAFAALLADRTRAAMCLALLDGRAWTAGELATHAGVARSTATEHLDRLIAGGLLTEARQGRHRYVRLADPAVAVLLEDLTARLQPGPPPVRTLRAATADAALRRGRTCYDHLAGRLGVTLTDALTSAGLLDQDTGFAITDSGLTWLRANADLTPADLLANRRPLARACLDWTERRPHLGGLAGARICRTFLAHGWLTRIGSGRAVRVTPTGRSALGRLLGVTEFD

SEQ ID NO: 12053 - protein, 324 aa, Actinoplanes utahensis
MRWGMTVPLGGVPLPDHAAVFTALADAGFTDAWSSEVAGTDAFTPLTLAAAWEPRLRLGTAIAPVYTRGPGLLAMTAAALAETAPGRFQLGIGASSPVVAGDWNAADFVQPFARSRDTLRFLRAALTGDLVDEAYPTFTVKRFRLERPPAVPPQILLAALRPQMLHLAAAEADGVILNWLSAADVHTALAETKEAGPDFAVAARIFVVPTTDAGYARTLGRRLITSYLTVPAYAAFHRWLGRAEILEPMWQAWAAGDRKGALAAIPDALVDELIVHGAPDEVRARVQAYAEAGITVPVMALLPTPELERGGFPALTELIAALGR

SEQ ID NO: 12054 - protein, 295 aa, Actinoplanes utahensis
MAVLSAAGAGIRHHRRWLVRDLDLVVEPGETVAVVGPPGSGRTSTLLALAGRLRLSAGTVSLGGTSSVGHVPGVNEPEPALTVLEHVHERLALLGRRRREATAVNLHGLEPDRRGRELTPYQRQVLGLVLALMAKPAVIALDDIESGLDAGERARLWELIGSLTAAGIAIVFTAREVDPAAVSQVVRVGHPESPQEPEAPKEPKEPEAPKEPEAPKEPEAPKEPEAPKEPEAPKEPKGPEAPEAPKEPEVPKKPETPKEPEEPESPEEPDEPVKAEEPETPETAGKPEEAERKAK

SEQ ID NO: 12055 - protein, 704 aa, Actinoplanes utahensis
MISLAGMEFRRFTRSKLTAAALAVLAVVPLLYGALYLYAFWDPYGHLSHIPAALVVEDQPAQDQKGNPVHVGQDLAQKLINRKVFDWHVVDAATADAGLKSGKYQIELRIPADFSGTLADAPNAKTDPENARLSAVSDDSTNYLSGVFARTAFDEVRAAVSAGASAKYYDQMLIGFTDLKEQTEKAADGADKITDGAGQLHGGAAKEAAGVDKAHAGAGQIAGKLTTAGQGADQLADGLRQLEAGAGQLASGTAQAAGGGRRLANAVDGVADRAEPILRANAGSIEHAATLVANGADLLAANVGAIDTAADRAVRDAKELRAYLDTVPSSAYAKHLADRLVADARRIQRKVHAADLAGLRAQLREVAKTARAVAAAAPHLADDVAKARSQVDQLANGLDRLATGAKQLKSGTAQAADGATRLRNGVYRLASGARQLDTGLAKLSDGGHKIADGLADLQNGAGELAGKLADGAGQIPSYDDAAKRSGILADPVSLDRAVRNPAGTYGVGFAPYFLALALWVGAMINYMLLRPLNRRYLVSGAPAPRVALAGLLPGVLMGIIQTIILYVVVHFRLGLSPVHPWLTLGLLAGTATVFAALMQLIGAALGAPGRIIALALLMLQLTSSGGTYPVQTSPGFFQGIHPLLPMTYVVDAVRHAVDGGETGPIVHGSLVLAGFGVVAYLLTVLVATRKRRMRVADLHPELVL

SEQ ID NO: 12056 - protein, 194 aa, Actinoplanes utahensis
MDGRSRRRGDTRQKLYEAAVELIAEKGFSETTVDDIALRANVAKGTVYYNFKSKTDLFEELLRHGVGLLTDEFRAAVVGLPPREAVRALVRAQLAYIKKYRAFAQLLVSEMWRTNREWQQTLILLREQAIGVIAESVQAGVDAGDLPADLDVRVASAALFGVGLVVAVDWLVFQPERPIEDVEASMLAIVRRVA

SEQ ID NO: 12057 - protein, 273 aa, Actinoplanes utahensis
MLRRWRDRVTPEVAGVPAGRRRRAAGLRREELATLAGISTDYLTRLEQGRATAPSAQVVESLARALRLPTPERDLLHQLAGHAAPGHDVVPTRITASVQRLLDRLAHTPVAVHDATWTLLVANAPYNALMGDTTTWHGRHRNAVWRSLAGTPTRVVYSPRERADHEARMVAELSLTASRYPADHTLRRLLHDLATEFPRFTELWESTTAPPPSDPAKRKIVDHPAAGRITLDCDTLLVATDDLRITVYTAEPATDDADRLALAIVLGIQPFTP

SEQ ID NO: 12058 - protein, 135 aa, Actinoplanes utahensis
MPSRISDDADLPAYTMGRAAELIGVTQAFLRSLDGTGLIEPERSAGGHRRYSRHQLALAGRVRILLDEGLPLTAAVRIVTLEDRLDAAHQRIRDLGGTLTAGEDASIPMQTRGAGPSRADEGGAGAGEMRARQDV

SEQ ID NO: 12059 - protein, 425 aa, Actinoplanes utahensis
MPSWNVEEWRRPGPTAQQRRNDLLTGLGATGLAVISLFLLRSTGYFESDRAPAIPEEVFWAVATTVPLVWRRRFPDAVAVVISVFFIAGQIRFSQEQMIVNYALFAAIYTLGAWGRNRQRARMIRLGIVAVMFAWLTLSFVLYHDAVSATMTDKGSGELSKLWSAIFISYLQNIVYFGFTYLMGNAAWRSVWRQHQLAEQAEELRAAQAAAAGRAVLDERVRIARELHDVVAHHVSVMGIQASACRRALDRDPARAVTALTAVEDGARTAVDELRRMLGALRATGPATRESPGAGLDRVEEIVERAREAGLQVDFGIFGTPVPLPDSLSQAAYRIVQESVTNTLKHAGASGLDIRIRYLAGELELDVADDGHGGGGRAGSGMGLIGMRERVAVHDGTLECGRRTGGGYRVRARLPYAPAAVESAA

SEQ ID NO: 12060 - protein, 219 aa, Actinoplanes utahensis
MSIRVLLADDHRLVRSGFRVILEMEDDITVVGEAADGATAVELALRLRPDVVLMDVEMPVMDGLEATRRIAAQSGPSVLILTTFDSDDYLFAALQAGASGFLLKNGTPEALTEAVRVLAAGDALLAPAVTRRVIAEFSAPRQRSPEPGVRLGELTPREHEVLVELAGGATNAEIAAALHLGETTVKTHVSRVLMKLGARDRTQAVVMAYEMGVVRPSRE

SEQ ID NO: 12061 - protein, 297 aa, Actinoplanes utahensis
MNPELSVDAVDRSFGERQVLKDVTFTVAAGRLTGFVGANGAGKTTTMRIILGVLAADAGTVSWRGEPVGREIRQRFGYMPEERGLYPKMSVLEQVVYLGRLHGLGAAEARRRTLALLERLELAERADDHVQKLSLGNQQRAQIAAALVHDPELLVLDEPFSGLDPIAVDTVVGVLRERAAAGAAVLFSSHQLDVVERLCDDLVIIADGTIRATGDRTGLREQYALPRYRIEVAGDAGWLRDQSGVTLIDLDGRHATFDLAVGLDDQVVLRAALDRGPVHAFGPVRPTLAEIFREVIQ

SEQ ID NO: 12062 - protein, 351 aa, Actinoplanes utahensis
MTTFEAAKLVAAREVRVKLRDKAFLFSTVLFLLIVVASIVLPTLLDGGATKVAVTDTATVATLQKSGFEVRVVADTPAAEALIRSGDVDAAVLPGPVVVAEQDRPDDVIAALSTEPQTRYLEHSDIAPALKILVPIAFAMLFFFTSFTFGMQIAQSVVEEKQTRIVEILVSSVPTRALLAGKVFALTVLAFAQVGLLALVAMIGMTATDAAPGLLNAMIPAIGWFLPFFVLGFVMLAALWAGVGALASRQEELASTTVPVQMLVLIPFFLALSVPHDGILMKILSYVPFSAPIAMPIRLFDGTAAGWEPIVAVVLLAATALGLLGVGARVYSRSLLRTQVRTPLMAALRRS

SEQ ID NO: 12063 - protein, 687 aa, Actinoplanes utahensis
MEMWLARNGRRSLLLSAVLVACAVAAAPAAPAAATPAAVPSGVLFDDFHYRDAGDPALAVHGWDVRTGAGGPGVAGTWSADAVSFPADDSARGGQAMRLRAGTDGTVGGTTQAQVNTVRSKFYSGTFAARVFLTDAPVSGADVDRPVQAFYAISPAADAHYSELDHEYLPNGGWGTTGPRHFTTAWHDPDPAVEDRVSTNQAGSLAGAWHTLVMTVENGTADFFVDDRKLLSTGSPYSPREPMMINFNEWFAESVAGAGATRSWDMKVNWVYYNRAGAQSPAQVAAAVDGYYASGTDFVDTVAAGTVAHDYNGDGISDISLLYDYGATQAAGCPVSPSRDTAMFDLSGRADRSGGLTGLATQWRGPCQPVLPRFTTSGDFTGDGRSDVAAFYDYGSAGTSCPGVDRVAVLVWPADPAGTGALLEPVTAWASSCFGSRTAFFEPGDFNGDGKSDLALLYDHGAGNLRMLTLSAKADGSGTFDGAVVRWEATDWGTGVKFVTAGDLNGDGKSDLALFYDYGTAGATCGGNSHQAVFVMTADGAGSGALSTPMKGWESTCFGGGTSSVKAGDFNGDGRSDLGLLYDYGAGHVKLLTIASGPGGLQGLAARWESTRWGTGTKFVTTGDYNGDGKSDVALLYDCGTAGATCTGAAHQIVYVLTADGYGTGGFPEVAKRWESTSFGAGTRFVS

SEQ ID NO: 12064 - protein, 510 aa, Actinoplanes utahensis
MSTEPAVSSSDEERLAQLGYKQELHRRLSGFSNFAVSFSIISILAGAITSYVIAMNAGGPFAITIGWLLVGGMVTLVAMAMAEVCSAYPTAGALYWWAAALAKRNKAAWAWFIGWFNFLGEVAVTAAIDFGAAITTAAFLSLTFDMAVTPGRTFLIFLVIIVAHGLLNTFGVNLVRVLSDVSAWWHLIGVAVIVVLLAVLPDHHKPVSEVFFEVKNATGFGFGAATVYAVLIGLLMAQYTYTGYDASAHVAEETHDAANAAPRGIVMSVVVSVIAGFVLLFAITWSIQDYDAEAATSLQLPPAQIFIDAAGHNVGTFLLFICMVAQWFCGMASVTANSRMSYAFARDGALPGSRLWKQVNPRTGTPTNSIWLCVTISTILVLPSLWNTTAYAAATSIAVIGLYIAYVGPVFLRRRNPDFRAGPWHLGKWSSLVGWISIVWVAIICVLFVLPTAGPITAKNFNYTIVAVAIVVGGATVWWFASARHWFTGPRSNLLEAAAHGEQTMPTAND

SEQ ID NO: 12065 - protein, 448 aa, Actinoplanes utahensis
MDLEDLDVAVGNGSIDTVLLALTDMQGRLQGKRLHGRYFIDEVAGAGSEGCNYLLAVDVDMNTVDGYEMSSWSTGYGDFVMRPDFGTLRRVPWQPGTALVLADLFDTAGQPVAPSPRQILRRQLDRLAAHGLTAYAGTELEFVLYRDSYEQAFDRHYRNLTPANQYNVDYSLLGTARVEPLLRRIRNEMYGAGLLPESAKGECNFGQHEIAFRYADALTAADNHVVYKNGAKEIAAQEGMALTFMAKPNEREGNSCHIHFSLRGRDDRSAMLGDGPAHLSVTGQRALAGLLATMREFSLLFAPNINSYKRYQPGSFAPTALRWGVDNRTCALRIAGHGQGMRVENRVPGGDVNPYLAIAALVAGAVHGIENELPLEDEFAGNAYRDDTAGRVPGTLREATELWAGSAVAESAFGADVVAHYANMGRVELAAFDAAVTDWELRRGFERL

SEQ ID NO: 12066 - protein, 465 aa, Actinoplanes utahensis
MDSNASKCEDLDVGTTDVINPADGRVFTTVPSLDLTGTDAAIERARKAFGSWRAVAPGDRARLLRRFATVVDDHLEELAQLEVRNAGHTIGNARWEAGNVRDVLHYYAGAPERLAGRQIPVAGGVDVTFHEPLGVVGIIVPWNFPMPIAGWGFAPALAAGNTVVLKPAELTPLTAIRLGELALEAGLPEGVFQVLPGKGSVVGQRFVTHPAVRKVCFTGSTAVGKSIMAGCAEQVKRVTLELGGKSANVIFADADLDKAAAAAPGAVFDNAGQDCCARSRLLVEASVYDRFLALLEPAVQKFRVLDPADEKSEMGPLISSGQRDVVASYVDGAEVAFRGSAAFTDGWWFPPTVLLASSAADRHWREEIFGPVVSVLPFRDEAEAIRLANDTEYGLSGSIWTRDVGRALRVSRAVETGALSVNSNSSVRYWTPFGGMKQSGLGRELGPDALLSFTDVKNVFLATGD

SEQ ID NO: 12067 - protein, 254 aa, Actinoplanes utahensis
MERLQDRVAVITGAGSGIGLATARRFAAEGAKVVAVDISQEAGKAVAQEVGGEFVACDVSDEGQVRALFDGVAERHGRVDIAFNNAGISPPDDDSILVTGLDAWERVLKVNTTSVFFCCKYAIPYMQRQGKGSIINTASFVALLGAATSQIAYTASKGGVLAMTRELGVQFAREGIRINALCPGPVATPLLMELFAKDPERAARRLVHVPMGRFAEPAEIAAAVAFLASDDASFMTASQFVVDGGITGAYVTPL

SEQ ID NO: 12068 - protein, 230 aa, Actinoplanes utahensis
MRPIIGITTYVMPASWGVWRDLPTALVPYDYAAAVTQAGGRAVLLPPDDMDAEVLRVLDGLLLAGGPDIDPALYGERPGPHTVTHPDRDAGELTLLRAALEADLPVLGVCRGMQLLVAAHGGSLHQHLPDVLGHERHRVAPGEYSEHDAVFVPGSRIAGLMGEDVTINCFHHQGVADAGKLTVTGRAEDGLPEAVEDPERRFLLGVQWHPEVSRDRRLFGALVTAAAERS

SEQ ID NO: 12069 - protein, 247 aa, Actinoplanes utahensis
MRRPLIGLTAYAQHVQYGRNELMAGMLPMTYVRAVHATGGRAVLITPDDPGTDVLESLDGIVFTGGADVDPAHYGAAPHPETEVDAVRDAAEIMLMRAVLDADLPVLGVCRGHQVMAVATGGSLHQHLPDLIGHDRHRGAVGTDPLAAGAGDYGRHDVVTADGSRAHDLFGRQTTVNSFHHQAVADPGEFVATGWCPDDRVVEILEHPGRSFAMGVQWHPERTTDLRVFAALTRAALISREIAAASV

SEQ ID NO: 12070 - protein, 233 aa, Actinoplanes utahensis
MGVLPARLRVAFERGGEMGRRMAELDWSASPAGDPARWPDELVGAVVTMLASRTQILIAWGPQHTVLYNDAYAAIAGGKHPAYLGRPGRDMWAETWDTVQRLIRRVHESDEAFYADDHPFLIERHGFLEQTYFDVSFDPIRSADGSVGGIMCIVAETTGRVLGERRVRILGALGRRLADLAVPAALAAEAVAALRVGSLDVPYAEVVLDAAGAHPAIRDVITTGRPGRVPLAS

SEQ ID NO: 12071 - protein, 516 aa, Actinoplanes utahensis
MAGARAVYAAADTDDVLAAPFATGQVTDRVRAGLEFGRVRRATVNGLRGLVDAAVALSSVTGIAEVLDVAARHVQAMTAAGRVVVCVPDARAERDGGAEADAEPDVLVPLPDTAGVQLGELRVWSGADGPVPPVVLTQLARLIGLRLANARLYETEHRIARTLQHSLLPQSLPRVPGAVVASRYVAGSSEARVGGDWYDVIADPDGGLCLVIGDVVGKGVQAAAAMGQLRNALRAYLLEGFDCGAALSRLNRLVDTLGRRQFATVFCLRFDPITRVARYSAAGHPSPIRVTGGELGSFLYRTALGPPIGALREVAYPAHEVRLALGDRLLLYTDGLVEDRRQGIDAGLAELTADVARPAEHIEDLLDTLLAKAARQVRRDDIALIALQVTEPTEFVMRLPADPTRLSVLRQRLEDFLTAHAVPDADQFDLTVAVSEAAANAIEHPVEPAEPVITVEASMQPDAIVVIVRDTGQWRPATDAGFRGRGLALIGALTELSVHRSPAGTAVTLRRPLTAA

SEQ ID NO: 12072 - protein, 104 aa, Actinoplanes utahensis
MDQEGQDPTFTATGAVDGDRVVVTVTGEVDMSTAGALFETATPERITGATIDLRAVTFFDSAAIHTLIRLAERYPETLEVIPSERVRRVLDISGLGGQPWLRSH

SEQ ID NO: 12073 - protein, 285 aa, Actinoplanes utahensis
MTVRAPLVPGKQSRERSVPATIVRPEYVGKKRPAPWHGSHVQTPETIERMRVAGRIAAQATQLAGEHCKPGVTTDEIDRVVHEFILDHGAYPSTLGYKGFPKSCCTSLNEVICHGIPDSTVLEDGDIINVDVTAYLNGVHGDTDATFCVGEVDEEARLLVERTHEAMMRGIRAVAPGRQINAIGRVIEAYARRFGYGVVRDFTGHGIGETFHSGLYVPHYDKPDLTVVMEPGMTFTIEPMITLGTHEYEIWADGWTVVTKDRRWTAQFEHTLVVTEDGVEILTLP

SEQ ID NO: 12074 - protein, 251 aa, Actinoplanes utahensis
MDRAVRAHAGGDRGRRRDPHPAVTPVIEHHHADVSGGWLRAATFGAMDGLVTNIALIAGVGGAQVSRHALILTGVAGLVAGAISMGIGEYTSVRTQNEQIAAELGKELHELRVNPDGEADELVAMWVARGLPAGLARQVADVLKRNPDQALRVHAQEELGVVPDELPSPWTAAGSSFVCFSVGAVIPLLTLLMGYDNLWAALAVGGLGLFAAGAVVSRLTLRAWWLGGLRQLVLGAVAAGLTYLIGSLIGV

SEQ ID NO: 12075 - protein, 262 aa, Actinoplanes utahensis
MAQVRPGHPADPDLSGSPGRLNDQNGVVLDEIDTTSPRGSLALRLCDAIQRRWPAEVLAIGVRGSVAHADDTETSDVNLIVVTYRPRTGPRPALRKVDGVPVDLAVLAADEAIAQARQLTPRWPLLADRYLTTMPLHDPRGCFRELREAHQNLLAEARPAEYAQLARHNWAIANGARQRAVRLTQWYDTDAALVLIAQARVNAALVAGFLTHTWFRNAADAVRRTGVAAADMQELGAILKYQAEELAARGRPVDGTLGALFD

SEQ ID NO: 12076 - protein, 142 aa, Actinoplanes utahensis
MKDELAAALAAEQAAIWAYGVIGVHLPPGAEQDQARAAEQEHRVRRDDLVEQLAGLQAGAAPTPAGYQLPFPVTDRAAALKLAVQIEDGVAQAWRPVLPVTENTQRTTALSALTASAIRATRWRKFAQVTPLTLIFPGRPGA

SEQ ID NO: 12077 - protein, 159 aa, Actinoplanes utahensis
MVLTDPVRIGDADPTRRRVLAAGGVLAGTVTLSGCGLFGDDPEPPKGPDPLQPVLDEAVTLAATYDRVILAQQSLSATLTPIAQAHRAHAAELARVIGVTAPGAAPGASIVDGTVAGLRRAELAAQKTAVAACQSAPAGRAALIGSIAAARATHAEALR

SEQ ID NO: 12078 - protein, 204 aa, Actinoplanes utahensis
MTQRGRAGARPGGRPSSRSDSRSAPALPRVDLTAARARLREVVEPVVAKAGYDLEDLTVSRAGRRFVVRVLIDADGGIGLDDVAVVSREISEALDAADERGGEVLAGEYQLEVGSPGVDRPLTEPRHWRRNAGRLVAVNGLTGRVLSTDDDGVTLDVDGAERRVAWADLGAGKVQIEFKRLDEAEFGDEDDADDEDEDEGEGEE

SEQ ID NO: 12079 - protein, 338 aa, Actinoplanes utahensis
MNIDLAALRALEREREIPFETILAAIETALLTAYRHTEGAESHARVEIDRRSGVASVLAQETDADGTVVREWDDTPHDFGRIAAMTAKQVILQRLREATDEQHFGEYAGRDGDLVTGVVQADAARAEKGIVIVDLGKLEAVLPQSEQVPGESYEHGSRIRCIVVHVAKGFRGPQITLSRSHPALVKKLFALEVPEIADGTVEIAAIARESGHRTKIAVRSTVQGVNAKGACIGPMGQRVRAVMSELHGEKIDIIDWSDDPAQFVGNALSPAKALRVEVVDAATRTARVTVPDFQLSLAIGREGQNARLAARLTGWRIDIRPDNEPATVADRDAAEAGN

SEQ ID NO: 12080 - protein, 128 aa, Actinoplanes utahensis
MRPRRGTDRIRGRRDRGVDLSSVGPTRTCVGCRKRAPAASLLRFVAVGSGEDLRLLPDPSRRLPGRGAHLHPDPACFEQAERRRAFGRALRLTGVADAGLLAEHIRTVSVPCGTTDDEAFSPRHDPAR

SEQ ID NO: 12081 - protein, 58 aa, Actinoplanes utahensis
MPGKARVHELAKELGVDSKTVLATLKDMGEFVKSASSTVEAPVARRLRGALEAGGALP

SEQ ID NO: 12082 - protein, 609 aa, Actinoplanes utahensis
MSSGAPRGQGQEIRLSRGASLSDFADKINANPGSLVQEMFNLGEMVTATQSVSDDTLLLLGEHLGFDVKIVSPEDEDRELLAQFNINLDAEVAEDRLVTRPPVVTVMGHVDHGKTKLLDAIRKTNVVAGEAGGITQHIGAYQVVVPHQGEERAITFIDTPGHEAFTAMRARGAQVTDIVILVVAADDGVMPQTVEALNHAKAAEVPIVVAVNKVDKPDANPDKVRQQLTDYGLLAEEYGGDTMFVNVAAKPGIGIDDLLEAILLTADASLELTAPIDGPAQGVAVEAHLDKGRGAVATVLVQKGTLRAGDSIVAGGAHGRVRAMLDENGQQVAEAGPARPVLVLGLTSVPSAGDTFLAAEDDRTVRQIAEQRQARRRAAAFANSGAKATLETLMAQLKEGEKTSLTLVIKGDSSGSVEALEDALFKIEIPDEIQLKVIHRGVGAITESDVNLASASSEQTATIIGFNVRASNKVKEMADRAGVEIRYYSVIYQAIEEIEAALKGLLKPEYEEVELGTAEIREVFRSSKIGLIAGCLVRSGLLRRNAKARILRDGTVVGENVTISSLKRFKDDATEVREGFECGLTLQGFGTPQIGDVIETYEMREKPRA

SEQ ID NO: 12083 - protein, 340 aa, Actinoplanes utahensis
MSRYAMLLAPSANRVYADQASRMSQAELAAFTPVLSSAPAEIGVTGIGGVEYVTFTAELTPRDVAHLSNLSSAYALFELVGDDLLRPVTLTPLARYDSDLITIPKYAGKTNEQFTKLVLNLTLLASASATKMLDGHLTVLDPLCGRGTTLNQALMYGYDAIGVEIDGKDVEAYKLFLQTWLKRKRLKHTADLVPMRRQGRRAARRLEVTMAASRDDHKAGAVQKLTVLHADTTALDGLIRGNVADVLVADLPYGVAHGSYDDAGGISRRPLDLLERAVPEWLPLLRAGGAVGLSWNTKVAKRELAEDILTAAGLEIVEHADLAHRVDQGIERDVLIARRR

SEQ ID NO: 12084 - protein, 97 aa, Actinoplanes utahensis
MYTETAVFDMLLPGDAQSLKQKRSYVRPIIAMLKKFEVSVAEVGFHDLHGRAQIGVAVVAPDPAQARAVIDTCEHQVAGRPEIELLSVKRRLYGDDD

SEQ ID NO: 12085 - protein, 169 aa, Actinoplanes utahensis
MTRGVTQSEVGEMSDPAKTRRHAERVRELVASLVREIKDPRLGMVTVTDARITGDLREATVFYTVLGDVTEQAATAAALESAKGMLRSRVGHALGLRHSPSLAFKLDNVQDNVKEIDDLLAAARHRDEEVQRLAAGKKYAGDPDPYKADEPAEDDEDETERVGAREDLG

SEQ ID NO: 12086 - protein, 338 aa, Actinoplanes utahensis
MTLPSGPAAEQWEAAVAAVRALGGDAAIQLICHVSPDGDALGSMLGFALALRRLGHTRVRATFPGEFRVPTPYTRLPGIEMLVPEPEAYHDPELFLVFDVAAESRLGGLAARVAAAPVSVVLDHHASNPGFGTIRLIDPCAAATSVLAEELVTRLGVPLDAEIAECFYVALATDTGSFRFEATTVAVHELAARLIATGLRPGEISRRIFDTRPFGAVKLAGEVLGRAVLEPSAAGGRGLVWTYATLADLDRHEQPPYVLDTLIDPVRSVAEADVTLLVKQVAENEWAVSLRSKGAVDVSRLAISQGGGGHRLAAGFTGYGGPGDVVDTVRRLLDEFLD

SEQ ID NO: 12087 - protein, 437 aa, Actinoplanes utahensis
MSPPAQHRTGSRQIASLALPALVVLAAEPLYVLVDTAVVGHLGRAPLSAVAVGGTVMSVAVWFGTLMAYGTTGRAARRFGAGDRPAAVAEGVQASWMALGFGLVLSILGVTLAGPVTHALAGNPATADAAAGWLRIAALGVPGLLLAAAGNGWMRGVQDTRRPLIIVLGANVLSAVLCPLLVFPLGLGLTGSAIANVTAQSVGGGLFLLALIRETRHLRPIPAVIIKQVVLGRDLLIRGAAFQACFLSATAVASRFGVAAVGAHQIALQLWFFAALALDAVAIAAQSLVGAALGAGDADQARDIARRVTIAGGIAAVGFAVLAGAGSSVIPGWFTRDPSVLSQAAIVWPWFVALLPFAGIVYALDGVLIGAGDVAYLRLTTMLAALLGFLPMIWLAYAFDLGLGGVWAGLGLFIVARLIATVSRWRSSRWAVIGATR

SEQ ID NO: 12088 - protein, 293 aa, Actinoplanes utahensis
MDGLIVVDKPSGMTSHDVVARIRRLAKTRRVGHGGTLDPMATGVLIIGVNRATRLLTYVIGAEKSYAATIRLGEATVTDDAEGEVTATVPVAGVADAAIRAGLAAQVGEIDQVPSAVSAIKINGERAYKRVRDGETVAIPARRVTVFRLDVLDIRRPADRDVIDVDVDVTCSSGTYIRAIARDLGTALGVGGHLTALRRTAVGAMTLAAASTLEELAERAPDVVGLPMAEAARRAFPQRVADEEETRTLRHGGPLAAVGIEGPYAVFDADGEVLAIVSERGGRARAEIVLSPA

SEQ ID NO: 12089 - protein, 130 aa, Actinoplanes utahensis
MSHRILLVEDEELNRMLVKAVLSRAGVDAVRDAELVDATTLTEARARVHDTELDLILLDLNLPDGNGLTLARELKSAPPADRPKPVVVAVTASVLPQDQKAALDAGCDDFLDKPYAAADLVATVARNLRL

SEQ ID NO: 12090 - protein, 917 aa, Actinoplanes utahensis
MSVEWSRLVLLAAELTFAVLFLRALGGYLRHRDPLRRDVALVFAPCTLAFCADLLRQSLATRPALAGGFTAVALMAQPVLTLRLAGRLRRVPPALTTAALLGFLALAGPLAVAHRPVPVPLKVAASTYFLSVEFIAAALLYDTARCRTGANRARLTIAAAATTAFGVMIMLLGASGGHVSGVRTASHVLALISGLGYLIAFAPPAWLRGLFAAAAAHSVTERLLRAPAESPEAVWQTYAEIMRVQTGADAVAVLLPRPDGQLWQIGYAGPPLDVPDEPIRAALGRPGPLRDGDPALLRHFGAGLADDFVTALRMPVPPDIEGWVLLFNRYRGLFNDDDLGLLAELGGHAGLLAERSAVTVRERRLTAELTNSVEALTRANEAKSNFLANMSHELRTPLNAIIGFSDLMRLEEPEGDRRRVPADWVDHIHGSGRHLLGLINDILDLAKVEAGRMDLRVAPVRVDTAIEELLTGLSPLFADKRLTVMTELAPVTALADRLRLRQILENLFSNAIKFTPAEGMVTITTGESGEQVTITVADTGVGIADTDAERVFEEFQQVGDPERRQAGTGLGLALTRRLVEAQRGEITLSSTPGQGSSFTVRLPAAPVTRPSATGAANAPCVLLIEDDPHSAELMQTQLSNAGYRVEVAGTGESGLAVARAHKPDAIVLDVELPGISGWEVIRRLKADAALAVVPVFFASILDEAAAGLALGAHDYFIKPVDQPALLNALANAIAARPAPRVLVVDHDDAVRQAIEDGLRAGGADVVSCADGRDGLARSRAENFDLIVCDMQSPSADGFSLLAAIEQDPSGRHTPVLGLSAAALAERAPGDTAPLIATAMAGGVVAEAMAGGAGWDSLAPLLGHHPGTAHPAIPHHPASIHPAVPAHPAARRTAGGAHPPAGAVPLRSAVPSSGKDRR

SEQ ID NO: 12091 - protein, 310 aa, Actinoplanes utahensis
MQRWRGLESVPGGWGRSVVTIGVFDGVHRGHQAIIGHAVKRARDMGLQSVVMTFDPHPSEVVRPGSHPAVLTESVRKAELIERLGVDALCVVPFTREFSQLGPDAFVHDVLVGALHAADVVVGDNFRFGHRAAGDVALLESLGRTFGFTVEEAPLVSADGVVFSSTYIRSCVDAGDVRAAAAALGRPHRLAGVVVRGDQRGRELGFPTANLMTHRYAAVPADGVYAAWLTRAGENAGRWPASVSIGTNPTFEGRERRVEAYALGFSGDLYGERVSLDFVEHLREQRKYDAIEPLVAQIRADVEETRVLLR

SEQ ID NO: 12092 - protein, 99 aa, Actinoplanes utahensis
MNRQHRSTEIMALDQDTKNKIMTEYATKEGDTGSPEVQVAMLTKRIADLTEHLKLHKHDHHSRRGLLLLVGQRRRLLNYVQKKDIARYRTLIERLGLRR

SEQ ID NO: 12093 - protein, 775 aa, Actinoplanes utahensis
MTEQTALGTESRTAVIDNGSFGTREIVFSTGRLAKQAAGSVIVQLGDTTVLSATTASKAPKEHFDFFPLTVDVEERMYAAGRIPGSFFRREGRPSEDAILTCRLIDRPLRPSFTKGLRNEVQVVETILALDPSHPYDVVAMNAASMSTKLSGLPFSGPVGSTRVAHIDGQWVAFPTIEELERATFDMVVAGRVTAEGDVAIMMVEAEATPQAVKLIAAGATAPTEEVVASGLEAAKPAIRELCRAQSELADVAAKPVAEFPVFLDYQDDVYAAVSDAVRGETAEALKIAAKQEREEALDLVKAKAHELLDERFEGREKEISAAFRSVTKAEVRQRVLREQVRIDGRGPRDIRPLTAQIGVLPRVHGSALFERGETQILGVTTLNMLRMEQALDTLAPEKTKRYMHNYNFPPYSTGETGRVGSPKRREIGHGALAERALVPVLPSREEFPYAIRQVSEALGSNGSTSMGSVCASTLALLAAGVPLKAPVAGIAMGLISDEVDGKTQYIALTDILGAEDAFGDMDFKVAGTSEFVTALQLDTKLDGIPSDVLAGALQQAHEARATILGVMNAAIESPAAMSEHAPRVTTVKIPVDKIGMVIGPKGQTINAIQDETGADISIEDDGTIYVGATNGPAAEAAVERINAIANPTLPKMGDKFLGTVVKTAAFGAFISLLPGRDGLLHISKVGDGKRVDKVEDFLNVGDRVEVQIADIDARGKIYLDKVRPEGEEAPAAAAAAAADAPSSEGRPERAPRENREGGGEPRRRRSRPAGERRD

SEQ ID NO: 12094 - protein, 443 aa, Actinoplanes utahensis
MTSSDRGPAGRPARVSTRTLQDGVKKTVLPSGLRVITEAIPTTRSAALGVWVGIGSRDETPAMSGASHFLEHLLFKGTHKRTALQISAEIEAVGGETNAFTTKEYTCYYARVLDTDLPLAVDVLVDAVADSILDPADVETERGVILEEIAMHEDEPGDEVHDVFTEAIYGTHPLGRLISGTPESVTPMTRNQINSFYRKRYRAPEIVVAAAGNLDHATVVRLVRKALAGSPLDTGPAEPAPPRPDGTRVRVQKPHTVVVHRDTEQAHIVLGAPGLSRYDDRRFALGVLNNVLGGGMSSRLFQEIREKRGLAYSVYSYASQYADTGVFGVYAGCAPGKAPEVLDLIRTELARVAAGGITAEELVRGKGMVKGSYVLGLEDTGSRMSRLAKSELLHGDLMGVDDLLARVDGVSIADVGEVAGALLSREHSLAVVGPFDEGDFPPG

SEQ ID NO: 12095 - protein, 252 aa, Actinoplanes utahensis
MTDVLEPIRVGVLGARGRMGLEVCKAVDGAPDLDLVALVDHDDTLQAAAEAGAQVLVDFTNPGVVMDNLRWAVEQGIHVVVGTSGFTEERLAQVRGWLAGRPEVGVVIAPNFGIGAILMMQFAARAARYFDSVEIIEQHHPRKLDAPSGTATHTARLIAEARKAANCPPMPDATEDEVDGARGADIDGVRIHSVRAAGLVAHQEVLFGQAGETLTIRHDSLDRSSFMPGVLLAVRAVVDRPGLTLGLDELVS

SEQ ID NO: 12096 - protein, 111 aa, Actinoplanes utahensis
MKKECMAQPDDMLNDDDYPAYTMGRAADIVGASQDFLRRLDEAKLIIPFRSAGGHRRYSRHQLRLAARAREMVDRGTALEAACRIIILEDQLKEALQHRRDHERRQQAGAA

SEQ ID NO: 12097 - protein, 67 aa, Actinoplanes utahensis
MATGIVKWFNADKGFGFITPDGGGADVFAHFSAIATSGFRSLDENQKVEFDITQGQKGPQAENIRPL

SEQ ID NO: 12098 - protein, 184 aa, Actinoplanes utahensis
MALGFVRPARPEDAGEIARIQLVTWRSAYRRMFPAHVLAQLDEAVLAGVWTEAITTPPTGRHRVLIAVEQGEHDHVVGFAAAGPADEQALAPEEPPLPDTVAAVTDLLVEPRWGRRGHGSRLLAAAVDLWREDAFSSAVAWVYDSDTAMRKFLDSAGWAPDGAGRALDVDDMLVPQLRLHVALT

SEQ ID NO: 12099 - protein, 180 aa, Actinoplanes utahensis
MTPSTNPATPAGSTVTSVRPQTDADIEAAAAVHVRSTRASYAGLLPAEHLAALDPAVFAQRRRAMAAKPEVHTLVAERDGRIVGFSSFGPDREDPALAELYAIYADPDSWGTDAGWRLFDESRRVLAEAGYPEVRLWVLAANERARRFYERAGMTTDGVPATHRAAAGIELPKLRYRGPL

SEQ ID NO: 12100 - protein, 405 aa, Actinoplanes utahensis
MTSLETISVAQARRITLAAQGFTDPKPGGATDLRHLRRVLRRLHLIQMDSVNVLQRAHFMPLYSRLGPYPADLLERAAYQRPRELFEFWGHEASLIRADLQPLFRWRMARAGESAWGTMRRIVAEQPDLVAWVLDEVRRRGPITANEIEHDAPRRKDHWGWNWSVVKQALEWLFWSGQVTAAERTTSFARRYDLPERVLPGAVLAAPTPEPAEAFRALVELSARALGVAAEPELRDYFRLPTAAARTALAELVEAGVLRPVTVRGWKPVAYLHRDAKLPRRVDVATLVSPFDPLIWQRDRTERLFDMTYRIEIYVPKPQRRYGYYVLPFLSGDRFAARVDLKANRQAGVLEVPAAWLEPSADRDATAGALAAELRRLALWLGLDAVAAPVAGDFADPLTAALKEL

SEQ ID NO: 12101 - protein, 184 aa, Actinoplanes utahensis
MALMSTVLPPWLEAQPLQGPPVPPGWPAYRHDAGPPPDRITRFFDRLAARSPMWLAPLVVLACMGGAVGYTLLTDPVHAEAGAEPTCLLKYTTGFVCPGCGGTRAAWYLLHGNLPAAARHHAIFVFAVPFLLYMYVAWAGQRLFRWRIRQLTVSPAVMITFMAVWVVWSVLRNLPWAPFTAFYV

SEQ ID NO: 12102 - protein, 297 aa, Actinoplanes utahensis
MTHDPRPFGRLLTAMVTPFTPDGSLDLEGAARLAVHLVDEQRNDALVVSGTTGESPTTTDAEKDALLRAVVEAVGDRARVVAGVGTNNTAHTIELAHAAEKAGAHGLLVVTPYYNKPPQAGVLRHFTAVADAAGLPIMAYDIPHRAGTAIATETLVRMAEHERIVAVKDAKGDLIASSWVLSRTDLAFYSGDDAATLPLLSIGGVGLVGTSSHFTGVLAKEMIEAYEKGDTATALARHRAALPLFTGIFRSPGTILVKAGLNASGLPAGPVRSPLVDASDEELIQLRQDAAAAGIVL

SEQ ID NO: 12103 - protein, 562 aa, Actinoplanes utahensis
MSHAHVELGPPPPLPEGALRVIPLGGLGAIGRNMTVLEFDGKLLVIDCGVLFPDVEQPGVDLILPDFGPILDRLEDIQAIVLTHGHEDHIGAVPYLLAHKPDIPLVGSEFTLALVEAKLAERRLDPYTLTVREGGIERLGPFECEFFAVNHSIPDALAVAVRTPAGLLLHTGDFKMDQVPLDGRITDLAGFARLGGEGIDLLLSDSTNAEVPGFVAPERDIGPVLSRIFGKAKGRIIVASFASHVHRVQQVMDAAWEYDRKVALIGRSMVRNMGIARDLGLLRIPDGLLVGLDEATHLPPDEIVFMSTGSQGEPMSALGRMSTGDHRHITITSGDTVVLASSLVPGNETSVYRVINQLSRAGATVVHKETAKVHVSGHAPAGELLYLLNVTRPSNLMPVHGEWRHLRAHAQLGIESGVAADRVVLCEDGDVVDLVEGHARVVGRVRSRYVYVDGLAVGDVSESLLTERRILGDGGFIAATVVIDSVTGKVVGEPSISAKGFSEDPDAFNPVIPLLTAALHRSAEDGITDTHQLQQVVRRTVGRWVNDAYRRRPMIVPTVVEV

SEQ ID NO: 12104 - protein, 526 aa, Actinoplanes utahensis
MQRRSIAVAAAVVAATAAAVAFTLPSLAGTTPTGGSGATKASGGVSPELLAAMKRDLGLDANQAATRLKRSKWAGGVTATLAATTGDSYGGAWLASDGTTLKVAVTDAAAARKVKAAGAVPVLVKRSEAQLDAAKGRLDAQVKSAAGLTGWYVDAPTNKLVVVARPGQKAAAQALAKRAGVATDAVTVQVSNRLPKPLFDVRGADPYFISLDGGTARCSIGFSVEGGFVTAGHCGTPGTKTSGFNNQAQGVVKASVFPGNADMGFVEVNGQWTPRPVVNDFKGNELPVGGSTEAPIGAAICRSGSTTGTHCGTILAKNQTVRYPEGSVTGLTRTDVCAEGGDSGGPWLSGDQAQGVTSGGSGDCTAGGETFFQPVNEILAANNLKLLTTGGGDGGGATAAPSDSATAAPSEAPSEAPGGNGDGTANACAGLAVQRQGSLSKAGTAQAQPDGGAFRARAGRHVACLSAPAGSTFDLVLQRLQNGRFKTVAKAAADGTLSVSERSGTFRYVVVATSGTGDYTLGFNVQ

SEQ ID NO: 12105 - protein, 138 aa, Actinoplanes utahensis
MQSLDNEMIKAALDARGFAYFVDADGDIAGNFQGNLIYFFRLGANKEMLQIRAMMQHVFTVEDVPRLYEFCNTWNRDQLWPKAYVQVTDDGAAVVVGEVSTDWERGVTPEQLDQVLLCGIATGCRLGDALGEWRNGQS

SEQ ID NO: 12106 - protein, 840 aa, Actinoplanes utahensis
MDVAGRATVSPMAGRTPPASRGRAASTPRGAATSRARQPARQPAKKAAAPRKRTAATAKRAAPPPMVGPAVGRGISAVWMGLATSVGWVARGAGRNARNIGPEHRRDGAGLLLLGFSILTAVAVWGRGAGPVGQRLADAVHLFFGGLGVLLPLLFFYGAIRLMRQPADPEHRGRNPVGWSAIIIAIASLLYISGPKGDDVALTGNGGLLGYGVGSVLERAVSVWVAVPLLILLFVFGLLVITATPINRIPERFVLLGELVTGRNRPVLEDDVEDDPVAEDEEARPARARRRKPSPVVPLDEMLEPEEPDEDLILHDTVVLPKVPATRRKPPPPDHSPAPVKVEQLEISAVDSGDYQRPPVSLLAEGAPAKARSRANDEIMAALTGVFEQFNVDAVVTGFTRGPTVTRYEVEIGPGTKVERITQLSRNIAYAVKSPDVRILSPIPGKSAVGVEIPNTDPENVSLGDVLRSPLAQRDHHPMVVALGKDIEGGFVTANLAKMPHILIAGATGAGKSSCLNSLLVSLLTRATPDQVRLLLVDPKRVEMTAYEGIPHLVTPIVTNPKKAADALEWVVREMDMRYDDLAANGVRHIDDFNRKVRNGEITAPPGSERVIKPYPYLLVIVDELADLMMVAPRDVEDSVVRITQLARAAGIHLVLATQRPSVDVVTGLIKANVPSRLAFATSSLADSRVILDQPGAEKLLGRGDGLFLPMGASKPTRIQGAWVDEKEIAAVVKFCKDQREPEFQEGVTDAPPTKKREIDEEIGDDLQLLIQAIELVVTSQFGSTSMLQRKLRVGFAKAGRLMDLMETRGIVGPSEGSKARDVLIKPDELEESLAALKVD

SEQ ID NO: 12107 - protein, 157 aa, Actinoplanes utahensis
MSAFHLAQINTARLRAPLADPSMAEFVAGLTLMNELADRSPGFVWRLIGDDGDGTIATDADPGRIYTMSVWETPAHLRAYAYQSDHLDYLRRRREWFHPHGPDAALVLWWLPAGDLPTLQQGLDRLDRLRADGSTPEAFTFRAPFPAPVLSETTHGR

SEQ ID NO: 12108 - protein, 219 aa, Actinoplanes utahensis
MTTSEDLGDLDAVTSLADGVRRQAYRTVAASRAPVGRDEVAEALGVGRTLAAFHLDKLVAAGLLETSYARRSGRTGPGAGRPAKLYRVATAEHVVSVPPRAYRTAAELLAEALEETGAEETLNRVARRHGERAAAAEGDVFEVLAGHGYGPVADGPERIELRNCPFHRLAEQFPPVICGMNLAMVDGLLTGAGLDAGWQARMDAAPGRCCVALCKKQTD

SEQ ID NO: 12109 - protein, 486 aa, Actinoplanes utahensis
MSVTPPPSRRVALLTLGCARNEVDSEELAARLDAEGWEVGTDAAKADVVLVNTCGFVEKAKQDSIDTLLAAADTGAKVVAAGCMAERYGRELAENLPEADAVLGFDDYTDIATRLNGVLAGEKFDAHTPRDRRELLPITPVQRHAAKVVVPGHATVDEHTPAHLRKVLRRRLDNSPVASLKLASGCDRRCAFCAIPAFRGAFVSRDPQELLAEAEWLARTGVRELVLVSENSTSYGKDLGDPRLLEKLLPQLAAVDGIVRVRASYLQPAETRPGLVEAIAGTPGVAAYYDLSFQHSSEPVLRRMRRFGSTERFLELLDSARRLAPEAGARSNFIVGFPGETRQDVDELVRFLTEARLDAIGIFDYSDEDGTEAAGLPGKVRPETVKRRYDRVVALAEELCAQRAEDRLGSIVEVLVDTIDDGEIEGRAEHQAPEVDGSTTLVAGDQGVDLAALRPGDLVRARVTGTEGVDLIAVPTEMISAAQADR

SEQ ID NO: 12110 - protein, 154 aa, Actinoplanes utahensis
MTDHDWRVGACLAFCVASATDFVDGWIARRWHLVTSFGKIADPIADKALTGTALVLLSAYDVLPWWITVLILAREWGVTALRFWVIRYGVIPASRGGKLKTGLQTLAIVWYLWPVPAPFDVVGPWVMYAALLVTVATGFDYVVQALRLRRTAGV

SEQ ID NO: 12111 - protein, 163 aa, Actinoplanes utahensis
MEMPVAAAAAVHMLVERRQTLATAESLTGGLVAATIVEIPGVSAVYRGGLVVYATELKGTLAGVPAALLAERGPVDPDVAGRLAEGARDRCGADWGLATTGVAGPEPQDGKPVGLVYVAVAGPPGTRVRELNLTGNRAAVRTESVTAVLQLLTDVLRAAPASV

SEQ ID NO: 12112 - protein, 132 aa, Actinoplanes utahensis
MVLLRRVIGDALRARRQGQHRTLREVSTAANVSLGYLSEIERGQKEASSELLAAICDALGARLSELLSEVSSTLSLAENMEGVLVPVDDKPGEPARQVATDGSVSVSVRQESPLKATLHATRNKKRDVVYAA

SEQ ID NO: 12113 - protein, 309 aa, Actinoplanes utahensis
MVSRRLPGRDATDRATLRGYREMANPFVKGWHYMMALFGAKIDEYADPKVQIQQAIEDAQRQHQALVQQAAAVIGNQRQLEMKLSRQMSEVEKLQGMARQALVLADRARAAGDEAEAQKYEQTAQTLATQLVSGEQSMEDLKTLHDQALGAAGQARKAVENNAMVLQQRIAERSRLLSQLEQAKMQETVAKSLESMSQLAAPGNTPSLDQVRDKIEQRYASAMGRAELASNSVEGRMLEVQKSSLDLAGSSRLEQIRASMAGDKLGGAAAQPAVGGQQNATPADAAGVARLDEIRASMNQKRGDTTAAG

SEQ ID NO: 12114 - protein, 265 aa, Actinoplanes utahensis
MDERSRYFRRLKKLRGSARRWSVLGGGLTAAAMVLVPYAGIGIADAAWAAGAGASVVLARWRWRDYRELSAQPAPEPALPGPRFTAALERTQVGRTVLHEVRRQKNRYAMRGSAIADAWDRLDRASTTMVGLAGRLTGPGETAALEAATAEHWLRDLGQRVASVERAIPLGQPAQRAALEQSHAALAEQFVEGVTAFEELVAAAASYVAEDGHPVADTRHPAYFGLVDAAERLRGIAEGLAELRDRTARFSSPGPAPAGSGGTSM

SEQ ID NO: 12115 - protein, 314 aa, Actinoplanes utahensis
MPEGDTVWNTARVVERALTGEVLTGCDFRVPRLAATDLTGWTVAESASRGKHLLLRLTREGHDPHTLHSHLRMEGAWRTYAPGERWTGRPAHLIRVVLRTARSVAVGYHLHDLSLIRTADEDSLVGHLGPDLLGADWDPAEASRRIAARPEVPIAEALLDQRNLAGVGNLYKAETLFLRGLWPWTRVADVADLTGTVVLAQRLVASNRGRWTQTTTGSLRRGETSYVYGRRAQPCRRCGAAIQKLESGRPVQKLESGRPVQKVESGRPLQQAGTQRAESSPIRITSGRIGTKAELEDRITYWCPRCQPEPARAN

SEQ ID NO: 12116 - protein, 308 aa, Actinoplanes utahensis
MRLVIFTEPQQGASHDDLLRVAKAAEDGGFDGFFRSDHYVKMGDVSGAPGPSDAWITLAALAVQTSRIRLGTLVSSATFRLPGPLAIAVAQVDAMSGGRIEFGLGGGWFDTEHQAYGIPFPPLGERFDRLDEQLQVITGLWGTPAGETFSFDGKHYRLTDSPALPKPVQSPLPVIVGGHGKKRTPDLAARFAAEFNVPFSKIDELPAHFDRVRAASAAIGRAEPPAFSAAAVLCAGRDDTELRRRAAAIGREVEEMRESGGVVGTPGEVVETIKRYAEAGASRLFLQVLDLSDIEHIELVASEVLPHI

SEQ ID NO: 12117 - protein, 1655 aa, Actinoplanes utahensis
MVGVREVLENFGPATRAWFTAAFAAPTAAQDGAWRAIGAGRHALVVAPTGSGKTLAAFLWSLDRLAREPVPEQVRRRCRVLYVSPLKALAVDVERNLRAPLTGIRQAAGRLGLPPPEITVGMRTGDTPADERRGFARTPPDILITTPESLFLLLTSAARESLRGVETVIIDEVHAVAATKRGAHLALSLERLDALLDRPAQRIGLSATVRPIEETARFLGGPQHVEIVRPPSTKTIDVTVQVPVEDMTRLDESPAGDDLDGGRHTPSIWPAVEERVLDLIEGHRSTIVFTNSRRGAERLCARLNELSAERVELARLGEQAAEHGEVPWRGGSGDPVGPPGAAPQARLDGPTAGAKAGLDELGAGPPAGLDELGTGLPAGLDELGTGLPAGLDELGTGLPAGLDELGAGPSADSLGSGMPMGRGGGRFRRTGKATSGTGNGPAPGGRPGGKPAGFRGNGAAGMPAAVMAQAGATLGAAPVVARAHHGSVSREERKQIEEALKSGRLPAVVATSSLELGIDMGAVDLVVQIEAPPTVAAGLQRIGRAGHQVGAVSRGVVFPKHRGDLLSCAVVAERMSEGAIEELRYPRNPLDVLAQQIVAMVALDAWPVDELAALIRRAAPFAELPESALHAVLDMLSGRYPSTAFAELRPRLVWDRGTDLLTGRPGAQRLAVTSGGTIPDRGMFGVFLAGSEKASRVGELDEEMVYESRVGDVFLLGSTSWRIEDITPDRVLVSPAPGAPARMPFWKGDSPGRPIELGRAIGARLRALVKAGDERATTALRESGLDEWAAGNLVNYLREQRESTRHLPDDRTIVVERFRDELGDWRMTVHCVLGARVNAPWALAIGRRLGERFGVDGQVMPSDDGIVIRLPDTAEEPPGADLVAFDPEEILQIVEESVGTSALFASRFRECAARSLLLPRRDPRRRQPLWQQRQRSAQLLDVAREFADFPVTLEAARECLQDVFDVPGLTGLMREIAGRKVRLVETETPRPSPFARSLLFGYVGAFLYEGDAPLAERRAAALALDATLLGELLGRVDLRELLDPGVVTETEAQLQWRTTQRSPRDAEDAAELLRLLGDLSPAELAERGVPEDWVVSLESARRAIRVRVAGEERWIGVDDAGRYRDALGVALPVGLAEAYLEPVADPLGDLVARYARTHGPFLAATCAARFGLGVFVVEQALKRLSATGRVTSGEFSPDGAGTEWCDAEVLRMLRRRSLAALRREIEPVPPKVLAAFLPRWHQVGGNARGVDALAAVIEQVQGLAVPASAWERLVLPARIADYAPPQLDELCGSGEVLWAGSGSIAGGDGWVTLAYADSAPLLLPPPDEEFALTPAHQAVLDALGDGQALFFRSLSDRAGSTDDTDLAAVVWDLVWAGHLTNDTFAPLRALLGGSGAHRAKAAPARSRYRRPGRPHLPSRTGPLNMAGRWSRLPDRDPDPTRRAAALADLLLERHGVVTRGAVMAEGVTGGFAAVYPVLSALEERGAARRGYFVEGLGAAQFAVPGAVDRLRALAEPAELAKRTGAGGLVLAASDPANPYGAALPWPERIVDSGDGEPVAKAGHRAGRKAGALVVLVGGELVLYVERGGRTLLSFADDPEALTAAGQALAASVRSGALGAMSVERADGESVHASPLREALTAAGFRATPRGLRLRG

SEQ ID NO: 12118 - protein, 768 aa, Actinoplanes utahensis
MAVRQMLVAGRYRLLEPVGAGGMGRVWLARDQMLDRDVAIKEIVPPDWMSEAEKDRLHSRTLREARSAARLTHPHVVRVYDVLHDDGVSWIVMEYVASRSLYQVLITQGPYSPVEAARIGLAVLDALNAAHRAGVLHRDVKPHNVLIGLDGRVLLTDFGLATFVDDGMVTTPGLIVGSPQYVSPERARDGASTVAADMWSFGATLYATVEGQSPYARDSAMATLAALATEPPNPPLRAGPIGPILEGLLRYAPEDRLSADETERRLRAVLGETGPAAAARPATVVAPVTRMVAEDSPTVAAVAPPSEAKTDSDRTEVVPVATGELVRTADLAGTGLVLEGESGPAEFPEEDEADHDDDAEDSDGWWQSGRGYIDGTFTVTDDLDAGSVPAAAGHSHYGAGRWTDGGNRAPSSSGVPRAHHNRQPSAAGRPAATRLLRRGNQATVRGIPSPRSPVSGPLPDTGVPPGRWALHPLPAKRISTRAVLAGLLAVALISGSLLSVHLMQRDDSAPQMVHSPMPAPSGMSSSGMSPSDMSPSDMSPSGMSSSGMPASGMSPSSRASAPEAGASQPRASPTGSVSPVTAGFSPIVCDAPAPHHAPVAPQAGAGRGVDGWRLQAGWSYFTDGTGFHLPVPDGWTYQRIGSTYCFREPRGGRVLSLDVGRPAATAPLQGCRAEDRRLRASRQVRDYRAMSLAPVVLLHAAVDWEFRYRTSGGVLRRARTRWLSMGGRAYALGWATPEAAWAAELGKLEMVWSTFYTDGGTPASASRG

SEQ ID NO: 12119 - protein, 217 aa, Actinoplanes utahensis
MLGITDFWTYVLGVVAIILLPGPNSIFVLSVGARRGVRAGYQAACGVFLGDTVLMVLSATGVSSLLGAYPPLFLVLKYAGAGYLAWVGAGILRGARARWRGRGEVSATEATEEPAEMQRPFRRAAVISLLNPKAILFFVSFFIQFVQPGYPHPALSFLVLGAVVQFFSALYLTALIFGGRFLVGQFQRRRRLAAGAATGVGALFVGFSIKLATASLS

SEQ ID NO: 12120 - protein, 479 aa, Actinoplanes utahensis
MQRGGEHPHRREGGAELPVAAHDAGLDAGRNLGGGPTTDLILFCHTDDSVLVQRRKQAVSPSREVLMTEVYATTDRTTATRTRQRMHYERDRAHAILDEAYDCSVAFVADGEPRVLPTLHVRVGETLYLHGSTGARLALGARGDGVPVCVSVTLLDGLVYGRSHFHHSANYRSVIAHGVARPVADPAEKAAAMHALVEKVGAGRAAGSRPPTDREMAQTSVLALPLAEVSARVREGGVVDEPADLDLPHWAGVLPIRRVAGPPESDAGVAVPPPAYLPGNPATEWQTPALMQGRLVRLEPLSPAHAAGLFEALDDEEVWRHIPQQRASSVADMAEDVAEVIRGQWRGDRAGWAQVDPVTGVVMGMTTYHDVDPDRRSVGIGHTMLGRRWWRTGVNTEAKLLLLERAFDVLGAAKVFWYTDIRNERSQQAIARLGAGRDGLLRRQRLRPDGTWRDTVVFAMTADEWPAAARRLRDRLAAG

SEQ ID NO: 12121 - protein, 448 aa, Actinoplanes utahensis
MAEQYQVSGGTAAEISASIETGVVRGDWQFGAALPPVRVLATALHVSPATVAKAYQELRQRGVVETEGRRGTRVRSRPPVALSRSALRPPVPAGLLNLSSGEPDLSLLPPLGPALRVIADQVGPPQGYTSAATMPELIEAARPRLLAEGVPVAEAAIAVTAGALDSIERLLTAHLRPGDAVAVEDPGWANLMDLIAALGMRPLPVAVDPDGPEPGSLDAALRAGARAVVITVRAQNPTGAAVSAIRAAELRDLLSDHPDTLLIEDDHAAELAEAPPHCVGPVTRWWAFVRSASKPFGPDLRIAVLAGDETSIARVAGRMRIGMGWVSTVAQRLLLQLWRDPEVTELVAAAARSYGSRRRRLRHLLQARGVRSSGDTGINVWVPVPDETHAIAGLRDAGYAVAPGALFRIASPPGIRITVSPLAESDIEALADAVSTVVHPAATGLPMR

SEQ ID NO: 12122 - protein, 221 aa, Actinoplanes utahensis
MSRTGGPVGAQQWVPPRPHSIDELKQAAAGCHGCELYENATQTVFGRGAPNAKIVFVGEQPGDIEDQKGLPFVGPAGRLLRDAVDDAGIDPADLYITNSVKHFRFELRGARRIHQSPGPAHITACRPWLVSEFALLKPQLVVLLGATAGKALLGPSFRVNRSRGQLMPWPASAEHPEDFPVAEIRALATIHPSAVLRADNRDIAYQGLVDDLKIAAAAITA

SEQ ID NO: 12123 - protein, 66 aa, Actinoplanes utahensis
MRLTDFWGRLEQAFGAAYARSIAADHAFAELDGRTIEQAIAQGVDTATIWRAVVASYPDRVPSRLH

SEQ ID NO: 12124 - protein, 348 aa, Actinoplanes utahensis
MVAAPDREKALELALAQIDKQFGKGSVMRLGERPVVQTAVIPTSSIALDVALGVGGLPRGRVIEVYGPESSGKTTVALHAVANAQKAGGTAAFIDAEHALDPDYARALGVDTDALLVSQPDTGEQALEIADMLIRSGALDIIVIDSVAALVPRAEIEGEMGDSHVGLQARLMSQALRKITGVLNNTGTTAIFINQLREKIGVMFGSPETTTGGRALKFYASVRLDVRRIESLKDGTDVVGNRTRVKVVKNKVAAPFKQAEFDIMYGKGISREGSLIDVGVEQSIIRKSGAWYTYDGDQLGQGKEKAREFLKENPDVAAEIEKKILEKLGVGQTSGDAAGGPELPPVDF

SEQ ID NO: 12125 - protein, 401 aa, Actinoplanes utahensis
MAGRRGARSGRGWDALPPRSGADAPDDETPGRGPGQDRRDSGRRGSAARRRPDADDPSLWQTFGSSSEASDDTDLSEAPGDDPASSDAGSAGRFGGRPRDRSGGPAVQGLPWSGQAASSDQPVGRSGRSGGGASDGQPGGRWGRSGGGASDDLPGGRWGRSGGGASDGQPGGRSGRPGAGGSGGQFGLEIGGPEGEGSDGRFALRAGARGGGGAGERKPAGPAQSESERAREICLRQLAVRPRTRAELAKVLARKEISEEVIAEVLDRYDEVGIINDAAFARAWVSSRHHGRGLARRALANELRQRGVDAEVAGEALESVDDESEAETARALVDRKLRTASGTPEAVFRRLVAMLARKGYPVGIAIRAVKEALAARDAEAAEFADAVDADALADQAEDPHS

SEQ ID NO: 12126 - protein, 574 aa, Actinoplanes utahensis
MAPQYWVLVVAIVVLAVSVIVGLTLGARALGQLRTERQDAHDRQEQEVGVAQAKVADANAKAASVRAEAAAAKAEAAAARAEARRVLENAHSEADTILEHAHRQAEADVEQLRTAARRSGEREIALLNATVKEQAAEVERRAARIDERERLHGEEVERLVERERRLVALESELAKREATLKARETEVEAAENTKRRELERIAGLTTETAKGELIDAIEGQAKREAAILIRDIEQDARSTADTRARHIVVDAIQRIASEQTAESVVSVLHLPSDEMKGRIIGREGRNIRAFESTTGVNLIIDDTPEAVLLSCFDPVRREVGRLTLEKLVLDGRIHPHRIEEVFDSAKNEVERLCDRAAEEALVDVGITNIHPELVKLLGRLRYRTSYGQNVLKHLVETAHIAGIMAAELGLDVPIMKRAAFLHDIGKALTHEVEGSHALIGADVARKYGEHEEIVHAIEAHHNEVPPQTIEAVLTQASDACSGGRPGARRESLEAYVKRLERIEEIAGGKLGVEKVFAMQAGREIRVMVRPDDIDDIGAAVLARDVAKQIEEELTYPGQIRVTVVRESRVTELAR

SEQ ID NO: 12127 - protein, 322 aa, Actinoplanes utahensis
MSQQSVLYDVPGPRQRRITLISSLLVAIGLLAGIYYLIYLPLHHKGQFSMKLWGPLIDPGNEDFSAVWDRIGVGVKNTLTAAVFAIIGSLIIGTLLSVLRIELESLARRRFPGIAAPVALLLRALSVALAWATRICIEVFRGLPVVLTIFFVARGLPEFGVSMDTLWYLVIGLTIYNSVVIGEILRSGMTGLPPGQREAAAAIGLSSPQTTMIVLLPQAFRIMLPALISQLVVVLKDTSLGFIISYEETLNIGKQIIGVLSNPIQVYAVIGTLFILVNYSLSKLAQYVQRRLSRGRKTAGMPRRQPPTAALIAQAEGAGGTA

SEQ ID NO: 12128 - protein, 236 aa, Actinoplanes utahensis
MSVIFDRFDVFAGGFWLTLQICVLAAIGALFLGAVVAVLRISPVPPLRALGTAYVTVFRNMPLTVVMFFAAFALPALGSNADFLRIPVLDAIFTRLGTDLPYFRFALIALVLYTAAFVCEALRSGVNAVQPGQSEAARSLGMTFGQNLRYVVLPQSWKASIVPLGSVIIAMIKNSALIGFFGVVGDLSQTADQLTSAEGLAFVPVAIGVSIGYLIMTVPLGALLDRIERRQAVTAR

SEQ ID NO: 12129 - protein, 293 aa, Actinoplanes utahensis
MRLQRLAAVATATALVFGLAACGDKSDGGSKSGAGSKSFPAGSTMERLNKAQTIKVGTKFDQPGFGLKGLSGKPEGFDVEISKIIVKELGIPADKIQYVETPSKVREDSIVNNTVDFVVATYTINDERKKRVAFAGPYYEAGQNILVKADDSTITGPDSFKDGTKKVCSVTGSTPAEKIKTYVKDVPSQVVLFDTYDKCIAALDGGQVNAVTTDNVILLGYISKNQGKYKLAGPNFTKEPYGIGVKLEDKDFRTFINDTLEKSFADGSWKKAWDDTAGKFGAELGAAPTVNRY

SEQ ID NO: 12130 - protein, 247 aa, Actinoplanes utahensis
MAGEALIVLENVNKWFGPLHVLKDVDLSVERGEVVVVIGPSGSGKSTLCRAINRLEPIDSGSITFDGQPLPAEGRALARLRSEVGMVFQSFNLFAHKTIVQNVMLGPVKVRKEKPAAARERAMALLDRVGIAAQADKFPAQLSGGQQQRVAIARALAMQPKALLFDEPTSALDPEMVGEVLDVMTALAREGMTMVVVTHEMGFARHAANRVVFMADGQLVEQATPAEFFANPKSERARDFLSKILTH

SEQ ID NO: 12131 - protein, 738 aa, Actinoplanes utahensis
MTTTTSPRSTDRSTSFSTCSGPNHLFTFSRTMRASPATPCPSARRSLDGCHLRGTQVSECDENGHGAVTQPARGERDVDHDGYGWPLELVRRRADRARARAERPGWSVGNPGGGDRRGGLRRPALRRLSGRWRFSDTDRCIPGPGPPRRGDDRQRGRGSAGRRAAAARRHPQPDPVRAGRAGRDAARRARRGGGDRRRCRTAACPPVHRRRPGLRHRPGLRPLPVPGRGLTAVPWSIAMTTEMQSSSGMPSAARTYDVRTYGCQMNVHDSERISGLMEDAGYVRAADADAADVVVFNTCAVRENADNRLYGNLGHLRPTKLKNPGMQIAVGGCLAQKDQGDIVKKAPWVDVVFGTHNIGSLPALLERARHNEQAQVEILESLEVFPSTLPTKRESTYAGWVSISVGCNNTCTFCIVPSLRGKEKDRRPGDVLAEVRALVAEGVLEVTLLGQNVNSYGVEFGDKLAFGKLLRACGDVEGLERVRFTSPHPKDFTDDVIAAMAETPNVCHSLHMPLQSGSDRVLKAMRRSYRQEKYLDIIDKVRAAMPDAAITTDIIVGFPGETDEDFEQTLEVVRRARFSSAFTFQYSKRPGTPAATMAEQVPKKVVQERYERLIATLEEITWAENGKLVGETVEVLVAVGEGRKDERTGRMSGRARDGRLVHFATGDLSPRPGDIVETVITYAAPHHLNADGAPLSHRRTRAGDAAEAGTTPKLKGVSLGLPTIGVPAPLPAAEGCAL

SEQ ID NO: 12132 - protein, 244 aa, Actinoplanes utahensis
MSRRRCRPPRAAPSKVLDRLPATPDGHDPRDGSWPFPGPRAARSSRDRATWPPPSPVYPDVRADRGSGNTERDSQFAGFVAEQRGRMVYTARLLTAGDAFLAEDLVQTALTKLYVSWAAFGRADSPDAYVRRALFNALVDERKRIWRRHERPVADVPDRAGELVGADDGDPELARALGELPPRMRAAVVFRFVHDMDVAETARALGCSAGTVKSQTARALDKLRAALGQPALATTFSGQPQGAS

SEQ ID NO: 12133 - protein, 240 aa, Actinoplanes utahensis
MDLHTRLERFGGPIEAAAADTIAADVERGQRALRRRRTFRTSAVTAFGMAAIVATISVTGAVTGTAPSGPAVAASLPAAAGSTPAARVKLVDYTGAQPKWFTIDKVPEGYFVQKDDEGGLTIAPASVKNPPPGADPSKDPRYDPSVLTDKIGIYLEPTWYREGNDDGEKVTVGGFPAVLHGAAPLQQLMILVSPKVYATVQADVPLTRDQLLELGAGLHVSKEAVDRMAASTGKTGKTGK

SEQ ID NO: 12134 - protein, 316 aa, Actinoplanes utahensis
MLDVTRLRVLVAVARCGSVTAAAQALHYAQPSVSHHLARLEAETGSRLIQRAGRGIRLTDAGRMLAERAEEILGRLDAAEAELAAHTGLRSGRVRLAAFPSALGTFVPAAAAGFVGAHPGIDLRFTEAEPPAAVRLLRSGEVEVALLFTYPGETVPDLDGLRPEPLLEERLYLVTPGDRAGDTLADHRDRPWISGCERCRAELLRVCAAAGFTPDIRFTTDDYVAVQALVAAGLGVTVLPALALAAHQDPGVRTVALPDTARTVYAAVYGDTPDPPGTTALLGHLRAAAGLPAYASIGNLNRPRTASGPRPGRSGW

SEQ ID NO: 12135 - protein, 319 aa, Actinoplanes utahensis
MELTLADFRAAHAVVRRHLAPTPLGGYPLLDRAAGATVLVKHENAQPVGAFKVRGGLTLLDALPAADRARGTLTWSTGNHAQSLAYASHRYGVPCTVVMPAGTDPGRAAAVEAWGARVVLAGDRLEDAQEHAGKLAAETGALAVSPGDTPELLAGVGTLYLEILEREPDLDAIVVPVGSGTGAAAACLVSAALGARCAVIGVQSAASPAAHDSWRAGELLARPNRSTVAGLATGRGYALPQRVMRAGLADFLLVGDDEIGAARRLLASAAHTLAEGAGAAALAGVLSRPDLFAGRRIAVVCSGGNADRAELGTMIDGRG

SEQ ID NO: 12136 - protein, 604 aa, Actinoplanes utahensis
MANFPRAPLSSWGEQHQPAVTLTRVVFALIGAAALMLGYAGLDDYLATAPAGSRDPLNLAYDTMQLFVLGSDPLQGGTRFPVALQIARFAAPLVTLYAVVEGGRLLLATEVRRWRARRSRDHVVVCGDTSVARTLAERLHRAGRRVVLVRTRPIGPLELRGRGLLGVQGDAREPEVLRGAAAGRAAVIYCCAESSAVNLAIAANAARVAGDGHRDLAIYAQIHEPDWALTLQARRLGVPDAGAQRLDFFQIDQLAVQVLLARQPLPVRLGGAAPRLLLAGDSPLVRALLVEVARHWRLRRGRPDRRLDIDLVAPDATRVLERVARRHTVLRDTCRVVPRETTVAELLAGAPADASRYERAFLFFADEKYGLQLALTEYRLWHRVAGDVVVAVDGLAELADAFSPEHPPPLLDPLNGRLKLFSPAAAGCDPTLIAEDLAERLARLIHERYVVARLARGDRRGDGLGDPSGGHPAMTAWADLPEPLRRANRLQAADIGPKLHQAHCAIVPRDGAADDFAFTAAEVEELAKRESRRWVEATLAEARAREVPPAERNVPFLGEWEQLPAEGQERCRRAIRDIPEILGEAGFQVVRLSDTGADRALFPA

SEQ ID NO: 12137 - protein, 165 aa, Actinoplanes utahensis
MIRIGVTGHIGLDRSSRRPIRNAIVAELRKHKPIHGVTCLADGADRIFVEAVRICRGTFEAVLPVPEISAEPEEDRELRELIRYATDVTRLTVPGAPELTYEAASREVVERSDLLLAVWDGTQAGARGGTAETVAFAREQGKQVHRIWPDGARRVAVTSAVPVSA

SEQ ID NO: 12138 - protein, 415 aa, Actinoplanes utahensis
MVRRRRENEDELMNEDWTAFGRVDADGTVYVKTAEGDRVVGSWQAGTPEEGLAHFARRFEDLVTEVDLVEARLKSGAADASHSLTSVKRLRTQLDEAHVVGDIDGLTARLEKLSALADEKASEAKAAREVARTEALARKTALVEEAEKIAADATGWKSAGDRLKEILDEWKTIRGVDKKTDGELWKRFAAARDGFTRRRGAHFATLDGQRKQAQTAKEELVTEAESLAASTEWSSTANRLKELMTEWKAAPRAAKEAEQRLWERFRAAQDAFFTRRSEVFSARDAEYQGNLERKQAILAEIEAVDVDADPRGAQNRLRDAQAAWHDAGRVPREAAAGLDRRWRAAEERIRVAMDSAWRKTSPQDNPLLRQMRDQVAEAEQRLERARAAGDNRRIKEAEQALASKKQFLALAEQAN

SEQ ID NO: 12139 - protein, 303 aa, Actinoplanes utahensis
MPSSPGPRVVTVVGPTAAGKSALSIALAHELGGEVVNADSMQLYRGMDIGTAKLGAAERDGVPHHLLDIWDVTVTAAVAEYQALARAAIDDILARGRVPLLVGGSGLYVRAVLEEFEFPGTDPAIRARLEAELAATGPAPLFTRLGVLDPVAAGRILPSNGRRIVRALEVIELTGQPFTAALPDPKPYYDTVQIGVDRDPAELDERIAQRVELMWSAGLLDEVRALDAAGIRDGRTASRALGYQQALAEIDGVLSGAQARADTVRGTRRFVRRQRSWFRRDPSITWLDGAAPALLADALAVIG

SEQ ID NO: 12140 - protein, 288 aa, Actinoplanes utahensis
MMGGVFFTKGHGTANDFVILADPDGELELTPALVAALCDRRRGIGGDGVLRVVRSAKHPAGAGHATEAEWFMDYWNSDGSIAEMCGNGVRVFARYLTARQLATPGPAGLPVATRAGVVHAVVDADTISVRMSTPRVYAASTARVGPLTVPGIAVDCGNPHLVCGLHDGVTLSGLDLTTAPGVDRALFAAGVNVEFVEPVIDPTPDTDRHVRMRVHERGSGETMSCGTGALAVGAVALREAGLATGSVTVDVLGGRVVITADAAGSWWLAGPAVLVATGEVDLSALPVT

SEQ ID NO: 12141 - protein, 486 aa, Actinoplanes utahensis
MVTTRLPSAGFSITIRIAVTADASSIGRLTTCVGEAGAIVTALDVVDSDPTRVLVDLTCDTADSAHADQVVKQLEEQDGVDVRKVSDRTFLLHLGGKIEVSSKVALRNRDELSRAYTPGVARVCMAIAENPADARRLTIKRNTVAVVSDGSAVLGLGNIGPAAAMPVMEGKAALFKRFGGVDAWPVVLDTQDTDEIVKIVKAIAPAYGGINLEDIAAPRCFEIEARLKEQLDIPVFHDDQHGTAICVLAALTNALRVVGKRMQDVKVVVSGAGAAGTAIMKLLMRQGVGDIIAYDRKGALHRGMPDLNESMQWLADHTNRANYSGDLPGAIVGADVFIGVSAPNLLTGDDIARMAPRSIVFAMANPDPEVDPREARKHAAVVATGRSDQPNQINNVLAFPGVFRGMLDVSAEEFTEEMALAAARAIADVVGEDKLNPTVIIPSVFDPRVTPAVAAAIRAVVRGVPAPSNPSATPESELDQAPEGIF

SEQ ID NO: 12142 - protein, 471 aa, Actinoplanes utahensis
MRNTYQAPVLDEPDLTTGDLELEERHSLRRVAGLSTELTDITEVEYRQLRLERVVLVGVWTEGSVEDADNSLTELAQLAETAGSQVLEGLIQRRRQPDAATFIGRGKVDELRDAVVASGADTVICDGELSPSQLRNLEQQIKVKVVDRTALILDIFAQHAKSKEGKAQVELAQLQYLLPRLRGWGESLSRQGGGAGGGGSGGGGVGTRGPGETKLETDRRRINQRIAKLRREIKAMRTARDTKRSRRQASGTPAVAIAGYTNAGKSSLLNRLTEAGVLVENALFATLDPTTRRTSAEDGRVYTLSDTVGFVRHLPHQIVEAFRSTLEEVADADLVVHVVDGSHPDPEGQVSAVREVLGEVGADRIPELLVINKMDAADEETVLRLKRAWPDAVFVSARSGSGISELRAAIAERLPRPPVDMRILLPYSRADLVARVHRTGQVLQSRHLDDGTELRVLVDERLAADLEEFRC

SEQ ID NO: 12143 - protein, 466 aa, Actinoplanes utahensis
MNGWRPIWRSSVAESHLSRGAKSDTYGPLTRVDPRVTPMGDAACDTVRMRRLVFSIVLGVGLVAIGGTGASAADPTPTATVSAKATAGKKICEIKSPLLNEVSGLVATKSGFVAINDSTDATRRFVFFLDTKCAIQRKVSIALSRDTEDMILSPDGRTLWIADTGDDDALKGQPARSNVGLWTMPVTGAQAPVLHRLSYPSGDQHDAEALLLDGDGQPLIVSKEIGAAHVYKPSGPLKDNNATGVPMTRVAELALPATETPGNAFARVFNKVITGGAMAPGDGKVVLRTYTDAWEYDVKGGDVLAALKTRPRTTGLPNEPFGEAISYSPDGKTFYTVSDMNGDANTANWIMQYDPATTVAAQSKNQSDGTADAAWYTKLSVSQITYLVGGVGLIGLLLVGVGVIGIVRFRKAHPAGVTVDDADSGPLGKDDNELIGVGSGAGYGSGNGPVYGSQPRPGVYGGQLAS

SEQ ID NO: 12144 - protein, 33 aa, Actinoplanes utahensis
MRALGLAALRTLRLAAVDAAALRPRLLRTTARR

SEQ ID NO: 12145 - protein, 263 aa, Actinoplanes utahensis
MSTDDRTSRQQQPIRQDPGSAAAAMRRRTPSRARSADAPQLRSVTPLNNVAEPVAGALTTRQRRILEFIREWGEKYGYPPSVREIGEAVGLVSPSSVAYQLKALETKGYLRRDPNRPRAVDVRSPGELVDDEALRAARPQPAYVPLVGRIAAGGPILAEQAVEDFFPLPRELVGEGEVFMLEVKGDSMIDAAICNGDWVVVRQQPNAEAGDIVAAMIDGEATVKSYRQRDGHVWLMPANPAFDPIPGDDATIMGRVVAVLRRV

SEQ ID NO: 12146 - protein, 46 aa, Actinoplanes utahensis
MVVTGGARHTAPPLRLTRRGRVVLLGLFFAVSVLASVVLFTTASRG

SEQ ID NO: 12147 - protein, 173 aa, Actinoplanes utahensis
MRCPYCRHADSRVVDSREADDGQLIRRRRSCPECGKRFTTVEEAVLAVVKRSGVTEPFSRTKVMSGVRKACQGRPVDEDSIALLAQRVEEAVRARGAAEIPSHEVGLAILTPLRELDQVAYLRFASVYKAFDSLDEFEKEIAALREAPPVRDAGTRHAVAPRSGTARVPRING

SEQ ID NO: 12148 - protein, 987 aa, Actinoplanes utahensis
MCPGSTADNEVVYEGEHISMAGDGITAGRQRSRTNTNGGDAAAAAGLRVERVWTTAGVHPYDEVEWERRDVVMTNWRDGSINFEQRGVEFPTSWSVNAANIVTTKYFRGAVGTPERETSLRQLIDRVVQTYRRAGEEHGYFASPADAEVFDHELTWMLLHQVFSFNSPVWFNVGTKSPQQVSACFILSVDDSMDSILEWYKEEGLIFKGGSGSGVNLSRIRSSKELLSSGGTASGPVSFMRGADASAGTIKSGGATRRAAKMVILDVDHPDIEEFVQTKAREEDKIRALRDAGFDMDLGGADIVSVQYQNANNSVRVSDEFMRAYEEGTEFGLRGRLDGEVIETIDAKKLFRDIARAAWECADPGLQYDDTINDWHTNPETGRITASNPCSEYMSLDDSSCNLASLNLMKFLRADGGFEVEKFVKSVEFIITAMDISICFADFPTEKIGVTTRAYRQLGIGYANLGALLMASGLPYDSDGGRSVAAAITSLMTGTAYRRSAELAGVVGAYDGYARNADAHQRVMRKHAAANDEVRAQGPVATEILREATRQWKNGNKIGEKNGWRNAQASVLAPTGTIGLMMDCDTTGIEPDLALVKFKKLVGGGSMQIVNQTVPRALRSLGYPEEQVEAIVEHISEHGNVVDAPGLKPEHYAVFDCAMGERSIAPIGHVRMMAAVQPFISGAISKTVNMPETATIEEIEEIHYQGWKLGLKALAIYRDNCKVGQPLSAGKTAKAAAPATVEAPAAVEKVVEKVVEYRPIRKRLPKKRPSETVSFSVGGAEGYLTASSYPDDGLGEVFLKMSKQGSTLAGVMDAFSVAISIGLQYGVPLETYVSKFTNMRFEPAGMTDDPDVRMASSVMDYIFRRLALDFLDYDTRAELGIFTAKERTAQAQAEAAAEAATVDLAGMAASAPAAPAVAPAATPGTSTVTVAEAKAATPVSAGSSTELLEIKTGHAADAPLCFTCGTKMRRAGSCYVCEGCGSTSGCS

SEQ ID NO: 12149 - protein, 177 aa, Actinoplanes utahensis
MGRPEELQAEARSVLALLEPLGPLTPTGSYVSGLMVWRDLDVTLFGGPDFTPADVLTLLGRAVAIPGVTGFDYRDERDAKPADQRYQVTITLGEWRVDLSIWLHDGHPSTADWHRDLATRLTDEERQAILAIKQLWHQRPEYPAEVNGFDITTAVVDHGVRTAVEFGVWLRETHGGR

SEQ ID NO: 12150 - protein, 393 aa, Actinoplanes utahensis
MSSVDVLPARVATARIAVGVTFAMNGLALAGWLSRAPAVRDGLELSVAGFGLLLLCMSGTSVASIPLAGPLVQRVGPARAVLLASMAMAAGLAVLATATLLGSVVLAGVALLFCGFGTSTWDVAMNVEAADVERRLGRTIMPRFHAGFSLGTVAGAGVGAAASATGVPIGAQLYVTTVIVVAVQIAVVRRFLPHSGPEPGSRPAMTAGQAWREPRTLLIGLILLGFGFTEGSANDWLAISLVDGYHTGDTLGALGFGVFVTAMTLGRMYGGLATDRWGRVPSLRLTALSAAAGILLVVFGGSVWLALAGALCWGVGASLGFPIGMSAAADDPIRAAMRVSVAGSVGYAAFLAGPPLIGFLAEHFGVRNALLCVFAALLLGLTASHAAKPLPTS

SEQ ID NO: 12151 - protein, 301 aa, Actinoplanes utahensis
MINDSLVDAGGVQLAVRDFGGDHPPLLLLHGAGGNLAHMTLLARALRPHHRVVTVDLRGHGRSADGPWTWDAALGDLAAVCVELELERPAIAGHSLGGMLATLWGQRHPESPGVVNLDGSPPPTRPDQLPGLTPDRAAAELERLTGVFDMVEAAAGQTVEAGELADLVERQRMAARDRGANEKVWIEGFRRNLVHGKDGTTTFRPSFATTTQLRALMTELDLAPVHAATKCPSLLVLATRDLPEQEPFADLYAAHRRYVLAQAEAIPHLRHVALADASHAMVIEQPEALATLITTFLAEAR

SEQ ID NO: 12152 - protein, 207 aa, Actinoplanes utahensis
MLLAEQIIRLLDIRLVDPLEILLEGDPGVDRVRRRLQVRAWEWAAMIEQGEEAEAVHIIARLIATLYPDDHAFAPPVEWWRTPLGQAVVRRMGHPFATTVSYATAGAMLGITRQAIHDLVRRGRLPRDPDGGVPVGAVRARLLAATPFTTPATAAPLTASGATSAGAAHRVPAPSVDFVHPSGFFSAASGDSDDLTDAEPTGNEETQ

SEQ ID NO: 12153 - protein, 184 aa, Actinoplanes utahensis
MRTVLAALGVVTLLAAAGCKKQDTDAPVSLPPVTIVEQPAASAGGACILWDWAFIQQKIGVRFSVAAADQVDDTSTCVVQTVDGSWPDLSLSVVEETKADAKVFLANRVPKKGVKLKGLGKAGYRLTGPAADGHGPTVEIGWLSEAEQLQTLRFTFEKGAASSSVTAMNDRLLELAKAMDTTDG

SEQ ID NO: 12154 - protein, 229 aa, Actinoplanes utahensis
MNDLVDTTEMYLRTILELEEEGVPPLRARIAERLHQSGPTVSQTVARMERDGLLTVEGDRHLVLTEQGRSTAVSVMRKHRLAELLLVNVIGMPWEEAHEEACRWEHVMSDSVERRVYELLNKPTRSPYGNPIPGLEQLGLPEDDATLEQPGPGERNLAFPGLTGSVVVRRICESVQTNSDVLRQLHAAGIDPGTTVTVAQERDGVTIDKAGDKIRLPREVASRVFVAAR

SEQ ID NO: 12155 - protein, 395 aa, Actinoplanes utahensis
MADETTAAVVWDKALLDYDMGDHPLNPVRVELTMALAGELGVLDRPGVRLVTPRPATEAELTRVHRPDYLDAVRQAPIDPFFAGWGLNTPDNPVFDGMHESSARICGASVAAVEAVWHGAARRAVNVAGGLHHAMPARAAGFCVYNDPAVAIAWLLDHGAQRVAYVDVDVHHGDGVQTMFYDDPRVLTVSLHETPLALFPGTGFCDETGGPGAEGTAVNVPLPPGTGDAAWMKAFHAVVPSVVRAFAPEIIVSQCGADAHRLDPLADLMLSVDCQRAAYLAMRELAEEVCDGRWVALGGGGYALVEVVPRAWTHLLAVVTGEPLDPATRTPKSWRRLAAGRSPGVEVPETMGDSALISSRAWSPATEDDPVDRAIMATRLAVFPLHGLDPYDPRD

SEQ ID NO: 12156 - protein, 258 aa, Actinoplanes utahensis
MERSADVLLADGTAVHLRQIRPADAPAIVEFHSRMSDRTRYLRYFSPYPRIPERDLQRFVNVDHRDREAFVTVAADGRITSVGRYERLGPDSPEAEVAFVVEDAQQGRGIGSVLLEHLAEAARDHGITRFVAEVLPENGGMLRVFGDSGYSVQRRYADGVVHLGFPIAPTEKSREVQESREHLTESRSIARLIAPRGIAIYGASASGHGIGAAMLGNLRDGGFTGAVVPVHPTAPTVAGLTAYRKASEAGAPIDLAVI

SEQ ID NO: 12157 - protein, 568 aa, Actinoplanes utahensis
MVGSAGFAEAGPDGAARQRALIETAHAAGLRVIGPSSFGLANTDPAVRLNATMAPRLPAAGRVGFFAQSGALGVALLAEADRRGLGLSSFVSAGNRADVSGNDLLQYWRDDPGTDVVLLYLETFGNPRKFARLARRMSREKPVVAVASATRPPGLAGDLPGPDAHAVTALFARSGVIRVDTVQELFDVGMLLAHQPLPAGRRVAVVGNSSALAALAEVACRAAGLTVAEGYPHDLSPMATAQDLADALADAAVDDRVDALVVVFAPLVPGQQLSEEDADFAAALGSVALAGEKPTVATLVFGRVPPRVPVYPSVEEAVRALTRVVNYAEWLRRPPGRMPALSGLDPAAAEAAESTTELLAAYGVEVVPSTLAGSEREAVAAADALGYPVALKAAGGGLRHRIDLGAVRLAIQDEDDLCTSYRDLAAAFGPEVLVQTMVAPGVACVVEVVEDPAFGPVVGFGLGGVASELLGDLAWRAAPLTDRAAEALVDEPRAAPLLHGYRGSTPVDRAALIDLLLRVGRLADERPRIRSLLLNPVLARPDGFSVLHAAAEWGEPGVRPDTGPRRLR

SEQ ID NO: 12158 - protein, 365 aa, Actinoplanes utahensis
MPPGRWPHLRLTRGRRSFWSPARMRLVGTTNGEGTQVVLETKATVEDIMTDEVEQVVDLDATDERGVSADLVRAYLNGIGRTRLLTAVEEVTLSKRIEAGLYAEEKLPAADAALAELLDIVIAEGRAAKNHLLEANLRLVVSIAKRYTGRGMAFLDLIQEGNLGLIRAVEKFDYTKGYKFSTYATWWIRQAITRAMADQARTIRIPVHMVEQVNRMVRARRDLSAQLGREPSIAEIATAMAVPEFQVIELISYDREPVSLDQAVGEDGESALGDFVAAVDPNQPGEGVSQGELRSEVEIVLATLSERESAVIRLRFGLDDGRQRTLDEVGREFGLSRERIRQIEKVTMLKLRDPERASRLEAYAV

SEQ ID NO: 12159 - protein, 261 aa, Actinoplanes utahensis
MVFRRMLQALGVGGPSVDTVLTDPNCFPGGFLAGNVHIAGGDHAVDVEYVAVGLMTRVEVETGDNEYQTNQEFHRQRLTGSFRLEPGARHDVPFRFEVPWQTPITELYGQHLHGMTMGLATELEVARAVDKSDLDAVQVHPLPAQERILEALLRLGFRFHKADVERGRVYGVEQELPFYQEIEFHPPAQYASGINQLELTFLPTPRRLQVVLELDKRGGLFTEGHDAFGSFDVDYATVDRVDWTAQLDDWLRQSARRRGLF

SEQ ID NO: 12160 - protein, 140 aa, Actinoplanes utahensis
MRALVQTVSRASVTVDDEIVGSITDGLLVLLGVTHDDTPAKAADLARKTWELRILDGDRSAADENAPLLVVSQFTLYGDARRGRRPSWIAAAPAEVAEPLVVAYAEALRARGATVETGRFRAHMLVESVNVGPRTILLEL

SEQ ID NO: 12161 - protein, 160 aa, Actinoplanes utahensis
MILPSESGRSGARQRTKPGPPRSQSATPGPVTGLDTAPDQANPGIDQRSTAELLSHSDPTDGRLPGPAWGIPGPTITEVHMSSEDSDLSSTVPAGTDPEELRNGGPSTGGLMTTTGGTAGPASFPNRPRTGPGVAPTTTGDATTGALRTPADEYTSDQAG

SEQ ID NO: 12162 - protein, 646 aa, Actinoplanes utahensis
MPLTSTTGGRTTEAPRAARPAPATTASRTARAPDGDANRRQARSVAKQQQAAERIAAATAEISAQNAEAAEASRQLTDSMQQIAAGAEEASGATQQSLAAMNQIEDRVNRQESTTRQVADLSQALQVLLNETRSGIVGLLTNVESASARQTESVVTISELEKQADEIGEIVKTVAHIADQTNLLALNAAIEAARARQHGKGFAVVADEVRTLAETSERSARQIRDLIDEVRNSVTEIAGAVQTSAETARGEAEKGKSITSQLETIRADMGTIMAGATEMAAAAEQAKRSAGSAKQRSEEIAAAAEQQSAACEESLQTVGQQTQALRQSEQAAEALAEVSETLRSSTDIAKSAEDVASAAEELSAAVEEINRAANQINVAIKEINTGARTAAEKGEQTSVLVTQIEQGAQLSADRGGAAVERSDTILEMLAANKEAVDSMIDAIGRAAREGIENVRKVTELEQISRRIDKIVDAIANVSIQTNMLAVNGSVESARAGEFGKGFAVVSTDIRNLARDSADNADRIKDLVKAVQDRIVEVRGDLEETSRMSLAEVETAKATTARLDEIERDMQQVRGGNLEVREGAEQIAKVLGEVKIGLEQISASANQAEQLAGQASTAAREQAQGAEELAAAVEEIAALADELQNAG

SEQ ID NO: 12163 - protein, 518 aa, Actinoplanes utahensis
MSVDMDEDADLGEDTADYVTFDMVGERYAFPMRRVQEIIRMPSVVKVPLGPPSLEGLANLRGRVLPVVNLRQCCSMEQAEHDETTRVIVVDGGVPLGFVVDRVASVISIDPQDLEPGEAVQATVRSDVLVGVIKSDGGEMTTVLDVDRLIGSQFARLAEKRGPGGRESVTRVSGEADPDADLDDTLELVSFAVEGQEYALPIDQVQEIVQAPESVSHVPNAGSRVLGVIDLRGRLLPVVSMRRVFGLPVTPLEPQNRIVVVSLDDGVVGVVMDTVREVLRVPHQLVAPLPGVVAGEGRKTEVESVVRLEDGKRLVSVLSVNRMFDSPEVRDEIAGYREDDEEMTAERASEADDGRGDEELFVVFRLDDEEYAVDVDAVQEIIRVPEALIRVPKSFSFVEGLVNLRGTVLPVVDLRTRLGLERTERDERQRIVVLIIGGVRTGFIVDSVAEVARVGRNVLEPAPELSEEQARVVSRVANLPDQQRMLLLVQVDQLLAAEQAAVAAELCEDVVSEALAGV

SEQ ID NO: 12164 - protein, 345 aa, Actinoplanes utahensis
MPTSVLVVDDSALMRRALKGMLAEAGDFEVHTARNGVDALEQLERVHPDVVTLDVNMPEMDGLTCLAQIMEKQPTPVVMVSSLTDHNALVTLEALQLGAVDYVPKPGGTVSLNIDEVATELVQKVRGAARAKLKRATGLKSRIRATPAPLETRPAAVDLVLIGSSTGGPALLSDLLPQLPGTLSAPVVVAQHIPASFTAALARRLDETCALRVHEVDRIMTVRPGNIYIGRGGADVVVARRTDGLIVKSAPAAAEYRWHPSVDRLVASAHRYLDPARLVCVLLTGMGDDGAKEMAAVRAGGGRTIAEAEETAVVWGMPGELAANGGATEVLPSYEIADRLADWVR

SEQ ID NO: 12165 - protein, 204 aa, Actinoplanes utahensis
MGLVKKPAAAPEPPPSLGPDDLIALLDHPDPERRREAALDLAGVPEAVPGLLARAGLETEPRVRDAVLTTLAGHDTEAVAAGLAVHLASDDAGLRTAVAEALATMPGSVPALLPDLLAAPDHDVRVMTAMVLADLPDPEARTWLVRMITDDPHPNVVTAAIDALLPGAGPEHAAVLEAAAQRFPDDPFLIFTVRAALPRLTGTA

SEQ ID NO: 12166 - protein, 289 aa, Actinoplanes utahensis
MAAAAPSGTGLSDAEFDRFTEYFYKRTGIHFTPGKRYFVDKRVETCIRSSPFDTFASWFAALRMDRPDMLQELINQLTVNETYFLREDYQFDAMLSTVLPKTLAARGGPGRMSGPVKILSLPCSTGEEPYSIALRLLEEWDQIDHVDVEIHGADIDSEVLAKAAHASYGERSLQRVPKAWVNKYFTSVGSGRFQVDEGIRSAVTLHRMNVCDTAAMKAFRDFDVIFCRNVLIYFDELSSRRAAENLYGALRPGGYLFLGHSESMSRISPIFTPTRLPEGIVYQRPTGAK

SEQ ID NO: 12167 - protein, 126 aa, Actinoplanes utahensis
MTRVLVVDDAATVRLYHTSLLRDAGFEVAEAANGLEAVEAAMTTPFDLFLVDVNMPKMNGYTCIETLRSETVGTAAPILMISTEDRPGDADRAYQAGANLYLVKPVPADRLIRVATMLTSGKDPEA

SEQ ID NO: 12168 - protein, 341 aa, Actinoplanes utahensis
MNPLLSQFLAEANDLLASVDDGLLQLERNPGDPELVNEVFRAAHTFKGSSGLFDFPELTRLTHAAEDLLDAVRGGRLALDSGMADDLLAAFDLIRGWLAHVTAHERLPATAGQDAAGLITKLRAPLGGEPSAADQEPIAAVRHVDAAPDWLAELGTEWLIETATWLNTTSSTLRFLRYLPDQDCFFRAEDPLHLVRQIPGLDRMVVVPPATWPAVAEYDEYACLLSFVVATRASYGELHHLFRYVPDQVSYVELDAAAINRHLEGEDAEEITPPPVPEPLNIDPGLAADARAVLTAAHRTLAVGEPAGTQLVALTASVTAAARALGVPLDLTGADAEAVNA

SEQ ID NO: 12169 - protein, 424 aa, Actinoplanes utahensis
MIAALAAPPAPVPAAEPAGRADDPGGQVGTRVLKVDQEKVDRLMELVGELNVAKNGLTFLAAAAEEEFGSRALSRRIKDQYAGLHRIAEELQAAVMDVRMLPLSVAFGRFPRLVRDLSRRLGKTIELVTEGDETMADKDVIEALGDPLVHLVRNSLDHGIETTEERIAAGKPGTARLTLAAVADGDAVLVEVSDDGRGVNPARVKQKAYEKGLISEEELESLSDSEAVDLVFRPGFSTADQISDLSGRGVGMDAVRASVEKLGGSVTMRSELGTGTTTRLRLPLSMAVTQVMVVSVAGQRFGVPVDLVVETVRVPAAEMGRVLHQDVVVMRGEVVPVIDLARALQMPWAADPDRDRAVLIVSVNGQRVGLLVEQFHREVDVILKPMEGLLAYADEFSGTALLGDGLVLLVLNLKEVLGLAARAA

SEQ ID NO: 12170 - protein, 91 aa, Actinoplanes utahensis
MPLELHDENATLIGVVTVDEVEQLVGWLRSCQRPRVSLRRCNHLHTGALQALLLFRPKISAAPKDAFLTSQVLPLLTGSNGDTGRQGTEPP

SEQ ID NO: 12171 - protein, 123 aa, Actinoplanes utahensis
MTTVMLVDDSATMLMSLKSILTKAGYSVETAGHGKEALDKLGKGVKPNLIISDVNMPQMDGITFAREARKAPGMRFTPILMLTTESDQAKRVEAKNAGATGWLVKPVGPDQLLGVIKQVLPGA

SEQ ID NO: 12172 - protein, 348 aa, Actinoplanes utahensis
MPSLLRRLTLAPEQPEEQGVSGDVVAEALEPIPAYCDVIDGHVKDVIEQTGEAAHAIVQQMVKIDSLAEVMAGDVAQLAGTLSRTERELSQVSSSNDQLVSRLIAYFLHRDHQIRALVEQMRELNQHVTQIEEVSRATNILALNAMIEAVRAGDAGEGFSVVADEVRKLAHRSSEAAHGIGSSIGDLTAKLDAVLSDDTQFDRAAEMPPVKEETAMTRRLGGIANAQREMSEMVSGILRDTVVAARQVQTSSNALTSETTGAVGHVQFQDISRQMLEHVAEAVADVRGQAESVAGYAQGRVTADEVRDGAINVEDLRSKHVMARQRFTHAAQTGEDASAGTEPLIELF

SEQ ID NO: 12173 - protein, 223 aa, Actinoplanes utahensis
MEPRRAVARPAATGVQSGRPPAGGRTRDGGRRAEPGGRALAQGPADHVRGAGPDGPVVTARHPDRIRDLARLGLDREEHRGYLGELVKTVADRLQTPFALADALLNDAQVFLAGTGPVPDWIGESGGTPLEWAFCTRFLTTSAPFTVGDFTEDPEHRDNPLVRIEGVRSYVGAPLISSTGHVLGGLCALDVRPRHFTEDDMRYLSGMAAETVRRIEDHAGRAA

SEQ ID NO: 12174 - protein, 194 aa, Actinoplanes utahensis
MYRMTFSLPIPAEANALLDRSPLAVLLGLVLDQQITMEKAFTSPLVLAQRLGHEPTATEIADFDPEALVEIFATPPALHRFPKAMAARAQEVCRVIADRYAGDVEALWRDASSGAELYQRIFALPGFGKQKAQIFVALLGKQVGVQPSGWRAAAGGYGEEGAYRSVADIVDDESLARVRENKKAAKAEARAAKG

SEQ ID NO: 12175 - protein, 123 aa, Actinoplanes utahensis
MKKQPSVLITDAARSPGDQLRSREVRYVLMMGTRVGCLILGGVLVSVRPPLLALWLVLCLAGMVFLPWAAVLIANDRPPKTKAERAADAAARERQQMALTEVVPEEREPVTIDSEIIESDKKL

SEQ ID NO: 12176 - protein, 298 aa, Actinoplanes utahensis
MPRVIVVGDLVTDVLVEHDGPIRPGSDTAAAIRVSGGGQAANTAAWLARAGQATTLVAAVGADQAGRDRVAELVAAGVGDAVRVLPGAATGSVVVLTGASERTMITDRGACLLLDPAHVTAALRAAAPGDHLHLSGYPLLHAGSRPAGLAALAAARQQGLTVSVDAASAAPLRDAGASAFLTWVRDADLLLCNADEADVLAGPAPAAAQATRLTATVRHAVVKQGPAGAVWATRDGSAWSAPGLSVPVKDPTGAGDAFAAGLLTSWLNDGSPPAALQAGAALGAAAVQLLGARPDPSR

SEQ ID NO: 12177 - protein, 319 aa, Actinoplanes utahensis
MGTVTDFAIRFGEHVIRARRDGRPVVALESTIISHGLPHPDNLRVAREIEQTVRDNGAVPATIGMIGGELIAGLDDAQIEHLALAGDVAKLSVRDLAIAAAHRADGATTVAATSAVAAAAGIGVFATGGLGGVHREANLTFDESADLTALARTPIVVVCAGVKSILDVGATLERLETLGVSVAGYGTRRFPGFFITDGGFDVDWQLDSPEQVADFIRARRDQDVTTGALVLANPLPTDEQLDPELHDRTLASGLAALAEQGVTGKAVTPFLLAHFHSSTDGQSLTTNVRIILRNAALAARIAVAESAGTAAPLGFSVPA

SEQ ID NO: 12178 - protein, 72 aa, Actinoplanes utahensis
MSTQILERPETKDADTGPEMFHYVRKEKIAESAVMGTYVVALCGETFPVTKVPKKGSPVCPQCKEIYEAMKA

SEQ ID NO: 12179 - protein, 204 aa, Actinoplanes utahensis
MASGYGLLVADLIGVAVFAASGASAGVAKRLDLFGVAFVGFASALGGGILRDLTIGAVPPLAFADWRYAVTAVLASVAVFWLHPRLHRVRRTVLVLDAAGLGLFTATGTLKALTAGVPPVGACLLGMLTAIGGGLTRDLLTGEIPVVLQRDIYASVALGGAILVTGMQRLGHTGPVPLAGAAALMTGVRLLALYRRWSAPVAVP

SEQ ID NO: 12180 - protein, 576 aa, Actinoplanes utahensis
MSPSLPNLEIFPPLRAWQRKAMVEYLRRRSEDFMAVATPGAGKTTFALRLAAEMLVDGTVDAVTVVCPTEHLKSQWAQAAARVGIQLDPRFRNSEIHSSRDFHGAVVTYAQVGMAPQVHKRRTITRRTFVILDEIHHAGDSRSWGDGVKDAFEPAARRLLLTGTPFRSDENPIPFVQYERGMDGIQRSKADSVYGYGDALRDRVVRPVMFMAYSGETRWRTNAGDELAAKLGEPMTKDLIAQAWRTALDHRGEWMPQVMQAAHNRLLRVREGMPDAGGLVIASDQTAARAYAKLLHDLTGEAPTVVLSDDDGASGRIAEFAASQKLWMVAVRMVSEGVDIPRLAVGVYATSASTPLYFAQAIGRFVRSRQPGETATVFLPSVPHLLGLASEMEAERNHVLGAPKEKDGLDDELLERAQKSEDAIGDLEKQFEALSATAELQEVIYDGTSFGVPARTGTAEEADYLGLPGLLTPDEVTMLLNKRQTEQLAVQKRHEQEAARNAPEPAPREAVVPMSAGERRATLRRQLNTLVAAHHHRTNLPHGKIHAELRRLCGGPPSAQATIEQLEERIATIQTF

SEQ ID NO: 12181 - protein, 431 aa, Actinoplanes utahensis
MRETTQHAVRLLERAQTGDATAALAEAETVLRSPGGDLACMHFVRVVCRIAQSDPAGAIAAVGPMLCAAEREGSRGWQAAGLASRAWQRLRAASTGGMTADHDTDEVLRDLVAAEMLADGEPDPVAAVNSRVAVAIGWYELRLYELAEPQFTVAYRMSSADAGRNGNRAMWSLNLAEMHLRWALELYQIHRPAEAEGHSAEAERYAIRAAGEVSGADAACWRDNALLYAACARADRHDPGGAAADIVRYTARLRDRGFPTDALAISRPFHGVALLRSGRPADALAVMAEAATGLPPDADWLVVASTHRTRAVLLAHLGSADAAATLAYGDGLAAALWRQRLNTLHAARTRYDLEQLRVQHEQVAKAAEIDPLTGIANRRAFDQALHAALSRPGDAAVLLIDTDKFKVINDTLGHAAGDAALRAIAAALLAS

SEQ ID NO: 12182 - protein, 88 aa, Actinoplanes utahensis
MARLGGDEFAALLPGAGAAEAAAVARRMVQAVRDIPDCLATVSIGIAVGPAAALHDVLEQADEAMYRAKHRGGDGTETTFTPQNRAAA

SEQ ID NO: 12183 - protein, 80 aa, Actinoplanes utahensis
MTPTLTPPAGSLAGTAADERCDRCNAAGKLRLTLAGGGDLVFCGHHANRYAEDLVKIAVQFSADPEFTWRGANMMSNSSN

SEQ ID NO: 12184 - protein, 515 aa, Actinoplanes utahensis
MTEAHQNGADVRSLTEALITHAQGAGGQLTSAQVAHTLESAAVNPAQAKKILRGLVDAGITVVVDGSASTRRKVAAARSATPASKATTAKTAAPVKKAAPAPKQAAAPSTDPAKATPAARKAAPAKKAAVTAKAAPAKAAKPGEEGPEGEEIDPEELAAEIEDVVVEEPPALVAAAATDAASSATDGDFEWDDEESEALKQARRDAELTASADSVRAYLKQIGKVPLLNAEQEVELAKRIEAGLYAAERLRAAEEGEETLERNFERDLKWINRDGERAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFSLLQDQLQQVLQTLSEREAGVVRLRFGLTDGQPRTLDEIGQVYGVTRERIRQIESKTMSKLRHPSRSQVLRDYLD

SEQ ID NO: 12185 - protein, 273 aa, Actinoplanes utahensis
MSEISPGSTPGELLEIAVRVAREAAATASRMRGEAIGDVQTKSTDTDVVTAADRAVERQVVAALRAERPGDTVLGEEYGGAAGAAPGAVRWILDPIDGTVNYLYGLPQYAVSLAAEVDGEVVAGVVRNAATGDEWTATRGGGAWRDGRRISCSTETVLGQALVGTGFGYDPRRRAHQGRVFAQMITRVRDIRRLGAASLDLCLAAEGRLDAFFEKGLNTWDHAAGGLIAAEAGMVVSGLGGAPAGPEMVLLAPPALHPALHDLLVEVDAAGGP

SEQ ID NO: 12186 - protein, 182 aa, Actinoplanes utahensis
MSFARVRALVVVGVLAVAAIVFVIVALVRDDQADIAAGGKCAAGAPAADIHLPDDPAEVTLQILNGTNRAGLADSVSTEFKNRRFTVKDPGKSKSKLKGVAEIRFGPDTVGKAQLVKAYFLAQAKMVYSDKRKGELIEVVIGSDFQQLATTTEVNQSLVEIGEPTLPPGACLKPVTKKPEND

SEQ ID NO: 12187 - protein, 98 aa, Actinoplanes utahensis
MATDYDAPRRDEVDLGEDSLEELKSRRADSQSGAVDVDEVEVAESFELPGADLADEELTVKVLPMQTDEFRCSRCFLVHHRSQLATERNGELICRECA

SEQ ID NO: 12188 - protein, 254 aa, Actinoplanes utahensis
MDATGDDEELGRTVAALTADDLESSGRRRLLGRLVGDVRRRGVGRLFKPRAALRWMAEVVTDVAPHIPVRDRETLRRHFPGLDDDDLADRLIRNAARATAGVGAAGGGVAAVEWVAAPVLLSAPVLLSAETIAVVAIEMKLIGELHELYREPIPGNGTERALALIQSWAGQRGVNPLVPGTGVASVLGTAARGELQKTLLRRFGRNLTSMGPMLTGAAVASYLNRRATRSIGDKVRDDLRKRALTRPDRPALDD

SEQ ID NO: 12189 - protein, 163 aa, Actinoplanes utahensis
MKDSRVSDVVIPVRLIDPDLPLPAYAHPGDAGADLVAAQDVEIAPGEWAKIGTGIAVAIPEGFVGLVHPRSGLAARLGVTVLNAPGTVDAGYRGEILVNLINHDRARAVKISRGDRIAQLVVQRVERAAFHVVDSLDDTARGTGGHGSTGGFSEGKAGSDVLP

SEQ ID NO: 12190 - protein, 216 aa, Actinoplanes utahensis
MMFSRKREGAKHVRAADAPPSKALAQSLAADGEAPAPEFGPWDVKHAPGDVQRLDLGSLQIPAIEGVEVRVQANPEGGVEQIVLVDGESALQLGVFAAPRTEGIWDEVREEIAGAMTADGVAAREVTGRYGTELLARVNTPEGPADVRFVGVDGPRWMVRALFQGAAAADPGREGVLGVALEGLVVVRDDEPRPVREPLPLRLPREMAEQNPAQQV

SEQ ID NO: 12191 - protein, 125 aa, Actinoplanes utahensis
MTTEQRTGLRRFLDRLTATDSELDAEELQRDAVKCGAMPAGQCRRGQVVSVSGRLRTVAYTPRTNLPTLEADLWDGSDVVTLVFLGRRSIAGIEPGRQLTARGRIAIRDDRKVIYNPYYELEAPR

SEQ ID NO: 12192 - protein, 253 aa, Actinoplanes utahensis
MTPGNEPRHVAHETVEERLAEDIVEELDLHPAPAPDEEEALPPLSEQIADQLGGVRGLIESSIPVLAFVLFNVLLGESVAGLDKQTALTWAIVGSVGSAVAIGGVRLARRQPVRHAVNGLFGIALGAYFAWKSGDAKNFYLPGILLTFGQAAALLVSVAFRKPLIGYAWGIMANKGRQDWFGNARLFRTFQWLTLVWVASLALRAGIQFYLWKLGEANALGIVRILISWPIYAATFAFTAWAIHRVTSAQKSS

SEQ ID NO: 12193 - protein, 221 aa, Actinoplanes utahensis
MRIAIAGAGNVGRSIAQELIGNGHEVMLIERQPRQLCPERVPQAQWVLADACEVSSLEEADVASCDVVVAATGDDKANLVVSLLAKTEFAVGRVVARVNRAENEWLFTEQWGVDVAVSKPRLMAALVEEAVTVGDLVRLMTFRQGEANLVEITLPRNAPYEGKPLRSVPMPRDAALVAILRGKRVVVPTPDDPLEAGDELIFVCTSEVEDQIRAVVLGAAG

SEQ ID NO: 12194 - protein, 221 aa, Actinoplanes utahensis
MHVVIMGCGRLGSTLAHSLDTRGHQVAVIDQNADAFRRLGSEFGGITVNGIGFDRDVLRAAGIERADAFAAVSSGDNSNIISARLARETFGVHRVVARIYDAKRAQVYERLGIPTVATIRWAADRMFRYLVPEAHNEVFRDPTSVVSIIEVPIHSDWVGRTVKALEDGTGARVAYLMRFGMAALAQPSTVLQDGDQVFALVTDDTVNKVLDIAGRAGNEGH

SEQ ID NO: 12195 - protein, 680 aa, Actinoplanes utahensis
MASTTSLAKRLLLGRPFRSDKLQHTLLPKRIALPVFASDALSSVAYAPDEILLTLSIAGAGAFAISPWVTLAVAVVMVTVVASYRQNVHAYPSGGGDYEVATVNLGPRAGLGVASALLVDYILTVAVSVSSGVKNLASVLPWDWVGNDRVEIAVGAVLLLTALNLRGLREAGLAFAIPTYLFILVTVGMILTGLFRVYILGDDLRAPSAGLQITAESSHLTSFAFVFLLLRTFSSGCAALTGVEAISNGVPAFKPPKSRNAATTLMLLGGIAIVMLFGIIALARMTHLQYVEDQTTQIISGPANYEQKTVTAQLAEAVFGHGSGLVVLVGAVTALILFLAANTAFNGFPVLGSILAQDRYLPRQFHTRGDRLAFSNGILFLAGVAIVLIVAFQAEPTRLIQLYIVGVFVSFTLSQGGMIRHWNRLLKIQRDPERRRQMIRSRAINAFGMGLTAAVLIVVLITKFLLGAWIAIVAMIVFYALMLAIHRHYTRVSEELQPTEERPTLPSRNHAVVLVSKVHLPTLRAVAYAQATRPDTITAVTVNVDDKDTRAIQAEWERRELPVQLTVIDSPYREISKPIIDYVKGVRRASPRDVVTVFVPEYVVGRWWENLLHNQSALRIKGRLLFEPGVMVTSVPWQLRSSQDRDLDRLDRGLSRAPARGPRFHPEATAVPDQPAEEKS

SEQ ID NO: 12196 - protein, 427 aa, Actinoplanes utahensis
MTSPVVSPADDLVEGDRIELTVGAPAHGGHCVARFGGPHGRVVFVRHALPGERVTAEITERHRGYLRADAVEIHEASPDRVTPPCPYAHPGGCGGCDLQHVSGDAQLRWKTQIVREQLARMANLHTDDDFVRVEPLPGGLLHWRSRVRYAVDAAGRPGLLQHRSHQVVPIDRCLIAHPAIQELDLLAHPWPDAAALQAVATTGGDVVTQQRPAATSGDPTAFGDPTEAAGGAGLVRLTGPERVTEVAGGRRWDLAPDSFWQVHPEAAATLTTAVLDMLRPAPGETAWDLYGGAGLFAAAVAARTGARTTIVESSALGVEAARRALADLPSVEVVQATVETALTRRRITGPVDLVILDPPRSGAGAKVVHGLAAASPRAIAYVACDPAALARDVKTFRSLGWELAELRAFDCFPMTQHVECVALLLPA

SEQ ID NO: 12197 - protein, 290 aa, Actinoplanes utahensis
MTTETTGARLLPGAPVAEAVLADVRDRVAKLKERGIQPSLATILVGDDDASAGYIRIKQKQAAELGFESPHRHLSGDVTQADLLQVIAEFNDDKSVHGVLIQYPIPAHLDYDAALQTLDPDKDVDGMHPLNMGRLAVGLPGPLPCTPAGIEALLAHHGVEVAGREVVILGRGATLGRPLAMLLAQKRPTANAAVTVVHTGVKDWPRYTRRAEILIAAVGVPHIIQPEHVKPGATVIGAGVRYEGRRLLPDVDESCAEVAGAITPRVGGVGPTTVAMLFRNAVAAAERANP

SEQ ID NO: 12198 - protein, 467 aa, Actinoplanes utahensis
MSVDAPAPRRRDRSHLLYLCVLLAMALGIAVGFAFPDFAVKLKPLGTGFVGLIRMMIAPVIFCTLVLGVGSIRRAAQVGRVGGLALGYFLIMSTVALTIGLIVGNILHPGAGLHLSQELAKTGTAQVSRTAEGGVDFVLGIIPDTLISALTSTQVLQTLLVALLVGFAVQSLGARGEPVIAAVALAQRVVFRILAMIMWLAPIGAFGAMAALVGATGFAALKSLAAIMVGFYVTCAIFVFLVLGLLLRLVAGVSIGRLLRYLAREFLLILSTSSSESALPRLIAKMGHLGVSRPVVGIVVPTGYSFNLDGTAIYLTMASLFIADALDRPLSIGQQIGLLLFMIVASKGAAGVTGAGLATLAGGLQSHRPDLVPGVGLIVGIDRLMSEARALTNFAGNAVATILIGTWTHEIDRDQAARVLSGEAPFDESTFDDDPHAGGTPPPAVDAASPASASAPPSPLAGPPTAL

SEQ ID NO: 12199 - protein, 640 aa, Actinoplanes utahensis
MSDSPSTPAGLLASVTGPGALKRLSAEQLTLLAAEIRDFLVAKVSKTGGHLGPNLGVVEMTLAMHRVFDSPRDKILFDTGHQAYVHKIVTGRQDGFDLLRQRGGLTGYPSQAESEHDLIENSHASTALSYADGLAKAFALRGEDRHVVAVVGDGALTGGMCWEALNNIAATKNRLVIVVNDNGRSYAPTIGGLADHLSTLRLNPGYEKVLDLVKDALGSTPLVGKPVFEVLHAVKRGIKDAVSPQPMFEDLGLKYIGPVDGHDQQAMESALRRAKGFNAPVIVHAVTRKGYGYRPAEQDEADCLHGPGAFDPQTGALTAKPSLKWTKVFAEELVKIADERPDVVGITAAMAEPTGIAALAKKYPDRAYDVGIAEQHAATSAAGLAMGGLHPVVAVYATFLNRAFDQVLLDVAMHRLPVTFVLDRAGITGPDGPSHYGIWDMSVFGAVPGLRIAAPRDAATLREELREAVAVDDGPTIVRFPTGAVAADTPAVRRVGQVDVLREAEKKDILLVAVGSFVGLGLDAAERLAEQGYGVTVVDPRWVRPVPIELTGLAAQHRLVVTLEDGIRAGGVGDAVAAALRDAGVHVPLRDFGVPAGFHPHGTRAEILASLGLTAQDVARDVTGWVSGLDAGTSVAAPAI

SEQ ID NO: 12200 - protein, 435 aa, Actinoplanes utahensis
MGAETVIDLGLDRGVPESYERPRRATVPQWFAPVLLALLLLISSSASAAPPKPPFTPLLRIPMGPADPYLITAAGRLVTQTGDVVTAYDLTSGALSWRAGRSTPVLRLRTGDGMLLMQPWTIGGAAAGTTAISLATGERQWVNPRSVITFAGSDALIAVTGTRSLSGSGRRVQGLIEVLDTLTGDTRWRVRVPSTAVVLGVPGPSDAGARMLVVRDDRTAVLHDVADGRVLATRELPSANYGPDNPVVAGGTVLLRHPGVSGMEVSAYDPLTLRPLWTEEADGTLDVRPCGLLACLLGGGGVRAVDPATGDQRWAQRGWQAVEQRGTSLLAYREADGALPAALVDSATGRVLTDLTGWRPLAGANRAGRLLVIRAVPDGARTMVAVADPVGGRLRTIAGLPPGTGGCEAAPDRLVCRSAAGELVVWSYDETAGAR

SEQ ID NO: 12201 - protein, 449 aa, Actinoplanes utahensis
MALIDLDRVAPPGPPRAARPPIRAYRRGGLLLALVLLTVLGGAVPAAGICWRYLGAITSPLAPDGPIELAGGRVYTVGTAGADPVVTAWSTDDPPRRLWSVRAPVGAGPGVVPPSSVTVRPAGDVALLTAGVATTAVDAASGRIRWSSPIAVTVLAGSGIGVTVDRVFRAGTVYDQASGAPGPLYFSATGEPHTEPPLRTDVRGLDLADGHTVWTVAPGGAVTVDQVPGPDPAVLITSSARLSLVSGRTGEPVRQADLPRLSGHGPAGGALLGDVALVSYQNPGRQVAYRARTLQRLWSRPVPDLVADPADCQGVLCDGGHGNLRVLDPGTGQARWRTGEDVDLAIRAGYVLETDAASGEPVRLTDPHTGATAVDLDGWSAPVAGAADAPLLLRRRDGHGGQAFAAVVPGHAAVRELGSAGVRLGDCDADGHYLACRSPEGLRLWAYRI

SEQ ID NO: 12202 - protein, 66 aa, Actinoplanes utahensis
MSVDTKSVAEDRGDEDGAGWPAFLAHSPGEARPVVTALVGDDPQVRCLARYQLIALSDHVVRPPRR

SEQ ID NO: 12203 - protein, 220 aa, Actinoplanes utahensis
MRVLVVEDERTMADAIARGLRRHGMAVDVAYDGAQGHEMAYVTRYDVVVLDRDLPGMSGDEICAALVDSGALTRVLMLTASASVADRVEGLQLGADDYLPKPFAFDELVARVQALGRRATPPAPPVFTVGNLVLDPGRRAVTRGETPVDLTNKEFGVLEVLLKASGAVVSSEELLERVWDANTDPFTTTVRVTVMTLRKKLGDPPLIDTVVGAGYRVVTT

SEQ ID NO: 12204 - protein, 410 aa, Actinoplanes utahensis
MTVYQGQPVQHRESFLRRLARPTLRLRLTLLNGILLVAAGAVLVVLAWLLVDEPLHPADRLRVGSSVTLNDGTTREARSWQTETIDEASDQLLVKGLSALVAISIIGIAGGYLVTRRALRPLHQVTQTAQRLGEETLDQRIRYAGADDEVAELARTFDAMLDRLAGAFESQKRFVANASHELRTPLAVMRTEIDVTLSDPDADLAEYRRMARVVRDASSRANGLVDALLVLARSEAQSGRRLVRKVPADLATSVYNALSAVKEEAERMRLEVTTDLAAAPVVGDPSLLDRLAGNLIENAIRYNHLLGRLWLRTVSVDGQARLIVGNTGHEVEQAEVPGLFEPFRRGGWERTGSRGSGLGLSIVRAVCDAHGGTVSAIALADGGLEVTVSLPAADTTPVVAATASVPRGRS

SEQ ID NO: 12205 - protein, 302 aa, Actinoplanes utahensis
MSQDPYPGQPFPGVPNPNVPPQEGLPPTQPFPGAYPQPQQPAYGQQPPPYGQQQPAYGQQPPAYGQQQPAYGQPAYGQPQPSFPPIPPAPKKSKALPITLISIAIVLVLCVGGVVAINLLAKDDKSKGTATATSTSSTKATEGGAAKPAADITVVEPKTLGGRPKLTTAEFATITKTMQEGLKDGYPGATKSLGAFYGTPVKKNMVMTIAVAAPISDPELELDRNFTSMSTTGFSAEHITAVDTGSFGGSAKCGDGKVSSVPVAVCAWSDSGSVGMLVWYYTSKSAAEKQFPAIRAEIEKVG

SEQ ID NO: 12206 - protein, 687 aa, Actinoplanes utahensis
MIENPNEVVTKALLRSVRVPGLDKPAALITLDNGFDHKKPNSFGPAGLQSLDEAITGALAADPAFIAVTGKPYIFCVGADITGMPLLSSREQAVELGELGHRVFARLRNSTIPTFAFVNGAALGGGLEVALHCHYRTVSSGATALGLPEVAIGLIPGWGGSQLLPNLIGIAGAAQVILQNPLTQKVLRPKQARELGVADALFEAADFLEDSLAWAAGVVKGEVTVERPEIDRDMWDGVLWFAKNQLDEKLHGAVPSANKALELLALAKEATFEDGTAAETEALADLIMGDEARASLYAFDLVQRRAKRPVGVPDKSLARKVTKVGIVGAGLMASQLALLFLRRLQVPVVLTDLDQERVDKGVAYVTGEIDKLVGKRRLDEGTAAKLRGLISGSVDKSVFADADFVIEAVFENLDLKKKIWAEFETIVKPEAILATNTSSLSITEMAAGLQHPERVVGFHFFNPVAVLPLLEIIRGEQTDDATLATAFAVGRELKKSSVLVKDAPAFVVNRVLTRFTSEVFKAVDAGTPLEVVNEAFDPMGLPMRPIALLQLVGPAVAYHVGETLHRAFPERYVDSPNLKRIVDAGLPLLVDDEINADVVKLLEVGDTVLTGDEVRAKALAALAEEIRIMLDEGVVAEAQDIDLCMILGAGYPFHLGGITPYLDRSGIAEQITGQRFLPNGLADVRRS

SEQ ID NO: 12207 - protein, 398 aa, Actinoplanes utahensis
MPREVREVVFVDGVRTPFGKAGGMYAETRADDLVIRCIRELIKRNPQLPTDRVDEVAIAATTQTGDQGLTIGRTAALLAGLPKTVPGYAVDRMCAGAMTAVTNVAGGIAMGAYDIAVAGGVEHMGRHPMGEGADPNPRILTEKLVDPSALVMGATAENLHDRLPHITKERTDLFALNSQLKVAKAYANGKLQPDLVPVAIRSSELGWGLATVDEAPRETSLEKLATLKTPFRPHGRITAGNAAGLNDGATAALLADEATARELGLPVAMRLVSYAYVGVEPEIMGYGPIPSTEKALKKAGLTIDDIGLFELNEAFAVQVLALLDHYGIADDDPRVNPWGGAIAVGHPLASSGVRLMTQLARHFEEHPEVRYGMNAMCIGIGMGGTVIWENPNWEGFKK

SEQ ID NO: 12208 - protein, 433 aa, Actinoplanes utahensis
MTDETPLRRRDAPESAGDGPHAVPPDPSSGGSEAVPLTAPRDGTPAPVESADGLAEVVARMAAGSGPVAVDAERASGYRYTQRAYLVQLRRAGSGTVLIDPLPLDDLRTLDTALADTEWVLHAASQDLPCLAELGMKPRRLFDTELAARLAGFERVGLAALTEHLLGYSLEKHHSAADWSTRPLPESWLTYAALDVELLTDLRDLLATELDKQGKAGWAAEEFASLVASADRPPRVRPDPWRRTSGIHRVRGARAQSRVRALWYARDAIAARKDSAPGRVLPDSAIVAAAEADPKDERTLLAIPGFGGRSVRRLVKTWLDALDQARALPDDALPVNQPVEGPPPPHRWAERDPIAAARLARCRQVVVGTAETYRLPPENLISPDFIRRLAWSPPDEVSAQTVSDTLRGFGARNWQVGLIAGQLAGVLPAPFTD

SEQ ID NO: 12209 - protein, 374 aa, Actinoplanes utahensis
MRSRVPARRFSIDFRVQPLRGLLRIPGCHADTTREAVRMTATYEPFTPEPRRHRAEESWGGQYQRWEPAAPEPRWPQEHPQWPEQARYEEPRPQWQEPPRFEEPRPQWQEPPRFEAPAPAYEAVPAKPTASKARPVVIGLVVLLLLVIGWQAYRIESVIKSSNDLAAAVSSEQNHSADLQKSLTGVFDPEGISTATLPSVYRVRAGDFTGTAFSVGTKAKSGTANLLTNFHVVESVYKAGTRTVQLEQGSTRISATIVKVSETKDLALLVAKKTIKPIKVATTKVKAGQQIVVLGNPLGLDDTVTTGVISAFRENDADGPTIQFDAPINPGNSGGPVVNANRQVVALATAKARDAEGIGLGIPIATVCALFDVC

SEQ ID NO: 12210 - protein, 372 aa, Actinoplanes utahensis
MEEEYADLRPGRPRRAAGRRSLTWHDDPVTVLDDSPFVRACRGLPGPHTPVWFMRQAGRSLPEYRKLREGIGMLDSCRRPDLVTEITLQPVRRHRVDAAILYSDIVVPIAAAGVDLDIVPGTGPVVAEPIRTAADLQRLRPITADDVDYVAEAVRLLVAELGATPLIGFAGAPFTLASYLIEGGPSRTYLKTKAMMYAEPELWHALLARLAEITLAFLRIQIDAGVSAVQLFDSWAGALSEADYREFVMPHSARVLRGLDDAGVPRIHFGVGTGVLLEAMGEAGADVVGVDWRTPLDVASKRLGPDKAVQGNLDPAILFAGWDVVEREARRVLAQGQSAPGHVFNLGHGVMPEMDPDILTRLTALVHEASAR

SEQ ID NO: 12211 - protein, 464 aa, Actinoplanes utahensis
MRKRIAVVGGGIAGLAAAVRLRDVTRADTEIIVYEQSGALGGKLRTGELAGLRVERGAESFLNGSPDGGPSAAVRFAHRVGLGDALVHPAAQPAALAIGGALARIPAGTLVGVPGDLSALDGVALPEADADADTGHPLLAAGQDIAVGELVRSRYGAEVVDRLVDPMLGGVYAGRADRLSLRATMPQLARTAETEHTLRGAVRAAQALSRRTPGQPVFAAVDGGMSRLIGAAATTARARISLGLPVRGITRTGNRWHLTLGPAPQPQTDEVDAVILAVPAAPAARLLADLAPGAAAALGDLEYASVALAGMALPPGTRLPELSGFLVPPGEGTLVKAATFFTRKWPHLTGPDGPVIVRASLGRAGEQERLQLSDPALLAIAHRELSELAGTRLPSPTASWIQRWGGGLPQYAPGHPDRVAAARAALPAGIALAGAALDGVGIPVCVASGEQAADDVNSYLEASA

SEQ ID NO: 12212 - protein, 233 aa, Actinoplanes utahensis
MSEQTNAARINELNATIRYTMWSVFRASSPLPALRDELAGEVDTLFEQLAAKDVTIRGTYDVSGLRADADLMIWWHAADSDDLQEAYSLFRRTALGRHLTPVWSQMALHRPAEFNKSHLPAFLAGEEARPYLCVYPFVRSYEWYLLPDAERRELLAEHGRQARGYPDVRANTVASFALGDYEWMLAFEADELHRIVDLMRDLRASRARRHVREEVPFYTGRRRSISEIAASLP

SEQ ID NO: 12213 - protein, 391 aa, Actinoplanes utahensis
MSGTGLGVAAVQVGVGAVLLDHEHVTAQPEDVVQRAGGQVAEGRDPQLVMRCGVHRHSVCGASSPPSPVPRCSDEATACGGRDDQAQQVVRQQDPGDLQPPGGRAVRGGQCGGHVQRLAAGPARAAGAPQRDPHGQRAAGPGGVRIPLPGDRRRVVRRPGGQRTPPISVSPRAVRRCAGVRQPTPDEGHIVADVKLAIIYYSATGTLHRMAQRLQEAAEKAGADVRLRQVAELAPPEAIASNAAWSQHFDTTKDEPRAAADDVVWADAVLFGTPTRYGNVASQLKQFIDTLGPQWAQGQLANKAYAGFTASMTEHGGQESTLLALYNTIYHFGGVVVAPGYTDPLKFADGNPYGVSHVTGGSNDAPLTDVQYAALDHLARRIVQIGGRLRA

SEQ ID NO: 12214 - protein, 265 aa, Actinoplanes utahensis
MAVDTQYEDLLRRVLETGTRKSDRTGTGTRSLFGERLRYDLSQGFPLVTTKRVHFKSIAVELLWFLRGETNVQWLRDQGVTIWDEWASESGELGPVYGYQWRSWPTPDGHVDQISEILDTLRTDPDSRRMIVSAWNVGQLDEMALMPCHAMFQFYVADGRLSCQLYQRSADLFLGVPFNIASYALLTRMVADQVGLTPGDFIWVGGDCHIYDNHVEQVREQLGRQAYPFPALEIAKRPSLFDYEYADFTVVGYEHHPAIKAPVAV

SEQ ID NO: 12215 - protein, 155 aa, Actinoplanes utahensis
MSVHLIWAQAHRRVIGAGGDIPWHVPGEQAIFKERTAGSTVVMGRATWDSLPRRPLPGRRNVVLTRDPGWTGDGAHVVHSPDLIGEVDFWVIGGAAVYQLFLPVAEHIVRTSIELDVEGDTFAPELGPDWKVTASTGWLTAPNGIRYVVEDLARV

SEQ ID NO: 12216 - protein, 134 aa, Actinoplanes utahensis
MATDETTLPTSEDEWRIRLDPDEFRVLRQAGTEAPWSGEYVNTKTEGMYRCRGCGAELYPSDTKFDSHCGWPSFDDAIPGAVKEIEDRTHGMVRVEIRCARCDGHLGHVFRGEGFTDKNTRHCVNSLSIRLDPS

SEQ ID NO: 12217 - protein, 161 aa, Actinoplanes utahensis
MEAASPTFRPTFQQAFGHGLYLGALSAVASVTTGVIATVVWPGPVGPPAWSWALLVLAPLVLGVVLGITLGRRTGVEVGSREIRTSSLLGEGEVPWNRVVDLRAERRGRRNVVSVYLDSGASVQLNAPYSGGLFAADPQFELKVFALSHLWRSHRFGGLPS

SEQ ID NO: 12218 - protein, 101 aa, Actinoplanes utahensis
MQTYATATERILLMSFVRRLAVGIPAAGVTAFAALAISSPVLAASFDAAHPAVHASADRGNAGYGAASPATTTPAATAPAATTPAAGGPTATVVATTPPAA

SEQ ID NO: 12219 - protein, 33 aa, Actinoplanes utahensis
MVATTVAVGPPAAGVVAAGAVAAGVVVAGDAAP

SEQ ID NO: 12220 - protein, 69 aa, Actinoplanes utahensis
MSPTGGAKTVPGGVSPTEVPSPITTKGSGVSSGSLPLTGRPVGATVAVGAVLVAGGAGALWYTRRRKSA

SEQ ID NO: 12221 - protein, 341 aa, Actinoplanes utahensis
MPKAAAEEHEIAGHPVRLSSPDKIVFAERGFTKRDVFEYYRSVGDGILRALRDRPTTLQRFPDGLEGEAFFQKRIPTRGVPEWIRTATITFPSGRTADELCPADLAHVAWAAQMGTVVFHPWPVRGGTPDHPDELRIDLDPQPGLGFSDVTAAAEVVHEVLDDLGWVGFPKTSGGRGVHVYIRIAPRWDFVQVRRAAIALAREVERRRPQAITTAWWKEERGQRVFLDFNQMARDRTIACAYSLRANRRATVSTPVTWAELPTITPDDFDLRTVPHRFATLGDPHATIDDVHHDLTPLLEWVDRDEKNGLGDMPYPPDHPKMPGEPPRVQPSKKNPANWQS

SEQ ID NO: 12222 - protein, 151 aa, Actinoplanes utahensis
MEFRVAGREDVPAVLALLADDEISRGRGFGEVPAEIGAALWAAFEAIAADPHNELIVGVQDGVVAGTCQLTYLPGLSRGGAWRMQIEAVRIRADLRGGGHGAAMMRWAIARAEERGCAMVQLTSDNKRVAAHRFYERLGFTASHVGMKLIL

SEQ ID NO: 12223 - protein, 521 aa, Actinoplanes utahensis
MPRRSRSVLALLAVLVMTAGGCTLPAFAPEGSTDPATPGGGASAAAAGGTAQWKPCPDVPTKLVGRGAAGVNYDCATVAVPRDWAKPDSGQTYDLAMIRIRAKSQKDRIGSLLVNPGGPGGSGVDLAVYLSFGPGFNGLPTEITDRFDIVGFDPRGVSRSSPLKCIPDAEQDASFGSDPDPVSQAEFDQVTALNKKIADGCGQKYGDQLANFSTEQAAHDMDALRAAVGDPKLTYLGFSYGTLLGATYAQLFPQNVRALVLDGAVDATEDYVTSSETQAKGFERAFGNFTKWCQATPAKCPISADPRGAVTAAMANAEKSPVKYRDGRSATAGWIFVGVISSLYTETGWTSLADAIRDLGRGDAKGILDLADQYAERKADGSYSNLFDANLAVNCSDTEGAPTVDQVRKYQSEWRKKYPMFGAPIAIGMLPCTYWPGKRDPYPTGAAKGAPPIVVVGTTGDPATPYENTAHLAAMLGTGHVLTWEGEGHTAYPSTPCITSAVDGYLLNLTVPKEGLRCPAK

SEQ ID NO: 12224 - protein, 484 aa, Actinoplanes utahensis
MRPQRRHGQQRAVPAAAGQPLLQRPVGVQRRATEPLLVQVEHPAHPPGVDVGEPLRREVDAGGAVVHGQVAHHGPDRVGVGGQRGEPLAVPARVGESSLSCPVHAIDSGVSPRGRVKASPDENSGQTERMQLPIQHPVKPMLAKPVPEIPPGLIYEPKWDGFRSIIFRDGDEVEIGSRNEKPMTRYFPEVVEAVLANFPERAVIDGEVIVADTGRNTLDFEALQQRIHPAASRVKLLSEQTPASFVAFDLLALGDEDLTELPFEQRRERLRQALGQAEAPVYVTPATDDTDTARRWFEEFEGAGLDGLIAKGRELTYQPDKRVMFKIKHKRTADCVVAGYRVHKSAENRIGSLLLGLYDERGVLASVGVIGSFPMKVREELFDQMQPLVTGFDGHPWDWAAHQQGERTPRKNEVSRWNAGKDLSFVPLRPERVVEVRYDYMEGVRFRHTAQFERWRPDREPRTCTYEQLERPVRFDLAEVLTSR

SEQ ID NO: 12225 - protein, 122 aa, Actinoplanes utahensis
MRIPYEYAVIQAVPRVERGELINVGVLLYCQRHDFLSARTHLTESRLLALDPSADVPAVRAALDSWEATCRGGGASAGMRLGERFRWLVAPRSTILRAGPVHMGLTVEPAAELERLVGLLVH

SEQ ID NO: 12226 - protein, 240 aa, Actinoplanes utahensis
MLREVTAIRYVTPLREGGSLPGVVEADDLGTYVVKFRGAGQGPKALVAEVIAGELARRLGLPVPELARVELDPVVARAEPDEEVQELIKASAGGNLGMDFLPGALGYDPNAHPVEAGLASRVLAFDAYVENVDRSWRNPNLLIWHGGLWLIDHGATLYFHHDWARAEAVVHRPYRWEDHVLKPYATALATEGPALAARLTRDLLAEVVALVPQDWLDDGDREAYLDHLARRAERPEAWLP

SEQ ID NO: 12227 - protein, 177 aa, Actinoplanes utahensis
MRFRPTDPPAADDAAAWITGAVPDGWFTEPPEVVTDRDEIIIWGRLPEPDLPAEATDADRAAALAGRITQFRENTRDDRIRVARQVEHRYQRKVAWGVRCGSADELWTHLSAPVMTRLRQPERQVLDTLVDAGVARSRSDALAWCVRLVGEHTEEWLAGLRDAMTKVDELRKQGPLS

SEQ ID NO: 12228 - protein, 293 aa, Actinoplanes utahensis
MEDSRFTRANLLFVGLIAVLGVGAFFTAVQSGRQDSALLFVAFPTVLAVLVALYPTGTTHGTVFRFTTVALLVCAVQLHEGAICVVLAAPLVYLVAHGVTGLVRMSKRRGNHLYALLPLPLLLVGSAEGTSGDLRIHPDQSVEVTRVVALAPDQVRAVLEAGPQPTATRSLPLRLLDVPVPEHVHGDGLAPGDRWTFVYHGSSHGPGGDIVTRVTDAGPARVTWSVIEDTSITGRWVGMRDATLTWHTVPAGTSITLRVDYRRGLDPSWYFGPLQDGLMHAGAEHLLDMLSLR

SEQ ID NO: 12229 - protein, 419 aa, Actinoplanes utahensis
MTLVRYASLLLPAAALLAAGRYPKASRQDRAGAFLAFLTTALGIAVLHEVATASGWWRFAPADGAYRGMPVDLWLGWATLWGPVPTLLHRHVRPQYALAVLLWLDLITMPRLEPLLHLGPHWLLGEALGLILIALPAQLLGRWTATGRHLQPRVILQMILFTGLILWLLPTVVFTLGDGGWNHLVALPRSTLTVLAQVAALLGVPAVAAVREFAVRGGGTPFPWDPPVRLVTTGPYAYVANPMQLSMVAELALLAGATHSLALGAATLGAVAFSTAVAAPHEHGDLGERHGEGWRAYRREVVDWRPRGRPYSAIASASIFIDDDCGPCAATRDFLLRRAPVRLAVVPAATHPTTLWRARYAADDGYSAEGVAAVAAAFDHLGIGWAYAGWFLRLPAVTALAQLITDAQIAPPHPAGGQR

SEQ ID NO: 12230 - protein, 209 aa, Actinoplanes utahensis
MSDTKQRLLDGALAAVRDHGVTGTSARTIAAAAGVNQALVFYHYGSVDELLGAACRQATEARVALYADRFAAVTTLRELLEVGRDLHTTELAQGNVSVLAQTLAAAQTNERLAEPIRATFQLWTDEIEKVLRRVLAGSPIAEVADVPGLAQAISSAFVGLELFEGIDPAGGHRAMEAIDQLAVLVEVMDELGPLATRVLRSRIKKAGKK

SEQ ID NO: 12231 - protein, 488 aa, Actinoplanes utahensis
MDDPRAQRLFGDSTVAPGDLAFSPFRVDRDRIVSSPFFARLAGVTQVISPGGAGLLVHNRLTHSLKVAQVARAIAERIGAAEPDLAEKLGGCDPDVVEAAALAHDLGHPPFGHLGERVLDRLARQRLGLPDGFEGNAQSYRIVTSTEIRGQATIGLNLTNATRAAILKYPWTRHDYPEPHPRFMDPPPRGAAAHPEEPAGGSTKFSAYSTEVGDVRAARAPFAGRVADWQQTVEASVMDTADDIAYAIHDLEDVHRVGVLQQGAVATELMAWQRWGAETDLRRAGGAIESLRRSLHRKEGWIADDDAFAGAVELVRAELVDGLLAQPFDGSVQAEARVAAFSATWTRRLVDSVELTEQAAVRSGHVQLSVAQWHEVQVLKFVQNRFVLARPDLALHQRGQGRLLSSLVEALLAWLTDPDEADRLPRRLRDLVELAESELPADTPQRIGRARGRAVVDFVAGLTDGQAVGLMEALSGRSRQLWTDAFVL

SEQ ID NO: 12232 - protein, 192 aa, Actinoplanes utahensis
MTIDILQAQSQLIVRQRIRLMVNQYEVHAVTPDGQEAGILAFAQQKRLAFKEQVTLYTDDTKQVPVLGFKARQVIDLGATYDVFDAAGVVIGLFRKKFGASLLRSTWVLEQPGWPEIVGQERNAFVAILRRFVDSLSWLPYHFDFVVDGRPAFSVERKWGLRDTYRVAIHEPNLDRRLVAAMAVALDALQSR

SEQ ID NO: 12233 - protein, 368 aa, Actinoplanes utahensis
MAKRVRTRTVVALALGAAAVWAARDLPAQIGARASGARRMRMESSPQFSGGRFRNTVPATEVTAASMPRLFVAAMTDRDARRPHLPVPVVTPPTAPAPADGLHVTWYGHSSALVEIEGRRVLLDPVWSDRCSPSRLTGPRRLHQPPAPLRELPPLDAIVISHDHYDHLDMTSIQHLVDLQAAPFLVPLGVGAHLERWGVPESRIVELDWNESHRIGTLEVIATPARHFSGRGLNRDETLWASWVLKGPTRRAFYSGDTGYFPGFAEIGAEHGPFDVTLVQVGAYGDAWPDIHMFPEDGVAVHADVRGGLMIPVHWATFNLALHDWSEPADRTWAEAKARGVKLAIPRPGERVDVDNPPPVDGWWQQIA

SEQ ID NO: 12234 - protein, 174 aa, Actinoplanes utahensis
MAGRHVSTAADVVALFDALDVHRVQACLGGGWAVDALLGEQTREHSDIDLWLPATHLEWAFRAFAALGVDRLFPTPGDRPWNFVLHDGDRRKIDLHLYETRPDGRLHYGSALTGEPFPAAALSGRGEIIGRPVRCEAPVWAVTWHTGYPPRAADRHDVPLLCARFGIPLPETFA

SEQ ID NO: 12235 - protein, 72 aa, Actinoplanes utahensis
MITRLLGALLAAVAVPFLAYRAGRTHAAWQDARSTRRSLRQDRRTAWAHTARLAAGALVLLAGLTAAALGLF

SEQ ID NO: 12236 - protein, 298 aa, Actinoplanes utahensis
MRTPRTIAVVAHQNKTLGGGLDELRRRLTDHDIKKLLWYEVPKSRKAPKQVRKALREKPDLLVVWGGDGMVQRTLDVVAGSDTPVAIMPAGTGNLLAGNLGIPTDMERAVEIAFEGDRKRLDLGKVDGEHFAVMAGVGFDGAMIKDADGALKDRFGKLAYVWTGIRHVDGDAPRTTIKIDGTAWFDDTASCVLIGNVGTITGGIHAFDDASPTDGWLDVGVATAQGALQWARALGTMAVKRSDSSPFVRTTRARKIDVKLESKLEYELDGGARSRTKRFSASIVPAAVQVCVPAVTDN

SEQ ID NO: 12237 - protein, 322 aa, Actinoplanes utahensis
MALTPAPGTGPSAFLWHSFEVTSALTRRLTPPERYQFGASVRPLLVPKHDPCGAIRDGAFWLAFRGPAGAATLCLTRAAGELLATGYGPGAEWVLDRADAVAGLRDDVTGFPELARRHPVVAKLAGTFTGVRMPATGQIFPRLLRAILEQKVTGTEAHRSYRAICRHFGEPAPGPAGLVLPPDPAMIAGTAYWEFHRHGVEQRRTQALLRAAAVAERLERCADPAEATRRMTALPQIGPWTAAEVVRTVFGDPDAVSVGDYHIPNTVAYALAGEPRGTDERMLELLEPFRGHRGRVCDLLALGGLMAPRYGPRMPVRSFARF

SEQ ID NO: 12238 - protein, 417 aa, Actinoplanes utahensis
MRRSKYRRATGPTWFSGRRRIIAVAATLAAFGGIVTVTQISSASTNPNTKSALAACDNLKAGGQTKLSTNTRRDTYTTDNGTVTQHPDDGSADVATTAQVRARCRDWVMKNVGNNQNNRRRGNNNNGAGQNTGGQNTGGQNTGGQNTGGGQNNGAGAPASQAASAPATNAGGQNNNNGGGQNNNGGGGQNNNGGQNNNNGGAQNNNGGQNNNNGGAQNNGGQNNGGNNGATTPPPGAGLGILTNSCATSNLPAHDGFQKGDRCVSTEFGEVGSAANNPSLLITQAPRVVNRNTAFTLKVSTRNLIRDRFLAAGQGGYYVESSVLQNGIVRGHFHTACRMLANTNEAPAPDPVPAFFVATEDSKGGRTPDTVTIQVPGLPTGGTAQCASWAGDGSHRIPMMERANQTPAFDVVRVRVR

SEQ ID NO: 12239 - protein, 252 aa, Actinoplanes utahensis
MKSWLVGATTVVLAFMLTPAGAAHADDGVPVPPNTGLTDTAKGTVSAADKDFVIKVRLAGLWEIPAGNMAQEKSDDPNIVKIGKSISAQHVVLDELDRAVAKKLGIDLPNQPNGDQQGWLAEMRNASGGQFNQIYVDRLRAAHGKIFPAIATIRASTRNDSVRKLAQQANQFVMTHMTLLESSGIVDYGALPTAAAPVAPGQKGPVPIDNQMIAAAGNGGGVPGLSNTVVLLVLAAALVVGVITTMRIFRSR

SEQ ID NO: 12240 - protein, 143 aa, Actinoplanes utahensis
MTKSLTGTSVARMGQVVENQNGFVLYRFDDDGHDPAKSNCNGDCAKVWPPALTNDGKPTLKDVDAKLVGTVTRADGTKQLTLAGWPLYHYVGDKKPGQWKGQNVNGKWFVVTPTGTKNLTCLPKISKPVAPPSGSDSAGDYSY

SEQ ID NO: 12241 - protein, 57 aa, Actinoplanes utahensis
MVTGVALAALVALPGCAPAGYNAADYGNAAQPAAADVAATPGAASTAGAVDPNVAGT

SEQ ID NO: 12242 - protein, 258 aa, Actinoplanes utahensis
MTQEDHYDVASYALGVLDERDAARFEDHLIECPQCALELESFVQVADVLADVDAEALLAAEKSEQDGLLLNKMIREVRSDRQRANSRRLYSLAAAVVIFAMLSIGALFAGGKWLGSDTSKNPATTAQRGSDQLDPLPDSNGLGIGGTALPGENHSSADSRTNVRGAVGLETKDWGTQISFAVSNLKGPKTCALTIVHRDGTSERVATWTIGAKGWGTAANPAPLMLQAVTGTPRDDIAHVQVQELTPGGGSETLVSIL

SEQ ID NO: 12243 - protein, 225 aa, Actinoplanes utahensis
MHAVAEDRLTPERVRVMARHSGSRWQAIDGGRGAQDDGSVIPRQTARHEAPASGPSHEDTLVKLLYEEHAGPLLMFVLRLTGGDRQRAEDIVQETLLRAWRNAHRLGAQGQQSLRPWLVTVARRIAIDEHRSANARPAETYDRELESFPSTADDTDRVLQSMTVSDALRQLSNSHREILIETYFRGRTVPEAAEALNLPLGTAKSRVYYALRALRTALQQRGVTE

SEQ ID NO: 12244 - protein, 322 aa, Actinoplanes utahensis
MTRMFVDAWDPAYGASFEGGDGEGPASPSSAQVEVDVEVPAAAWAPIDVPAGARAPRVVFLVDGVRRNDAQIWTAEEDGTSYAGLAASFAAGVVRCDLGRGVAELVAARVGRGLFTASPSIADLQAGTVRYEIHRINGTGEASKLPAAVQGPLTALEIEISSAARDTGSDGADLLIVDGPLRNRRQLPRTIGYIKTQQKQYLPTALTAVVTALRPGQRTPVFHLGSLWGGWSWYLRLPGATGAPWSGIVRVECSPELTVDQAIELAGLSGATLPRFASSSYKDPRAPQNLVPIAGLERRLRGMLGDSRVLHRALALATAASR

SEQ ID NO: 12245 - protein, 244 aa, Actinoplanes utahensis
MLSAHGSTAAAQDAIAALFTAAGVRPPATAPEDAEATLIRAAAVAAERAEAAWQRLVERHKQAREQQERRMTLQRESRVAKSLAGHLRANNFERWLLEEALDLLVDGASRILRELTGGQYELMHDKGEFSVIDHHDAGLRRGVRTLSGGETFQASLALALALSEQLAGMSTTAASLESIVLDEGFGTLDAATLDVVAATLENLAARGDRMVGLVTHVQALAERVPVRFEVHKDARTAHVERVGL

SEQ ID NO: 12246 - protein, 401 aa, Actinoplanes utahensis
MRPLRLDMSGFTVFRDQTTVDFTDADYFALVGPTGSGKSTVLDAICFVLYGQVPRWGGARGIGNALAPSAAEARVRLVFESAGDRYVATRVVRRDGRGNVKTSGAGLQLMPPGFDVTKLDTGMDLTDLGEVLAGVPAEMDDAVLHAVGLPYEQFTSCVVLPQGQFADFLHAKPAVRQQILINLLGLQMYERVQEKAAERGKTAETKLTMVDQSLAALQDATDEAVEAAAGHLARMRELTGAVEAAMPGLREARAAESAARDARDTLDAELALLASVRTPDNLDEATGAVTAARDAAARAAQAVHEAEEAEEKVRGELAAAGDPGSLRLALDRHTELSRLVEQEGWFAGKVSVAEMECRDARAAADLAESEHTGAQQLLEQARQDYRDAQQRDRAVALRGHL

SEQ ID NO: 12247 - protein, 383 aa, Actinoplanes utahensis
MRILHTSDWHVGKVLKGRNRHDEHIRVLAQVVEIARAEKPDLVIVAGDLYDTAAPTADATRLVTRALSALRQTGARVVAIGGNHDNGQALDALRPWADAAGIELRGSVRDSLGDLLIEGTTAGGERWRLVALPFLSQRYAIRAAEMYELTEAEANQTYADLIARLIAKLAEPFGEPGVVNLITSHLTLVGASTGGGEREAHTIMGYAVPSTVFPQNTHYVALGHLHRAQRVIGPCPVRYCGSPLAIDFGEEENVCSVAVVDVGVDRAAQVRDVPVTSAITLRTVRGTLEQLATVNLPEAWLRVLVREAPRPGLREDVQELLPNALEVRIDPDMLPERTGARAAERAGRSPRELFGDYLDSRGNAEEGVRELFDQLYDEVSSNQ

SEQ ID NO: 12248 - protein, 581 aa, Actinoplanes utahensis
MIPVSDETSPVGRVLGTADATPLQFWTAVAPGSYLQLDDVVTTRRDLPDREPVTISGVVTQVRARHEGAQFDSDVFAIADGTLPAMVQEAAEITTTRVDPELYVPPAPGAIVHRASGEDRDAALHFDRMERRVPMGTGRDGVPVFLNADFLDGTRGAHVSISGISGVATKTSFATFLLYSVFRSGQLGADGANARALIFNVKGEDLLFLDHPNTKLDDPTRAYYKLLDLPDSPFTDVRVYAPPRPGDPSGAPDVSGRLTGVDAFYWTLDEFCSTKLLPYVFADADDERQQYTMVVHSVTAHLHRFAVPAEGGISIDGRRIGSYGDLVDHIVEQLTDDETRSTWAGSAVSMGTVNAFARRLIGSKRDLARLIRGDLAQRRPHQIKTADSAQVTVVDLHNLPDRAQRFVVGVTLKSEFEEKEKAGTGRPLLFVVLDELNKYAPREGSSPIKEVLLDIAERGRSLGVILIGAQQTASEVERRIVTNSAIRVVGRLDPAEASRPEYGFLPPAMRQRALLARPGTMFVNQPDIPVPLCVEFPFPAWATRKSESGPPPAETLRSIVQSADPFAVIGGRAGGDDDIPF

SEQ ID NO: 12249 - protein, 257 aa, Actinoplanes utahensis
MVRLPAPAGRADPAGDRPTRRVSALPDTRDGLVERYPRADRPTLRVNFIASADGAVSVDGLSAGLQGPGDKEVFDTLRMLGDALIVAAGTVRAERYDALRLTAEDRAWRVAHGLPEFPLMVIVSGSLDLDPEQLIFSDAPIRPIVITHRGAPDSPIRAVAEVLELGDDRVDLAAGVAELHRRGATQLLCEGGPGLLGSMIAADLVDELCLTVAPLLAGGSAGRIASGPPTPPRPMSLRHALTREDMLFLRYTRVVHS

SEQ ID NO: 12250 - protein, 235 aa, Actinoplanes utahensis
MLLRVRVTLPDRPGALGQVARTLGVAGADIVQVVVLERLGGRAVDDFTVVWPGAARVDRLLAGLAAIPGVQVDGVWKAIGAPVNGGHDAELLAQVAANPADGLATLVDAMPGLLAADWAAAAVVPADWASRNGGPGTGHEPQVTYASWRAPSPLRLPEVTPLRARPLTEPGGARYAVAPFGRAGLVLVLARTDEAELPAAAFHVTEVDRVAQLVRAAAVILGDRLDTVTAATVRV

SEQ ID NO: 12251 - protein, 347 aa, Actinoplanes utahensis
MALWRIRATVDDRPGYLSVLTASLALKSVNILAVQVHTTEGGAVDDFLVDAPDAMTEADLLAAVTKGRGRDAFVTRAEAQGLADQPTRALAMAGRLVHEPDSLGETLVALLDATDVRWRPHPAFDRPGVHGGRMTLADPAGGSYEVLRALPAFTPAEYARAQALVELAAAVTRHQRENVTFLLPDGAEVTLRPATADDLAAVAELHRHCSAAALRRRYPAGPPTESRLRRLLEPAGGLTLLAVTTAGRVVGTAGLIVEGQLGEITVLVEDAWQRRGLGTALLRRLRAHAERSGLAALVAHTGADDVATLRTLRRLGHGELARDGALASVTLPLAGQPASLDTPATSG

SEQ ID NO: 12252 - protein, 58 aa, Actinoplanes utahensis
MFCDRCGEATATGDHTGCAAARELEPPRYCPECRRRMKVQVLPTGWTATCVEHGTRRG

SEQ ID NO: 12253 - protein, 331 aa, Actinoplanes utahensis
MPQILDRARARVLDGGAGLDQAGILEILRLPDDDLPELLQLAHDVRMKWCGPEVEVEGIVSLKTGGCPEDCHFCSQSGLFASPVRAAWLDIPSLVEAAKQTAATGATEFCIVAAVRGPDQRLMDQMRQGVKAIREAVDIQVAASLGMLSQEQVDDLVDMGVHRYNHNLETCRSFFPNVVTTHSWEERWSTLQMVRESGMEVCCGGILGMGETIEQRAEFAAQLAELDPHEVPMNFLSPRPGTPFGDRPVVEGKDALRAIAAFRLAMPRTILRFAGGRELTLGDLGTRDGLLGGINAMIVGNYLTTLGRSATADLELLQDLQMPIKALSATL

SEQ ID NO: 12254 - protein, 284 aa, Actinoplanes utahensis
MADWSESLDRLARDRAKAGLTRHLRPRPADDDVVDLAGNDYLGLSRHVAVTSAARSAIAAYGVGATGSRLVRGSTDAHTALESGLAGWLGAEAALVFSSGYLANLAVVRAAAAVCDLVVSDAYNHASLIDGCKISGRPVVVAPHNDPAAVAAILDAHPGRTAAVVTESVFSVDGDLAPLAALHAVTTARGALLIVDDAHALGLLGPAGAGGVVAAGLAGQPDVIVTATLSKSLGGAGGVVAGPARVIRHLIDTGRTFIYDTAPPPAVVAGVHAAIDLARAADDR

SEQ ID NO: 12255 - protein, 304 aa, Actinoplanes utahensis
MSDPGEAGSVGRRPAEAAGATGDAESAAGSVGGAAGTSEAAAGSEGDAAGEPDVKAAARRAATAGEWHGIVLVTGTDTEVGKTITTAAVAAAAQAAGLRVAVVKPGQTGTITGEPTDAETVTRLAGPDTVKMLAEYPEPLAPLAAAKVADLPPLELYEVVDAIRAEADKHDLVLVEGAGGLLVPMGLRPSGEAWTFADLATTLGANVLVVARAGLGTLNHTALTLEALERRGVPAKVILGAWPADPELVHWANLSELVPHLVGALPAGAGSMDPGVFRRSAPGWLTPALHGVLDNWRVWAEEAG

SEQ ID NO: 12256 - protein, 271 aa, Actinoplanes utahensis
MTSEASPGRSAADRSEASRHQVTFTLTIDCGGGGIKGSVLDDAGTMRAHPIRVPTPYPLPPELFVKTLVDLGGQLPTADRVTVGMPGMIRHGVVVATPHYVTRSGPRTRVDPDLFEAWRGFDARTALAEAFGLPTLVLNDAEVHGAGVVAGTGCELVLTLGTGLGCALFDGGELAPHLEMSQAPVRWGMSYDTYIGEHERRRLGDALWSRRVRNVIDGLRPVFLWDRVYLGGGNSRLITPAQLARMGDDVVVVPNTAGIVGGVRAWTLGQR

SEQ ID NO: 12257 - protein, 255 aa, Actinoplanes utahensis
MIAVAGDGRVAGKGPAVLPAALLLDFGGVLADAPAAQRSASPELVLRIYNLINGVLSPGQIQQAFASGGQAYARWRDEDAPDELLQAEVWERFVIRDWPPAAQVPVRGAIARLSYDWAFRPGWALRPGIREALDAYTAAGVPLAVVSNTLSGAAHRDFLAAAGVGDLFAVQVYSDEAGVRKPNPQMIWNATDVLGVDPRACWFVGDSRRRDVACARRADVARAILMPSGRQDPPGSPEPDVVVEDGHELAELIRW

SEQ ID NO: 12258 - protein, 209 aa, Actinoplanes utahensis
MLLDFVRAHTVPAPVPFVPEIRLRQADEPIALWEATEAGGTEQPPPFWAFAWAGGQALARHLLDDPGLVAGRSVLDLATGSGLVAVAAAKAGARPVVANDIDPLSLAAAEANAADNGVVIETNEGDLLDGDERYGVVLAGDVFYSREMAGRVLPYLRRAAGRGSLVLVGDPGRAYLPTGLVKRATYDVPVTEALESCTIRTTTVWQVTI

SEQ ID NO: 12259 - protein, 1004 aa, Actinoplanes utahensis
MPTRWPAALFGGWILLLGVGYAAQPALHGWLVLAGGLSALGAVLFGTYRSQPDDRVPWWLLATATGLSGVGAALGDAPESVTDELLWLAPAGTALLLLSYPALAVALAGFVRRRTGASRDVPGLLDAAIVTSGVALLVWTFVIGPRMSDASVRGLEQLLPVADLLCLGLLIRLETVPGRLVASGYWLGAGTGAMLIADVLRAPAYGQLALYATAGTAALIPSMAELTRRSEAPPAETSRGRLALLAVAALAAPSVLMVKMSQDGQVAGLFLVAVLSLLMLMLVLARMGGIMTSHRQAMGREQALREASAALVSAADAEAVGLAVRTTVAQLLPGDVPHGVVLAISIAQSEPLSPEAAAQAAVDRDTGTAARLVQTRDVDWAVAVRLTQFAETLRCPMVLQDRPTGDPLVGVLHVGAPTWALRELQRSVEVLAGQVALALERIALSHQVNQRNSEAYFRTLILNTADVITILDRQDRIRYASPSALGVFGADPTGYRLPDVIHPGDQSRLEEALAAVRGGDTVQQLDFRAVGAGRTEVLLEMHCRDLSADPSVAGLVVTMRDVTEQRQLERELIHQAFHDAMTGLANRVLFHDRLKHALARSARDGSVVGVLFIDLDDFKIVNDTLGHAVGDQLLIAVANRLAGALRADDTAARLGGDEFAALVENVNDPGAVEETATRILTALAPSIDTDAKPLHAVASIGITTTLEAQDADELLRQADLALYVAKGAGKNQWRRYQRHLHDEMVARLELRSALDHAVNEGHFLLHYQPIVDLVSSAAVGFEALVRWHHPSRGVITPDQFIEVAEESGLIVPMGRWVLEEALRTVADWRRVLPAGRTPYVSVNVSVRQFREAGFVDQVRAALQHTGVPPGSLMLEITETLLMKDDEARVWADLGVLRDMGIRIAIDDFGTGYSSLGYLRQHPIDVVKIDKTFIDDMVTSPQLVGGIVSLARSLQLTVVAEGIEDLDHRDLLVRMGCPLGQGFLFSSPLGPTEVLAWMTSLAVAV

SEQ ID NO: 12260 - protein, 359 aa, Actinoplanes utahensis
MRVVIVGATGNAGTALLRRLRTEPDIETVGIARRVPQDTGPYAGMEWHPVDIGRDDALDRLTAIFETADAVVNLAWQIQPSHDTRQLYRTNVLGSRAVFRAAIRGGVSTLVHASSVGVYSPGPKWAYVKESWARNGVLESSYSRHKVLTERMLDEIESDHPMMRVVRLRPGLIFQRDAGTEIGRYFAGPLLPARLLRPGWVPVIPAHPGLRLQAVHADDVAEAYLRALRADVRGAFNIAAGPVLDPMVLAKAFRGVPLPVPGFALEGAAALSWTLRLQPVDRGWVRLALKAPLMSCDRAAGELGWRPRRGAVDALHEVVAGLADRAGRPESPPLDPAASQPGRLGGLLRGRLPGTGNPY

SEQ ID NO: 12261 - protein, 115 aa, Actinoplanes utahensis
MAKQIITLLTDDLDGGEADRTVEFGLDGVNYTIDLSEKNAGKLRKALEPFLSAATRLGRSGATPPVARRAAPAATSRSSRDQNQAIREWANKNGYPVSERGRIPSNVVEAYHAKR

SEQ ID NO: 12262 - protein, 546 aa, Actinoplanes utahensis
MTDYDIVIVGSGFGGSVSALRLTEKGYRVGVLEAGRRFTPETLPKTSWDLKNFLWAPKLGMRGIQRITLLKDIMVLSAAGVGGGSLVYANTLYQPPAPFFADPHWSGITDWAKELEPHYDQASRMLGVTTQPTMTPSDVVIKQVAEDMGVGHTFRRTPVGVFFGEPGKTVPDPFFGGAGPDRTGCTECGNCMIGCRVGAKNRLDVNYLYLAESKGATVHPDTEVTKIRPDGAGWVVETANGTFTAGQVILAAGALGTQRLLHAMRDTGVLPRISARIGSLTRTNSEALLGAETRKVPAEPFSRGVAITSSFHPDATTHIEPVRYGPGSNAMGLLSTLLVDGGGRLPRPLRFLVNCIRHPMVLAHSLSVRRWSERTIIALVMQTLDNSLTVRRTRRGRLTTSPGHGDPNPTWIPVGHEAVRRIADRIDGFPGGTVGDIFNVPMTAHILGGATIGADADSGVIDPYHRVFHYPGLHVVDGSAVPANLGVNPSLTITAMAERAMSLWPNKGEADPRPAPGEAYEPVEPVAPHSPAVPAHAPAALRRAGK

SEQ ID NO: 12263 - protein, 534 aa, Actinoplanes utahensis
MPRRRLLFLLAVVAMLGQMAFAMVTTATQLTPTIDEPVYVATAEVYTQQHSLRYNFEHPPLGKLIMATGLAFGGAHRLDPAYPGDQSALGRNLLYESGNNPFRLLLAARVPIIVLTLLFGLVVLAFARDVAGPWAALIALALYSFDPDVIAHGSLATLDVPAAGLLLTAFWLAWRGRERAYRYLPLAGVALGAALATRASALPAVPLIALLCGWSMWRAQRSASRRRRLVAGALAAAGVGLIAVAVVWVVYLAVDPHLRWTTPDYLAHPDGLRAAAVQWLPLPQAYRDGLLLQFRLEARTYNGFLLGQAYRGNLWYYLPVALLIKTPLGMLVLWIAGALTMILVPRLRAAAVYVLPVSALLLLVAMTGSRDYGTRYAIFLPMFLAVAAGTVALIRIRRVPWVTAALILFVAISSVRTFPYYLPYSNEAFGGTADTHRNLHDSNVDWGQDLARLAQKLRTDYPGEPVWLVYKGSGVPAYYGINATDPYGVPEDRVHGLLVVSDSRVALAGVKLQRLIDTSRAIDQVGYAMTIYRR

SEQ ID NO: 12264 - protein, 555 aa, Actinoplanes utahensis
MADPDFRQARDFLLAHREDLQAAYDGFRWPRPAHFNWALDWFDVIAAGNDAPALWIVQEDGAEQRFSFAEMAERSSRVANWLRAQGVARGDRIVVMLGNQVELWETILAGMKLGAVLIPATPLLGPADAVARVTRGGARHVIAMASAVAKFDQVDPAVTRIAVGAADGWRDFRSAYASAPEFVPDAVTRADDTLLLYFTSGTTAQPKLVEHTHVSYPVGHLSTMYWIGLRPGDVHLNISSPGWAKHAWSNVFAPWNAEACVFIYNYTRFDARKLMAEMQRCGVTSFCAPPTVWRMLIQADLTELTTPPRIAVGAGEPLNPEVIEQVKAGWGVTIRDGFGQTETSVQIANSPGCPVKAGSMGRPVPGFRIALLDPVTGREADEGEICVAMEPRPVGLMVGYHGDPVLTGERMVDGYYHTGDVASRDADGYITYVGRTDDVFKASDYRISPFELESVLIEHEAVVEAAVVPSPDPVRLAVPKAYVLLAEGWAADGTTAAAIFEHARKHMPPYARIRRLEFADLPKTISGKIRRVELRAAEVAKHADPAATPPGEFTG

SEQ ID NO: 12265 - protein, 308 aa, Actinoplanes utahensis
MGTAPAARRARPPRPSRARLNRPASGGVTATGRGPGRCPRRPERALVTVTLREIRERTYKPIDAWWTVLLVDPLAARLVRLIAPYRRLTPNVLTLVATVIGVGAMVCFARGDTRWLIAGAVLFHLSFVVDCMDGKIARLNGTGTIFGQWLDFVLDRVRVFFCALTLFGGQYARHHDVTYLWLMSAAIFLDLIRYLNGGQVAKVRQTMVDELGALAVPAEAGAPPLSRRGRAGALLRRNRIRTHLFSGIEYEMFVYIIGPLTGLIIGVTVLAGAALLAFELVLVYRFWQQAAGHPARLAAARERVPTSF

SEQ ID NO: 12266 - protein, 746 aa, Actinoplanes utahensis
MTSLPTKPPRAGGDQPVAAAPGAGPVTRFVTRFPKLVLLITLLLAGLAVAFSGDVVSALKTGGFDDPNTDSVRGRQVLSEHFRAADPNLVVLIAKPGGSVDDPDTRAAAQRVTQRLAADPAVTVAGSYWANHLPQLAGRDHDTGMILVHVDGDEDTSADRVAALHEDLGRDFQDQQIKVEFGGFTQINNDINDQVTKDLATAESIAIPITLVLLLLVFGTVGAAGAPLLIGLFSIVSTLGTLRLLAAITNVSVFSVNMATALGLGLAVDYSLLFVSRYREERVTAADLRTAIGNTMRTAGRTILFSAATVAVALSSLMVFPQYFLRSFAYAGIAVVVTTVGAALLVLPALLTVLGDRIDRWALYRPRASSTFWARLAGFVLRRPVRTAAPVILVLAALALPFTHVRFGVADDRVLPKTAESRVVADTVRGQFADTGSGATVVVAEHWGSGTDGRIRAADYAARLSELPAVNRVDSMVGTYQHGVIVIAPGHADPRYVNGDATWFSVVSDVEPYSGAGADLARAVRAVPVPGRYPALVTGPAAQLVDITGSIADRLPVAGILIAVTTFVLLFLLTGSVLLPIKALLLNTLTMSAVFGVAVWIFQDGHLSGLLGQTGTPLAVAIPVLLFCVAFGLSMDYEVFVLSRVIERHEQGADLHTAVVEGMSRSVRVISAAAGILSVSFLAMLTSGVSLIQFFGLCASLAIILDALLVRPVLVPAFMRLAGEWNWWAPRPLRAVHARLGLREHG

SEQ ID NO: 12267 - protein, 1522 aa, Actinoplanes utahensis
MVEFWSNSLAAAHQFRPVPSARWNHETFYSTNFRDTHSTYTDRVAFLDEVEKFAALHHRIPPRRAKAMDPQHRLLVDLAREAVQDAGWERRPFDRATTGVFVGLSTADYKDLTGARLTASLLADGSLSSAADDPALLAAIAEAAKLAIDPPQSFSMAGSLLNMAPATVSELLDLGGPSFAIDAACSSALVALHEAVNHLRTGSCSAALVGGVFLNLTPNALVGFSRVGALSPAGVCRPFDTRADGFVLGEGGSLAVLRPLDDALEAGDRIYAVLNGIGTANDGKGAGPMTPKAEGQEAAMRAAYRDARVEPGSIDFLEAHGTGTTVGDRVEVEAIRRVRAKATDRPCYLSSGKAMIGHTLPAAGAAGVLRTALALHHRTVPPQPAAMDPHSELPLAEAGLSITTEPKSWPQPADDRRRAAVSSFGFGGTNVHAVLSEAPEPETDGDDADGTRPWVVLISADNGELLTSYAQRLSVLIAADPGLTPAAVARTMASRSLLTARLAVMCRSRAELAERLAVAARELAAGATGRLAAGLYASTAPLAPEQRSLAFLYPGQGSLRPGVLRDLVARFPALAEHVRPLADRVDERTGAPVTDLLCDTPNPGDEERVSATRICQPGLGVAGIGMTQLLAEMGVTPEVTLGHSVGEMAAAVAAGALTPDDGIEFLIDRGAAVTSGEEPPPGTMAAVRIDAAGFEQLRIGIDGVWAGCYNHPTQIVASGHRDAVGRLVERCRDRDVPVAPLRVSHAFHSPLMSEVDLRVGEFVAGLPVRKPIRTLVSSVDPAAPTDSETLRALWARQGSAPVLFRDAIDQAVRVGAKILVQVSAGDALLGMAAQTPAARGLDAIALMPAEPDDGYALLEGLGRLAVAGVPVNLTPLFEGLGVPLATLPPSPLATQHYSIRRTPGSASLSRFVSKKETAVRETPPTRREAQPATGIRNGAQTPVNDVISLLREQLAVLRDIGAEPGAEPAAGAVAEVVAAPPAPPALPAAKEAPEKAAPPKVPAQQPRKTEDKQVFTEVAAMVGKISAYPADTVRPDQTFGADLGFDSIMTAELIAAAKRRWPDLDLAPEQVFGIETVGELVQLLQQALGVSAPAPAATPAPEPVQDLVPRAGDVRRPEVADVTKLPEVVQFEARGNILERVGVANPYYIVHDSVINARTSVHGRQLISFSSYNYLGLSGHPMVNYAVKEAVERYGSSVSAARILSGNRALHDELDRSLASLVGAEDAISLLGGHSTNVGIIGHMVGPEDLIVHDALAHDSILQGCRLSGANRQPFPHQDLAALDALLTRIRDRYRRVLIIVEGVYSMDGDICDLPALIALKKKHGALLMVDEAHSIGVLGARGGGVGEHFGVDRKDVDIWMGTLSKSLASCGGYIAGRHELIEYLRYTLPGFIFSAGMSPANAAAALAALHIMREEPQRLKVLHDRAATFLRLAKQAGLDTGPSAGTPVVPCITGDSVKALKLADMLLKNGVSANPIMYPAVKERLARLRFFVTAEHTVEDIETTVDLLARHLDPARVPQPA

SEQ ID NO: 12268 - protein, 156 aa, Actinoplanes utahensis
MSVSVWVKRPLRLVLCVMKHTTMRWLAAAVALAGLAASSPAQAAPSQPRFAPIRMNATAYYGTLDVIARETLGLKAHFTTWDGHPVAGLPIQFTTTGERFPMCEATTDFAGWAECKNGPVPPPVSLANLLVNGYDAVWLGNRRFAPVSAHNNIGIG

SEQ ID NO: 12269 - protein, 349 aa, Actinoplanes utahensis
MKPGRRTGWLVGMTTMTERPRAAGSDFAELSRRINAAGLMRRRPGYYALRLGLVAAALIGGWTAFALLGASWWTLAVAVLLAVVNAQVALVAHDLAHRQVFRTNRPSSRAGLIAGNLAIGMSYGYWMDKHTKHHANPNHDDLDPDVGPGVLVWSREAAAGRGFLTRHQAWFFFPLLTLLGISLKHDSVRALLDGTVKRRGLEFTLLTAHFIGYVAALLLVLSPVQALAFFVVHQALFGVYLGLTFAPNHKGMPHPDGTEDFLRKQVLTSRNVRGGRLVDAALGGLNYQIEHHLFPAMPTPNLRKAQPIVRRYCAEIGVPYEMTGLVESYRQALRHLHEVGTDLRGAGRV

SEQ ID NO: 12270 - protein, 431 aa, Actinoplanes utahensis
MMRMDSRDWIRNGLRAVLGGLLGIPLAVLNLVLFAFSVIALILSVVPGLGFVAFPAVTRLVRARADLARRLDGRVGLPIARPYKPAPERARLGGWRHYRWILTDQATWRDLAWLVPGASIGAVLGALIIALPLYGLEGILLVPLWVWLGTGWYGYGVIWPFDTVGDALLSLPQGTLFLIIGVAAAPYLPRFGALFDRLLLAPTRNAELRLRVSQLTVTRADTVDAQAAELRRIERDLHDGAQARLVSLGMTIGLAEEMVEADPRGARRLLAEARENSSAALVELRHLVRGIHPPVLAERGLDGAVRALALALPIPTTVEAVLPGRLDTPVESAAYFAVAEALANTTRHSFARVAQVELRHTGNALVMRVSDDGLGGADPTGGTGLRGIERRLAAFDGTMSLSSPPGGPTVVTMELPCVLSSPKITPSSGTG

SEQ ID NO: 12271 - protein, 212 aa, Actinoplanes utahensis
MRVVLAEDHALLRDGLTRLLTAHGCAVVIAVDNGPALLPALVEHRPDVAVVDVRLPPTFTDEGLQAAIAARGVLPGMPVLVLSQHVEPLYARELLSDRSGGVGYLLKDRVSHVAQFVDAVRRVASGGTVMDPEVVHQLLVRRRSPLSALTAREREVLGQMAEGRSNGAIAARLFIGEKAVSKHINNIFTKLDLPPSDDDNRRVLAVLTYLNP

SEQ ID NO: 12272 - protein, 352 aa, Actinoplanes utahensis
MTFKRSLSIVLAVVAALATPQPASAAPASWKLTPTGTTARFRGLAPVSATVAWVAGSAGTILRTVDGGRTWISVGPADAAALQFRDIEAFDARHAVALTIGTGTDSRIYTTADGGHTWTRSFQNEDAAAFYDCLTFLDRRHGLALSDPVGGRFRILATGDGGRTWSVLPDTGMPAAQDGEFAFAASGTCLVSAGGRAYFATGGGATSRVFSSRDLGRTWQVTTTGIPSGPSAGIYGLAFRDSRNGPSSGDSGNGLAVGGDYTAPAAAPAGAAFTRNGRAWTTATTPPGEYRSGVAWAAGPIALAVGPTGSDISWNAGVTWHRFDTGSFDAVACTRLACWASGEQGRVARLSF

SEQ ID NO: 12273 - protein, 566 aa, Actinoplanes utahensis
MQVSPASLRARIPRPRRPAVPFAAIPVPNPRRIIRAPLSLTGAGLAAVFFSLAFTPSLLPRTGILQGVVAGITAAMGYALGTAIGALIRLRFRFSPRVVRIWWRVLAVLLLPMIATCLVLGVRWQRELRMRLGMAPAQEYDIVRTVGASLLTFGLLLLIARALRLATHGCAQVFRLIVPDRAAYCAGTVVVAVLSYGAFDGLLVAHLFAVADRSAAVINSGTGNGVHVPASALRSGSSQSLVGWDTLGRQGRNFVASAPSRQELTDFVGRPAQEPIRLYAGLASAGTMRDRADLIVREMDRTGAFQRSVVALFTPTGTGWVDNKVTQSLEYMYAGDTALVSMQYSYLPSWIAFLGDRSEVVDAASALITAVRARWSTLPADHRPRLLLFGESLGTYGIEATYGDAAGLVNGADGVLMEGPTFANPIHRRLTRDRAGRSPVWDPVYPSLPVGFADTAEELRDQAGVRPRVVYLQNSSDPIVWWNWSLLWKRPPWLRGDRGPDVMPSMHWFPWVTFWQTTCDLVFANQAPTGHGHVYKSGTVDGWATVAPPPGWTVADTVRLRAKLGN

SEQ ID NO: 12274 - protein, 793 aa, Actinoplanes utahensis
MPGAGGHRALPMVRFHRLEPDGQPGPERRGDQRTGHLGEPGVPGAAGARGAARPADRPAEPAPDAGRAQLHAAPRPGGRALRRPGRVQAGQRRVRARGRRRVAASGGRSAQRLHPGRGRAGPGRRGRVRGADARRAGPERRGRDGEPGAGRGGDAVPDRRPAHHHRRQRRGAPGRSRGGSGFRAARRRPRYVRDQAVRREPCPAGGAGECREAPRARRRLVHTGCMNSRVLSRRDLDFLLYEWLDVTSLTARERFADHSRETFDAFLDVSQQIAERDFAPHNRKSDLNEPTFDGERVTIIPEVGHALRVFAESGLLGATMDAEHGGLQLPHVVQRACFLWFQAANTATSAYAMLTGGNAHLLLAHGTQEQIRRYVHPMIEGRYTGTMCLSEPQAGSSLSDVSTRAVRQEDGLYRLTGGKMWISGGDHELSENIIHLVLARVAGAPPGVKGLSLFIVPKKLDSGERNGVTLAGLNHKMGYRGTTNTVLAFDDALGELVGEEGRGLQYMFHMMNEARIGVGSGAVALGYTGYLHALAYARERQQGRPVTAKDPAAPPVPIIDHADVRRMLLAGKTYVEGGLALVLYAAKLLDEPSPEHSLLLDVLTPIVKAWPSQWCRLADDLAIQVHGGYGYTREYPVEQFYRDNRLNSIHEGTDGIQALDLLGRKVTMHGGAGLTLLLDRIRAVAAASPADLGDPVRKACDRLAATTAKLWADPATALANATAYLDAAGHLVIAWMWLEQLAAAGDRPGDFYAGKRLAARYFVTHELPRIGPMLDLLDSGDTLLLDLEDAWLG

SEQ ID NO: 12275 - protein, 319 aa, Actinoplanes utahensis
MAGKATVIEVGDHDVRVSNPDRVYFPELGATKLDLVEYYLAVSDGIVRALRERPCMLHRFPDGLAGEKVHQKRVPNGAPPWLETVRVTFPRYHRYADELCVTKPADVIWAVQMSTVEFHPWNSRRADTECPDEWRIDLDPMPDCPFDTVRRVAPIVREVLDELGIAGYPKTSGGRGLHIYVRIEPRWGFSDVRRAALAFAREVERRAPRDVTTTWWRKDRDPSALFIDYNQNARDHTIASAYSVRGVPEATVSTPITWDEIAGVQPREFTIRTVPARFAELGDLHATIDDVHHRLDTLLEWADRDEQAGLETPEEPEGT

SEQ ID NO: 12276 - protein, 111 aa, Actinoplanes utahensis
MRQPSEQVRAGAGVFARSGVLLALIAVLTWAGEGVNGVCSRDDGAVAGLATGVVIAVLGYPLLLVAGFRRTRRNRARRGLLIGWSAALLVAVALILAAGDHVRGLPAGCPV

SEQ ID NO: 12277 - protein, 444 aa, Actinoplanes utahensis
MVVAEHHQRQEEVVPRRGHREQQHGDRGRAPRAAPSRSSPGSAPARTRPPGAHSGGPADPRTPGSSARTAGTDVHRRRGVTCRKLGAVGGGTLRREVTLRDVAELAGVSSRTVSNVVNGYANVTERTRSRVQRAVEELGYRPNVLARNLAQGRSGQIALVVPYLDTPYFSELLQSVLRAARARGYNVLIDQTDGDPEHERAFIAHGSRRLLFDGVIFSPLGLDQQALADHDPHLPLVVLGERSSDGTFDHVGIDDVAASRQATEHLLDLGRRRLAAIGDQPYASGEAAQLRTRGFREAHTARGLAAREDLIIGTPRFNRRDGAQAMAHLLDRADPPDAVFCYSDLVALGAIHTLVGRGLRVPEDVAVIGYDDIEDGAYANPSVTTISPDKEMIATTAVERLLLRIDSPTPPPALELRAPHKLIIRESTAGRTRQTGQPAGSPRT

SEQ ID NO: 12278 - protein, 502 aa, Actinoplanes utahensis
MLRARVALNPGAVVAPVNRRTFGSFVEHLGRCVYTGIYEPGHPGADEDGFRTDVLALARELGVTTIRYPGGNFVSGYRWEDGVGPRDQRPRRRDLAWRSIETNEVGIDEFARWARKADVEIMYAVNLGTRGVQEALDVHEYVNHPEGTALSEQRRANGAEKPYGIRIWCLGNELDGPWQIGHKAAQEYGLLAAATARALKSAEPDLELVVCGSSSSTMPTFGAWESTVLEHAYDVVEYVSCHAYYEEHDGDLGSFLASAVDMDHFVNSIVATADAVGARLKSTRKINLSFDEWNVWYLSRFQNAPLPNEWEVAPRVIEDRYNVADAVVVGNLLISLLRHSDRVTAACQAQLVNVIAPIMTEPGGPAWRQTIFHPFARTAALAKGEVLETRVDSPTYQTARYGEADLVDAVATHDPATGDVTLFVVNRSQDGPVELTVDLAAFGAGLAVGESVTLADDDVRAVNTRDDPERVTLHPTAGITVDGTTVTVPLPRVSWTALRLSR

SEQ ID NO: 12279 - protein, 105 aa, Actinoplanes utahensis
MRRKRTFLLTSLATVAALGTAWFALPASAASATATLRTVSDWGSGWQDEVVVSNDGRSAMTSWKVEFDLPAGTSIGSFWDTDMAAAGSHRTFTNRSWNGAIPVGQ

SEQ ID NO: 12280 - protein, 432 aa, Actinoplanes utahensis
MTFGFVGSGAQPVNCKLNGAPCGDSAPVPVPTTVPASPTAPATPAVPATSAPATSGPVTTSAPATIPPREALLPVTVTNKTGRGDAVHLYVLGVNLDTGKLGYVDRAGRFTAWSGGGAVPLAAPDVSIPGPATGASTTIRVPRNLSGRLYFSFGRKLDFRLTRDGLVQPAPWAAGDPNHDILFDWSEFTVNSSGLWLNSSQVDMFAVPHTVSVTGGSGTTSSTGTPVANGRQRVIDAIKASPDFARSVVTRSDGTVLRVLAPGKAADAGLMSPTYLDPYIATAWNAYTGRTLTVTPFTDRPTVRYLGRTSGNVMSFTDPAGRVVASFTRPSTADVWGCDGALGAPNDQVVGPIARTLCAALQRSTLGRIDTQPAGRAADFYQGNPANLYAKAVHAAMLDGKAYAFAFDDVLNQESLVHDGDPRTAAITFTPF

SEQ ID NO: 12281 - protein, 401 aa, Actinoplanes utahensis
MARPAPRPTTGPPGRTFAWSSPSGPAIDEQHLSQPVEPFSPQPWSPLDQAADAIADATTDATTDAAADSPLTLLRELDRSVAATLAAGAPSGTAEWRVVETRLDRLDDLIVRVGRLPLVADPQALTDRLAELRRTDIRACLREIDRACRQLGAVEHAWHDDPESMTDLLDTVIEQLENRGEPEIRTLPGPAGGLDGSAPRRPIADLTIRDSRAVVYGCGTTVHVVHRCTVERPVIEVASLLDYDEAADTEAWFHSVEPVRATGTDGMQTRIIRSSGVSIGTGSRQHSVFTHRIPSCTADLGAVVALPPVRQAILDHRRSGGTPEATAALREAVRRAVDGVDVSVLVPDGMVARLAADRLRTPSLRGGGPTLTIRHGAGVAVGWDTSVTGETRIDVGRPTVR

SEQ ID NO: 12282 - protein, 1362 aa, Actinoplanes utahensis
MKHPGSGSRWMRILIGAALVVAMSPAPVHAAAAAPKPKLAHSVTFDGYSFLIDGRRTYLWSGEFHYFRLPSPSLWLDIFQKMKAAGFNATSLYFDWGYHSPAPGVYDFTGVRDVDLLLDMAQRAGLYVIARPAPYINAEVDGGGLPGWLTTKDEQNRTDDPRFEAHADEWLTQIDRILARHQLTNGTGSVIAYQVENEYYTGTTAGRAYMQHLEDKAKADGITVPLTGNNNGTFNSGTGALDVDGPDSYPQGFNCSNPAAWQGVPDISYDHPAGRPLYTPEFQGGAFDPWGGPGYDKCAQLINDQFANVFYKNNIAVGATAQSFYMTYGGTNWGWLGMPENYTSYDYGAAIRETRQLDPKYYQDKLIGFLTQSMPDLTKTDKIPVTAPDDPAIVDTARRNPDTGAQFHVLRHNDSTSIAVDRTHIAIDFNARAGTSYTYDDADPALQYTGAWSHVSNQSYTGGDYHNSESFSNVAGDSLAVDFTGTAIRWIGSKTNNHGYADVYVDGAKQATVDTSGSAAQAVLYQAAGLATGPHTLKIVVTGTHAAGSTDDFVPVDAIDLPPAVATAEAVYPRVPQKPGTAITLNGRDSDIIVADAKLGDSQLQYSTSELLTDARIGSRDVAVLYGDPGTDGETVLRFGSKPAVQVTGGPVEQTWDPATGDLRLDYTHSGLTRVSITPAWGHPLQLLLADKATAETFWRQDTAAGPVLVRGSHLLRTATSAAGGRALALTGDNATDPTIEVFTAATAIRWNGRPLRTRSAGPGSFTAAIPAAAPVTLPALTNWKHQAESPEAQPGFDDSSWQVADKTSTFSVTGPGSLPVLYADDYGFHTGNTWYRGRFRTSAGTTGVHLSSDSGGGAQAFSAWLNGVFLGSSTSGSGDFTFPAGALRTTGDNVVSVLTVNMGHEEDYNSSNGNKAARGLTGASLIGAPTAPVTWRLQGVRGGEREIDPVRGPLSTGGLYGERAGWSLPGFDDRAWTSTTLPNRDTTPGVSWYRTTADLRLPAGQDTSLGLTVTDDPPHRYRAELYVNGWMIGNYVNYLGPQHSFPIPNGILRTDGRNSIAIAVWNLDGSTGGLGAVSLTDYGSYASSLRVADVTSPSYDPRKYALPAAPDVHVDLQVPASVQPGTAFTATATVTGPRSVSDVVPALTAPAGWTVSAPSPARTRALPAIVTWQVRPPTGAQPSTAALTATVAYSERGRRSTARDERIVGDYSPPPAGSVAVSDLPLLSATNGWGPVERNQSNGEQGAGDGKPITIAGQTYAKGLGTNAVSDVAVYLGGKCTRFTASVGVDDEQKGAGTVTFTVAADGKTLATTPVLKGGQAAASIDVDVTGAQALDLVVGDGGDGNGNDHGDWATPTLTCS

SEQ ID NO: 12283 - protein, 70 aa, Actinoplanes utahensis
MALRHGSQRRAGAGPEGLGQRHVHPATPWRPRNEAYAESVREAFLTGASPSDFPAEDYEKDRPDRFRPGS

SEQ ID NO: 12284 - protein, 44 aa, Actinoplanes utahensis
MTHHRADPTAIRSLASSPLSRTGRYPDLMAALSGIPDVRAGDSV

SEQ ID NO: 12285 - protein, 171 aa, Actinoplanes utahensis
MTALIISVSWPTLVLVLIFRGQFKEKSIAGRPTAPLIIGGMGILIIILNAWWFTLTPAVWAYLVVSAGIGALFGALRGRAARVYWSPQQKAAVRRGGVATCALFLAGLVAHYLAEVAFLQKAPILAYGGALTVNIYLAASIGAAGTVYRRRARALRHGHKLPMTALDPSSC

SEQ ID NO: 12286 - protein, 208 aa, Actinoplanes utahensis
MQTFTDLVREPKDAASFTERQRRAQLTAATIDLIAESGIEAASFAAIAGRTGASKGTIAYHFGSREELLLAVTRSIYRDAADAMSPVRQEACAADALRSYVATNIAWIAARRQATVALIILRTSGVSAVRTLCAAVDEAILADLSALIEAARAETGVPPAGTDDLARALRGAIDAFAIGLARRSAHLDADAYTAVLHHLFAPTAAASR

SEQ ID NO: 12287 - protein, 37 aa, Actinoplanes utahensis
MMEYGAAWTTLADRMGNPFDVGSSLAAAHRLTMRINF

SEQ ID NO: 12288 - protein, 346 aa, Actinoplanes utahensis
MPPASSRNHSRDSGRNAIHLQNPATSGYRGDMLRSVAVLTMSGVAPFELGVLCELFGYDRSAEGLPAYDFAVCSVDAKPVRSRPGFTIAPTHDLAPAETADLVAVAPNDLRPVPAEILDVLRRAHARGAWVMSVCTSAFTLGEAGLLDGRRCTTHWLHTAALAARFPRAEVDPDVLYVADGTILTSAGTAAAIDSGLHLIREEQGSAVAAQIARRMVVPPHRDGGQAQFIETPMPTVSCETMQPLLTLLLETLDREHTVDTMADIVHMAPRTFARRFRAETGATPHDWLTAQRVLLARRLLEETDLGIDAIADRSGFGSAQTLRHHFTQRLSTTPQAYRGTFKAKV

SEQ ID NO: 12289 - protein, 40 aa, Actinoplanes utahensis
MEIAMLVFFVLLLAASLAGLTADSRDSADWKPTNDGRRAA

SEQ ID NO: 12290 - protein, 565 aa, Actinoplanes utahensis
MHLSRSRFAAAGIAGVALAASVSVPAQAAATGVDAVPTPKLGWYKCYAIAECATVQLPLDYDRPQGAKTEIAVLRVKAKDQKHRIGSLFVNPGGPGGSATDFALGASDFLSDELLQKFDIVGVDPRGIGASANIRCFKTVKDQTAVVDQLNIAFPLGRKQEASYVAGARALGKACSSTGKPLSGAVSTTEVARDMDVIRRAVGDRKLTYLGFSYGTALGEYYANLFPDRFRALVIDGNLDPRAWVGAGAAGNQILDARLHSADGAYRALKEIFKRCDRAGEKYCSFAAGDPEKNFAAIAASLKAKPLVITDESGTYTITYADFVSAVLGGLYSTYAGESAMDTAAQVAALIKGDSPAAVAAARTTLLKRIKAARSVGYDFPYDNGLEAGTAVICTDGTHPKNAATWPAATAARDKQAPYFGRAWGYIDTPCARDTWTVRDEDAYRGPFNHRTAAPVLIVGSFWDPATNYDSSVAVSRTLPNSRLLSSDNWGHTAYGTGDCATAAIDRYLLNGTLPAKGTVCAAEHQPFTEPIDPGTVATRVAAAAAVHGKRLPPVVSLRPKSILG

SEQ ID NO: 12291 - protein, 213 aa, Actinoplanes utahensis
MSIAWPQVFLSCVRRRTGGLSPAAVLLSVAMPAGWLTYGLLIGDRIQVVSNTLNLIAGVAVLIALLAGRPNLRGAASIAGPVFFAICAAASSVLLPHVTAARAGALLGTVLALSSLLSALPQPVALLRDRAQDISGLSAARFRLATAASSAWLVYGLGTGQPAVWASALVGVVSAVTVCFVLTGRRTTVDPAAFGTPQWRDTVITRSLAVTGV

SEQ ID NO: 12292 - protein, 388 aa, Actinoplanes utahensis
MLTDVDLPAPGLLWTRWAALSAVTTGTDRGTLWSVDPSGARHDDPATGWARFALLDGRRAVLYGAHHDHHAAVSADPAADPLTGAPDWLPWSELTSLAESDQLGFVLWHDQGRWSRVRYRRPYEDGLADVLWPLLTEADAVAALHARHPRAVGRTTAAALLHAAIRGEVDAGHLTALLGEEADIPAALAIAGRAGLTPGTTPPRIPPGRRPAMRRVRHLSHGEHDRLVWAAMHDAAELRRPAPPDTEELGELVRWLRERAPAGDGRCSLLAYADATSFSSQPGDHPPASRPAEERYAAFRRLTELVRALRRAESDPRYGRWLFVRVETTAAGHEIERCYDSWPAWWHDDGVSGPWRTDLQEETDARHDRWRPSWTPLLDPEIAYRPTS

SEQ ID NO: 12293 - protein, 189 aa, Actinoplanes utahensis
MTTVFTEHLTGLGEFSLVRLDPAAHADLVHTWVTRPRNRFWGMLDHTPEQVREIYAFVDSLDTHHAYLQLIDEGPIGVFQTYQPEHDPVGGCYDTRPGDFGLHLMFDPGDRHLPHLTSVVIPALLRFCFRDPAVRRIVVEPDVRNTRAVTRMRRHGFEPGPEIDLGHKRARLAFLTRDRWAATGQEVGR

SEQ ID NO: 12294 - protein, 594 aa, Actinoplanes utahensis
MRVYRDAYGIPHLRAGSVLELACLQGRVTAADRGRQITVERLRSLGRLAAVAGPDEVPWDRFARRARLDDTARRCFAGLPDETRRFLTAYADGVRAGGCDWDPWSPLGVFQVQHILFGTFPHKLWREHVERTLGPAATGWFSVEGPPGGSGSNAWATPGQIAGDPHRLLELPGVYQQIRLACDEFDVAGLTFPGVPGVQHFGHAGEVAWAVTNAMADYQDLYREEFRETPAGLEARGPDGWEPARRHRETIDVRGAEPVPIDVIETARGPLIDSGLTLRTPARVSSDLGFGALLPLLRARTAGEVADAFAGWVEPVNSVLVADSAGTLLQLTAGRVPVRDDRNRQVPVPAWEPRHTWQPAWAPGFRAPVARAVNANDRRPDTAPYGVDFCPPGRAARIRELLDRGATAEQIHMDTALPAGSPGHQAWSRSQTARGLHGHPALRPLFAPSGYDPLFTPWTDPRARIGHHLDGVLDGLGLTVTDTPAPGPWGARHLLAPVVLTGLDVTVPRVELGGSSGCVLNTSSVPGVSDRCTRGPVARYVWDLADRQRSRWVVPFGALDDPGSPHFSDQLPLWANGDLVPLVTDWDRLTLEPR

SEQ ID NO: 12295 - protein, 735 aa, Actinoplanes utahensis
MRLIPLDLDRDLELLHRWVTHPRSRFWGLQGAGPDRVRAEYQRIRDDPHHHAWLGLDDDGTPLFLAETYEPAHSELAGHYPVRPGDIGMHVLVAPPSRPRSGVTSAVLRAVLDFCFADPRIDRVVVEPDVRNEAIARKNAEAGFVEEGQVRLRDKVARLSFCTRTGYEMSVPHLRPAVMAYAHRRLIAKAIAEFSHERLLAPEDLGDGAYRLGALTFRARRFALEHWVVDPDSLDGPLDALDFISGLRETLGIPERLLGTYLEEIAATLAGTAWKATHRRETAAQLVHADFPTIETAMTEGHPGFVANNGRIGFGLRDHEAYAPEAGRPVRLRWVAVRKDASLFVTDGDERAHYLAELGAAGLERHERYLSSLGLAPDDYRYLPVHPWQWEHKLTVTFAADVARRAIVPLDEGTDRYRAQQSIRTFFNVDRPDRHYVKTAIAVQNMGFLRGLSPKYMRDTPPINEWVAQVVGGDPELRACGFGVLREVAAIGYTGDAYHRAGTAGAYTRMLAALWRESPVPLLAEGERLATMASLLHRDRAGDALVTALIRESGREPAAWVAAYFRAYLRPIVHCLLAHDLAFMPHGENLILVLADHVPSRVFLKDIGEEVAVLDDRPLPPRVERIRAEVSDEIKELALFTDVFDGFLRHLAGILAVDGVLAERDFWTLAGDCVRGHAKDHPELAGRLNLLRPTFRHSCLNRLQLRDTLQMVDLTDQAGSLIFAGELENPIAVFG

SEQ ID NO: 12296 - protein, 492 aa, Actinoplanes utahensis
MRRADAPAAAAAVPRRRRDRRRDHRRRPSLAEVHRAQPRHHGRAPARHAGPDRGGRRAARPGGAGLMRTYDFAAVGVGPFNLGLAALTENVPDLDGVFLDARPGFDWHPGLMIEGVTIQVPFLADLVTMADPTSRFSFLNYLKQVGRLYPFYIRENFFPLRAEYNAYCRWVAAQLPAIRWNARVDTVTHDGEAYLVHTAAETFRARRLVLGVGTAPHVPAVAGRVPHVHSADYLAHRDRLRTLGSITVVGSGQSAAEIYHDLLAGIDTYGYHLSWVTRSPRFFPMEYTKLTLEMTSPEYIRYHHGLPMATRDRLAREQRHLHKGISADLVDAIHERLYAGSLTGPVPTSLLTGVELTDVTWDAAAGRYTLGLHHREQDRSFATNTEGLVLATGYTPRVPSFLEPVRDRINWDARGRFDVAVDYSVDRTGKEIFVQNAEEHTHSLTAPDLGMGPYRNSVILRGLTGREVYPIEERIAFQEFGVPTRQLVTTCG

SEQ ID NO: 12297 - protein, 481 aa, Actinoplanes utahensis
MEPVLPHLFSGSTLDAYTSAVWHASALLADRVKAVRQPYAGATVAELREQVDAVDLDRPLGDTGAALHEVARLYLDNAVWFHEPTYVAHLNCPVVIPALSAEVLLSAVNSSVDTWDQSTTATLIERRLVDWTAGRIGFGPDADGVFTSGGTQSNLQGLLLAREHALERRDRAEALPRLRIFATAQSHFSVIKSAGILGLAGDAVVGVATDGDGRMDAAALAVAIDDVRRAGGIPMAVVATAGTTDLGRIDPLPAIAAVCGHQRIWLHVDAAYGCGLLVSRRRRHLLDGVERADSVTVDFHKSFFQPVSCSALVVRRGESLSRIAVHADYLNPRAATVPNQVDKSLQTTRRFDALKLWMTLRTIGADRIGDMFDTVVDRTHEIFAAMRTRSGFETLAAPTLSTLLFRFRPAGMSVAECDELMPRLRQRLFHDGAAIVAGTTVDGHHWLKFTVLNPATTAGHLHDTLDLIEAAAVLHGPAVPA

SEQ ID NO: 12298 - protein, 190 aa, Actinoplanes utahensis
MNVRDDPFTGGVSPRYRRIDRELTTAIIDAQCRDWTADRPDRVGFARLGHVRHEVRNAAARYRVQPSAISSVTVPVALAAVALVVLPLVLLIPHATRPLPLAAIAVAGVWAAYALRAGLRHLQVRRHRRAADPPAPIDDPFLYARLRRAIESCAAAARADRHYPRRAAAADLEYALDWLSAAQEELPRLR

SEQ ID NO: 12299 - protein, 729 aa, Actinoplanes utahensis
MRWSWPVLAGVVEVTLQAVDGLAQQQVRVGQPGQHRIGGHRAVQGRGVPVGAAGVAQTGRHQLHPGPFQGERDCHQPGPRRVREWRQVGGYAAAAQDGGQVQGGGQHQGGEHGHGGRGCLRRGGERGAQGDHHGGDGSVHQHRGQGGAAGEQGGQDGVGGGEPAAGGADPDLFHVAVPGEFGEAVGDQRTHGADFGGQRANRRHTQQNRTDGAVVNCQVSASGRRHPAAGRAMVDRWAHVHGVAADRPAVRRQWLKLPAGTVARTRVAAVAVGGIGIVMQLGQLGNAMRPVAFSRVSGASIVALVLLLVVMHRRQRSGWWSVPVIPVLIAVGAAGLRDPLAATALSLATLITCTLYDTPRRWLARVVAALVALPAAVAISPDVLPQAPSWHAPSVLALLPQILLMGLLTRAFHLALQRQERAAERDALLTRAGQKLLAVTDNQGIHRVGERTALRLADMHPGVVLVIVVRDADGLFVEFCAGVPSGPVGTRLSGAAPDPAELTTLLPGYGHWHTDSLGGDPATAPVLMMVGGRRAVPVEVLDAFRSLSYQVTLAGEAHQARVELEYRANHDQLTGLPTRAKFRAAAEAATGGVALLNIDLDGFKRVNDEHGHAAGDELLVAVAGRIATAAGRHGVAARFGGDEFALLLTGVEDAGQAEAAAGRLCAALAEPVRLGAATVRVGASIGVALAEPGVGVTDLLRRADLAMYTAKHGGKNRVVRYGVECPAAV

SEQ ID NO: 12300 - protein, 244 aa, Actinoplanes utahensis
MRILLLGGTTEARRLAGLTADDHEVTTSLAGRTSAPLRPAGDVRIGGFGGADGLARYLVEQRIDVLVDATHPFAAGISGNAGSAAAATGVPLLVVRRPGWTATPGDAWHRVASLEAAVARLTGGRVFLTTGRQTIGAFAARDDCWFLARSVEPPEPPLPRRLEVLLDRGPFTVAGERDLLLRHRIDVLVTKDSGGSDAKLVAARELGVPVLMIDRPPLPAAATVPTAEAAAAWLAQTAAGHSTP

SEQ ID NO: 12301 - protein, 403 aa, Actinoplanes utahensis
MRAENPPVVTVVGIGAGGFPDYGGTPSASLAAAEVIFGSPRQLALLPDSVGAERVPWPSPMLPGLPDLFAAHHGRRICVLASGDPMFHGIGATLATLLGPERLRVLPHPSSVSLAAARLGWDLARTDVVSLVTAPVASVGRVLNPGRRLLVLSAGADTPAAVAAYLTARGYPRAQLTVLEQLGGPRERVCTGAAGDWALPPGDPLNVIAVECGDGPPLPVVTGLPDDAYDGDGQLTKREVRAVTLAALAPVPGALLWDVGAGSGSIGIEWLRAHPACAAIAIESSAERVTTITANAARLGVPGLTVVHGRAPDALDGLPRPDTIFIGGGLTRDGVLDSCLAALRPGGRLVANAVTVESEAVVAAAYARLGGALTRLTVQRGSPVGGFTGWRTSMPVTIWAVTR

SEQ ID NO: 12302 - protein, 530 aa, Actinoplanes utahensis
MAIPAFQDQRQLPEDDDGYFAGLRSDTDDRPSWNGPSHAGPTWDAMPEWPAAAPSQPADPYRRGDILVESNTSPTGWKAGTGVPVPEDRPPAEATSGNRLFTVMLFFSGLATSVSLWLFDTHAGAVHDTASMMLATGRITGLIGGYLLFIQLLMMSRVSWLEEWVGSRDLLRWHRWLGTSMLVAVLAHIVTIVYAYALQADTGVVDQAWSVITTFPEMISATVATGLLVLLSFTSIRWLRTHLPYELWHLIHLTGYLVLLLGYGHQVATGADLSGRYASYFWPGLGALVIAALVWGRIVEPVWLNARHRFSVAEVVAEGANTFSIYIAAKNLDRLPAQAGQFMRWRFLNANGWWQSHPFSLSAAPNREWLRLTVTVAGGHTAKLGALRPGTPVWAEGPFGTFTAQRRTRRRALLIAGGSGIAPIRALLEDMPPDTIVIYRASRPDELVFRAELEELAEQRDAWVRYIVGSRTDPGPQRLFTEAGLRGLVPDVNRRDVYLCGPPGLVNAAVATLRQLEVPDSQLHLDPFEF

SEQ ID NO: 12303 - protein, 167 aa, Actinoplanes utahensis
MRRSTAAAVGTLTGAALILGVRLSVQPPAAPAAEAAPVADQQTTEPAAGKKPASSAPSKKKDEKPADKAADKPAASGLKDGTYKGRAVQNQYGTVQVTIKVTGGKVTDATATYPKNGYSGTINPNAVTKLGQETLKAQSAKVDTVSGATFTSGSYKTSLQAALDAAA

SEQ ID NO: 12304 - protein, 249 aa, Actinoplanes utahensis
MRHVEHVMGTVVSIDLADDLPESRLRELIASTCAWLHEVDARFSTYSHDSEVSRLRRREIRPEDCSADLRLVLDRCADLWRETDGYFDAYARGPLDPSGYVKGWSVEVASARLAAAGSTRHHLNAGGDIRMRGAGPGGGPWRVGVRHPWEADKLAWVLGVRDGAVATSGTYERGAHIWNPRTGRAAAGLRAVTVTGPDLAVADAYATAALAMGEPGLAWLAERVADGYESAAVTEDGRAFTSPGLPVID

SEQ ID NO: 12305 - protein, 402 aa, Actinoplanes utahensis
MSWRNRLDDGMQIRQITADERTATMFPLQSYAWLPSPGTPEDETKHRANQRYFATTTMLVAEAGGETLACAAGYPMRQNVRGVVHDMAGVASVTSRPEARRGGLVRQLLDRLLAQSREQGCAVSALYPFRPSFYARFGYVGIPRVRVARFAPEGLSDLLRRELPGSVQRLPGRDGFAEYDVLTHRLLADRHGFAVFDETRSQLLREDPVWIALARVDGETVGGLRYRIDAHGGDLLGSNLFSTGPLGRALLLQFLARHVDQVSRVEVLLGADELPELWGTDMTVTTAATVQNPVRNAPMVRVLDLPALAGVEVGVGGITVAVPGDPLIGGVWRLGADDGRLTVRPGGTPAATLTVAGLSALVYGVLDPVEVVTRGLGDLDRDAITRLDALFPRRTPYMFADF

SEQ ID NO: 12306 - protein, 87 aa, Actinoplanes utahensis
MANLLLSVMGAFAEFERALILERQREGIAAAKQRGVYTGRKPALTTEQADRLRERVAAGERKADLAREYGISRETVYAYLRPTAATS

SEQ ID NO: 12307 - protein, 113 aa, Actinoplanes utahensis
MVRKAKKKRVGYIRVSTVDQNTVRQLDGIEVERVFTDKASGKDTTRPALDELIAYVRDGDTVLVHSMDRLARNLDDLRRLVRTLTGKAYGSSSSRRTSSSPARTPPWPTCCSA

SEQ ID NO: 12308 - protein, 116 aa, Actinoplanes utahensis
MPVNSLPAEWLRGTLSLCVLGLLSEGDSYGYAITERLEEAGLGVIKGGTLYPLLARLESQQLVEPVWRSGQGPDRKYLHLTDAGRSELTDLRSRWKRFASTVDSLAHGRTKDDHGG

SEQ ID NO: 12309 - protein, 168 aa, Actinoplanes utahensis
MVLTFSTGASASTGVLGSSSASAVKADTYASTNAAAQKVYDETFKSLESTGSASFTAADGSKHTISVSDRDIVLDGKSAISKSAARTGSVVGPMAGGTSVWCKAKIAAAVAALAAVGVAFIAFMITGLSESAMVAIAGITMRVSSWQAVIAGGISVAAIGNLIKEYVC

SEQ ID NO: 12310 - protein, 693 aa, Actinoplanes utahensis
MTTAAGGEGLGGGRVVGSGDACADRGGIANTGIYIDLRPAPSRPDPVWPIIEVSSLPVQASAFQPRPGLRQRVEAAHRAGRDVVLTQPDQQQALGRGTQVLAGGGGVGKSQLAAWFARQAIAERTDVVVWVNAASTDQIVTTYAAAATKVAAPGADGTDPATDAKAFLSWLRTTDRAWLVVLDDITDPAQVRGWWPPHGRTGWTLATTRRRDAVLTGGGRHRIDVDVYSPTESVAYLAQRLTDGGCLHLFDESTAHQLGMALGHLPLALSHAAAYMIDQEESCAAYLDRYTSAAPLAKLMPAEADSDDYGIPVAVTLLLGVDAADQREPVGLARPALGLAALLDPAGHPDTLWTTTAVTDYLASHRSTGAGVPVTAEQARQVLRLLDRYGLIAHTSADTARSVRIHAQTARATRETLTDPSPVAQAAADALRAVWPDIDHGTTDLITALRSNTTTLAEHAGDLLWHPDGPTLLYRAGISLLNAGLHTTAVAYWQHMTDQATRLLGDDHPDTLTARASLAASYRLAGRTADAIALEEQVLVDTVRVLGEQHPGTLRARGNLAASYRQAGHTADAIGLEEQVLVDTVRVLGEQHPDTLIARGNLAASYRQAGRTADAIGLEEQVLVDTVRVLGEQHPDTLIARGNLAASYRQAGHTADAIALQEQVLVDTVRVLGEQHPETVAMGEALRAWKSTT

SEQ ID NO: 12311 - protein, 156 aa, Actinoplanes utahensis
MNREALVSNLELIVGALAAGASAGVKDTASAVVRDAYAGFKAMLKPWVRGEARAALDADETDPQVWQARLGQELTVSGAVDDEQILAAAAALLEAVVDADRVTDSGAATATAGGHASTGIAGAAGDRAAQVTRSGEARAEGHGSVANTGVYRSPRP

SEQ ID NO: 12312 - protein, 144 aa, Actinoplanes utahensis
MATSRSLRLSTARAHGPTPCRRANKSPSEPARWPTSTAHRLSAQSSRYSPRRGAEGASGSSRHTACNESSARINDDLAVKLSDLARVLQDEDSLDETLQAIVEAAVNTVPGAQYAGLSLVEHSRVVNTRVGIAELVFQVDEARR

SEQ ID NO: 12313 - protein, 67 aa, Actinoplanes utahensis
MNVGKNVTWFTSSRSGAAGHCVETAFLENNQVAVRDSKNRAGPTLIFTGPEWEAFVAGAKAGEFDLP

SEQ ID NO: 12314 - protein, 258 aa, Actinoplanes utahensis
MSRSHFSRLIRAGLAGSVALTLAAITTPTGAFAAGADTPVDFPNFNGSSRMLDRNGTADILVAGRRHQRILRLTAGGYEQTGSAWALPKFDLTSSFETAFRVYLHHGRPGADGIAFLIQGVGPHALGGWGGGLGYRGIKKSVAVEFDTFQNTSDPSSNHLAVVLNGDPEHHMAAADPSIPLYGRPFNARITYNADAHELKAYVKSLRAGTTEELVLDESIDLTAETGVDAAWLGFTGSTGTALSKQDIYSWSVQGTKS

SEQ ID NO: 12315 - protein, 258 aa, Actinoplanes utahensis
MRAGSVGAVNRTGRLYALVEELRAAAPRPVTVAALAARFEVSRRSVQRDLQTLLETGVPVRAVPGRRGGWVIDPAMTLPPIRFTPDEASALVLALAAVGSTVPYSGSVRSALQKIAASLSGPASDVARNLAARVVALPPRPGPAVRGAVEQAITGHAVLRLCYVDSAGRDSEREIEPAGLLTSQGRWYLIGWCRTRRAARGFRLDRILAAAPTGEPAPPRDLAMLLDSAAASATLPDALTPLACATAPAPPASERTAT

SEQ ID NO: 12316 - protein, 311 aa, Actinoplanes utahensis
MNLVDQDCLAETEAFNAQFEAAAASRPSREASLDAATLATLRRNRLAGDAPPVRLPQGRDRVVEDVPVRVFVPDHVDGVYLHIHGGGWTFGSADGQDERLWRLAQQARLAVVSVEYRLAPEHPLPAGADDCETVARWLVKNSEAEFGAGRLLIGGESAGAHLSVLTLLRLRDRHGVIGAFQAAHLLFGPYDLSMTPSQRLFGSRRLLANTPSARATYERVTPGLDPVQRRDPQISPLYADLTGLPPARIVVGTMDPWLDDSLFLATRWTAAGAPVQLNVVAGAMHGFTLFPLTVTDREERRGQDFLRNARG

SEQ ID NO: 12317 - protein, 642 aa, Actinoplanes utahensis
MTAGAIYGSVHVNGRVPISWPHRVGVVPPRADCRQPRGEDTTLHTAGPGHTVVCQVVTGLGGVGKTQLAAELAHRYWDEHLVDLLVWVTATSRSNIISAYSRTAAEISGVEDPDPEQGAARLLAWLAATDRRWLIVLDDLADPGDLRGLWPPVPPVGRTVVTTRRRDTALLAGRHVIALGLFTPVEADTYLTHKLAGQPHLLDGARELACDLGFLPLGLAQAAAYLLDRNLSCTGYRTRLADRRRRLADLLPDDGALPDDHQATVAATWALSIELADALKPAGVARPLIELAALLDPNGIPATVFDTDKVAGYVNSRVGRPVDAEQLRDGLQALHRLSLLTADTSTGMVRVHALVQRAVRDTIPDDRLPELAAVAADSLLTVWPDIDRDPAYTQTLYANTTALHTTTGDTLLTPDGHTLLFHAPTRLGETGQVNAAITAYQRLFDTCLRVLGPDHPHTLTTRSQLARWRGHAGDPTSAATAYEQLLADRLRVLGPDHPDTLTTRHNLAYWRGQAGDPAGAATAFEQLLADRLRVLGPDHPHTLTTRSNLARWRGEAGDPAGAATAFEQLLDDYLRVLGPDHPDTLTTRHNLAYWRGQAGDPAGAATASEQLLDDYLRVLGPDHPDTLTTRHNLAYWRGQARR

SEQ ID NO: 12318 - protein, 133 aa, Actinoplanes utahensis
MSNLEVIVAALAAGAGAGVKDTASAAVKDAYAGLKTMLRPWVRGDARAALDADETDETALQGRLAKELQASGAVEDEQVLAAAQRLLAAADPARAATYNINVGTNSGVVGGTITAPVTVNHTPPVPPVPPATA

SEQ ID NO: 12319 - protein, 118 aa, Actinoplanes utahensis
MTALVTEHVAAWADGQGWHVAREVPARIARQTRNGPYQARLDMMCQRPGNLPPVAIEIDRTGKVWSLRKLVAEADAGAVALWVRWRGRTRIAIPADIGLVDISGAGPTIRLPRGARPW

SEQ ID NO: 12320 - protein, 263 aa, Actinoplanes utahensis
MTGKRTGDGFASIAAIVDLINHMTRWRHISGLELIPPGKVTPHMFRRTMAMLTRDTPGAEIAVGMQLKHVATRALANRITSSYMDNDPSWARQLDKSITERRFERLTELFDADTDGHTIGFGPGADRMRETFAAVRAQAEQLRATNQARRGDIRVERDLLRRTRISIRFGKLNHCTMNDNDPAGAKCLEDAIVPDGHLGPLLDRGQPSRCANSIIAPAHIPIWSAEQSSLHHLLDTDKLAPSHRRRIEAELKEVDRVLDRHHP

SEQ ID NO: 12321 - protein, 226 aa, Actinoplanes utahensis
MIDIEPDFWGYVRSLGNPHRVAAQVTAANPKDCGAQENSAAGLARCLIAMARRYAPKTTVGMHLSCWDWQTDSAGCARDYRDLGASKADFLVGDVSDRDAGWYALPQHGGSNGFWTDAKAAAALRFYKSMTEAVGRPLALWQVPVGNMAQNNTLNHYRDDKVDWFFAHMDQVAAAHVVALLFGAGQQEQTSLLSRGPPPASPDTPSPCAPAPESTRRASTTGRRAT

SEQ ID NO: 12322 - protein, 103 aa, Actinoplanes utahensis
MTLVTGETATALELTVRVVTTPYLSSSGFWSTIPADHLTTTVEQQPGALVYRFTLKPGTSLGAGSYTFAVQYHHAVGGRDPGRDTYRATATVGGRPVAVSGGF

SEQ ID NO: 12323 - protein, 293 aa, Actinoplanes utahensis
MAGRDGPVVAGRRPAGARRPVRHHAAPDAAMTAPGQTADTSSTCPSCGAAMEVAHDAGVMRCPYCRRESPLPGAQTGWPFGAGATGMPRITVSTRPLLTPDLVRRQKKIAWIAGGGMLVFLLIVMVPIFSSFSHSAADYSYQPPEKKVQEVAIGATAQVKGFEATVRSVDCTKQSMTRTADDPATSWDESDVIKAEGKFCVIAFSAKNVGARTDTYPTFDLEASSPTERVFSRNTSAEWYLNKNTDDLSKPIDPGKTVDSFLVYDVPTDSKFAYLRLSDGILSDTIVKVKIDK

SEQ ID NO: 12324 - protein, 362 aa, Actinoplanes utahensis
MSMADKIRGEFIDIVEWLDDSRDTIVWRFPRYHNEIKMNARLVVRESQVAVLVNEGTIADAFGPGTHTLTTQNLPVLSTLKGWRYGFESPFKAEVYFVNTRQFTDLKWGTQNPVIVRDPEFGMVRLRAHGAYALRITDPRLLLTELVGTDPEFRTEEVAGYLQQMIVSRLTSALAAANVSLLDMAAQQEAIGAQLTEALAGQVAPMGLRIPAVIVRNISVPPEVEQALDRRTQMGIIGDLQRYTTFQTANAIEDAARNPGAAGLGTGMGVGMLFGQRVGGAAAPPAMPVQPPPLPVSTPWYVALHGSQQGPFELGTLGVQVGTGAITRETLVWRAGMAQWSPAGDQPELAALFATTPPPMPR

SEQ ID NO: 12325 - protein, 271 aa, Actinoplanes utahensis
MNSNDHRDLDVRLRAAAEPVGRGRVHHPSAQDLLDRIVRSPRTGGAPVTAPRRAVRHTGRWAVAGLAAAAVSAAVLVIPGLSGDQAAYASWTGTPAALGAGDTQALSRDCMTQKLTPDWGYTQAQLDHARKVLGEARGAYRYVAIATQQWTATCFRDKAGTVYWGSSFESPVSDGQLGAKGVELQAWGQLKTDEGYARLMSGHLGTDVTGVAVTTPDGRKVEATVDDHYFLAWYPEKAGETRPTTITLRLRDGSAVPNLSASDLYDAPKLN

SEQ ID NO: 12326 - protein, 195 aa, Actinoplanes utahensis
MNRSNAPMVAERRAETPRDDEATFRALFEATYDDLLCFVERRTHQLAAEDVVAEVFLTAWRRLDDIPGDLDPARAWLFTVAHHVLRNRRRSDHRQHALALRILREPGGPDPVAEAVDIAGRVDLNRAWEQLSQDDQQVIALIALDGLTGPQAARVLGISTTAFSLRLMRARRRLRRHYTGVAAAAAPTSDSGVNR

SEQ ID NO: 12327 - protein, 70 aa, Actinoplanes utahensis
MSNFLIKAGDRLLARVLRTEVAGACVPDHGQSCGSITYVCHLGRLYKHDPGRVQCNGQCVTTVTYVGTCD

SEQ ID NO: 12328 - protein, 173 aa, Actinoplanes utahensis
MSITVAVALALVGAVTVLNLFLLTAVMRRLRAHEAAHAPAALALPEPGHRIGAFRTTTPDALSEEDLAEPAVVLFVMPGCAPCHELLDAVPDAGFDPARTFVLVAGDAALAPTRELAALVRPLGRVAVIDPDGPVTAAFGGIRGYPTVVHVAAGRVVAADRRLSVLVRSAAGA

SEQ ID NO: 12329 - protein, 602 aa, Actinoplanes utahensis
MAGSGFSRAAAICLRLSWAASRPATVAVIGLSAVASVLPATTAWFGKELIDELTRGPAAATGRATVFAVAAALAGAVFAGLAQLGTLAGAYLQRETNARIQERLFAAVNGFHGVRRFEDPAFRDRLELAGTGAQQAPESVTTMLSGTLRGVLTIAGYAGVLLTVWPPMLLLLALAAVPAFATYRRIGRRAAGVSESTVARIRRQLSYRMLMTEAVAAREVRLFGLGRLFAGRFAASLRETSGAELADRRRAAGAETLLSLAGAVVALAGTLVMIREVAAGRLSVGGFSLFTAAAIGVQGALTSVLSQIGMATRNLALFHHYAEVVGAAPDLADGDRPVAPLTDAVTLDDVWFRYDEDGPWILRGVTLRIPRGATVGLVGLNGAGKSTLVKLLCRFYDPQRGTVRWDGTDLRDLRIAGLRRRLGAAFQDFVRYDLTAAENIGVGDVDRLDDRPAIRAAARAAGIDAAVEALPKGYDTLISRIFLDGDDADEGVNLSGGQWQRLAVARALMREDCDLVILDEPNAGLDADADAEIQAALRAHAGDRTTLLVSHRLGTLRHADEIVVLSGGRITERGDHDTLLAAGGEYARLFRKQSAGYVPAGG

SEQ ID NO: 12330 - protein, 145 aa, Actinoplanes utahensis
MWWLAVLAVPLAVAAAARAGLRVVEVRGHSMNPAYADGDRILVRRGRARTGRPVVFRRPDLAGPAAADVDWLVKRVVATAGQPVPQALAGVVPDAVVPPGRLLVRGDNPHSIDSRHFGYVAEADVLGVAIRRLSTGTGVPDRAVP

SEQ ID NO: 12331 - protein, 175 aa, Actinoplanes utahensis
MPCLEIAARLLIGTVFAVAVAGKVRSGAAYREHVRSLRRMGVLPDRWVPAAAGAAAGAEAVVVVLLAVPARWTGVPGFALAGGLLAVFTAAIAVSLRGGNRAPCRCFGASSTPLGGAHVVRNLLLLGVDLAALTAMFVAARPATLAGGVVAALAGLIAGALVTSYDDIVALWRPA

SEQ ID NO: 12332 - protein, 367 aa, Actinoplanes utahensis
MAEPGRWRGWLRRRRVEQGGPGRHAAPETPAPPATQPEPVVRAADRTDPWRPIAGEFALRLLTLTWEAVHHIGEAEFREQDAERRQILFRIDHSVTRVRRLAENLRVLTGEPLDDPDQQVTSLHDVTHAAGAAVEHYERLHFGPIADLAVTATAADDVIRILTELIDNADRYSPPTEPVTIAAHLTGDGDVVIRVEDTGIGLNPAHLPWIERLLTDGPGDGELQPAHLGLAVAAVLTHRHGSLRVRLVPRQPRGTVAMLLIGADLLCESPRVAPDESPAEKPQPAPNGRNHRNDVTMVLPAMPKPMPRRVPASVRANGATLPPPPPASTATHETTWHDDAAAFNAGVDAARAQQESPPGIMEAEGPQ

SEQ ID NO: 12333 - protein, 147 aa, Actinoplanes utahensis
MTDTQQPDVSWLIGQLVREVPTITAVVLVSADGLQLASSGHLSREHAESVAALAAGFLGITGQLGGLLQLGAPENLSIRYPHGHLAFLRIDDPAGEFVAALLVAAQPQTQIGHLGYAMTTFSQAVGHALTPETRHALHQRTLPAPVR

SEQ ID NO: 12334 - protein, 116 aa, Actinoplanes utahensis
MGRRPGLHWKVRPYMTARGRTGSRSPLLMHTLVSTGNRYDPVLAASLTPASRSLYEQARRTSSVAELSASCGLPLGLTRLLISDLLKIDQLVVHDARPSQDLALLERLRAGLLRLT

SEQ ID NO: 12335 - protein, 190 aa, Actinoplanes utahensis
MQASSASPEMHSAKIVIAGGFGVGKTTAVEAISEIPAIRTESWMTAAAAQIDHLDPGIDKVTTTVAMDFGRVTVDDSLVLYLFGTPGQPRFWPMWDDLVRGAVGALVLVDTNHLENSFAAVNYFENDAAVPWIVCVNLFHGVQTHDLAEVREALTLPPHIPLIAADVRGSRNVAQALLAVVNHATEKARQ

SEQ ID NO: 12336 - protein, 416 aa, Actinoplanes utahensis
MRKILIVGAGQAGLQLALSLHAEGYEVTLMSARTPDEIRTGWPTSTQAMFDLALGTERAYDLNHWEHVTPPIHGLRPQLSVERGRLALAFNAPLERPAQSTDQRIKMSRWLQDAEERGVEVIYNAVTTQDLDAITQLGRYDLTVVAAGKGDLVAMFDRDPERSPYSTPQRGLAVAYVHGLEPDPAWPDPHVGFHALPGLGELFVIPALTHTGPCDILFWEAIPGGPLDRWAGHPGRMAPDQHLAITLELAREHLPWLHARAEKVELTDAKATLHGRYTPTVRRPVGHLPGGGVALGLADVVIANDPITGQGSNTAAKAAHHYLQAILARGDEAFDEAWMNATFESFWGAHGAAVTGWTNAMLQPLPPHVQQLLGAATGSETIARRFAAGFNDPNDFLNWFVDPEKAAAYLAEVSGA

SEQ ID NO: 12337 - protein, 357 aa, Actinoplanes utahensis
MSFHWPWALAALLVVPLLLVARWWLNRRRRRTAVTVSSVALIRAALPGRSDWHRRIPVVLFLAGLLALAGGVARPQARVPVESDNTSILLAIDVSGSMCSTDVTPNRLSAAVDSARRFVTSQSDGTRIGLVAFSGIAGLLVAPTTDRDELLDAIDTLKTARGTAIGQAILTSIDAIAEMNPAVPATGADLGDTIARGDYESDTIVVLTDGSNTTGVDPVTAAREAAARRVRIFTIGFGTTRPSPMVCTADQVSGDSFPGGGGLPGGGGFGGGHGRVQEIDEDALNQVADLTGGRYFKAQDADELNGVLHDLPKEIGLHRADVDISFWFVLVGAVLVVTGLALSLWWSRPRAKIHLKG

SEQ ID NO: 12338 - protein, 322 aa, Actinoplanes utahensis
MSFRYPYLLIVAVLLTIGAVVFYVGLQRRRAAALKASGFGALIGGGLRRHLPYALFLAALPILLVGLARPQARVSVPRVSGTVLLTFDISNSMAATDVSPTRLAAAQAAATEFVEAQPDTVDVGVLVFGDTALLTQAPTGDHPAAEAAIARVRPGGGTSLGQAILVGLGTITGKPVSLPKDGGTADTRTLGYWPSATMVIFSDGENTGGPDVEAAAEMAAAAGVRIQTVGVGTARGATVEVDGYHLNTALDERTLTAVAQVTGGAYHAAGDADTLNRATSSIDLRLTTRKEPLELTAPFAGAALLLLALGGLLGTRWHGRII

SEQ ID NO: 12339 - protein, 305 aa, Actinoplanes utahensis
MTSPPDRLLRRLEWQLGRRLDGRLQGAYRTVWHGGGLDFTDLRAYTPEDDVRHIDWNVTARLDDPHVRQYTEDRELTAWLVIDKSASMRFGGYEGKESAATELAVSLARVVSRGGNRVGAILFDNAAQRVIPPRAGRDQVLRIAHELLKPPATAEPKRFRRATEPPAAGTDLAAMLRLAATTTARRRCLIFVMSDFIGAPGWHRPLGQLTHRHEVVVIRVVDPAELVLPDLGVILVEDAETGEQLLVDTGDPVLRGRLADQVRAREAGLADVMRRAGVANHRITTDQDLMAALVHLVQASGRGRR

SEQ ID NO: 12340 - protein, 330 aa, Actinoplanes utahensis
MTGNDAPPAAAGDIEKVLYEVKKIIVGQDILLERLVVALLARGHILVEGVPGLAKTLAVKSLAEAIGGEFHRVQFTPDLVPADIVGTRVYHQPSGEFKVQLGPVFTNLLLADEINRAPAKVQSALLETMQERQVTIGRQTHRLPNPFLVMATQNPIENEGVYPLPEAQVDRFMMKVVIGYPTATEEFVVVERALAPAAVLQRIIDPDTLVTLQQAADQVYVDPSLIEFAVQLATASRDPATVGLTDLSRYVTFGASPRASISLVLAARALAYLRGRDYVVPEDLSDLALDVLRHRMVLSYEALSDDVTPDVILAKILANLPFPEPAGRGR

SEQ ID NO: 12341 - protein, 325 aa, Actinoplanes utahensis
MPALRVNGRSCVPETIGGRTGNSGKSLVASRNAECGGRAVMTVLRPDGSDPPEPAPQEPTPTRLSSWNSPERRRKALFALVALWAVVITAVVFLRGGPKATPQATAPQPKPSASPGPLAVSQIYQTLLPSVVLIQTTGHDAKKALESATGTGVVANADGTVMTADHVVDGAETIKLTFADGTTAPAKVARSNPKLDIATLTPAKLPDTLVPAVLGGGVEVGDPVVAIGNPLGLVDSTTSGVVSGLDRRLDRDEQGDIAGLIQFDAAVNPGNSGGPLVDDQGQVVGIVVSLANPSGAGTFIGIGFAVPIGAALGGGEQGDGRAPPL

SEQ ID NO: 12342 - protein, 253 aa, Actinoplanes utahensis
MSSNEEADLPTAPNLFPAGAVTTLPARDPWSGAAAPAAAGPAAETVPTAPEWTRTGQILEVAGTSSAGSPSAGGPATGPVSAGTSSAGSPSAGGPVTGPVSAGTPAAEIPMSPQAVPPGAVPPPGSWAPVAVAGRKPRSPKTILIAAVLATAVASSGITAGIMSAVGGSSTPASSQQGGPGGRGGFPGGGGGFGGMDQNGTTQDGTTGQGGIGQGGAGQGGIGQGGAGQGGTAQNGTTQQGRTGQGGTTGTGT

SEQ ID NO: 12343 - protein, 114 aa, Actinoplanes utahensis
MGGEFVVRGRILLPAGERPVRAARVVTRAEDAGRADAPAVVIAEAVQEAVALPGRDGVPFEIRVPAAAAGRCTLRFHVDVTGSGGVTAGDYVSTRVYPVAAFPAGLDVPMSRVT

SEQ ID NO: 12344 - protein, 621 aa, Actinoplanes utahensis
MTQVETPGPWRNQGEFRGGERGTAMISGVTFRPRPVVFSRIDGLAIFEGDIALGTVEQLERQLADAREQAVAGDIASAVAISGTRFRWPNALIPYEIDPALPDQRRVTDAIAHWEANTRIRFVARTAANAGQYPNYVRFSEQGGCWSFVGMQGNGMQTISLGAGCTAGNAIHEIGHAVGLWHEQSREDRDMFVRINWANIQAGLEHNFDQHITDGDDLEGYDYGSIMHYPRNAFSANGQDTIVPLQANVQIGQRTKLSASDVAAVHQMYAAILGGGWAGGWSELYSDSDHLSSLDVIANADGRLELFGVNEDDRIWHTWQTRPSSGWAGGWAELYSDVDRLTQLRAARNRDGRLELFGVNRDGRIWHTWQTAPGNGWAGGWAELYGPHDRLVSLDVINNADGRLEVFGINAEGRIWHTWQTAPDNGWNGGWAELYSPVDRLHTLRAARDADGRLEIFGSNAEGRIWHTWQVRPNGGWVNGWSELYSPVDRLVSLDVINNADGRLEVFGINAEGRIWHTWQTAPSNGWNGGWAELYSRTDRLRVLRAARNADGRLEIFGVNSQGRIWHTWQMRPDGGWIGGWRELYTDSDYLTNLAVLANADGRLEVFGLGEKGRIWHTWQL

SEQ ID NO: 12345 - protein, 124 aa, Actinoplanes utahensis
MPLTGRAAPRPVPSAQAAPSYLSANKTPTIRAWAARNKVELCLTPTSASWANPIEAQFGPLRMFTMANSNHPNHTVLARKLQQYLRWRNANARHPDVLAAQRRERARARSERQQRWGRPRTKAA

SEQ ID NO: 12346 - protein, 482 aa, Actinoplanes utahensis
MARLRKGTIAVVIGSLSLTATTPAHADEPVPDTTPPVITSTGLTPGQLVGAYKGFKPIVSDNSGTTQMQVLLNGKLSMTMPVNWDGPIRLNAKALPTDTDLDVTLRVKDPAGNTTDATTRVHLDSSLPTATPSPAYGTAMESGPVTITLTDVPDDVTKIAMHFYSTGQDVIRTEGPWTFQWDASEQSEIPYFILTDRAGNTNNVITGYIVDNDPPVIEHLSNYIPQITLKPGTTTTIGAYATLTAVVNDKSRLSRTEWWVNGVLRATNPDEFRLTPDMTTGTTATIELRVWDGAGHPASAIFPLAIDRVGPSISNITPDAMALVRGTSFTTTVVASDPNGVADFTVYSGSDAASGNSQQQVPTGRDGRLTYTWQATDRFGNETSASRTVVVDNTKPALAFGAAPANGAKLTKTATITATASDHNRIAKVQMLVNGKIVATDTTPGYRFVLNPAKYGRTFTVQLRAYDKAGNVSHSSTRTYHR

SEQ ID NO: 12347 - protein, 1590 aa, Actinoplanes utahensis
MRAAFTVRQACDGSRCRRRRDKTPFSCEEEIFNMRVLNSRPRWLAAVTGMATLVATSMSSPAVAATPDGDVGYVGNVSKTTSSLLTTDQALAQARKTGTKVEVTAATTATDLLTANPDGTLTMTRTAAPIRQRVGGQWKNLDATLTANPDGSLSPAVSTSPVVLSGGGTSPLAKLSGAGLGFDLSVPMTLPKPTVAGDTATYADVLPGVNLQATASVYGGFSEVFVVRDAAAAANPALKKLVLAAHPSGITLASDAANNVAGKDAAGRTVLSAPTPLMWDSTTTAATTTTQRSAVTPSTTSRNAGAARAASSPDGPGAAANVAPLPTTATSTGITLTPGSMLQDSTTHYPLYIDPDFQWTPASPTLSGWATVAKSHADSNYWKATPDRQGFLQVGYSGDTIVSRTLLNFALPSVLKGATINSAELNMSNNYSYSCDARPISLYAPTTKLTSGNAKWTYWDGVNLGAAVQTQSFAHGYDTSCKPITVGFDVTKTINADVNGSNPQTLQTFMLKAGDETDKWAWKNFLLSTVSMTVTYNHTPDVPTKLTSSPSTACNASPASAVGNGPLSLYAYVTDPDAAAGGSASLGAGFQLYKTQYASLFPSTGDGDSTKLVASTPMSSTASNKNNAVLNVPQDTLSKAADVDGASNKLITQFSWRVRVTDFPASPSDTSHYSKWSAPCTFRYDPTRTGAPTVVLDTTVTDPSVNTFPPVQGKNSRILITPNSNGTTPSGYLIQVNGGAPYKVTADATGAGSAQIKPTRFSNVVTVTSLSPGGNIGDTGSLPVTAYAATPAQPDDFNGDDIADLVTVGGTNNLPPGLWLAAGNNNGQVMPVAANIGVYGTGQATVQTPKSYTGTQVITGRFTGYGSQDVISYHTQKDPAVDPATGTGSILTGSGDGTPIQPSDSNQGTISGLQEISPDDFSSIQGTEPNQVATLNTVAADGTASPFASLLGTSKAADGTYHVNYFENVNGTFGNPVTLAGLLNPAGGTDWKDWTMAGTLTHDPTTGHDSADMFLWNRSTGALALWRNVQYDNGPKTLTATKYTLNTDVSKWATVPTSLQAADINRDGTPDLWALGTGATVTSYLVTGVTSTTGTTGAVANQTPQTLVTGNHAWLLNDQNSGNVDAATAKDIVGDLDASGATAGAAGATDGATWDTNDLFSPDVELNGPDAHTKTGYLTTKSMPVPTNASFTLSVWAKPTTGGTVLSQDGKNTAAYKLWADPSDKSWRFAMSQGDTTTATWDSATAGPASAPWNAWSQLTVTYDATTGLGILYVNSVYMASFTHTVKWTPADSNTTPMPMRIGAHRSGTGTATAGYFGGKVAFVQTWNRMWKYPVAGNHDFNGDGRNDVVTVGSDGKMWLYANRSTGTSTFAAPVSIGVGWSSYRWDISDWDLDGYADLLGYTTDGILWWYPNNHASGFRSRVQLGVGWNGFVHSTGNADANMHPDHFSIRTTTDPSGKDPIGTLYHYPNGCCRVVIGHGWSTYRMVPGDLNNDNRDDLVAVDSSGNLFIYPNTGNPGDQMFTAGRTQIGTGWGSFRYAVIDINVDGKPDIIGVDANGNAYLFPGTGAGTLGTKTQIGSGWTTTVATTIG

SEQ ID NO: 12348 - protein, 2183 aa, Actinoplanes utahensis
MAAVASGLVLTLLASGQGQAVAAPSTAPAAKTNPAPDVKPGRAVKGVYALKPAKQPHRPDPAEQKFVPTATTLPPAGHAAITISGAGKSHAAGSAVWAQTVAAAKTRMAAASPAAVDVQVLDQQTATKLGINGVVMTAAAPTAGKVRLGVDYAGFAQAFGGNYGSRLHLVQLPACALTTPQVAACRKPADLGSANDTASQSVSAVVDLPATPATPQAAPGASTRSLAPQKAATTQRAAVFAATAATGGDGGSAGGSYAATSLSPTGTWSAGSSTGAFTYNYAFKVPPAATGMAPEVALGYNSSSVDGETVSTQAQADWAGDGWATPQSFIEQSFVSCADDPEGSAAPKKIDDRCYNGPVLTMSLNGNSSSLVWDATKKVWKSEDDNGEVITKVTGSNNGSGSYDTSYWTVTMRNGAVFQFGRNQLPSWTSGKPRTNSVDTVPVYAAHSGDPCYNATFDQSWCTMAFRWNLDYATDAHGNAMAYYYHQDTNTYARYQGATKTSYVRDSYVDHIDYGFTDGNAYGTAPNQVVFNTGDRCVSGTCQPLNSTNKANWPDVPYDLICTSTGTCNVWSPSFFSTVRLASVVTQQYSTATSKYEAVDTWTLAHTMPATGDSTSPTLWLNSITHTGNDTSAQPNSSAITVPAVKFDSIKLQNRVDTVSDGLPAFYRQRISQITTEAGSIITADYSRTNACTAPVTITPSSNTSSCYPVRWTPPSYVDPITDWFNKYVVTKITQSDPTGSAAAQVTSYSYLGGAAWHYDDNELVEAKYRTYGQFRGYGKVQTRTGDLTNDKQTLSEVTYYRGMSKNNNTTPLPLTDSQGGSHEDLNELAGTTLESTIYRGDGGPVESSEISSYWVSDATATRTRTGLSALTANWVSKAETFSRQRIASGGTPTYRYTQTDNSYDADIASLTFGSLRQTYSHTVPVDAQYDTCTTNTYAPVNKTKNIAGLIAETEVVSRACGGYTAGSPSSAPGTLNRLTAPDSVTRPAQVVSDERYFYDDPTFSTTFPQAVAPTRGTRTMEQHANGWNSTGYTYKTTNKTEYDSYGRTIAAYDGNGNKTTNVYTTNAVGLITSTTTTNALNQTVATTTLDTRRSLPLTITDANNVVTTLWYDALGRSKAVWLNSRTTDLPANRLFSYTLSQTGISSATTQILNDVSQYQLSTLIYDGMLRPRQTQQGTPRGGRLVTDTFYDSRGWTKAVYNNWWDDTTTPDTNLVSAANLGKQVATQTLFTYDGLGRAVKQEQAKDNVVQTGETTTTVYAGDATTVFPATGGTVSTSYTDPLGRTVKTDTYKTVPTLTTPSNTFTGDYTFTGGTKISSTFGYNDQGLQNSIKDTAGNTWTTSYNLLGQVTGKTDPDAGTSTGMTYDGNGNLTQATDSRGKTISYTYDKANRKTGVYAATVAAQAAANKLADWVYDNSDNAVTGMTNPIGQLTSSTAYWGANHDAYKTQQLGFTIFGTSKGVTVTIPTAEGTLAGSYTFNKAYTTTTGLPLRDVYPAAGGLAQEIVTYGYSTPYDLLTSSVGTNAYGKITVFDAWSRVQQESIGSSPTYGYVVNNWDAHTGRLTNQTVSRQTGTPATVHSTDYTYDPIGDITKLVETRQGSTATSETQCYRVDGFRRLRAAWTATDSCAAEPTSTSKATVGDALGASSAYWTTWTFNDLGDRTTQTQHAIGSGNDTVTNFTYNGNAKNQPHTLTSTAATTGTTTVNTAYTYDTAGNMATRAAGKGNQSLTWDDAGRLTAITGSTAGNTNFVYDADGGLLLQKDPGQTTLYLPGEQIALNTSTKALTATRYYTLPGGGSCIRTGSTYSFALADHNGTPTLYLNSTMSAPTWRQYTPDGATRGAGGAYPDNRGFLNKPVNNSTGLIQIGARNYDPATGRFISVDPLFNPDDQQSWNGYAYAESNPVAFSDPSGLQVPPDERIPGWQISGAPAWGTSGFNTGGSNGSGSSGGSGGKKSTASLDEKTANGLEKIRAKIAKKYQVATIDDLPEALHEYALEDIESEACLKYPSRCYDILSAMARDQVFIANPGETKVDGPYSKWKAANDVAQATTEVLDEDPKQVMENHLNPEERAGLLRSMNNGKFYRFRMLYGRALHKAVAAKLMKRFPGEWVYKESWGPDLFHKSGAVVEITTAGEMSNHTSRSQREHEAYRDYEGAAYVGYANAPLTQGEMFRLAGEMAAGNDR

SEQ ID NO: 12349 - protein, 254 aa, Actinoplanes utahensis
MPSWPACRSQKISEAADRKPSPICAAGWCDICFGAVRLNPKGVSFRRCQHCRGYDGVLDGYVPIGSSVADGLESLLHRYNNFGPDHRWLAAPLAALTRGLLVRHLRCLETRFGPLDFATHVPSWGGDRPFDPLPTAASLISDWPVPWIFNLMSKTREGRPARGVVDSSYFRFNASTRLPGLAILPVDDTWTSGASLVSTAKMLRAHGAARIVGLTVGRQLTEGFGSSDAVKAALRDMAFLPRICVICSWRATRR

SEQ ID NO: 12350 - protein, 185 aa, Actinoplanes utahensis
MLAPLLPAASTTGRPPKWDKRQLIDAIRGRIRMGTPWRDVPAVYPPWQTVYGLFRRWQRDGTWDRILAALQAAADTNGRIIWTVSVDSMTSRAHQHAAGARTKGLHPQQEGPGRPPQGQRIPRRTPAEVRQGPLPQASRRREQHRPTQALPGHRHPLRKAGSPVPSRPDHRDHRRVAMTSFQNTP

SEQ ID NO: 12351 - protein, 109 aa, Actinoplanes utahensis
MTCATAPPPWHEACADLKTLQDLLGHSSIVVTADTYTSVLPDSQRRCADATAALVLAAARHTRQRIKEKAAKNRPTGRAGKEAPSEKWPTSKKRSRRSRSRRNPVSRGK

SEQ ID NO: 12352 - protein, 1185 aa, Actinoplanes utahensis
MGRHALILGTATYHADRKLTPLPGVRQDVEQLQTLLETDGEFDSVTARIDLPAVQMKQLVEEFYGARLAGDLALFYYSGHGVLHGDRQSLFLGTIDTDTSILHTTAFDVEGILRHMLNDTKAGQKVVLLDCCFSGSFTARHRFTGGVRQEPRRLKRERGTFLLQSSSHLKASKAQGPDRPSLFTEVLLTGLRGAAQGTAEDGWITASDLSRYAMTEMSRRRREEKPVESSEGVTEPIPLVSGSVERRRHVPGKPAEEPDDAPFDTERWRRLLGYYVNCLQRSAVLQFFVDPVAGDSYVPAPAGREVVFSASEPVRFGERGQQLAKAAEAGGRSLQYGYPVVTLSPKGRQQLHWAPLLVCDLTVGADGLAHPAPPQPSPALVDHFQLSVVEADELREAVAERLVPGDRRSLADAVNLVAKAFGLKPASPLDPQNLAGRVDRGPLNRVQNAGMLFAAGSTESPDRQLIEDLQEIVKNAGKIASTALGALSNANDDPRVEPAADVLTVAPSSVNETQEEIIRAAMSRPLTVAQGPPGTGKSQLVTALLATATAAGQSVLIGSTNNRAVDEVVERVTAMVGSGLILRTGNKDYRQQEPQYLAEVMQAWPPPAADTRGPFHELRLVAHEIEQLREELDHHRRLERDLADLAFARDATLTDTDERTLAKLVDLTERALRSRWFGWWYRRRLRSSGAFDRDAITVLGESAVIEQCWRERQRQLVALPHAVEDAWQRLRTLQHDTRAEHSKELLRAQIATRVSGNTTLLRNRADEMAKPNGSSWTYMSALVKALPGWAVTAKSARRLQPRAGLFDLVIIDEAAQCTVADILPMLYRAERALIIGDPRQLTPVVELSADDDRREQARAGLGHGWLTNRRLTYRDHSAYEAFAAAAGSTILLDEHYRCHPEIIDAPNRVVYQNRLTVLTDPGRLAAPAEPATRWVDVPGHFTKGATGSGRNADEIQAVVTEVQRVRKEYPEASIGVVTPLAEQQRHLQRALLDQGLTDNLLCATIHKFQGSEKDIMVVSPVGAQGISERTRGWLVNQTNLWNVAITRARSQLIVAGDRSWWSGQRGLLADLASPTRTTAAGTDVGPRPADRLIAGLRETGLTVHWETPLPGYPVDFTISLGDKRLAVLVDDPDGDPDGHSLRRVLSRLDIIASAATVKRVPAWRCLAEPEQVVAELRDAIGTDLH

SEQ ID NO: 12353 - protein, 124 aa, Actinoplanes utahensis
MSEVFIEVSFTPLPEDDDFVLDQLTEELEEDLRDIGEVSRLEAPAVPDGKGVGEVVLAAVAAVAGTDPGYAQALVDLVVGFLHRNQGRRAHLRIGDVEFTIDQATKAETAKMIDIVRDAIERSR

SEQ ID NO: 12354 - protein, 350 aa, Actinoplanes utahensis
MTSTDDRVLNAAMGGDRRAREDLFRRQLPVIYSAVARLVPAERVDDVVQETATRAIEHLDELRDTSRLRSWLLTIALHEARRDRAARSVAPDWRLPEPGPDIDPQDVAVARVTMSGQRRELAAATAWLDPDDRELLTLWWLETLGEMDRPAVASTLEQEAAYVAVRLQRLRERLMKARVLVRVLAGTDSCPELAAESSGWDGEPSALWRKRFLRHVSSCGRCGAAGGALIPPERLLPAFPLLVPAPAFAAVSSAAAGAPAKAAGTQVKTVVRAVRRLQSLGGNTAAAVVATVAVAAASIGVYAVRAHRPDPAPAAAVEPAAPGSPAGRAPSAAPASSAPAPARASVTLAS

SEQ ID NO: 12355 - protein, 131 aa, Actinoplanes utahensis
MTVFEKATREKFRYPSAKGLLSTEQLWDLPLTAKSGFSLDDVARAVNAELKAVDTESFVATDGNPAKATWEAKLEVVKHVIAVRLAEDQAAKAAAAKKLEKEKLLAILGRKQDAVLENLSEEELLARIDNL

SEQ ID NO: 12356 - protein, 689 aa, Actinoplanes utahensis
MRFSGEAGSLGSAVIEGDDTVDGFQQFVTDVSARLSTMSKDELFVVGDGLDRDSLWLTFLDAFPAGTNVRFRERSEYDCSTCRVFVKNFGNVVEIRDGQVRSVWSGVSASDPVFSVVAAAMDEFVGTLPLSTIFRSTQARYGTKTTRALRDGRVEVWDHLHGRVEKRHRAEDIGAARGVFDAAVQVFQRGLAELTTPALDTVVDLIDDNALYRGAEHRRAVTEFRSLRNRWTQATDRRAFVFANAVNPAARFRNTVIGTLVQDLSAGVDPEHAVRSFETKVAPQNYQRPTALITPAMVQAAMKTIDELGVEESLQRRFARLSDVSVTNVLWVDNDTQSRMKDGIEGLLMQAATTGSAAARPRDAKPEEVPVAVFLKDIMPGAAAIDLWVADSHEPHLVSLTTGRHPDAPRLFRWDNDFAWSYGGNVTDSIRERVKRAGGNVTGKLRVSLSWFNHDDLDLHVFEPNGDHIWYQDKRNKLDVDMNAGGAFSREPVENVTWTGTVPDGEYRIEVNQFRKRESTRVGFVIETESNGRIEHYRHDRAVGQKETVEVGRMTVTDEVITAFRPGEDMRLGSAGREVWGITTEQFVPVSTIMYSPNHFDGNEVGNRHYFFILQGCVNDQPTRGIYNEFLRDDLLAHRKVFEVLGDRTKCEPAQDQLSGLGFSSTVRNAVVAKVTMTGGRRRLISIQF

SEQ ID NO: 12357 - protein, 88 aa, Actinoplanes utahensis
MTLTGELVAAVAAELRDLGVVRGKHQALMVRGERGDTVLVKLERHASPPRMEEFVVDISSALPRPHVPDRGPEHHGSAGSHPLLPVAL

SEQ ID NO: 12358 - protein, 61 aa, Actinoplanes utahensis
MPARRGWRSSSSTSPLPFHDLMCRIEDLSTTDLRDLTRFFRSRSDDPSLAQLADWIEKHFQ

SEQ ID NO: 12359 - protein, 388 aa, Actinoplanes utahensis
MALTDPLELLDVAGLLSDEERQIQETVRRFVADRVRPHVAEWFEAGTFPRELAPELGRLGVLGMHLEGYGCAGTSAVAYGLACLELEAGDSGLRSFVSVQGSLAMFSIWRYGSPEQKQEWLPRMAAGEAIGCFGLTEPDFGSDPANMRTRAVRDGDDWILTGTKMWITNGSIADIATVWAQTEDGIRGFLVPRGTPGFTSRTIKQKLSLRASITGELILDEVRLPDSARLPGARSLGAPLSCLNEARFGIIFGAVGAARDALQVALDYAGSRVQFDRPIAAFQLTQEKLANMAVDVNTGALLALHLGRLKDAGTLKPHQVSVGKLNNVRKALAVARECRTILGGSGITLEYSPLRHANNLESVLTYEGTSEIHTLVIGQALTGHAAYR

SEQ ID NO: 12360 - protein, 272 aa, Actinoplanes utahensis
MAELDALDRLGPGDHACLVFDDESVWARGVASFIRSGLRRHLRIMYCGRDADRLPAILGGLGLNVGAALESGQLALAGVDTAYLRKGVFDPEASLLAWAAQVAAARAAGYRGMVGIGDMSWACRYAGIEQLAWYEAQVNRICVDGFTMGVCLYDRRLFSEPDLRRVTRTHPAPLLRAVRTSEPRGLRVAGEADLSNRQALRAVVEHLIEDTAAGPEPVTLDLSDLRFADSAAARILLTPARGTPLRVTGVSGPLRRLLDFHWSGPPEDLRIE

SEQ ID NO: 12361 - protein, 580 aa, Actinoplanes utahensis
MRGQPSDRRMDEGFTLLEVLVALAVISAAMAGLGAFFVNGALTVAQQRDQRYAARLASSALEQVRALEGSALLDGRGQAKVDQQWAEVQSGPFASMMQPYLSHMLKLGIPNSTEGDNAALPTVPKPVTVGTTSYQQSIFVGPCEVYVTRDDDCVVPLPLTDPNRPTDATSILSYYRVVVLETWRHKTCTAPGNQCGYVASTLVSSKKDDAKFSSTRAIPKIRQPDMKVFYRNLNKVSVKMKVTGGNLPNTWSAVNLPDGLSIDPQTGMVGGTPTKLGTWSNATTGTYVRVVENAPPTGTLSPRSDNDKALGLTWKVIDPPVARSPATWSYAGAAISIAPVVVDTSVPYTYSISGLPAELSFDPATGVITGTPAQTFSATVTAVTTANYVAIDVPFAHTVVQPLTLQPITDQTVDLVSTVSVPAVAAGGDGKYTFTATGLPVELSINATTGVISGGPVLIAGRYLPTVTVKDGLGGSVSVSFVMQVGSPSTTLMFTAPAAVQTSSAGKAVTIPITTNADALNVKGVKVTATGLPTGVSVDKKGENLTGTPLLPGVYTVTLTGTPSGKDAQVTQYTFVWTIL

SEQ ID NO: 12362 - protein, 236 aa, Actinoplanes utahensis
MPPWKRRPADDDDQGFSLMEVLVTTGIMSVVTIVAVTALLQIYSGTRQIEQNSVAGDQLDISYVRLDRELHYATYVYGPTPGATNSRSYLEFAVPPRQKLLTDTVDPPVRCRQLMFDPVKKTLTMATWDLPGTTPGTPATLATDVVLDAGATTPFAVVKPGDTPFVTASAGTVGVGPQFNANYLMVRIRFQAKVGDAVQRFDNSFTSQNITDENDGDTSADPVPDPDRNCSNVGRP

SEQ ID NO: 12363 - protein, 515 aa, Actinoplanes utahensis
MMTLHRSGDDDRGSLPIAMMVVLTGLVLSVAVLPMIVRQVSGERSISDRNTALAGARIGLDVVMARIASASMKIAASDPSAVGLLEDLPDCRNPVEGDVGVGQEKLKYSVTIAYKDSEGTSLTCPLTKVPKTAELKSTGAGSLNVAPIGKPAQYGSRVLNASYTFALDNDNQKAVGGSIRIDTSTVGNLCMDAVSKTPAAGAPVKARLCDGSSTQQFQYTEELYLKLVNSETDAYPNGMCVFGTTAHANGKAVVLQPCPSGSIVADFQWSLDNNSELKSTSPTRTVENFCINLTTGSKVDTPLVLNSCSSNSSLNVWRFDAGVGAGMAGEETYQLVNYSQFSRCLDVTSRSVTSTYMIAWFCKQDPNGVVDWNQTWYHPVPVAPAVEKQGVIYVISSGKRYCLKSPLVATTSSWVTVTATGCPQTTVTSNVGIPAELLWNVRRATGSYTTSYRIEDAKGLCLQPTDLATGVKNVDLHADGTSKVKVAVCSSAELQKWNAPPDISNSSPLTGVKEN

SEQ ID NO: 12364 - protein, 786 aa, Actinoplanes utahensis
METTHPADSHDLIRVHGARVNNLKDVSVEIPKRRLTVFTGVSGSGKSSLVFGTIAAESQRMINETYSAFVQGFMPALARPEVDVLDGLTTAILVDQERMGADPRSTVGTATDANAMLRILFSRLGDPHIGSPQAYSFNVASISGAGAVTMAKGGVTTRERRSFSITGGMCPRCEGRGAVTDFDLTALYDDSKSLNEGALTIPGYSMDGWFGRIFRGCGYFDPDKPISEYTKRELTDLLHREPTKIKVDGINLTFTGLIPSIQKSFLAKDREAMQPHIRAFVDRAITFTTCPDCDGTRLNEGARASKIRGVNIADACRMQISDLAAWVRDLDEPSVAPLLGKLRHTLDSFIEIGLGYLSLDRPAGTLSGGEAQRTKMIRHLGSSLTDVTYVFDEPTIGLHPHDIQRMNDLLRQLRDKGNTVLVVEHKPEAIAIADHVVDLGPLAGAGGGEVVYQGTLEGLRASGTLTGRHLDDRAAVKNDVRKPSGFLEVRGADRHNLRGVDVDIPMGVLVVVTGVAGSGKSSLIHGSVAGRDGVVTVDQGAIRGSRRSNPATYTGLLEPIRKQFAKVNGVKPALFSANSEGACPNCNGNGVIYTDLGMMAGVATTCEVCEGRRFDASVLDYRVAGKNISEVLAMPVAEAVEFFAAGDGRNPAAHRILARLLDVGLGYLTLGQPLSTLSGGERQRVKLAVHMGEPGGVFILDEPTTGLHLADVEQLLGLLDRLVDAGRSVIVIEHHQAVMAHADWIIDLGPGAGHDGGLVVFEGTPAELVAGRSTLTGEHLAAYVRA

SEQ ID NO: 12365 - protein, 184 aa, Actinoplanes utahensis
MRRYLLILALGLVCLTSADTVGVRLVAWPAPARSSGPLVAHPGWTSCAGVDASDESALALPLLDDTFTPVAAVSCAVGPDRTAVPGGAGALAVVLQERRFEDVGTLVAALRQPDRTAVRSDALVDGDLLCTLEKRPVPWVAVIDAHGRWVHPGLPVEACGQVSHRLLDLIRAMPATRVVTTPLH

SEQ ID NO: 12366 - protein, 168 aa, Actinoplanes utahensis
MRDDAFRAYFEKHHASLSRLAYLMTGETAVADDLAADALTEVWRHWDRVQAADDPVAYGHGILMNLARQWVRRRGRERLIALGLSGRATAGSDVPAVLDVRSALRKLPHRRRACVVLRYAFDLSEREVATTLGISVGAVKSATSRGAKQLAGLLGGTVTRIDGWEAAR

SEQ ID NO: 12367 - protein, 292 aa, Actinoplanes utahensis
MRPSDEHHDGPARPRAPRSGDAPPTDDRLRAVLRAEAAAHRPDREAMLARVTTSVMSEPMARRRGGSRLRLALVGALVAVFGGGGVAAQWALTGDGDRNDATPVVTVTATTPATTPATPPPATGRPAPSSAVPSGTPPTSSKPAVVGAPATSPAAVRSRPGNTRVEQGPLWSDGSVDAGGGSSVVTLRTGERITALTVTIRLVKTPGLVSRGGTKSVPGASVTTKVEDRGDALLYTFTLSSADRVAPGTYTFTAKYVHADGGRDAGGDTYEAVATTAGGQSLDVYGDFYPAG

SEQ ID NO: 12368 - protein, 816 aa, Actinoplanes utahensis
MGRMDLRQGSQGIGLRRLGTTADEFQQDLLSSLYYRRGTTVESASPRDAYEALALTVRDRLADRRARTAAAHYASNPRWVYYLSAEYLLGAQLEQNLLYSATGAIAAQAVKALGRTLEEIEDLDVEPGLGNGGLGRLAACLVDSMATRDIPAVGYGIRYDFGIFRQSLENGAQAERPDDWAFQGNPWEFPAPDDRQTVGFYGHTEPVAGSPVRKRWLPGEVVLGEPSHMLVPGYGTQTVNIVRLWRARGSEASFDLSRFSAGQYAEAVQEAVRAENISKVLYPDDSTELGRELRLKQQYFLCSCSLRDIIRRFRMRNTDWDDFAEKNVIQLNDTHPTIAIPELMRLLVDEYGLDWDRAWSITRRTFAYTCHTLLPEALETWPVHLFERLLPRHLEIIYLINMLFLREVEQRFPGDTDRVRRMSIIGEEGERRVRMAHLAVVGTEAVNGVAELHSKLLRETVLNDFADLWPAKFQNVTNGVSPRRFVKLANPRLSDLITEGLGGDGWLHDLEQLAGLERLAGDASFAERWRAVKRANKVDLAAGDPDSLTDVMIKRFHEYKRQQLKLLHVITMYHRIRQHPTGDWVPRTVLFAGKAAPAYHAAKSIIRLINAVGATIAADPVVAPYLRIVFAENYNVTLAERIIPAADLSEQISLAGKEASGTGNMKLALNGAVTIGTLDGANIEIRARVGEENFFLFGLDAFQAAEVRLGGYDAKRFYEQDPELRAALDAISAGMFGGVGREVADSLLGWDEYLTLADYRSYLDAQEEVERAWRDPRRWTRLSILNTARSGFFSSDRTVADYAARIWRVAPVPVPH

SEQ ID NO: 12369 - protein, 590 aa, Actinoplanes utahensis
MDTRNWTAWNKFMGLWNADTWAYVPVDNPANTLEATADLPPGNYFVTAMYGIYGVDSYLITKSFTVGARGARYWAVPMTGESSGTFLATYLRAPGTFTAYMTPGVTWSRLVDYGSQNLNLTDVNLGSGETGTAETVGAGPLMPGTGRYGSQTRRERDKLYLYEPIQLTDTAGNPGSDPSTSRTTMTLSAGGTVLKTAASLSLAADVPPAAQLYTLDQTTTHRSQQSLLNTRIQNTWTFSSATTTSARLPLIDVAVGATGLDARNRASGGPVQLTLTPSTRSSDAVTRVDRLEWSADDGATWTAASVTTGGASITVPPGAAFVSLRITAANDRAGTLVRTVTRAFAGPAEPADEKLGTTGEFGGELEISGVTVNGGQPLTVGTAGTFEAMTATYAVSDPVNATIRSGLVLYHGSYTQPDGIIPASVNCVRFQQVIGRCTADFRSYDHRWALNSNALAGDWHVAIWAENAAGTRMIDRHDAATVTLRKATQLTTDATPEPVAKHRTITVAGALSRADWETWTFRPYAGQTVDLQFLQSGASSWNGLRTATSDAAGKLRTTTPAVTSGAFRYRYAGDGASAGISSAADSVAVQ

SEQ ID NO: 12370 - protein, 241 aa, Actinoplanes utahensis
MIGQVGDAPPSGRAATPTLASVIRAVIIDVDDTLCLTEAASFDLENDVLAQVGQPPMSRAVHLATWGETLLDAMPHRSPGVDLERFAALFPAAHQRYLADGRLDVIPPDNLDALDRLVGTGHTVMLLTSRTGPEVQHLLAPDHVLAGRVTRAYHQDNTRYRKPDPRVFDELLAETGFHPEECVYVGDSPGDAVAAGGAGIRFIACLQSGVRRLPDFDPRFVTAAVATFPEVPAAVNELSEG

SEQ ID NO: 12371 - protein, 260 aa, Actinoplanes utahensis
MITARITDARVGVAARPDGGASPTCPIIRDPAVVGAAARRWCARLPAVLDRLLPHPVRSAFALTDDPDEACYPGEESLVATAVPNRRREVVTARRCAREALLALGHAPAAIPRGPHREPLWPAGVVGSITHCTGFRGAAVAHTGELTGVGIDAEPHAALPPRVLGAVTDPVERAMLDRLATTHPETCWDRLLFSAKESIYKAWFPLTGRWLGFEDARLDIDPDGTFVGHILIESPLPRLAGRHLVDRGLILTAVSVPAQG

SEQ ID NO: 12372 - protein, 709 aa, Actinoplanes utahensis
MALLLAVAGGLVALDRQHVAATRQREAQASQQEAASRQYAAEAVNALNRDEIAAVRRALDSWQVRETTEARGAVLSAQMVNAIGTLGTDPGGTAAAFSPDGRRIAIGHGDGSVRLWDATTLTPVGQRMVPPNRSTRSYTRSLAFSPDGRFLLAGVAARNGLYIWDAATGDLVRALPGGAGAAWLPGTSTAMGWRTDTKEGMPFELGMWDAASGRLIRSLPVGDYAAYDLAISADGRYVAVTRPVPSPAKVWRISDGRLVTTVPDTAYVAFAPDGTLIGANRLGQLTQWAIPSGRRRQTMITESVTPFAAPIRVTPDGVVVVNNGLHSVALFALAGGDRRTEDTGVASLPSPAVSPDGRTIAVTGVDAPTAVFRRATTWLPHGTRVITSAFAPDGRRLATAGEDGKVRVWDPGSRALLTEIPTDGVPISVAFPDPGTLVDSTTNGRLEVRDAATGKVRVTVPLPGTPADLAVSPDRSLIAVVTQQSQEDLTKRGVTGQADQALVYDVGRQAVRARFPLGATPSSVAFSRDGTSLFTGLTVAGGYHDGYALQRWRTADFSPAGSVPLGYRPLDIAVSPVDGAVAVTGTNGSVEVREPDGAPVRWQTPPQIQQVDAIAFAPDGRTLASTEFDGRVHLWDVGARSLTATLNGHDYRSGALAFAPDGSLLASSGFDHTFGVWRLDPVAVLPDLCRVARIASRNDGKPLSPLCGN

SEQ ID NO: 12373 - protein, 627 aa, Actinoplanes utahensis
MPDPDDTPGPVERARAGVRSWVRESGRRGRARLRSAGPYAILAFLTASAVAPVAGAGLGVPGAFAMALAQLGGLGSNYLADVLAGTAQRMRGGGPITEQQWRDAVADELLPLLTAGDERGGRLQAEVSAVLHEIDAVATALTEAATADDGFRHQLEAVFEELGSDVGSLRWMLTDVRRSLDDLRQQFAGQTLLLHRQLEQVRRQLLAVNQETAPAAPPLSGSVPPYPGLASFQPADAPWFRGRETQVAELLARLSEQLVGGPPLVVTGVSGVGKSSLVRAGLLPAIGAGRLGPAATAWPWIVLTPGATPLRDLVRHLAGLPGATPEQAGDPAADVDGLLRDVRREPASLGALAGRAAAGGRRPVIVVDQFEELFTQCADPAERLAFAAALTAAAPALVMIAVRSDFYPACVELPPLARLLAGGHVVLGPLDAGSLRRAVVEPAEQAGLKVDPGLPELMLRDLGEGGAGAGGYEPGALPLLAHALRATWERRDGDQLTVEAYRATGGIRHAVAETAERIYLGLGPEEQAALRAALLSLVTMTGTGTVVRRRGRRSPDGSRVLDRLVAERLVTAGTDTVEISHEALLTGWPRLAGWVAEARSDLELRQRVAEAAEDWDRSGRDPDLLAS

SEQ ID NO: 12374 - protein, 142 aa, Actinoplanes utahensis
MGERHATVRIMIDADITRRVVTEFLAYVRSGRDPGRATALMAPRVRAHQVQSEDPVTIVRTPADYAGHVQEMIDTWGEFHLQVEDLLVDGARAYVRLAQTGRHTATGRVVRQVNAIVYHVENGRITEYWMQIDRAGLAAQLT

SEQ ID NO: 12375 - protein, 320 aa, Actinoplanes utahensis
MTERAFRFGVIAAQARTGAEWAANARRAEELGYDTLLIPDTLVTLSPFAALAAAAAATRTLRVGTYVLNAPNRTAAQVAWETRSLQTISDGRFELGVGGGRPGGHADTAALGGLWGTPGERLRRTADTIAAARGLPMPPTVLVAASKPGMMRLAAEQADVVTFGLPPVATPGELARAATEFRGLSNRADQVELLVGVTAFAPTIFALPAWLSRQVGGDPREMAAAGAATFLIGDADHAAEELLRRRAAGGFSYFAVNGPFMEAFAPVIQRLRGTGPVGGSAEPAAPDGDRRGGERRPAGTPGPSTKVAAASRLHRPTEAS

SEQ ID NO: 12376 - protein, 400 aa, Actinoplanes utahensis
MALRDEQLEDRLTGPRRGRTLALIALILGAANLRLAVTSIGPVLTEIRAGLHMSGTVAGLLTSVPVLCFATVGLLAPRIARRIGPVPVIAGGLVLLTIGLATRPFAPNSAVFLLLSAVALAGIALANVLLPSIVKDFFPTQVGAVTGLYSVALNLGATTAAAITVPLTESFGDWRLGLACWALAAVVALPPWLLMARRTGPRRAAPAAATAPVRMIRQPIAWALAVYFGMQSTSAYVIIGWLPQIYRDSGLSAEKAGVLFATTSLLGVPLGMALSAVAGRVRSQSLIAICLGAFGIAGYAGLWADPAAAPWLWAVLLGVVNTAFPLVLTMIALRGRTPGTVVRLSAFAQGVGYLIAIPGPILIGALHDATHGWKAPLGIMVGLMVPQIVAGAFAGRDRQI

SEQ ID NO: 12377 - protein, 276 aa, Actinoplanes utahensis
MANRPARPAHQGVVTRVERLTPHMVRVVIGGEAIGRLDAARFTDHYIKVLFPRDGVTYPEPFDVGTIRETMPREDWPLVRTYTVRKWLPEVPELWVDFVVHGDEGIAGPWAARARPGDVVRFSGPGGAYAPSPDADWHLLAGDESALPAIAAALAGMPDGAPVRAYLEVDGPDEEQELPTAADAEIVWLHRGDRPVGEALVKAVRELEFPAGRVHAFVHGEAGFVKELRGYLRVERELPMEQLSISGYWRRGLNEDGWQSSKREWNAQVEREQETR

SEQ ID NO: 12378 - protein, 153 aa, Actinoplanes utahensis
MVPTPAPTKTDNGGETVGQTKSTIITTKPTTKAPTKAATASSTAGSDSSTAGSSGGDPAAAPAKTTRKAEPEATPTGDAAPAADYGVNVGAADNPAPKGTGGPGETVAEPPASTKSGPLTLLSDHPAVFGGGAVVILLAIIGFAFARSRPRRY

SEQ ID NO: 12379 - protein, 255 aa, Actinoplanes utahensis
MGSTGHRRTGLTAAGSGRGRLLAAGAVVLAAGGAIGFTQLSHADETPQAKAASQSGAGKIVNGQKILTDTCIDSRLPAHDGFQKGDRCVSTEFGEVASAANDASLLITAAPVVVAPNTPFTLKVSTRNLIRDRFLAAGKGGYYVESSVLQNGIVRGHFHTACRMLASTRSAPDPDPVPAFFVATEDGKGGRTPDTVTIQVPGLPAEGTAQCASWAGDGSHRTPMMERANQTPAIDAVRILVRAGNGGNQGGGLAS

SEQ ID NO: 12380 - protein, 258 aa, Actinoplanes utahensis
MRLSRSSRQTRGGLLVSAVLSILAAVPATGAPAAPSAMHESHPITDGHGHDLELNGTAALITRTGTGKRIIQLTAGGYKQIGSAWSTGKVDLDRSFSTSFKAFLHHNRPGGDGIAFLAQGHGPRALGGWGGGLGYRGIRRSVAVEFDTFQNSTDPNSNHLAVVLGGNPDRHLKAVTASIPLYGKPFQARITYGGADHRLRVYVRGLYRTAKEKLMLDERVDVARETGVRAGWLGFTGATGDRVSHQDVYDWTVDAPQA

SEQ ID NO: 12381 - protein, 298 aa, Actinoplanes utahensis
MPTVDRVLPPETGTEELEELEQLEELDQIEQSVTGTEPPARPAAEAEPEPLVSVVVPALNEARNLPHVFARLPRVDEVILVDGGSTDDTVAVARRLRPDIRVVTQNRKGKGNALACGFAACTGDIIVMIDADGSTDPGEIPRFLEALRAGADFAKGSRFRAGGGSADITRLRRAGNRMLSVLVNMLFGTRYSDLCYGYNAFWACHRDVFDLDSTSPAPAGADGRLWGDGFEIETLLTLRAARARLAIEEVSSFEHDRIHGVSNLNAFTDGIRVLRTIAREWPRGLRRGSRQPAGRAAR

SEQ ID NO: 12382 - protein, 644 aa, Actinoplanes utahensis
MSAVTARPAPGLVGSRSGRPRSPVTEALWCAASLSVAGAAGTAAIVTAYHRAEWGRGGQFGWFWAGMLLFTLPVGWWALRRGTSPRLRLAVLIGYGAFTYLPKLLRHPSGPLYHDEYAHWGQSHHILADGRLFEANPIVRVIGDYPGLHACVAGLAALTGLSVWQAALFVLTTAHVLLTLGVAVLAGQLRPDARIAAAAAVGYSLNSSFLYFDTQLGYESLAIGILVWALVAAVRASRATTTGARLGWAACTLLLALVMTATHHLTALWMTGILGLFALVTTVQSVRVRELITPARVVWALTSGTALIVAIWLGIIAPRTGSYLDPYLGRALTQIGGLAGGEEGGRELFSKSVLPWWEQTAAYIAPGLATVAMLGALLLWWRRRHTEEPVTHAGITAMLLLGGLYFPATLLILTPAGAEGARRSWAFSYLGLAIAAAPAAVALLDLFAGRVLRSIAGALLGTIGAVLLVGNNAAGMNPSYRFPGPPVYGSDTRAATPEVLAAAHWLLDTQGRGIRLVADRYSGLILGSYGEQQPATGSASFPAYDLYRARPGQPIDRHLLAQLRDWHFEFLVVDRRMAEQVPDINIYFETNEPLRHDGVPAFDRAQLTKFDTMPWLIKVYDGPHLAIYRFDFDSLAHPTAGRPQ

SEQ ID NO: 12383 - protein, 596 aa, Actinoplanes utahensis
MGRRGRRGGRARAAGGRRGRRPPGRADPRHVAHRRGHRAADRAVAARRRGGDPRGGAGLAPGPARLPDGGAGRLGGRAHPPGRGAGPRPGRAGPDHQFRAADQHRLAAPAGGRRGRGDPPGDRGQRQGLRAQRAGAGVAAGRLPATGRDQRGRDRHGLLRPLRDHRAGPAADRVLITATRRVLDDSLARNSLLIMATSVVNGGLGYLYWLLAARSLAPAQVGTATALISAATAVSMIANLGAGHMFIQRLPGSAAPLWGRIVGGGLLAGGAATAAAAAGAAVLVPMVAVNFGFLARPAGAVAMIGTATAITATTLLDNVYVAHRAGHGMFVRNLGLAAGKIVALLGLLALGVHAAGVVVLSWTLPTIVVSAATVLAGLPRLRPGARLRLTGLAAEVPHLRAALTGHHLINLTQAGPAALLPVLVTARLGPGANAHFYLAWMTASMLFMVSPAVASALYAERTNAARVGLRRAALVVLAMVGAPAALLLAAGGRILAMFSAGYAAEGSMLLQILVLAALPDAVNNLAVAHWRSLGEFRLCRRLNAVRAVACLSLSWLLLPGAGVTGAGIAWLTGQTMSALLVGAVAVALSARRKALA

SEQ ID NO: 12384 - protein, 411 aa, Actinoplanes utahensis
MKILHLSNLYHPVIGGLERSIATSSAELVRRGHEVTVLTLATPATRQDQEMIDGVRVRRVRSVATTLLPGMNADAAKPFHPTVADPFTTTAIARVLRAEHFDVVHSHDWMMYSYLPLRRTRIGRPHVHTAHDFGLTCVRKTFARAGRQCSGPGPIRCVNCAGAQYGGPRSLALTAGLHAHRHRGIDVLTAISTSVAAALGQARLPGDLPVRVVSSLVPDGLDALADRTPRPDWLPAGDYLLFVGALGPHKGIGVLFDAYRRLCSSWSGPLPALVCLGTPRPDTPPAPPGTLIRHDVPHAQVMAAFRGAAAGVVPSLNEGMGQVAVEAMLGGAPLVASAAGGLTDVVEDGVSGLLVPPGDPDALHAALRRVLTEPGLADRLRAAGRQRGLDFTAARVVPQIEEVYRACVASS

SEQ ID NO: 12385 - protein, 388 aa, Actinoplanes utahensis
MPVSRRPRVVVAGSGWHFLSGISYYTCRLSNAMDERYDVGAILMRRLLPARLYPGRDRVGQRLSDLAYAPGVEVFDGVDWWAAPSLPRAVAFLREQRPDVLVLQWWTGAVLHSYLALAAAARRMGIRVVIEFHEVQDTAELRHSWAARYVRAAIRPLLARTSGVIVHSAYDQDQLNRVYDLGGLPSEIALHGPFDHHGGTGQRVPGPDGIVRLLYFGTIRPYKGLEDLVAAFGDLGANHRLTVVGETWEGWTLPLEAIAASPARDRITVVNRYVPDAEVDEYFAAADAVVLPYRRSSASGPLHIAMSHGLPVVVTSVGGLVEAAGPYPGTVFVPPGDPAALATGIREAAGLIGRRHTDPSSWDRTVDAYERLFTRIGIGRDVVTSSPS

SEQ ID NO: 12386 - protein, 552 aa, Actinoplanes utahensis
MKLVGRRAAILASSLLLSVFAQHGVASAATKPAPAKATVKTGAAPVKTPAAKPGAAPVKTPAAKPAPTPAKPGPGGNAGAGAPAGATAAPAKATVKGTPTLASRLDAVRTAKTINYYPSNAGWSAMWTRFDAARIEADLTKAAALGADDVRVIVFPSTFGYPTPKADYTARLNKLISIADGHGLTVKLTLFDWWEGYTDTAGSAAWARAVLAPYANDPRVLSVEVQNEFDPSDARAVTWVKKIIPSIRAAVPTMPLTLSVSGATGSNGLSQIRATLAATPLDYLDFHFYGNSERSLAEIRTAQAAAAPLPIVIGETGLSTVSGTEGEQAAYLARVFAAARVAGVGSVAPWTLTDFSDGAIPTNSAVSKIPAQYKYGLYRADGSAKAAAAVVKAYWAGQPLTNSVLDLGFEAPAGNSPWRPYLSDAGPAVRVNGVAHSGSGSVKFTGTSHTDDGLPAIRTAPVTPVQPGLRWHAEAWAKGQNLTGTTQIALSWFDANDRWLGQTSSRALPTGTTGWTKLTVDATAPAGAAGVQLHLKSGNNRGTAWFDDVTMS

SEQ ID NO: 12387 - protein, 636 aa, Actinoplanes utahensis
MFADGRDPAAGLVWLADGRGPEAGSVWWTAPEGGAGTGSGKVGTVTDGVVRGRLYGVGLGPGDPELVTVKAARLIEKADVIAYHAARHGRSNARAIAAGYLRDGQIEEALIYPVTTGTTDHPGGYQGAIDEFYEQAAGRLAAHLDAGRDVVVLAEGDPFFYGSYMHMHKRLAHRYETVVVPGVTSVSAASAVLGRPLMERDEVLTVLPGTLPPAELARRLAATDSAAVMKLGRTFDGVRSALAEAGRLDDAFYVERATMAAERVGRLSDIDPDTVPYFSLALLPSPAATAFAEANGSLAAGGTASAPADRAEASGLDAKPDASGVGADARGADAHGVGVGVGVGVGVGVGADARGADAHGVGARGMDAAAAVGSGGGGGAGAGRVTVVGLGPGAAEWLTPEARAALAEADDLVGYTTYIDRVPVDARQRRHASDNRVEAERAAFALDLAKRGRRVAVVSSGDPGVFAMAAAVLEVAEDPQWKDVTVRVVPGLTAAQAVASRAGAPLGHDFCVMSLSDRLKPWSVIESRLAGAAAADLVIAIYNPASQSRKEQLVRARELLLEHRAPSTPVVVGRDVGGPAESVRVTTLGALDPASIDMRCLLIVGSSQTRAVATGNGDPVVYTPRHYPTEGGTAIP

SEQ ID NO: 12388 - protein, 205 aa, Actinoplanes utahensis
MDYERDGAEIYRRSFATIRAEADLSGLPEDVARVVVRMIHACGMVDLVPDVRYSPGVAAAARKALLGGAPILCDAEMVASGVTRRRLPAANDVICTLRDPAVPGIAARIGNTRSAAALDLWGDRLDGAVVAIGNAPTALFRLLEMIEAGAPRPAAVLGIPVGFIGAAESKDALAESGLEYLIVRGRRGGSAMTAAAVNALASEAE

SEQ ID NO: 12389 - protein, 651 aa, Actinoplanes utahensis
MQRPQIVGAALRQIGVRVRGDAGRDRRQLHQIGVRRHLAAQHHHRQIPAEQLVEALLPGPAAAQDADHDQLHPVQQGRQIGHPGAGRIAQPPCRAAGPGAEQVRVGRRQQQKHACAPLGVRAPGSKNHGDRSSWLPGSSPGDSGGTAPDSHRLPPRQCRSNSLVVAHATERCDAADDSGGCRPEAPVLSGAARSIRAVSRLRQSDTDACPGALRLHAAADGLLARVRLPGGMLTGAQLGCLRELAEEFGDRRLELTSRANLQLRALPQDRVETVAARLRAAGLLPSATHDAVRNIAAPPMASDTVRDLVRRLDAAICADPGLAALPGKFLFALGPVPLAADVTAVPLAGSPAGDRFALTFGGRDTGLRVTHDSVIEALLASAHAFLAEREAQRGGGAAAWRLRELTDGAARVSARVAAALGLATAEVPAGPAPGGGGPAATDPLAGVTTGHEQDAAGALVGVVTGNEQDAAGALVGVVTGNGQFAAGALVPLGRLESRQSRLLAEAERLVVTPWRGVLVPGLTPEDAAAWAGRMAATGLVVTPTSRWTGVTACAGRPGCAKSRADIRADAEVATGFADGLPVHWAGCERACGSPAGPHVRVEATAASPAAPGSLGAGGAGYTVTRRADPETVVEVMPAGALGDVVAAARRG

SEQ ID NO: 12390 - protein, 1179 aa, Actinoplanes utahensis
MFLLLSTSDTDLLSARASGSAWRLGNPARTGVADLPALLDGVELVVVRILGGRRAWEEGLDELLGGDLPVVVLGGEMAPDADLMKLSSVPAGIAADAHTYLAQGGADNLRSLHDFLSDTVLLTGNGFAPAVESPQWGILPRAAEGSGSDGPTIAVLYYRAHHMAGNTAFVDALCRAIEAKGARPLPIFTASLRTAPDDLLAELRKADALVVTVLAAGGTRPATASAGGDDEAWDVGVLAELDVPILQGLCLTSSRATWEASDDGLSPLDAATQVAIPEFDGRIITVPFSFKEIDQDGLSVYVADPERASRVAGIAVSHARLRHIPPAERKVALMLSAYPTKHSRIGNAVGLDTPASTVALLAALKDNGYKIGDFSAYDGDGLIHTLIAAGGQDPDWLTEEQLAGNPVRISGARYQAWFDTLPEDFRASVTRHWGPPPGELYTDNGDIVLAALRDENIVVMVQPPRGFGANPVAIYHDPDLPPSHHYLAAYRWLADEFGAHAVVHVGKHGNLEWLPGKNVGMSASDGTDAALGDLPLIYPFLVNDPGEGTQAKRRAHATLVDHLIPPMARAESYGDIARLEQLLDEHANIAALDPAKLPAIRAQIWTLIQAAKMDHDLGQAHRPDDEEFDDFIMHIDGWLCEVKDVQIRDGLHVLGAAPQGEARINLVLAMLRARQMWAGQVAALPGLREALGLAEDAPIARVDEIEAEARRLVTAMEDGGWPADVSAISDVPQVRDVLRFAATEVVPRLSRTTDELTNVLHALNGGYVPAGPSGSPLRGLINVLPTGRNFYSVDPKAIPSALAWETGQAMADSLLARYRADYGDWPKSVGLSAWGTSAMRTAGDDIAEVFALIGVRPIWDPASRRVTGLEPIAREELGRPRIDVTVRISGFFRDAFPHVVAMLDDAFRMIAELDEPDNHVREHALRDRAEHGDWRRATMRIFGSRPGAYGAGILPLLDSRNWRDDADLAEVYAVWGGFAYGRDLDGVPARGDMENAYRRIDVAAKNIDTREHDIADSDDYFQYHGGMIATVRALTGRAPAAYIGDSTNPDAARTRSLTEETARIFRARVVNPRWIAAMRRHGYKGAFELAATVDYLFGYDATAGVVTDWMYEQLATTYALDAENQEFMRQSNPWALHGITERLLEAAERKLWDSPSPDTLTALQQLYLETEGDLEDGPA

SEQ ID NO: 12391 - protein, 122 aa, Actinoplanes utahensis
MPSVVLELVHLRASQINGCGPCVDSGARGLRKNGETDDRLFAVAVWRETPYFTEPERAALALAEYATRLADNPDPVPDAIWDEAAKHFTEEQLAAIVLWIATTNFFNRINVTTRQQAPTNWG

SEQ ID NO: 12392 - protein, 235 aa, Actinoplanes utahensis
MHQLQDDARHVPAWLTTVTGRVCLDMLRARGSRREEPPVAESPGAEDPERDAVLADSVGAALHVVLEMLTPAERLAFVLHDLFAVSFDEIAVVVGRSPAAARQLASRARRRVHGGSPAGMADFARQRRIVDAFLAAARGGDFAGLLSLLDPDVMLRMDDSGARLGEGTTAEQAARFFCGRAHGAIPATIDGAAGAFVRTPFGARIALSFTVAGDRIIAIDAIMDPDDAITIELLT

SEQ ID NO: 12393 - protein, 257 aa, Actinoplanes utahensis
MRQTQGVRKIYVIGIGAGDPDHLTLQAAKAIGRTNVFFLLDKGEAKQSLIDLRERIIRAYSHPHKRIVEGRDPDRDRTPADYTGTIADWRSRRSQVIEELIAEHLKDEETGSFLVWGDPALYDSTIAILDEILARGAVTFEYAVIPGISSVSALAAKHRVGLNRVGQPFQVTTGRRLAEGWPAGADDVVVMLDAQQAFTAYPEAEIFWGAYVGTEDELLASGRVADVGDEIVATRAEARERHGWIMDTYLLRRRAGD

SEQ ID NO: 12394 - protein, 422 aa, Actinoplanes utahensis
MSDPFGGFVTAVAAAAKPDFDDVIARSTRYRRRGRSRWFAAIAATILTAGGGTALGVAAGRGTPDPSPTAGVAPWRTTVARNAPGPLAPREYRQTRPDFWVPVGSGDTLTGLQTQMRAGDVDHLYLQYQKCGGDGCHQMLASTTDRGKTWHKFPLPAPISAIYKQAEVTDTIGGMVVALSAPRVVTAQRLPVIWASPDAGATWHRTRVDTGATVPFGWRVQPTEAGLVAIDPATGDGTMYLSSQARFSSTMVMSPQAGIWWMDAGKDALDAEVSRDGGRSWYRYPLPLPRGAGLSTIWCQICTGDGRLVYVTRMHEGLLHLWASVDGAVTWEDRATLDADGPVVSVLPVDDRTVILQGAGGSFRSTDQGRTFVRVGPRLGHDAYRLGGGGFMIATDSDSDEFSAWVSADGADWTFVHRPEVP

SEQ ID NO: 12395 - protein, 182 aa, Actinoplanes utahensis
MGEHLPRPFPAGAPAVDPDIDLRELYAASAGRLVAQLYGITGDFAEAQDVVQEAFARAVARPGGVLQATNPEAWMFRVAANLARSRHRRRQLFDRVVRTGRLRAADPAPAISPDHVALVAALQRLPRATRETVVLHHIADLPVAEVATMLGISVESVKVRLFRGRRALAEFLRDTDLENTHV

SEQ ID NO: 12396 - protein, 67 aa, Actinoplanes utahensis
MATGTVKWFNSDKGFGFIAQDGGGPDVFAHFSAIASSGFRSLDENQKVEFDITQGQKGPQAENIRPI

SEQ ID NO: 12397 - protein, 391 aa, Actinoplanes utahensis
MILHADLDSFYASVEQRDDPALRDRPVLVGGGVVLAASYEAKACGVRTPMSLSRARALCPQAIVVPPRMTAYAAASKAVFAVFRDTTPIVEPISIDEAFLGVDGLRRISGTAEEIARRLRADVRARVGLPITVGVAGTKFLAKVASGAGKPDGLLVVPPGGELAFLHPLPVEKLWGVGPKTADRLRERQIRTVGDVARVGEAALIAMLGGNTGRHLHALAHNHDPRRVGSGGRRGSIGAQCALGRGRRAPEDVEAVLAALVDRVTHRMRGAHRAGRTVTLRLRFDDFQRVTRSRSLLKATLQTGAVLRLATDLLREARPLIDQRGLTLIGVAVSNLDGEGGVQLELPFEAPRQDGLDAAVDRVRDRFGASALRRADMLGREMNPSVPILPD

SEQ ID NO: 12398 - protein, 172 aa, Actinoplanes utahensis
MCSNRGRGCADHIGGGNRVPAIPVRKVESLTLKLMENEEPTMLLTTPTVRDLERLTARVTSTRATGARLDAYREDDTFHIDIDLPGVDPASIDITVDGRVLTVRAERGRAEREGVRYLIAERPVGPVSRQVHLSEKLDTDRLEARHDNGVLTLSIPVLEERKPRRIEVAVAG

SEQ ID NO: 12399 - protein, 220 aa, Actinoplanes utahensis
MGTAVYPCRVDQRTPTVYRTRSWTNRNRALIGLGGLALLLLGYGIGRWQDTPSAPAAVPAALTASATAAASSAPVDTPAPSSPAPTPVEYGLLQAESASELAGIQAQDTQDESGGQNVGWINRGDHLRFDKYDFGEVPATKAKIRVASAAGVSGRVQIRLDGLGNAPVGELSVSNTGGWQTWRTDVAALRPVTGTHTIYLTFTAPDDSEFMNVNWIQFEH

SEQ ID NO: 12400 - protein, 290 aa, Actinoplanes utahensis
MLISFGLPVSGAWAEAETLTTVARRAEELGYHGLWTFQRLLVGEEQELAPVYQSVLDPIVALSWAGAVTSRIRLGVSVINLPYVSPALLAKQAGTLDRLTGGRLDLGLGTGWSEPEFTATGSDPTPRGRRTEEYLAALRTLFAEGTASFEGEFYRVPPSRMRPRPVQAGGPPILLGGGADVALRRAGRLAAGWVSSSRASLADIERGAKLVRAGAAGAGRSADDVRIIVRAVAPEGASYPEIRASVRRFAEAGATEIFHEPNWDPRIGGPDADPVRAAELGLEMLEELAP

SEQ ID NO: 12401 - protein, 906 aa, Actinoplanes utahensis
MTLNNGEGPVDIRRWVHVCIAVAAVLAVLAVLVGTEAGGRQLAADVSTWALAILPMVAAGTCVWRSRLFTGRARWGWAVLGAGVFSWGAGASYTVAEFFPHGGDPQIPSWADLGFTGLMLLVPLGLLILPSGAQPLANRARSVLDGLLVASSLVLVGWVFVVDPRLGHGTAGTDLYLTLSYPLGDIVMATIIGYMLPQRRALYRCSADLTFFGLGVIGFAISDIGYAYQRMIHDYQAGALIDMGWIAGFCLIIVGAARPKDAEPLKSEFSARAQATGVMFPYAAVTAALFASALFHLVSGHSSPFVTWTRSLLILLLIGRQVLTLLENRNLTRTLEARVDERTAELYAREQRFHALVRHSSDVVTVIDADGRVTFQSESMLRVFGYGPELFVGRRYTDLVDAEVAMRLAQAMRQVAVRPYATATLEVVHTHRDGRKCPSEVIITNLVDDPHVGGFVLNTRDISERKELQEQLVHEAYHDPLTQLANRVLFHDRAQAALARTTDLTVLHLDLDGFKRINDSLGHLAGDQLLVQIADRVQACVRAEDLVARFGADEFAVLIEAATGDEAEFVARRILDDLELPVEVGARRIHVRASIGLAAAALLEPNEPDGAEQLLRNADLAMHHAKAAGGSIFTSFHPRMREGLVERLELENDLRAALENHELRLHYQPTIDLETSAVVGFEALVRWPHPTRGMINPLDFIPIAEATGLIVPLGRWVLHEACRQAVEWSEAADGRPLKMSVNVSVRQFDQQDFAETVSAVLAETGMPADRLCLEMTESVLMTDTEANLEQLVRLKALGLTLAIDDFGTGYSSLAYLRRFPVDTLKIDRSFVERLGVLAGDTALTDTIVRLGKSLGMATVAEGIEEFGQLAALREMGCGFAQGYYFSRPVPAVEAGRLFLEGADAPL

SEQ ID NO: 12402 - protein, 214 aa, Actinoplanes utahensis
MPITVLLVDDQHLVRAGFRSLLRRGRDIEVVGEASTGDEAVRAARDLRPDVILMDIRMPGMDGIAATRTILAAESTTRVIILTTFETDEYVFAALAAGASGFLTKEVDPDGLRTAVRVVAAGDALLSPSVTRRVVGQFTQYADKTPERDRLTVLTDREREVVALVATGLSNDEIAARLVISPLTAKTHITRAITKLGVRDRVQLVIIAYQDGLV

SEQ ID NO: 12403 - protein, 371 aa, Actinoplanes utahensis
MRVTAAGRRGGPAAAPSVLTMNFVYLGAAATLVGVPAGLAMTDGNKQSVMTVSLAVLLALLVLAARRLPRTTLVVSVLTVTAFHSAALTTAGWVWPATAALVLTVLAGRPRTAVVVASVLLSFGAGWDWAVTRHGSGWVFAQVGGEMLWTGAVIAAALAWRNSVRWRELEISRRRVEERVEIARDLHDVVSHTLAVVGVHLNVALDAFDEDPEEARASLRLAQEVRGRAMNDLKSLVGVLRAGALPSLAGLEPLAEQVRAAGLRVSLTEVGDPVEVPAPVAGAVYRVVQEALTNTVRHAGATTATVTIRYAPDGVLVDVRDDGTPGGPITDGHGIAGMRERVAALGGALTAGPADGGFAVRATLPCTEPKD

SEQ ID NO: 12404 - protein, 173 aa, Actinoplanes utahensis
MTAAELLAASGRFPIAPGLTDREFTDLEAEFGFTFAPDHRAFLAAGLPTGIGWPDWRGADRTALRSALIAPVEGVLFDVAENDFWYEGWGAPFGDRVATARAGLMIAPRMIPLYAHRYLPAAIPGHPVLSIYQTDVLCYGADIGDWLHREFGLGRPADRRVRPTVPFWSALVS

SEQ ID NO: 12405 - protein, 700 aa, Actinoplanes utahensis
MDRGWGEGRAGRAGRPVHRGLPGPAVPQRCGGRRRRGEREAGADPADGPARPAGHLPGARRCRAHRLHRRRPGGGSDLLLHRVEPARRAARRPGRRPDRARPDLLDPGRGAPGQRGLEQPGGARPGRHHRHTRGPARPAGRPRPAPGRRGGGTTRGGPRLDPADAAGGGADQRSGRATVRRAVHRRHLVGRRAGNPGDRRLRHPAHVRQRRPGHPRLAAGRAAADRRQGGLSADGRLGGGRPGGQGGHRLPLVHLPRQRQDLPVAGRLVHDGDRRAQHQRHRVLVENGQLGGRAAGVQQREGLDPGPHRHPGRGFLALPALGDGGLEVGHPGPVLRARFGLLAALAGGHHQGPRRVHHRPRPQGSAGRAGPGRRAVPAMMAGMAEERDGVPLTNLDQEIFPAAGATKRDLIDYLDAMSARLLPVLRDRPLSVIRVLRGQDRFMQKNLPKYTPDWVPRTTVWAEASHREVTYALGNDRRTLLWLGNQRAVELHPALALASAPHRQTHLIMDLDPPEDDGFPAAVAAARLVRQALAEAGLSGAVKTSGSKGVHVFVPLAGDPAPEDVAAAQRAVAARAERIDPVLATTAFIREDRHGRVFLDATRAGGATVAAAYSPRIRPGVPVSFPVAWDELDGVTPADFTIHTAPALLRDDDPWAAAMPAPQPLDAGLIAEGHTIPVARVQAMHEGKRRAKARRESATD

SEQ ID NO: 12406 - protein, 78 aa, Actinoplanes utahensis
MLGLARRCGARPGPPMRRGPGIARGQGGGLATAYGNRLALTVMTVTYASAGLIVLAGPFRGRRDLPEPAVGPALSTVR

SEQ ID NO: 12407 - protein, 82 aa, Actinoplanes utahensis
MAKFMDVHDGFFGVTAQQLNAAHDADLKIEGEEGVHFERAWLDPEAGKVFCLSTGPSKEAVMRVHERAGHPTTQVFELTAEV

SEQ ID NO: 12408 - protein, 83 aa, Actinoplanes utahensis
MALTSPVLVGRSDQLDLAGRRHTEAAAGAGELLLLAGEAGIGKTRLLREISGRATAAGFAVIGAAAMPGDLEVAAGLLADLGA

SEQ ID NO: 12409 - protein, 37 aa, Actinoplanes utahensis
MRWSRAGGDEFDHLDQVGDQQPPMPVRVAAGALALAS

SEQ ID NO: 12410 - protein, 427 aa, Actinoplanes utahensis
MVVARLHAALAAAYMLDRRLTEALDHGQRARTILGDNDDLDATVGSVLLFHGRLDEGIGLLEAVIARAVAGNHEREAARAYRMLGSSASVLVEYDRAERWLAAGIAYAERVERCNDRHYMAAHLAHVRWATGDFTGAAAQARAALADGRGGITTRITALHVLGYAALPTDPVAARTQLREAAELGSGMRELQRVSPAWWGLAELALLENDPDAAIARCEDGYAASAAVHDAAYLFPYVVTGTRAYLAASGPTRAREWVARTGALLGDRRIPGTLGAVDHARGLIHLAEGQTGKARTSLERAGEFWAGRRRVWENTGALLDQARCAHRSRRPGEAARLVAAAWTTWGGPVPAGWSISPTGTAGTSPLTTRELEVARLVAAGRTDREIAGTLVISPRTVAAHVEHIRTKLGVTRRTQIAGWLATVEASS

SEQ ID NO: 12411 - protein, 268 aa, Actinoplanes utahensis
MSVPGNTVILLVLLSAFVGCVGYALGRWHERREGGADRAEAYRDGYDHAARSVFSMAARVAGRRRGRGAVRASAVVSPPDPSVAPVSSSPAAPAPVSAPASAAAGPVAVSGMPQPVSTGASAEAPLAGVPSSGVPSSGVAASGGPAAGVSFPAPEPIVVPGLPEPAAEGGVHYSSLPDPRWGAEETVSPPPVPRARHYVSTAGETDTPAPREGAGRHTVPDELVQAATYKLAADRVARARVPRSSGETTDPSESDQGGRPSVPRPRGL

SEQ ID NO: 12412 - protein, 115 aa, Actinoplanes utahensis
MVTVDDVRRVARDLPRSTEHLIRDRVKFRVGKIVYVAFSRDETIMGFGYPRQERDALIAADPVTFHLPRESDLRFNWVQAYLAHLDEQEMTELVLEAWRMCVPKKVWTAYLPRLA

SEQ ID NO: 12413 - protein, 219 aa, Actinoplanes utahensis
MAAAGRFRQPLDGSYAAVDRNHVHTTIKDLRPIHAEAVRATVDLVARATVEDLRRSTPCAGWDLATLLGHMTAQHRGFAAAARGNGWDLSHWAAAPAGADFDARYAEAAADVVAAFAAPGALDRPVHLPEFTADRTFPCHLALTFHLVDYVVHGWDVARTLDLPYHPGPAVLAATVPIARAVPDDAARLAPGAAFAPALPVPPSADPLTEILLLLGRRP

SEQ ID NO: 12414 - protein, 149 aa, Actinoplanes utahensis
MERDDLGAMAARLGRRLIAMEQPILARHGVSMWGYVVLNALAENAIRTQAALATGIGADKTRLIPILDDLQQRSLIDREPDPADRRVRLLALTGSGQRLHRAVQAEIRAAEDELLDELPAADRETFLRVLAILARRPDGNGLRSVQPSG

SEQ ID NO: 12415 - protein, 219 aa, Actinoplanes utahensis
MASLTRQPSASTPSTVSRRRACSPRAGHPSPSDRAARPTRAPPSRTADRSRSVPPAGGFGMVRGMGDHSRIVEIYTDGACVPNPGPGGWGAVLRWGRSEKDLCGGEATPTTNNRMELTAPIRALETLNRAPLTVDIYTDSVYVRDGITKWLPRWAANGWQTAARQPVKNVDLWQRLDAAVRRHEVRWHWVKGHAGHPENERADRLAARGLQEAVAAAKL

SEQ ID NO: 12416 - protein, 309 aa, Actinoplanes utahensis
MGGDVAAVEIRDVVVRYGDTTAVKGVSLDARRGRVLALLGHNGAGKTSLLQVCEGFRKPDAGTARILGMDPIAEHDALMPRLGIMLQSGGVYPWAAAGEILRLFASFAANPLDTGMLLDRLGLRKVERTRFRRLSGGEQQRLSLAVALVGRPELVFLDEPTAGMDTEARHTTWQLIEELRADGVSVLLTTHLLDEAERLADDVVIMRSGEVAATGTPAELTAAAGIDLLEVRADAGLELTSLRARHEVVETSPGEYAITGALDTRALADVLGWFAAADAHVTAVSSRRRTLEDVYLSLTGNQSTVGATR

SEQ ID NO: 12417 - protein, 255 aa, Actinoplanes utahensis
MSVATGTFTPAPGRASMRTVISRQIRMELLLTARRGEAVVLAMGVPLLVLLGAGLTHATNLPTGDRLGFVVPGVLALTVMSTAFTGQAITTGYERSYGVLKRLGASPLTRPGLLLAKTAAVLVQIVLQVLFLGLVGVLVGWRPDLAEVLPAAGVTVLAAAGYSGLALLLASVLKPETTTGAATLIYVLMLSVGGIMFAAPDLGTAGWFLLPLAAHAQALRDTLMNGASIPLSIWLALATWAVVWLTAAARSFRWE

SEQ ID NO: 12418 - protein, 278 aa, Actinoplanes utahensis
MEAIEVSSLRKTYRDKEAVRGIDLAVGRGEIFALLGPNGAGKTTTVEILEGHRRRDGGNVRVLGEDPGTAGRGWRARIGIVLQDADDAADLTVREMVRHVAGFYPQPRPADEVIELVGLTAKQNSRIRTLSGGQRRRVDVALGIVGRPELLFLDEPTTGFDPAARRQFWELIRALAGDGTTILLTTHYLDEAEALADRLAVLADGRIVAEGTPATLGGRAAAGARVSWQQDGRTRTEQVADPSDLIRELVATGADLRTLTITRPTLEDTYLTLIGADR

SEQ ID NO: 12419 - protein, 261 aa, Actinoplanes utahensis
MSSMSLGRGHVEVLQFLRDRTAVVFTFLFPAMLLLLFGTIFGNDYDRAGASAAQVYTASMLAYGVLTTGFVTMGSGLALDREDGTLKRLRGTPLPVTSYLMGKLILVLTLSVAEAALILLVGVVVFDMPLPPASHWVTFAWLMILSVTCCSLLGVAVSAVVRHARSAGAILNVPVVALQFISGVFINPITQLPSWLITVASFFPIKWMAQGFRYVFLPDSMKSLEAAGAWELGRVAVVLGVWCVIGLALCLVTFRWSDKDR

SEQ ID NO: 12420 - protein, 410 aa, Actinoplanes utahensis
MGAGPGRRGARCVVCDRIGAVPGDLPVERQGPMTDSEAVHARYSRWWDTYFFVITAAGAAAVVTSGAGAGHRGVAAAAIVAMLIVHATVGWRAARGPDGPFSIAVLGVQVALFMLAAASAPVASWLLFAVIPLIFQLAPVRLAIGAVVLVTLVPPAVDLAAGTGNLKTDLVISAISAGSGVWLGLWIIRVIRQSTERANLIAELEESRAEVARLSHEAGVTAERTRLAGEIHDTLAQGFTSIITLIQASDPELRDERLALAVRTARENLAESRAIVAALSPSALDAGLTDAVRRQTARFTEETGLAASFRTTGEPRDLATPIEVVLLRATQEALTNVRRHARANEAAVLLAYSPSSVRVVVRDDGCGFDTTTNGGFGLPGMRQRAEQVGGTLTVRSDPDTGTTIELEVPA

SEQ ID NO: 12421 - protein, 205 aa, Actinoplanes utahensis
MIRILLVDDHPVVRMGLRGMLDAEPDLTVIGEASDGAEGAEIALRDRPDIVLMDLRMPGADGVEATGRILAGDPGIRVMVLTTYESDRDILRAIEAGASGYLLKDASPADLADAVRAAARGETVLAPSVASTLVRQVRTPAPPALSARETEVLKLVAAGLTNADIGRRLFISEATVKTHLLRVFNKLDVADRTAAVTTAMRHDLL

SEQ ID NO: 12422 - protein, 448 aa, Actinoplanes utahensis
MNIRGRVALAAAAAAVVAIPSMAMAGDSHRDNTWAALHAIKGGTARNVILLLGDGMGDSEITIARNYQVGANGRLAMDTLPLTGAYTTYAVQKAHPELPEYVTDSAASGTGWSTGHKTYNGAISVLPDGSPVKTILELAKKAGYRTGDVTTAELQDATPAVLASHVVDRGCKGPQSMAACAVNDKVNGGAGSIAEQLVQTRPDVLLGGGKAYFDQTVQAGRFKGQTVTDQARSVGYQVVTDATGLAAASWAAPILGAFAPNNMDLEWTGPTPTRTGTAPSTCATNVARNAAQPHLVDMTTKALDVLDRQTRHRDKGFFLQIEGASIDKQDHAANPCGQIGETVAFDAAIKKALDYQKKHPDTLVVVTADHGHTSQIVEAATMGYTATLVTHDNATMTISYATSDITGSQQHTGTEVRIAAGGPQAANVLGVTNQTDLFFTFKRALGIR

SEQ ID NO: 12423 - protein, 1112 aa, Actinoplanes utahensis
MGHRPIQAASHERVPFTFWGRPRIRTVLATVAAAAAAFAPAVMVPAPALAANPSTVDNLTITDAGNWEGSKVTFTLTYTGSSPGDFTIATAAGSASSGASDFTATPSKTSITFPGTAASSNNSTTVTVDTAADADTADETFSLVATDTLGNTKSGTGTIYAVSVYPTFGLTPSTSTVAETATKDAQGNVTQKTVTVTATLTAPLPHDISIPVSTVNGADVDPLKNATSAGGVLRDYDALPATAVITIPAYTYTGTTTVQLYDDNVDETATNGQSFTVQATDTPVVLATNVGASKSTITITDDDPTPVASIGDATSAVTEGGALNFPVTLDRPSDATNLSVGYYTAAGTTMTGSSAGSPSDVTTPGSSTTPNVATIAAYSTTRTIAVPTDNDVNFEGAENVKEVLSSANSSAVGVTIGTKSTGVGVINDNDAGPAVTLASVSTSPGVFPEGDSGERVQKVRVTVAAGTYPVPVKIDWATRDGSATAGSDYKAASGSFTIPAGTDTTSWYGDIPITVYGDVVKENSETFSIDVTSSTSTIGAVSGDTTITLSEAGESDAKPTFNVGDVSVSEGNSGTSFAKVPIVMSGASPSDTVFTTTFHAGTAVGTSNGVPGDNDYTVPTDSTVTIKAGDTTGYLSIPINGDTVYERDQVFSVDFTTASSDVTNTNTPDVQHTARVTIGNDDAQPTLTFNSSNATEGQPITVTGKIVGVSEYAYKLGLTVGGTETNAATTGTDFTVPASLATTSIAVPAGYSGELTDIPSVGGGYTWSFPTLDDQIDEPTEGFTVTANETTGVPTGFTPAVGTYKIADDPLDLPPAIAIGDTTVNEKDGTAEVPIDLTFNGDATSTTQNVTVQYNTSDGTAKAGKDYTLTKGTLTIPPGTMKTSIKVPIINDSDMEDDETFSVRLSNANPLGAQITSGDSTVTIKSDDTVAPVTPTLMLTGPAAGAGAVTAWGKATPGTKVMLYGAALPEMDKKDLKLIDTVTADASGMYKFKSLTATTGWAFYVQAEVGGATSIRVVKLNQSPGLTLSTSKGKLGVTVNGNPKASGQTVTIQRKSGSKWVTVGSGKTTSSGFKGSYSFKSGTKLTVRAMVSGSSSLGINAGYSSSKAITIK

SEQ ID NO: 12424 - protein, 658 aa, Actinoplanes utahensis
MTAPNRPPARPMGGPPAARMMMGAGGPPEKLQDFKGSTKRLLRMLAPQRALVGVVLLFGVASVFLSVLGPRLLGHATDVIFNGVVGKMLGRTLPPGVTKEQAVEGLRQRGNTKFADLLAGMNDVIPGRGIDFDKLMHVLAWVVVVYLFAWVFGVLQGRITARVVQTAVYDLRNQVEAKLSRLPLSYFDKQPRGEVLSRATNDTDNIAQTLQQTFAQLVTALLTVVGVLGMMFWISPLLALIALVTIPLSFFLTTFIGKRAQPQFVAQWKTTGQLNGHIEEMFTGHSLVKVFGRQQEAEGTFREHNDRLFASSFRAQFISGLIQPAMMFISNVNYVLVAVVGALRVTSGSLTLGEVQAFIQYSRQFSQPLTQVASMANLVQSGIASAERVFALLDAQEQSPEPAVREMPPVQGRIAFENVSFRYLPDKPLIENLSLAVEPGQTVAIVGPTGAGKTTLVNLLMRFYDVTGGRITLDGVDIATMPREQLREQIGMVLQDTWLFGGTIAENLAYGADDHDQAAIVRASEAAHVDGFVRTLPDGYETRIDEEGSNVSAGQKQLITIARAFLAEPSILILDEATSSVDTRTEVLIQRAMNTLRTGRTSFVIAHRLSTIRDADLILVMENGTIVEQGTHDELIAAEGAYARLYSAQFAQAVAEVD

SEQ ID NO: 12425 - protein, 578 aa, Actinoplanes utahensis
MLMKLLRVHLRPYWNTIGLIVLFQFLQTLATLYLPTLNADIIDNGVIKGDTGYVMRIGGGMLGITVLQIAAQIVAVYFGARTAMAVGRDLRESIFTRVQTFSAREVGQFGAPSLITRTTNDVQQIQMLVLLTFTLMVSAPIMCVGGIVLALRQDVPLSGLLLVIIPVLIGVVGLIISRMRPLFRSLQVKIDRVNQVMREQITGIRVIRAFVRDEREQARYEVANNDVTQVSLRAGKIMALMFPTVMLIVNLSSVAVLWFGGHRIDSGAMQVGALTAFLSYLMQILMSIMMATFMFIMIPRAEVCAERIQEVTATETSVTPPAAPVTEVTRHGELELRAVSFHYPGAEAPVLSDVRLIARPREVTAIIGSTGSGKTTLLNLIPRLFDATEGAVLVDGVDVRELDPDLLSRLVGIVPQRPYLFTGTIATNLRYGNPDATDDELWAALEIAQARSFVEKMDGRLDAPIAQGGTNVSGGQRQRLAIARALVHRPEIYLFDDSFSALDYATDAALRAALTDHIADATVVIVAQRVSTIRDADRIVVLDDGRVVGTGTHEELMDGNPTYREIVLSQLTEQEANA

SEQ ID NO: 12426 - protein, 614 aa, Actinoplanes utahensis
MLAQQRDGRRDQRGPPLTRRQGRLSSPSVLHAAQPTERALTQPLTFVMDPRRTGNGTVAYQGDVSQQKSYRRVIRQVTTGFAAILVFLALILPDQITRLPPGNHWYTALLRIPLEALIAGAALLVVPAARWRRRLAAALGLLLGALTVVKLVDIGFFAILARRFDPVLDWTLFDDGYNFLVDSMGRGGALGVASGVVLLAVLLIAGMIWAMLRLTQVALGHRRLAWSGLGAATAAWTVLALLGTQLIGGLPVAAHAAADLAQETALALPKDLADKRAFVAEAGDDAYRDRPADQLLTALRGKDVVVSFIESYGRDAVENPAFDGSVLTALADGDKKLAAAGFAARSGFLTSSTAGGGSWLAHSTFLSGMWVNNESRYRSLMATDRLTLTRTFKNAGYRTVGVEPGVIYAWPEGDFYGYDQVYDKAALNYHGPQFSWSPMPDQYALAQFQKAEYSRPNRGPLLAEITLTSSHTPWAPVPGMLDWDQLGDGSVYGPMARSTNPKDVWSDDSRIKTEYARSIAYSVDSLIGWAATYGDDNLVMVFLGDHQPASVVVGQNASHDVPIAIVAKDPKVLDRIASWGWTGSVKPAPTAPVWPMNTFRDRFLQAFGPEGDPH

SEQ ID NO: 12427 - protein, 271 aa, Actinoplanes utahensis
MTVSCRPSGPKAIRTRGFPHPPGRKPAGCALGAAGRPYARAVLAEPSLTHRPEDGHSAPLLLWRFPEPVLAASTAVLGGGVGRCEWVINASVPMSYARPDPANHLAELAAALHLTGPGIGLLTGVDVHDMVATTEDGVEVCATVGLGAPIRAAEPGVTGFAHHPGTINIVIWIPQHLAPGALLNIVATATEAKTQALYALGLHATGTATDAIAVLCPAAGPTAAYGGPRSRWGAPMSRAVYEAVHTGGHTNLTTGRSWSSRAAGPPADRRP

SEQ ID NO: 12428 - protein, 194 aa, Actinoplanes utahensis
MEALELADFRAAVARMYLEPGGLSDFRRRRDELFAGHPQSPIPADERAGFAGLSYFPPNDDLIVEVPVREADGELTIDTGGPDGAVRYRRAGILETPFGELTLWWIAAYGGGLFLPVRDTTCGTQSYGGGRYLTDTVKGTHGRGLQWLRPGRVRLDFNYLYNPSCAYDPRWACPLAPPENRLAHPLAAGEHSYH

SEQ ID NO: 12429 - protein, 189 aa, Actinoplanes utahensis
MRASHRRCILGDVPERISEVTALLAEVLAPRAPLTVIVDGGDPGAAADFASRLAAAFPASARAWSIDAVLGLTGPGRGGGFDSALNVLEPATDQVLVYLRGGPRNRFAAGDGERRAQVVIDHRDPDWPVIRHVHPSLADPDRWYLSESRAFFAARAANWDVKFGDDLPAYARAVREAGVRPGDVVLDVG

SEQ ID NO: 12430 - protein, 151 aa, Actinoplanes utahensis
MGCGTGRALPALAAAAAPGGRVIGLDFTPDMLAEAARAGRDASATLLVADARRLPIATGAADVIFAAGLINHLPDPVAGLAELARVTRPGGTIAMFHPVGRAALATRHGRTLRPDEPLGAARLAPLLAGAGWVLTSYEDGEDRFLALATRL

SEQ ID NO: 12431 - protein, 272 aa, Actinoplanes utahensis
MPDMTQWQAVVTDLDGTVVPAGGDLVSAATLNAAAQLRHRGIPLLAATARTRNGVTRLGAFAGHLTVAVCHGGALGWTPEDGGRTLWQRTLPAPELRDLADFSRTLPGAALSVFGVASWDLTPEYLALRGSPPPEPWRSVPLTDITDQPAYAAAIRHASLSSDELVARLTEAGFAERATLTYAAPHLVEIGPPGVDKAAGVARALDWLGIAPEHTVAFGDMPNDLSMLALAGHSVAIGAAHPAVLAAATARAPGVDDDGFAAHLAELGLISA

SEQ ID NO: 12432 - protein, 382 aa, Actinoplanes utahensis
MGMVKVVGLVLHPRRDCGSAVDTIVSWAAARGVTVLGLPDEINRIDCSAVAVSAEEMVERAGLLVSLGGDGTMLRSMRLVEGRKTPVLGVNVGRLGFLAEVDLPDLKDALSSIDDHSFRVESRTAVRTVLPDGRRVTAFNDIALVRVPGHGLAAVGIRVEGKRFVNYAADAVLVSTPTGSTAYSFSAGGPIVSPNVEGLIVSAAAAHSSFNRSLVLDTSEHLSLDVLPTSGRLAIEVDGIIEGYAEPGAAVEIEPVPGAAQVIRFGETSFYERARRKLRVEGSAQAGDWDTGDAVVVDSFERQRYEVLVGGEVAGMLHYRRHGDRVELLHTEVDQAFSGRGLAGRLASAALADARSRSVPVTATCPFVAGYVERHPELTELS

SEQ ID NO: 12433 - protein, 552 aa, Actinoplanes utahensis
MGQAAILTVDDDPSVSRAIARDLRRRYGDRYRVIRAGSATEALDVLKELKLRGGRVAVMLADYRMPQMNGIEFLEQAMDLFPHARRALLTAYADTDAAIQAINLVDVDHYLLKPWDPPEEKLYPVLDALLDAWQATGDQEMPDIRLVGHRWSEPSFQIRDFLARNLVPYKYFGADEPEGRRLMEAADAGPESIPLVVTADGRALPRPSVQQVAEAAGLSTNPGRDFYDLIIVGGGPAGLGAAVYGGSEGLKTLLIERQAVGGQAGQSSRIENYLGFPDGISGAQLTDRARRQADKFAAETLNTREVVGLRTDGSARTLTFADGGEVSAHAILLATGVSYRPLVAEGVAGLTGSGVFYGSAATEGPACAGSEVYIVGGANSAGQAALFFARYARKVTLLVRGDSLESSMSYYLIQQLAQVSNIEVRTRCEVIGAQGDGHLQAITICDSKGGTKATVECGYLFVFIGAEPRTDWLGDAVERDGKGFVRTGSDLLANGTRPRGWDRDRDPFYLESSVPGIFAAGDVRANSIKRVASAVGEGAMAVALVHRYLEAQ

SEQ ID NO: 12434 - protein, 489 aa, Actinoplanes utahensis
MTIEADEIQLQPCEPGRLTPAELKSLFLFEKLTDEQLAWIAEHGCTMRVAGGGLVLREGDPADQFFVLLSGTIALTRRVGQDDVQTSRTEQRGVYMGATNAYLRDDGVPQRYMASMRALSDAEFFVLSAGDFGRLMRDWFPMAIHLLEGLALGMRSSQAAIGERQRLQALGALSAGLMHELNNPAAAAARATGALRERVAAMRMKLGKLAKGKVAPDRLTALLELQEEVIERAAKAPVRTAMQIADLEDELGDWMDEHGVTSGWDVAPVFAQGGIDAECLTEILARLESPELLDQAIHWIGYALETEQLMSDIEDATGRVSSLVNAAKQYSHVDRSAHQWIDVHTGIDSTLVMLAHKIGNGVRVVKDYDRTLPQVPVHPAELNQVWTNLIDNAVQAMSGAGTLTIRTYREDDRVVVAVGDTGPGIPDEIKKRVFEPFFTTKPVGEGTGLGLDISYRIVVNGHGGDLSLQSAPGDTRFLVRLPLSEPASA

SEQ ID NO: 12435 - protein, 133 aa, Actinoplanes utahensis
MATVAVETIVDLPAARVWEAIADVGAVHERLLPGRVVAAEIDGGFRTLTMPNGARIRELLIAIDHELRRFAYAVVEGQGLPLTYHQAAFQVFEVEDQARIVWTTDLLPDALAGAVRARVERGIVEMKAVLEAA

SEQ ID NO: 12436 - protein, 288 aa, Actinoplanes utahensis
MAEYRASQTAVLVCQGRAAAHDRIAPGRFADPTAWELLRDDERTQVDLVREQRLPADWNGRVGYEMVLRCAEMMVPRTVAIDEAVREHRTPQVVILGAGLDGRAWRMPELAEVDVFEVDQPASQQDKRDRAGKLPGRAPVFVPVDFGRDRLGDALAAAGHRAAMPTTWVWEGVVPYLTPEEVTTTVRAIASLSPSGSRLITNYQTKSASAAFGRFVVQGMARLTGRANPWAAEPWRSTWRPESMSQLLTRHGFTVVRDNHLLDLAAGMMAATPDTISFRTSRVTVADI

SEQ ID NO: 12437 - protein, 167 aa, Actinoplanes utahensis
MDVTGLLDDAYGRLPAMVESAVQGLTPEQLRWAPAPGANPIGWLVWHLTRVQDSHLAELLDTEQVYVEGDWAGRFGRKPDPSDTGYGHTAAEVAAVVPESAAALIEYYHAVHKRTVNFVRGLTEADLDRIVDRRWDPPVTLGVRLVSVYDDDAQHAGQAAYVRGLLS

SEQ ID NO: 12438 - protein, 242 aa, Actinoplanes utahensis
MTERAQARIWDGIDIPKTIAGTLAAVSAAVIGSFLGVAGTLAGAALVSLISSVGTEIYRHFVHHGTRKLQAAFVTAPAAIGTPEVAAAPAAPADAPAGPSRRIHWKRILLVAGALFLLALGTLTTAELLAGRSAADATSGRDSGAPTVFHWSGRHTTDKKQAPAPSPSTTATGSDQTAKPAGTTAPADSGPGPTATTKAPQPEQTGGTGSTPGSDTATAGTGDGAGADTQQNSEQHSDQQGD

SEQ ID NO: 12439 - protein, 448 aa, Actinoplanes utahensis
MSLRPGARAWAVWAAGLAAYVIAVLHRTSLGVAGLDAQHRFGVGAGTLASFAVLQLLVYAGLQIPVGLLLDRFGSLRLVVCGGLVMAAGQVLMANAHGITGAVLARILVGAGDAMTFISVLRLVPHWFPPRRVPVLTQLTGLVGQAGQIISAIPLAALLAGPGWRTAFLSAAGAGVFVALVALAALRDTPERRMSSGSPVSMRQLGADLSGAWRHPGTRLGLWTHFTTQFTGTVFALMWGIPFLIAGEGLTRGEAGSLLTVFVITGMAAGPVLGTLVQRYPLRRSLLVLGIIAVNLGAWALVLLWPGRAPLPVLILLVVALGSGGPGSMIGFDYARTFNPPHRLGTATGVVNVGGFVASLLTIELIGLILDARTGGSADYHIADFRVAMSVQFLVAAAGLTGILRTRKLARRRLEQEEGIVIRPLRVALAERRVLAASRAVKEEGWRD

SEQ ID NO: 12440 - protein, 99 aa, Actinoplanes utahensis
MVVTPSAAEVRAMPKINVYLPDELAEAVRETGLPVSAICQRALEQAVRRVTAIRETSLGELSSGDLEERFPLMTGRTRTVLALAVERARASAARAAAAG

SEQ ID NO: 12441 - protein, 608 aa, Actinoplanes utahensis
MRQRDDVAVLPAFTEISSEIAGNWSPALSPDGRHAAYVSDRGGTPAVRVQPVGSDRAFAITFPEPVAAVAWSSGGGWLACRLTPGGAPRHEVWLVRPDGSDPHQVAGFGTDTAENMRWLPGRPLLAVTENLTHALLVDAVTGTRTVVATGDLISLCDIDPAGRFALLRQGPRGARRILCKNLLAGTSETIAPGELALFSPGGGCVYARSEAGEFPALIRATAGTVETLTTEPVELETFAITADGRTAALLWNVRGGESALELRTLDHVVPPASSPTGRAFEPTVGTTTRSVTVPLPGTVISEPVWSFDGSTLAFTAESPGQPQGVWACDRDGGNVRPISAEPAAPDAVRPTLEKVTAHDGLTLTGWLFTPPGGTAAHPTVIWLHGGPEAQERPGHGPLFQSLVRRGIAVFAANVRGSSGFGHTFVNADNGALRYDAIEDVRSCARHLRDSGIAGRLGVMGRSYGGYLTLAALCAYPDLFAVGIDICGMSDFATFYRYTEPWIAAAAVSKYGDPVADADLLRDLSPVHRLDHLRAPLLIIHGENDTNVPLIEATQVAESLAARGAPHRLVVFPGEGHDLLHRSSRAAFLQETVTWLTTHLSGDQRSRHE

SEQ ID NO: 12442 - protein, 590 aa, Actinoplanes utahensis
MCGIAGEICYGERVADTDAVRRMLPVLQSRGPDGEGVWEHGRIAFGHRRLRIIDLSDAGRQPMTDDVLGLTVVFNGCVYNYRELREELRGHGYTFVSGSDTEVILKAYHRWGADCVTHLHGMFAFAIAEHDTGTVTLARDRLGIKPLYLAETPGRLRFASTLPALLAAGGVDTTIDRVALQHYMTFHSVVPAPRTILSGIRKLPPATVRVIKADGTGSERTYWSAAFTRTADRSAGEWAEAVRERLNIAVKRRMVADVPVGVLLSGGLDSSLVVALLAEQGQRDLTTFSIGFEAAGGESGDEFAYSDLIAKQFGTEHHQIRIGHDRFLPAVDRTVAAMSEPMVSHDCIAFHLLSEDVAQHVKVVQSGQGADEIFAGYSWYPPLAGVPREQAAEAYAREFFDRPHAALRGQLNPAWMLDRDHAAAFVAESFARPGADTAVDAALRIDSQVMLVDDPVKRVDNMTMAWGLEARVPFLDHELVELAAACPPEHKLAADGKGVLKDAARGLVPDEVIDRPKGYFPVPGIRHLEGAMLDRVRDALHAPAARARALFRPEYVEALLADPNTPRTTLGANQLWQLALLEMWLQDKNI

SEQ ID NO: 12443 - protein, 876 aa, Actinoplanes utahensis
MLGDDRKWARDTSATPDRNAERTSELKAVAMAESLTLGAEEELHVVDVTTRELTPRAPEILDRLDPAHFSAELHRSVVETNTPVTTTLDGLREGITQRRRTAVAVAESLGLGLVAAGTVPLVDLDALPVTGTTRYRRMLHEYQMLVREQLICGAQVHVGVPDRDEAVSVAQRVAPALPALLALSASSPFWMGEDSGYASVRSLVWMRWPTAGDSGVLHSAAEHEQLVSDLIASETISDPKMVYFDVRPSAHVPTVELRVTDACPDVDTVVLLAGLFRALVRRAQHEHRAGVPLPPARPPLHRAAMWRAARSGLEGDLLDLPRTPAPVPATVAIEHLVGELRPHLEELGDWEQVCDLSARALSRGSAAARQRRALARRGRIADVVDLLITDTRGTAAASVAGGGLSGPDRLLPYDVAGDEAFPAESVAPEYAEVLPVLTALGATGLRKREDARDEEQRANGVTFSVAGEAATRLFPFDLVPRIVPAADWAELRAGLTQRVRALNAFLSDVYDDRAIVAEGIVPEWVIDGSPELRASGALIGGGAVRAQVAGVDLVRDADGGWCVLEDNLRVPSGIAYAMQNRRLTESILPELPRPRNLTPVEDTPALLKDALLAAAGPAAGDDPALVVLSQGPEDSAWFEHRMLAEAMDVPVVRTTELFVDGGRVHRLRDGKRYPVDVIYLRMGEDSLVHAPGADGMPLGPSLVAALHARTVTLANALGNGIGDDKAVYAYVSRMIEFYLGEKPLLADVPTYLCGVAEQRAEVLSRLDELVCKPVDGYGGDRIVIGPHATADELDALRRQIRAAPHRWVAQDLVRLSTHPVFDGQRLAPRHVDLRAFVFTGRQPVVAPAALTRVAPAGSMIVNSSRGGGSKDTWLLS

SEQ ID NO: 12444 - protein, 356 aa, Actinoplanes utahensis
MGNVVVITGSAGLIGSESVRHFAGLGMDVVGIDNDMRGYFFGADGSTKWNLERLTTEIGPRYTHYSLDIRDREGLGKIFAEYGRSIGLVIHAAAQPSHDWAAREPFTDFDVNAVGTLNMLEAARRHAIDAPFIFTSTNKVYGDTPNSLPLVELDTRWELPEDHKWFQGIDETMTIDNSLHSIFGASKVAADVMVQEYGRYFDMPTAVFRGGTLTGPGHSAAELHGFLAFVMRCVMEQRKYRIFGYKGKQVRDAIHSHDLVSAFEAFHRAPRVAEIYNMGGGRTSNCSVLEAFALASEIAGLPADTEYVPENRVGDHQWWVSSTARFEEHYPDWKVTYDVPMILRDMYESNRDVWKA

SEQ ID NO: 12445 - protein, 377 aa, Actinoplanes utahensis
MSRSTSTTPDAVTRYAGSSRCRAWVRICAGSISRTPTTISTAASTAIGMVSSSAAQNSTKTAIHTPCRIADARLRAPAATLVELRTITPVTGRPPSSPESVFAAPWATSSRLSRARGPSCIRSTATADSSDSTLATSAMVSTATVIRRSGASGQIGVISSASGSSGRSTRTTPAPSTQASAVTAATATSAAGNTVIFTKRGQSSSTAMVSRPSRVAGAWWMATWPGSCRRLSQALLCGAPPSSTWIWLSVMTRPMPASMPCTTAGDRARAARPSREIPSRIWTRPAAATIAAVPAKPNSATAPATITVRPAAGPLTWSGAPPRAPATMPPTTAATRPASSGAPDAAAMPSESGMAIRKTTTDAGRSRRSNCVSTDIR

SEQ ID NO: 12446 - protein, 398 aa, Actinoplanes utahensis
MSVLTQLLRRDLPASVVVFLIAIPLSLGIAAASGAPLLAGLVAAVVGGIVAGALGGAPLQVSGPAAGLTVIVAGAVAEFGFAGTAAIVAAAGLVQILLGISRLGRAALALSPAVVHGMLAGIGLVITLSQIHVLLGGAPHSNAWDNLRQLPGQVAIHHAPATLLGLLTIAVLLLWPRFVKITVLPAALVAVAAVTALAWVLGAGVVRVDLPEEPLAELITPIWPDAPLRRITVAVLTIALVASVESLLSAVAVDRMHDGPRARLNRELVAQGAANTLSGLLGGLPVTGVIVRSSTNVAAGARSRASAILHGVWIAVFVLFCAALLETIPMAVLAAVLIVVGVRLIDPAQIRTHARHRELPAYLVTASGVVLVDLLTGVALGVLTAVAWRRASRLAVGS

SEQ ID NO: 12447 - protein, 331 aa, Actinoplanes utahensis
MTKRLAEVAKKAGVSEATVSRVLNGRDGVSEATRASVLTALDVLGYERPTKLRGERARLVGLVLPELQNPIFPALAEVVTASLAQRGFTPALCARTIGGVPESDYVEMLLDHQVSGVIFAGGSYALADASHEHYRRLTDRGLPVVLVNAGVDELGFPRVSTDDAVAVEQAFGHLRSLGHERIGMVLGPEGHIPSRRKLTSMIQVAGWTDDKWVERSSFSMEGARVAAAKLIERGATGIICASDVMALGTIRAARRLGHAVPADVSVVGFDDSAFMTCTDPPLTTVRQPIETMGQSAVDLLVTQIEEARVVRDELLFEPELVVRGSTGPAPR

SEQ ID NO: 12448 - protein, 459 aa, Actinoplanes utahensis
MSAPQYRKAVAFALAAGLGLSLAACSTKSDDESTSADGKTTITVDCMPVGTEKELVANWNADVAAFEKANPNITIKSVSVGTQCNNPPDFTARLAGGTTTDVFYGYMTDLQQVLDSGQAMDITPYLTDENVPTWKDVDPALKQVFTDGGKTYALPIKNYSMGLVYNTVLFKKAGLDPANPPKTWAEVRAAAKKIVTADPAVAGYADYSAGNTGGWHFTAELYSQGGQILTADHKKADFNNAMGKQVLQNLKDMRYADNSMGSRQLLQWGDLLTNAAAGKVGMFIGAPDTTQQIVSQFKGRYSDWAVAPLPGQDGLAKATLGGGDGYFFKKGLTDAQIKAGLKWVAYEKLTVGKGQFDYPRAKPQNYPVGLPQPLLFTRDSATAKAEFDLRKANANVDPAIYSLFEAQQLPIKGEPTNAQAIYAVLDSAMSGVLTNPNADPGELLKTAEQKVDQLLAAGS

SEQ ID NO: 12449 - protein, 315 aa, Actinoplanes utahensis
MATITAPGTTGKPAARVVQARTGARRSRKIRDNLTGYVFLIGAILCFALFTWYPMIRGIIMSFQKTRRGVTTWVGFDNYTRIIADPSFWPAWRNTVYFTVLALVIGYAVPFFVAILLNELRHAKGYLRVLVYLPVMLPPASALFLFKFYAYDPGDAGLFNAILKFLHLPTSQWMQSPSATMPAMVIASTWMNMGSAVLIYLASLQNIPGELYEAAELDGAGLWRRIWNVTIPQTRLILGLLAMIQIVATMQVFIEPLILANGAGTQDSATTVAYLIYQHGFYQNDLNGAAALGVIILLALAAFSGVYLRLTTKND

SEQ ID NO: 12450 - protein, 295 aa, Actinoplanes utahensis
MSQDSGTRTLVSQAQLRRGRGRYVYWTLLGLVVLAFTLVFIGPLYWMVTGALKTGQEVAQTPPTLWPRHPDASNYTNAWQNLNLGKLLFNTFYYAIGAVLFQLVFDTAAAYSLSKLRPVLGNVVLGAMLATLMIPVIVLIVPQYVTVIDLPFVHTSLINQPLAIWLPLVANAFNIFLLKRFFDSIPEDLMAAAQVDGAGPLRTLWSIILPISRPILGVVSIFSVTYVWKDFLWPKLVMPDPSTRTVSVGIVAFSGGSSVNEVIAASVIAAVPTVIIFLIFQRNIMSGLTAGSVKG

SEQ ID NO: 12451 - protein, 519 aa, Actinoplanes utahensis
MSAKDSAWWRDAVIYQVYPRSFADSDGDGVGDINGIRARLGHLRDLGVDAIWMSPWYPSPMADAGYDVADFRDVDPVFGTLAGAEALIAEAHAAGIRMIVDIVPNHISAEHPWFRAAIAAPDAPERDYFWFRPPSERMPTGWTGEFGGTTWTKAPDGSWYLHLFTPEQPDLNWEHPDVQAEFEDILRFWFDRGADGIRIDSAALLFKDTTLPEVEEGRPHPFHDLDAVHDVYRAWRRVADDYEGRALIGEVWMPDVERFTNYLRPDELHAAFNFDFLGCAWDPALLRSCIDRTLDAHVKVGAPATWVLSNHDVTRHVTRYGRTDTTFSFENNLDGTPVDLELGTRRARAAALLSLSLPGATYVYQGEELGLWENENIPEEQIQDPMYGRRGHTRDGCRVPLPWSGDEPPFGFSSTDPWLPQPAEWKDRTVAAQTGDPNSMLELYRSAIRLRGEHLDDPAMTWFDHGDDVLAYHRGADFACLLNLSGAPVRLPEHQTILLASGPLDGDLLPRDTAIWLRL

SEQ ID NO: 12452 - protein, 755 aa, Actinoplanes utahensis
MANRTAPLLTAAVVLAAAVTTVMWQSPAAQAAGLSPFDVAGRGATVPFTEIEAEKAATNGTSTGTDRTYGTLSSEASGREAVTLDAAGEYVEFTLTEPADAVTFRYSIPDGRNASLDLRTGSTLIRTVPVTSKYSWYYGYYPFTNNPGDGRPHHFYDEARALFGTTYPAGTKIRIQVGSTAQSPSFTVDLADFENVPDPIGKPAGAIDAVADYGADPTGATDSTAKIQAAVDAGSASGRVVYVPPGNYTLYSHVIVDRVTLAGAGPWYTVFGGRHPTQRNLAAGIYGRYANQGGPSRNVTVKDLAVIGDIQERVDEDQVNAFGGALSHSTLDDVWMQHTKVGAWMDGPMDRFTIRNSRILDQTADGVNFHMGVTNSTVTDTFVRNTGDDGLAMWAESTPNVGNSFTHDTVVAPILANNIVSYGGRDITISDNVMAETVTNGGGLHVANRYPGVQGPTAVAGTWTLARNTLIRTGNSDYNWNFGIGALWFWPDSGAITGATLNVTDTDILDSSYAGIQWIGNGTSGLTLTNVTIAGAGTFALQVQAPATATFTNVTATGIAQNPPTYNCTGSGLAITDGGGNSGWQTPAPYCGPWPAPRWGNSTRPPPTSSPTPSPPANGNLAQGRAVTATSANGPYVAANAVDGNAATYWESANGAFPQSITVDLGQNRTLARVVLTLPPATAWATRTETLSVLGSTDGSTFSTVKASAGYTFDPAGGNTVTIPVTATSRYLRLTFTGNTGWPAGQLSELEAYAS

SEQ ID NO: 12453 - protein, 1272 aa, Actinoplanes utahensis
MSRFRLIAAAAAASVVAALVHAPAALAAGPNLAAGKTFSASSYTDVYPAGNAGDGNADTYWESSNNAFPQWLQVDLGSATPVNQAVLKLPPATAWNTRTETLSITGSTDGNAFSTLKASAGYTFNPSSGNTVTVDLTTVSTRFLRLNFTANTAWPAGQLSELEVYGPVSGDSQAPSAPSNLTWTQPASGQIRLNWNASTDNVGVTGYDIYANGQLRTSVAGNVLTYTDSQPDSATVAYYVRARDAAGNVSGNSNAVTRTGATGDTQAPTTPGTLSYTTPASGQIRLSWGASTDNVGVTGYHVYVNGTLKTTVTGTTYTDSQPDTATVAYYVKARDAAGNESAASNTVTRTGAPQTGTNLAVGKPIEASSTVFTFVATNADDNDTATYWEGSAYPANLTVKLGANAGVTSVVVKLNPSSDWGTRQQTFAVLGREQSSSAYTTLVGSTTYTFNPATGNTVTIPVTATTADLRLSFTANTGAPSGQVAELQVIGTPAPNPDLTVTGITTAPASPVETDAITLSATVRNAGTAASAASSVNFYLGTTKVGTASVSALAAGAATTVTASIGARDAGTYAVSAVVDEADTVIETNDANNSYNSPTSLVVAPVSSSDLVASAVSWSPGNPSAGQTVTFSVTLRNQGTAPTGSGAHTVTVTVLNGSTTVKTFTGSYTGTLAAGAASPSINLGTWTAVNGRYTVHTVVAADTAELPVKQGNNTSDKAFFVGRGATMPYDMYEAEDGTVGGGAAVVGPNRTIGDLAGEASGRRAVTLNQTGASVQWTTRNATNTVVARFSIPDGTTSSINVYVNGTLNRTLALTSKYAWLYGSETAPQNSGTGPRHIYDEANTLLTGSFPAGSTIRLQKDAANSGSIAIDFIQLEQVAPVADPDPSKYVVPTGFDQQSVQAALDTARQDSTKLGVYLPAGDYQTSNKFQVYGRSLKIIGAGPWYTRFHTPDTQTETDAGFRADATANGSTFADFSFWGNYTIRIDGPGKVFDFANVSGITIDDIWAEHVVCLYWGANTDNMVIRNSRIRDTFADGINMTNGSTGNLVDNNESRATGDDSFALFSAIDAGGSDEINNTFSNLTSLLTWRAAGIAVYGGYANTFKNISIADTLCYSGITVSSLDFGYPMNGFGANPPTVLDNISVVRAGGHFWGQQVFPAIWMFSASKVFQGIRISNVDILDPTYSGIMFQTQYIGGNPVNPITDTVFTNVTISGAQRSGDAFDAKSGYGIWANPLPEAGQGPAVGSATFTNLTLSNNYRDIENPTTTFTIIRN

SEQ ID NO: 12454 - protein, 170 aa, Actinoplanes utahensis
MHIEFTHARSQEYFHRRFAGAGSKVARPFAIPAAILGVLGWLVCCAAGSVRSELAAGGVLIAVAAALAGVAFLRWRQEVVVPADWREPRTYVLTDESFTSWTAKTSAKLAWSAFTWLRQEDDAYLLRTIAGRTWDIPREPLTAEQDAVLAGFLAELLAAGSAAPAERDRS

SEQ ID NO: 12455 - protein, 169 aa, Actinoplanes utahensis
MTDWDQGDSWSSSSAGQEDWSAQDRQRDSANRLANVSNDMATATQAAVHAAETAVQVIQRLEASSTEIGKVVQLIATIAKQTNLLALNATIEAARAGEAGRGFAVVASEVKDLANETATATNEIGTQVGGIRTDTQNAVEAIQEMQGLIEELDRCQKVISGIVVEQQAG

SEQ ID NO: 12456 - protein, 129 aa, Actinoplanes utahensis
MASRRPPRARACPCGSPAYARCCGPLHEGKPAESPEALMRSRFSAFALDLSDYVQATWHPDTRPATLESDPGLRWVRLEVRETTGGTLFDAEGTVTFRAHFRDNGTPGVLDEKSRFVRHNARWVYHSPV

SEQ ID NO: 12457 - protein, 283 aa, Actinoplanes utahensis
MSATRPIEDGIVRDFKVNLSYGEYLHLDEILGAQHPVSVPEHHDELLFILQHQTSELWLKLIIHELRAVLRNLAKDDLKPALKGLARVKHIQRTLTEQWSVLATLTPTEYAQFRSFLGTSSGFQSYQYRAVEFLLGNKDRGMLPIFDDQPAARELLAELLGTPSVYDEFLHYLARHGHPVPEAILARDVTEAYEYQPDLVPVFQHIYEKAEQYWEAYEACEELVDLEENFQLWRFRHLKTVERTIGFKRGTGGSSGVGFLKAALDLTFFPELYAVRTEIGVPR

SEQ ID NO: 12458 - protein, 405 aa, Actinoplanes utahensis
MSLLARAADLDAADPLAKFRERFVPAPAVASYLDGNSLGRPLIATAQLIDEFVRDQWGGRLIQGWTDGWLEWPLTLGDRLGAVALGAAAGQTVVADSTTVLLYKLARAAVDARPGRRRVVLDTDNFPTDRYVLEGIAAERDLTLVWITTDPVTGIHPEQVAEVVDEDTALVLFSHVAYRSGWLADIPEINRIAHEAGALTLWDLCHSAGSVPIRLDEWGVDIAVGCSYKYLNGGPGAPAFAYLRRELQDEVRQPIHGWMGHRAAFEMGHGYEPAPGIRALLSGTPPILAMVPMHANLDMLAEAGIDAVRAKSLLLTGYVLELADEWLTPLGVEVVSPRDPARRGGHITLRRAGFEQLLEPLWAGGVIPDYRRPDGLRIGPAPLSTSFTEVHQGLATLRDLAGKHR

SEQ ID NO: 12459 - protein, 428 aa, Actinoplanes utahensis
MTASETPPSEVCDPASPAASASSPCGGAGCGGAGCFSRTSRSARPGESDAGGTPRPARPGESPSDGPPRHSRSGQSRPTVTRVPDPRVDDRIDWLIADSVWWGGRLRRGVALRVAADGQAKPVPAEMAPPDAVRRFPGTLLPGLVDAHVHAALVDLGTVRSGGIAAVWDLGGVPDTLRELAARSAEPGTGLPHVRYAGPFLTAPGGYPSDRTWAPPGSWREITSAADAGAAVADAWSAGATLIKVTAHTGGPTLPQPTLRALVDAAHAATLPVVVHAEGPGTVAAAVEAGADLLAHTPWTEPLPDALIRACADRMTWVSTLDIHGWGSPDAAQGIAVDNLRRFIDAGGKVRYGTDLGNGPLIPGVNPRELRALRSAGLTPDEILIAMTEPGTPGVTWLPAGLTLAPDTFADSLATARVLDDSTRPRPA

SEQ ID NO: 12460 - protein, 340 aa, Actinoplanes utahensis
MIERVRVGLVGYGSGGRIFHAPLIAAAENIEFVGVVTTSEERRKQIAEQLPGVEAYDSIEALAAAGVRAVAISTPASTHADLAREAVRLGLAVVVDKPFALDAPTARELVKSAEAAGVPLTVYQNRRWDSDYLTVRKLIEKGSLGTIRRFESRMERWAPDRLPPAAGGGTLLDFGSHLVDQALKLHGPAQRVYAEVRGEGELDDDFFLAMHHLSGVESHLWGSWRQAGPGPRFRVTGTAGTYISAELDCQEEMLKAGKTPAKLGDRWGVEHEHRWGHLWRGTTGAPVESCRGRWDSFYPAFADAVLGNGPLPVDPWDTVRAMEVLDAARVSASTGRSVAL

SEQ ID NO: 12461 - protein, 263 aa, Actinoplanes utahensis
MTTPLPRPAPAAPAWLTWPIRAVALIVVFPFRLLWELGVLVQRFVVRPVGRALGWLLRTLLVAPLLRLVRQLLQWVLLPVWHALRWLVAALVTGVAWVLRQLVRFLLRPLLVFLGRFVLFPLGRALAWTWHVLIAPAGQAVYNWVLAPIGHGMAWVLITFYRRVLTPLGQALVWAADASYRWILRPIGRGIAGTAALIGRSLAAAARMVYRFLLRPAGIAIAFVGRHAVGPAFRAVGAVGRRLRDEIVRPAGNVVRTARGLRR

SEQ ID NO: 12462 - protein, 307 aa, Actinoplanes utahensis
MEPAQQERTPFADIDGLTAPMTDLVLTALTEMGRHPEIRRVRRAGFDALRPAPGMRLLDAGSGSGEVARSLAAETGPRGEVIALDYSAAITAAAIARHDGGNVRYVTGDVGALELPDDCVDGVWCERVLQHVADPDAAVAELRRVTRPGGRLVLIDTDWDSLAFDGMPARLWAELSAYAARHFTPPQRDMGRTLRRRLVAAGLSGLTATPVTCLFGSPESAAVVLPMVNPRVPAETWQTPPGLREEWLSCVEAAGARGDFLAVLTIWVVTGTVQRSTAATGRAEPSPTIVPRGPSGAGGGPAACWRS

SEQ ID NO: 12463 - protein, 491 aa, Actinoplanes utahensis
MNTTDITRHNITMQPDGRRVVIKLFVPGEDAHATHNRTACMIERMLQLDENDIGTLLEDVLNRFSGRHHDILSVFQHHYEVVQHRVPPEIELSPQARTLIGAYFSHEFSVEAAALCNPSMVPHPDQSDLAPGELRGALSLRQIGEGHISSIGFCSVIIGPGAAIRLEDRDGPLAIGTRVGAKHMKHQLFAALGDEDIDNECSAYILNSLPERYDDAEFEDILSHLPPELQARPTTPMTMDLIRRIVLDDYAVTFPATMPLHQRVLWPATPSESRGMEDARFVQVIDPDGRPAYQATYTAYDGFNISGRVIYSRDLRHFEVTALHGPAARNKGMALFPRYIKGRKMALCRSDGETLGLAVRDDQHRWQPAGPLLVPHRGWDLIQVGNCGSPIETEAGWLVLTHGVGPMRRYAIGAMLLDLDDPAKVIADLPQGLIDPDEIEREGYVPNVLYSCGGLVHDGRFWLPYASSDVRISFASMPLDRLLHRMVPVER

SEQ ID NO: 12464 - protein, 360 aa, Actinoplanes utahensis
MSQGLRLIPPPVRLTDVPEPRFDHVLRLSDDTGLLEHARTAIVRREHGYCVDDVSRGLLVVSREPRPAPEVLRAGERYLAFLTHAQDADGAFRNRMGYDRRWQDEPSLGDWWGRALWGLGTAAARSTAGWIRREARYAFHLGATRRSTWPRAMAFAGLGAAEVLRADPRDRLAADLLGDAATVIGLPGSDPDWCWPERELTYANPALAEVVIAAGDLLGDEALLADGLRMLAWLCRTQEHRGHLSTVPVGGWRPGSARHRHDQQPIEAAATADACATAAAVTGDERWDAPLFQAIAWFLGDNDTGTVMYDSETHGCYDGLTADGPNLNQGAESTLALVSTLQHARTLAIRSATRPQGGLA

SEQ ID NO: 12465 - protein, 388 aa, Actinoplanes utahensis
MPATYGFLSTYPPTQCGLATFNAALAMHLAAGTPGATAGSGVVRLLARDNTSGGIALDRAAPRVVHTWHTDLPGGWAGAAAALNRFDVAVIQHEYGIYPGDAGAEVLPLLHALKVPSIVVLHTVLTQPDTLQRAVLEQIAEVADAVVTMTDTARQRLTTNYAVNPRKITVIPHGAGSHAGVPREDHDRPHLLTWGLLGPGKGIEWALRALALLDDLSPAPIYTVAGRTHPKVLEQQGDVYRDGLKSLADDLDVTASVRWLDAYLDAGELSRLIRSADAVVLPYDSTEQVTSGVLIEAVGAGVPVVATEFPHAVELLASGPGLLVPHQDPEAMACAIRHVLAEPGLPGRLAGLAGGPTLRWPAVAARYQSLAARLLADRVPLPAATLTA

SEQ ID NO: 12466 - protein, 337 aa, Actinoplanes utahensis
MCFVVKIALLGPIAWRTPPVHYGPWELITSLLAEGLTARGVDVTLFATLDSVTKATLDGVVPTGYEESDSLDGRVWEAIHVSHALARSGEFDLIHNHLDWLPLAFSAHCAAPMLTTVHGFSGANILPAYRRAKSRFVSISDSDRSPELDYVATVHHGVDLDGLPLHTTGGDDLILFGRIHPDKGTDLAVEIARRAGRRLVICGIVQDRRFFREKVEPLIDGDRVVYLGSVGPEERGAILGSGAALLHPIRFAEPFGLSVVESMICGTPVIAYRKGSMPEVVDEGVTGRLVGSVDEAVAAVDEVAALDRRVCSARARERFGADRMVDAYLAIYRKIVC

SEQ ID NO: 12467 - protein, 566 aa, Actinoplanes utahensis
MTDSWWKKAVVYQIYPRSFADSDGDGMGDLRGIIGHLDHLAELGVDVLWLSPVYPSPQDDNGYDISDYQNIEPMFGTLEIFDELLAGAHARGMKIVMDLVVNHSSDEHPWFAESRSSRDTPKRDWYWWRPAREGMEPGTPGAEPTNWGSVFGGPAWEFDEKTGEYYLHLFSRKQPDLNWENPEVRQAVYAMMRWWLDRGVDGFRMDVINMISKVTPLPDGRLSAGAAYADGSAGFVGGPRLHEFLKEMYREVFDGRGELLTVGEMPGVTVDEARVHTDPAEHEIDMVFQFDHVWADRGPDPWLLQKLQLTNLKAILGRWQAGLAEVGWNSLYWNNHDQPRIVSRYGDDSPEHRVASAKMLGTVLHLHRGTPYVYQGEELGMTNYPFRGIEDFRDIEALGQYKQALELEGRSAEAVLTVLRARGRDNARTPMQWDDSPQAGFTTGTPWLAVNPNYPQINAAAQRADPDSVFHYYRRLIELRHTEPAVALGDFTMLLPHDERLYAFTRRLDATELLVIGNFTGETVQAEIADAASWAHADVLITNVPGATPRNLTLAPWQAVVYKRTV

SEQ ID NO: 12468 - protein, 183 aa, Actinoplanes utahensis
MDPDPPLRRAAPQPPQRLPEDLGPSRAERAGVGPRPDQQVGLQAGVPASPIERDWRADLLALCVMQRALMLAHPWLPGVLAGRRLIGRNLLGFLEHGLRALQPAGLPGVAGMTLLGLLTGFVASYVTSELADASDAVAQIGAAVATGDFPLLARTLGEGGTPLDFPRIADWMITGLVERAEHR

SEQ ID NO: 12469 - protein, 684 aa, Actinoplanes utahensis
MRRNRLAARLVTALVAVTPAIALALVGLGPAPAGGDPLLQTFALTGGLRLAADGAGADVERSLPERDTKPFSLVGVTWDDPRAVAAGTIQVRTRPAGRRTWTPWRELETDAPDESGGQAVRGASDPLWVGPSDGVQARVIAAGAARALPAGMRVDLINPDARPAPVADAMAPAAAERLRRIAGVEIPDRPVPRMLTRAAWGADERMVREKPAYTGPVQVFFVHHTATGNDYSCGSSTSVVRGIQAYQVKSKGWNDIGYNFLVDKCGTIFEGRRGGITRNVLGAHTLGFNTDASAVAVIGDYRGTAAGSATEVAVAQLAAYKLGAAGNAPDGRVVVTSGGGPKYRPGTRVRLYRISGHRDAGLTECPGTSLYRRLPAIRALAGGAPAGLRFAKLTGSTRWGGAYWTRGSLTPLWSLSTPGQLLNRFDVYVDGDLVLSRASTERLGQLQLSPGPHTVTVKALHLSGRSATATVKVIADVEPPAFTTLPQASLSSGTIGTSTPVRLDWSADDPAGIRAAAISGASRATLDGAIRSLTGTAPVGAASSWTVAVTDHAGNERTASISRTPAIVADSDATRTGSWRTVSDSHHLGGAASAAASDSAALSWTFTGRSAAVVAARNPAAGRLKIYLDGDFLGYVDLRSAAPQYRRLVWTQAWSTANEHTVKVVPEATAGRPTVTVDGLAYLR

SEQ ID NO: 12470 - protein, 401 aa, Actinoplanes utahensis
MRVLISGSSVAGPASAFWLHRAGAEVTVVEKSRGPRPGGHAVDVRGVARQVIEWMGIREAIRARQVDERGLKLVDRHNRSMGRMPAEAFGGEGIVAEIEIARGDLAQILRDVTAGFTDYRYGDRITALAQDAAGVDVTFASGLRERYDLVLGADGVHSGVRSLAFGPDQEYVRYLGLYSAYFTVADPGDMDNWYLMYNEPGGLVAGLRPERGGTAKAHLGFREPRMRYERLSRDEEKRVVTERMAGAGWKVPSLLAQMADAPDFFFDSINQVHVDRWWRGRIGLVGDAGYCGSPIVGLGTSMSLVGAYVLAGELSRHGDPERAFAAYQSEMAGYVATGTKLPPGGAAGMAPKSALWIKTRAKTMGMMTRWPIRDLMASQFAKADAIVLKDYGLTPAGAQRR

SEQ ID NO: 12471 - protein, 294 aa, Actinoplanes utahensis
MAEAAYTRIVAELRRRIDSGELRPGDRVPSARAITRDWGVAIATATRAHAVLRDAGLTVSRPGVGTVVAGPAPRRDPDLSRDRIVEVAIAVADRDGMAEASMRRIATELGVATMSLYRHVPGREELELAMIDAALGELRVPPRYSGDWRADLDGCARALWELFQRHPWLGLTMSLTRPQVSPNAMRLGEWIMGTLGRTRLVATDRMMVQVLLFSFIRGVASALQPEAEAMRDTGLTGDEWMEAQEKEFQRFVEANPMPAYEELFLRTPDFVFDLDVLFEFGLARFLDGIAVWIG

SEQ ID NO: 12472 - protein, 194 aa, Actinoplanes utahensis
MPWWGLPLVAAVFALAGALAVQFAAARNNNLLSRRRRTRRWYEERKTAYVQLLAGFERSYVRLRAGFDAGEKPPALLQYVDEIGPALMPVRLLASGPVRSAALAVHLQMERLHGPMNPAGVSGVRPETHFRELLAQVPLIMQQFEAAVREELGIEASPPNPPAHTANGKARLPKRWATLRAADSVATRPERDTH

SEQ ID NO: 12473 - protein, 213 aa, Actinoplanes utahensis
MTDHRAPLDPVSAAIVDSGVVAVLRAPTAGAFAPVADVLVAAGITALEVTLTSRGALDAISGLRRRLPQGTVIGAGTVLTPDDAKAAIDAGATFLVSPVLDTLTDQPVPCYPGAYTPTEVYTAHRAGAPIVKLFPAGGLKPGYLKDLRGPLPNVRIMPTGGIDLDDIADWLTAGAAAVGLGGPLIGDAATGGSLTALAARAKHAVDAVTFARS

SEQ ID NO: 12474 - protein, 298 aa, Actinoplanes utahensis
MGIFVADGIGAFEHARAFTLAVGGAETNVAVGVARLGGAATWLGRLGPDSTGSLIEGRLRFAGVRVLAVRDPAPTGLMVRYRRSAQFIHADYHRAGSAGSRLTPADLPLTELQQAGILHITGITPALGDTARATVFAAVEAARAAGVPVCLDVNYRGKLWSRFDAAPVLRDLVSRSDIVFAGPDEAAIFLNTDDPLDGLTKLGPTEVIVKDGPHGCTALIDGDHFTVPALPVTAVDPVGAGDAFVAGYLADRLAGATPAQRLTTAITAGAFAVTVPGDCDSAPTRADLTALSGADIHR

SEQ ID NO: 12475 - protein, 50 aa, Actinoplanes utahensis
MGGPERCVWCGAVVTVLSADAAWWVVRVVRGGCHRARRGHRLASGPEWCG

SEQ ID NO: 12476 - protein, 138 aa, Actinoplanes utahensis
MQPTPFTPWSFRDPEALSGGYQPTEADVVDETGRIGVDLVGYQVEATDGHIGSVDQASYDVGGAFLVVDTGPWIFGRKVLLPAGTVQNVDQADRKVYVDRTKDQIKASPEYDKDTFETSAYRDQVGDYYTGSYRDYPR

SEQ ID NO: 12477 - protein, 273 aa, Actinoplanes utahensis
MRAASSSSSMTSTVSLRHPVRISPRSGRSCMAKSQRRALRPVDLARPHGLSAQAIRNYEQDGVIPPARRTASGYRAYEERHLLAVTAFLALAKAYGHGPAGVIMRAVLAGDLETAYATIDAGHAELARDRETLTAVEATAEVLTVPTRRGAALPVGALAHRLGVTPATLRKWEEAGILVPVRDRGQRAYSPDDVRDADLAHLLRRGGYGLPHIATVLRQVRDAGGAASLAASLSDWRARLTDRGRAMLTAAARLAELLSVESRAAVVIRDQRG

SEQ ID NO: 12478 - protein, 162 aa, Actinoplanes utahensis
MQLLPLRGEILTGCLNDTVEVMELDELAARICRLPEVVQLIAGPGTGAPELSWGDRFFFVGEDRMRPFATIVVRDVPGFDECSGLDRPGVFRLNLELGRSRFGDLFGFGPEEFAARRSGIDFATPDRWFPHPVYAVQSWASVVNPVTVDVDSLIGHARGRRR

SEQ ID NO: 12479 - protein, 188 aa, Actinoplanes utahensis
MTEALIVIDVQESFRARPLWAAVDNPDLIPNVQRLVDRARAAGHLVVWVLHAEPGTGGVFDPASGFVRLMAELTPADGEPILVKTVHNAFTTTDLQFRLTSAGVRAVTVCGLRTEQCVETTARVASDLGYQVTFVTDATATFPIPHRDAPDDLDDPRTLSAADVVARTEYALAGRFATITTVDEVEKG

SEQ ID NO: 12480 - protein, 293 aa, Actinoplanes utahensis
MSLVVFVLTPQVHLLDLAGPAQVFSTAPDYTLHYVADADTVPTWQGVTLQASRDWPGLTPDDLVLVPGWRDGYGYFRPETLRRLREHHDRGGTVASVCAGAEALGRAGLLDGRRCTTHHDLQDTLARGYPRAGVVRDVLYVSDDRVVTSAGIASGIDLALHLVALRHGPAVAARVAREMVVYARRNGDESQASAMLRHRAHLSDVVHRVQDRIDAAFAEPLRLAQLAAAAGVSERTLSRLFSAATGRTPLRYQQLLRMERAEYLIGHGATVEAAARAVGFGDARMLRRLRARK

SEQ ID NO: 12481 - protein, 458 aa, Actinoplanes utahensis
MQPHVDFPADETGRRSGTALGRAVVADALRVVDPAAAGAAEREADWRRGYPRHFRALVEAGLSADGAAGYEIAEAGLLSLHARIRYVRPDGEFTLAQALLAGGGEPYRTVEVTGSAAPDRTVGLLPRLDAWRAAGVIEPSCADAVREVAADPDWRDLSDLTFALLGAGAEMGPLRWLLDRGATVLAVDLPRPDLWERIAGLAAGSAGRLFAPVRGAGTPGADLTADPGAVAAWLLSFDRPLVLGNYGYAPGSAYPKLAAVTDALAVHLRQRRPDTAFAVLATPTDVYAVPAGAVEQARERYAGRGVRARAVEPLSGGRLLRPNYPLPSTPGINDSLVPQQGPNYALAKRIHRWRATLGRRDGVVSFAVAPPARTRSVLSNRLLKAAYAGAHLFGVEVFDAATASELMAILMIHQIRRPRAADAAAWRDETVAAAHGGLWRSAYHARTALPIAAVRGLL

SEQ ID NO: 12482 - protein, 344 aa, Actinoplanes utahensis
MGLHRASMSFSYQGWTSPPTNGRGSGRRRGAFPRGPAESVDMTTVAVAAPPRRHRPLTVLTWASLALAVIAGIGLIADARILTGVPIWLKPFKFAVSFALYAWTLAWLISVLPRRSRVAEGAATIIGAASVIELAVITVQVIRGTTSHYNQSTPLNSALWSAMGMSIMVLFVAHLTIGVVALRQRVADRATAYAIRLGLLISLIGMLAAFPMTTRKTASGLVGAHSVGVPDGGPGLPLTGWSTVGGDLRIGHFVGLHALQVLPLLAYALGRWAGDRFDATTRARLVLVAGTGYGVLGPLLTWQAMRAEPLLRPSAVTLAAFLVVAVATAAGLTAVASSSGRMRA

SEQ ID NO: 12483 - protein, 135 aa, Actinoplanes utahensis
MTGALFTLTFLLAAPFWALMILLPGWTGTRRIIGSPLIVLPIIGIYAVLIVPNLGHVLPAVANPTLGGIRDLLGSADGAAAGWAHMIAFDLFAGRWIWLDARDRGMRHLILAPILLLTILFGPLGLGTHLVVRKS

SEQ ID NO: 12484 - protein, 380 aa, Actinoplanes utahensis
MALDARDTLTRMLLLDCSGLAYLLVIGRTGHPPTPLQWALAVPAFLSALLLHRHPPINLLLQTALFAAGMLLLDDSTINQVGTAWAIGEFALWAGNRWLLAGGIGMVAATYLICDPPDAVLPSVMGLATSLGLPTLIGLVVRTTRELGVQAEQRAVSEQRAARADERGAIARELHDVVAHHVASMVLRVGVAQHVLPGVDPKVAEVFDDVHRTGTAALGDLRRLVAVLRDPDRAQGDAALTAIEPSALPAALDGAVETARRAGVIVEAEIDPRVAGLDAVRGLALLRLTQEALTNVAKHAGPAARAVLRVTMGGDDLHWSVTDDGGAAPGAARVPGGGHGLTGMRERVEILGGALAAGPEGSGWRVSTVLPAPLPDGIPA

SEQ ID NO: 12485 - protein, 208 aa, Actinoplanes utahensis
MIRVLLVDDQQLIRAGLRMLLDAEPGMEVIGEAGDGRTAIALAAQLVPDVIVMDLRMPGVDGITATSRIMADRPAIRILVLTTFGDDDHLYPALQAGACGFLLKDAPPTDLLNGIRQAAAGESPFSQEVLRRLVRRAVHARPEPPARIDGLTTREQEVLDLVAEGLTNTEIAERLHIGVTTVKTHITALMTKTSSPNRVRLALVARRR

SEQ ID NO: 12486 - protein, 766 aa, Actinoplanes utahensis
MIPAMDKWLELIPAAVDAEPAPDSRRWAFALQWHLAAAERGSPDYGTGADLYELTAEPLPWRREDLSWALRVLGTARVPYDGQAYRLPAVIANQLPVDQLRAYGPVLGAVLDEVLSDWTMPTEARRSISAQYGTAIGRLTGGLPAHLLFGEDGFGPLARHRLGARVTDPATRDALAFAITLTKPVPAKSWLRQAERVRAAGPEVPASIGTVLAAFVELGRPVHDDHDLLLRGLSWLLSLDPGEESTTLLGRVAATAATPWRQGGARLTAAMTAAATVEILTDRPGQAPAGVLGRLMNTRSRPLRDRVWTALERIAAARGWAPGEAMELAVADHDLAPDSTHRYAAGDDFTLGVEIIGEKATVRAWQDGLPLRGVPAALRLQAGPARTLAAEVNKTLAAERARVEALLAQDRTWDWPAWEQRYLRHPVTGTLGRRLIWEVSTAGGTSWTAALPEPDGAGGWRLAGHSGAGCSVRLWHPVLADPAEVTAWRDRITTAELRQPFKQAFREVYRLTPAETQTGTYSNRFAGHILRYRQANALMRVRGWSATYLGTWSSGADSAATKEFAAGEWEASFAHESAGPLGHRDEVEFCSTDQVRFARREGHRWEPARVDEVPPRVLSEALRDVDLFIGVTSIATDDSWTDRGEHPFRAYWREIGFGTLSGSAEVRRDVLARLLPRLTIAARCDIDDRFLRVHGTRTTYKIHLGSANILMEPNDAYLCIVPTGRHPRLALPFDDDERLSVILSKAFLLAADDRITDPSILHQLPR

SEQ ID NO: 12487 - protein, 130 aa, Actinoplanes utahensis
MAEVLMRDETMTGREIGSWMLPDLPDRIPARELLRLRVREEVARFNAAGGELYRGLVRPAAATETPHGFRMPAGGRIDETAQADAACAAFERNGFVMIAGERQVESLDQIIDLRRDAEVAFIRLVALVGG

SEQ ID NO: 12488 - protein, 627 aa, Actinoplanes utahensis
MPRWRSSAWSRWWVARARWSGWTPVPAQCPRSAAGWLTTYGRKGVDVDRLGGRLVQGVCGLKRGRWRPITRGMRKWTLGALLTSAVAASAALLGPAPALAAGTVIGAELPGALPGRYIVTLKDRGTGPSVHSMGAGRLVRSFRSIPGFAAEMTAAQARRLAADPAVRSVEQDRMIHIATQNRPGWGLDRIDQRSATLSKTYTATDDGSAVHAYVIDTGIRITHSEFGGRASYGYDFADGDRVASDCNGHGTHVAGTIGGARYGVAKKVQLVAVRVLGCDGGGSISDVIDGVDWVTEHAIKPAVANMSMGGSVSRSLDYAVQESIASGVTYVVAAGNEDDDARWSSPADVPAAITVGATDSRDRRASFSNYGSGVDLFAPGVDIRSSVADSNTATDVYSGTSMAAPHVAGAAALLLDANPSLTPGQVRDRLVANATTGRVADRMGSPNRLLFVTAPPAKPVIATTRTAAAVVGTELSTRLALTANRVGSWTLAGGTLPPGLSLNRSGVLSGTPAQAGDYVVTVRFTDYVPQVVTRQVTIPVEASVPVIDPTLPDGQAGVYYEGQLTTADQRDGVWAVTAGALPAGLTLDEASGLISGVPSATGSFTVRFTDPWGQTATADFTITVGAA

SEQ ID NO: 12489 - protein, 39 aa, Actinoplanes utahensis
MALAVERVALRGDRVALAVSVWRWRWSVRRFVVSVWRWR

SEQ ID NO: 12490 - protein, 159 aa, Actinoplanes utahensis
MTAIVVVSGNPRAGSRTSALAIAVGEALATRHGAPAPTVIEVGTLGAGLLTPGDSGTAAAVAALTGADLLVVATPTYKGSYTGVLKVLLDQLPNQALAGKHAVPVVTAGIAPQAAAAEALLRQLLGELGADVRAGLPVVEADLPETAAIAQKYAAAADW

SEQ ID NO: 12491 - protein, 207 aa, Actinoplanes utahensis
MALATTIRYAYLTDRNSILAGCRRIRWQEPLKESHMSALAIAHPRASHIRPDLRPVPDLPEQAPVTVTISIAGGVGGRDRVLAALRELVDAAGPDAAIELDEPVESPADGEIVLDPRARTALRDGRRLDLSRLEYDLLLFLAQHPRQVFSRTQLLTHVWGHRHTTNRTVDVHVSRLRTKLDDPELITTVYGLGYRLADDAPIAVLEH

SEQ ID NO: 12492 - protein, 346 aa, Actinoplanes utahensis
MLNPKLRRPIVGLAAGILMGSALVAASPASAAPALADPSFAPSALAGRIDAQLGTRDAGSYLDASGKLVVNVTDAATAADVTKAGATPRYVARSGATLAAADASLKVNLKTPGTAFAVDPVSNQVVVSVDESVTGAKLAAVKATVAKLGDAARLETIAGRTSTRISGGDAIYTSSARCSLGFNVRDSAGTYYFLTAGHCTNIGATWTNGSSTLGTRAGTSFPGNDFGIVRYTNTSVTKSGAVGSQDITSAGTPAVGATVYRRGSTTGIHSGRVTALNSTVNYSEGTVSGLIRTTVCAEPGDSGGSLYSGTTALGLTSGGSGNCTSGGVTYFQPVVEPLSVYGVSVY

SEQ ID NO: 12493 - protein, 68 aa, Actinoplanes utahensis
MVDELPALRDHMVNDVMPLLSKLDQVGPDLHKLLEVTEDLHLAIAGLPGLKLLRRRGEERTEDHHVKP

SEQ ID NO: 12494 - protein, 211 aa, Actinoplanes utahensis
MASLLSRAVHLSRVALSAPAVAADLTRAAIGQVISTAGAVASLPVRAAGLLGQAELLVTRAGLAVARTEDLLHRVATVTTSAETTVADVRDITTAARTAIAEVQAITAAAQTAVGEIQAITTTAHTAVGEIQAITTAAQTAVGEVRAITTAASLALDEVGAISSAAGDIVHRAGATADAAGTIIIEAGTLTTSAAEIVAEAGAVSAAALAS

SEQ ID NO: 12495 - protein, 359 aa, Actinoplanes utahensis
MGPFCARPAPRAGDGTWWCCGSPSKFGYLWTIHSRQHTHNRCGQCIMAGVRRTPHWILIFAAVVAVGGVAVLAKGVMGSGDTGATYLTGSSTGTAAGTGAGSSAGASPAGPSAAELARIARDKQVKALDAALRKYAATVPEFSVAVLDKKTGQLYAFRGDKSYETASVVKVQVLSCLLLTAQDGGRQLTAWEDSRAKKMIRLSDNNSTTDLFGHLGRQAGVQRCDKRMGLTQTTVNSSWGLTRTTVTDQVKLLSQLVADKSPLSAKSRAYAHTLMSTVDKGQQWGVPAAARSGEQFTVKNGWLDRSTEHGLWIVNSVGRITGGDTDVSIAILSHGHRTQAAGEVVIEKAIKMTRTYLKY

SEQ ID NO: 12496 - protein, 194 aa, Actinoplanes utahensis
MIATLGALGWLFAVVCFGAIIPIVPTGAAVSGAATLAFHEHHPITMVFVLAAGAAGAYVGDLAMYAMCRFGGEQLARRLRWLRDEEHLAAVKDRLRDRQVPVLLVSRLIPGGRVPVLLAAAFAGLSWRTFVIANLPACALWSVVYAAIGVAGGSVFPRPWQGVLAAIVLILVINQAITWWNRRTSSTSNTSGSS

SEQ ID NO: 12497 - protein, 258 aa, Actinoplanes utahensis
MSTTSVTWWGHSTVWLADSGVTLLTDPVLTGRLAHLRRMAGPAPVLAGVPDAILLSHLHADHFHVPSLKAVGGEPLLVVPAGAAAFTARTLGPGVAARCVELAPGDEVTIGAVRVRAVAARHDGGRGPWSRERAAAVGFVVEGASRSWYAGDTGLFDQMHDLGPLDLALIPVGGWGPSLGAEGHLDARDGAEALRRVKASWAVPVHYGTLWPIGMGRIRRHMFDEPGTRFAEFAARACPDTRVRVLAHGETLTVGPAA

SEQ ID NO: 12498 - protein, 301 aa, Actinoplanes utahensis
MTDLDQLRQTLRTTLAKAGWPEPAWFETTPEDPGRGQAKRAVAEGAELVFACGGDGTVTAVVTALTGTDVALAVLPAGTGNLLAANLGLGTDPATGLQVALEGGRRRIDVGVIGDQCFVVMAGMGFDAMMLQDTSEKAKKHIGWPAYLVGAAKHLLDRPMRVRIRLDGGAPMPRRPRTVIVGNVGRLQGGVRLLKRAAPDDGQLDVAIISPNNLFHWLQLAAGVASRRERVPLMETFTASRVEIYSNRAQPRQLDGDLIAPGKAMKISVRHRALLLCVPQPDADPDLAYDAEATAKRAKSL

SEQ ID NO: 12499 - protein, 566 aa, Actinoplanes utahensis
MVGGEPVPGRVHPDQRQLRRHLRPADRDDGAAALGQPDRHRVLRRPGLRRPARSPPGRGETGPARPVGACRSSRPAHRRCTERADGVSTRAVSDVKARRFAERSVLGLIAVIVVGLGFASLLLLVRFHWTPLQSLDHAVADGLNHQVAGSDVTVKILQQISSFGGRVFMISLVTVVVVMLLIRRQRRLALYLVVTGAGALILDPSLKTLVGRVRPVVESPVAHAPGNSFPSGHALGSMVVYGMLALVLLPVFRSYGRYVFLGLMGLIVALIGFSRIALGVHFLSDVLAGWMLGIAWIGTTAYAFRVWRRESGQRTENVLQEGLEPEASHNLEIAPAEEAVLPHPWAKGAEILVGWVLTFGLLYGVGYTVTHWNPGWDNAFDRWLQTFRTPGLDKISWGWSKAGDTHAILAVSLIFCPIALALWRQWRPVLFLVLAMFGELSLFLTSAAAVGRPRPEAAQLDGQMPTSSFPSGHIAATLCLWTAIAIIVLARVRQPWRWIFVVLAVVMPLGVALSRMYRGEHHPTDVFGALLLASAWINVLYWTVRPNAHAVTATEAAVENKQLVVT

SEQ ID NO: 12500 - protein, 261 aa, Actinoplanes utahensis
MRMMTWNIKTGGVDRGHRFRLPAIAEVIAAEKPDILTLQELRDFQRGGERRMHELASAVGMTPYLARSGFGMPVGVLVRDPLRITRTTGVTWRLHHAAAVVVVATPSGPLTVISAHLDPFSPYRRMREARWLAARHARSARVLLAGDLNGLDPVSDHTEALASQQSMFRKRHLYPDGTVDSRALAAFGDAGLVDLWSRAGSGDGRTVPTTEGGGREFGGMRLDYVLATPAVADGAHDMRVVRGGAAEHASDHYPVRVDLDL

SEQ ID NO: 12501 - protein, 140 aa, Actinoplanes utahensis
MRLPLVPSAILTVVYLVGYLTLSIVYHRRWDARLRAALGRRLGAPVGWEYHDRWHDPLSDATSAGYHGWAAQGDASLRQRFLVNIAHLAVLVLVGVGPIAVYLLIAFAGLIHPLALWAALFLFIPIFALFWAGRYRWNRT

SEQ ID NO: 12502 - protein, 202 aa, Actinoplanes utahensis
MIDQLTVPPRVVVTSTVSGLMMMSFFTLAWVSNLFAGWAAPAAWSATAIALACVLCFVGRAVQLIRSRHAFPAELSEEQQRQRRTSGRTFGLLFGAEAAAIWVVVLLLGATGRSDYVVPAIALIVGLHFFPMARLFRRRVDLYIAAWTCLVAVAGLILTGVTDLPAARVDAWVAVGAAAATAAYGWYMTGTAGDLLRRAARG

SEQ ID NO: 12503 - protein, 240 aa, Actinoplanes utahensis
MLTPWWRTRTPSAAPSTGSTAATPILDWPSPPLTELLAALGPVTDPWDRLRSAHTLIAARVRPVYAVDDQQPVSVTLTRGRGSCSQRLAVLEAVARASGVATRCRALVVDGRFWYPRFPRLRRLVPAEVLLAWPEFRLDDRWVPVTELFGSVEQLSAGGGGFTNSGGETLFDAVARTAVDWDGVTSTPGGCSSCDLSATVLADLGRFDSRDEVFAGYGQTMCWGARTLGGPILSRWAPGR

SEQ ID NO: 12504 - protein, 485 aa, Actinoplanes utahensis
MRSRTAQRRATGLHFPPDDVRNTAETHEVPARNRGWRVCIPLIVGCRALEESMPAHLDSGDTAWLLVSAALVLLMIPGLALFYGGMVRIKSTLNMLMMSFACLAVVSIIWVLYGYSLAFGPDAGDGLIGGLTLAGMTGIGPGSLSGSSPTLVFAAFQMMFAIITAALLSGAIADRAKFSTWVVFVAVWVTLVYAPIAHWVFTPDGWIAAHLRILDLAGGTVVEINSGASGLALAIVLGQRLGFRSDPMRPHSMPLVVLGAGLLWFGWFGFNAGSALAANGSAGLAFFNTQASGAAGIAGWLLVERLRDGHATTLGAASGAVAGLVAITPACGSVNPLCALLIGVAAGALCGYVVGLKHRLGLDDSLDVAGVHGVGGFLGTILIGLLATATATGGPRGLLFGGGLSLFGRQAAAAVTVALFSFGATWLIATVLHRTIGFRVDPDHEHGGLDLAIHGETAYDLGVGGGHTTHAARPSSHHHAPADAS

SEQ ID NO: 12505 - protein, 169 aa, Actinoplanes utahensis
MTIEFPSPTRPAGGTAEVFTGYLAYFRETLLAKVAALPEGERRGSRLPSGWSPVELVKHLRYVELRWIEWGFEGVAFDDPWGDRNVDRWYVSPDESFADLAEALRAQGAHTDAVIAKTGLSAVGQPGPRWDGAEPPTLERILFHLVQEYARHVGHLDIVVELSVGAVGE

SEQ ID NO: 12506 - protein, 526 aa, Actinoplanes utahensis
MTTETANCVPTGLAQLGALEAAVVDLETRPHSQFRTVIEPARVIRRQAEELGAEELYHRAELLLASVDLREGRIGEGGQTAHRVRVWAEQHDSPYLLARAHRQLSVFYRFVGDAADGLKHAVQCVAHLRDDFPTTIRAQHLMSLSVALEETGSRADGERRCREALALTIAAGDHEMTIMALNNMVYSAYENDDEPTARALVAQMHDIQSRTGHRFGAGELDTLARVELMGGHYDEVEALLTPVLADLVAANEGDAIAECRLTLALARRLAGRYPEAQTALDDNLRICEERGLAAVRARIREEQAALYAATGRFAEAYEAHRVFHAETTALLSVQRDARARALQAVFEANEARRASEHFREMALRDALTGLYNRRYVNERVPALLAEAAERHTPLSLAILDLDHFKRVNDTLSHATGDTVLQHVAELLEEAIPGAGLAARMGGEEFLLVFPGIGADEAAVRCERLRLRIRAHAWGPITGSLPVTTSIGVITSPDGHGTLSTLLSEADRNLYAAKRSGRDRVVAHLTA

SEQ ID NO: 12507 - protein, 59 aa, Actinoplanes utahensis
MVISGGRAGQRPGEFQRLPAGAVDYEVYSLDSAVDYCFTVAVQSAGGALAASAPVCTAR

SEQ ID NO: 12508 - protein, 364 aa, Actinoplanes utahensis
MRYVAPPLAELTAQAQSLSSAGDLAGARAVLAEVLRSADADPRRATAELATAAALFARVLIALGDPQSARLWAAFAHAAEEQLHGTRDERTIAAAALHAAVLHRIGQYGRAALVYHDLVGELAHVDDPDAPRVLAAEADLATAEHAAGHCAAARARLTDAWRRHRRRYGEESPAGIKMLARLGAMERECGRDAASRDHLATALRLSHEYLPADHPLALQAAALADGERSGRHTCGRMTRPSRDDDTELRPGGFRPFPRRPTVPDPDAVGSGSRRFPPAPDDTFDDAGQPPPDNLATDPNGTVYQQPFYLSDLSLPGDPAGRHARADTPPPLPGRKAPEYGPDGRPVPIGTARPARPRRGGHPAL

SEQ ID NO: 12509 - protein, 295 aa, Actinoplanes utahensis
MSVTTVKRELLVRHLEAWAAAAVHRGRRAIYVHGYADVDGGASAEAAVRVLADLPDLARGRELSMVAVGDDMTTITPRLGEVQQQAGAGAGLSVLPIAATVEVAVRAAGAKNVPTLGYLDAGAASEPPAVPTVACLAAGKPAEVLLVLPPGASADPYRTAGFPLLTAAELATGEEPGQVVVFATGSGKSLEQFKEALWAVDEFAGVRLRDPADPERHLIDISLQPHPGPLRREILAYLGRVGAATVSDLRTFALTGTVYRAADANRVLHLMIDAGVVAREPAHGRLGGDVLISPI

SEQ ID NO: 12510 - protein, 57 aa, Actinoplanes utahensis
MGLMFRSRKKFGPLILNFTENGFSSWSIKIGRWSWNSRTRAHRVDLPGPLSWKQDKS

SEQ ID NO: 12511 - protein, 151 aa, Actinoplanes utahensis
MQISARGDYAVRAALSLAQAYPSLMSAQAIAQDQEMPRKFLEAVLADLRRAGVVRAQRGAEGGYTLSHPPREVTIGQIIRAVDGPLAGVRGLRPEETQYTGAAENLPNLWVAVRAAVREVLDEVSLAELVSGRMPAHVRKLTTRPDAWQPR

SEQ ID NO: 12512 - protein, 311 aa, Actinoplanes utahensis
MPALIHRAERVPACIPPAWAGVGACALPVAAGSAIGLLECHALVLISTGPVHADVDFTSHLAGPGTLLWARPGQAIRFQTPGKTPGKTPGKTPPGETTTGDTTTVVFRPGLFQPGELPGLHPDDPDGPATAPVVLPDPGAWKAAMTQLAADAEGTGAARGEVARALLRHQLAALLLRLRLLDGGGHDSGNVESRTFERFRRRLEDGYQQSRRVEDYADELGCSVRTLTRASLAITGRTAKQVVDDRVALQARRLLAATDLSVAEIGRVLGFGEPTNFGRFFHRETGLSPGHFRGDFHERPTGIPGQRPPAD

SEQ ID NO: 12513 - protein, 143 aa, Actinoplanes utahensis
MSTIRPTTVEVETSLRLVAPDATALPVRASLRYDPSDPYAVHVLFHAESAGGEAVSWSFARELLVTGLDEPAGIGDVRVWPWATPRGDFVALALSSPDGNALFEVPRSVLVRFLRRTYVVVPRGRESEHLDVDAAVNRLLAGR

SEQ ID NO: 12514 - protein, 135 aa, Actinoplanes utahensis
MGVKPDDRATDVRLLDRIRSTPGGRLALKIGVGTVGTLVVAIGIVLIPFPGPGWAIVILGLAILSLEFAWAKTVLTLTRRHVKTWTTWAARQTLAARAALGALGLAFVAAVVYYTVRLSLHIDLIRVGRDLLPSE

SEQ ID NO: 12515 - protein, 364 aa, Actinoplanes utahensis
MAWVENRGDGYRVRYRRPDGTVGTDSSHTTKKAAQDRVKAVETEQQQDTYVDPSGGKITLREWADLWLAAHQVSKSTAAKHQTYLKVHLLPRFGDTPNNDITRMMVRTWIKELSQRRAPATVTDILALLSMLLGEAVEERRITINPCRRLRPAAVPKAERPWATPAQVLAIASHLNQPEATLVITAAYTGMRWGELVGLQRHNCDLRDARIHIDPKVGALHEIAGTLELGPPKTPAAVRTIALPPFLVTRLREHLDSRDHVHVFAGADGGLHRRSNFARRFWRPATDGDPKKLIVPVIPGMHFHDLRHTHKTWMIEDGVPEVAQAKRLGHRLPGVRGIYSHVSPAVEQRLVDGLQKRWEDTAKR

SEQ ID NO: 12516 - protein, 804 aa, Actinoplanes utahensis
MSGLTLQDLLEFDAGPWHSAADVWQQVARGLDTATDQLIVGTRDLVAVWPHGGGSEAARQKAAMLRAELENTYLPAKRLADAFDQHAYAMKSLRSQAEGIVESARHAGYTVDSVAVTITAPASAYMGGDLDRTGRETGTLLNDLRQVVEYARAQDDATAATINGNVPSPQNGFGASPPGAAARAEELAKKLLDSNYRPTPAELDELRNLITLYGRDKVFDYDFLTALGPKGLLQLNGVLATYQPDGPGKDADGWMFSNETADTVRDLQNGLGLMLATATEHTGTQTGPRGDTYVPGDHELSGQWVGDLMAAGRSKMTVVGPYGPPQDVNVYGYQLLSPLLHNGSYDARFLTAVGGDMVDFEMSQGKNSGLWTAERGDNLRLDWTHGHDDNTVAAGYDPMNGLMDALSRNPEATRDLLTGVTSFSADGPVGGRLDRLDYLLTDRNWNADVPGGSGWSNEVMQHGGDYKSTALDDFGTALESATTGEPSPQARHIVESIIYETGVDEQAQGYHNGVIPGHGKSEDFAHSDLIQPQLRQHLAKITSAYIFDVNLNIADGHNAIPGQTLDVDHNHLVRFLADLGKDPGAHETIAKAEAAYAAGSYDEILSGRQNPHNGLDRNLSSMENVSHNYGSVMGALDKGANDVHHITSAQLDEAYNNKVESHYKIAGRLVDEVMGKVTSKITVPVAGDLAKEYVDGLMSQAEEQAKVDNTGHVTYEVGQSLGAARNTAVGLTEQALYDSGKLEDLPERLLVDGHPKPVSAWDGDDIKEWQRWKAHLGQSVLGNAANSAGDNYQKGYEWAGEILK

SEQ ID NO: 12517 - protein, 228 aa, Actinoplanes utahensis
MRSRTSRSKPTTLGVLLAAVTVGLTTASCTSDDPPATPTASHATPVSSARPVLTYDEAYRKLPMNGTKDLPITWDLSKTPDVDAVLGARRGLVYRYWDLSATDSTTVSPIGRFVYTERYYQQFLAPFATSTSDNPSIGPIWVKVMGVETNSADRMTVTFCADLGYWHEAQQKNPGVRKGRANLESYVMQDVQSSDGERHWLADDLLDKDPDRKAKYGTECTEWAQHQP

SEQ ID NO: 12518 - protein, 124 aa, Actinoplanes utahensis
MIVTAASVSDNTIGIDLLDRATRIYPTLTKAWGDAGFRTKVVEHGATLGVDVEIVTTDPQVKGFSVIKRRWVVERTIGWLMQHRRLARDYETLPATSATMIRIAMIDNLTKRAVDETTPTWQDT

SEQ ID NO: 12519 - protein, 183 aa, Actinoplanes utahensis
MSIRPNHGRGWAPRTHPDRLPATYHRTHGIRYFHGCYSLGDDQLWGVNRRRKGADHTLSALKSIRKARPDGAPIYVIMDNLSANKTPTIRAWAARNKVELCLTPTSASWANPIEAQFGPLRMFTMANSNHPNHTVLARKLQKYLRWRNANARHPDVLAAQRRERARVRSERQQRWGRPRTKAA

SEQ ID NO: 12520 - protein, 198 aa, Actinoplanes utahensis
MARLAADQRQAGSVRDAVDLLVRRDGHAGAAEWLTPRAQDDDWESVVLLIEQVELSGQADAAAEWRLRAAERGHGEVARRLAESYTAAGDHVRAAAVLWPSATTDRRSAGKLLGVLAAAGDIDGLEKLHRTRVLLRLAYGVGELADFLASHGREAEAEDVEQYGIEPDGSTALKWQIPDDVLETFAAAAVGKAVAEQR

SEQ ID NO: 12521 - protein, 100 aa, Actinoplanes utahensis
MDPAHLRDVLSRHDPDPEAVLAQLRAKQGARRRRQAMIAMGTAVVLVAGGIGVWSRLGQVPATPDYTAGASPAGTSPPGGGRLAGADADQAASACLALPE

SEQ ID NO: 12522 - protein, 152 aa, Actinoplanes utahensis
MVFREGLLAGEYLPDQVTVIRQLRRSSPCCRRRHRGFRCHSRSAVFSCPVRVQHGGPSCASRCCRFYDGTVAVQDVSPDNRRLSVSGNGCDRACKIWFGTEDLADQPAMVVVSDCLLVFAESVERNAALLVLRPADSHDVSPVAHGHAPSRC

SEQ ID NO: 12523 - protein, 103 aa, Actinoplanes utahensis
MAIDLIVDLRSRKIETLDDFWDAVAKPCGLPAWFGRNIDAWRDTIQARGISDLVDRHDAVVVHVDRAGLFSRKDHEARALRQAFAGRRSRLVVHQPPPSVGQD

SEQ ID NO: 12524 - protein, 433 aa, Actinoplanes utahensis
MADWSLLTGWLPWVVTITGAIAFVGLLARRDRRFWTRVVPIVLASAVAAVVAFDIAVEKVWRPFPDEIPTHDLVWGAVGLAAVALAAVRLRRLSWRLRPVAVVAALAVVTTSAVQINVYWGMYPTVEALREAAHSDRARPLPGGVPPSELVTAAAGTMLIDSWKPTQQIPAHGVVYPVGIPGVVSRFPARPGYVYLPPAYAVLPRPVLPVMVLMAGQPGEPKQWLTNLRLADTLDAFAQAHRGLAPVVVVVDDLGATTANPLCVDSPLGNVETYLTQDVPAWIRAHLQVASDRQQWFVGGYSHGGTCALQLAVRAPSLYGKFVDISGQREPTLGAHVTTVQRVFGGDNAAFTRINPLDIMKRTRFPTTAAFLAAGNDDHRYLPQQQDVRAACQAAGMQVEWLQIPGKHNITFWREAFRQALPWISTNGQLAES

SEQ ID NO: 12525 - protein, 392 aa, Actinoplanes utahensis
MRGTPVQRRDPTPGRPNALSLLRRFGGSSLSYMATWRGVRHWSTPDGQVVVPYRLVGSVALTISDPIGERSLIRGAVRQFTAHCRSNGWTPCLYSISEEVSTLLATDGWQLLRVADDARVPLELLQFTGRRWQDIRTAQNRARREGLVADWISFPASAAAITEQIEEISAAWMAQKEMPEMTFTLGGIDELRDDRVRCLIAVDAEHRVQAVTSWLPVYRAGATVGWTLDMMRRRPEATNGVMEFLIATAAMQFKQEGAEFLSLSGTPLTSAQHECRVPRLQRLLEHSGRLLEPVYGSRALQAFKAKFQPVYLPLYLAYPDVTSLPRIGRAVMRAYLPGLTVRRALRLAVTVLRGSRRARSRGSSASVAVTHRAQPEVAACRCARSRMRRQGG

SEQ ID NO: 12526 - protein, 829 aa, Actinoplanes utahensis
MIRLAAAMLRRRIGSAIATLLALTAGVALLTAMGALLESGLRYQAPPGQYAGADVVVARHTMAFTPEQTGGEETVTVDLPAGGTVPDALADRIRRVPGVATVVADHQVAVVVAGPATGHGWSSAVLTPYKIIAGSPPAGPGDVVLDARVAGGAEPGRRTTLLVAGVPQEYLVTGIAEGTGPASVFFTDARATALSAAPGRAAAIGVLAAPGVDVHDLAARIGTLADADGADAYSGRNLGRAEHDPAAPEELLIAVGGTFGGYVALLVMFVVAGTLGLSVRHRRRDLALLRAIAATPGQVRRIIVAESGLLGLISAAAGVPAGLLAIGWAHHQFVDRGFLPASFPMVTGGFSVLIAAGAILVLSMVSGLIAARRVTRIRPAEALGEAAAEPLGGGRVRLVFGVLTLGGAGAAATFAGATSGSTAVNSAIGMLYLFVTAVALLAPWINRVAAHVLGPALRAFWGPSGYLAAKNLKANAKGMTTVLTSLVLSVGFGGSVWFLQDNVQRATVSQNREGTLADVTLVSPAGLPAAAAAEARRIPGVRAAVGVQHTSVLTASESAAPVEAQAIDPDGADAALDLRVVAGRLSDLGPETVAVSRLQADSAGWTLGGRATFWLGDGTPVTPRVVAVYERGLGFGDVTLPRQTVTGHTGNALDERILIRTEPGAATAEALATLATRYPGSAIATTVGLNDRLAADLSLGSWLNKLLIGVMVGYAALAAANTMVMAALARRRELSLLRLVGVTARQAKRMVHAEQVGLLGIALVIGGGIAAGTLTTVVGTLTGNLMPYVPALGWIAVLGGTTFLALATTILPVGRLLRIAPIHSIGIKE

SEQ ID NO: 12527 - protein, 275 aa, Actinoplanes utahensis
MLARFRQSGDPGAIAVRVEQVSRVYGAGEQQVIALDGVDAAFERGTFTAVMGPSGSGKSTLLQAAAGLDRPTSGRVWIGDTELSGLSETALTKLRRTEIGFVFQAFNLIGALTVEENILLPLRLAKRRPDRQWTTEVIARVGLGQRLRHRPAELSGGQQQRVAIARALAVRPKVIFCDEPTGALDTQTAAEVLTLLRAVVSEQGQTVIMVTHDPVAASYADRVVVLADGRIVRDMPQPGAARIAEELGTLGRPVPAGSSVPQSPAGQQAVSGMRR

SEQ ID NO: 12528 - protein, 687 aa, Actinoplanes utahensis
MPGMVSGTADVDWASMDHAYGSAEEVPAILQALGSPDADRRGRALADYYNKVLHQGSVYSSTTASLPFLLALARDPATPDRAAIVALLVNIGTNAAEVADAGYAGEDHIEAVAFLRAHAATFLDFAGDAGCRVRQAAIPGLGVLVDDAHRSLTALQDRCGMTSCLIERILVARTTATLARRLPVIEPAATAWLAALASDPAGEPEFRLAALIHHTGCTPEAIDDDPVPAVLALLREIAAAVPPEQPWPEPPPVEPPADGVPPFVAAAFEDLDRHNRCHALTTDLLQTLHRLLGARVAQRTDLLIEQLSSPDPGVRLDAIRMADDLVWHFRHDHTALIRLVAAQLGARNLEVAAEAATLLERHHPIAEPAREALAGLLAAHGPDGWVTPRRHLRRLHQRAAMASARLGDPRALPSLLVAFDDDVDTWRAVQVAGALPDAAHQLAPRLCDRLIGADLSGEWPSPVGGVLAALATLGAPSSLPVLTETLTAAAARPDRTLVSAALTALGALGPAAAGALPAIRAAVGADDPWTRVAAITTLQAVSGDHDEILSPALALLDTHAAAGAADVLGRIGPPASAALPRLRALSTADHDGIRVHAAAALWDIGGEPEATTVLDTLRQAWHHDPRTVDHVAACLRRMGRHAAPAAPQIRAELARPERRGQFGGIGTDEDLRRTLTEVLISIDSAAG

SEQ ID NO: 12529 - protein, 320 aa, Actinoplanes utahensis
MTMGRHARKPATRTVRSQRNTGDRTADLGTVAGVPRHVARSGRAAGYLAATALAVAVLVLVAGPRAIVSSAASLVASWQSPGPAAEPPATTPSGPYRVVGLGDSIPAGSVCGCTSYVSLVAQDEAARRSRTADVANLAQGGLTTTGLLTQLGDATVRRQIAAADLVLITIGANDFDTGSVDDDSCAAPELSCFQPALKAQQSQLADVLKQVRTALATRSATVLITGYWNVFLDGAVGATHGADYVRNSISLTRTENTQIAAAARAQNGTYVDLFTPFKGNSGAEDDTSLLAADGDHPNAAGHRRIADAVESAVASTRPAG

SEQ ID NO: 12530 - protein, 439 aa, Actinoplanes utahensis
MRRHWRHLLTAVAAVLAALVATTTLVPASPAAAAALTEVTGFGTNPTGIRMYLYVPDHPAAKPAVLVAVHYCTGSGPAFYSGTEFKSLADQYGFIVIYPSTVRTGNCWDVSSAGALTHNGTSDPVGISSMVKYVQQRYATDPARTFVTGASSGGMMTNVLLADYPDMFAAGAAFMGVPDTCFQATAGNPADPSQQAGWNSACANGQVARTPAQWGDAVRNSYPGYTGTRPRMQLWHGTADTTLNYNNFGEEIKQWTNVLGVSQTPVRTDTPQSGWTRTYYGNSSAQPPVQAISIAGVGHSLPMSGQARMAITFFGLDNNPVPPSSPPVSPPPSSPPPSSQPPLPSGCTASIALNSWTGGYVATVTVTAGSSAINGWTVATTLPAGSAVTNSWSTTGSGTTGAVSFTNVGYNGSVAAGQKTQFGFQGTGSGPTSATCSAR

SEQ ID NO: 12531 - protein, 282 aa, Actinoplanes utahensis
MVGSGRRARCVVATLLGMLVLPAAPARAVTTPATATDRDFVRRVHLTATAVGAASALARGMSGNTSVKRLTAQVTPQCEQLDGLSRSVAGTLRVALTDPLAAEQQSALATLQQSGGEAFDAGYVDYLWRADSALLPIATTVKGTTRNAVVRRLAERAEAVTAEQLPMLQDSGLLRMTVLPTPATPATPATAASASAVGRLPGGVPMDRRLMAETRSGTGYLAPPIWLRLAVLIIATAVAGVLSRRLLTRRRTGRPRRRWAARRSRGTGRGSPGRHSRVRRPS

SEQ ID NO: 12532 - protein, 369 aa, Actinoplanes utahensis
MPSATPIRPALRLGLPEPCRRAVIAPRAMAVGPKTMLKKNRPATPRTSEPTARSSRLATRLTKFMSIPSGGGGSAAGQGGGATDAEQDGGGQDHADRDQHRLAGEQGRADEQGDECEDGHQRGHRRPLSVDSCVLKHHSSGNRCLLSDMSHHHPPPADRLSRPEQKARTRQALLDAALALMEHRGLGSIGLREVTRAAGVTPTAFYRHFPDVDNLGVALVDECLGSLRGTIRAVRDGVSPSDEVINRSIGVLARRVRENREHFRFVARERHGGVPAVRAAIAEQLDLFAAELATDLAGDKLVGGPRFDRWIATDLRMISSLMVNHMVWTAAALLDAPPDAPGAQARVIDTAGRQLRLILLGARCWTDGD

SEQ ID NO: 12533 - protein, 382 aa, Actinoplanes utahensis
MLARLVDRSVERIGEMSAGGRWFDRHEAGMIAEAWADRARDVFGMLGVWPRVMRDRKARTILRRMADSRAGLRDWMVAAGGPGMDRLLGPAAAEPPFYRDFRGRVQPGTVSSDPAGIAEDYDLARARVASVWAERAGDGLRGSVRVLVPRRYADGEALLTFGADRVRDLWFDSADGAGLVVRRHGDGFEVRLGAEGVMRTAALSCFPVDQQWHLSAAGRTADRVTSRRRPPTAADLFEDWADGARGDAGAAFQAAVRRLGRLRVPEEMARIPVGELCEALVGAGTRALAAADLPSEQRFAAWRDLLARWSRVGPDGPEAEGELPAGVRLALVTYEAEPAVLTAIFTGADDERLAAAKLPWPHRLLLSGQAGELTLPDTAHGA

SEQ ID NO: 12534 - protein, 202 aa, Actinoplanes utahensis
MAPPDRLSSGGVRDPDRVAGARVHRAAGLGHAAASRPGATVRGGLRADPCRHAGGGMSLNTRHDSADDSPGLLLWQVTNRWQAAQRAALKPFDLTHVQFVLLATLTYLQAEGPVTQKALAGQAATDPMMTSQVLRALEARALVHRPPHPDDRRARAVAVTDAGRELVNRAVVAVEECDAAFFGGLGDRLPAFTRGLLALRAN

SEQ ID NO: 12535 - protein, 155 aa, Actinoplanes utahensis
MRPSVLIPIAAALALAGCSSSNEPDPATAPVSSAPVSSAPVSSAPVKSAPVRSAPTKTAAAARGNGCPVTAATLNAVHVPDAGDVKVKVVSKSIKCADGYAQADPGVEGSDGVFVYRYDAKAKAWRFLTAGSSIDCGAIAIPRPAGDKLSVCYYQ

SEQ ID NO: 12536 - protein, 944 aa, Actinoplanes utahensis
MSPDRVRGLRRWMTVGAVAAVVVGIAAPGANAQGPDDVTSRAFAQISALQQLKKSMTAAERKLDSRLAVELRQRSGRVATSELPRVDTRIAVTKGGTTEVEVHADRVDAALLGRLRAAGAGIRYPSAKDRSVLVEAPLGVVTTIAGWSDVTAVTAARGLTTGHETDPRRTAPEPSKEARAAGVEAAVKAAESVRPLAVDPRGSVVSEGDRTHAADTARTRFKISGVGVKVCALSDGVDSLAASQATGDLPADVDVLTGQDGSGDEGTAMLEIIHDLVPNARLGFATAFTSEVSFADNIRALRFTAGCDIIVDDVVYYHESPFQDGAPARAVNDVIADGAFYFSSAGNEGNKLDGTAGNWEGDFADSGRGIGKFAGRAHDFDPGPGVQVFNPLSPNSTRCVTTLWWADPLGGSANDYDLYLLDAAGNVTDFSQDVQDGNDDPFEALATGTGTNQRLAVVKFSGADRYLQLSVFRGRFADTPYGTLKGFSTPGALRGHAASAGAFAVAAAPAHDALPFDLEDGDPPNPAGPYPNVFTRQTEPERFTSDGPRRIFYNPDGTAITPGDFSSTGGLVRTKPEITAADGVLTSMSGFAPFYGTSAAAPHAAAIAALALSGNPGLSNAEIRAALTGTALDLAPAGVDNRTGFGVLRADLLLRDTGATPQPLVKTGTPTVTPITGDGDAYLEPGEQATVAVPAVNVGDGTATGVSVVVGADDPRATVTPHAASYGTIAAGATKAKNYKLTLAADYPLGRPVTLTTKVTFAGTLSPTTGRLVVPTGQPGTSVRDFAYTGAPVPIPDNDPTGVTATVDVSGVGYASALTFSIDGTACSTDAGSPTVGLDHTFVGDLIGTLTAPDGRAATLFSRSGAGGNNLCQVVFDDSATVAFTDAESANAPFTGTWRPDGSLSSLRLSPVDGTWSFHVADRAGSDTGSVRAFSLHLTGFAPA

SEQ ID NO: 12537 - protein, 117 aa, Actinoplanes utahensis
MIFQSERTFQVWRYSVSHATLLLRSTRTAAQPTRIDLIFSGVRRMLLQPTFDGITVALASAEERDAAVRRVGGDWGDRELYLLDPAAANFVASAPPAWHEDEGSYSDPSYFQSMLFL

SEQ ID NO: 12538 - protein, 585 aa, Actinoplanes utahensis
MARQARNGARGFADKAKLASDNADLLAGDTEKMSGTITSISNSVWDMARGMSGLAKTLMDTAWKAYDVEQAAAETAWMRWLQEKSDQAIDHWMPWGADIVKGAKDDLLGMVEGLWYISDCTVGTFIGLDPATDEYTVPDVTFWPKPDKACKTLQDGFGKLLSDPKQLLHWDEWGKNWQRALGMTIVDVVTLVGTDGIGSIFKAIEKGISKDIAKAGLKDLISGAAKYGGELLSNAVTKLGALNAARILDLAESLAIKLTLSPEEIAAMARSIVVKGIDAVEQAFRNLRDIPVVKGLEDLIKSCLSRNSFTADTRVLLAGGGTKPIAEITIGDRVLATDPAQGVTKGEPVTRLFRNRDTALADVTIGSGAVLRTTQEHPFWDATTRSWTAAADLRPGDRLRSTVTAPRVAAVRAYSGDRVMFNLTVDELHTYYVLAGRTPVLVHNCDKNVVLGINRHSEGLAAELRKLEETADAVTYNGDNLKGINPESGLAGWQEKVNDALKNPGSVIHVALDDMEGATPLEAFINAYKKAKSGDYGATDWEMGQIGFYIRMGYREWGSIKWYLNGRALTPAEMPEPNWLELMKS

SEQ ID NO: 12539 - protein, 615 aa, Actinoplanes utahensis
MASRLAALPMIAGALAVAIAVPQAAFAAPPKSVPPAAAAPLTLTQMLERLAGPATAVPPLADGPVDDADLDRMLCQDLADYDADPAVRAAAQAALDTNDPVRIRDFLDKGLPVYRKAAVEIQKIKATEDRALVQHWADTGTPILRQKAAAALATGDAAKIADFIAIGKAAADAADAQGVLSAQQQAQLIQSRVEQMVAHGGYEVQSQGQLALDSEDPEVIAEFYNHGYAIAAQQDTDAQHEIEDALAARSAAVGNLSTLAGKAARAATAQQQIVAASISATQSLTVAANSMGLVNRYAKQADATYASDLPVRAAGGATHTADLTRLRSDACAESATTARNADQVTAQAGVAATAAQTLIDTGLTHGVDWNEVLQAQGDAATAAKQAAETACHAAEATEAAAKALDADHHATADAANAVKYRQAAEREQAAAEKLAVHAEKLAAAAKAAAADAHAQRLRAEAAAADARLRVSKAQAYYETAVRQRQIAQQAAADAINHEKQAYDAAARAIDQQNIAVSKHDEAKQAYDRSVAAGKHFQQVGKQTKDLIDRAKKSADGAHSKELEAEAAEARKMAADMACKYPNNPSGTGCPGTAEMQQLAADATRARADATAARSS

SEQ ID NO: 12540 - protein, 400 aa, Actinoplanes utahensis
MRQAQRLASVRYDIRGPVLRRAQELEAAGHRILKLNLGNPAPWGLATPEPIVADVVQNLAAAQGYSDARGVYSARVAVAQHYQTLGVPSVQPDDVLLGNGVSELIVMVLQALLDSGDEVLVPSPDYPLWTGAVNLCGGRAVHYRCDESAGWEPDLEHLAARITDRTRALVVINPNNPTGAVYSPETLLAMIELARRHGLMIFADEIYDKIVYDGAVHHTLAALAPDVPVVSMGGLSKVYRAAGFRSGWLATSGFGPDADYLDGLQLLANMRVCPNVPAQHAIQTALGGYQSINELIQPGGRLIEQRNHAWEALTAIPGVDCVKPAGALYLFARLDPAVHKIHDDERLVIDLLEQQHLLISQGTGFNLDTPDHLRLVFLAPTEVLDDAVARIATFLAAYRQ

SEQ ID NO: 12541 - protein, 331 aa, Actinoplanes utahensis
MCLFRQGVFAVYTGEVPQTHRSTDAFQQVALGYRGELLAHCYQMLGSLHDAEDQVQETYLRAWRAYDRFDESRASMRTWLYRIATNTCLTALESRGRRALPAGLGAPSDDPQQPLTHREVPWLEPFPDALLAGDPAAVLLGRGRLRIAFLAALQHLAPRQRAVLILREVFDFSAAETAEILDMTVAAVNSGLQRARARMATVRVTEEPSAGDRAVLDRYVAAFESADIPALVRLLGETPILEMPPYENWYRGVADYAAFCARVFAMRGTDWRALTTSLNGQPTLAAYVRRGDRYVAHTLQVLTIRDGKVLRNTVFSEVTLFSQSGLVEELA

SEQ ID NO: 12542 - protein, 124 aa, Actinoplanes utahensis
MSQTVQEFFDLSEAAWIAGDADAVAELYTADATVVTSGAALRSRAEIRQFFKTGFAGPLKGSAPLDRQESIRYAGADVAIVSSTSGIRMAGEPEVPADRIRRATWVLTREGDHWLAAAYHNSPA

SEQ ID NO: 12543 - protein, 237 aa, Actinoplanes utahensis
MYMYLVHETCTLYGCQVTPAERLSRAAVAERALRLADEEGLDAVTIRRLAKELGVTPMALYWHFKNKDELLLGVVDHVLSGVRADRSAGDPWQRQLRAIVETVVGVMRDHPCLPDLLHAADKTQAASFTRATNDTLALLADAGFDVEEGYWIAMYLLNGAIGLVGAQPDRPADVPAGRAEEWRRQKRVQMECLPADEYPMMIEFARTYRRAPDVERYYAFGLDLLMAAVETMAAGRR

SEQ ID NO: 12544 - protein, 472 aa, Actinoplanes utahensis
MEQNRRWWALVAVALGTFMTYLDNNVVNVALPSIQRELGLSISGLEWITSAYILVFAGLLLAGGRLGDVLGHRVVFLSGLGVFTVASVAAGLSGSQELLIGARAVQGIGAALLSPAALALIGEFFPDPKERGTAIGIWGAVGALALAVGPLTGGVLSQHVSWGWIFLINLPIGVATLVLSLVAMPRDGARTRSGGLDPIALGTSSVALFALTYALIEGDAKGWTSAVILGSFAVAALTGIGFVVQQARAADPMVNLAFFRQRMFTGGLLAMGLWAFGVFGIYFYMAIYLQNVLGFSPTEAGAGFVPLALITAVGAVLAPRLEARFGVARVTAFGLAVMGASIAGIARYGEGTHYLDLLPWFALYGVGGGLLIPLSNVVIGALPSGRAGIASGMLNVSREVFGLLGVTVLGAILSNRAGAATGTELHRYLVGYQFALVVAAALIVAGVPLSLWMLRTARPAPQITPVPVLETV

SEQ ID NO: 12545 - protein, 406 aa, Actinoplanes utahensis
MRVSAVVAGLVAVLVSFSGPFVVVLTAASAAHLTAAQTTSWVWAIAIGSGLSGLVLSLLSRMPVITAWSTPGAALLVGSLSAYRYTDAIGAFLFAAVGMTILGFSGLFGRILTRVPRGIISAMLAGILLPFALEAFRQLPGAPAVVLAVLLAYFLGRRFLPNYAVLLALGAGTAVAALRHDLHLGGVHLDIAKPLLTLPTVNPSALVSIGLPLLIVTMASQNAPGLAVLKTSGYDPDDRLLLTGTGVVSVLLAPFGSHGINLAAITAAICTGEQAHPNPRQRYLAGVACGAFYLICGFLGTGLVGFFTALPKPLVAAVSGVALLGALLGSLAGALDDKSAREGSLVTLTATASGMTVAHVGSAFWGLVAGVGVHLLLNHRPRRAGDPQPDDESPDHEARVDRVQHR

SEQ ID NO: 12546 - protein, 238 aa, Actinoplanes utahensis
MTWLDDLLTAFYTAKWQVTADQAIYWREIVGNAFGLGSALFGLRRSAWAWPVGIVGNILLFTVFLGQAVGNDQGTPLYGQAARQVFFLITSLYGWWRWRRNRRSGLGSAVVPHWAGRRQRLILLPVALLSVVACFFVFRAVGAGFPVPWWYYLADSWIFVGSILATFAMARGWVEFWLCWIAVDLVGVPELLHFGYYPSAVLYAVYAGFVIWGFVVWLRISRTSRPMIQQQVYANAGD

SEQ ID NO: 12547 - protein, 332 aa, Actinoplanes utahensis
MTAAISCPVQTRLYADGKVAAKDFGYAELTARLRAHPGAVAWLDLLEPSAEDLAAVADEYGLHPLAVEDALAEHERPKLDRYPDHLFLNVYAVAVPDAEGRPSKVEISAFVTERVLITVHKGKGDVDRLTERWDEDPSGLAAGGGVNYLLYGLLDVIVDGQYAAARQVDEAMDSIEDQMLGEGGAPRPVRMRGFALRRSLALLRRAVAPMSDVVAELTRTDNGVVDEDLRPYYRDVEDHAKRSLESIEHSLIRINELIEADLNEQSNVLNDITRKLAAWAAIIAVPTALTGYFGQNLPYPGYQKPWGFVESMVLIVVSAGALYYYLKKRGWL

SEQ ID NO: 12548 - protein, 217 aa, Actinoplanes utahensis
MTTVDLASVDLGYHGGDPVLRGVTVHARPGEMLAITGTSGSGKTTLLTAMAGLLAPTSGVVTVDGAPLGDRDAAVGRGVVLIPQENGLAAILTAAENVSVAVIATGGSPADARRRTADALTAVGLAGQANQLIEELSGGQQQRAAIARGLALRGTVLLADEVTSELDAANRQKVLELLRAEAQRGAAVVLATHDPEAAAACDRELHLADGAATWARA

SEQ ID NO: 12549 - protein, 268 aa, Actinoplanes utahensis
MVAIGRRLTGLAVAAVAVVLLQPMAAHATEPGVPDPPNQLITDTGEGAVTAADRDFVVRVRLAGLWEIPAGQMAQQKSKDPRIQQIGKAIAAQHVVLDKMDRDVAKKLGVTLPNVPNSDQQGWLGEMRSAAEGTDFDQIYIDRLRAAHGKIFPAIATIRASTRNDSVRKLAQRANQFVMTHMTLLESSGIVDFAGLPTAPPPAAATTAPAAGAGAGTGTATNLTAAEQKGSPLSSPVVAGVVIASLAAAFFITRRFWPSNQRRRRRYY

SEQ ID NO: 12550 - protein, 280 aa, Actinoplanes utahensis
MNGLAVACRRVVHIYRAEAGDVVALAGVDLSIAPGETLALVGPSGSGKSTLIALLAGLMRPSAGRINIGTYDMGKLSDSEISRLRGTEIGVVLQGAARNLLPYATLHRNIWLAQRRAAHTRGITLDDPDRILDLVGLPGQGRRKLADLTPGGRQRAALAVGIATGPGLLLVDEPTSRLDTAGRDEVLAALETVNRERETTIVVVTHDNEVGARLGRAVTIRDGRVGAEGRDGQDFAVVAGDGTVQLPPEVLGSYPPGTLFTVQHVDGEVTLVPGGTETAA

SEQ ID NO: 12551 - protein, 314 aa, Actinoplanes utahensis
MAVRDIAVFTGSAHPELAAEICEHLAVPLLPTKISRFANDCIEVQLQGNCRERDVFLIQPLVPPTQEHLAELLFMLDAARGASAGRITVVLPHYAYARSDKKDAPRISIGGRLVADLLTTAGADRVLAMTLHSPQVHGFFSIPVDHLHALRELAHHFRGYDLSNTVVVSPDLGNAKEAAAFARLLGIEVAAGAKQRFADDKVVINSIIGEVGDRDVIVLDDEIAKGSTVFELLARLRERNVRSVRVACTHGLLTDDAVQRLAAEKEIEEIVCTNTVPIPASKRHEKLTVISVAAPLAEAMRRIHNGESVSALFV

SEQ ID NO: 12552 - protein, 673 aa, Actinoplanes utahensis
MGVMAYPLRYALADLALALSRAATDPAEVRSTAARAAADMIGDGAGVQLLRDDGEYEAIAYHHVADDRSTALAKALDRAGRAPDDEYSTTLAASRRPIVLAGDSAAALAGPGDGITAAVLSPVIVDNTYAGYLILTRHTPDAFYSTPEVELARDIAGELSLAVAGARAQERLRAAEERYRRVLETIPEGVLQLDPEGVATYANEPIGVVLGMPRSELIGVSLRGFLDNQGQKELDRRIAECKQGRSTVGATRLMRADGSRRSVRMSMMPIRDDHGEFAGVLCMITDTTDHIDARGLKRQLDHLRRLDSLGQLIGGLSHDFNNLMTVVAGSADMILSQSADGTPQQQLAKDILDAVATGRTLTHQLLAFGRSEGNRPEVIPIPDLLTDVQSLFSRTLGEHIGLDLAFGPDVWPVRAERGPLEQALVNLAANARDAMLHGGMLRVAATNEVVEPGQLAEGAPTGKLVHLVVTDTGTGMDEEIRKRALEPFFTTRPTAAGLGLATTAGIVQNLGGHIELESKPRMGTTVHIYLPAAEERAQPAGERREKSAVIGRVLIVEDQPDVAQLVQRLIAPAGYEIAVATDALTAVTQVASGARPDLLITDVVMPTMTGPELAGALRTHQPDLPVLYMSGYTAASLGPQLHLDDNSMLLEKPFTRSTLLGAIRSLCGPQPTP

SEQ ID NO: 12553 - protein, 317 aa, Actinoplanes utahensis
MQDSTDSEPLAGRSVGNSYRLVKPIGQGATGTVWEGEDSTTGEPVAVKLLHESLLRQPRLVTRFVQERTILLMLRHRNVVRVRDLFSVGETLGLVMDLVAGGSLRDHLHRERTLAPAEAVRLAAQVADALAEAHDLGIIHRDLKPDNILVLERNGRLETRLTDFGIARILNVPSMTTPNAVVGTPHYMAPEAFHGVTPSPATDVYALGVLLYELVSGQPPYLSDSVPELMRMHAEGRPKRRPGIPDDLWRLIRGCLSAKPRQRPAAAALVRELRELNRKLAGIAPLPPPAPPSLPPADPDDRAVDPPELRDGIRLPR

SEQ ID NO: 12554 - protein, 191 aa, Actinoplanes utahensis
MLLAAGVAGSIWRHGGTPASPSALPSHPAPAASVQVVPRRKVVSSTKPAKPSRVRTKRAVQPRPPQPEDEVRGPWECAPGLMIDLATRSPLAPKPCQSIGRTVQFQASLTAPAGGRAHIEVTLRDADTGRTVAGPTTCDGLTFTGGQMTRACGPAGATPRRGRNYTVVMAFRYERDGHTATSTARGRVFTW

SEQ ID NO: 12555 - protein, 214 aa, Actinoplanes utahensis
MSFDLYVWHEPEPITPAIAESRLRQGAFRPHPAVRAMRAALLDRFPPGSGTWSIVPPASDELLALSVAWPRAGEVGAAVVALAREHGLVCYEPQSGLLNPNAAGHLAAFTLTSAAGPEIPDPSSDRIDTLVGELGPDNHFVILERSDGWFVQVGYGPAAGTEPGRYALEYREGGPEHHFRTETTDPLEASRLLTGFLTGDDSWKRRYVWRPLFS

SEQ ID NO: 12556 - protein, 101 aa, Actinoplanes utahensis
MARVNTLLFLLAVALVVVALIDCLLTAPARLRHFPRAAWLVLILCCPVAGAIAWFRAGRRQNAGQGEGLAGHESAGRGEKPIGPEDDPEFIRLLAAAIREG

SEQ ID NO: 12557 - protein, 260 aa, Actinoplanes utahensis
MSRATVLACLVSSSVLALTIAAASPAQAAGVDYVALGDSYSSGVGAPGQSGSCLRSNYSYAAQWAAKHSPASFQFLACSGAVTDDVLNTQVPAMTSGADLVSITIGGNDAGFAPTVLTCLTSSDATCAAKVAAGKTYVANTLPGKLDATYQAIRAKAPGAKVVVLSYPNIFDTSSALCEMDATKRKALNSGAQALDDMIKARATAAGFTFADVRGNFTGHGVCASRPYLNGLTIIPPQNSYHPNTNGYTYGYLPALTNAA

SEQ ID NO: 12558 - protein, 124 aa, Actinoplanes utahensis
MDENRARRVVARLRERNVFAHLKLPHAGLTQYGIRIVLPDGREAIWDNDGTAGLEAQVMRDGVLVGFVASIPGSERFTDEQIIDAVATADYDRPIGRSAPVAGRRPTPAPAPPSLAQRFRSTFG

SEQ ID NO: 12559 - protein, 256 aa, Actinoplanes utahensis
MPESRFDQARGMRNTPVVELIDVTRSYLGVRALAGVSATFTSGTFTAVMGPSGSGKSTLLHCAAGLDRPGTGRVLLGGQDIGDLREPKLTEARRRVAGFVFQSYNLLDSLTVWHNVLLPQRLAGVRADHGWAREVLRRVGLGGREQARPAQLSGGQRQRVALARALAARPQVIFADEPTGALDLAAGRDVLGLLREAVDDLGTTIVMVTHDPAAAAHADRVVFLADGVIVGAMDAPSADRVAARMTEVSAAEGVAR

SEQ ID NO: 12560 - protein, 105 aa, Actinoplanes utahensis
MIRLVLGSLRQHRGAYAGTLLAALLAVALLGGGGLLLFSVLTAKPPADRFAAVPVVVAGAREVSLETVTTKAKKEGKTKVKHKVKTERLTGAAPLPADLAGRVAA

SEQ ID NO: 12561 - protein, 723 aa, Actinoplanes utahensis
MPVGAELRITTRTGTRTLLVSGIAAPPGRDALPAQGAVFVADSEVAAISGLTGPTAIGVRPAAGLDPSVLRDRITAAVGVPATSGTSPAPASSTAAVPAWALPAAASSTAAVPVGALPAAASSTAAVPSGVLPASAPASGASGGAGAIVVLTGDDRVRADLPGALPDYIAPISIFGFVIGITAFAAIFVLTGTVTLSVRQRLRELALLRTAGATPGQLRRMLGREAIVLALIAGLPGAPLGVVLAHLVAARFRALGAVPAPFVVRVSVPVLLLAILAGTLVTYVAARLAGRRAVRIAPTQALTETATAPTGGRAVRVLAAVVTTAGAVAVLSFVPLDGPFGMGMSFISSALLLCAVAALGPILVRPLTALLGRVSGLAGRVSGLAGLISRAEYRRVAAVAVPLVLMFALNATMLLNGRLQDRLAGVQQRERLAGATAQVAVPGGLALPDAERIAARPGVTGAALLLPTRVILAQGGKPEDYAAQGLMTTGADPAIDLGIRAGAPGDGLGASAAVARQYGWRIGEPVDLWLADGYRVTLPLAMTYARNRGFGDLVLPAALIAAHDPKGLVSVISLRGAPGVARGLPTISAATAGGDHADQQGAWELMVVISVGFTAIAVVNTFAIATAGRRGEFAALRLTGATAGQLHRLAAGEAVVTVLTGLLLGATVSGIVVGAFSLAQDGALRVIVDPVTYAGMAAGVAALGLAAGVLPARLLLRRRAPAI

SEQ ID NO: 12562 - protein, 409 aa, Actinoplanes utahensis
MIKRTGRALGYLITGPVAGLAGFVWSTVAGLLVTVLAVTQLRDPAFLGAAWVTRHLARAERRRAGWVLGARIPDPYLAGTPVVAQPATWRDLAWLVLLLPIGVATGVAGVVTAAVDAAAILAPAVFWAVPNPHAPFPMRPLLTTVPGRIGLTVLGLALLPVAARLVRALAAGPARLAAVLLGPGEHGRLVARAERLAETRRRVVDAQAAELRRIERDLHDGAQARIVAAGMTLALAARKLRAAAPPASGRPDGGGDPRTDVELARRQLDDALAELRRLVRGIHPPILTDRGLHAALAALAGDSPFPVALHGDAAARYPAAVESAAYFVVAEGLTNAAKHAGAASGEIDLGRVGGVLRVTVTDDGRGGADPAGAGLVGLRRRVEALDGTLTVTSPPGGPTRLVAELPWSS

SEQ ID NO: 12563 - protein, 267 aa, Actinoplanes utahensis
MGTDGIDRSEHRPHRKHLAHRRHRRHRWHRLHRAHRPHRRDRRCRGGRGSAVRIVIAEDLLLLREGMVRLLTETGHEVVAAVGDAIGLLAAVDEHRPDLSVIDVRLPPGFRDEGLRAALRIRAADPGARVLIVSQYVERAYAAELLADGRGGVGYLLKDRVTALDDFLDAVERVAGGGTAMDPEVVRQLFARGGGNHGIDGLTAREREVLALMAQGLSNAAICETLVLAPVSVEKHITNIFGKLDLPPAADAHRRVRAVLTYFNAAT

SEQ ID NO: 12564 - protein, 337 aa, Actinoplanes utahensis
MPPPLKRATVHDIAAAAGVSRGTVSRVLNGGYVSAEARAAIEAAITEVGYVPNTAARALKMRRSEAVAFVALEPHSLFLDDPNIGALMLGANAALSLADHQMVSLVVESTRDMERVAKYLSGGFVDGAIVVSARAHDPIIQVLGDLRLPAAFVGHPPDLDHSTPYVGIDNQGSAREITTRLLATGRRRIGMIAAAVDRDSGMDRLTGFRTALGPAFNPDLVAEVPHYDYGSGVKGMRLLLERDPTIDGVFAASDAIAAGALETLREAGRTVPTDVGIVGFDDSTWAVRTQPQLSTVHQPAKELGAAAAHLILRQLRGEEINVPAQLLPTPIIWRDSA

SEQ ID NO: 12565 - protein, 724 aa, Actinoplanes utahensis
MLGGGGAAGGTLAGREVVNREAAGKAGRERPAIKDAAVAIDLASDVVLVCARSHIRNADVGAGKCVHVHTSVTRSFMKSIVLGCDYNPEQWTPEVWREDVALMREAGVKLVAVNIFGWSHLEPSPGRYEFDALDEVIGLLHAGGIRLNLGTGTASPPPWLTTLHPEALPVAADGTTRFPGGRQAWCPSSPAFRERAFALVEQVADRYGDHPALDLWHVSNELGCHNALCYCEASAAAFRSWLRRRYGRIETLNDAWGTAFWSQRYGDWAEIQPPRLALSVRNPAQIVDFHRFSSDELLDYYRSEAAILRARSAAPVTTNFMVTAHIRNLDYWSWAPEMDVVANDHYLDHRLGDPTAELSFAADLTRGLAGGKPWMLMEQAAGAVNWQPHNLTKAPGEMLRNTLTHVARGADSVCFFQWRASAQGAEKFHSALLPHAGTDTVAWREVLRLSDTLGRLGEVAGTTVRADVALLFSWDSWWAAEGEARPSQAVEYLDQVHAAHRALRDLGVTCDVVAPGAELTSYKVVVVPCLYMVDDLAAVRIADFVAAGGKLLVTFFSGIVDERDRIRLGGYPGAFRDVLGVRVEEFAPLKPGDEVRLSNGATATLWTERLRVTTAEPVASYLDGPLLGVPAVTRNAFGAGTAWYAATALDAGALRDLLREITGVTAEKPKNTEVVRRGHYLFVINHGAEPIEYPVTGFDLVTEKATDGLLRVEGGGVAVVREES

SEQ ID NO: 12566 - protein, 286 aa, Actinoplanes utahensis
MIKKRAIAFFVLPFGVLFVAFYLAPIGFAVKQSLYRVTRTGTFGPAHEVFGGLTQYQRVFENAPFWQSVGRVLLFGVVQVPVMLGLALLLALLLDSGLVRGRRFFRLAFFVPYAVPGVVAAIMWGFLYSPNLSPFTAVTRAWDLLSADLVLWAMANVVTWVYVGYNMLIIYSALLAIPQEVYEAATIDGAGPWRTAWSIKIPLVMPAIVLTTVFSIIGTLQLLAEPQVFRTFSSAVSSTYTPNLTVYSTSSIPNFNLAAAFSVVLALATFVLSFTFLKFTQRGGEK

SEQ ID NO: 12567 - protein, 275 aa, Actinoplanes utahensis
MKSKTAAMAVMGICTFYFLVPIWWLFVGATKSRGDFSNTAPLWFADFHLGQNLRELFAYRDGVFLRWMANSLAYTGGAALLGTLLAAMCGYALAKYRFRGRELIFNIVLGGVLVPATALALPLFLIFSKLEATNTFWSVFLPSLVNPFGVYLARIYATASVPEELLEAARLDGSGEVRTFFTVSSKLMFPALVTIFLFHFVAVWNNFLLPLIMLGNERLFPVTLGLYSWNTQVNQLPELRMLVLTGALVSIVPLVVAFLLLQRFWRSGLGSGAVK

SEQ ID NO: 12568 - protein, 853 aa, Actinoplanes utahensis
MDLGLRGLGRQLDLLGRAGHQRQVGGRADAAVDRGRQGRRQLGRLVDGGLQGLEAPVRGGRVRDLAEHLGGGVDPAQREGEPLPGDQGRRGAPGAGQGRRLLRRPEDLRRVRAGLHPGHPGLHLGADDDLDLRHRLGRLQGGGLRQRHPAGRAEEGADVDGRQSQVAEHPGRRVTFTHLRAAGVSFVLNARGAVLYWGADLGELPDGFAASRIPAIPPSSIDVPLQLSLLPSIEDGWTGRPAFPGHRTRITAVQHGQNTITVRAEQAGKGLELTTECELTPEGVLRLRHRVDNHGLAVVDLAALNVLLPIPPEATELIDFSGLWAHERRPQRAPLRDGVWSRESRHGRPGHDDAFLLMAATPGAGFRTGRVWAVHLAWSGDKQIWAERSPLGQSVLGAGELLSPGEIRLAPGDSYTTPWLIAVYSENGFDGLSDRLHPWIRASRRTAKPRPVVLNTWEAVYFDQSLDRLTALVDAAAESGVERFVLDDGWFTGRRDDRRALGDWHVDPVIWPDGLHPLIARVEAAGMDFGLWVEPEMVSPDSVLARAHPEWILGPPDALTWRFQRVLDLAVPAAYAHVLGRLTDLLTEYPIAFLKWDHNRDLLEPGAAHRQTTALYRLLAELRAAFPELEIESCASGGARIDLGILPHVDRFWTSDTNDPLDRQLIQRWTSVLIPPEMLGGHLGDGVAHVTGRTSALGLRMATALFGHAGIEWDLSRAAPADRALIAAWTAEYKRLRGLLHTGVVVRADHPDPAVLLHGVVAPDRSAAVFALVTLGNPVAALPPPIRFPGLDPDRSYTVRPLGHPPRMVQDAPPPWLAEGAVTLTGRVLAEAGLPAPLLVPEQAALFTLTAVA

SEQ ID NO: 12569 - protein, 879 aa, Actinoplanes utahensis
MVRRWIPFAVAGLLVTTVPGTPAAAATPATRYVVRLTGSATADRVARSAGGKVHHRFSAALHGFSADLTPAAVARLRRDPSVAAVDPVRPVHLADTQTGPDWGLDRVDQRALPLDGKYTWTGGGAGVTVYVVDTGVMTTHTEFGGRATAPISTVGDPFGTTDCHGHGTHVAGTVGGATYGVAKKVKIVGVRVLDCQGNGTDEGVAAGLDWVIQNHVSGPAVVNLSLGGDPSAVMETAVNNTIADGITVVAAAGNDSTDACQHSPARVPAVITVGATAKDDSLAGYSNRGPCVDLLAPGDDITSAATWSTTGSTEMSGTSMASPHVAGAAALLLGREPTLSPAVVAARLGSAATPNVVTGLTAATPNLLLSTLTTVLPLATPATRRLADPLTGRAYSAGLQATGGVAPYTWSTVSGTLPAGLTLSAAGQVTGTPSAAAAATTVTVRVKDTGGRTADSKITLAVKAPGLPAIGEFVPAVRTAGGGQSFSDAGGVSLSADGRYAAFVSTAGDLVTGDTNGVADVFVTDLTTATTTLVSRTTTGAIADAESWEPDISADGRWIAFTSTAQLSPDDTNEAQDVYLADRTTGAVRLVSRPPGKPAAGGSHAPSVNQDGTRVAYLSSEPVLWGGTDPAVIDQALVATIATGAQTVVSVTTAGKPPTDGNSYHPVISADGRYVAFGSAAAAISSATPAGNFADHAYRRDLTAKTTKMVSAHADGTADSWGELLDMSADGRYVLVTSMDELAGDVGAVYTQAYWRDLTAGTIKVASRDPGAAYTADQVQGGRLSDDGSQATVTVEHTDSADPAAARSSVLAVTPSTGASRRIGPWYLPMPPDYAGTRRVSDDAVLSRDGTYLLAATTNASSVPGYFAGPLTPAVTRLR

SEQ ID NO: 12570 - protein, 244 aa, Actinoplanes utahensis
MARTALPGRLTWQVATVSAVRAETATARTLVLDIPGWPGHLPGQHLDVKLTAEDGYSAQRSYSIASDWPGEGPVEVTVQRLEDGEVSPYLTDVVEAGDQIEVRGPIGGWFVWRSAQPAPVLLVAGGSGIVPLMAMIRDRGRRRGRQPFRLIYSVRTPADGYYADELRRRVRDDPGLDVHFVHTRSGPGPNRRIDVATVNTYGWPPDFAPDVFVCGPTAFVETVADILVALGHDPKKVRTERFGG

SEQ ID NO: 12571 - protein, 199 aa, Actinoplanes utahensis
MGIISRGFGGRRRDSAPDLPPGQYLTHDFPVLSTGPTPRVDTDRWSFTISTETGEKHRWNWAEFTALPAEEITRDIHCVTKWSKLGTTWKGVSLDTLFEDVETAADYVMAHSFGGYTTNVPLADLLDGQAWIAYEFDGEPLEEEHGGPARLLIPHLYFWKSAKWVNGLEMMHEDEPGFWELAGYHMYGDPWHEQRYQGD

SEQ ID NO: 12572 - protein, 548 aa, Actinoplanes utahensis
MRGKLFTGLLTATAVVTLGTVALPVSAASAADRAPVRLVTTTLDPLGRPVITVREASAGSRHLEEAGAEVDGRVHALDATTDGTDPYRARQWDLDTMHVPAARSMSTGAGVTVAVIDTGVDGSHPDLAGQVLTGYDAIAGQAGGNTDPQGHGTHVAGTVAALTGNGIGVSSVAPGVKILPVRVLDANGNGYDSDTAKGIVWAADHGANVINMSLGGTDRSSAISDAVTYARGKGVVVVAAAGNDRAAGSPANYPGADDGVIAVAATDSGDTVAAYSNAGGYVDVAAPGSAILSTYPTALGASGYASMSGTSMATPHVAAVAALLLAAKPGLTPDQVQTALETSAADLGTAGRDDDYGYGRVDAAAALTAVDATPGSTPVSTPQSTPPVVSASVSRRSVTYGSRTSTTFRVSDWADQPASICISVAGGSWACDSVRTSAAGTFTLTRTATASFRARLTAGSASAVTTYTAIGVVSLTRTAKRTLTIRVSGAGGQKLSLQRSAGKRWTTVKTFGATGSRRVTGLVSGGSYRAVLASTSKVSGVTSKTVKA

SEQ ID NO: 12573 - protein, 160 aa, Actinoplanes utahensis
MRSGRPRGAVEVPLIRRRIGRMPLTGEYQPGTLDWAREQAEQYEATGGAGTPEIIVVTSVGAKSGKLRKTALMRVEHDGDYLAVGSLGGAPKNPVWVYNLRKNPHVEVQDGAERHDYDARELTGAEREVWWQRAVEVFPNYAEYQTKTERIIPLFVLTRR

SEQ ID NO: 12574 - protein, 383 aa, Actinoplanes utahensis
MRTPHQPLDRANGAAVPAARTPQQLPSAAMPLSGSVDDGDRLVDLVDLIALDPFVTGREPYGRTTWLENLRADSALTVPDARVIREAVEDDGHGRLSVGDGWTLHVMRWKQSRRARVTVTAVSGELAEAILTKVTAGAVEEPAPADDSVPVGFWHYGPHGPRRTQREIGAAPWETIKRNYAKPVGDTLERLMAIDASTVTGRLLLLHGEPGTGKTTALRALAQQWRSWCQVDCVLDPERLFGDPAYLMSVALGSGEDDEPRWRLLMLEDCDELISGDAKASAGQSLSRLLNLTDGLLGQGRNALIAITTNEDLSSLHPAVVRPGRCLASIEVGRLPYREAADWLGTTTGIGPDGATLAELYALKTGAEPVTVPRQAPPTGMYL

SEQ ID NO: 12575 - protein, 515 aa, Actinoplanes utahensis
MRTSFRAAIAGVAALAVLGPVGYFWYDSLVPGTYDMAAMGYPDSGGGPAVAHDHGVGMSVADLRGPSGTPDVAVTLVARKEGARYTLNGSTPGPAIRAVQGQLIQVTLVNASVPDGVTLHWHGVDVPNGEDGVAGVTQDAVREGQSFVYRFVAKDAGTYWYHSHQVSHEQVKNGLFGALVITPRAEPAATTTGQAEPSQVAMVHTYQGKRTINGTPGSSPLTTATVRLINTDAGPIRVWVTGTTFRIIAVDGRDVHEPGPIRDRNVLLTAGGRVDLHLDTPGRIDVGGDAALVSPEGRPATESPAASPGPAADPGPAADPGPTASTGPAADPGPTAGRSPAAVLQAAPLPRETVDLLAYGTPAPLGFDPAEAGRRFRYDIGRRFGFLDGRPGMWWTVNGHLFPDLPMFMVGTGDIVRMTLHNGSGEVHPMHLHGHHVVVLSRNGVVATGSPWWTDSLDVADGDTYEIAFVADNPGIWADHCHNLDHVPEGLVVHLAYAGVHSAFQVGGPHHNTPE

SEQ ID NO: 12576 - protein, 140 aa, Actinoplanes utahensis
MRALYRALAGLIALSVVVQAAVLAAAWFIVIKDTDNGVVFDKNNEGNWGHAAHGIIGMMVVPLLALLLLIISFFARIPGGVKWALITVGVVALQIVLAMVSFGVPVIGALHGINAFAVAGVASIAMRQARESIAPPVAVA

SEQ ID NO: 12577 - protein, 429 aa, Actinoplanes utahensis
MRGEHRPGGPAIAGRQPAEVVMEHVAVVDLGYGDAGKGTVVDALCRSGRVRAVLRFNGGAQAAHNVVTDDGRHHTFSQFGAGTLRGVPTHLTRFMLVDPLALAAEAGALGNPFELLTVDGDALLTTPWHRAANRRRERAERHGSCGMGVGETMAYALAEPDAPRVADVLHPARLRRRLAKVREAYGFGDAPLDDVADAFTAFGRAVRITHESHTMRLLAEGPCVFEGAQGVLLDEWRGWHPHTTWSTTTFANVAELCPSFRRLGVVRTYTTRHGAGPFVTEDPLLDLPEAHNGTDEWQGAFRAGHFDAVAHRYAVEVAGGIDELAVTHLDVPAREPALKICTSYVVDGERVDRIVPGPHRDLAHQAGLTAWLGRARPADLHRPPDWAREIGALLGAPVTLESYGPRAGDKRMVPEGVARPVRIRRAAYC

SEQ ID NO: 12578 - protein, 284 aa, Actinoplanes utahensis
MGSGRWSTDVWTAAENYRAATGQSAFAYSDSGARQAHPALDPRGVFMRESRDSREHPASTPIVVMFDVTGSMRHVPRVLQTKLPQLLGLLTRRGYATDPQIMFGAIGDATCDRVPLQVGQFESDNRMDEDLSRIVLEGGGGGGRRESYELAMYFLARHVVMDSMITRGRKGYLFLIGDEMPYDTVKPDEVRAVIGDELPQALPTREVLAELRRKFEVFFILPTAAGHGGDRAILAAWRDLLGQHVLELDNVDEVCETIAGAVGMCEENTGPAAPRSLAGSLRRW

SEQ ID NO: 12579 - protein, 341 aa, Actinoplanes utahensis
MNPGYATAEQRTRTSHRISFEDAAARIAAARTFAELIDSGLIDSRALGIERRTASGTAFVNARHAYRTLARIVHPDAAGAARREPATAAFARLSALYHERGVDGHVKPERTRWTARPLFAEGDIAELFEDGDLLLKIARDPADNDLMAAEANALRRLNTHGRPGFRAYAPRLTRSFSYHGRTVNVLTRQRGFRDLATATDRGLPDLVWIWRRLLAGLGWAHRAGVVHGAVFEEHVLIDPRVRGLVLIDWCYATPVGARPRALIARHEHRYPFEVPAGQPVTAATDLHLATSLMKRLFGTDMPLPLRRFADGCLYDAPRMRPQNAWRLLAEFDELVPPRYRI

SEQ ID NO: 12580 - protein, 253 aa, Actinoplanes utahensis
MVDEASFLAGYNPRDYPSVAVTVDVVALTIRDGQLCVLLVERGEQPFAGHRALPGGFVREETLDRAALRELAEETGLAPGPEADADLERVWLEQLRTYGDPGRDPRMRVITVAYLAFAPHLPEPTAGSDAAGAYWVPVDEAKDLAFDHDQVLADGLERARAKLEYTPLATAFVGTEFTISELRSVYAAVWGEELHAGNFHRKVLSVPGFVESTGETAARGGERGGPKARLYRAGDARSLHPALLRPTREDGVR

SEQ ID NO: 12581 - protein, 95 aa, Actinoplanes utahensis
MTQMMNMPRVQTCTVTDCGYNHDGCTAFAITIGDLNAECDTFVGSGLTGGMGVATAQVGACKRADCKYNHDLECQAPAITVGASADRADCLTYEK

SEQ ID NO: 12582 - protein, 759 aa, Actinoplanes utahensis
MRKSRNAARPRWARVGLTTGVVGAALLVYPQAAFAASSVTPPVAPVGGSVTINDTAPSPNFTTATGSTRVQIITTGTCAATYTTPTTSIVSANVTAAAAQSGGTPGTVTFTVPTGVSPGTNGQAKRYIACVYAGVTGGTSTREGAAAGYPFYVGTPATPSPAAGVTGGGNTVTLTAGTGGPIFTGVTTIGAAFTLNTSDCSQTYGTPTANLATTVTRTSDTVASLTVPAGVVSTTANPTAYNICLYNGNTSSAALFSVVPYTAGQLQLSQTTGPWQGGNGLNITSPNQFLAGIDNPGVIFTSGACPAAYDSGVTATNIPVDPVNSVRKLSNTRLATTAPAFYGTANDASTAFGSAGSITWNLCIYDGSGNGTSNLVVANPYKVTTIQTSTGVSPKAGPALGGSLITVTGTAFPTDPTLISATLGGVPLTDINPLSTTAFTARTPRHAPASNVALVVTTASGSHTLNNAYSYTSALVIAPNTAPNNRVVQLVVDGVGFQSASWGNTLVTGAHVFLVKGSYSSTDNGNVVRSNAPVADCSNVLVLSDTELICKLDLTTRLDATGAATLSAVPTAGNAVVTTAGSRLITGTAFAPTDVGKAVIEAVDAPVIPAGTVITDVLNATTAVMSNAATGTASAADVTLASPLTSAATVTTTNSSTGLTAVSPTLGTGDVGKYIIGASIPTGRTISAQGGATGTLSAAAASSGGGVHPVVLAGTTIPVPEGAYNIQYVSNAAVNAVATDPSYVQSQISSTSTFTVAAF

SEQ ID NO: 12583 - protein, 760 aa, Actinoplanes utahensis
MRKSRNAARPRWARVGLTTGVVGAALLVYPQAAFAASSVTPPVAPVSGTVTVNDDSAPFIGSNTDRVELLTTTGTACPATYTTPTASILAAASTTSSTTSQVVFVLPTTATAGSNGQVKKYMACVYASNTAGSSARKGATNGYPVYVGTAPTVSPTSGTTGGGATLTITGGTGGPIFTGVTTVGAQFATQANDCPTTYGTPTANVATTVTRTSDSVASLTVPSGVTSTTATPTPYFACLYNGNASASALIAVVPYNVGQLSLSQAIGPYGGGNNIDITSPNPFLAGIDTPGVEFTQGDTCASTYTVGQTGGTNEPLLTANIRKVTNNRLAVTAPAFYTSGAYTTALGNQPAGATSVPWQLCIYDAATAQGNLIASNPYKTTTVQTLSRISPNAGPALGGSVVTVVGTAFPTDPTQISATLGGVPLTDITSLSSTAFTAKTPMHAPANSNALVVTTPAGSATLTGAFSYTSALVVNPKTAPNTRSLDVVVNGVGFQGAPWSSSLTAGAHIFLSRGNYSNASVGGARANAPVADCRNVLVLSDTELVCRLDLTKRLDLTGTALLSAAPKYGVTASVTAGSRVLTATGGTFDASDVGKAVVDPAGVALATGTVITNVVSGTTAIMNNPASATLANNATITIASPTYRAATITTTGTNTVAAITGPASTFVASTDVGAYPVNANITAGTTIQAVGSDTGATLSANAATAGASVASIIYSQYVPVPEGAYNLQYVSNAALNAVQTDATYVQSQVSSSSTFTVSAY

SEQ ID NO: 12584 - protein, 229 aa, Actinoplanes utahensis
MANEEQNQPTQDLTPRPGKRRKQAMVAVAGAAVAISGAAFFAATQQDDSPTARSATVAAPDAGASADQVGRIAAAGDELTKSKAGTDPSLPPSAKDRVDAARRAAAKDGVKITHPLPAKPDPEADGAKEVTVGSAKKGQTMRIITAHGDLTGTHELAWVAGGITRHGDIQCSQQFKFYNEAAPKTRDNLLVCWRTSAHRSVITVDAKIGGHPPVAQSLAVINREWHKLG

SEQ ID NO: 12585 - protein, 422 aa, Actinoplanes utahensis
MISSRQFRRALLAGTVTTGLAVAGGPAPAYAGSTALPMTLSSATGPSGGGNTIIGTVTPTAANPNPFVAGSMPTVQFQYNTCTANARAVAAITGTGTAATGGVLTVNPDNVKRNGTTRIAFEVPSASYPAKVDDKDSTINTGGLVLTGTQTSAKWNICVYDSDSLSTSTLLAQAAYTIGVRPKITAIIPPSGAALGGQSITVTGAGFSATSNATTASIGGVPLTNIKVAANGNSFTATTGQRAAATGLTLIVNTPGGQVLSSDPDNNGLPQDADDKTPDAPITFTYSNGIQISPNTAPAGTKVDLLIKGVGFQQMTFDKSADATPTSVTAHVFLVKDAYVAASNRGVQECKKVLVASNTDLVCTLDLGADRLSPTDSSAVSGKTVDEGSYTVTVVANGATDAGDAAAPTVVSSGATFTVAPY

SEQ ID NO: 12586 - protein, 397 aa, Actinoplanes utahensis
MRRALGLAAVITTGLVLGAATPASAAAVGLTLSSNYGPGGIIKTLIGTVPSTVTGVTFAAGVKPVVQFQYSTCSIHASAITQITSTNGTATTAGVQTVDPAKVTRISGSKIAFQIPTGSYPAGNNLNTSGVVLVNGQTAARWNICVYDTDSALTSTLLATAQYTLSLKPTIATILPATSPSAGGQTITVNGTGFTGVAPITGSIGGVPLSNIRAATTGTSLTAVTGAHAAGPGMVVTINAPGGTVTSADPNGDGSTGDAIDFTYSNGITVSPHTASRGSVVTVDITGAGFSVPTFEPSIGTPGSGNAHIFLVNGAYDSSSNRGVAECTGVTVVSDNELVCTLDLSINALDPQNSNLTGAPVPDGAYIMTWVADGTQGSTGANPSIISSGSDFVVAPY

SEQ ID NO: 12587 - protein, 674 aa, Actinoplanes utahensis
MKVVLRRYAVGAVAAAAVAGVAAFALPTGTVGWTPVTYGLHQTADQLLPATVTAEQPARVVGTTIDRNGKPVVTVREATTRDGAAKLVEQAQKAENAVGVEIDAKAVALDAVTGGDLYRPQQWDLARMRATDAWPTSTGAGVTVAVIDTGVDASNVDLTGKVLTGWDAVADKPGGNTDQNGHGTHVAGTIGAVTGNTVGVSSVAPDTRILPVKVLGADGSGYMSDTAEGIIWAADNGAQVINMSLGSTSQVGAVSNAIAYARSKGVTVVAAAGNERANGSPVSYPGADAGVIAVAATDSADNVASYSNAGGYVDVAAPGSAILSTYPSALGRSYATMSGTSMASPHVAGLVALLKSVNGGLTPDQLEQALETSAVDLGTPGRDDDYGYGRVDAVAALAAVTAAPSSAPTSAPTSAPTSAPTSAPTSAPTSAPTSAPTSAPTSAPTSAPTSVPTSAPVSKAPTAAPTTAPTSKAPTASPTTAPTSKAPTAAPSPTVAKAKPVIVANPARADVNYGTTNVTTFTVTAAGQPWVKKNAQLCVAESGKAFQCVDVVTSATGTVTANRVATAGYQLELRIAATTANEAATGAAAYTVHSSAYAVRTGTRTMSVSLASPAGLNVEVQQLIGGSWKKVLQFASNATTTKATVSGLTTGQQYRVVVPTTGSITGSTSSIVVA

SEQ ID NO: 12588 - protein, 242 aa, Actinoplanes utahensis
MSDDDRPDRTRGGSVYASEAATAPHRRGLQRRQTAIGIAGAIAVLVGSGFIVTQLMDARQDTLPEPAALAPLTTAATPGMEGTGVSAVPGNLRAPRTTHPAEAAKRAPSPTPMSLPEEPGASAPYAPSSMAVAQQGQQAPVIRRVETVHNGTVRISTARADLTGRGDLQLAADTGFAAGDGIRCTNRVRFSPDEPATTREYLLLCWRTSDRRSVITMAVAAHGAPTPADSAKIIIREWDSLG

SEQ ID NO: 12589 - protein, 73 aa, Actinoplanes utahensis
MTEGTEHLPARPSWDCRVCAQPWPCPPARETLGRGHNRMDLAVKMWDYLEEAARDMPQVPAPELFDRFLRWTQ

SEQ ID NO: 12590 - protein, 182 aa, Actinoplanes utahensis
MLFRRIPAMLGLAGLLVLPATAAQAAASESDAAFLKAAHQVNLAEIAAGRIAWTKTTDPTVKELAATFLRDHIRMDADLYLTARELRVFLPADPTEEQQALAHRYEVAGTDTFDEYYITTQLAGHRAALRLASDEAANGSDESVKALAAKAVPVIRHHAEQLRDAAVAAGLAGYLGGGGRPS

SEQ ID NO: 12591 - protein, 66 aa, Actinoplanes utahensis
MAKTGLDRDASPADRAVGALLGLVLSRPVDEAVTPILYAATDTAAPTGCHIGPGRPFRPRGRPSRG

SEQ ID NO: 12592 - protein, 419 aa, Actinoplanes utahensis
MRAQAGEHVEPGAPMADETTSTTESTAGAARERMRRWRLVLGGAAEESLGKAEGRDGAVDGALAALYDSGGDGDGTGSKRSAGLGGSAPRVARWLGDIREYFPGTVVQVMQADAIERLDLTRLLLEPEMLAAVEPDVHLVGTLLSLNKVMPDATKDAARQVVRSVVEQLEKRIAQQTRAAVSGALNRAARINRPRQADIDWDRTIRANLKHYQAEHRTVIPERLIGYGRRSSAVHRDVVLCVDQSGSMASSVVFAGVFAAVLASMRSLRTSLVVFDTAVVDLTDQLSDPVEVLFGTQLGGGTDINRAVAYSQQLISRPRDSIFVLISDLYEGGVRDEMLRRVAEMTAAGVQVVALLALSDEGAPAYDHENAAALAALGVPAFACTPDAFPELMAAAIERRDLTAFAERFADRKATGAAL

SEQ ID NO: 12593 - protein, 108 aa, Actinoplanes utahensis
MSQSSEDAELFSHSAEQPAGGETPALPTMLQFSHPTQEAVIGSASHAAEPAGRLFSHPGPARGATEFDEMSGWAGQAGGGRGGNRSGNRDRGPGGRGTGGRGAGGLAS

SEQ ID NO: 12594 - protein, 764 aa, Actinoplanes utahensis
MPERFYGIRHHGPGSARAVVRELTAQQPTVLLVEGPPEADELVRWVAGSDLEPPVALLGYAVDDPGRAAFWPFAVFSPEWQAIRWAVDNEVPVRFFDLPYAYRVGDEDGGPAPAEASPRVGDSPPVEGDQPSRGDGDAEAGGDMDRTAAPGRPVDPIGELAAAAGYDDPERWWEDVVEHRGMPAFEAIAEAMTAIREGAAEDPEDLPREAYMRTVLREVRRKHDNIAVVCGAWHVPALTRKVPAKDDNALLKGRRKGKVAFTWVPWTYGRLASWSGYGAGVGSPGWYHHLFTSADSVVPRWLVDAAGVLRAEGVPTSSAHVIEATRLAEALAALRGRPLAGLAEVTEAAEAVMCDGEPLRTALINRRLVVGERLGSVPDEMPAVPLARDLAAQQRSLRLKPEATERELRLDLRKEIDLRRSRLLHRLRTLAVPWGEPAPGRRGTGTFREEWVLRWQPEFAVRLVEGSMWGTTVAAAATARVTRRASTAQTLAEVTALLETCLLADLRDAYPRVLTALDTRAALDADIHHLMAALPALARTLRYGDVRRTDVGGLATVTASLLKRICAGLPSAAGSLSDEAARQLRDGVDGVHQAVGLLADDDLRELWLVTLESLARRPDLHGLPAGRLTRLLLDADRLDAGEVRRRLRLPLTAGTPPAHGAAWVEGFLAGGGLLLVHDDALLTLVDEWLADVPAEGFDDVLPLLRRTFGTFDAGERRAIGERVAGPRAGAAQAAAVTIDEKRAVSVLPVLGALLGREIRVREDA

SEQ ID NO: 12595 - protein, 379 aa, Actinoplanes utahensis
MSYPGGSLQFEPAIGRAGGPGDSGVRVTALRPHAEDQYADELTRLAAADDRPRPPGWRLSPQAVVTYLLGDGAKITPKYVGPRRLIEVAVSTLATDRALLLLGVPGTAKTWVSEHLAAAISGDSTLLVQGTAGTAEEAIRYGWNYARLLAEGPTAAALVPSPIMRAMRGGSIARLEELTRVPSDVQDALITILSEKTLPIPELGDEVQAQRGFNLIATANDRDRGVNELSSALRRRFNTVVLPVPANADDEVEIVARRVAQLGRSLELPEVPAALDEIRRVVTVFRELRSGLTEDGRTKLKSPTGTLSTAEAISVITNGMALAAHFGDGTLHPGDVAAGIVGAVIKDPVSDTVVWREYLETVVRERSDWLDFYRAARDA

SEQ ID NO: 12596 - protein, 329 aa, Actinoplanes utahensis
MVDWTTATGTERLGHLITLRRSEPAHARRLVESTWGADSSENRARFLGAFTDGLSLDDEELLERALDDRRKEVRQTAVDLLRRLPGAALGERMRDRAHAAVRLAADSARLLVTPPAELDAGLRRDGVSATPAHGTGVGAWLLEEVVAGTPLTSWAALEPTGYLALARGNDWVTPLLHGWAKAAITQGDARWAAALLAGDSGMLREGVRWELHLVLPSDTLARLAAEALRAEDAAAHRLLALHPGPWPEPLSVTVLETILRRARHDRHTWQLGELCRTAALAMPPAYADLAGRLAAQLEPEVDPSRVRPIADLARTLAFREEMLRELSEP

SEQ ID NO: 12597 - protein, 99 aa, Actinoplanes utahensis
MPAERWSIAQAESIAPDASALKRARSVAGQFGPVGLLDDVLWGLCRGYQVAADLSGPAFKCSCPSFQTPCKHAVGLVLRWAEAGAGQDPAPDWVTRWPS

SEQ ID NO: 12598 - protein, 328 aa, Actinoplanes utahensis
MRVLLITALTPAVWGTTYAITTEFLPPDRPLLAGVLRALPAGLLLLAITRQLPRGAWWWRSAVLGALNIGFFFALLFVSAYRLPGGMAAVLGAVQPLLVAGLSTVVLGDRTTARTVIAGLLGAAGVALAVLTAAARLDPIGILAGLAGAASMAIGLVLTKRWGRPGVSLLTATGWQLTAGGLVLLPIMLLGEGLPASLTGRNLMGYGYLALIGTALAYTLWFRGLDRLPATRVSLLSLLSPVTATVLGWAALGQALTPVQVTGMALAFAAVLWGQSSPDRGRRQGASSQVRVGHHATRQAGAGGPEHPAAGRLGGGHPAGREAAERRP

SEQ ID NO: 12599 - protein, 162 aa, Actinoplanes utahensis
MREPDGVDRILAQWAVERPDLETTAMGVFGRIQRIARIASDAGERAYAAYGIGRPEFDVLATLRRSGAPFRLSPGALAASMMLSTGGTTARLDRLEKAGLVARSPDPDDRRGVLVSLTEQGFQVADQAVTAGLAEQQRLLAHLTPAQRSQLADLLRAVLSGD

SEQ ID NO: 12600 - protein, 62 aa, Actinoplanes utahensis
MTAGEDQRDQRYLTTRITADGRDGHPGEAGRCRLVVSRAIIVRRLCRPGRPGSERPAHPARP

SEQ ID NO: 12601 - protein, 401 aa, Actinoplanes utahensis
MYAVVDLQTTGTKTTWHDRIVEIAIVRLDETGKVLDEWCTLVNPDRDLGPQELHGISGAEARRAPVFAELAGQIAERLAGRLIVAHNLLFDAGFLTAEFGKLGVAVPVDDERGLCTMRLAGHFLPTASRSLAACRAAAGLGPHREQSALHGARAAGELLGYYLERAGDPPPWAELLDSARQADWPRLRVTTVAAVPRRRPEEREPHFLTRLVDRLPRQLDPKADAYLALLDGVLLDRHISASEADQLVAIAARIGLSRADAELLHHRYLCGLATVALADQILTPAERLDLDGVAELLGLTSADVDRALAEPAAQVTRWQLTPGDQVVFTGDLHPPREHLEVDALTHGLRTARKVTKQTRLLVAADPDSLSGVAKLARQYGIPIVTPAAYKTMLEALLSAQR

SEQ ID NO: 12602 - protein, 230 aa, Actinoplanes utahensis
MAVSDASKGLVLVVEDERPIADLVRLYLSREGFGVQVEHDGAAGLAAARRLRPVACILDIALPGMDGTEICRRLRADGDWTPVIFLTARDDEVDRILGLELGGDDYVTKPFSPRELVTRVKALLRRAAGPPEEDGVRRLGPVALDRSRRAATVDGQAVTLTATEFDLLAHLLGRPGRVFTREELLAAVWGYASHAGTRTVDVHVAQVRAKLGGAAGLIRTVRGVGYTADA

SEQ ID NO: 12603 - protein, 485 aa, Actinoplanes utahensis
MASGGGGPGWFGQVASGGGGQVPVGRIGAAGMREFLRTLTGRAVLVTVATAVVSVIVTALVAVPVAMRSTNTQVRAELVEKSAIAVELLTDEKPAARERIANRLRADDIEIYLIRRGVPDRAGLPPRVIAQISGGALVDAAGRVGGRPSFIAGRPLTGVDAGVVLTRPAASGLALRVLGSVWWALLAGLVGGALSGALLARFVTRPIELAAAAAGRLAAGDRSVRIARHGPAEAVRLAEAVNQLAAALQTSEGRERDFLLSVSHELRTPLSTIRGYAEAIADGVVAADGAPQAGATMLAEADRLDRLISDLLVLSRLEAADLPLDVVRVDVVELIREAGRAWSARCAADGPALSVELPDAPVIVATDPGRIRQVLDGLCENALRVVPAGAPLVLAVHAGGSGAVVEVRDGGPGFTDDDLAVAFERGALNRRYRGIRKVGSGLGLALAARLVARLGGRITAGHAPEGGAMFTVELPDEPADPGTLR

SEQ ID NO: 12604 - protein, 256 aa, Actinoplanes utahensis
MTQPIWGPVHAEMSAILQEHPDDVPAVVDQLTKLQDVLCQVPPLLGGNPLADFNRLYLAITENVLDRLYAGRFKDPAFLSRLDVEFAARYFDALRYWTHGSPACPGAWAGLFSRVPGPGPRLLPSAVAGVNAHVNFDLPFALVTTFDHLGSGPVDDSDQHHDYLQVNDIFAEEIPGLRRGYLDRWQLLIDTMNGDLDDWWQGEMVEYTRNVAWRNAQKIWALRHDQTALDKERRHLDRTATGLGKLLLSPFADFLQ

SEQ ID NO: 12605 - protein, 1100 aa, Actinoplanes utahensis
MPAGQEAPPQRLLDRQARAHGRGGRRRLEAVHAGAEHRHHRVSHVLLDDAPAVADRVGDDREVVPLQRPHLRTVQPVHQRGEPDDVDEQHGHGLAPLLTGDGDGGHVSRSPDHCVDREYGASRAPPADPQNDVSLTASTLVIFVTQNSPNRRHGGKGFRIRLPVMASQGDDGPLVGRTGTLADIQSYLRNAGPGGTAAVFVTGESGVGKSRLLRETADALRGGGFAVLFGTCLDIGDASPLHPVLQALRRHDSAPATGAGGPGALLDRVSQDLRAIAGDQRLLLVLDDLQWADRSTRQLLLYLLAGLGDVRVSVLAAIRAEALHGTHPLRRVLAELRRLRSVRVVDLAPLDHEQTRELVTAIAGDGVTGEDADRVHKRSGGNPFVVEELARDLRDGRVELSDTLREIFLARVDELPPNAHAVVHALAAGVEPVEHAVLSRVVRLPEDELLEAIRAAVAYRFVVGDGDGYRLRHRLVAEVLEQEVLPAEAAALHRRYAESLQACPNGPDHARLAHHWQRAGLPSRALPSVVAAARSAESLYGFAEAHRHWTLALRLIDDDAADRTELLGHAAESAHQCGEHQLALTRLAELAGRKDAPVEGELHLRRARYLAAAGRSEPAEREYELALESPDCSPRLRATAAAFLAELLLHLGRYADANRHAREALELAAINGATADLVRASAALGFSAAFREDPDAGLAVIRHAVEIAERSGHPDDLGVAYLHLAELLTGPLNSIEEGVLVARRGAERLADRGAGRTYQTRLLAIAGNGLFRIGQWTEADAVLEQAMRHRPSGADAVELLLARSRLWVGFGEVDNARRDLDAAATLLAGGGARHVLPMLTLRAGLAMWQKEHADARAAVQRGLTETRSDDLVLLGVLAWHGLRAEAEAHAAGSPVDPGALRRLKTVVTRLEAGANAAAPEVRAVLDGYLYLSAAELSRVEDRQDPEPWARSAALWDRRQQPYPAAYSRLRHAEVALARRSRRTAAINGLRQAYTTAIAMGARPLANEIKAVAQRFRVALSDDADTVPIAPPESDPGDELAILTGREREVLAAVAEGLTNREIGELLFISERTVGVHLGHIFDKLQVRTRVQASRVFLTAA

SEQ ID NO: 12606 - protein, 685 aa, Actinoplanes utahensis
MTAQPETLYGAADLTHLEGLDAVRKRPGMYIGSTDSRGINHLANEIIDNCTDEGVGGHATRIAITLHTDGSVQVDDDGRGIPTDVHAKSGLSGVELVLTRLHAGGKFGGSGYKASGGLHGVGASAVNALSLRFDVTVKRDGKVHEISFQRGVPGVFDGPGPQASFTPQAGLRIARRMKRGEPTGTSIRYWYDARYFETGARLDVEAVRTKLRNTAFLVPGVQYSLFDATAEEPHTETFHYPNGLVDMVEFMTPAADKPVSGILVVTGEGTYKENAADANGVMQSNVVRHAQVEIAFRWGTGYERSVECFTNTIRNVHGGTHRKGFERALVRALTEAIRNARGLLKPKEEPPVLDDFLEGMTAVIHVRVPEPQFTSQTKDELSTAGVTRVMQTLVESYLKEWVDGRRTKTEARTVLQKVVDAARVRLTQKQQKDAARRKTALEGASMPPKLVDCRSTGISRSELYIVEGDSALGTARMARSSEYQALLPIRGKILNVQKASLQQVLDNAECSAIVQVLGAGSGRTFDIGAMRYGRVMIMADADVDGSHIRTLLITLFAKYMRPVIEEGRLFAAMPPLHKVVTKGRNGDTVYTYTQQEMETTVARIERSGKSVQKPVPRFKGLGEMDADELWDTTMNPASRTVRRITLDDAERAEATLELLMGERVEPRKNWLIDAAGRIDQETIDA

SEQ ID NO: 12607 - protein, 841 aa, Actinoplanes utahensis
MARRKTPDNRVDLSAFDQAGARVIDNPLTTEVEDSYLEYAYSVIHSRALPDARDGLKPVHRRILWSMSEQGHRPDRGYVKSARVVGDVMGKYHPHGDVAIYDALVRLAQDFSLNVPLIDGHGNFGSPDDGPAAARYTEARMSREAMLLVGELGEGTVDFKPTYDGDDVEPKVLPAAFPNLLVNGTSGIAVGMATNMIPHNLGEVVAAARHLITHPDADLDELMRFVPGPDLPTGGQLLGLDEVRRAYETGRGVVRMRARAQTGPLEGGRGRQAITVTELPYGVGAEKIIEAITDEVKGKLLTSGPRRGQRQAARLQGIADVKDLTDREHGTRLVIECKVGVNPQALLADLYRLTPLETSFGINNLVLVDGQPRTLGLKALLEVFVQHRYDVVTRRTEFRRTKRLDRLHLVDGLLVALIDIDRVVAIIRGSDDAAAAKAALMSEFSLSDIQATYILDTPLRRLTRFDRIELETEQERLRAEIAELSRILDNEDVLKQVVSDELAEVTAEFGRPRNTTLIDGDLKEVLAASAPAGPLEVADDPCQVILSATGLIARTAAESEESAEARKRSGRVKHDAVRAIIHSTARGRILLITNRGRAFKTDVLPLPVLPEQSGTVSLRGGMSASELVPLEKGETVVGLAPLTTGGDSPGLAMGTRHGVVKVCAPEWPVRSDEFEVITLKEGDEVLQATWLTDGSESLVFITSDANLLRFPAKLVRPQGVKGGGMAGVNLSGEAAVISFNAVATADTSHGEPMVVTSTGTQVKVSPFASYPAKGRATGGVRVQRFLKGETALTVAWVGPRPAGCSTTGDPVELPEPDARRDGSGAAVLMGPQLIGHHIERD

SEQ ID NO: 12608 - protein, 68 aa, Actinoplanes utahensis
MTDACHRRSPPPAAAHEEIPRLGCALLVTPAPTSDLQPDDLDTIEADARVARHRRTRTGTAPAFITTP

SEQ ID NO: 12609 - protein, 147 aa, Actinoplanes utahensis
MRRDLLDLPVLLLGAATTLVDSINEGVRARGFTDLRPAHGFAFVRLAPDGATVIELAEHLGVTKQAASQMADELVRKGYVERHPHPRDARARLLTLTPRGWACTRAADEAATEALQPWADTLGPAHLATVRSALAQLTTPGRIRPTW

SEQ ID NO: 12610 - protein, 124 aa, Actinoplanes utahensis
MGIHRRDEGVEHRLHGSVFRSYVSPGSGSAELCAWRLQIAGGTAGARHRVDREEVFLVLAGRLQVFLDGVVEEIGAGDVLRVPVGVEFGVDNVGAETAEAWVTTSVGLKATMADGSVISPPWVR

SEQ ID NO: 12611 - protein, 314 aa, Actinoplanes utahensis
MELRDFGRLGQISALTLGGGGIGAVWGPTDRREAVATVHAALDAGITMLDVAPSYGADFEAERVAGEAIRSSSHPDVLVTSKVGLPDDTERDFAARIRRSLTDSLRRIGRDHLDVFFLHTQLRTAVPAPGTIGRDGYLEAAGEFLRLRDEGLIRAWGITAVGHPDQVITVLGDTPRPDVAQVVVNALDLNADWYFPGVAPRSDAIVRSANDNGVEVMAIRAVAAGALTSSLDRTVPSASPVASDFAAAEPFRKLAAEWGATPAALAHRYALTVPGVSTVILGVKNRTELAECLAAEAAGPLTPAELTTIQALRP

SEQ ID NO: 12612 - protein, 66 aa, Actinoplanes utahensis
MRAGAVIIVIWLLLGLVAAFERNYFKDTGDASCAKAGTVIVTVIAGPLNWLGVNPKIKCEVPPPSK

SEQ ID NO: 12613 - protein, 312 aa, Actinoplanes utahensis
MGGRLSAALRPGRGRLRDPAADAETECAVVPGPHTLRRVTDYLTINRANWDERATPHAESPDYRVADLVRDPAHLSDVVRFDLPLLGDITGQRGVHLQCHIGTDTLSLSRRGARMTGLDFSGESLRHARALATAAHADIDYVQSDVYSARDALGGGFDLVYTGIGALGWLPDIRRWASTVASLLVPGGRLFLREGHPMLWTLDYDREDDVLAIVEPYFEQTEPLVYDEPGTYVATDHRFVHTVTHEWNHGLGEIVSAVLDAGLTLTGLVEHRSVPWNALPRRMRRLDGGEWQLTERPERLPHTYTLQARRPV

SEQ ID NO: 12614 - protein, 438 aa, Actinoplanes utahensis
MTFIWGVATSAYQIEGAAAEDGRTPSIWDTFSHRVVGEHGDVACDHYHRMPDDVQLIKSLGVDAYRFSISWPRVQPGGRGPANQAGLSFYDRLVDELLANGIDPWVTLYHWDLPQELEDAGGWPHRDTAYRLADFAGLVLDRLGDRVRDWQTINEPWCVAYLGYQHGVHAPGRRDYGAALDATHHLLLAHGLAYEVLKRPDNTVGIALNLGTATPASDDPLDVAAARRADAGANRIFLDPLVFGRYPDDLLADLAARGHTLPIRDGDLRIIGRKPDVLGVNYYFGQDFAGRDEDGNTHDADGHPIVREITPDVPKTAMGWAVTPDRFTTLLLRLHHEYGLALAVTENGAVYDDVPGPDGFVADQERTAYLESHIAATLAARARGADVRGYFAWSLLDNFEWAEGYQRRFGLVAVDYATQRRTPKQSALWFRDRIRSGA

SEQ ID NO: 12615 - protein, 335 aa, Actinoplanes utahensis
MNEPVLEIKNLNVGYGLGDQAVRAVRDVNLTLHRGEVLGLAGESGSGKSTLAYGMTRLLPPPGVITGGQVIYHPEQGEAFDVLGLSDRDLRGFRWSETAIVFQGAMNSLNPVHKISTQLTDVLRAHRPEMTETQRNARAREMLKLVGIAADRMDAYPHQLSGGMRQRVMIGMALILQPQVVIMDEPTTALDVVMQRQILGQLIELRERLGFSVIFITHDLSLLVEFSNRIAIMYGGRIVEEAPAAAIYRDSLHPYSKGLLGSFPALRGPRRELTGIPGSPPDLKGMPTGCSFHPRCPRAFDPCAGNIPVLGRPDTADGSTRSVACWLHPTEQPVG

SEQ ID NO: 12616 - protein, 352 aa, Actinoplanes utahensis
MTIPTSSIEQVIPGQGSMAQPETDRPAKARRQRFRFVSNKKAATGLVVIAIYALFAVIGPWVAPYSPDARSNDLVKPPSGAHWLGTTHLGQDVFSQLLVGTRSVMFVGFLAGIIATVLSVLIGVTAGYLGGKTDEGLSALSNVFLVIPALPLIIIITSTLNNAEDWLIALVIGLTSWSWNARVLRAQTLSLRRRDFVDAARATGEKTWRVIVFELMPNLTAVIASGFVGTVIFAVLSEITLAFIGVTSSSTWNWGTILFWAQGQQALAQQAWWWFIPAGLAIALLGTSLSLINFGIDEFVSPRLRSAGKTKIKTIDGRTVRMRIGFTPVLSHTPEPITHASPTPVVRTEVTP

SEQ ID NO: 12617 - protein, 326 aa, Actinoplanes utahensis
MKYLLQRIAFYLFTAWAAITLNFFIPRLIPGDPVQALIARYQGQISSQATQSLYVLFGLDKTKSLWSQYVDYWVQLFHGDLGLSFAFFPTPVSEIIKTSLPWTLMLVGITTVISFFLGTGLGVLAGWRRGSWADGLLPVTTFLSSVPYFWLGIIAIYLLTGPDSFFPSSGGFDNGLVPAFDQYFIPSALRHSLLPALTILISSVSGWILSMRNMMVTVSSEDYITVAHAKGLSDRRVALSYAARNALLPNVSGFALSLGFIVGGTLLVEIVFSYPGVGFELFQALGASDYPLMQGIFLIITISVLVANLLADVAYLLLDPRTRKEG

SEQ ID NO: 12618 - protein, 351 aa, Actinoplanes utahensis
MTSIPDAKAPAGEVVLEAISLTKHFPVRRKLRDLFSNRKDAVHAVDDVNLTLRRGKVVALVGESGSGKSTIARLLAQLYPRTGGDIRLHGETTKVRGGSAFRRYCSRVQMIFQDPFASLNPTHTIRYHLTRSLKIHGNAGRTATDLDQALHDLLERVQLTPPERYLDKFPHELSGGQRQRVAIARALGAQPEALLADEPVSMLDVSIRLGVLNLLRDLRDRLNLAILYITHDIASARYFADETMVMYAGRMVEGGDSETVTQSPAHPYTKLLIHSAPDPDRLTGISEAEGEDAGNGEPPSLIHPPTGCRFHPRCPAAMPRCRTDLPVPLEIGDAPGHWAACWLYDRDEVSK

SEQ ID NO: 12619 - protein, 561 aa, Actinoplanes utahensis
MQRRKLFAVALAGVLATGGVAACGDSPNNNKNASNSKGADFLSIGMPNGTVTESNNPFLGTSAAASLGYRWTIYEPLGMWNNVKPAEPAKPWLASDIKWAPDYKQLDVTIRDNATWSDGQKLTAEDVAYTFNLIKSNEALNIFALPLDQITPNGNKVTIAFKTSQFTTWHKIISQIPIVPKHVWEKIADPAKDPIKEPVGSGPYTLKTFSQQGIVLERRESGYWQSPPAVKELRYTSYTDNNAQTTALATGQSEWSFVFIPNYQQTFVAKDPQHFKVWAPGVLGIHGLYINTTRAPFDDPKLRQAMNMVINRADIFNQAEAGYFHPELKSITGLPSGAGDAFITDAYKGQDLKVDVEGAKTLLAGAGYKLDGTTLKDKSGKPVTIKLSDPAPWSDYQTTLEIIKGNLAEIGIAATVEKPNQNVWDQNVQKGDFGGVMRWTNGGSTPFDIYQTVMDGDLLKPIGELAQQGNFGRFKSPEATAALKAYANATSDADRTTALATLQKIFVEQAPMLPIGSDNVGGAISTKNWVGWPSEADQYAPLQPTQSGALDVIMHLKPANS

SEQ ID NO: 12620 - protein, 336 aa, Actinoplanes utahensis
MPITIADVAARAKVSKTTVSRVLNGKGELDESTAARVRAVIEELGYVPSARAVNLARGRTRVIGMLVPSLTWPWMGEVLQGAVDVLESEEYGLLLFTFNRGDESMRQFAAQVAAKSFDGLLAIEPEGTLSYLATLHSRGLPMVLIDDRDQISGGQIPTVGTTNHSGAADAARHLLEIGRHKPLLITGPSRFGCTVQRTDGFATVYAEAGHPIPEHCVVTGDFTVACGADAVKRAFDAGLDFDAVFCHNDLSAFGAVQAIQDAGRRVPEDVAVVGFDDIPMAAHHQPPLSTVHQPMREMGEAAARTLLAHFEGTALPNRPTVIPATFVARSSTRAKP

SEQ ID NO: 12621 - protein, 284 aa, Actinoplanes utahensis
MDLGLVEQVARLDGWLGDGGVVVLSGAGLSTDSGIPDYRGPSGSARRNTPMTYQTFTGDPLARRRYWARSHLGWHTIGLARPNDGHRAVARWQERGLLHGVITQNVDGLHQAAGARDVVELHGNLARITCLACGALTPRTELAARLSAANPNFAVVASAVNADGDAELDDAALDGFTPVDCLACGGLLKPDVVYFGETVPPERVSRAFELVAGARTLLVLGSSLTVMSGRRFVLRAVKQGVRVAIVNRGVTRGEPYADLVIDAPLGVVLPNLAAETETYRLLPR

SEQ ID NO: 12622 - protein, 108 aa, Actinoplanes utahensis
MRVAGHPGRLISVTAVARGADRSWDGRRLLRFLTSLAVLALAVTLRLPFGGPVAGPVGGFSAAPSVGSSVGSSAAPTAGSSAAPAASAATSDAAPAAVPPAAPVAAAS

SEQ ID NO: 12623 - protein, 234 aa, Actinoplanes utahensis
MDSAFLNSVPQAVAIWLIIVLLLAVAAATVSVPRVLTEPAPDVTDRERYAGEVAIAAGRARATADRRRADWQAAQQAVDDAWAAYEKADRVARRIAAAGVYPLLDRRRKPGENVDRERFLHRAASELCRSQDLSIDQLNDVFAHRGWNPRLHPVQQEWVLAQAVRANRLTGYREAVERERAAWRSADAAAEALRGLRAEAMAAPLLVDVPEPADQQWWTEQWTTADLPASAAPA

SEQ ID NO: 12624 - protein, 349 aa, Actinoplanes utahensis
MVAATPAETSAAVARMHRAALVEDAVHEIIERGLRNRGWKPYITAYTGYGAPGWARVMARVLLSRPRLVRRKREKVRGWRSFTTTPVSGATVRIEVGGSVTETRTDRSGYIDCRVKGDLAPGWASVRIHCEGGAPVDAPIRVIDPAVKFGLVSDIDDTVMVTALPRPLLAAWNTFVLDEHARMAVPGMAVLYERLINANPGAPVIYLSTGAWNVAPTLTRFLSRHLYPAGPILLTDWGPTADRWFRSGQEHKRTTLRRLADEFPGVRWLLVGDDGQHDQEIYSEFAREHPDNVAAVAIRRLSPTQAVLAGAVPGPTETPEAVPSGGKTWFAAPDGAGLWSLLRDTDLTK

SEQ ID NO: 12625 - protein, 279 aa, Actinoplanes utahensis
MAIPPRRAGWTPRPPGCAAGSESRPGCTRVVGAPPGRSPPRSPRLPPAPPVPLPSTNASAENRHVVADISLDEAIELTRTGDIWIFRGRSGPDRAIQTLTNSPVNHVGMSLVIEDMPPLMWHAELGRSLPDMWSGTFQRGVQLHDLRDAVTVWARRYGQRGWLRQLEPGVTRAMEDKALKTVARLDGTPFPSTSQLAWRWVRGRVPQIQPPWKPAKTDATLERAYCAEVVAVTYEDMGLLPRNHKANWYDPGRFWSGDELELTAGYLLGDEISVRVPDA

SEQ ID NO: 12626 - protein, 137 aa, Actinoplanes utahensis
MLGPGRSQRLMARNGRSLDAVQPEGFRKMMKTVRGRATRVAAAAVVATAALAAPQLSSPASAAGCSGTFILYTGFNYTGNSQYYSTPVNNLTLNRNVASIRNYSPCTLTLKTDNGTYRVVGNGGISALGRYVYTITN

SEQ ID NO: 12627 - protein, 452 aa, Actinoplanes utahensis
MTSFIELGVPAVLTGALAELGITTPFPIQAATLPDSLAGRDLLGRGRTGSGKTYAFVLPVVARLAAAPTRPRPGRPRALILAPTRELATQIEATLRPLADAMGLRTLTVFGGVGANPQIAALRKGVDVLVACPGRLDDHIRNGHASLDAVEITVLDEADHMADLGFLPVVRRLLGQTPAGGQRLLFSATLDNGIDVLVKQFMRKPVTHHVDAAAQAPVEMDHHVLHVQPDDRFGVLVDLLAAPGRSVVFTRTKRRAKVLTRQLISAGVPAVELHGNLAQNARNRNLSAFSEGSAPTLVATDIAARGIHVDDVALVIHADPPVEHKAYLHRSGRTARAGARGTVITLMTDDQQADVRDLTRKAGIRPLTRRARPGDALLSELAPGERTFVTPGQHQPGAAVPDVDLDGAAPAGTGRSGRRRGGRRPAATGNASAAGSGTASAARSGTAGAGPS

SEQ ID NO: 12628 - protein, 343 aa, Actinoplanes utahensis
MNDVIKWVTLRRSAGDQSYWSPTATFLHPVSNQAALSLADLFPQRRTPPLRPVLRRPLMNGEAPAVDRRREDIVRANMPLVGHLVREMLARVPAHVNRDDLLSAGYAALVAAARGFDPERGVPFPRFAAARVRGALLDELRGLDWASRSVRQRARRADAAREELTAELGRIPTPQELAERLGCTVEDIEHGNDDVHRATVFSLQGFATATADDLVTERTPGPEEMLILRERLGYLRHAVDALPDRLRVVVQGYFFDERPMSDIAADLGVSESRVSQLRAEALVLLRDGLNTHLDPAIAAQTPPKEGCVARRRAAYYDRIASRGTLRSRLAMTGPDGLPVPAAA

SEQ ID NO: 12629 - protein, 172 aa, Actinoplanes utahensis
MDFNTPYRRITVLALAAVATLGVTSACSGGDDAPAGNAAAAAAGGPEPKTLDGAKAAAQTVFDRFSGGDFAGAWEMYTSAGKQAISKDDYVKLNQACSRKGLAITLTSARMEGVDKAIVIAKQLVAAQSYTMVYEGNGWRLEPAAEGLALYKMGAAKAIAAQKKAGTCANNQ

SEQ ID NO: 12630 - protein, 758 aa, Actinoplanes utahensis
MSSSSADFDAEQAYLTELYQRLDQLREQADSRLKGILLEAGGTPQGRTQREATRAHYTEQLAQMNSVENGLCFGRLDFAAGDPRYIGRIGLFAEDRDQDPLLVDWRAAAARPFYLATAVQPDGVTRRRHLRTRGRTLTGVDDEVLDLAAGDGTGREDVTGEAALLSALTANRTGRMRDIVETIQAEQDEVIRSGLPGVLVVQGGPGTGKTAVALHRAAYLLYTYRQQLTRSGVLILGPNTTFLRYISQVLPSLAETGVLLATLGDMFPGVRARATEPDEVAALKGDLGLMLPALENAVADRQTVPDDFVEVDHDGYPLRIERAVLEDARSAARRSGRPHNVARAVFVTEAIHQLSLQIAERIGADPLGGDNLLSEADLAETRRELREDIDVQQLLFDFWPVLTPRQVLRDLLTDADRLESAGLPTVLLRDPSAGWTPADVPLLDELAELLGVDDTLKKREQERQREAAIEYAEGVLEIVEGSRSLDFEDVEEEILSAVDVVDASAFVERHEVIDTRTAAERAAADRTWVFGHVIVDEAQELSPMAWRLLMRRCPSRSMTVVGDVAQTSEPAGSTSWEQVLEPYVGQRWRLVELSVNYRTPAEVMAVAADVLAAVGAGVRPPRSVRSSGVTPWARRVPVGGLVEELLADVRKEAAAVDSGRVGVLVPARLTGPLGTALVEAIPGAAVGEQPDLLNHVVLMTVRQAKGLEFDSVLVVCPDEIVTESPRGLSDLYVAVTRATQRLGVLHTEPLPEVLSALA

SEQ ID NO: 12631 - protein, 259 aa, Actinoplanes utahensis
MTNNPPSDKASLDGPGSVPDALFTDPRLAPLYDLFDGDRDDLPAYLTIIESLRPARILDVGCGTGALATLLAGTGHTVIGADPAAASLDVARTKPAADRVTWLHTGAAGLPQAWPLPEPADLALMTGNVAQVFVTDDDWTAALRGIHAVLRPGGHLVFEARRPEFRAWEQWDHPPATAGGVERRFMLTDVRLPLVSFRYEYRFLSDETVLTSTSTLCFRDRSEIEESLRATGFEVLEVRAAPDRPGRENVFLCRRAGTA

SEQ ID NO: 12632 - protein, 306 aa, Actinoplanes utahensis
MTSTVTTAADFAADTAPATPVLSAAQQEELIRTHMPLVGHLVRDMLSRIPNHIHRDDLTSAGLHALVTAARGWDPERGVPFHRFAGTRIRGALLDELRSLDWATRSVRSKARNTDSTRQNLTTSLGRTPTPEELAQALGTTTSELHQTDTDVQRATVLSLQGFTTSSADDLVTERTPGPEEMLLRREQIGYLHHAIGSLPDRLQTVVTEYFLQERPMADIAKDLGVTESRVSQLRAEALSLLRDGLNTHLDPELAPTPDNPESITARRRASYYATIASNTDLRSRLAMTNAHGHTAHGRGLRPTAA

SEQ ID NO: 12633 - protein, 171 aa, Actinoplanes utahensis
MLRMDLSDSAAGINLITGLLVAGGVLGVFLPVIPGLLLSWAGVLLWVLLTPTDSDLKWAMLAIATGITALAMVIKFLWPARKLRDSGVRSSSLLAGGVLGVVGFFVVPVVGLVLGFLLGVYLVEASRLGGTAAWRTTRRALAAVGLSLLVELAAALCLAVIWFVGVVATAS

SEQ ID NO: 12634 - protein, 412 aa, Actinoplanes utahensis
MIRPLLTIPLTALLAIPAVPAAAAPKPAQQAKTGAEVPCPHPRIAKPSAPPRPVPPADNPRDMAVGGPDLATHGLVVPPGATTPPAVTATTWIVADLDTGEVLGACGPHVYQTPASVQKTLLAATAMDRLDPKQNVKIVQSDLDIEANSSAVGIVVGGTYPVATLWLGLLLNSGNDAANALARMAGGGGADGVATTVAAMNAKARELGAFQTHAVTPSGLDGKGQFTSAYDLALIARSDFAKADFRKYVLTRSAQMPAQRSPRVGGFQFQNENKLIYNYPGAMGGKTGFTTVARHSYVGAAQRNGRRLVVTLLGAEAHPLRGWQQGAALLDWGFAQPAGASVGHLVTPAEAAALTATPEKASAGVSGTAAKPVVKSHSRSLIVAGTGAVVLAALPLTLLAIHRGRRRRFRKP

SEQ ID NO: 12635 - protein, 143 aa, Actinoplanes utahensis
MHDEQADWLAHHRRAVAGRAAALEAGRTAEAQQAAALLEDFVRRAAERGLAPHPLVATTYDGRWSYRTRARGWYLKRNRSVAVGEDGEYLVLTVPASLRARFVGADLSPSMPRLIVGAGGGDGETVPLEHLLEHRLEAGARWP

SEQ ID NO: 12636 - protein, 115 aa, Actinoplanes utahensis
MARQVITTLIDDLDGKKADRTVEFSLDGVSYTIDLSEANAGKLRKALDPYINAGTRLGRTAGRVAARGAAPARTAGSRDENRLIREWAISNGHKISERGRIPQEVSNAYRAAHGR

SEQ ID NO: 12637 - protein, 293 aa, Actinoplanes utahensis
MRFGIVILPDQRWSESSRRWRLAEEFGFDHAWTYDHLGWRDLVDGPWFDAVPTLTAAATVTERIRLGTYVASPNFRHPVHFAREATALDDISGGRLLLGLGAGGIGFDSAVLGGAELSPRARVDRFAEFLELFDTILRSPSTTWRGEYFAAVDARSTPGPVQQPRPPFVVAANGPRALRLAARYGDGWVTTGPQAETAADWWRAVTEIKNRFEDTLAGSGRRPESVDRYLNLDSSPVFSMSSVDAFQDAAGRAAALGFTDVITHWPRQSSWYAGEEKTLEAVAAGLPRLRATI

SEQ ID NO: 12638 - protein, 154 aa, Actinoplanes utahensis
MEHANDVAAAIESSVESLAAVLERARVARTPAVPPAQLRVLTIVAENRHTNMSRLAEALDVVPSSASRLCDRLEATGLLRRVVDPRDRREVRLLLTPAARRLLADLRERRRAVLAEVLERMPVAARQDLVRALRAFEAAATDDSRTAGDDLRSA

SEQ ID NO: 12639 - protein, 380 aa, Actinoplanes utahensis
MSDQPVPIGSLLRSTAPDRLPEVAAEHLRRHFAAEQVEVMVTDLPQRRLAPLLSPAAPDNDPSALRTLASQRVNTDTGPGGRARVHLPISCWGERLGVLRVVLPDRPTPDQTDQLQAVADELAVTIRAADRATDRYRRAQCLERLTMAAELQWDLLPGRSLDDERFRLAGQLEPAYDVCGDHFDWALSGDRLALTVLNGAGQGLEAAILTATAVNAMRNARRCGADLIEQAELASDALHARYGGGLHAATVLLEVDLVSGWVEAVDAGSPHCMIGRGNDISQVRLEQQLPLGMFGEAHYEIERFRIEPGDRLLVISDGVHAAAPGGGPTFGESALLSALRGTRLQPPAEAVGTVMRGLREFHAGAEPEDDAVTVCLDWRR

SEQ ID NO: 12640 - protein, 130 aa, Actinoplanes utahensis
MRMSVRLSLPREVDSVPAVRRLLRCSLTTLQIDRQAGADLEIALTEACANVVKHATGAEDFEVRLDVGEQHCSIDVVDNGAGFDPDDRPEPTTAGESGRGLFLIRALAENVRMQSSPRTGSLIHFEKSFA

SEQ ID NO: 12641 - protein, 588 aa, Actinoplanes utahensis
MANQPDTATVVAARAGDPAAIDRLVAGYLPLVYTIVGRALEGHADVDDVVQETMIRVLRSLGELREPEAFRSWLVAITVRQVRDRFRNRQSAPDALLDPDLRDPGADFTDLAITRLELSGQRRETAEATRWMDEDNRELLSLWWLEASGELTRDEIVDGTGLGRQHAAVRIQRMKGQLETARAVVRALHRQPICPELAVVIEPWDGRPNALWRKRIARHTRECRMCAGAWQDLVAAERLLAGMALIAPAPHFAKPLIATKLAAKVGLGAAQKALVTALAVSVIGGGGAAVYALSSQKDPAAPPVAAVVPAPVVPAAAAPRVSPSATPRRTAASPSAKAAVPAAAISAKKGVGVWKFTGSAAALKDVRAGWYYDWAAQNDDVPGPTGVEFVPMIWGRQNVTGATLRQAKSEGRVLLGFNEPDMGGQANMSVEDALAAWPQLQATGMRLVSPAVAYGGDTAGGWLDRFMAGAEAKKLRVDAIALHWYGSDFSAAAVSQFLGYVDAVHQRYGKPIWITEFGLMNFSGSPKYPSDAQKVAFIEGATAGLQKRSYVERYAWFGLPAVGDSVDFGLYRDGHSPTEAGKAYRAAG

SEQ ID NO: 12642 - protein, 335 aa, Actinoplanes utahensis
MSFMIRFGYKASAEQFAPADLLRYGILAEELGFDSVFVSDHLQPWRHDGGHAPAALPWLGALAARTERVLVGTSVLTPTFRYHPAVVAQAFATLGCLAPGRAILGVGSGESLNEVALGTQWPDGKERFARLKEAVLLIQKLWAEDRVTYEGQFYKTENVTIYDKPSTPVPIYIGASGPAATRLAGRIGDGFITTSGKGHALYTDTLLPAVTEGAEKGGKKIDDLDLMIEVKVSFDDDIDRARNDTHYWGALALSPEEKTGVEDPVEMQRLADALPVERTATRWIVSSDPAEHAAKVTEYLDMGFKHLVFHAPGPDQERFLRLYAAEILPRLRDRS

SEQ ID NO: 12643 - protein, 308 aa, Actinoplanes utahensis
MPLASHRPSSPTVSVVIRAGTVALPVLLAGMPPVDEIVVVVGRRDGTGTVVPPGARVVRQTRAGAGNALACGVAAATGDIVVTLAADGSCDPAELPRYVQALCDGSDVAQGARQRPTLGARIVLWMMAALFGARRTDPGFGYRAFWRDAAGMLELPRVSGVDAVRGDGAEIDALLTVRAGLNGLSVTEVPSAAAARPVPLVEAVGALLGEWHTRRRVAPPAPAESIVVLTGKADPEQTRVLPRIGTDAVLPRTSRPAAYAGVDRRQGPRRLRALEKEQATRPRLRVINGEGGGTGPRTGTLRSVPPAI

SEQ ID NO: 12644 - protein, 289 aa, Actinoplanes utahensis
MRLGLHISNFTWPEGPSRLAPTLAEIASAADEAGFERISVMDHVWQIGVNGPPEMDMLEAYTTLGFLAAHTRRAKLLTLVTGVVYREPGLLAKAVTTLDVLSGGRAMLGIGAAWNEEESLGLGLSFPPTRERFERLEEALQICRQMFAGDEAAYEGTHYRLARLLNHPLPLARRVPILIGGAGEKKTLLLVAKYADACNLFPGPELQHKLDVLKRHCDTVGRDYDEIEKTVVFRFDPGERGEKVGEIIDAMRHFAAMGITVTHGGLRDAWDTKRFELFRDEIVPAAEAL

SEQ ID NO: 12645 - protein, 217 aa, Actinoplanes utahensis
MIEAVVFDLDGVIIDTEEVWEEVRRGYVAEHGRAFLPDSQDRMMGMSTAEWSAHLADEVGVPLPASRVADDVLGRMAERYRAELPLIPGAVETVRALGARFRLALASSSARILIDQVLATAGLTGEFEVTLSTEEVPRGKPAPDVYLAAVARLGLTPEVCAAVEDSSNGLRAAGAAGLAVVAVPHGVYPAAPDALAQAALVVTKVTEVTPEAVAALR

SEQ ID NO: 12646 - protein, 388 aa, Actinoplanes utahensis
MDVLISGAGIAGPAVAHWLARAGHRPTIVEVAPRPRTGGQAVDFRGPLHMGLLERMGVVEALRAVETHGTAFRFVDEHGDRLMEWPAHLAGGDLEVRRGDLSRVLCAASKATAYLFGDRITALVEHPAGVDVTFASGTQRTFDLVIGADGVHSGVRRLAFGPEERFVKHLGYYVATWPVANEWGDLGRTALLHNSPGRMISIGQDHRDPSRAGVFAAFAAPVLRYDRHDAGEQKAILRATFAGLGWLTPRLLDALDAADDVYFDQICRVDAPEWTRGRIALLGDAACGATIGGQGTGTAIVAAHVLAGELAAAGGDHRVAFPRYRQRLAKFARGTQKGGDTTGRFLAPRTARGIRLRNYLNNRQWFLDATFKVAAGRSTDLQLPEYPI

SEQ ID NO: 12647 - protein, 214 aa, Actinoplanes utahensis
MDFLWQERTGGRRGPKPALTLSSIADAAIAIADAEGLAAVTMQRVATDVGYTKMALYRYLPGKSELVALMLERAMGEPPELPAGDWRAALSRWCESLMAVFVGHAWALQALTGNRPVGPNEIGWMEAALACLPTGLTGAERMDTVAVLAGHARALALQPAESGLVTALTRHAARFPAVGAALADMAVHGGADQAFRFGLERILDGLETLITKRV

SEQ ID NO: 12648 - protein, 553 aa, Actinoplanes utahensis
MAVSGLRLDVGFVDYLILAIYFITVLGVGFMARRAIRDSSDFFLSGRSMPAWVTGLAFVSANLGALEIIGMAANGAQYGMMTLHYYWVGAVPAMVFLGIVMMPFYYGSKVRSVPEFLRRRFNQPTHLFNAISFAVAQVLIAGVNLYALALILQALLGWPLWLSIVIGAAIVLSYITLGGLSSAIYNEVLQFFVILAGLIPITVIGLVKVGGWHGLVEKVQASKIGDAALHTFANTADSDNPLGANWIGIIFGLGFVLSFGYWTTNFAEVQRALSAKDMSAARRTPIIGAFPKLLIPAVTVIPGLIALVTVQGLGAKEGDLTYNNAIPLLMRDLLPNGVLGVAVTGLVASFMAGMAANVSGFNTVFTYDIWQSYVRKDRPDGYYLRVGRIATVIGVLIGIGTAFIAAGFDNIMNYIQALFSLFNAPLFATFIVGMFWKRMSAWAGFWSLLLGFLASLTLYLGYLGDVFSFNSDLEESFWGAGAAFVTAVVVAVLVTFFTPSKPEDELRGLVYGLAGSSTSGETIVAGDRVWWRNPVVLGAVAVALAIVLYIPFW

SEQ ID NO: 12649 - protein, 80 aa, Actinoplanes utahensis
MNRLFDLRAVIGGMFTLYGVIVTLIGIFDSPADIAKAQGVRINLWMGLAMLALGLLMLLWLRLNPPKPVEAGDDRDTPEV

SEQ ID NO: 12650 - protein, 109 aa, Actinoplanes utahensis
MCPSCLLVAQPPDIFKTGGGASDNGGMDPLASISSLASGGQRSAGWQAQLRVDYVVNKVTQTHRGQSEDQVKQALSDQLRVFGVVPNAKQMAIYARAIAALPELPPNNK

SEQ ID NO: 12651 - protein, 487 aa, Actinoplanes utahensis
MRALRRPVTAAILTLATLLGFGRPALAAPAVTWSVCPEDAHVECGTMRVPADWSNAYGPTIELQMARRKATDPAHRIGVLIVNPGGPGGSAVNMALDTDFFSPELRKRFDIIGLDPRGVGRSSPVLCSQALVDAKPSPLITDPAGFAALAGYNRRLAADCTSRSGPVVEHADTGSVVRDVEALRVALGEPRISIFGASYGSLIGELYSDRYPATLRAAVLDSVMDHSVDVDTFLAQETAAVQDSFNEFVKWCARDTRCVLRGQDIPKLWAALMQRAAAGTLKDPYDPPAKLGVWELISAAFAAFYDPQWFSFAHYLQDAAVPARAVARRARTVAPPADLTPDSFPAVFCGDWALPVGDFPAYRRRLDNLAKIAPQVRASPLALSAAAGCVGWPVAPAAPQHRLNPARIPMLLVNALHDPATGHAWAQQAAVQLGPSARLLTYQGWGHVAYSHSPCVQAAAEKYLLTLALPAVGATCPAVEPEPFGIG

SEQ ID NO: 12652 - protein, 589 aa, Actinoplanes utahensis
MRFLSALAALSLTSLSLTAVSAPALAATGSTAQGYGGAIATVDATATAAGLEVLRRGGNAVDAAVAAAATLGVTEPFASGIGGGGFFVYYDAHRHRVFTIDGREKGPASMTPTYFVNPVTGQPYAFDEARVSGLSVGVPGTLATWEAAARQWGTRPLSRALDDAAEVADRGYTVDGEFRRQVTENAAAFGQFDATRALYLPGGAPPAIGTVIRNPDLADTYRLIARKGTAVFYRGPVGADILQTVTRPPVSSSPSSPWAYPIRPGVLTAEDLASYQVRRPAPTRSDYQGLSVYGMSTPSSGGTAVGEALNILDASPLDSASTVEKLHYYLEASALAFADRGRYVGADTPRPVLDTLLSDRWARQRACQIDPHHALVKPVAAGPSGCTAAAGADTPDTGMSTTNLTVADRWGNVVEYTLTLEQFGGNGMVVPGRGFMLNNELTDFNFTGTQGDNPDPNLPGPGKRPRSSMSPTIVLKDGRPYLAAGAPGGSTIITTVLQILYGRLELGLTLPQAVAAPRAAQRNTAGIQAEPAFHTTYGPELTALGHVFGPDAAEIGAATAIEFGPCGSQLAVAEPVRRGGGSAGVVHPR

SEQ ID NO: 12653 - protein, 305 aa, Actinoplanes utahensis
MINVVAVAMLAGIVPVPALPTPMAYVRGGDVYVSAGPAEKRITTGAGYARPRWSPDGRQLAVLRDGRLWTMKPDGTGQRRVSDRPAGGASWSPDGKWLAFASTSCTGGPGVYRIAAAGSGNPEVLFPAGCRGEDLPEVEAPQKVTGSLADRLRVDDAVAWSPDGKQIAFRGGECDAVYDACLSIGTVSSGEERTVAAYGGGSLQNKGFAAVPAWSPDGKRLAFTAYQEGETAAENEPVHVVEWDPGTGAKRTVGVPQDREAAYLDAGHALVTSQTRGHSWVTLVDLKTGARTLLHQGSQPSARPR

SEQ ID NO: 12654 - protein, 234 aa, Actinoplanes utahensis
MTETPRDTPGPGIDEPRPIRTFHPRRGRMSSRHADAHAALWPLFGLTVLDGDRTPLDLPRLFGRAAPVVLEIGFGMGDATAAMAAADPARDYLAVEVHTPGIGNLLALVGDLGLTNVRVALGDAMQLVHRIAPEALDAVHVFFPDPWPKARHHKRRLIQPANVALLRDRLHPGGVLHCATDWPHYAEAMAETLDADPGLRRLPAGSPHTRPRTKFERRGTEAGRPITDLRYTRI

SEQ ID NO: 12655 - protein, 292 aa, Actinoplanes utahensis
MGKKKAAALLEDLAPVEETVAAEETTESTSVEAAPAATAEAEDAPTDAASTETAQAEDAPTDTASTETAQAEDAPTEAEPKKDKKKKGKKAKKSAEPITDEAAAEDSVADEADGADEPATEEAPAEAAADTADATEAEDTADAPADDATEEAAAEEPASEAPAAEEATAEETAVEATAEEKPKKGKKKGKKAKKTAEATVDAAPADEVEAPADEEVAVAETAAEEAPGEEAPGEEAATEVGPAEETTEETEAADETAPVEEAAAEEAPAAEAAVEDEAAEAPKKGKKGKKKK

SEQ ID NO: 12656 - protein, 765 aa, Actinoplanes utahensis
MRREDPGSGAGLPGRASAAEAAALARAAELHGGTAVDEHPGLPAAASKAFGNREARVGGDFRRMAGTGPVAGSEQTDGGFGPADGSVRRRVGGEVAGGAHLLRDVLGGAMLPVLHRGVLTSGTADQLAALTARGAQTPSACIQFVEGEKLRLYGSWGVAEDWAAIADTPLHGSLGGLVVHGGGAVIVDDATVDDRVPDGVVRRHGGAYLGHPVHDRDGQVLGVCCAYDLRPREWSPEQITAVAEAAEVATLLIGEQLARYELEQQHRFLDAVLESLHDGVIACDADGHVVFANERMRRTWADDPRDTDELGLFRALAGEPVRDEPLARPSRTKRTRHFLIDAQPILGPDGRVVGAVQAMQDVTRQRRAERFRSCELAVTTALAEAASIEAAGPRVLEAVVATLDWVHAELWMADAGAAVIRAAARFSTPGWATGIAVPDELTYGQGLAGQAWQVDKPLWIRDVGHSDSVISPDSAQRLHAALAIPVHDGTGTIGVLTVFTDAVEDPEDELVALMSGIAAHLGQFVERRRVEDLQRQLVRSKNEYLALIGHELRTPLTSISAYTELLREADEATLVRDGPRLIAVVERNALQLREIINELLELSALDAGHADVRRTPMDLAEVVRDVVDRTRVAIGAAPVAIDTDLPAELIVPGDRDRLRHIVENLIGSAIRYSPDGGHVEVRLRRAGRAAELAVSDAAVDVPQDEREKLFTGRYRTSRGHERTLPGSGLGLTLSRAVVERHHGSIELTGDGDGTTVLVRLPLDAR

SEQ ID NO: 12657 - protein, 471 aa, Actinoplanes utahensis
MSGMTRWTPDPTFYPSPGDAAGAPAEKLAYIAAFDRSATRPDALAVVDTDPGSGSYGRVVGWTDLPHTGDELHHFGWNACSSALCPTAPHPHVERRYLIVPGLRSSRIYVYDTQPDPQNPRLVKEISAAELAAKADYSRPHTIHCGPDGIYVSALGAGQGGGPGGIAVLDHQSFDVRGQWEADRGDQKLAYDFWWHLTQDVLVTSEWGTPDMIEDGLVPELLLGRQYGHRIHFWDLAKRTLVQTVDLGDQYQMTLELRPAHDPAATYGFVGVVVSVEDLSASIWLWHRSGGQFEVRKVIDIPAEPADPADLPPALQPFSAVPPLVTDIDLSVDDKFLYVSCWGTGELRRYDVSDPFHPVFVDSVHLGGIVRRTPHPAFPDEPLAGGPQMVEVSRDGKRVYVTNSLYGSWDDQFYPDGVGAWLAKLDVTDTSFTLDDRFFPHGDEFRGLRVHQTRLQGGDASSDSYCFPSAP

SEQ ID NO: 12658 - protein, 217 aa, Actinoplanes utahensis
MTWETYAALIALGAFHGLNPAMGWLFAVARGMQERSRRVMLLSLPPIAAGHLASVAIVAAIISATRSVVAANVVGIAGGALLVGFGLWRLLSERHFRWAGMRLSSAQLAGWSFLMSSAHGAGLMLLPVLTTTPVPGASHAGHAMPGAGAGGSPLAALTGLAAAGVHTVAMFTVMAGCALLVYEFLGVNILRRAWFNVDRLWAGVLVAAGALTIAITA

SEQ ID NO: 12659 - protein, 317 aa, Actinoplanes utahensis
MSSFFSSSEAAVNPRLSLLQLSIGGLLWGTAGVVVQVVAGRTGLGAVAIGFYRLLFAAATMLLVGGRARRQIGVALRSAPGTVVLAGVGLAAYQALYFLAVRLSGVSIATVVSLGLAPVLLSVWETIRTRRRPENAQAGASVAAVIGLLLISGTTGSTGSSTGLGLLAAIASGTVYAASTALSRHTTQGVPPLVLTTLSCAIGAVALAPVAIVQGLTFTPGVTPIVLLAYLGAITTALAYACFYTGLRHTTGSVAVVVTLLEPLTAAGLAVVLIGEPLALPTIVGGLLMLGAVTGLYLGAGRRTTPAASRRPVPVTD

SEQ ID NO: 12660 - protein, 788 aa, Actinoplanes utahensis
MDSCRRLSRGFTAASDDEKNEDMRALRRGESVPGPAAERSATTPPSRAQAATTPAPLRSAAARDARRTRSHPHGNPPGPPAPRAPQPVPPACPARGVAGPEPLPGPEAAPGLSRRPGPKRRRRLKRRPRLKRPFPGAGSAPGNGLGGGPAGDWPTEPPRRVRRRWRSARWPCAGGEASVLGEAGLAGKRRCRLGFRWSVPGPGRRRWWWLSGGGGGPDGGEGGGLAGQPAFDVGVAGGGVEAVGDAAAEVDQDRVGVREDLVHVPGHQVEHGGDQFRGGRLLVEVDADRLAVAVVEAQAEVRVDLHSEGADAGQGIAGLDQRDRLGVAERGQVGAGARAQRLVERLPPVFHQVDDAGEIAAAGAEGDVRLQRFDQLAVRVETAAPLPLLAQPADERGLGGTGARDIPREAQHRCVRRDDGHGVGRDRGQGGRGHVGLLTRAASHRTGVRNRPKISSSGPLFRTHILIDGYDIPNRTGGPPGVEEDRSRTGRAVPCRGRGAAAERGGRGGKRRPRRKGRPRVPRSGTSAAPVPVRWPRMGRVALIRCDFDSEALELRTSMTVILPDEDAGTPPPVLYLLHGLTDDSTAWSRFTSVERYAAEYGLAVIMPEVHRSFYANEAYGMRFWDFLSAELPETVRKFFRVSGRREDTFVAGLSMGGYGAMKWALREPERFAAAATLSGALDLAYIQEHDLRPHMRALVARVFADRVVAGGDEDLLHLLRTGDPGRLPRLMLRCGTEDHLLAQNRRFVAACKAHGVELDVTFSPGGHAWDYWDAQLPAVLRWMLDHK

SEQ ID NO: 12661 - protein, 476 aa, Actinoplanes utahensis
MRDVRGVAQRGMPVLPEPEFEQVADAGRHLDPLQPRLVFAEQTLVGGVRGHADRAGVGDGHRDRVQPDGGLDPEAVDQAGEGGDEALPLQVRLGAGEQQERDAELVADEVQGEHRVVVALEVVGHEDHRGPAGPVVEQLVQVEGGDDLALQIFQKAFPGELDRAARVDEPGQRLDEHRAVQGRQLPGHLVEPVWVEHAADLLEDVARSRGLSAANSRAAEFIPASSHHYVRRGPPDGWAAPCRVSDRADAVTMATKRLATGLPSRSAAKPPADPPEPEGVPRIRKAVAVALPLLAGSLLLAACASATTPQAAPSPTGTPWLLMATGSVAPSPTRSVSPGTTPGLASLPPLPSGSATPRPSGSPGCDPAVFKGGQINGLDVTAGSTTATVKWFNPGGDQLVDYHILAVSQKLVVGAQPETPGWLTVTPTACGWMTATVTGLIPKTPYVFSVDGMWLRAGTDGTYTRTVARSGVITTA

SEQ ID NO: 12662 - protein, 524 aa, Actinoplanes utahensis
MESIVDTVVLVAISVVGAALARRLGFVAPLVLLVAGLALSYVPGFPQAHLEPEFVLIGILPPLLYVAALQTSVPAFRSALRPILLLAVGLVLLSAFVIGFAVHWLLPGAPLAACVALGAIVAPPDAVSATAIARRVGLPRHVVTILEGESLLNDATALVMVRISVSALSGTAVGFGEIGRQVAQKAGGGIVIGIVAAVAAAKLHRWIEDPLLDDAVSLLTPFVVVIVAEELGTSSVVAVVITGLYLGHRIPYLLSATSRLQTDAVWRLVTFLLEGVVFLLVGLQLRMVVDGIETGVATTVSVTALVFGLLVAVRFVWMYPATYLGRLFPRVRARGPRVPVSVPTVVAWAGMRGVVTLAAAQTLPLPGLRDVPMYPRDLFIFVAFATIVLTLLLQGTTLPGLAIRLGVREDNSAQDALAEAGIQHAASRAALAALEENADGAPASVVDRLRGLVESRSNNAWERLGSQQQETPSAAYGRLRREMIRAERHVFKIARNEGRIPEEVLVRAQRELDLEESQLRRSEE

SEQ ID NO: 12663 - protein, 87 aa, Actinoplanes utahensis
MICQHLKESGEPAPLSAYEDGCPQCVAGGFDDWVHLRLCLSCGLVACCDSSPRRHMSAHHAETGHPVMRSFEPGETWRWCFDDEQLG

SEQ ID NO: 12664 - protein, 310 aa, Actinoplanes utahensis
MFRRRAARMRILVAGAGATGGFFGGRLAEAGRDVTFLVREGRATVLAERGLRIRSPGGETRLTPRVITRVDRHYDLVVVAVKSYALDAVVAGLGAAIGPRTVVVPLLNGMRHVPTLITAFGVEHVWGGLCMIHATTDEHGDVVQMTGLARLVCGPLDGGPDDRMDAVAAAIGEAGFDARTSRHIRAEMWEKWVLLATLGAATTLMRGSIGAINAAPGGPEVNRAIADEAIAVATAAGFPPRPQAREIVHTTIGSSEPTTSSLYRDLVAGRPVEGDAIVGDLVAEGRRHGVRTPLLAAAHTGLAVHSASVS

SEQ ID NO: 12665 - protein, 415 aa, Actinoplanes utahensis
MRRILMLSWEYPPLLVGGLGRHVHALAGALAAAGHEVTVVTRHAPGALVEEHGDGVRVIRAPEDPPAFEVAGGDLLAWALAFNHTLTRAALRAARGRRFDVVHAHDWLVAHAAVTLRDHLDVPLVATVHATESGRHQGWLPAAHNRSIDDIERWLCHEANRVIVCSEYMRAEVTRHFEVPAGRVDVVPNGVDALRWRARPRAVAAARDEYAGTGGPLISFAGRLVYEKGVQHLLAAVPELRERFPGLRVVIAGDGPYRRELELAGRELGETVSFAGFLTGHDLTALMAASDCYVVPSIYEPFGMVAVEAAAAGTPVAVAATGGLSEIVEHGVTGVHFPAGDPGGLAAAVSGVLSDQEYARGLASRARARVVEDFNWPSIAARTAQVYPVAAAPRISSKILAARAMSGEIHSAMRV

SEQ ID NO: 12666 - protein, 603 aa, Actinoplanes utahensis
MFENEHRDDVPRMDLLTFGPQVCGVPAPDAGTGREWLVSDGLGGWASGTVSGLRTRPEHALLCVGGPGRTPHVALASLDLTVTLATGTKVPLYTHAWESGRLDPAGYRLLETFTLAGGLPRWRWRIGDVVIERELAMRPGLAVIHRVLSAPGPVTLTVAAMCTWRAAATSRRADGPGLRIEPAADGVVIEDAYRLAGTGWQAAGQWHLGARTGEQIEDLWLAGTFGKQVGPGESLEISAWAGDPAVRPPAPPVVLAAARERAHRLVTAAKAEGYAGTLALAADTFILDGPQVADGYPWSGRPAPLAAYEGLFLDTGRADEGRELLTALVEQPSGEVDFPLWLVHAIDRHVTRTGDSDLARASAVPLGRLLRQSLAASPGMRLDPHDGLLTLPADGGRAGKLVELNALWVNALAGLADLLAEGGRDDAEPRGRHAVARASFLRRFPAPEGWLHDIVEGPAAPYPLGAGTQHDDPTLRPYQLLAWSLPHGPMRGGGDGPVRAVGRALLTPSGLRTLAPDEYGYDGSQPDQGRVRPWLIGPYADACAATGRPVDGLLDGLAAQLAEAGLGSVGEAAHGDAPHPAVGRPFDALAVAEMLRVETRYAP

SEQ ID NO: 12667 - protein, 703 aa, Actinoplanes utahensis
MQVWPGHRYPLGATYDGTGTNFAIFSEVAEAVELCLFDASGNERKVLLHEQDAFVWHAYLPGVEPGQRYGYRVYGPYEPHRGLRCNPHKLLLDPYARAVDSDIDWHPSLYAYEMGNPDQMSDLDSAPYMPKGVVVNPYFDWGNDRRPDIPYHHSVIYETHVKGLTQRHPEIPREMRGTYAAIGHPAIIEHLKSLGVTAVELMPVHQFVHDNRLHDLGLRNYWGYNTLGFFAPYHGYSGTGTLGQQTQEFRGMVKALHAAGMEVILDVVYNHTAEGNHLGPTLSLKGIDNRTYYRLVDDQPQFYMDYTGTGNSLNVRSPQSLQLIMDSLRYWVTEMHVDGFRFDLASTLAREFYDVDRLSTFFEVVQQDPIVGQVKLIAEPWDVGPGGYQVGNFPPNWTEWNGKYRDTVRDFWRGEPATLAEFASRITGSADLYQDDGRKPFHSINFVTAHDGFTLNDLVAYNDKHNEANGEENRDGESHNRSWNCGIEGPTQDEKVLELRAKQRRNFLATLMLSQGVPMISHGDELGRTQQGNNNAYCQDDEISWIDWENADEQLLEFARKLTAFRHRHQVFQRRRFFTGLPVTARGGGDPLPDLEWFTPDGRPMAGDDWGNDFGRAVALFVNGEGIRERGQYGQRHVDSSFLLFFNAHDAPIEFATPPAEYGEKWEKVIETAEPSPDRPSVVEAGHKILVPDRSLIVLDRTV

SEQ ID NO: 12668 - protein, 755 aa, Actinoplanes utahensis
MRPSSTYRVQVRPDFPLKATAEIADYLADLGVSHLYSAPLLTASPGSEHGYDVVDHTQVSPELGGADGLRALSAALKNAGLGLVVDIVPNHAGVAVAKANPTWWDVLKRGRESAYAKFYDIDWERGKILLPVLAADPGALDELKVEGDELVYYDKRYPIADGTGGGTPREVHDRQHYELADWTRGDSEINYRRFFAITELAGLRVEDPEVFEATHAEILRWVREGLVDGIRVDHPDGLRDPAGYLQRLHDAAPEAWLVIEKILEPGEPLPRWPVAGTTGYDAMAEVNGVFVDTGTEAFFDTLDHHLTGATVTFQNLTHDTKHHVATRLLAAELARLARLVPEVEAAPRGLAELAACFPVYRSYLPGGARHLAQARAEAGRRRPQMISTLDRLTGRLRNPADELAIRFQQFTGAVMAKGVEDTGFYRWTRFVARNEVGNDPTRFGVSTDEFHECSGARQQDWPDTMTSLSTHDTKRGEDVRARLAVLSELPGDWTEVVRRWVRLAPLPDPALAHLIWQVTVGAWPLSKDRLLAYAVKAAREAATSTTWQQPDEPFETALREMVDRIYDDPDLHREVTDFAASITPPGWSNSLGQKLVQLTMPGVPDVYQGTELWDYSLVDPDNRRPVDFAARRELLGRLDDGWQPPVDETGAAKLLVVSRTLRLLRRRPELFRSYRPVFAEGRLGEHVLAFDRGGVVAVATRLPVGLSRHGGWHDTTLSLDGHSWTEVFTNTSYGGNRLAVADLLQTYPVALLVKE

SEQ ID NO: 12669 - protein, 577 aa, Actinoplanes utahensis
MTTFEVWAPEKSPKLRLDDQEHEMEPGDGGWWRLDVPTAGPGTDYAYVLEDVAAPVPDPRSAWQPQGVHGPSRVYDHAAFTWTDQRWPGRQLPGAVLYELHIGTFTPAGTFDAAIERLDHLVDLGVDLVELLPVNAFNGEHNWGYDGVCWYAPHEAYGGPDGLKRFVDAAHAKGLGVVLDVVYNHFGPSGAYAPMFAPYLSAGQNTWGSSLNLDGPDSGEVRRYIADSVLMWLRDYHIDGLRLDAVHALHDEGAVHLLEQLAVEVESLSTALRRPLTLIAESDLNDPKLITPREAGGYGLHAQWDDDVHHALHSLLTGERQGYYGDFGSLDCLRTVLEGAFYHAGTWSSFRNRRHGRPVDRQRTAGHRFVAFLQNHDQIGNRAIGDRLTATLSPGLLKVGATLLLTSPFTPMLFMGEEWAASSPWQFFTSHPEPELAAAVQTGRRREFARHGWAEADVPDPQDPATFQRSKLDWSELGKPEHAEMLALYKKLIRLRREVPDLTDPWLSEVEVWHGDQFVVIRRGRHAVAANLAETPQTVSLRAVPSAVLLATADGVILERDRVVLPPESAVVVRTSR

SEQ ID NO: 12670 - protein, 150 aa, Actinoplanes utahensis
MERVRHDVAVTNVPDDLVAAEPDEPGKRNRWYDNCDCGPGCDLPDCDVPGCDCDGPGCDLFRLSSLLTVVALLGHRSTERPAERLVVAAIRGYRKVSPRLPTRCRFTPTCSAYALAAIQKYGLGRGLRLAADRLRRCGPRVPLGTGDPVP

SEQ ID NO: 12671 - protein, 455 aa, Actinoplanes utahensis
MGSVGQPPESASDSGASPGTTRIPAAPGVSGPPGVSAPASSPGGSGASSAGRVGASSAGGSGASSAGGSGVRDSFRGGALLGDLAGGIPPQLRRVWKLRRRTVEDIAARDIAVQEAVDEGRLPLPVEPGTLPEPEPLPERADRFNMAALRLAGLGLALALAVGMTMVRLLVGGPPSVADLRAQSGVDGWPVLTVGVKDDQYGTAYYNEKTKIWSGFDIDIAYMIAEDLGFRRSQVHFYGMESEDRARMQANDEKGNRVPVKMVIASYSITPDRIAAGVTFSQPYLYTEQSVITLTGHSPVAALEDLRGQNVCTLSTSTSEAAPSRVGANVVRKNRVRECFAMLDKHEVDAVTTDAAILAGWKAEFPAKYAHWDLGLDATEAWGVNVGDNPALKKLVDLTLYRSYADPHDDRWENAFRNNLQVEVAENGKTPIAVAEQPRVTRPDVRQLPWEDPLG

SEQ ID NO: 12672 - protein, 341 aa, Actinoplanes utahensis
MTDYYAKGPVIAPRRRRAQLNWLLTVLPAFPLMLLVLRVWYLSRQDLPTMLLMVQYINPLGMISALFITLSWAIPAVILILRVLGGILLVSNPGDAGRSPIAVAALRMPDWVVLIAVLIAGFTWQLRLLPALEMLVVAVLGLTAVQRLRVGRPVMAWNTLVVPILVGVLTWIFVWPGVVSAIRGGEQGTALMLAVPPLLGPLLTGPVPARWARLVTHWPAVAAATALPIVVGVVFLRAPVLPRSAIEVGPPDGPVREVIVGQLIAVDDTSTTMLLSTGEVTFIPNGQMRSKILCPEPVRPPESAVAVRGWPVEETVLEWIAPTRKVTEIDPRCLGRPHDPA

SEQ ID NO: 12673 - protein, 240 aa, Actinoplanes utahensis
MTLHLRWAAVTDQGHVRSNNEDCHYAGDRLLVVADGMGGMAAGDLASRITVESMVSLDAPIDTDNQMDALHRGLELANRRIAETVVADPSLQGMGTTLTAVLFNGERAAMAHVGDSRAYLLRDGRLNQLTKDDTYVQMLVDQGLIKPEEAAGHPRRAVVTRVLQGEPVSPAYVIVEPQAGDRWLLCSDGLTVVVNDVTIEEEMRTVPDPKACAERLIDLALRGGGPDNVTVIIADVTDGD

SEQ ID NO: 12674 - protein, 966 aa, Actinoplanes utahensis
MLAARTLVVITTARLIGTVALALAVVAVGEFVGAPRLYTDTAQLAAGAIAAWACLVVARHRLGIPRSWRRLAAGGLAAWTAVRVWWVVQDAAGHDRLAHPTLFDAGFVVLPACMLIGLLTATRTRPRPIPTSPRRDQVALLIDSVLITGSVLALGWSLIPARTLDVIASWQTLGWWVAAYPIADLVLVTMVVLLLTTRPDSPAGRRPLMLIGAGLVAFGVADSVRLLGLCPAWLETAGHLLGPGCIALAALSPAAPAPTPADRTTTQRDWFHLLLPYVPVLVTGVVLLARTATGHPLTSFQAYLGWLGLGLVVTRQMITILDNTVLLHRVAETQRRLHHQAYHDPLTGLANRALFRERLVLALDANQHLGTPVAVLFADLDDFKLINDTYGHAMGDRVLHAIGERLRASVRPQDLVARLGGDEFAVVLDQSDTVPPTVPRPRGAVSALRRAMGRRRGYVLSAAGIRVSAASRAASRPDGGRRSGDTRPARRRTDFPPAASGSEWAAFPLAPAGSPNHADDSAGSAPAAAGSGSGAASPNTGASSGSVAVPSAAASASAVPSAAASASAVPSAAASASAAPSAAASASAVPSAATSASAAAGPRAAVSSNGAAFPGAGASVNGAGSGGEGWPWVVEAEGVGERVLAALREPYVIDGRSVTVGASIGLVAAEPGDRLSADLLLRRADAAMYAVKRRGKGAMIRYTGPVHGPSADLPQLLAGALSGGSPAAAGFEVHYQPIVRLSDRATVAVEALARWTDPVAGPVHPDVFVTMAERTGLVSAIDDFVLDQACTDAHALAERYGRPIAVHVNVSAGRLGQQGLEDAVDAALTRHALPPDRLVVEITETLRIPDLPRAAAVVERLRARGVRVALDDFGSGYNALAQLHGLAVDTVKLDSTLTDVDTAPERAGTLCRSVLAICADLGITVVGEGIETNERAEALAALGCPLGQGYLFGPPRRLSELDHPNR

SEQ ID NO: 12675 - protein, 257 aa, Actinoplanes utahensis
MTNTFTPAEKTWLSRLGSLRQVVRQEVVARQLAQRLRPDAPRVLDVGCGQGTQAIRLARQGYDVTALDSSEQMSAALGRALSEESTAVRSRVHAVRADASRLAGTFSPGCFDVVLCHGVLMYFADPGPLLTDLARMLAPGGTLSLLVRNADALAMRPALLGDWAMAGEAFGTTTYGNRLGIRARADRLSDLTAALAGRGLEVFAWHGVRVFTDTAADDAPLPADNELARILDCETRAGATDPYRGVAALTHIFARRP

SEQ ID NO: 12676 - protein, 46 aa, Actinoplanes utahensis
MELVASVVGGAVVGFGWSTAWVVGGAVAGFGWSTTWVVGGAVAGFG

SEQ ID NO: 12677 - protein, 225 aa, Actinoplanes utahensis
MARRVRRLGAITLSSRRLTDPDPAAVRAALLTGLRETGLGLLTWNRSADELRARLAFAHAALGDPWPDVSDTALLEHAADWIDPGSARRRSDLAKIDVTAALRRLMPWSVAGRLDEVAPERLPVPSGSQIRLDYSDPGAPVLAVKVQEAFGWRDAPRLADGRVPVLLHLLSPAGRPVAVTRDLASFWVQGYPQVRAEMRGRYPRHPWPEDPMTAAPTRRANPRSR

SEQ ID NO: 12678 - protein, 582 aa, Actinoplanes utahensis
MLIRADALPDLPVRDLLPEVTATLSGAGAAVLVAPPGTGKTTLVPLALADAGRVIVAEPRRVAARAAARRMATLLGEPVGERVGYAVRGDRRVSRRTLIEVVTTGLLVRRLQKDPELSGASTVVLDECHERHLDSDLALAFLVEARAVLRPGLRLLATSATADADRLAEVLGQPGSPAPVLTAHARTHPVEVIWSPPPGPVAPPHGLRVDPKLLDHVAATTRRALAEGDGDVLVFLPGAREIELVATRLRGVGADVLPLHGRQSGETQDAALRAGPRRRVVLATALAESSLTVPGVRAVVDCGLSRVPRMDHSRGLGALVTVPVSRSSAVQRAGRAGREAPGRAYRCWAEAQHERLPAQSEPEIAAADLTGFALDLALWGDPSGSGLALPDQPPAGALRAAVATLRDLGAVDTDGRVTARGRALAGAGLHPRLARALLDGAALVGARRAAEIIAVLDDPRSATDDLVAAVRRARAAGDAGWRSEVRRLTSAAATDLPAPAAEPAAAAAAAGSGSGASAGAGAAGAGAGAGAAAGPGARIPDDLATGLVVGLAYPERVALAREPGGPSYLMAGGTAADLPLAS

SEQ ID NO: 12679 - protein, 238 aa, Actinoplanes utahensis
MVLPVPGGATSTAAPAPDSVAVTSGSRSRTGRSGRASARISTRTVWPIPPTSFRGLWTAAGYPQARFRRGERWQGGRVAFSVRRRTPRARHVRVINGGVRWGSSGFAGSPGRGGGECPVPADDGTAAEAHARISTHILDTGTGDPAGDVYVRLERHDADGWSTVAEGRSDGDGRLRFRVPMRDWQAGGYRLLFYVEPYLGQDCFFPEIMVAFHVRDPDRQYHVPLLLNRYGYTTYRGS

SEQ ID NO: 12680 - protein, 511 aa, Actinoplanes utahensis
MTEILSDAAVAFVADLNRRFRPRRNELLQARAARRAEIAAGASLGFLAETADIRAAEWSAPPAPADLQDRRVEITGPTERKMTINALNSGAKVWLADLEDANTPHWSNVVDGQQNLYDAIRRTITLETDKKTYELNGGPYPTIVMRPRGWHLDERHLPVDGEPAVGALVDFGLYFFHNAKELLERGSGPYFYLPKMESHREAALWNDVFTYAQEQLGIPVGTIRATVLIETIPAAFEMEEILYALRPHISGLNAGRWDYLFSIIKYFRDNPRMILPDRAAVTMTAPFMRAYSELLVSTCHRRGAFAMGGMAAFIPSRRDPKVNEIALAKVNEDKEREAGDGFDGSWVAHPDLVPVCQAIFDRVLGDKPNQLSKLRPDVAVDARDLLDVAALDAQVTEAGLRNNVNVALQYLEAWLRGNGAVAIHNLMEDAATAEISRSQIWQWIHNGVKLPDGTPITAELVTRIEDEELAKIKETAGEGGRFDDARKLFERVALADDFADFLTSAAYDSID

SEQ ID NO: 12681 - protein, 505 aa, Actinoplanes utahensis
MITPQTALSAASRHLRVMRGRVRHRVATFRPEGCSTWQETAAPIRNSAKRGESIRNPAKHGESIRNSAKHGESIRNSAKHGESIRNSAKRGAWIRNRGAWIGTQPTAARRSGTFMGQNGAVPRTVTLVLVDPAGDLLGAMPPFSVASPWWQEVAEVVAAAGAEVTVLRLLHADRPAPPGGHVTYLAETRARPAGLTPLGADLVPHALRAPWAEPGGPAVTLAWAAGVLDRLGFPGLTAVQQRTWNLSAIWRMDGPDGPVAWLKQVPPFLAHEPAVLGLVVEVAPSLVPYVLAAGSAGRMLLAHVPGEDRYGAGADLCARIAEAFHPVQEHYAGRVGELAGVPDRRLDAARFAAVAAPYLSGIPGLTGLIDDLPRRLAAVAACGLPDTLLHGDLHPGNVRTGSGPDSLVIVDWGDAAIGNPAFDLLRLVDGLADPEPIVAAWARRWRVTVPGSDPERAVELLRPVAGLWNAATYAGFLANIEQSEWPYHAGDVPDCLAAAVAAAGA

SEQ ID NO: 12682 - protein, 381 aa, Actinoplanes utahensis
MSTVCCMTDLRRRYIDLIRQDGVSLSPELATAFGSVPRELFVTGGFHRRDGSWMEPVDPDFLPTVYSNDVLVTKVDGDRPISSSSQPSLMAIMLAALDVRPGMRILEIGAGTGYNAALLATLGAEVTSVEVQEDVAAHARAALARAGISRARVVTGDGYPGSPDARYDRVIVTVGVAGLSPHWFAQLDPAGFVVAPVEHAGHHPVLTVTGSGTGRVVCSAGFMGAAGPLGARHPGSHPPPAGVLHGLTETAPPRWDPPLDSTAYRDLWYAAGAWDRRVTRATLPAGEVVRRDARHAFRSGEDIYLTLLDETGTGGAVLLPDGSVLAGGGDADRRTADAAALIDRWHRRGRPPMRAWQVGLTRAGDPDAPILVPTTWQPADD

SEQ ID NO: 12683 - protein, 39 aa, Actinoplanes utahensis
MAAGRRSGATWQPADDQERRGSRPTIKKDMAAGQERAPR

SEQ ID NO: 12684 - protein, 222 aa, Actinoplanes utahensis
MPAVNASAAARVVLAEDGVLLREGLIGVLGRFGFTVVDAVGDAEHLIASVGVHQPDLVVTDIKMPPGFHDEGLRAAVELRRNRPGLPVVVLSQYVQEEYASDLIGTGDGVGYLLKDRVADIEDFVAALRTVLAGGTVVDPEVVRRLLHRPRDPLAGLSPREREVLGLIAEGRSNSSIAAALFVSETAVGKHIGNILGKLGLPPTDDTNRRVMAVLTYLGARS

SEQ ID NO: 12685 - protein, 371 aa, Actinoplanes utahensis
MRPDRAAAPAAGRRPRDPARSPAPAGRRLPGRDRRRDARRRRPADRAAGRRAGTPPAAPGRPAPAARTRPAGPAAALRDEATWRAVLYTVLLALLAPPVFLAASLWVSVEALMVASPFGIGTWEFGNWQVHGGAHSIPLSVLGVLLAPVTLYLAGILAAGHAMLARRLLGAGDPLRDQLSDVAQSRARLADAFDAERRRIERDLHDGAQHRLTSLTLHLGMARLDLPEDSPAAGPLGQAHTQAKELMVVLRDLVHGIRPQVLTDLGLPAALRELAATSPVPVTVETDIVARPPEGIETTAYFVAAEALTNIAKHARATAARVRVTGDGTRVDLEIQDNGRGGADPAAGTGLTGLADRVAAAGAAAAGQLAS

SEQ ID NO: 12686 - protein, 548 aa, Actinoplanes utahensis
MRAADRGLTVRASSTSEGLPVPLEDWLLTAAERGNPHTGIPTWSAGNTAEPLIHGKRYFARLTERVEKLQAGDHLFFTDWRGDPDELAVDGGPTIAELFAAAARRGVIVKGLLWRSHLDKLAYSEEENRNLGDQIREAGGEVLLDQRVRRGGSHHQKLVILRHPGQPALDVAFVGGIDLCHSRRDDDDHHGDPQAVRMAKAYGPTPPWHDIQLELHGPVVGALDLTFRERWRDPAPLDQHGPISTAIDLLNHADLDADHLPPQPPDPPECGPLTVQVLRTYPAMRPKYSFAPLGEQSIARGYTKAIRRARKLIYLEDQYLWSAEVAKLFAEALQTNPELHLVAVVPRHPDVDGRFALPPNLVGREQAIELCKHAAPDRVHVFDLENTEGTPIYVHAKVCVIDDIWCSVGSDNFNRRSWTHDSELSCAILDDTPDEREPADPAGLGDGARRFPRDLRLALTREHLGLPAGAGSAELIDPIAVVRRMDAAAAALRDWRDNGRHGPRPPGHLIPHQTERLPWYQRAWATPAYRLIYDPDGRPWRDRRAGRW

SEQ ID NO: 12687 - protein, 41 aa, Actinoplanes utahensis
MSSEPLTTDVVPEVAESAETGLLVTMLLLVLFGTAAMLYLF

SEQ ID NO: 12688 - protein, 399 aa, Actinoplanes utahensis
MDWIPRFAEVVVRAGVNIQPGQGVVLNTDTAHLEVARAVVEAAYAAGAAWVEPVWSDGPMRRSAVDHSDLADLTSSRPWALQRIREWADQGAAWITLIGDADPHLLDGADPAKAAAIRTGEMVARRDAMIGKLRWTAVGAPNPGWATQVYGEPDLERLWQAVGIAMRLDEDDPVQAWRQRSATLAERGTALDALGLTEVRYVGEGTDLTVGLIPGCHWTGGGMIDDAGIPYLANIPTEEVFTSPDRRRADGTLRVTKPVAIGGRVVTGLRLTFAGGRITAVTADEGADVVRAQLETDPGARHLGEVSLVDKESRIARTGTLFHNMLFDENAACHVAWGQSFPFAVPGGVAMTPEQRAELGLNSSGVHTDVVVGGAGITVTGTGPRGTVEIIRDDEWVLV

SEQ ID NO: 12689 - protein, 78 aa, Actinoplanes utahensis
MTEATDLAAAASSADPRVGLRAVVALRRLLEGLEHLQVANARKRGWSWQEIADVLEVTRQGVHKKHAHLMPMTDPREG

SEQ ID NO: 12690 - protein, 207 aa, Actinoplanes utahensis
MFERFTKEARTVVVRAQMEARELGHTVIGTEHVLLGLLAQDSRAAAVLHRAGIERARVRDAVVRAVGDRTDEAAVTADQDAEDAAALKAIGIDLDAVRAAIEENFGAGSLRLPRPAPKKRGIFGKFSAPTTGGHIPFSKRNKKVLELALREALRLKHKFIAPEHIMLGVIREGQGLAMRILADQGTDFDRLRADLDRSLEAGAANRS

SEQ ID NO: 12691 - protein, 316 aa, Actinoplanes utahensis
MPAITVDDVLVLPRLPKLDPVATEFRPVRRLTTAPQGYEGEGFPVRRAFAGVPLSELDPFIHLDQMGEIDYAPGEPKGTPWHPHRGFETVTYMIDGIMDHQDSLGGGGSITNGDTQWMTAASGILHIEAPPEHLVTSGGLFHGLQLWVNLPAAAKMIDPKYQDIRGRESALVTTPDGGGLIRIIAGEVAGHAGPGSTFTPINLTHVTLQPGARLDLPWQPDYNALVYTLSGEGWAGTDMRPIRLGQLATFGAGDAIRVEAKSELDLFIMGGRPIREPVVHYGPFVMNTKAELQQAFEDFQKGRLGVIPASRLPHTD

SEQ ID NO: 12692 - protein, 391 aa, Actinoplanes utahensis
MRSADSGGYLRRDRLGQCSPVNAHRSVGLSDSRVGRATGLRLADPALGVDEVAGGLQRREHVSHGRAVGHALGDDRYVVHEASRDLLARGEIRLGVLQRHVSGDVDRLGRDDAERPAVGQQPAEVGVMMTDYTDLLPVAHQAVDLARKIMRTMQPGALTAKGDRDMASEVDYAIEDQVRTFLAKRIPEIGFLGEENGLSGTTERLVWALDPVDGTVNFVHGSPLCAVSLGLITENRSVLGVIDLPFLGSRYSAAEGNGAHADGQPILVSTTQRISDAVVALGDYAVGQDAAEKNRARFAVTQRLAASVQRVRMHGSAAIDLAWLAIGRVDAVVMLANKPWDTAAGVVIAREAGALIADRDGSPHSFASSATIAANPGLLSGILDLAGGDHR

SEQ ID NO: 12693 - protein, 288 aa, Actinoplanes utahensis
MRIDWTALPEAVTTKVAARIGGTHAVPAEAGDHAEIAATVSGTAGKVFVKAACTEFGVRSLRYELRVSEAVKGPHSPAVEWHFEAAGWLVVGFEHCDGPHADLSPGSPHLDLLAEALTGLGKTLAPEVPLFTPTGRLGFPHPAMDGDVLVHSDLAPTNLMVSSRGLFIVDWAFATRAAPWVELAMLTQWLIGSGHTPEQAEHWLARFPAWAEVSPDVLDDFASKNATKWASRAKPGSPAWMHDLADWTGQWASHRRAAEETRIVTIPPGPRRAVKADPGAGLGTTPPR

SEQ ID NO: 12694 - protein, 51 aa, Actinoplanes utahensis
MTDLLDPESDLSGTQAAVDAANGQLHEIMDRQTDLQQSAECSGTHLDRWYY

SEQ ID NO: 12695 - protein, 391 aa, Actinoplanes utahensis
MSETQAAPPPARWRRAAFALATAAAFLFGMPAGPAGAAPTAALSRIAAGYAHSCAIRTDHSLWCWGGNSKGQLGDGSTVSHGSPTRVGTAGDWAAIDAGTSYTCGVRTDHSLWCWGANTRGQLGDGSTTSRNTPTRVGTDSDWAVVTTGDSHTCGVRTGGTLWCWGFNRLGQLGTGMSVYTATTPLQVGTATTWSTVSAGFAHTCATRTDGTLWCWGDNGDGQLGLGVLTPSVTPAQVGTATNWATVTAGYAFNCATRTDGTLWCWGDNGYGQLGAGGTYQTAPAQVGSGTTWTRADAGFNTACGARTDGTLSCWGNNATGQVGDGSTVNRGTPVQVGATTTWTGDYATGYQTCGFRADQSLWCWGNNANSQLGDGTTTQRTTPGQVTLPS

SEQ ID NO: 12696 - protein, 149 aa, Actinoplanes utahensis
MAEPLSETQMQHWRAFIESSWALHTALEDELRAATGLSMNDYHVLVALAEAPDRRIRMGELANRLVLSPSRITYQISSMVKRGLVEKQSCPDDKRGYEAVLTDAGLTALREAAPAHLETVRRRFIDRLEPDELAVIGRAFAKISDAHRS

SEQ ID NO: 12697 - protein, 258 aa, Actinoplanes utahensis
MERHMRIRGYAPMTPCWVELASADPARAAQFYGELFGWESAGDRFKLNGRAVAGLTRSGSDRPDGWLTHLSTPDLEETLEQVALAGGTCLSHPADAHGGRRAIVADPAGAVIGLWEPSDFAGAQAGGEPGTMSWPELITDDTHTAARFYGSAFGWLLRHDFGVGEWLNQAHDAIAGLTPGYRGAWWRAAFEVEDIVEAAARCERLGGALIAEPAEAGLTEFAELRDPFGARFTVAALVHHPVELTVSLGSLPAFQRFA

SEQ ID NO: 12698 - protein, 707 aa, Actinoplanes utahensis
MVGSGAARPPAISTLPVQSAGAKGCAALVHAFDWSRTSLGPLERWDHAVRTAVDLMLESPVAMMLVCGADYVVLYNDAYAEVLGGRHPVALGRPAVQAFGEAWDQPGMSDVIGRVFRTGHAVLEPESQVTLRPGGAEPAFYTRGHSVVRDSHGTIAGVLTVAAETTQVVHRLQSLGELTARLAGALTIDDVTRVVLTYAMASFDLDHCALAVDDGTAYRFVRRIRGEMLDEADERLPPVWRRIAADQAAPLVAAAETGAATFVADGEPLRAVAQDRHERRVRSLAALPLRTPSVRGALTMGFRRAHAWLPAERALLRAAAELVAQAAERARRFEAQHGTAQLLQRSMLPEHLPELDTFRIAARYDVGVDGNAAGGDFYDAFRLLDGRLAMVLGDVAGHDVRAAAVMGQVRAALRALALTDPAPPSVLAGLDRLVGSLGAESRNEEIFVTVVYGVLDPADGSVTLASAGHPPPVLRRAGLGGGPATAELVKVPPGAPLGLGGRWQTGTLTLEPGDTILMYSDGVVERRGHALNAGLDALVAAAAGSASGDPRNMCSLATAAVAGTTDDDVAVLAVEHALAMSRSATMHVAAEPTGPSRVRQWMSARLREWQVPEPVIGAAILCTSELTTNALLHAGTPAQVHIDLNLERLLVSVADTGTRGSVIRARADTLASRGRGLGLIEDLSDSWGTDPTVRGSTVWFEMLLNRE

SEQ ID NO: 12699 - protein, 248 aa, Actinoplanes utahensis
MSHRPTVRFLTICETVAPHCVTVRDLACDLRVLRSFIVAAVTGDTTGEPVPGSEAQAPVEGGLDGWSASAETAAVPAPAPAEEILGFAATSEPYPVVPRLRLVVPPASATPGGPPSGVASAAVAIVRGWLSRRRPVVAAGGETADTGTPAVLSAVYHYDDGSHRGSVQVVNAGGGEAADWTVTLSVPGGEPVTVTSGEVAVAQSGTVVTFRPAGAALGAGDTVTFGFGFAAAPTSAPVGCAVNGSARS

SEQ ID NO: 12700 - protein, 118 aa, Actinoplanes utahensis
MNGLFSNAAARAALRSAHASLADLTAAVGVSGLAAAQANPGLMSVIDQHAAGVRDSLDADTRPLTPILLAAYAEGVRDAAFQHGWVAPEGEIDWSENDWVLRRLLAVCSLARTLPNPR

SEQ ID NO: 12701 - protein, 165 aa, Actinoplanes utahensis
MTGGNGTAAEAARGNGTAAEAARESGPDAAHRRPDGVDDVTVEALGKLSEALETVERVRGHLYSLHQLIGSADFKLDEAVSLFMQGGQTAIAERIERELIGRNVVPGRWTFQLVEEFDDGYYSEFRRLEREAREELVGGRRHLYEAELKERRRTHGRPGHEARPR

SEQ ID NO: 12702 - protein, 103 aa, Actinoplanes utahensis
MVERLRRNTEGTIGQRRIGRTGDGDPDLSRQNFRVRSAGFLSERQRRLAWVGFLLAAFQAPLAAKLIADASWFFAVVVALVVATVIIADDAQRRRPRQANYQE

SEQ ID NO: 12703 - protein, 253 aa, Actinoplanes utahensis
MVPSVLRRSRSTIAVIGASALVGALFAGFFRRSPQVAQPILPVTERVQAGPLLDRTGAWLTVGDPASRVRVQTATLPGLLYRISAASDAGIVPVVTRRGGRVAVRFRATQGDGLDEVHIVLNRDVRWDIRLPAGGGEQQLNLADGQVSRVELGASGLAEVTLPDPAGTVPVTFTGGVGTAVLRAGPAAVFRIRLEGGAGAVETPWVVNNGTPSGAVLQEAGWPRAADRYAVRAVAGMGSVILRRSGPDPRPTP

SEQ ID NO: 12704 - protein, 60 aa, Actinoplanes utahensis
MTDHVEGAWRDEKKLPVDELTRAMASWDTDGQDDPSDNEYGRQPDDRDARPSTTGLTGPQ

SEQ ID NO: 12705 - protein, 154 aa, Actinoplanes utahensis
MSTVTEFVDVNVPVRTCYDQWTQFEEFPRFMEGVEEIQQLDDTHMHWKTTIAGVTREFDAKITEQLPDERVAWTATDGEKQAGVVTFHRLDDTHTRVTVQLDFDPQGLVELAGDKLGLVDRRIKGDLHRFKEFIESRGGITTGSWRGHIDRPGI

SEQ ID NO: 12706 - protein, 132 aa, Actinoplanes utahensis
MERGNSKHGAVLDDQMASEVRGIFRGPAGGRADESHTPEPAGEDQPEVTIAPNGDFGRGVPNGVGSAQGEALSRFGSFLGRNAFPGDRAALEASARAMSAPDDVLRRIGTLPEGQTFQNTAEAWHASEGGDA

SEQ ID NO: 12707 - protein, 527 aa, Actinoplanes utahensis
MVDAIVVGAGHNGLVAANLLVDAGWSVRMLEAAGEPGGAVRSGELTAPGYLSDLFSAFYPLGFASPVLRDLHLERYGLAWTHAPNVFSHVLPDGRAATISRDLTATMASMEAFAPGDGERWKHAYDDWADVSDRMLPVILRPFPPVRDGLRLAGRLGSVDSLRLARRLMLSARELGSELFSGEGAQVALAGCALHTDLSPEEAGGGVYGWLLSMLGQEVGWPVPVGGAGQLTAALVRRLTERGGEIVCGTRVSRVLVARGRAMGVRTVDGRDWRAARAVVADVPAPALFLDLVGERWLPGRMAEDLAHFRWDGATVKVDWALTGRIPWRTAEVAGSGTVHLGADLNGLTRYSGKIATGEVPEHPFLLLGQMTTADPSRSPAGTESAWAYTHLPHREDWPADEIAAHVERMEGVIEEQAPGFRNLIAGRHVFAPGDLEAADPSLVGGALGGGTSAAFQQLFLRPIPSLGRADTPVDRLYLSSSSAHPGGGVHGAPGANAARAALARDRALTGGAYRAVINAGHRAIYG

SEQ ID NO: 12708 - protein, 145 aa, Actinoplanes utahensis
MATVTRTVQASPDRVFAVLANGWSYSDWVVGTSHIRDVEQDWPATGSKLHHKAGPWPLSLHDSSTVLECVPGRELKIRAGLWPLGEAVVDIVLEPASDGATRVVMHEDFQSGPLLWMRNKINDLVLHQRNVEALRRLADIAESHP

SEQ ID NO: 12709 - protein, 396 aa, Actinoplanes utahensis
MRIAMISEHASPLGVGDQHAHVAELSTALAELGHEVRVYVRRTDPAVPEIVPVGAGVHVVHIPAGPPSPLPDEQLLPHMAEFAGRLNELWQRDGWTPDVAHAHFWTSGLAAVTAARQAGIPVVQSFHELGTIQPAGAGPSRTGYERALGRAVDRVVAQTQDEVQGLVRIGVPRAQLTVVPAGVDSERFTPDGPVAPRDPDRTRILSVGKLVEHKGFGDVIQAMRYVPGAEVVVVGGPPADQLPADPGAKSLRALAERFQVADRFRLIGAVPHRDMPSWYRSADLLVAAPWQEQFERSALEAMACGVPIIGTAVGGLTETVVDGLTGDLVPARDPRALGGALRRLVNDKVRRFTYATAALDRARQAYSWKRVAAQIGSVYSAVTGLRRTTAEPEVVA

SEQ ID NO: 12710 - protein, 300 aa, Actinoplanes utahensis
MTVIEVSNLSKRYGDTVAVRDVSLAVEDGEIFGILGPNGAGKTTTVECVAGLREPDGGTITVLGRAPRDPALRLQVGVQLQESRLQDKLTVREALELYSAFYPEPADWRTLAGELGLEGKLRTSYSKLSGGLKQRLSIALALIGNPRIAILDELTTGLDPAARRDTWDLIESVRDRGVTVVLVTHFMEEAERLCDRLAVIDKGAVIALDTPAGLVARTETGQTIRFRPSAPLDDALLTALPEVRGVRRLGDRVEVTGTGNLLGAVSSMLAVHQIVANDLRLEQASLDDAFVRLTGVPTQE

SEQ ID NO: 12711 - protein, 246 aa, Actinoplanes utahensis
MNVFVKLTRTELKLQLREPVTAFFSLLFPTILVIILGSIPAFRKPSPELHGGRTIDVYVGIAVALSVAMLGLQVLPMVLAAYRESGVLRRIATTPVRPITLLAAQMAALMVMSLGSAALTIAVGFVAFDVPLAGNFAGFVLAYLLCAAGVFAIGLLIAALAPTGKAGNAIGTLLFFPSMFFAGLWTPREFMPGIVQKIGDYTPMGAGERALHDAMTGHWPNGLSAAVLIGYLAVFGLGAARLFRWN

SEQ ID NO: 12712 - protein, 410 aa, Actinoplanes utahensis
MQEQHSRRHSGVAGALLAGSTVLAVIATWTDLPQEPLPLTLGVVGATLVWILAFRALPPTRYQRAPSIALFVALIVLSALLVWCNPLFGFFVWTGYLFTAYMLPGWWALAGAAAVAVVTATAQIGGPALVRGAGGLLLFGTLLVLNAGISMTMTWNEIGKQRTSERRIRTIDALAQANAKLEEALKENAGLHAQLLVQAHEAGVLDERQRMAGEIHDVLAQGLTGIVTQLEAAEAQPADRERHLATAKRLARESLTEARRSVQALRPQRLDGAALPDALGEVVETWAGMHGVRADLILTGTARRLLPEIETTLLRTAQEALANVARHANAGRVGLTLSYMEDMVTLDVRDDGDGFDPARPREVTAAGGFGLDAMRERLARIAGTLEVESESGGGTALSACVPAIAIGAAA

SEQ ID NO: 12713 - protein, 210 aa, Actinoplanes utahensis
MIGVLIVDDHPVVRDGLRGMFTADDRFTVLGEAGDGREALAVAAAVQPDVILMDLRMPVMDGVTTIRSLQESGSVARVLVLTTYDTDSDVLPAIKAGATGYLLKDAPREELFRAVVAAHRGESVLSPAVAGRLMGRLRAPAGEKEPLSQRELEVLTLIARGCSNRETAGRLFISEATVKTHLLHAYAKLGVRDRAAAVATAFERGLLGRD

SEQ ID NO: 12714 - protein, 369 aa, Actinoplanes utahensis
MERATVIGAGVGGLTAAVALRQRGWKVTVLERAAGLEQVGAGLAVAPNALRTLDTFGLGDPLRRLSGIAGAAGVRRPDGTWIARSNADEATERYGDPVIAVHRATLVDLLAGALPEGTIRFGQTVSAVDPDTGTVVTAGGPLPADLVVAADGINSAVRGQLFPDHPGPVYTGVSSWRFVVPHPGISIIPAETWGAGKVFGTVVLGDGRVYCFATAPAAPGGRGNELPRHFAAWHDPIPSLIAAAGDTVTRTDIRCLDQPLPALHRGRVALLGDAAHAMVPNLGQGACQAIEDAAVLAAHPGDLARYTAERLPRTTGVARASRRIARMAGLANPVAAWLRNTGMTLAGRLGPDLILRQMDPVLTWRPPEV

SEQ ID NO: 12715 - protein, 136 aa, Actinoplanes utahensis
MVTMTDHRSAPAPQVWPSLRAEDCRGLIRFLVTAFGFVENVTYGEGDRVDHAQLDWPPGGGIMLGSVRDDEVSLPPGTFGAYVVTDEPDALFKQARAAGAQVVREPFDTDYGSRDFAVRDPEGNMWFFGTYRGEPR

SEQ ID NO: 12716 - protein, 167 aa, Actinoplanes utahensis
MTDEPLYAKLGFTDAEWGLLVGLPHAVLTAASAATPDSARKTRAESAAGLGRISDARASASTLVTAVASAAVAEAGDPELGEEPPVIEPADPAGYAEDVLDRASEAASLLAAKASVADAETYRHWLLEITDAVVGAATTGGLLGIGGETVTEDERSFRDHLASALAA

SEQ ID NO: 12717 - protein, 237 aa, Actinoplanes utahensis
MTFFTPSTGCCDNPWVREVVDGIFEIRYAGVNVHLVVTDDGVILVDTGWAGQTAVIERALRKLGRPLTEVRAILLTHHHADHAGGAADLRQRTGARLVAHAGEAPLINGALRPELPARRLARLLARPLAPVPSTKVDQLAGDGAEPVPGFTVLHTPGHARGHLSFLLDRAGGVLFAGDAAASRRGRVTGPNVMFTAEPPRAGESLARLAERDFEHAVFGHGRPIVGGAAARFREAVA

SEQ ID NO: 12718 - protein, 81 aa, Actinoplanes utahensis
MIDGRILRRSAARLVRTLATILFAVGVAGSVVSAVVLLIALTAADRFTRPAADAFITFGRLLAVAAVLYLVGRLLRRRDRS

SEQ ID NO: 12719 - protein, 554 aa, Actinoplanes utahensis
MKLPIYGPRLRKVARTHFGWPSLRPGQFKPMRAVLRRRDALVVLPTGAGKSAIYQIPAVLLPGPTVVISPLLALQQDQIAALNERADAKVRAVRVSSAETPREQQEAIEELRAGRAEFLFITPEQLANPERLAEVKSLKPGLVAIDEAHCISAWGPDFRPDFLALGDMIEQLGRPPVLALTATASPPVREDIIARLRLRDPEIHVSGLDRPNLFLEVTHCPDEAYRWRRLTALLDEGQRPGIIYVPTRRAAEELAEKLTGAGYPAEFYHGGMAAGLRQQRHEDFIDDKVDIMVATSAFGMGIDKPNIRWVAHTALPDSPDSYFQEIGRAGRDGEPGRVLLLWRAEDEAIQRFFNGGGPDPDELRELAGVLHKGPITKTALQKETGLGPRRLGQYLALLEQAGAVRTGKNSKLRVPAGAPLPAKAAEAAVAEFERQQAVIKSRTDMMRAFAESRQCRTETLLAYFGEEIRRTCNHCDNCADGSAEAVNAAEEEGPFPIHSQVRHGEWGTGMVMGYEEEKMTVLFDTVGYKTLSVPVVVQQQLLTGEASAAEKRMK

SEQ ID NO: 12720 - protein, 42 aa, Actinoplanes utahensis
MPLTPLAEATVDWSQVHAVRLLGVALALLFLLWAIRRMFGGK

SEQ ID NO: 12721 - protein, 509 aa, Actinoplanes utahensis
MSKHGDLPELAAAVLQPGFVGTSAPDWVRRWLAGGLGGVALFARNVESPAQIAALTAQLRAENPDVIVAIDEEAGDVTRFESRLGSSRPGNLALGAIDDPRLTEAVARDLSCHLAAAGITLDYAPDADVNSNPGNPVIGVRAFGAEPLLVARHTAAFVRGLQTYGVAACAKHFPGHGDTSVDSHHDVPLIERTAEQLEACELVPFRAAIAAGARVVMTGHLLVPAYDTDLPATLSPRILTGLLREELGFDGLIVTDGIEMQGVRRRFGLAGATVRALAAGVDAICVGGDHADEQTAILLRDAIVAAVRSGELPEERLRDAVARVRALGAWTTRTQQEAGVVRGPQPESEIGYTAARRAVRVTRTAHAPELPVIGVPHVVEFAPPRNIAIGEETPWGIGAPLTDLLPGTTSIRLGAEDLNGLCDPASRVLDGAAGRPLVLVVRDVHRHRWIEDTLAGVLAVRPDAIVVEMGIPVTVVGGVHVATFGATRACGLAAAELIAGAVVPEPIAA

SEQ ID NO: 12722 - protein, 95 aa, Actinoplanes utahensis
MSDHPFRDNTVAHRFELAVDGAVGALASYRMRGEDVVVVLHTETHPDMRGRGLAGELARRTLAEIRERGWRIVPACPFFAHYLSGHPEDAELVAH

SEQ ID NO: 12723 - protein, 274 aa, Actinoplanes utahensis
MSSATSNVKYHASRAANSKPLEYLARGGFVGYGIIHLLFAWIALQVAFDGSGKESDQSGALSELAAKPFGKALLVIIAIGLFAMALWQLFAAIDGQSGEQNRSAVAERVTSGIRAVLYVYLGWVAIKVVRGANASMGDNSESRSAGLMQHSGGRWLVGLAGLVVLGVGIGIFVYGLRKKFTKRLDTAKMPASARQTVIRLGMAGYSAKGLAYAIAGVLFLTAAVTYDPDKARGLDAALKTLAGHPWGVWLLALIALGIAAFGVFCFAQAKYRKI

SEQ ID NO: 12724 - protein, 403 aa, Actinoplanes utahensis
MGRWHSTRPWRGLFVSSVLTAVLGITGAAVAAIVIVEASHRVMLRIGRRSPLAADLARTMHRPFLATLTLIAVQQAVRVFGGDFPGRAAVVHALVIVCIAAFAWLVAALLLVLEDMTLARWRTDVPDNLRRRRIKTQVVMLRRVTVASIVVLTAGVMLMTFPGIRALGASVLASAGLVSVIAALAAQSTLGNVFAGIQLAFSDAIRVDDVVVVESEWGRIEEITLTYIAVQIWDDRRLILPTSYFTTKPFQNWTRSSSAVLGTAEIDVDWSTPVEPLRAELRRVCEGTELWDRRVCVLQVTEATGGTIRLRALVSAADAGALWDLRCLVRERLVGWMWEHQRGALPRTRTQLDEVDDGAAPIRQSRRAAEASPDARVFSGGNDGEARGVAFGAAENDPAPAAR

SEQ ID NO: 12725 - protein, 143 aa, Actinoplanes utahensis
MADVLNGRARPLSEQSTAELVQRASEQLSRLVKDELTLAKAELAEKGRHAGIGVGLFSGAGVFAMYGVGALIATAIIALDLVWPLWLASLVVTVAIFLVAGVLALIGRSQFRRVAPAEPVAAIEGLKADVDEVRHAVKERGRG

SEQ ID NO: 12726 - protein, 103 aa, Actinoplanes utahensis
MSESSNGTTGKPDLVALRAEIKQTRAELGETVQALAARADVKARAREQVAQTRQRLLGQAAAAGDRLQAVSAGTVRANQLPVVLIAAGLAAVVGVILIVRGRR

SEQ ID NO: 12727 - protein, 90 aa, Actinoplanes utahensis
MAGKLGKIALKPVNVVAGIAAGAVAGLLFKQVWKLASGDDDAPDAGDEDRGWGEVLAAAALQGAIFAVVKAAVHRGGAVGAKRLTGQWPD

SEQ ID NO: 12728 - protein, 67 aa, Actinoplanes utahensis
MAQGTVKWFNADKGFGFITVDGGGADVFVHFSAIQTSGYRTLEENQRVEFEIAQGQKGPQAEQVRPL

SEQ ID NO: 12729 - protein, 82 aa, Actinoplanes utahensis
MVNNETESTAGDPTRLRGWLSMSLGLLGIVLGTVWTLQGLDVFENELMSDQPAWAAAGGVVIVLGLALVVIGMRRRTGGSLS

SEQ ID NO: 12730 - protein, 325 aa, Actinoplanes utahensis
MEKRSFRRMGRDASVIGLGAWQLGADWGDVSEADAHATLQAAVDAGVTFIDTADVYGDGRSEQIVGSFVKDRPGLTVATKMGRRLPQVPANYSIDNFRAWTDRSRANLGVDTLDLVQLHCPPTPVFNSDEVFDALDTLVQEKRIAAYGVSVEKVEEALAAIARPGTASVQIILNAFRLKPLERVLPAAAEAGVGIIARVPLASGLLSGRYDEHTTFAADDHRNYNRHGESFDVGETFSGVDYATGLEAVRRLRPLVPEGVTMAQFALRWIIDQPAVTVVIPGARNPEQARANAHAGDLPSLSPETREMINAVYDELIRPQVHDKW

SEQ ID NO: 12731 - protein, 247 aa, Actinoplanes utahensis
MWDPAVYQRYGTERSRPFFDLTTRIGARRPREVVDLGCGFGDLTRTLAERWPAARITGIDSSPEMIAAATGGDFRVGDIADWTPGPDTDVVVTNAALQWVPGHQRMLTRWVRELPAGAWLAMQVPGNFGAPSHRLLREVAAGHGVERGIRESPVDEPTVYAESLTAAGAAVDAWETTYVHLLPVDGPDHPVLRWMEGTALRPVRAALTADAWTSFRAELGARLAEAYPTGHAHVAFPFRRIFVVASI

SEQ ID NO: 12732 - protein, 341 aa, Actinoplanes utahensis
MSDLTEFITGLPKAELHVHHVGSASPRIVAELAARHEGSSPVPADPAALADYFEFRDFAHFIEIYLSVVDLIRDAADVRLLTYEIGRELSRQRVRYAELTVTPYSSVRRGIPAPAFCEAIEDARAGARRDFGVELAWCFDIPGEAGLPAAEETLRIALEERPDGLISFGLGGPEIGVPRPQFKPYFDKARAAGLHSVPHAGETTGPETIWDAIRDLGAERIGHGIAAAQDERLMAHLAEHGIPLEVCPTSNLRTRAVADLARHPITTLAAAGVPFSVNSDDPPMFGTSLEREYAVAAELLALDHAGVADLARAAVRHSFLSPQGRATLLAEIDGYAAGFPE

SEQ ID NO: 12733 - protein, 46 aa, Actinoplanes utahensis
MRDVLNHPDTEEEEPRFNRRRLIRWLTILTIGTVVMLALWQDPLYP

SEQ ID NO: 12734 - protein, 210 aa, Actinoplanes utahensis
MSVRLTWSAASDTATYEVSVGGKPVATTKATRALLIGLKPDSAYKVEVRSRTNRYHATGSAHTAPAARPVQNSWFVLTNSLTGGAADLYAARAADGTPATLGPADGGNQQQWQLSPAADSGSYTLISRASGKCLMPLGGTPVAGAPLVQGDCANAGARWRLQASDFGFTLRSETGDLAVGVGGQRFGWHRVLALEPDTGQRHQSWTAVPS

SEQ ID NO: 12735 - protein, 452 aa, Actinoplanes utahensis
MVPSHRPPARRGDALPAHRRSAFPGSPGSRRRPSRSATSRLLPVALGLTLLGVGGVVGPSVIGASSRKDPGRFQLTALPKDAPDQGLVYEGLKPVAAGALCAGSYLLADDTCTHGPDRAPTGLSVREDVAPVTAATRLPGTVRTMHPVVVPTDAEIARDLGGSALTPDAPALIPDPAPGNADFVLGPAGVACDGDGQDGKRVQLLYVYAAGTATRYNRYVNSFRTWAAGVDAIFDASAGETGGSRHVRYVTTPECTVAVSEVELPAGSLDSFTATVKALGNLGYNRTDRKYLMFSDANVYCGIGTYVDDNRPGRTNNNNAGPSYARVDSGCWSSVMAAHELTHAFGAVLNGAPNGTGAGGCLDDYDLLCGPDRSGRAVRSSCPKAHEVRLDCGHDDYFNTNPKPGSYLDTHWNVALSDFLLRSDGGNDIPDVPGAVTPDPGQAAAPPAALAS

SEQ ID NO: 12736 - protein, 513 aa, Actinoplanes utahensis
MAAALGRRGPDHRRAFVLATPETGRVRGEAPLPAHRAGGRIPVGGAGLRLRLAYTTAATTAVAALVFLVPLGWGLRSDHREEALAGAARATSTVAGALLAGAGDKGVAAAAATAGDPVVHVPGLAPTPGGRATGKQIDEAASRPDASVIEVPGGVIRLQPVTAGGKAWVVEGFVPASELTENTARDWWLLLGLAVVLVGGSVIVVDRLARGAVNSANNLVEAALAVGDGDLGVRIHPSGPRELAEAGYAFNRMADRLVTSRTDERELVADLSHRLRTPLTALRLDAEALDPDDTQIIDLTADEVDRRRGIRRIRQAIATLEDEVNSLINTTRQTVAAQVAANPEEGLCDASEVVRERMSFWSALAGDQERQYRVTGAHVRIPVPVPRADLAAALDAVLGNVFRYTPQGTAFEVALSRRDGWVALRVDDAGPGIPDPEKALRRGQSQQGSTGLGLDIARRMTQSTGGSVSLDRATLGGASVVMLIADADATPKTPSRFGLVGRGGRGRRGQRAT

SEQ ID NO: 12737 - protein, 398 aa, Actinoplanes utahensis
MPGAERGGPHRRAVAARPLPVEGGRGGDRPGQPFADLPEHHHGSRAVPPIGFAVLAEQEGEGVPVEVALLEDGHQAAGLLGVVGPGPDARGHPGVEQVGGPVAGHEILRAEGVADAQAGQAVQGQRAARIGEEGERHRWFGSYSITEGHQSISFHEPLGFPRRRQYGLRMATVLLVEDDHVVRGAMLRSLADRGHAVHAVGTALEALRRVAAETPDLVVLDLGLPDLDGSDALRMLRGITDVPIIIATARDDEQTVVRLLRAGADDYMVKPFTGAHLDARIGTVLRRVGRASRAAQPAVHEVGELRVDVGERSATLGDQPLALTRKEFDLLAYLAARPGRVVSRRELLEEVWRQPSVGEDQTIDVHLYWLRRKLGESAAKPRYLRTVRGVGFRLVAPD

SEQ ID NO: 12738 - protein, 384 aa, Actinoplanes utahensis
MVFHPKGGVIKREMEDYVRARHIEEGFQYVGTPHITKENVFVTSGHLPYYKDTMFPPMQLEGADYYLKAMNCPMHNLIFRSRGRSYRELPMRLFEFGTVYRYEKSGVVHGLTRVRGLTQDDSHSYVTAEQAPGEIKHLLNFVRSLLDDFGLDDYYLELSTRDPGSDKFIGTDEQWENATGVLEQVARESGLDLVLDPGGAAFYGPKISVQAKDAIGRTWQMSTIQYDFNMPARFGLEYQAADGSRQEPVMIHSAKFGSIERFFGVLTEHYAGAFPAWLAPVQVVGIPIRDDHADYLSSFVERLRREGIRAEVDYSSDRMQKKIRTAQQQKIPFMAIAGDDDVNGGTVSFRYRDGSQRNGVTLDEAVAHVVEIVRSRINTGPSAA

SEQ ID NO: 12739 - protein, 172 aa, Actinoplanes utahensis
MVVMDVTGEPDGLERLWTPHRMAYITGENAPAGCPFCVAPGLPEGDSLVVARGELVFAVLNLYPYNPGHLMICPYRHVADYTDLTEEETAEVAAYTRTAMRVIRAVSRPHGFNLGMNQGAVAGAGIAAHLHQHVVPRWGGDANFMPVIGRTKVLPQVLTDTRVMLARAWPAS

SEQ ID NO: 12740 - protein, 189 aa, Actinoplanes utahensis
MGHREELLKGAKKALLEKGYARTTARDIVALSRTNLASIGYHYGSTEALMTAAMLSAMEDWGNALGRALAAPDPTADPLLDFWRRVIGSIQTDRPLWLASIEVALQAEHNPQLKEQLAGGLTAGRTGMAAMLTGIAEDQLDEATVRSLGAVQMALMSGVVTQWLTDPASAPSAEEVVAGVRMLATLAPA

SEQ ID NO: 12741 - protein, 393 aa, Actinoplanes utahensis
MVSGMTNSRVLISGAGIGGPALAFWLFQRGFEVTVVERASTVREGGYKVDVRGSATAVLRKMGLLDAAKAADTGMQQITYVKPDGSPIAKLPADLLMGRRGDDLEIMRWDLSKILYEATEDRVEYVFGDAIASLADGPDGVDVTFEHGAPRRFDYVVGADGLHSATRRLVLGETPLTFLGAYISIFSVPNDLGVTREEVFYSRPGRLIFAYAMEPGQPARVGMVFASPERRYDHRDPAAQKAMVREAFAGQGWRSDEFLAAMETAPDFYFDSMSQVELPSWSSGRVVLLGDAAHCPSPASGQGTSLALVGAYVLGRHLGEPEGLAAYEREMRTYVEKNLAFGRKMVKDMVPGGRLTIAFRHYGMRTLKYHPQKEKVINKVLAPMHEAANAITI

SEQ ID NO: 12742 - protein, 719 aa, Actinoplanes utahensis
MAQKTSEKGLAGAAAPVVTEPGRVRNVVLVGHSGAGKTTLVEALLAATGTIPRAGTVADGTTVTDHDPAAVRQQRSVALSCAPLVHQDVKVNLLDTPGYADFVGELRAGLRAADAALFVVSAVDGVDESTVALWEECAAVGMPRAVAITRLDHPRADYEQALQDCQEAFGENVMPIYQPMLGDDGRSVAGLIGLVSLRVLDYSAGYPPRVGEAEQAHLNPIADDRNQLIEGIIAESEDETLMDRYIAGELISTDALIPDLEKAVARGNFYPVVPVCAATGVGLDALLDGLVSAAPSPLEHDLPVVTGVDGAPRPPLVCDPDGPLVAEVVRTTIDRHVGRVSLVRVFSGTLRPDQTLHVSGHGMAERGHPDHDADERVAHVYTPLGATLREVGRCVAGDICAITKSGSAETGDTLSGRDDPILMSPWSMPEPLLPIAVVAKTRSDEDALAKNLARLVAGDPTLRLERNPDTHQLVLWTMGESHADVVLDRLRAGGVELDTEPVKVSLRETFGAASKGHGRHVKQSGGHGQYAICDIEIEPLPRGSGFQFVDRVVGGAVPHNYIPSVEKGVRAQLEKGIIAGYPVVDLKVTLVDGKAHSVDSSDAAFQTAGALALREAAAAGQVTLLEPVDEVVVRVPDTYVGAVMSDLSGRRGRPLGTDTAEDGGHSLVRAEVPALELVRYAVELRALSSGAGTFSRSYVRHEPMPAHLVEAVKKEHAVR

SEQ ID NO: 12743 - protein, 206 aa, Actinoplanes utahensis
MAKIVQVTARAVVSYGVNPVARSLLKIGVSPDAVTVAGTVGVLIGSYFGARGHLFWGTWIVTACALTDVLDGTMARLRGSSGRFGALLDSSMDRIADGAVFGAVVYYLATQGNPYGGVPAALICLAAGQVVSYVKARAQSLGLDADVGVAERLERLIIVGIGGLLGSAGLAWGLPAALWVLAALSLFTVFQRLLHARRTEPKVAAE

SEQ ID NO: 12744 - protein, 288 aa, Actinoplanes utahensis
MKDRLTTLGYLAGWRLVRALPLPVARALFTTVADRAWKANGKGTQRLRRNYRQVAGPDMPETLVRDGLRSYARYWMEAFRLPSQTREQHVAGFHMEAASYDEMKSVIAEGNGIVLALPHIANWDAAAAWVVSHGWQMITVQERLKPEALFQAFMDYRESLGMRVLALTGGERAPLDVLAEHLRQGWVVPLLADRDMSRNGVEVEFFGGRTRMPAGPAILAVRSGAPMYAVDMWYSEHRVEARLRKITPPVDGPLDERVKRTTQLMADAFAAGIAEHPQDWHMLQKLWL

SEQ ID NO: 12745 - protein, 378 aa, Actinoplanes utahensis
MRIGIVSPYSFDVPGGVQNHIMDLAEALIGLGHHVSVLAPADEDAELPHYLVPAGRALPLPYNGSVARIAFGPVSTARVRRWLARGEFDVLHVHEPLTPSLSLLAVLSARGPVVATFHTAMTRSRALAVAQNFLQPVLEKITARIAVSELARKVQVEHLGGGAVEIPNGVAVAKFATAAALPGWPGEGGTLGFLGRFTEPRKGFPLLRTAFVTLARERPGLRLLVAGPGDRDELFDRIPAELHPRVEFLGLVSEADKARMLRSVDIYVAPNTGGESFGMILTEAMAAGATIAASDLDAFRRVLDGGRAGALFPNGDAAALTALLSALLDDPVRRADLASCARQVVGTFDWPSVAARVLEVYTTAIEATDGRVFDADEA

SEQ ID NO: 12746 - protein, 166 aa, Actinoplanes utahensis
MLGAILSAYLGWIAQRVERVHARAQSAERALDAHLLRRAAAAAVVAERTDAVELYAAARLALDAGPEERESAENDLTRQLQGIELDPADTAARTLIASSRRVVLARQVHTDLVRDALTARRRKVVRVLRLPGRYPRPRYFDIVEPVMPPLPVSAATHEAPLPVQAV

SEQ ID NO: 12747 - protein, 298 aa, Actinoplanes utahensis
MSENQPAVGTARVKRGMAEMLKGGVIMDVVTPDQAKIAEDAGAVAVMALERVPADIRAQGGVSRMSDPDMIDGIINAVSIPVMAKARIGHFVEAQVLQALGVDYIDESEVLTPADFANHIDKWQFTAPFVCGATNLGEALRRITEGAAMIRSKGEAGTGDVSNATTHMRRIRAEIRRLQTLPEDELYVAAKELQAPYELVKEVAEAGKLPVVLFTAGGIATPADAAMMMQLGAEGVFVGSGIFKSGNPAQRAAAIVKATTFHDDPDVIAKVSRGLGEAMVGINVDEIPQPHRLAERGW

SEQ ID NO: 12748 - protein, 197 aa, Actinoplanes utahensis
MLALQGDVREHLSALAESDVLARPIRRPEELADVDALVIPGGESTTMSNLAITFGLLDPIRKRIADGMPVYGSCAGMIMLATTVLDGRPDQESFQGIEMTVRRNAFGRQIDSFEGAVEIEGIEGGEFHAVFIRAPWVEQVGPDVRVLGRVASGDAAGRIVAVRQGNLLATAFHPELTGDLRVHRYFVEMVRQAAPAR

SEQ ID NO: 12749 - protein, 250 aa, Actinoplanes utahensis
MSGHSKWATTKHKKAVVDAKRGKMFAKLIKNIEVAARTGGGDPSGNPTLYDAIQKAKKSSVPNDNIDRAVKRGSGLEAGGADWQTIMYEGYGPNGVAILIECLTDNRNRAATEVRTRLTRNHGTFADAGSVSYLFNRKGVVIVPKGELTEDDLMLAVLEAGAEEINDLGDSFEVVSEPTDLVAVRTALQSAGIDYDSAESSLVPTMTVEVDEDAARKVFKLIDALEDCDDVQNIYGNFDVSDETLAQIEG

SEQ ID NO: 12750 - protein, 211 aa, Actinoplanes utahensis
MIVGWAEDLDVSGDTAPWERPDLGRWLGDTPPAQFDIIAGMKIDRLSRNLLHLVRLIDWAAERGKYVAAYMDSVDTSDKTGELIAKVLALFAEFEGTTIAERSAQSREHLRRIGRWHGGTAPYGYRPVRNSNRAGGVFEHDPDTLIVFREIVERVKDGKSIRSVAQDLNARGVLSPRDHAADSLRSSRRPGGHGEAIHSRRGPYGRTPESR

SEQ ID NO: 12751 - protein, 44 aa, Actinoplanes utahensis
MKDQKEANREDGNTRKSVSDSLRQKAIYLASVGSQVQLDGVVRP

SEQ ID NO: 12752 - protein, 186 aa, Actinoplanes utahensis
MNDPVLHLSALEDLDVEDLAHLPRGYRYELHDGNLVIMTPASYRHQDMAGRIYVMLLAVGARAFLDPGVRGTRERDCRLPDVGVVAALPPNTADYANLPGSAMSLVVEVISEKSPNGEFTHKADWYAEQGIAEYWIVERDAEKSHDDATVHIHRLVTHGDKPDYFRERTLPLSQLEREYAAKRAAG

SEQ ID NO: 12753 - protein, 217 aa, Actinoplanes utahensis
MPSTRITASPHVRVFDTLVRGSLAPAADTPRPWVREVPMNVIPPMQDDPPPEFVQVIAAHEPVLRREALRLTGGDPVGYAIYEEALTDLAGHWRRLRFWSRVTGTDVPGDYLRQRILKRTRAWREDQVYEVEVRVLRTPAPFPVPVGGPAPSLALRKASLIDGTSRAGLLTLADAAVAWCHAWRRSEHRRILRLIIGGLLLIATMIQTMSWLAGPGS

SEQ ID NO: 12754 - protein, 175 aa, Actinoplanes utahensis
MRVLGIDPGLTRCGVGVVEGVPGRPGTLIAYHVVRSEPDEDIAMRLLHLDRSLAELVALHQPESVAVERVFSQHNARTVMGTAQASAVAILAGSRAGLPVQTYTPSEVKAAVTGSGTADKKQVTAMVTRLLRLDAPPRPADAADAIAIAICHIWRGGTRARIQAAAVAAARRSAR

SEQ ID NO: 12755 - protein, 200 aa, Actinoplanes utahensis
MIASVRGRVAAILHDSTVVEVGGVGMRVFCTPNTLAALRTGAEARLATTLIVREDSLTLYGFADDDERQLFELLLTANGVGPRIAQAVLAVHQPDAVRRAIGGGDIAALTQVPGIGKRGAEKMIVELKDKIGPVGFGDAGGTGVLAGAWQEQVRQGVLALGWSATQADQAVAAIGETIDGEVPPVPILLRQAIRLLGRTR

SEQ ID NO: 12756 - protein, 348 aa, Actinoplanes utahensis
MTDDFLSPEAGDEELDAEASVRPRRLADFIAQHRVRDQLELLLKASMGRGTPPDHILLSGPPGLGKTTLANIVAAELGTGIRTTSGPVIERSGDLAAILTGLGPGDVLFIDEIHRIAKPAEELLYSAMEDFRVDVVVGKGPGATAIPLDVEPFTLVGATTRAGLLSGPMRDRFGFVAHLDFYSPADLDALLHRSARILGVPITAAGAAEIAGRSRGTPRIANRLLRRVRDYAEVRGDGVVTEEIARAALQVYDVDALGLDRLDRAVLRALIESFKGGPVGLSTLAVAVGEQSDTVEEVCEPFLVRAGLLARTPRGRVATEAGWAHLGKTPPTDGRSGVFQGDLFARDA

SEQ ID NO: 12757 - protein, 145 aa, Actinoplanes utahensis
MTPRPRPAAVPVAYGRLFLVHLAASSSSNPLGLFLPFVLILGVMYFLMIRPQQKRRREAMEMQNKLGAGDAIVTIGGLHGTVVTAEDDVVLLEIAEGVQVTFARPAIARVVTRAGEPAEAAAEPVVAEPIVAEPESPVVDVRKQD

SEQ ID NO: 12758 - protein, 189 aa, Actinoplanes utahensis
MHPGRQLGVLGLIFVVLYLFVFFGGHAKGTFTDRLKPKMGLDLVGGTQATYIATQAGGAPTPEAMAQARDIIDKRVNALGVAEADVVIQGKNTIVVSLAGEAKDQLKDLGKAANMRFRLLTGTTMDVSKNALNPASPAPSAAASGAPSVAPSGAAVPKSGASAPAAVVSPSKGTGGQGGGEAVPSALAS

SEQ ID NO: 12759 - protein, 375 aa, Actinoplanes utahensis
MAALSPQMQFNVPTISCDQLNQRPNGSIDDPAQPVVACYSSQAKVMLDPAKVVGNDISSASPQLDQQNGQWVVSLDFKSDGQKKWADLTRVAFNATSSDPCYTAIQSLYGTSVQHCAVAVVLDKEILSAPQITAVLTGSSQITGSFTAATAKQLADQLKFGAIPVTFTSGPAETISASLGLQQLQAGLLAAAIGMGLVAIYAFFYYRLLGSVIFLSLLLSGLLTFGALVFLGRTMGYTLSLAGIAGFIVSLGVAADSFVIYFERLKDEIHEGRTPRSAVPRAWHRARRTIISANTITIMCAVVLYIVSIGAVQGFAFAMGLSTVLDLVVVFLFRHPIMTMFANTKAFLSPRVSGLGRVLRRNPTEEPGSSRVKEA

SEQ ID NO: 12760 - protein, 389 aa, Actinoplanes utahensis
MAREGLASRLYAGEANINIVGRRKMWFTIAAALVLISIGSFVVRGFSLGIEFAGGTSFSVPAEISGKSLTQNEISDAVAKAVRSANSEATVGSTQKVGNGPGASYTVRASALSAAESESAKTTLVKDLGVDPAKISDNQVSAAWGGQVTQQAVIGLVIFLVLVVAYLIVRFEWRMAVAALASLVLDLLLTAGVYSLVGFEVTPSTVIGFLTILGYSLYDVVVVFDKVQENTRGITAGSVRTYSEATNLAVNQTLMRSLNTGLVALLPVGGLLFIGAGLLGAGTLKDLGLVLFVGMGFGVLSSILFAAPVLSALKDQDPKIRAHNARVLTRRAGRSEDVARGERRPGNATDSDVPAMAGSTTPRPGARPAARRGANRGGTAGNRPDGKRR

SEQ ID NO: 12761 - protein, 266 aa, Actinoplanes utahensis
MPARRPGVAPTAAARPATGRTASGADNAAGGSRQRYGTRDGPAPRERWRAVSRQVDPGSGRRCPGGGAVAPIRWSRLSAVTTEIPAAPGDSGPELAALVAGASIDVPDFPKPGVVFKDLMPLFADAVVFRRVIDGIAAHHGAGSFDVVAGVEARGFVVAAALAYATGTGVVPIRKAGKLPRKALSASYALEYGEATLEVHEDAFVAGQRVLVVDDVLATGGTAAAAMDLVERAGGTVAGFTVLMELGFLGGRERLAPRTVHALLTV

SEQ ID NO: 12762 - protein, 810 aa, Actinoplanes utahensis
MSSDVVPPAEGTVQPTQDPRTGTGDVAPAEARIDDKTAGDPETTQPFTPTGETSGFGFASAPTGRRVRARLARFNAPWQSTQVSEVLEPLIATHRASHPKGDVRQLQKAFDVAARWHSGQYRKSGDPYITHPLAVATILANLGMDTTTLVAALLHDTIEDTDYGLEQMRNDFGAEVALLVDGVTKLDRVKLGDAAKAETIRKMVVAMAKDPRVLVIKLADRLHNMRTLTFLPRAKQEQKAKETLEILAPLAHRLGMNTIKWELEDLAFGTLFPKRFEEINRLIGEHQPQREALLRQVTNRVSLDLKSAKIKAETTGRPKHLYSIYQKMIVRGRDFNDIYDLVGVRILVDTVRDCYAALGVIHANWQPVPGRFKDYIAMPKFNMYQSLHTTVIGPTGKPVEMQIRTFAMHRTAEFGIAAHWKYKEQKGATIVGPPAHIDEMTWLRQLLDWQREASDPSEFLDALRFDLSSQEVYVFTPKGDVIPLPTGSTPVDFAYAVHTEVGHKCIGARVNGKLVPLESTLSNGDVIEIFTSKSSTAGPTQDWLGFVKSPRARTKIRQYFNKERREEAIEDGKDAIVKAMRKQGLPLQRMLTSENLTTIARDLHLPDVSSLYAAVGENTVSAQSVVAKLVAGFGGEEGAVEDIAETAVATRPPRNRSTAQDPGVVVKGVSDVWVKLARCCTPVPGDEVFGFVTRSGGVSVHRADCANAQDLREQEERVVEVSWKPTSASTFLVAIQVEALDRHKLLADVTRVLSEERVNILSATVTTTRDRVAVSRFTFEMADPKHLGHLVAAVRKVDGVFDAYRVTSGA

SEQ ID NO: 12763 - protein, 276 aa, Actinoplanes utahensis
MSSIKDRQRAAARARLEKEMAERATAAKNRRRRQAIIGSALAVVVIAGVAVLLVNHLKKDDKKPTAGASALPAGTVACTWTPAGATGGKVKEVGTPPTAVPNTGTSTLTLDTNLGPIEATIDLSKAPCTGASYKFLASKNFLDNTKCHRLVNQDGFKVLQCGDPFATGKGYRETDGQGGPGYMMAEENLPTDTNNPYPAGSIAMAKTQQPGTTGSQFFICADNTQLPPQYTLLGKITKGLDLVQSVVKAGDDGAFAQSAGGGHPKKELDIKTMTVS

SEQ ID NO: 12764 - protein, 289 aa, Actinoplanes utahensis
MAPSKDRQRKLARAKYDRQMARRAVRERQRRRVLAGAGTALAVVLVVAAGLWIGGVFDGKGKSTTTEAQDDCIWTPFDKSKNANLKEVGTPPTKNVPQTGTEQMTVTTDLGAPLVATLDVASAPCAAASFSYLAGKQFFDGTPCHEVLDIGAVHCGDPSGTGLGGPTYSYYDENIPDRPAPSASAGAGTVAKPTVLYPKGTVATIGNPAGSNGSQFLIFFKDYAPTAAPTYSILGQVTGGLDTLAKIAKIPTVADSAGDKVTPKEKITIKSLTVAADTVAAAPSASVQS

SEQ ID NO: 12765 - protein, 232 aa, Actinoplanes utahensis
MLVASFPAQAFGTNCYVVAAGPGEQCLIVDPGIGVLDRLDEVLAQHRLSPAAVLLTHGHLDHTFSVAPVCGARGITAYVHPDDREMLADPSKGLSTDLSSLFGGRLQYSEPDDVAPLTDGAVLSLAGLQVTVDHAPGHTGGSVLFRLPGAGSSWDAEELCLSGDVLFAGSIGRTDLPGGSTPTMMASLRDKILPLADDTVVLPGHGPATTIGRERASNPYLRDLTAAPGRFL

SEQ ID NO: 12766 - protein, 436 aa, Actinoplanes utahensis
MPISGFPEWLPPQRMIEQYALDKIRSTFELYGFAPLETRAVEPLETLLSKGETSKEVYLLHRLQEDESGKREDQLGLHFDLTVPFARFVVENHGKLVFPFRRYQIQKVWRGERPQEGRYREFLQADIDVVNRDTLPFHFDTEMPLVIGDVFRSLPIPRATILVNNRKVCEGFYRGLGLADTAQVLRTVDKLDKIGPDKVAAALVETAGATDAQAAACLKLAGISAADASFVDAVRALGVSDPLLDEGLAELEQVVVAANEHAPGLIRAELKIARGLDYYTGTVYETQLQGYERFGSICSGGRYETLASVGNTRFPGVGISIGVSRMLGLLFGQNAVSVSRTVPTCVLIALPSEEQRSVSERTAAALRRRGIPTEVAPTAAKFGKQIQFADRRGIPFVWFPGEPDTVKDIRSGEQVEADTATWTPPAADLHPVVTGA

SEQ ID NO: 12767 - protein, 173 aa, Actinoplanes utahensis
MTQTQASLVASRTRTFSWTDPAEHARLFVERSGLEVLQAMAAGEVPPPPIFQLIGGNRLEVEPGSVTITLDPQEFHYNPIGTVHGGIIATLLDTAAACSVQTTLPAGIGYTSMDLNVKFLRAVTVNTGLVRCTGTVLQSGRRTALAEARLTDARGRLVAHATSSCLIFDLPKA

SEQ ID NO: 12768 - protein, 187 aa, Actinoplanes utahensis
MPESGSWTQAGTRLLHLSTRPSLHGMVSHVTPPEALDWDVDNCTISRAMEILGEKWTMLVLREIFSGIRRFDDMRVRTRIPRQVLANRLTALVAAGVLRREPYQEPGARVRHEYRLTEKGFDLYPVLIALAGWGNRYLADPAGPPIQFVHRECAAEVDVAIRCADGHDVTDHRDVLPRPGPGARRRG

SEQ ID NO: 12769 - protein, 295 aa, Actinoplanes utahensis
MDARLLLIGGAAGPALLIRFVELAGSASARIVVIATASAEPAVAEESSVGAFRQLGAGSVRALRLASRADANAPAAAAALREATGIFFTGGDQRRITTVLGGTATDSLLQELVAGGTTVLGGTSAGAAMMSATMIIGGDGPGVTAASVQTGPGLEFLPGVLIDQHFAQRGRLNRLLSAVALYPHELGLGIDEDTAILTDGDRFEVLGSGAVTVVDAGAATDIRVPPSGPIALAGVRVHVLPAGHTFHLTGRRPGIGDTPHEDREPAPPARPQRVSVPAGGGGPVAPGGADRPGDL

SEQ ID NO: 12770 - protein, 945 aa, Actinoplanes utahensis
MKIESLRRLRGPNVYLSRPAVVARLRLEELTGRETSDVTGFTERLLRALPGLAEHHCAAGAPGGFVSRLRGGTYFGHVTEHVCLELSQLIGRDVSFGRTVSAGEPGLYDVILECPVDESPESRVPGELLEAAVDLVLAVQAGQAGQPPRLAELAALAEREATGPSTRAIIAAARRRGIPVERFDDLSLVRLGWGTRRRMAWAAMTDRTSGVGIDIAGDKHVTRCLLGEAGIPVAAGGAATTVEEAVRLLDELGAPVVVKPRQGRQGRHVVLGLGTREAVERAFGEAGGDVVVERQLAGRDYRVLMVAGEVAAAAERIAAHVVGDGTTTLAGLVERTNADPRRGPGHSRVLTRIALDEVALRVAGIGPDDVPAEGETVWLRECANLSTGGTSRDVTDQVHPDVTRLCQRVVALVGLDIAGIDLRLPDIGAPLPPAGETEPAGGVIEVNAVPGLRMHLAPVRGRSRDVGDAIVRAMFPGGSDGRIPTVAVTGTNGKTTVTRLTAHLLGGGGHRVGAATTDGVFVDGRAVYLADATGPRSAQQVLGDPQVDIAVLETARGGLLRRGLGYDWSDVGVITNITADHLGQDGLDSIEDLAHVKAVVAERVRDGGTLVLNADDPWVRSLASRPRVRADRKRLVWFGLDPGNPVLTEHLGRGGTAYLLQDGWLVQATGARRTPLLRVAEVPRGVRRRRPARRGQRARRDRGGPGPGCPPGDRGGPAQRVRPGRRQPGPGHPAAARRRLGLPGLRAQPGRARRHPAYPAPALGGEPVRGRGDAAGRPARRPAGRVRPDSGGRADPGRALRRPGPAGTRAGGGAGAGRAGDAGPPAEPAGGPRERVPGGGDHRAGSGRDGRRGAGDLREVGADAGLPDRAGRRPGRCPADDAGHRRGASHPTTGVKQCDRSWTFLISLRSDSLTDRVCLHDGVTRYLKQQVPTKRAIPRSARGAA

SEQ ID NO: 12771 - protein, 313 aa, Actinoplanes utahensis
MSTADLPGSGLLAGRYRLVERLGAGGMSVVWRGFDEVLGRQVAVKVLPPSTSADPSFRRRLRAEAQAAARLSHPHITNVYDYGEASTVDGEPVPYVVMELVDGESLAAVLARVRTLPWNQAVRISADVAAALAAAHARGIVHRDVTPANVMLTPAGAKVVDFGISALIGENDTDPDGSLLGTPAYLAPERLEGGQVSPATDVYAVGLLIYRMLIGQLPWDVGTTTALLRAHQYVEPDPLPPVDGLPREVDALVGRCLEKRPADRPPTAEVAHLLAGVAAGAQAAAATGFRGDWEDSGEDTTILPSGYPYAGMG

SEQ ID NO: 12772 - protein, 286 aa, Actinoplanes utahensis
MSPSAPADDRSPAPGRRQVRTRRALVVAGTIAVMSALTYGWSLAAPGAGDKRADAVTPGPSVVPAAGNCIVSYAVWSQEKGRFKAQVTLANRGDKPVDDWQLWFLMPGDQILSGRSLTQDQRAVTVHSASTLAPQQNTTVEIAGRFAKSNAAPMLFQLNGKTCQAYVSSSPGQPSRPVEQLSDGSVRLGDPASDSTPAPGISIDPVGIVHITPSTLPARPSTIPLPGSSSTATGGGGSTKPSDGASDTVQPEPAQSPTSKAPVEQPSNPPPGLPGASLDGCDSQDC

SEQ ID NO: 12773 - protein, 83 aa, Actinoplanes utahensis
MISIVKDLAAEALFVSCLQPSEYPTRRALEDAITSTLLQYGSDGCAAGVAAEFGDHPDIAVRRMRWVQAELAEVITFRAPALH

SEQ ID NO: 12774 - protein, 338 aa, Actinoplanes utahensis
MKKLHKSNRVRPSLHPTATTVLLVSRFHQPVSTSEEDYVTATTELPATIGVIHDAPSARDIEDLIREHMPMVGHLVRELLNRVPGHVHADDLSSAGFAALLGAARSFDVTRGIPFHRFAAVRIRGALLDELRGQDWASRSVRARARRAATARQELTAALGRTPSDAEVAEMLGVGISELASVEDDVQKASLLSLQGFPTGAAEEMVPELSEGPEDLLLKRERLGYLHQAIQALPERLRQVVEESFLQEQPLSEVAARLGVTESRISQLRTEALRLLREGLNSSLAPELLTVAAGGPRTRKGCLQRRRSEYFAKVQQQGNLHTRLALTDSHGVPIAVAA

SEQ ID NO: 12775 - protein, 362 aa, Actinoplanes utahensis
MSTAPDRHAVGHDVSVRAIVIDSARARPEVREVPEPTAPPGGVVVRVMATGLCRSDWHGWAGHDDDITFPHVPGHELAGEVTAVSPGVTRWQPGDRVTVPFVCGCGRCDWCRTGQAQVCPAQQQPGFTHAGSFAESVALHAADTNLVAIPAGVSFTTAASLGCRFATAYRGLAGRARVTAGEWVTVVGAGGVGLSAVMIARALGARVIAVDRNPRALAAAAAIGAGHTVLTGAGVDVPGAVAELTDGGSHVSVDAVGSEQTCADAILALRRQGRHVQIGLLPPVGGHPRVPMSRVIGWELDVLGSHGMAAADYPAMMALIEQGRLRPDRLIERTVGLGEAAALLPGFDQATVAGMTMIDPAR

SEQ ID NO: 12776 - protein, 522 aa, Actinoplanes utahensis
MTSLDRGRYAALYGPTAGDRIRLADTDLLLEVEEDRSAGPRPGDEAVLGVIRESVGQSRAARADGTPDTVVTGVVVLDHWGVVKADVGIRDGRITAIGKAGNPDIMDGVHPDLVIGASTEIITGNGRILTAGAVDSRAHLIRPAVLDAAVAAGITTVVGGGTGPAEGARGATVTPNVWHLARMLAAIDTFPVNVLLLGRGDTVSPEAMWEQLRGGAGGFALHEDGGCTPAAIDACLRVCDASGVQAAIHAGTRNEAGSVDDTVRAIGGRPVHAGAAAAMITVAAQPNVLPSSADPAGSATPATDLLHDLGAVSMIGSGATGRPGEVILRTWRTAHAMKAWRGPLAGDGSSDNNRIRRYVAKYTICPAIAHGMAAQVGSVEPGKLADLVLWDPAFFGVRPVLVLKGGMIAYAQTGDAAASTLPPQPAMPRPMFGAHGVVPAHTSLAFVAPAAIDALLSDRIGVRRALVPVGDTRAAGKADLPLNDAMPRIEVHAGSGEVRVDGEVVQPQPVTEMPLAQRYFLF

SEQ ID NO: 12777 - protein, 135 aa, Actinoplanes utahensis
MIPGEVLAGDGDIVINPGRVTRDLTVRNTGDRPVSVGSHFHFAEVNTALEFDRAAAWGHRLAVPAGTSVCFDPGAAREVVLIPLAGNRVVPGLRGLAGGPLDTLPPPAEPDPADIEPAGSLDEDTGEAQPNGSPR

SEQ ID NO: 12778 - protein, 100 aa, Actinoplanes utahensis
MFLSRHEQERLLIHVAADVAQKRRDRGLKLNHPEATAIITAFLLEGARDGRSVDELVAAGGRVLTRDDVLPGVPEMIAEVRVEATFPDGPRLIAVPGPIA

SEQ ID NO: 12779 - protein, 738 aa, Actinoplanes utahensis
MPTPGELLGGRYRLDDRIAAGGMGEVWAATDAVLGRPVAVKTLLGDHGTDPGFLNRFRHEARAMAALRHPGVVAVYDFGDTGDGAYLVMAHVAGQPLNRVIADRGHLSVAETMSIVAQAGRALQAAHEAGIVHRDVKPGNLIIEPDGTVVLVDFGVARSANSMTLTGAREVVGTALYIAPEQVSKQATGPAADIYALGALAYHCLAGRPPFLGDNPLAVALQHVTDEPLPLSRDVPRQVRDLVGTALAKDPAERFPSAAAMAAAAEVAAQEIAGGGVAARTGASLAALSAAPGSMPGFPAAAATSGSIPGTPTAAATPGSTPGTPTAAATPGSTPGTPTAAATPGSTPGTPAAATAIDATAGSGTMPDRPGQTTSATPGISDGSAAESAGIGTGGQNTAARTDIAEQNQNTAARTGVAGQARNTEAGAGGGGRDDVTQAVAAAAGAGIVARAMVGAPRYEDRPPVGPVRDGHTMADGGFTALDVASAPGATAAPQSGANPRSDVDPRSDVDSPVVAPRRAGIGATSLAAGAAAGSAVANGGAGRPGGRFATGGNAPGTSQGEASLPAYETAGRAAASGATVGRADGGAGAGGARRGLVVAGVVLLVLLGLGAVVALADPFGWFGDEPSGGAPGGAVKPSAVVSHRPSTGAVKNGGGHSSQPRRSSAPALPGGNATAPTGAATGKPTPTETAGGETSAPAEDPTTAQPTETSKDDSGGTGGGEDNNDSGSGKSGSDTEN

SEQ ID NO: 12780 - protein, 126 aa, Actinoplanes utahensis
MPKRAVMTDKAAPVGGPYSHAVVAGDTIYLAGAIPALPDGTRVTGTFAEQAHAAFRNLAAVAEAAGASLDDAVRVGVYLRDFGDFAEMNEIYQQYIKGEHRPVRTTLPVPLVGFDIEIDAILYVGD

SEQ ID NO: 12781 - protein, 418 aa, Actinoplanes utahensis
MTFDILLTGGTLLPAGPGPAGVRRNIGDVAIRDGRIAAIGPALPRDAHRVVDVSGRLVTPGLIDLHTHVGPGYWGIDPDPVAWHSGVTTWVDAGSAGAYTLDGLRRVAAAATVRVPALLNISAIGLAGRTGESRDLATCDVPLAIDTIQTHRELIRGVKVRIDRDTVGDNGIEPLRRGLTAAEACGVPVMVHIGTAPPRLDEVLDLLRPGDIVTHCASGIAAPLGPAVHAAAGRGVLLDLGHGSGGFAFDVLQAQLDAGLMPHTVSTDLHARSLYGPVFDLPTTMAKLLAVGVPLPEVIAAATVHPARALGLPGGTLAIGAPADLAIFRVRDEEFPVVDAHREVRISPVRLVNEATYVGGALLPPRLPAPPAPWIPLTEAQRAALDQRARHIRDLLATPLVGVDGLAEQFPRDQPRSS

SEQ ID NO: 12782 - protein, 474 aa, Actinoplanes utahensis
MARSSCLLDLRSVFQHATTSHIRTTRRDAMIIGIVVHSGQRGRFTEAARTLTGVSFAWAVYEREEEIRDRVTTLLAAGPLDGLLLGPVPHARAGDLVPPGLPVAITRAAALDLALAWARARGNGWPATPVSIDTFPDETVTEVADALALDRSAIATLPFRPEQPIAEVVAFHQEHLARTAAPYVITVRTGVAAALDGRTAVLQAMATPGTVRADLHDLVSRVRGQQADGQRFAAAVFRAPAPGAREALRQALSALPELADAWIDEHGPRAVIAFAPAGVFETLTSHWVSLPGGFHRGRRDHGQPGEPPAAEPDATVEDPAGPAVGFGIGASARSSVALAEQAADRAERAGSTSGYLITEDGVMIGPIGAADPPLAYSYREHGGLEELAVRAGLSAATMSRLAALERSLAGRAITPGELARALGITDPSGRRLIRKLGEAGLVAGEGSAQPHHKGRPTRLYRLTIQAALTAGGAG

SEQ ID NO: 12783 - protein, 542 aa, Actinoplanes utahensis
MNEPLTSIVPRPARVTSGEGAFHLGPGTALDAGPALTGVAAWLRGALGRVIGGHLLPGPDGIRLRTVPELAPEAYQLEVRDTGIEIRGGSPAGVFYGAQTLRQMLPPVTLRRARLTDGPWTIPAGRVDDAPRFPWRGVMLDVARHFMPVADVLRLIDLIAFHKLNVLHLHLTDDQGWRLEVPGRPRLTSIGAWRPATMLGSRRHERFDARPHGGFYSDDDLREIVAYAADRHITVVPEVDMPGHMQAAIAAYPELGNGFSGDVRAGWGISPHVLNLGPEALDFCRTVLDHLCDLFPSELIGIGGDECPADEWHDSPVAQARIRAEGLGGPDRLQPWFTTRMAGHLATRGRRVFGWDEILAGGAPPGAVIAAWRGPGPAAHAARAGHPVVSCPDMSVYLDYRQSDDPGEPTPVGTRLTIEDVFAFDPVPPGLTPAETALVRGGQANLWTEHMESARRVDYQAFPRLCAFAEAVWGPAERDFTEFIRRLPAHLERLDALGVNYRPLSGPRPWDARPDAPGNPRTRNDRLAELREMTADLERERS

SEQ ID NO: 12784 - protein, 305 aa, Actinoplanes utahensis
MVEIALPDSFTRRVAQCWGAPGTRWLADLPEIATRVLHDWDLHLDRPCPLSLNWVTRVRRADGSAAVLKMGIPGADHLSDEAAALEFFAGRGAVSMLAHDAARGAILLEEVRPGRPARSLVPDRDEDATAALIGVIRGLHRPAPPGIALPELAARRATFDEHLRRFPDDGPLPRHLVERAGRLLTELCETAIERVVLHGDLHHDNVLAAGREPWLVIDPHGLTGDPGYEIGAMLYNPYPMDDDTVLRLVPGRIEQLADGLDIPIERVVAWGFVQAVLSEVWNATGDGIATGRPLRLASLLLPRLP

SEQ ID NO: 12785 - protein, 396 aa, Actinoplanes utahensis
MTIDWRSKGFWLPHGGRTAEQIASERPSIFGGGFTWPLLVIRQAAVEANIATMAAYCRRHGCDFAPHAKTTMAPGLLEAQLRAGAWGLTVATANQALVLRRLGVQRVLIANQVLDPIALRWLAGESDAGWEVYFQVDSLAGVRAAAAAGRIRVLVELGHPGGRTGVRTLDELDRVARAVAAAPGVELAGLTGYEGQLADLAEVDTYLDRLAAGFEQLSAAGLLPEEPIVSAGGSAWFDRVTDRLKALAPRARLILRSGASVTHDDGFYRERTPFVRVPGEGPLTAALEVWAQVLSAPEPGLALAGMGKRDAPFDEGLPVPGEVRRPDGTTAPADGLRVTRLNDHHTYLQVADGTVVEPGDLVRFGISHPCTAFDKWRDIPVVDEQRRVVDVLHTYF

SEQ ID NO: 12786 - protein, 250 aa, Actinoplanes utahensis
MGRKVRSMGWEGLWQWGDDVARLEPLAEGVANDVWTVRVGGRVAVGRLGVRSDADLAWETGLLGHLHRAGLTVPVPIPTVDGRLFAAGLVVMTHVEGGPPETRDDWRRVAETLHKLHRLTRDWPQRPGWRSSGDLLHAETGTRIDLRAMPPEGVARCRAAWARLVGRPTCVVHGDLNPGNVRMTGERVALIDWDESRVDVPELDLVLPDNAAGLDDGLYDVAAQASAAWEAAVCWEDDYAVRRLAEVRAR

SEQ ID NO: 12787 - protein, 173 aa, Actinoplanes utahensis
MRSGGLPRCEPAESALQGNSVAATRWSFVVRRGGHGPGIAVPGCEKRVTEDVDLGTLGGVMETMTLWRPTGPEEWELVRASGRKRWPARLPDQPIFYPVLNEDYAVKIARDWNVAASGVGFVTRFEIDAAFAARYPVRQAGGNTILELWVPAEELAEFNDHIVGTIEVVHEFR

SEQ ID NO: 12788 - protein, 98 aa, Actinoplanes utahensis
MSGGRAGLRLPAAAGRGHDRPGFPAAGSSCFLFPAADGPGLLPAADGSWLRLRVVDESCMLLPAADGSWLRCRVAGRPLLRHRATGGSGLRLTTADGS

SEQ ID NO: 12789 - protein, 130 aa, Actinoplanes utahensis
MTYAKEALDVRIGCAAVVYLDLDEPRAGVGAQIGDLRYDSRCGNGPARLSLGAGATAGSSVARTDLDDDGCLRAIRNGPLEPGAAVNVRVGTALCVLTAAQPAKLVLVEIAGVGVTGNLSLRATSWLAPA

SEQ ID NO: 12790 - protein, 600 aa, Actinoplanes utahensis
MIRTHDAGSLRATDAGTTVTLAGWVARRRDHGGVIFVDLRDASGVVQVVFREEDAHALRNEFCVKVVGEVNARPAGNENPDLATGAIEVVASELTVLSEAAPLPLPIDDAVTASDDIRLKYRYLDLRRSGPAKALRLRSRANQIAREVLHAHDFNEIETPTLTRSTPEGARDFLVPVRLQPGAWYALPQSPQLFKQLLMVAGMERYYQIARCYRDEDFRADRQPEFTQLDIEMSFVTQDDIIALGEEIVAKLWSELADYQVQLPIPRITWTDAMNRYGSDKPDLRYGVELIELTDYLRGTEFRVFAGAIDAGGYVGAVVMPGGASQTRKELDGWQDWAKARGARGLAYVVLDAETGAPRGPVAKNLSEAHLAGLADAVGAKPGDAVFFAAATERREAQELLGAARIEIAKRAKLIDESAWAFCWVVDAPMFEKTDEGGWTAVHHPFTSPNDEWLDNFESAPDKALAYAYDIVVNGNEIGGGSVRIHRGDVQSRVFDLLGITPEEAQDKFGFLLEAFKYGPPPHAGIALGWDRTCMLLGGFDSIREVISFPKSRGGFDPLTGAPTPITAQQRLEAGVDAKPKAAAGTPGTDGQAAPVERSN

SEQ ID NO: 12791 - protein, 174 aa, Actinoplanes utahensis
MRGRRCFVRLVGVEPTIVQCAEQPYVGRRESITMTEFARVADHLPTMFAGLGRRGVRVSGAPFFRYRVIDMAAEMVVEAGIPVTGPVTVEPPDFIDTLPAGRYATVSHVGHPDQLMAVTARLLDWAQRRGLTWDMTPTPTGERWAARLEMLMTNPAEQPDMHKWETVLLFKLAD

SEQ ID NO: 12792 - protein, 191 aa, Actinoplanes utahensis
MADKLIEVRLTGPQIRALAQPLRLRLLGRLRQAGPATATRLAADLDTNTGATSYHLRQLAEVGLVIEEARPGSGRQRWWRAAHDTSHFRRSYYEDDPEATAAAEWLETYQVSHFAQAAENWRRALPGEPESWQNAAGISDYTVHLDAARTEAMMREIEAVIERYRQAGQDDPRPGTRPVMVVAAALPRVAS

SEQ ID NO: 12793 - protein, 426 aa, Actinoplanes utahensis
MSLPARQVRLRYLILITLRWLPVGLTIPVLVLLPLERGLTIAQAGVVTAVQGVTVMVLELPTGGFADALGRRPVLLLAGAVNLVSLSLYCVAHTVGFFAVAWMLQGVFRALDSGPLDSWFVDESLAADRNADIETGLSHGEVVLSLGIAGGALISGGLVWLGPIGPVSALTVPVALSILLSLLSTVAIAVLMHEERPALGLAALSASIRGVPIAIGSALRLARRSRVVLALIAVEILWSFGMVSFEKLMPIRLSEVLADKDAAASLMGPVSSAAWGASAAGAALIPLLVRRIGAPRTGFTLRLLQGATVVGMGVLAGPAGVVTGFLLTYAVHGAANPVHNALMHRQAEGEYRTSLLSLSSMASQPGFAIGAILLTAVAQSVSTSVAIVAGAIVLAAAAPLYLVKPKFHEPIDGGTSLTSALTPGGT

SEQ ID NO: 12794 - protein, 594 aa, Actinoplanes utahensis
METDGLFSLAQPDLPPPAHTAAAAGFGAPAADAPLPVRMRPASLDELVGQQHLLAPGAPLRQLVTGASPMSVILWGPPGTGKTTIAHLVAHATDRKFVAMSALTAGVKDVRAVIDTARRERRAGGPPTVLFIDEVHRFSKTQQDSLLAAVEDRTVTLLAATTENPYFSVISPLLSRCVLLTLQALEESDVRALIRRAVTDQRGLGGAVTLSPEAEDHVVRLASGDVRKALTALEAAAGSAVAQGSAEIDLATAERAVDVAAVRYDRDGDAHYDVISAFIKSMRGSDPDAALHWLARMIVAGEDPRFIARRIVIFASEDVGMADPQALLVATAAAQAVQLIGMPEAQLNLAQAVVHMATAPKSNSVTAAIGAAMTDVRAGRGAAVPTHLRDAHYSGARGLGHGRGYRYPHDDPRGVVRQQYAPDDLVGTDYYRPTEHGAERAVGERVPRLRRIVRGLPRAASADSADRAAGGATAPDASQSSAASSPEAGGAGGSVAVSASVPASLPVAAGGPAPVADGGADSGPAAVLADGGAPGAGSDLASGGVAVSASAGTGGTEGSAGTATGSGTAQAGPDAGSDGERSDERGDAAGEEQP

SEQ ID NO: 12795 - protein, 412 aa, Actinoplanes utahensis
MPGQRGGPMPGGQPAPQGQVPPGGRPGPQGQVPPGGRPGPQGQMPLGGRPGPQGQMPPGGPSGPQGQMPPGVSMPQPGGPVPGGQQDTGRAGPHQMPPGQMPSGAMPPARRGGPGAPVSPGARSGGPVPPGARAGVSPEPGAGRRQVDPGQPGFPAQAGPAGQPGYPDPSVSPAIPRSGNAPEIPGVQAGGPDPRGMTSGVRPVSPGVRPTSPAAPARDRFRAAAAPAPVDVQPSGPIPPAVYQTGPIPPVGGGFPPDTVPPSVYRTDTVPPSVYQTGPIPVGPTSGGPGADDPGGRARGRNRRSRAESGPNAPAEVYGARPADGFQGRPGSGAQGPHHAPDGVYGGTGPQPVSGAPVPHAAPDSSTPGAPNGPRGGAARPTSGSHAAGPDGTRGGSARPVSGSHAAGPEGT

SEQ ID NO: 12796 - protein, 604 aa, Actinoplanes utahensis
MVVPLVPFPVRTRSRRIGSAWLPVPRVAPPAAVRVVRPVRTPGTMAPGDTRRRARPVPTPATSTSDGMRQPVDPAWPADRGCPVDRGVPADPECRAGPGRSVDLRCLADPECRAGPGPPVDLGRPTDPERPTASERPTDPGCPTDPGCPTDPGCPGVPGGPGVAGGPGRPGVAGGSGTPDGPGGPGAAGMPGAGVPGPRRTGPGDGRPIRAAAAVPPPVVPGRQGKRSPAMPGRAGAMAESTSGVIQPPAPRGGNGQLQPDEDGFTTDRRSQTGSIIPGQGSVSVPGQPGPGRRGRGEPQDARVTADTSAGMGSPERSQGFPAGAGSPEQSQSFPAGMGSPERSQGFPAGAGSPERSQGFPAGMGSPERSQGFPAGMGGPEQSQSFRAGLGGPEHGQAFPGGAGPESSQAFPAGAGGPEPTSRGRRRRAVPEQGAGDGRGPRRDQGSPAGRHGAEPEYGQDFPGEAPTGRHGQGPEQSQGFPAGTGTPSGPVSPAPGPRGGGPRRGGGAATAGAAAAGAIPGLEGPGSASTRIPGNGAPRNVPGGPGRGAAGVPGTGSGGPGRGAASMPGNGPGGVTGVPGGGPGGPGRAAAGVPGGGPGGPAS

SEQ ID NO: 12797 - protein, 359 aa, Actinoplanes utahensis
MPGGAPVPATGKGTGKASVPGQGRNDGFGPGSGDGFGPGSGDGFGPGSGDGFGPGNGDGFGPGSGDGFGPGSGDGFGPGSGDGFEGGDGSGSGDGDGFRDEGGKGTGTIAVARAGSAAGVPRNRTGMDSGPGGEPERGLSELRQKLRSQRRLRLITLTTLAAVVLLVLPAFFGIRAVSSDPVFASLDALNVPSWADQKPDDKNSGSRWCFGDCRFRERTTESQRPFKETTEAYSKALTEAGWSPWKVAGCPESPIKAEEGTYTCWRRDEFTLDLAVGLPGCAVDQVAADALPDAGTDQAEAGTKGAQKCADGSTVSIKVRDEITDERGKVDQHPGPVGATPDPVLNQNDPLLQPTPQAS

SEQ ID NO: 12798 - protein, 149 aa, Actinoplanes utahensis
MNAGEIAGLIAAGAFLMLVVVLAFPLLKLGRTIDAATRGINEVVDRTGPLLGNVNTTVENVNTALGQVQVSLDGVNLQLAKVDTMTEHVQNITANVANLVTVVSAAAANPLVKVASFGYGVRKAARARSAAEEDREVRTEIKRRRKATR

SEQ ID NO: 12799 - protein, 96 aa, Actinoplanes utahensis
MKRLLWLGVGLAVGALVVRKLTRKAEEFTPTGIATSLSQSAGGLVESLRSFVEDVRDGMAEREQQIHEAFAEGVLYEDKFAELRDDTRPGSQEGNR

SEQ ID NO: 12800 - protein, 893 aa, Actinoplanes utahensis
MKTAEVKRRFLAHFEANGHTVVPSAPLPAIDDPNLLFINAGMVQFVPFFLGQRTPPYQRAASVQKCIRTPDIDEVGKTSRHGTFFQMNGNFSFGDYFKAGAIPLAWELSTKPVDQGGFGLDPEKIWATVYLDDDEAIEIWKQTGLPAERIVRRGNKDNFWSMGIPGPAGPCSELYYDRGPAYGKEGGPEVDEDRYLEFWNLVFMQHEITDVRSKEQFTIVGDLPKRNIDTGMGLERIASILQGVDNLYEIDEVRPILARAAEMTGKKYGAHSGHAASESHPDDVRLRVIADHVRTALMLIGDGIVPSNEGRGYVLRRIMRRAIRSIRLLGWQGPAFTELLPIARDCMSPSYPELAEEFGRISTYAYAEEDAFLSTLKAGTTILDTAITETRAANKTQLSGDQAFKLHDTYGFPIDLTLEIAQEQGLQVDQDGFRRLMAEQRKAAKADAAARKTGHADLSAYRSALDAGGTVEFTGYQEISRESRVRALIGAKGRVEVAGEGETIELVLDTTPFYAEGGGQQSDTGLIKVGGGQVEVFDVQQPIPGLIVHKARVVQGEVRAGESGLAEIDVTRRKAISRSHTATHLVHQTMRNFLGESATQAGSLNAPGRLRFDFHTPGAVNPSVLFDVEQQINEVLLRDLEVNAFITSQEEARRLGAMALFGEKYGDEVRVVEVGDYARELCGGTHVARSGQLGLVKILTESSIGSGVRRVEALVGIDAFGFLAKEHLLVSRLADLFRVPGDQVADRVEQTVTALRDAEKELEKLRAQMVLAGAAGLVDQAKELRGVAFVGTEAPEGAGGNDVRTLAQDIRGKFDPARPAVVAVTARSGGKATLIVAINAAAKGRGLSAGELVKGALSGRGGGNADLAQGGGVPAAEAPNLLAAVEKALADAN

SEQ ID NO: 12801 - protein, 153 aa, Actinoplanes utahensis
MTHGFTRGVRLGVDVGQVRVGVAKCDPDGILASPVVTVARDQQAGEDKLPTDLAELVALVEEHEAVEVVVGLPVALNGREGVAAGHVRAYAQRLGALVAPRPVVLSDERMSTVVASRRLSERGVRGRRQRAVVDQAAAVEILQGWLDAQRRQT

SEQ ID NO: 12802 - protein, 393 aa, Actinoplanes utahensis
MSDNDLDPMFEGAEDPGRWRHRKKERGRGRTIMALTLVLLLFGALGGVGYIGFGKIRSFFTVEDYDGPGTGEAVVEVKSGNTATDIANTLFKAGVVKSAAAFVDAAKDDPKSKDIQVGTYLLKKEMKAKDALAMLLDLKNKNVNKVTIPEGLISLQIFDRLSKSTGIPVDDFKAAAKNVQKLGVPSMWFKRRDGKKVDPSKIEGFLYPATYEFPKDAKAEDILKIIITHFNDEMTKLDFANQASKLNISPYEALVAASIAQVEALLPQDMGPVARVLYNRAYTGEFPCSCMQLDSMVNYYLRISGKDAKASENLLRKELHDPKNPYNYDAKGLAITPISSPGEVALKGAVTAPKSNYFFFVTIDKKGTMAYGRTNDEHQANIRIACQNGIPIC

SEQ ID NO: 12803 - protein, 395 aa, Actinoplanes utahensis
MLDDLDSVLAEEQQPQPDAPRHKRGRTGRSAIAFFLSLVLLALLAGGGWLVYSKVKGFFVADDYSGPGGAETIVQVQSGQSATDIGNTLYQAKVVASAEAFVDAAKDNNRSKNIQAGWYRLKVQMKAADALTLMLDPKSRWVTRVTLPEGLSYQQTFQKLSEATKIPVAEFTKAAKDPVALGVDPSWFTRTDGKKADKTDIEGFLFPSTYELSPKADATDVLKTIIANFNTQMDQLEFVSTVQKTRGGISPYQALIVASIAQAEALKDEDMPKVSRVVYNRAYGDFACHCLGLDSTVNYWLRISGKGSKASEKLTNADLHDPKDPYNTHDKPGLPPGPIGNPGLGALKGAMSPTENFPYYYFISVDTKGTMAYGKTGDDHERNRQLACHNGIPLC

SEQ ID NO: 12804 - protein, 286 aa, Actinoplanes utahensis
MQTTSSRRAAVLGKPIAHSLSPVIHRAGFAAAGLTGWTYEAIECAEAELPGLVAGLGPEWAGLSLTMPLKETALTLAASATPAAIAAGVANTLIRQDDGGWHADNTDIPGMVRVLRAAGLGAGTGRHAAKEAPPRITVLGGGGTARAALAAAAELGAEVVTVVTRRPEARAELEPVAGALGVKLDGAPWSAAALDADAVISTVPKGAADALAAEVTWRSGGVFFDALYDPWPTPLAASAIAAGVTVVSGLDLLLAQALSQFEQFTGVAEAPEEAMRAALDEAARNR

SEQ ID NO: 12805 - protein, 392 aa, Actinoplanes utahensis
MLRWLTAGESHGPALVAMLEGVPAGIEVTSADITRDLVRRRLGYGRGARMKFEQDEVEFIGGVRHGLTLGSPVAIRVGNTEWPKWETVMSADPVDPDVLAAQSRNAPLTRPRPGHADLAGMQKYGHTDARPILERASARETAARVAVGVVAKQLIRQALGIEIVSHVIELGSVAAKTGLIPTLDDFDRIDADPLRCLDPEASARMVAEVDAAKRDADTLGGIVEVLAYHVPPGLGSHVQWDRKLDARLATALMSIQSVKGVEIGDGFTQARSRGSVAHDEIVPTADGVRRVTDRAGGLEGGITNGEPLRVRAALKPISSLNRALQTIDITTGEPATAINQRSDVCAVPAGAVVAEAMVALVLAEAATEKFGGDSVAEIRRNLASYRDNLVVR

SEQ ID NO: 12806 - protein, 167 aa, Actinoplanes utahensis
MPPRAVLVGPPGAGKTTIGEAVAATLGLSFTDTDTIIEQRAGKPIPDIFVEDGEPTFRTLERTVVAESLSSFDGILSLGGGAILDETTRALLKDHTVVFLSVELADAIKRVGLGAGRPLLAMNPRATMKFLLEQRRPLYTEVATHTVLTDGRGPEEIAPEVAALLRA

SEQ ID NO: 12807 - protein, 388 aa, Actinoplanes utahensis
MDIRRRGPPDGTAHLAEPRRAQRTEARLADRVTAVVTRIPVHGDRPYDVIVGRGLHDELLPMIDGAARVAVVHPAALRERAEAVAKAVGGCTVVPIEVPDAEKGKTVEVAARCWDALGAAGFTRTDVVVGVGGGATTDLAGYVAAAWLRGVRWVPVSTSVAGMVDAAVGGKTAVNIAAGKNLVGAFHPPAGVICDLDALDTLPAEDIAAGLAEVVKGGFIADPRILELIEADPDAALDPRGEVLRELIERKIRVKADVVGVDLQESGLREILNYGHTLGHAIERRERYTWKHGHAVAVGMIFAAELGRLSGRLDDATAGRHREILVRLGLPTSYDRHAFGELEAGMRVDKKTRAATLRFVVLDGLAKPGILTGPDDDLLRRAYAAVAR

SEQ ID NO: 12808 - protein, 139 aa, Actinoplanes utahensis
MIYVLNGPNLNRLGTREPDIYGTTTYQDLVDMCRTVADDLGREIAVRQTNAEYEMLGWLHEAADEGADVVLNPGAWTHYNIAIRDACAMLRGKLIEVHISNVHTREEFRHHSVISAVATGVIAGLGIDGYRLALEHICR

SEQ ID NO: 12809 - protein, 185 aa, Actinoplanes utahensis
MASTNDLKNGLVLNLDKELWSVVEFQHVKPGKGPAFVRTTLKHVLSGKVVDKTFNAGTKVETATVDKRTMQYLYQDGDDYVFMDLDTYEQIHVPGATVGDNANYLLPEAEATVALHEGVPLYIELPTSVFVEVTYTEPGLQGDRSTGGTKPATIETGATVQVPLFITTGEKIKVDTRDGRYLGRS

SEQ ID NO: 12810 - protein, 144 aa, Actinoplanes utahensis
MAEGPKKERLARRKARKRALDVLFEADMRDLPPSQVLVTYLDRIAKPHPEHLAYAITLIEGVAKNIDRVDELIASYAEGWTIDRMPVVDRNLARIAVYELLFEPDVDDPVAITEAVELAREMSTDDSPRFLNGLLDRIAAFATR

SEQ ID NO: 12811 - protein, 162 aa, Actinoplanes utahensis
MPSEYAKSLGARLRSIRQQQGLSLQGVEEKSNGRWKAVVVGSYERGDRAVTVSRLAELADFYRVPVSELLPDGSGIRLEATNKIVLDLEKLYDTTGEDLAYVARYARAIQQQRGDYNGRVLSIRADDLRALAIVYDISPSGLIERLTEQGVLVADPRAFFAS

SEQ ID NO: 12812 - protein, 215 aa, Actinoplanes utahensis
MIKACATGNVASARHPLTTRPVRRGRRSAVAQPRADAPSKIILAGSDLSRVVDRIAHQILEKTSGATGTVLLGIPTRGVPLAHRLAARIHAFEGVEVPVGSLDITLYRDDLRLKATRALGRTELPPGGIDGLRVILVDDVLFSGRSVRAALDALKDLGRPSSVQLAVLVDRGHRQLPIRADYVGKNIPTALSESVKVALTEVDDADEVRLIGGLQ

SEQ ID NO: 12813 - protein, 306 aa, Actinoplanes utahensis
MIKHLRSAADLDAATATLILDTAAEMAALSGREVKKLPALRGRTVVNLFYEDSTRTRISFEAAAKRLSADVINFSAKGSSVSKGESLKDTALTLQAMGADAVVIRHAASGAPHRLANWVEGSVVNAGDGTHEHPTQALLDAYTMRSRLGRLDGLNVAIVGDVLHSRVARSNVLLLTTLGARVTLVGPPTLIPVDIAPALSKETRVSYDLDSVLPDSDVVMMLRVQTERMQDSYFPSAREYSRRYGLDMTRMRKLPEHAIVMHPGPMNRGMEIAPEVADSPRSTIVEQVANGVSVRMAVLYLLLGGK

SEQ ID NO: 12814 - protein, 422 aa, Actinoplanes utahensis
MAYLLKGVSILGAAPTDLFIDNGVIAERTAEADPVVVEAAGLVALPGLVDVHTHLREPGREDAETVETGSRAAALGGYTAVCAMANTSPVADTAGVVEQVWRLGREAGLVDVQPIGAVTVGLAGKQLAELGAMATSAATVRIFSDDGFCVADPKLMRRALEYVKAFDGVIAQHAEEHRLTEGAQMHEGEVSTRLGLTGWPAVAEEAIIARDVLLTEHVGSRLHVCHVSTAGSVEVLRQAKARGVRVTAEVTPHHLLLTDELAAGYDPVFKVNPPLRTAKDVTALRQALLDGVIDVVATDHAPHAVQDKECEWSYARPGMLGLETALPILLSVFGEQWDLIADRMSVAPARIAGLSGHGGDLTEPGTPANLTLVDPSARWVVDPGALASRSRNTPYAGMTLPGRIVATFLRGEATVLDGKAVK

SEQ ID NO: 12815 - protein, 368 aa, Actinoplanes utahensis
MTKAILVLEDGRSFTGTAYGAVGETFGEAVFTTGMTGYQEVLTDPSFHRQVVVQTAPQIGNTGVNDEDDESDRIWVAGYVVRDPARRPSNWRATGDLGERLAAEGVVGISGIDTRALTRHLRERGAMRVGISSLDLDVQALRERVKAQPQMLGADLSAQVTTGERYTVPAEGEHRYTVAALDLGIKRNVSRRLAARGVTTHIFPANSSIEDLLAVSPDAVFFSPGPGDPATADGPVALAREVMNREVPLFGICFGSQILGRALGFGTYKLGYGHRGINQPVLDRTTGKVEVTSHNHGFAVDAPLDEVLTTDFGRVEVSHVCLNDNVVEGLRGIDVPAFTVQYHPEAAAGPHDADYLFDRFVELVEKKG

SEQ ID NO: 12816 - protein, 1105 aa, Actinoplanes utahensis
MPKREDLKHVMVIGSGPIVIGQACEFDYSGTQACRVLRAEGLRVSLVNSNPATIMTDPEFADATYVEPITPEFVELVIAKERPDAILPTLGGQTALNTAIALHESGVLDKYGVELIGANVEAIRKGEDRQLFKDIVAKAGGETPRSRVCHSMDEVRATVAEIGLPVVIRPSFTMGGLGSGMAHSDADLEMIAGAGLAASPVHEVLIEESVLGWKEYELELMRDRHDNVVVVCSIENVDPMGVHTGDSVTVAPALTLTDREYQKLRDLGIAVLREVGVDTGGCNIQFAINPDDGRMIVIEMNPRVSRSSALASKATGFPIAKIAAKLAIGYTLDEIPNDITLQTPAAFEPALDYVVVKIPRFAFEKFPGADKELTTTMKSVGEAMSLGRNFAEALNKAMRSMETSQAGFWTYADKTDDLQEVLEALKTPHDGRLYTVEHAFRLGATVEQVHAASGRIDPWFLDEIKALVDLRAEILAAPVLDEELLRKAKRSGLSDRQLAALRPELAGEDGVRALRHRLGLRPVYKTVDTCAAEFAANTPYHYSSYDEETEVAPSDRPKVIILGSGPNRIGQGIEFDYSCVHAVQALRGVDFETVMVNCNPETVSTDYDTADRLYFEPLTFEDVLEVFHAEDSSGKAAGGPGVIGVIVQLGGQTPLGLANRLKAAGIPIVGTSPESIDLAEDRGLFGTLLAENGLRSPEHGTATSFEEAKAIADTIGYPVLVRPSYVLGGRGMEIVYDEPTLKGYIERATEISPDHPVLVDRFLDDAVEIDVDALCDATGEVYLGGVMEHIEEAGIHSGDSACSLPPITLAASHLAEVRRYTEALARGIGVRGLMNVQYALKDEQLYVLEANPRASRTVPFVSKATGVQLAKAAARVMLGATIAELRAEGMLVPDRDGGSVPAGAPIAIKEAVLPFKRFRTLAGNNVDSLLSPEMKSTGEVMGIDAGFGQAFAKSQAAAYGSLPTSGKIFVSVANRDKRSMIFPVKRLADLGFGIVTTAGTGEVLSRYGIDCEIVPKHYESPGTNAVELILAGEIALIINTPQGSGASARQDGYEIRSAAVTADIPCVTTVPGAAAAVMGIEALMRGDMSVRPLQDLHRLLRSDLS

SEQ ID NO: 12817 - protein, 342 aa, Actinoplanes utahensis
MNLFRNAVRPVLFRLGGGDAETAHEWTLHRLASMPPAAREVMRRRYAFSAPVEAFGVRFPNRVGLAAGMDKNGLALPAWPALGFGFVEVGTVTAKPQPGNDRPRLFRLRESEAIINRMGFNNAGAAALAARLEELGPIGVPLGVSLGKSKVTPLDEAVEDYRESYRLLHPYADYIAVNVSSPNTPGLRSLQDRDAIKEILKALSGPVPVLVKIAPDLTEPAIAELLEVCLEHGAAGLIATNTTLARDGLAPGDRHLAAEAGGLSGRPLTERAREVVRFVHEETGGRLPIVGVGGILSADDASRMLDAGATLVQLYSGFIYKGPDLVKAVAQGARPARATTPR

SEQ ID NO: 12818 - protein, 424 aa, Actinoplanes utahensis
MSPVERELLALDRAHVWHPYGPMPGRSDPYLVESAAGVRLRLADGRELVDGMSSWWAAVHGYRHPVLDAALAEQAGRMSHVMFGGLTHEPAITLARTLVELTPPGLEHVFLCDSGSVGVEVAIKMAIQATGRRRLATWRGGYHGDTFHPMSVCDPDGGMHSLWTGVLPAQIFAAAPPADFDQAYADSLRDMIAAYATDLAAVIVEPVVQGAGGMRFHHPEYLRVLREATAEHGVLLIFDEIATGFGRTGQFFAAGHAGVSPDIMCLGKALTGGYLTLGATLCTTAVAEAISAGPGGALMHGPTFMGNPLACAVANASLGLLRDGGWADRVRVIETGLTEGLEPLRDAPGVADVRVLGAIGVVQLDHEVDVPRATAAAVAQGVWLRPFRDLIYTMPPYVADEADVARITAGITAAALSHEQRGTR

SEQ ID NO: 12819 - protein, 276 aa, Actinoplanes utahensis
METFGERLHAAVAERGPLCVGIDPHAALLARWGLSDDVAGLERFARTVVDALADRVAVLKPQSAFFERFGSRGIAILESTIRQSREAGALVLLDVKRGDIGSTMAAYAAAYLDPASTLRSDAITVSPYLGVGSLRPAFDLATATGAGIFVLALTSNPEGASVQHAVAPGGSTVAQTVIDEISQLNAGVSPLGSFGLVVGATIGDTGHDLAGVNGPLLAPGLGAQGATPADLRRVFGESLHNVLPSYSREVLSAGPEIAGLRAATDRVLDDCRAALG

SEQ ID NO: 12820 - protein, 105 aa, Actinoplanes utahensis
MPLPSLSPEQRAAALEKAAEVRKARAELKEQLKSGKTTLAAVLDRAEADEVVGKLKVSAVLQALPGIGKIRATQIMEKLKIAESRRLRGLGDQQRKALLGEFAAN

SEQ ID NO: 12821 - protein, 197 aa, Actinoplanes utahensis
MSMDDDARPAARLTVLSGPSGVGKDSVIELIRARSPWIRLSVSVTTRKKRDYETDGEHYHFVTRSEFQRLIDGGQLLEWAEFAGNLYGTPRAQVEGWLQQGRPVLLKIDLQGARQVRAAMPAAQLVFLAPPSVDELQRRLIGRGTDDPETIKRRLAHADEELAAESEFDVTVVNDFVERAADELVGLLGSLYLAHEH

SEQ ID NO: 12822 - protein, 86 aa, Actinoplanes utahensis
MGTVANPEGITNPPIDELLDKTSSKYSLVIFAAKRARQVNAYYSQLGEGLLEYVGPLVETTPQEKPLSIAMREINAGLLTAEPTDH

SEQ ID NO: 12823 - protein, 403 aa, Actinoplanes utahensis
MTEVVLGVCGGIAAYKACELLRLFTESGHGVRVVPTAAALQFVGAPTWAALSGRPVATQVWDDAHEVPHVRIGRAAELVVVAPATADILAKAAHGIADDLLTNTLLTATCPVVYAPAMHTEMWDNPATRANVATLRSRGALVIEPAVGRLTGRDTGKGRLPEPSAIFEYAVSALRGRPDLAGRHVVVTAGGTREPLDPVRFLGNRSSGKQGYALARAALARGAKVTLIAANVTLPDPAGADLVRVGTTEELRRATVEAAGSADVVVMAAAPADFRPATVADQKIKKTDDGLPAPIALVTNPDIAAELGAAKRPGQLLVAFAAETHDALEHARAKMIRKRADLIVVNEVGVDRVFGQDRNTVTVLGTDGFTEALDELSKDDVANRIFDHVVDRLDAQVGGGRPL

SEQ ID NO: 12824 - protein, 396 aa, Actinoplanes utahensis
MARRLFTSESVTEGHPDKIADQISDGILDALLAQDPRSRVAVETLITTGQVHVAGEVTTQAYADIPSIVRDTILRIGYDSSKKGFDGASCGVSVSIGSQSPDIAQGVDSAIELREGDSEHVLDQQGAGDQGMMFGFACSETPELMPLPIALAHRLARRLSVARKDGLIPYLRPDGKTQVTIEYDGLRPVRLDTVVVSSQHAADISLDSLLTPDVREHVINPELEGLGLDTDGYRLLVNPTGRFEIGGPMGDAGLTGRKIIVDTYGGYARHGGGAFSGKDPSKVDRSAAYAMRWVAKNVVAAGLAERCETQVAYAIGKAQPVSLFVETFGTENVPVERIEKAINEVFDLRPAAIIRDLDLLRPIYQQTAAYGHFGRELPDLKWESTDRAQDLKNAAS

SEQ ID NO: 12825 - protein, 734 aa, Actinoplanes utahensis
MATKSVRADREPAEHLPVARVCVDVQLPHLDRPFDYLISSADDAAAQPGVRVKVRFAGQLVGGFLLSRAEASEHQGKLAYLEKVVSAERVLDPEVARAARAVADRYAGSLADVLRLAVPPRHARVESQPVPGNAGAGRSLGEGDGSVPEGGRSVSEGGGGSVSEGGRSVSEGGGSVSEGGGSVSEGGGSVAGGGGESSVREAGPAAGARPPAPDLPEPAPGGWDSYPTGPAFLAALRAGRPARAVWSALPGEEWPLRIAEAAAATVRGGRGVVIVVADGRDLDRMDRALTTALGPDRHVALNAALGPAERYRRFLAASRHQVPVVVGTRAAMWAPAADLGLVVIWDDGDDLHAEPRSPYPHAREVLLTRAQLAGCAALVGGFARTGEGQLLLETGWAREIVAERGVLRRRQPAISPTGDDPQLARDAGAVTARLPSVAWQAAKQALQAGAPVLVQVPRRGYLPSVACAECRTPARCPECSGPLALHAARDVPFCRWCGRNFPAYECPACGERRLRASVVGAKRTAEELGRAFPGVPVRTSGRDEILNTVPGTPAVVVATPGSEPVADGGYGAVLLLDSWALLSRADLRAAEETMRRWLNASALARSGSAGGRVIVVADGSLAPVQALLRWDPGWFAARELAERRELGFPPAARMASVTGPAPAVAELLSIADLPDGTEQLGPVPAREEQERMLLRVSRSRAAGLAHALHVAAGVRSARKAAVPVRIQVDPADLF

SEQ ID NO: 12826 - protein, 185 aa, Actinoplanes utahensis
MTVQPIRLFGDPVLRTAADPVVDFDKELRKLVKDLTDTMLDEGGAGLAAPQLGVGLRVFTFDVDDVVGHIVNPVLSFPDEQEQDGPEGCLSIPGVYIDTKRRQNVVANGFTEYGDPVQVVGTGLMARCVQHETDHLDGVLFLDRLDAAARKDAMKQIRSAEWYDAAKPPMIKESPHGRGIFGVGR

SEQ ID NO: 12827 - protein, 308 aa, Actinoplanes utahensis
MRLVFAGTPEVALPSLEAIAASGHELLAVVTRPDAPAGRGRRLVRSPAGAWADEHGIEVLTPERPREPEFQARLRELAPDCVPVVAYGALVPPSALEIPKHGWMNLHFSLLPAWRGAAPVQHAVLHGDEVTGASVFELEAGLDTGPVYGTVTDQIRFNDTSGDLLTRLAHEGAGLLVAVLDAIGSGTARAHPQPRDGVSLAPKLTADDARVRWTDPAFAVDRRIRACTPAPGAWTTLRDDRLKLGPVRPIANAPHLQPGELRVERTQVLAGTATTPVQLGEVRAAGKKPMPATDWARGLRLEPGEKLA

SEQ ID NO: 12828 - protein, 489 aa, Actinoplanes utahensis
MTEHRASRPHGAGPRRPAGPGHPRDQRSGRAPRAGRPPSDPARQAAYEAVAAVHRDDAYANLVLGEILGGMGLHGRDAAFATELTYGTLRALGTLDLIIASAAGREVARIDPPARDALRLGAYQLLYTRVPTHAAVNQTVDLVRSVAPGASGFANAVMRTISETPLETWLERLAPNYADDPVANLSVLHHHPQWIVRAFAEALGGDLEETARLLIEDNQPPAVHLCARPGRADAVELADEVNGVPGAFSPYAVYLNGGAPRDLAAIREGRAHVQDEGSQLVAAALLAAPVEGRDTRWLDLCAGPGGKTGLIGAIAAGRGAEVTAVEVAEHRARLVEQATEGMPVTVFPMDGRSVGRDPDLPEEAFDRVLVDAPCTGLGSLRRRPESRWRRQPADLPPLTRLQRELLVAALRAVRPGGVVAYVTCSPHMVETQVTVSEGARRSGVEVDFVDARPLLPPGMPGLGAGPTVQLWPHRHGTDAMFLAVLRRTA

SEQ ID NO: 12829 - protein, 226 aa, Actinoplanes utahensis
MTSSPIIAPSILASDFSRLAEEVHAIEGAADWAHVDVMDNHFVPNLTIGLPVVQGLRKATTIPFDVHLMITDPERWAPGYAEAGAYNVTFHAEACDDPVGLAKTLRAAGAKAGLAIDRDTPVEPYLELLPHLDTVLIMTIKAGFGGQKFLPEMLDKVRDVRRRVSRGNLDVRIEVDGGIAADTIEQAAEAGADAFVAGTAVYGAADPAEAVRKLRALAADRMGISR

SEQ ID NO: 12830 - protein, 335 aa, Actinoplanes utahensis
MSTAEPGPVVDDFGLDDEEQRPDLILVVDDDQDIASFVEFNLRMQGFEVIRARDGQEALDLMETHRPDLAIVDWMMPRMDGVELIRALRADPLTSALPVIMLTARSMTVDKVVGLTTGADDYLTKPFDTAELIARVSTTLRRNKEFREVSPLTGLPGNARVRREIIDRMRAGGDYSVGYIDVDRFKSVNDVYGFDRGDEFITALARSLQRASAATGKPSIFLGHIGGDDFVFICHPDQVLPLTKNMVTDFESAADRLYDPRDAQRGYIEVPDRRGNKHRAALVTLSIGVAQATSGGRQFADPRMVIAVASEMKKVAKSQPGSYVAIDRRRSDAED

SEQ ID NO: 12831 - protein, 225 aa, Actinoplanes utahensis
MPATPPRNRSKPGMPPLYRAARGSLGLLLRGLWPTTVTGLENLPSSGAILCANHHAIADQIFLGVTTPRHIAFWAKAEYFRGNPLTRHVVTGMGAIPVERAGGRAVLTAFDAAIPILKAGGLVAVFPEGTRSPDGRLYRGRTGAVRLAGQAGVPIVPVGILGTDRIRPTGRHLPRPQPITLTFGPAIEIRVNSARDARRLTDRVIAAIQSLTGQEYVPTYAPARR

SEQ ID NO: 12832 - protein, 198 aa, Actinoplanes utahensis
MPADDALRDRLVRVGAELLRTEGPGTLSLREIARRAGVSHGAPRRYFPTHLSLLSAIAHVGFADLKTQVQAALEAAGPDPRRRLATLARLYVRFAATDRAMFDLMFRHDLLQSGGELGLRHAALPLFTLLVELVTAVHPTPDPPAEITAAALWSALHGLAELSNWGSLTLATGETDPASVIDAILTAHLGPRRTTEGA

SEQ ID NO: 12833 - protein, 393 aa, Actinoplanes utahensis
MDVDALRAGTPGCRHRIHLNNAGAALMSQATLDTVVAHLRLEAEIGGYEAAGAVADRVAAVYAGLAELLGGRADEIALFDNATHAWQAAFHAVPLKAGDRVLTGRNEYGSNVLGYLQAARRVGAEIVVVPNDEHGQIDTVALAGLIDERAKVIGLTHVPTAGGLVNPAAEVGRIARAAGVPYLLDATQSVGQFPVDVTEIGCDFLCGTGRKFLRGPRGTGFLWVRDGILEQLEPHVVEIQSADWDGARGFGWVPGAQRFATWELNYAAVLGLGAAVDQALNLGLGEIGKRNAELGDRMRGLLEDTPGVTVYDLGRERCAIVTAEVAGVGAEQVVARLAESGVNVTSTVPAHQQFDTEDRDPPPLVRFSPHYYNTEDEVEHAATLVSAMVTKPL

SEQ ID NO: 12834 - protein, 351 aa, Actinoplanes utahensis
MVTEDEAMRRAIALAARGLGTTSPNPVVGCLLLDAAGEVVGEGFHAYAGGPHAEIVALAQAGERARGGTCVVTLEPCNHTGRTGPCSDALLQAGLRRVVIAVDDPNPVASGGAATLRAAGVQVETGVRRAEAELGNLAWLTAVRRGRPFVTWKFAATLDGRSAAADGTSQWVSSAESRFDVHLLRSTVDAIVAGVGTVLADDPQLTVRDLRDGSLAIRQPLRVVVDSHRRTPENARVRDAAAPTWIVTADEVGAGPDGRVDLTAVLTGLYDRGIRNVLLEGGPTLAGAFLAAGLVDRVIGYVAPKLLGAGRAALVDAGVGTIADALELDFTDIAQIGGDLRFTATLRHKEN

SEQ ID NO: 12835 - protein, 402 aa, Actinoplanes utahensis
MSESIERAIAEIRAGRPVIVVDDEDRENEGDLIFAAEHATPELVAFMVRYTSGYICVAITESDADRLELPPMYHTNQDKKGTAYAVAVDARHGVSTGISAADRARTISLLGAASTEPSDLSRPGHVVPLRAKAGGVLRRPGHTEASIDLAVLAGCTPAGALCEMVNDDGTMQRMPDLEKFAAEHDLVLVTIADLVAYLRERADRKIERVVETVLPTEHGVFTAVGYRTQADNGEHVALVYGDLSDGEDVLVRVHSECLTGDVFGSRRCDCGPQLDAALERVAAAGRGVVLYMRGHEGRGIGLLHKLQAYQLQDRGFDTVDANLELGLPADARDYGTGAQILCDLGVRSMRLLTNNPAKRAGLEGYGLRVIGREELPVRLHPENVRYLRTKRDRMGHLFEALG

SEQ ID NO: 12836 - protein, 158 aa, Actinoplanes utahensis
MAGFGDPHMQTVDAAGLRLGIVGSRWHNDLVDHMIDRARSAAEACGVTEVIVTRVAGSVELPVVAQALAKRCDAVVALGVVIKGETQHFEYVCDAVTAGLTRVALDEQTPVAHGVLTVHSLGQARDRAGLEDSIEDKGWQSTVAVLDAALAIREVEKF

SEQ ID NO: 12837 - protein, 246 aa, Actinoplanes utahensis
MVLSCRNVRKVFDGRTVLDDLSLDVGEHEVVALIGASGSGKSTLLRCVNLLTEIDDGTIGLDGEEITDPRIDPDLVRRRIGLVFQSFNLFPHMTVLQNITLAPTRVHGRPAAEARAQALEWLERVGLADKAGSYPDRLSGGQQQRVAIVRALVNSPRLLLLDEVTSALDPELVGEVLTMIRDLKGEGMTMVLATHEMGFAKQVADRVAFLDAGRVLEQGPPEQVLGDPVEARTRQFLARIIEAGRL

SEQ ID NO: 12838 - protein, 468 aa, Actinoplanes utahensis
MDVGDVHQRDRARAQEVRLRHQPVLHHRRAPAGGRLLLAVLPRAADRDHDEEVEDRGRQVPGRPGRRQAGCPGGHHQLPGDHRRDQADRQAVGLQQQRRRQGGAGQRHRRRHRGGPADRVLHDRRRAQGRRHHRPAPAGRRARAVRPGARQGIQADRLRQQGGRPAAPGRHPRGAGEDLALRRRSARTPVTYAPSQRQRERFAYRRRQAIRSVLLAALSTAVAGTLLGVAITGSPGWPRVKQSFFDPEVARKYLPDILTGLWLNLKLLSVCAVLALLLGLLIAILRTTRGAVFFPVRALATGYTYALRGLPLIIVLYLFAFGIPGLRLRGTPDVLVLGAAAIIVTYGAYLAEVFRAGIESVHPSQVAAARSLGLGYRRTMRHVVLPQAVRRVTPPLLNDIVALQKDVGLISLAGPIDAIRAAQIGTAESANFTPYVVAGVLFVLLALPLIAVTDWVTLRAARRQNAGS

SEQ ID NO: 12839 - protein, 87 aa, Actinoplanes utahensis
MKTFEELFAELQRKAAEQTPGSGTVAALERGVHFIGKKVVEEAAESWMAAEHEGKDRTAEELSQLFYQAQVLMIASGLTLEDVYRHL

SEQ ID NO: 12840 - protein, 280 aa, Actinoplanes utahensis
MLRIAIPNKGTLSAPASQMLRDAGYRQRTDPKDLVCRDEANNVEFFYLRPRDIATYVGSGDLDLGITGRDLLVDSGVPATELLDLNFGGATFRWAAPAGTLTSVDQIGGKRIATAFPGLVGAYLVEHELKAEVVRLDGAVENAVRLGVADLIADVVETGATLRQAGLVTLGEPLIRSSAVLIGRDVQAPAGAAQLLRRLNGVLVARNFVMLAYDVRADLLEQATGLTPGIESPTVSPLHREGWVAVQAMVQRSQVHRVMDELYDLGARAILVTDIANCRL

SEQ ID NO: 12841 - protein, 152 aa, Actinoplanes utahensis
MTDVVFRPRRIRWVAGPIAAAVAIFFTVLSFGLHGQGGFDHSGQVGVGSFQRGDQVAMIGLGILLGLGILTFCRPRVAADEQGVHVRNVVGGYDLPWDVVRAVRFDRNSPWAQLELFDDEQVSIHALQAVDKDYAVDGVRALRALHSASHKA

SEQ ID NO: 12842 - protein, 204 aa, Actinoplanes utahensis
MNEQIRAREVRLVGPEGEQVGIVPVERALQLAADVDLDLVEVAPMARPPVCKLMDFGKFKYESALKAREARRNQQQTVIKEMKLRPKIDPHDYETKKGHVVRFLKAGDKVKVTIMFRGREQSRPELGFRLLRRLSEEISELGFVEASPKQDGRNMIMVLAPHRATKAAAVAATAAGVKPAREPREDDGTEVPSAETADSTAAAE

SEQ ID NO: 12843 - protein, 64 aa, Actinoplanes utahensis
MPKMKSHTGMGKRVKVTGKGKIVRELTGKRHLLEHKSSHVTRRMTGTVVVAKVDVPRVKKLLGR

SEQ ID NO: 12844 - protein, 130 aa, Actinoplanes utahensis
MARVKRAVNAQKKRRTLLETASGYRGQRSRLYRKAKEQVLHSMQYSYRDRRDRKGDFRQLWITRINAAARANGMTYNRLIQGLKLAEVEVDRKILADLAVNDATAFAAIVEVARAAVAAEGTGGAAAQAA

SEQ ID NO: 12845 - protein, 257 aa, Actinoplanes utahensis
MYTPRTPRIVSARRLQRRRDRDAAGRFLAEGPQAVREALAAGAVLELFGTPAGLDRHAELAAQAPEVSPVTDDALAALAETVQPQGLVALCEQVDVPIGEALAKGPQLVAVLAEIRDPGNAGTILRTADAAGAGTVIFAGDAVDPYNGKCVRASAGSLFHVDVVRAPLDVLDLLQDSGLQVLATSGTGSDDVDSLLDGGLLAAPTAWLFGSEAHGLPGELLDAADRRVRVPIYGGAESLNLAAAAAVCLYASARAQR

SEQ ID NO: 12846 - protein, 353 aa, Actinoplanes utahensis
MSYRNDPYDPKQAALLDPSALEESIKAADAAFADAASLDDLRALKPAHLGDRSPVSLARREIGSLPPAAKSDAGKRVNEARQAIQAAYESREAELEADRAARILVEERVDVTLPWNRRPRGARHPLTTLMETMGDMFLGMGYDIVDGPQLELEWANFDALNIGPDNPVRGASDTFFVDLPGLVMRTHTSPGQVRTMLTRTPPIYVVSPGRAYRTDELDATHTPVFHQIEGLVIDEGITMAHLRGTLDHFARAMFGPDARTRWRPHYFPFTEPSAEFDVWFAQHRDGPRWVEWGGCGMVNPKVLTACGIDPDRYSGFAFGMGVERTLMFRNGVSDMHDMVEGDVRFTTNFGMEL

SEQ ID NO: 12847 - protein, 820 aa, Actinoplanes utahensis
MKTSLSWLREYVDLPAGLTAERLDLALNTLGMEVESIVDQAATVQGDLVVGRVLTIEELTGFKKPIRFCTVDVGRDAPQEIVCGARNFAEGDLVVVILPGGELPGGFRIGARKTYGRNSHGMICSAAELGLSGDHSGIIVLPAGTPGADARPVVGLDDVLVEVEITPDRGYEMSVRGIARELATHFGVAYRDPAAIPAAAATGDSPWPVTVEDTVGCDRFSARVVRGIDPQAQSPEWMQRRLIQAGIRAISLPVDITNYLMLEFGQPMHVFDLQRLRGGLTVRRARAGEKLTTLDGVARILDAEDMVICDETGPISLAAVMGGETSEWQPGTVDVLLEAAHWDPVMVGRTARRHRLFSEAAKRWERGVDPQLTLPALERAVAILLEHAGGTADERILDLDHVAPPAAIHLPAELPSKVIGLPYPPDRIAELLTAAGCTVAGSDVVPPSWRPDLQAPIDLVEEVARLGGYHDIPSVLPPAGASNGLTPGQRRRRSVGRALAENGYVEVLSYPFVAPGAADQLGLPADDPRRSAVRLTNPLSEEEPLLRTNLLGPLLGTLKRNLGRGHRDVALFETGTVFLPRLTAEAPPVLGVDRRPDADEWARANAIVPDQPWHLAAVLTGDAAPAGWWGEGRPASWADAIEAARIAIAAAGVPAARVGVRAAEQAPWHPGRCAAILVDGEVVGHAGELHPAVVSALELPKRTSAMELSLDALPDAPVVDAPLISTFPPALIDVALVLDRTVPADEVRAALAEGAGSLLESVALFDVYESAQLGEGKRSLAYKLTFRAPDRTLTSDETIAARDAAVAVTTARFGATLRGA

SEQ ID NO: 12848 - protein, 102 aa, Actinoplanes utahensis
MVAAPAYGAFFRHGAGTTGLHELAWFLLATATLLLILIVADRSLSRLSTTADENHLGTTDDQNRPGIAAGTHVGEEDRPGSTADTSADEDRRRSTHPKGSPS

SEQ ID NO: 12849 - protein, 114 aa, Actinoplanes utahensis
MRQAYAHHATLVLDPSADPRAPGAAITLALCGAHRHAGPCPVAPHHTGAEARADGLHLRILFAVAPDRVDAVRAAIDTALSGGPWRLVESGCARIDPAERDHARRLLKSVGPRG

SEQ ID NO: 12850 - protein, 458 aa, Actinoplanes utahensis
MEPLPTRPLGSLYPDALWTAGDPALPVLEPDGIHPLLGAVARAFADHRPLTLSPDAVWLTILEGVARHIHLNADDLRDRLVGHQGRDLLTVVVRGEPVWPDVVAKLAGMLPSRLGASDCDFSTSTEVDRMAGRVVLMDAYSPYFAYRVSVLCGIPSISLTGTAEDWRRIRARVDVLAGAGLGLEKWCRSLAPIADHFVRAAAGAADPEFWKRIYNPIDAYGGDKSTGWITRLYPYVGESGSPNPLLDLPLGEPRNATGPGVSTDAVRATLARVRMLVENAITGEQTTVALHAGLTAVVQEPGGSLRPISGCHLTAAGPELDDVLDRLDHEGEMDPPGHPALLDLPEVAALYRRFGSGVLFGGAWRLRVSGTFAEFQADWWVAPVFDLADGRSVCVVKHWESAWSYWIAVPWASDRTIEDPADVRVYGTSLAALLEGALDTGGDLTHLDSGSLSQYLAM

SEQ ID NO: 12851 - protein, 248 aa, Actinoplanes utahensis
MDLRIQRSVVANLRNRPHAAESGPFVLGLDHGTDSPHINYATPVPGATITRDDVAALVTAFGGRAPRLEYVVSCAPELEDLLIEAGFAVESRNEYLICTPETLVTAGAPDGFEILEPATDAALTGMISAQNEAFGGSFEAAADSVARYRRNRSLGAVLVAAYTTGGEAAGGGTAVAPHDGLSEVGGIAVRRRYRRRGLAGAITAAIAERLFAGGADVAWLEASGEDSWRVYERIGFRPAGQRLYIAKY

SEQ ID NO: 12852 - protein, 451 aa, Actinoplanes utahensis
MTKRRVLLSAAMAAPLAGPATGAHRRPPDAELRAILRAIDPVRIEATVRRLAAFGTRHTLSSQTDPGRGIGAARDWIHDQLRSYAEAADGRMTVEAPSFTQPVSPRVPTPTVITNVIATLRGSVSPERIYVVTGHYDSRVTDVLDHTSDAPGADDDASGVAVVLELARVMARHSPEATIVFAAVAGEEQGLYGSDHLAQSFRDAGADIEAMFSNDIVGTGDAHDGSRPEPHTVRLFVEGVPTAETPAEAGVRRSVGGENDGPSRQLGRFAREVAANPQTGMDIRVVWRRDRYLRGSDHVSFLLRGYPAARFTEPRENFAHEHQDVRVVDGVQYGDLVEFCDFAYIARVARVNAATLWSLATAPGTPKDVVIDTTRLTNDTTLRWTLGTEPDLAGYEIVWRETTAPDWTGAHAVGLVGTATVDISKDNVQFGVRAVDRDGHRSPAAAPKPSA

SEQ ID NO: 12853 - protein, 185 aa, Actinoplanes utahensis
MTAPRRSDGTRAAILTAARERFAADGFERATIRAIAADARIDPSLVMRYYGNKEKLFAAAAEFDLRLPDLTAVPPGEHGRALVAHFFTRWSEDETLLALIRAGVSHEAAAGRMREIFAAQVGPIAARLAPDPASAPTRAGLIATQILGFALCRFVLRLPPVTALSEAEAIAWLAPVVQRYLHDTI

SEQ ID NO: 12854 - protein, 456 aa, Actinoplanes utahensis
MHTTVAIVGAGPTGLLLAGDLAHAGVDVTVFERRSGTSNLTRAFGVHARTLEVLDARGLADELIATGAKVARLRLFQQIRVDLSELPSRFPFLLITPQYNVERLLEERAVKAGARIVRGAELTGLDQGTLTFGTQTVTADWVVGADGVHSAVRQAAGLPFPGRSVLTSIMLADVRLATPPDDVLAVNAVGDAFAFVAPFGDGWHRIFAWDRHHQVSDREPLTLDEVRAVTRRALGTDFGIVESRWMSRFHSDERQVPSYRAGRVLLAGDAAHVHSPAGGQGMNTGLQDAANLSWKLAATVQGWAPAGLLDTYQAERHPVGRLVLRSSGALIRLAMIRSVAGRWTRNTAGSALMALPPVMHRAAGVLSGVGIDYPHAPRAADQELRDGSRLYERLRDGRHVLLTDDRVPADYAVRLNVAPPRDPSPEATLIRPDGHVAWHGPATDLPGALRTHLGSV

SEQ ID NO: 12855 - protein, 289 aa, Actinoplanes utahensis
MHDQPIPVRQPGAGHHGRAGTLPDPGAVGRGRPPYEEIHATMVAGRSRHGSGRRPRVPACHSGRVLKLPRLRPASLFLVGGLATALSVALVAASNLWVREESTGHVYSVADVPSAPVALVLGAQVDPPGEPSAFLAARLDLARRLYQAGKVKAILVSGDHADWSYDEPGAMLVWLVAHGVPADRIVMDHAGFDTYDSCSRAGRIFGVRQAIVVSQSFHVPRAVALCRSLGIDATGVGDDTQRANKPLWARGQAREWAAAVKAAWDTGTGRDPVFLGPHESGVDTAVAHG

SEQ ID NO: 12856 - protein, 32 aa, Actinoplanes utahensis
MARRAAQSCRAAATLRMAKPNPVYVATAAVLW

SEQ ID NO: 12857 - protein, 117 aa, Actinoplanes utahensis
MNADDIADKLQFEWSADGGFLYGLRYGHFDPLAAERFLSVLNSVDPEDPARFEPRVVGRLWLIPYYMLSHLHNSERQGLDISEQQRVMFRANDVLAVIFGGRGGTSASSGGAEQAVS

SEQ ID NO: 12858 - protein, 314 aa, Actinoplanes utahensis
MSKAVGLKGIDAVENLLRNLKDTPLIKGIGDFIERCFKRNSFTPDTRVLLADGTSKAIADVRIGDQVLATDATTGYTSAEPVTNLITNTDTTFTDLTVQVADGQSAVLHTTTHHPFWGSDTKSWVDAGQLAPGSALATPYGGIAKVAAVRSFQGSQQMHNLTVAALHTYYVLAGDVPVLVHNCGVDEPIPTDFAPNTVYRAVRKDEDPAKGLFARGDGDVEPWQHVLSSPSDSPWISTTKDPAVAFGKYMKNGLGVVRIDLTKVPSEMVDAAGNLRVPPGYEWMEIGETALRDRELLIRGTIPADAITGYWPAG

SEQ ID NO: 12859 - protein, 287 aa, Actinoplanes utahensis
MAARSKAVADLLDLAQRAKQAADAQKKIIEASVAATKALTDAANAMALANKEAKQADAIYAADVPRRQASQPTHTADLSALRGQACQDASIAAHQSDLVTAQSGVAATAAQTLEKTGLSQGIAWTEVTQAQADAGTAARLAAETACYAVTATEAAGKTLDADHNATVDANNAVKYRQAAEREQAAAEKLADKAEKLAAAAQAAAADAKAQRLRAEKDAASAHEHADNAAAYYRDARRQRDIARAATAAAIQHSLNAYSAAKRAIDQQNIVVGKGAEAKQKQDEALAS

SEQ ID NO: 12860 - protein, 748 aa, Actinoplanes utahensis
MPAETPYLDPALPVEQRVDDLLSRMTLAEKIGQMLQLDARQDLAEIIQDKLAGSILHTSPAKLIEASELLSRTRLKIPLLTAEDCIHGHSFWPGATIFPSQLAMAASWDPALLERVARATAVEVSATGIHQTFSPVLCIARDLRWGRIDETFGEDPLLIADLGAAMIRGYQGTGLTDPTGILATAKHFAGYSETQGGRDASEADISRRKLRSWFLPPFERAAKEGCQVFMLGYQSMDGVPITANKWLLNDVLKGEWGFTGTLVTDWDNVGRMVWEQKVCADYAEAAALAVQAGNDLVMTTPGFFDGAQEAVARGLLTEADIDAAVRRILRLKFELGLFENPRTPDAERIGAVIGSPEHTALNLEVARRSLVLLRNDGTLPIDPAAASRRIAVLGPNADDVSAQLGDWAGNSGQVGWMPDGHPRELTATVLDGLRATVPAGWEIVHERGADIERLVPDPEGETFPDGQPRPPISESAPVDPARIAAAAELAAGADYAVVVVGDTVNLTGEGCSTATLDLLGGQIALLDAVAATGTPTIVVLIDSKPLALPPSALGAAAIVQAFNPGMRGGQAIAELLLGLIEPSGRLPISAARHVGQQPVYYNQLRGQHGTRYADLTQDPLFAFGEGLSYTTITYDGLAIGEPEVPADGVVRATVRLSNTGTRPALETVQAYVSDLVTSVTWAHRELKGYRQVVVPAGESVTVEIEIPAADCTLVTADGDRVVEPGDFELLVGPNSRPSALQSAKFRIS

SEQ ID NO: 12861 - protein, 393 aa, Actinoplanes utahensis
MSSADRVLRGAAEAIEHISGICFKTGPPRHLGVELEWTTHHVDDPAVPVPAADLRDALGVHAPAALGNPQPVPLPGGGTVTAEPGGQLEISSAPADALPALHAAVTADHAALAGMLARAGLRLGDRGIDEHREPARILDTPRYAAMERSFDRAGRTMMTGTAGLQVCLDAGEAHQIAGRWAALHDFGPPLLALFANSAVHAGRDTGWASARMAAWYGIDPRRAGPAFRESGSPAEDWARYALDAPLLCVRRDDGRWDAPPGVTFADWITDGTPTVSDLEYHLSTLFPPVRPRGYLEVRYLDTQPGPDWIAPAAVLTALMADDVITAQGREIAAPVAGRWRAAARDGLRDPAVRAAAAGLAELACRHFDRTGLDDVVRKQVSDVVDARLKGNAR

SEQ ID NO: 12862 - protein, 430 aa, Actinoplanes utahensis
MINPDKNLIAAELERSRARTALLTDAVDDDDLVAQHSPLMSPLVWDLAHVGNQEELWLVRDVGGREPVRQDIDELYDAFQHARSDRPALPLLDPAEARRYIGQVRDKALDVLDRVRLDERPLLAGGFAFGMIVQHEQQHDETMLATHQLRGGSPVLSAPPPPPGDARVRGEVLIPGGPFTMGTDTDPWALDNERPAHTVEVPAFLIDATPVSNSDYLAFIDAGGYDDPRWWSARGWTHRHEAGLTAPMHWLRDGDAWLYRRFGRISPIAGDEPVVHVDYFEAEAYAAWAGKRLPTEAEWEKAARWDPATGRSRRFPWGDEPPGPEHANLGQRHLAPAPAGAYPAGASPLGVHQLIGDVWEWTSTDWHGYPGFRVFPYAEYSEVFFGGDYKVLRGGSFGTDAAACRGTFRNWDHPIRRQIFSGFRCARELV

SEQ ID NO: 12863 - protein, 246 aa, Actinoplanes utahensis
MCRHLAYLGPPEPLSAWVFDPPHALSHQAWAPRDMRGGGTINADGFGVGWYPPEGGPPVRYRSAMPIWSDPTLPRLAEVTRSGAVLAAVRSATEGMPVIATATAPLQDGRWLFSHNGVVRGFPGTLADLAAALPVEDLLTLDAPTDAAALFALVRHGLRAGKTAEEALLSVVTAVLRVAPDSRLNLLLTDGDRILATTAGHALAVRATGDAVLVASEPLDDHPAWRPLPDRRLLIATPAAVELGEL

SEQ ID NO: 12864 - protein, 323 aa, Actinoplanes utahensis
MTSLEKHLDERDLARSLRADVRDGLSADPKRLPPKWFYDARGSRLFEDITRLPEYYPTRTERAILSAAAAEIARLTDAKTLVELGSGSSEKTRLLLDAMLGRGTLGSFIPFDVSQSALAEAVDALSVTYPGLSITGVVGDFTRHLRHLPDGDSRLVAFLGGTIGNLIPAERSAFLGDLRSVLHAGEWLLLGTDLVKDPAVLVPAYDDAAGVTAEFNRNVLHVINRELRADFEPLAFEHVAAWDPDREWIEMRLRSVRAQTVRIEDLDLTVSYAAGEEMRTEISAKFRRERLAAELAAAGFALRHWWSDPQDWFGVSLAQAVTD

SEQ ID NO: 12865 - protein, 198 aa, Actinoplanes utahensis
MADVELIVTDAEALRAWLTDHHATSPGVWLALTRKGGTATTLTWQQAVDEALCFGWIDGQARKGDDALSWIRFTPRRPRSAWSQRNVANVTRLEAAGRMTPAGRAAVEAAQADGRWAAAYAPPSEAEVPDDLAAAIAADPAAQAMFDVLTRGNRFALIYRVNAVKRPETRARKITEIVAMLARHETFHPQKAKPAPQP

SEQ ID NO: 12866 - protein, 117 aa, Actinoplanes utahensis
MRHDQWDPRGPGGRLLTVATVAAMTLACLVLSGCTFQDAECSDGEYPAAQVDGPGSYCVPDGQEPDPGFVRYPAGRVPRHVGDEWDVYWQSHRLDAQGNEIPDGPRPAVSVAVSPSR

SEQ ID NO: 12867 - protein, 605 aa, Actinoplanes utahensis
MRRHAPGRRPDPGGRHQTLRPLALAGRRQPRRIPAHHAGADLHRRASARVVADPAVRPPRRRFPARGRAGVRRRLPDRRPDRPAGGSGPPAAAPAGGAGSPIPVRPADRRRRHHARLLERHGEESDGPRTGRDAHLDRRSAGRHRSGRRRLGRHWFGRHWFGWRGFGRHWFGRYRFGRHWFGRRREGSAAVSRSGFDEQYGRDLLSQLPPMPDLPPHVDLSAAVTAGRRRRRARRIRTTVTAATLTAALVVAAPLAVRMQRRSEPPADPAPAATAAAPVACTAAWLPMPDAGTGARVLTAGDATGRWYAGSYRAQQGNGDTVILLWHDGRLVRTGRFPGVGQKINGINAAGTAVGQTIDDRRYRPYAYVGAQAVRLPGVTEGTAVAVNDAGVVVGSRMAGDHPVPVRWRSVSEAAVDLPLPAGYGTGEAIGIDKDGTVVGSIGPHGGVPEQPYLWHPDGTGELLPLPIVQGRPARVFDPSGIRDGWVAGVVVAAGDKTLRPYRYNVVDRTFESVAGRDVAISAINGSGWAVGYHTGAPGGSVLFAGPRETRLPAVPGAGEPDTRAVVISDDGRTVAGDGRNAAHRTQPVLWHCDVETMAGTAGHR

SEQ ID NO: 12868 - protein, 411 aa, Actinoplanes utahensis
MTKRKIVLAFSGGLDTSYALVDFREKGWEVVTANIDTGGLHSGEAEAVKARAEELGAVEHHVVDARAELYDRVVTYAIKANYLRNGAYPSCVGAERLIQAEKVVEVALRVGADAVAHGSTGAGADHVRYDAVIRALAPHLEIITPVRDERLVREEEAEFLRSRGFAVSEKVKKYSINEGLIGTSIGGEETYGSWEYLPEDAWTYTKSIDQAPETGVELHLTFDRGVVVDATVDGAPLVAADAPNYAILSELNVLGGAHGVGRGIHMGSTMVGNLARVGFEAPGMLILIAAHRELEKLVLSNRQQATKAQLGNTYGDLLHEAVYFDPIMDDFRAFLDSSQTRVTGTVRVKLHKGNIVLLGSSSPHSLLDAATRAGIVYGHGSSAWTGEQARAFAHMYAMPGSIARLAANPAP

SEQ ID NO: 12869 - protein, 297 aa, Actinoplanes utahensis
MTFPPSVETRFPNFADHTGKLAGLGVEFFLASNETIRPHLNEQPYGHKLSWLDFTDTGERDWSVRDFLNLFNVINGIAFGDRGIPMPQWVMVDLILMPAAALIAGLPQDEFAAMVERSTFRFDTDVKQLLRKVQEDMRAGGYTGPVPVGGYCAAPSAEPGRWVGWSLWSLMPAVGLGKAAKALALSAYRAQKLDGVTQYDNSALKVHTEFGALKVLVATVPFHTSPGSFVYQSDLTLPADAALPEPAFLLDPFDYDRQQAMQKAIEAGSSEFYVLPPGHVVQDGRTYVPIFEKELPR

SEQ ID NO: 12870 - protein, 163 aa, Actinoplanes utahensis
MTRAGRHARIVELIRGRTVRSQTELADLLAAEGVQVTQATLSRDLEELNAVKVSGAYLIPEDGKRPLRETTGQGPARLIRLLKELLTGVDSSGNIAVLRTPPGAAQFLASALDRSGLADVVGTIAGDDTILVVARDSGPTAGADLAEKLGNWSRSDTDREETR

SEQ ID NO: 12871 - protein, 310 aa, Actinoplanes utahensis
MTLRHFLRDDDLSPQEQSDVLDLAVEMKASRFAFTPLAGPRSVAVFFDKASLRTRLSFEAGIAELGGQPIIVDTQNTHFGRGESLSDAGRVVSRYVAAMVYRTHGDERLAELASGVDVPVINALSDGYHPCQLLADLLTIRERFGTTRGRIIAYVGDAANNMAHSYLLAGATAGMHVRVAGPSGFDPSPSVVGRASEIAAWTGGSVEVFRDPREAADGAHVLATDTWTSMGQEEDGKDRLTPFRPYQINSGLLAVAAPDAIVLHCLPAHRGDEITDEVMDGPQSVVFDEAENRLHAQKALLTWLLAVNEK

SEQ ID NO: 12872 - protein, 657 aa, Actinoplanes utahensis
MAGALPRRDDRDQVRRQRHDRPGAAARLRRRHGLPAACGDQAGRGPRRRAADQPDAPAGRHRVGVPRRPAGHHPGDDGDRPDGAHRPGRPGAGRPDQPARAVRGGPVRRGRPAVHRGPPGRHDRRRAGRHRPGRRRRPGGHLRGRRSHRGRPDPGDRHGRPGRRRAGAQRERRHRRLRAGRRTRRPQARGAHRRARPLHQLAGHFLVDQRDRRRRARQAAARPGVRDGPQDGGLPARGARRGPVGTRRRRPGRPLDAARNLHGRRIRYHGGPLMTTLVERWQQSMMNNYGTPAIALVKGEGAVLTAEDGRRYVDFLGGIAVNALGHAHPAVVAAVTQQIQQVGHVSNLYIAEPPVALAELLLALAGRTGRVLFCNSGAEANEAAFKISRLTGRTHIVATDGAFHGRTMGALALTGQPAKQDPFRPLPGDVTHIAYGDVAALAAAVTGETAMVILEPIQGENGVVVPPPGYLAAAREICTRNGALLTLDEVQTGIGRTGHWFHHQGEGVEPDLVTLAKGLGGGLPLGACLAFGTAADLLTPGSHGTTFGGNPVSCAAGLAVVRTIAGEGLLDHVKRVGEQLRRGIEGLRHPFVKQVRGAGLLLGIVLNQPNAAEIAARLLDAGFLVNAAKPDVIRLAPPLIISSDQADALIAALDGIR

SEQ ID NO: 12873 - protein, 389 aa, Actinoplanes utahensis
MTVTHPRGFRASGVAAGLKTSGNPDVALVVNDGPDYTAAAVFTGNRVKAAPVLWSQQVVKGGVIRAVVLNSGGANACTGSQGFRDTHTTAEHTATVLRTTKRMMVGPGDIAVCSTGLIGELLPMDRLLPGVNAAVKALATDGGPRAAEAIMTTDTVAKNAVAQRDGWSVGGIAKGAGMLAPALATMLVVITTDASADNETLDAALRAATRVTFDRIDADGCMSTNDTVLLLASGASDRQPTLAELTAAVTEVCHDLAQQLIADAEGATKHIAIEVAGAASEADAVQVGRTVAGNNLVKTAFFGNDPNWGRILAAVGTTSAAFEADRIDVAINGVWVCRNGAAAEDRSKVDLSGRDVRVTINLHEGEMNATIWTTDLSHAYVHENSAYSS

SEQ ID NO: 12874 - protein, 333 aa, Actinoplanes utahensis
MGIRVAVAGASGYAGGELLRLLAGHPEFDLIAATAHSQAGQHVTSVHPQLTGLDLTLGSTDAATLGDADLVFLALPHGQSAAVAGQLPAGVKVVDLGADFRLESAEQWTRYYGGGHAGTWTYGLPELPGARAAIRAANRVANTGCYAATIILALAPLIAAGVADPADVVVVASSGTSGAGRNAKAHLLASEIMGDLSPYKVGAHQHVAEIKQATGADSLSMTPILAPMPRGILATVTAKRRNGGDPREALQAAYADEPFVHVLPEGVWPHTAATAGSNSCHLQATVDVDSGRIIVVSALDNLGKGAAGQAVQNANIMFGLPETAGLSVFGVAP

SEQ ID NO: 12875 - protein, 298 aa, Actinoplanes utahensis
MPILSLKPVVLPAPGRGDDLQVRVSAPAAGTGLPVIVFAHGFGGAMDWYDPLVDHWAANGFVVVQPTFLDSATLGVTPADPRHPTIWQTRVDDLSRVIDDLAPIVEAVPGLAGRVAHDRLAVAGHSWGGQSAGMLLGARVLGADGRPGADRTDHRVRAGVLLATTGLGGDQLAPFAREHFSFMNPDFDTLKTPTLVVAGDADQSALSTRGPDWFTDVYHLSPGAQGLLTVFGGEHLLGGIHGYRAADTTDESPRRVELIRRASTAFLRTALGIDATAWHTEVDAVRATPDPAGRIDTK

SEQ ID NO: 12876 - protein, 276 aa, Actinoplanes utahensis
MRRPAPAGRHRGRVRAGRRVSGTGSAWWLLRGPPRTGAAFRFTVRSDAPFRKGEGSIAPVGCSAWHNRGVSKESGGAPPRRRADVERNESALVTAAAEVFATSGVDATVREVAAAAGVGMGTLYRHFPTRAALMVAVFRHQIDACAEAGPTLLAAAPTPFAALLDWVHLFVDFLGTKHGLAKVWQGDDAGFTELHQLFLDRLVPVLSELLGAATASGEVVADIRPYELIRAVGDLVAWTVQDPNYDVRRIVTLLVTGLRQIQPERSGPSGFDLVQV

SEQ ID NO: 12877 - protein, 227 aa, Actinoplanes utahensis
MDNQARKLSTGSTVGGRIFGAAFGLVFAGAGVLFAAADVFADSFDPFRAMSDCVTSGDVAGIPADALPSGVTTCDWLHEGLTAFQIAGLLAGGLFALVGLLIVVASVRGSAAWLDGSRLRVRRTFGTRVVDLATADVTAGIVTHTDSSDSGPVRVRRVPTLVAREPATGRKVTLALQGISLDRLPPVELRALADAIVIGRPESDVDAFRVAEQLRAMADDPLELHRH

SEQ ID NO: 12878 - protein, 209 aa, Actinoplanes utahensis
MPFIALGLLAGCGHAAETSSGTVATPTPPVSTPSSAHPGSRCPAEGVRLELDEGDAAMGLRVRGITLVNCGSRTYRLNGYPVVRALDEDRAPLDLQVLQGVTEIVGSSMPWDGPPRPVTLGPGQRASAAVAWRNTYDDIRKPPVDATFLRIEPLAGRPAQTVEADLDLGSTGRFGISPWVAVPDTTAAPASSPPAPAPSDPVASDIPLP

SEQ ID NO: 12879 - protein, 418 aa, Actinoplanes utahensis
MAEPGSLAEAVTERAPRAPAGTEPGPRAGALSAIGLYVVLRVLSLEVMYALAAQAHSRSPGRQVFPDGSIGNQWRSFTSAADALLSWDGRWYIKIAGSGLGGPVGAVDADGVPYELRLAFFPLYPWLARPLTFLPFVNPVAACLIVSLISAIAAAWGIYAVGRLIRDHRTGLMLAGVWAVAPAAMTQNGAFTESLFTALAAWALWAVLTRRWLLAGALAGLSGLSRPTAAALIGTVGLAALIAAARRRDGWRPWAAIVLAPAGLIAYLTFASARLGGFDEYTSIHANTFGARWDHGANTGKMVSDILLGVDDDNAAKPIRVMSALFLAGFIVLLVLLAGRVPWPVTVYTAAMLVLAAGTSTHISMIGRHLMPAFPVLLIPAMLLARASNRNLGIVLGALALLSGWYAGWLPFISGQAI

SEQ ID NO: 12880 - protein, 476 aa, Actinoplanes utahensis
MPESDEPTRLWGARFAGGPAEALARLSVSVQFDWRLAPYDLLASRAHARVLANAGLLDAEELGRMLAALDDLEQACTTGEFRPTIEDEDVHTALERGLLERLGALGGKLRAGRSRNDQVATDLRLYLRDHARGVAVALIELADALTEQAARNVGTPAPGMTHVQHAQPVSFGHWLLAHVQPLLRDLDRLRDWDVRTAISPLGSGALAGSSLPLDPAAVAKELGFAAPAPNSMDAVADRDFVAEFLFITALIGVHLSRLGEEVVLWTSTEFGWVELDDAFATGSSIMPQKKNADIAELARGKSGRLTGGLVAVLTMLKGLPLTYDRDMQEDKEPAFDAVDTLELLLPALAGMISTMTVRVDRLAAAAPVGFSLATEVADWLVRRGVPFRDAHEITGKLVALCSARECELEDLTDDDLKTVSEHLDPSVREVLSVSSALAARTTPGSTGPGPVRDQLATVQHKLDTWRQWAVEKAVPR

SEQ ID NO: 12881 - protein, 353 aa, Actinoplanes utahensis
MADLDLTGDVVALTRVVCDIPSVSGDEKRLADAVESALRAYAHLEVLRDGDAVVARTSTGRPTRVVLAGHLDTVPIAGNLPVVEDGDVLRGRGTVDMKAGVAVMLHLAATLTAPRYDVTYVFYDHEEVAARLNGLGRLVRHHPEWLAGDFAILGEPSDGTVEGGCQGTMRVRIAVPGVAAHAARSWRGSNAIHSAGAVLDILRAYEPRQPIVDGLQYREGLNAVKIEGGIAGNVIPDLCTIFVNYRFAPDRDPDAAETHLREVFAGFDLEVTDRAPGARPGLDQPAAKEFVDLVGREPQAKLGWTDVSRFAALGIPAINYGPGDPLQAHTDTEFVPIPEIHTALENLKTWLTA

SEQ ID NO: 12882 - protein, 349 aa, Actinoplanes utahensis
MRARMADIARQAQVSEATVSRVINDRPGVSPETRQAVLTALDVLGYERPERLRKRSAGLVGLVVPELDNPIFPAFAQVIESTLAQSGYTPVLCTQSPGGVTEDEYVEMLLDRQVSGIVFVSGLHADTTMDVERYHRLLARPLPIVLVNGHTDGIDAPFVSCDEQLAGDLAVGHLASLGHRRIGMISGPHRFSPVQRKLDGYRAAMQRELGVPAADADDLVELTLFGVEGGEVAAERLLNKGATGIICGSDMMALGAIRAARRRGMRVPHDVSVIGFDDSPLMAFTDPPLTTLRQPVAAMAVAAVRSLVYDINGHGSPRSEYLFRPELVVRSSTAMAPAHRALTADASAA

SEQ ID NO: 12883 - protein, 417 aa, Actinoplanes utahensis
MRIRTAGVIAASMLCLVGAAACGDKKTSTSAGPKASAATGELIIWADDKRSAALKPFADKFGQENGVTVKIQAISKDQQTTFLTASQQGSGPDVMVGAHDWIGNLVQNGAIDPVQLSDAQKSGLQPGALKAVTFNSQTYGVPYATENIGLIRNTDLAPTAPATIEDVVAQGKKLVAEKKASEVLCLQSGPTGDAYHAYPLYASAGGYLFGAAGNGDLDPKDLGVGKPGSVAAFEKLRALGEKGDGALKRSISPDNSVATFTGKKCAFLVSGPWATADAKKAGINYDITAVPPFKGGKDATPFLGVQTFYVAAKGKNKALAQEFVTNYVTTPELAVALYQADPRPPALTSALDQVKANDPDVAKWAEAGKNAIPLPAIPEMAAIWEPFGKAEAAVIGGADAKSTVDAAAKTISAAITK

SEQ ID NO: 12884 - protein, 518 aa, Actinoplanes utahensis
MTTQLEGPAATRALPAPEAEVEKSSSLRSQSIKIVLLGLVVAIAVWAAFPLAGGEHWIGLGILAATTAGLLYLYLSPRHIPAKYLVPGTIFLIIFQIFPVLYTAGTAFTNFGDGHRGNKAEAITAIQTASVTRVPGSTEYQLKILAKGDQLAFLITDPKTGKVSLGDAGGLKPVDGVPAGYTVLNAGEASARSREITDFAVPTAAGAIRSAGLSRAYEGKAVRAFDPATDSIRDTTTGKVWKADDGQGAFVATDGERLAQGWKVNVGFANFTRVLTDDTIRSSFVGTLIWDFLFAIGSTGGTFLLGMFCAIALQSTRMRFRGLYRILMVLPYAMPSFAMLLVWRDMFNTDFGLINNVLGIHVDWLGTPITAQLAVLLVQLWLGYPYMFLVTTGALQAIPAELTDATKVDGAGPFQAFRAIKLPLLLVALTPLLISSFAFNFNNFNAIYLTTEGGPFPADNPNSGATDLLITYTYRLAFGGSGAQYGFAAAISIFIFLIVAVVSAVSFRRTRAQEEVYS

SEQ ID NO: 12885 - protein, 283 aa, Actinoplanes utahensis
MTAKWFKDTGWRHLVAVLAVVFSLGPILFVLSAALNPLGTLSSSTLIPSGASLDNFSRLFTDTNFPHWFLNSVMIAGLASASSIFLSALAAFAFSRRRFSGRRTGLLFLLLIQMFPQFLAVVALFLIFSTITDLWPEIGFNTWWGMILLYLGGALGVNTWLMKGFFDTVPKELDESATVDGASHTGIFFRILLPLVSPIIAVAGLLAFIGTINEFLLANLFLRDGASKTLAVGLYGLVQGSDRNTNFGMFCAGTLLTAIPTVGVFMYLQRYIVEGLSAGAVKG

SEQ ID NO: 12886 - protein, 1774 aa, Actinoplanes utahensis
MLSLLLPLLTVPAAEASAASNEPSASVIANWGSDKPASNEQYYFVLPDRFANGEKSNDKGGLTGDRLSTGYDPADKGFYHGGDLKGVIDKLDYIQGLGTTAIWLAPVFKNRPVQGTGADVSAGYHGYWITDFTQVDPHFGTNADLKKLVQLAHRRGMKIFLDIIVNHTADVIKNRENKYSYIDKATSPYTDTEGQPFEDKNYATGRNGFPKVDATSFPYTPTVDPKDKKVKVPAWLNDVTMYHNRGDSTFSGENSEYGDFYGLDDLWTERPEVVRGMTRIYADWIGATGIDGYRLDTVKHTDLDFWPQFTAGINQAAAKAGKPGFFMFGEVYSADQEIESTYVRKGGLPATLDFSFQAAAQAFVTGGGTAAGLSDVYAKDDLYTTPTTSAERLPTFLGNHDMGRIGSFIAAASTADTQLKRDELAHELMFLTRGQPVVYSGDEQGFTGPGGDKDARQDMFASKTADYLKDDLIGTDRTHAVDNYDTAHPLYRTIASLAKLRKANPALVDGVQVTRYAATGAGVLAVSRIDRTKRTEYVVAANNATTTQTVSFATSSPGATFTGIYGGAAPVVAGADGKVTVTVPALSTVVLRSNAPEAVPAAAPTVTLKPAAGAKVATRTELTAETTGDPLATVTFAAQVGDGPWKLLGTADRAPYRVYHDLDGLAGGTPVKYKAVVRDSRGRLASSSTSITVATPTPASTVGYAIVHYQRPAGGYADYGLYTWGDVDPSMSTSWPNGQPFVGEDAYGRFAYVKLAPNAKSMGFIVVGKDGVKDTDADRSLDPTKNPEVWLKQGDPAVYTTPPAVQQDQGKAIIHWRRADGNYDGWGLHVWDGAATGTDWGSPLKPTKIDSYGATFEVPLADGAAGLSYIIHNGDAKDLPTDQRLTFADAGHEVWLLAGQQERLLPLVKTAGGTGSTDVTKESAVWMDRSTLAWQTGGSTDGKVYDLVWSPTGGIGVANGELTGDYKTVSLHAKGTGLTERQRDRFPHLWQYRAFTTDARNVADIVRGQVVVTERNTDGRLLAATGVQTAGVLDDLYPKAVDAELGYLHGRVAVWAPTASSVELETYDNATASSATLATMKRDDRTGVWSLPVARGDYGKYYRFRVTAWQPAAQKVVTASVTDPYSVALSTDSKRSRFLDLNDPKLAPAGWDRLRKPAATAPAKIQIQELSVRDFSIADSSVPAAERGTYAAFTEARAAGVRHLADLGKAGVTHVHLLPVFDFATVPENRADQAQPGCDLAALPADSDQQQACVAKVAGSDGYNWGYDPLHYTVPEGSYAVDPADRTREFRSMVAGINNAGLRVVMDVVYNHTSAAGTDPNSVLDQIVPGYYQRLLADGTVADSTCCANTAPENAMMGKLVVDSVVTWAKQYKVDGFRFDLMGHHPKANILAVRKALDKLTLKRDGVDGKNIYVYGEGWNFGEVANNARFVQATQQNMAGTGIGTFNDRLRDAVRGGGPFDDDPRIQGFASGLADSGTDNARLLHYQDLIKVGLTGNLAGFAFTGNDGKVVTGKDIDYNGAPAGYTAAPDEAITYVDAHDNEILYDALAYKLPQSTTAADRARMQSVALATTVLGQGVGFVAAGSERLRSKSLDRNSFNSGDWFNAIEWDCTKGNGFGKGLPPAADNQAKWQYAKPLLADPALKPDCAAINLADNRYRELLRIRTSSPVFGLATGKQVQQRVAFPLSGKTETPGVITMTLDARGLGGKWKSITVVFNSTSATATQTLPALAGKKVALHPVQQASADPLVRTASFAAATGTFRVPARTVSVFVQN

SEQ ID NO: 12887 - protein, 228 aa, Actinoplanes utahensis
MRGGCSPQAADRLPGLRLPGSFIPMAEETGIIVEIDRWVLLEACRSVKQWQTDDPATAPAWVSVNLSATHLEMPDLTDQVAYALSATGLAPSCLVLELTETVLMRDLAVTAARLEELRELGVKIAIDDFGTGYSSLGYLRDIPVDVLKIDRSFIDGMAGNGRQQELVNAVIQLGHTLGLRVVAEGIEDADQLNLLTVMGCRFVQGYHLGRPEPVAQLQDRLSAPVLQN

SEQ ID NO: 12888 - protein, 295 aa, Actinoplanes utahensis
MDLTMALAGLGVGIIVGLTGMGGGALMTPILVLLFHVNPVAAIGSDLAASAVMKPFGGAVHAKRGTVNWKLVGWLCAGSVPSAFLGVLLLRLLGDDRAVQHTVKIALGAALLLAAAGMVAKAWASRRTADAPPAAITVRPLPTLLIGIMGGLVVGLTSVGSGSLIIVALLAVYPKLRANDLVGTDLVQAVPLVTAAALGHALFGDLHLDIAGAVVLGSIPGVLIGSRISSRAPGGLVRSALIIVLLASSLKLFDLSAQLVGVITGGALLVAIGLGLRARRRTTATGPQHRETVAV

SEQ ID NO: 12889 - protein, 73 aa, Actinoplanes utahensis
MPATEESCANRRILRSMGAPAWRRTDGPGLPAAAVLIPGGAGYRFAQGFHFARPMPAEDIAPLLGDPSRRESR

SEQ ID NO: 12890 - protein, 66 aa, Actinoplanes utahensis
MDELVLEMLRDDLDRRVTAAAATMADTLRLLTAARELAGDAPGGESLRAAIEELTAAHADLLVRSR

SEQ ID NO: 12891 - protein, 538 aa, Actinoplanes utahensis
MASAAASANPAAASIARSTATRRSPRRTRRAAASSARSTISLVRQSSIRFSTSSCMVGASWPRTATGPLGRSSAPSPGATFGYLASSLRSLLVLAVSPLLHPDSRDRSRHQGRPADLGARPPTSGKTAGSAPDVPETRAGTDHAGPAGASSAAEAYRYSSVRGPRPGRRQRPPDPEQREKTTSSIPEGCVTVRAGRAGGVYRVAVEIGLWSVVAEPEALALAGPGATLLTGADAAYAVGPDAVVVIAPGGGADEMVLPGPFPELLEERLAGVLRPAVRAFARLPQGCLALGVARSAELGYRRGALHDIRLRFEEALPPGLLEPGPEWLDMVGHDPTGAMERFITAWYSGVPARRVPDVDPMGQPTALRAFHRVAAGRPEVYGISSRILPEPLADRPDGLITFGHEGDGMFTLAMPPGEDDPEVFYDGLSDRLLPERERLAGFLLNAALARAAMDGPLGGMAFVDRPQAQRIIAPLRRVPLRPMRWPCLFSRCYAGPGTVVLLGEDDADWCEMYVGVRHPGLLRRLRRLGLDWESFTDS

SEQ ID NO: 12892 - protein, 548 aa, Actinoplanes utahensis
MTVLPSAAELPGVPVGRRAVLLAGLTAGAGAVAAAALPSVAGAAGSAFQHGVASGDPLPGGILLWTRVTPTPESVPASGLGPQVDVDWQVATDAGFATVVRSGTVSTGPDRDHTVKADISGLSPATTYWYRFGLGGEWSPVGRTMTAPAATDAIARLRAGVVSCANWEAGYFAAYRHLAERGDLNLVVHLGDYIYEYGTGQFDAGGTVVRTVAPLNETLTLADYRTRHALYKTDPDLKALHASVPWIITWDDHEVANDMWSGGAENHTPATEGDFAARVAAARQAYAEWMPVRLAADGHIYRRLRYGDLFELSMLDLRTYRSQQASGAVVDDEDRTIAGAAQLNWLTDGLVNSTALWKIVGNPVMISRLDVLALPAWLLGPLGELIGVPQNGVVLNADQWDGYNADRERLVDTLRAHDTRDVVFITGDIHTSWANELTTKDTGTAHPAAAEFVVPSVTSDNINDALGTSPGGPLSLLAASLIRATNPHVKWVETDGHGFGVLDITRSRCRMDWYHLADRTRKDSAAKWVQGWSVGRGSAKIRKESAPG

SEQ ID NO: 12893 - protein, 576 aa, Actinoplanes utahensis
MRGPGHRPPGLSRRSPGLSHRSPGALSRVPPRSGSLLASRATITPNGVALRRLTLLAAAVVTLLPVTLLSTAGSASAASGTLTVNTYDRSGQVFHTSLRIINLSSNQSYTASSFSAKALPKGAYAVITDMWNQRDGTDTLGATMVTVPAGAVTATIDARGGQPVGVRLDQGPGAGYAQTVRAAICSEATGAPIKVDAYNQPGKLFVLSNNSTHLRFSWSSIWQSQGGNETWMVAGGPHPKVPAGVHGTIAVSSLGTVSAAVRRGPAGSDQAGLTFHEDDDCHPGYGVGVFGGPAPGTAKVHASAGKWRLDADWSAVETGGATAGLGFDWRKVTVAAGRTSSTTFFASAWGPAYHVPEMMTGASLNFDTSTMFRDPGNADEFEASERSLVTLTDSRSRVVKQQWRQNWADGDPGFIAKVPAKGWYTLQVNARRYRPGITYPADLLSSSSQAIFRVSLDPEARPYLTDVQLPRLAPAGLNLNNQGTAGGTTVVQILPDRRSGNPDITVGRASAIRTVTLLASFDEGRTWTSMPVTGSGTTWQGTVTNAMSGRVWLRSRVTSVNGAYGEVTIARAYALG

SEQ ID NO: 12894 - protein, 194 aa, Actinoplanes utahensis
MRGRPPVDRNRPAVAGRALASAVMMSHRGLLWYSVLCGAGVLWAGALVVALALGHRPVDKVVAVGIAALLTVPGFAAGVLANRRAYRTQQPRRLWSLASWVPPHVPVWAAIAAGVVFFGFWLTIVLAFVALQGNPEVRADGTYVLADHDRLTVVDRTTYDRQLDHEQQISLAVLGAFAVGGAFLCAARATDHQA

SEQ ID NO: 12895 - protein, 262 aa, Actinoplanes utahensis
MTPQATVTFIGNATTLLRLGEFTLLTDPAFGHAGSRVHLGYGMWTRRLIDPAMRFADLPPLDAVLLSHLHGDHFDRAARRSVPRDLPILTTPQAERRLRRRHWDAARGIPVWDATEWQRAGQTLRITALPGRHGPGFVDRLLPDVMGSLIEWERDGEPLTRIYITGDTLHRPFLSEIRERCGEIDAMLIHLGGTRILGLLVTMDGRQGAALTGLIRPKVALPIHYDDYRVMKSPLSDYLRRCRENVHPLRRGETYDLPLRVR

SEQ ID NO: 12896 - protein, 777 aa, Actinoplanes utahensis
MSSLSSLAEEQFHLGVLYGRLDELRAQARNRLDEARRQGGGLPSWRSHRDAATQAYAERLARYDAVEPGLCFGRLHLRDGDSLHIGRIGLHDPDRALLVDWRAPAARPFYTATAITPQDVTLRRHIRTRDRTVVDLDDEILDLDTATDRSLVGEAALIAALTADRTGRMRDIVATIQAEQDAVIRSDAGGVLVVQGGPGTGKTAVALHRAAYLLYTHREQLAARGVLIVGPNATFLRYISQVLPSLAETGVLLATLGDLYPGTTARRAEPAEVAEIKGRATMPELLAGAVRDRQRIPETPLEIPVDGHVLRLTAADCVTPREQARASGLRHNPARPIFAAGVLTALAGQIADRIGDDPFWDDPLGGDDALAGPNVLDEDDLADIRADLAENPRVQAALDSLWPVLTAARLLTDLYASRPALLSAATDPPPVAAPVPVSEGPADGGGPVAGRLLSVAECAALWREPGGGWSPADVPLLDEAAELLGEDDRDARAAAAREQSRRLAYAQGVLDITAGSKSFELEDDDEAAIPNAADIMEADMLAERFQDRVHLSTAERAAADREWVFGHVIVDEAQELSPMAWRLLMRRCPSRSMTIVGDLAQAGSLGAPTTWSEVLTPYVADRWRLAELTVSYRTPAEIMSYAERLLATVDPTIVPPRPVRSTGVAPWEATGTLTDLAARVTADIDALAGGRLAVIAPAGHQAALAAALPALTTGPSPDLEDHAVLLTVAQAKGLEFDTVLVINPAEILTDSRRGSHDLYVALTRPTRNLGVFTLLPR

SEQ ID NO: 12897 - protein, 206 aa, Actinoplanes utahensis
MTYGWMDLPAEAVDEAARQLLGWHLTANGVTARLTEVEAYSGLGADPASHAHRGLTNRNAVMFGPAGRLYVYQIYGMHYCANIVCGESGRAAAVLLRAAAIVDGHDLARARRPAARRDTDLASGPAKLMQVLSLDRAANDTSVIDGSGPATLTPPAGAVGAVAAGPRVGVTSAHDVPWRFWLADDPTDSAYRRHTPKPRAVRPLPR

SEQ ID NO: 12898 - protein, 334 aa, Actinoplanes utahensis
MAQGHNGDGAPDPETVVAGVAESRPVDAEVIEALRAATAHRDGAAEVADPAEPSILDAEPEAAEPEAAEPEAAEPDGADAATVPPEVGGTGLPRTAAIGKRWGALIAGVLAVVLLVLIGLACSGVFTSAAPPTPLPSADPLTPSAPGSSGLPATPKAAVHPARTAGDLDQVCGGTFFPASPKYQGRGPHPILISARERLDLTDRATRTLHRFAFAGAASGKLTWAPAVPKVQLVACLDLAGPGARLRDCPGDTAKSPKLPLVVGRYRLTVVEVATGRTVAESELTGAGKSCPWVAMTGSDKTLYSSVDDNQLYRALKAPVAQAIPGSAQPRKRS

SEQ ID NO: 12899 - protein, 83 aa, Actinoplanes utahensis
MLVPRTEHVGERPSWDCRVCGRPWPCATAKVELAEQYHHFSHGLSVYLGSCMIEAIDDWAAGTGGPPADLYERFLGWADPGIA

SEQ ID NO: 12900 - protein, 287 aa, Actinoplanes utahensis
MSTVPRRQVGRLLRQLREQAGISLMAAAQELEFSRARMYRIENGEVPVRKHDVIAMCGVYGAPGHMTEVLIGLAQESKAKGWWHAYGDVVPAWFELYVGMEQGACRLRQYAPSVIPGLLQTREYAEFVFGRWLGDDPVAVENAVAVRLERQSLLQRSRPRAPRLEVIIDEGVLRRGVPDTLGMQKQLAHLVNVSTRQNVSVRVLPFAAGPHQASSSGQFTVLEFPAVGTASPEPTTIYGENLTGALYLDKLAEVETYERIWSALDAIALSQSDSDDLIGTIIKESDG

SEQ ID NO: 12901 - protein, 70 aa, Actinoplanes utahensis
MADLSGAVWHKSTRSGGNGGDCVEVAGNLPGIVALRDTKDPDGATLIFSREQWHAFLAGVRAGEFDHRAR

SEQ ID NO: 12902 - protein, 244 aa, Actinoplanes utahensis
MSLSAAARFRYTLVAGSTAVVIGSGFILMGLGGPDSAQADSRSADVPLAAATTATAAATASPGAAVEPSKATPGRTASASPATARTSATPRPKSSTIKVATGTTRSDSATVLDAVVAHINAARADEGLPPLTLDAQLSKASAKHNALMIDGCGLEHNCSGEAGIGTRYVGVQWHTAGENIGYASTRSEAETIATANGITDSMLAEVAPNDGHRRNLLNKDFTRIGLSVVRDGKGLVWVTQDFVG

SEQ ID NO: 12903 - protein, 184 aa, Actinoplanes utahensis
MRRSAAKRVEVLAAAGEVVAARGADATRFADVSAATGVGVSTLQYYFGTREDMLIAVFRHAAERDFELVGERLAGLTDPWDRLLAIARHLGSDLSWRLWVESWRWASRDAEVRADVLADYTRWRELIAATIEADNPMRVARQVLALIDGLALPVVLGDPAVDRAAANELLEEALARLLGRAPAL

SEQ ID NO: 12904 - protein, 344 aa, Actinoplanes utahensis
MTRYGPMFGPDYTFLGIPACDWREPSTYADADVVIVGAPFDGGTSHRPGARFGPQVIRGTDYLAHDGTRPHMAMRVDALGADLTVKDAGDVEVFSGEIERSCRSIEEAVGFIARHGAIPLVLGGDHTVTWPDVTGVAGAHAASRVSVIHFDAHADTGDIEFGSLYGHGQPMRRLIESGAVRGDRFLQLGLRGYWPGPDILDWMADQRMNSFHMSEIVERGLDAVLDSAFAIALDGCDGVFLSVDIDVCDPGHAPGTGTPEPGGLTARQLLDSVSRICHELPVVGMDIVEVSPPFDHAEITAMLGNRVVLEALSGMARRRKDGDGPRWKRSTPLLEGRGTTQQPG

SEQ ID NO: 12905 - protein, 171 aa, Actinoplanes utahensis
MLEMLISFLRKILGGPTEAPTRSGVSKKPAAPRPPAPQPRPPRHLPTRDRGRTIDYAPDLDGDADPGEIVWTWVPYEDDPSQGKDRPVLVVGRDGRTLLGLMLSSQSERDGQRNWLALGAGDWDRTQRPSWIRLDRVLEVDEDGIRREGAILDRDRFNRVAATLRSEYGWA

SEQ ID NO: 12906 - protein, 287 aa, Actinoplanes utahensis
MVRRAGPGRAGGRSARRVRPGGDHRAGRRARRVPGGRSLEHRPDHADRSRPRPPADRRGGLNETEADHMRKYVIMGVQGSGKGTQGQLLARDLDLVHISVGDIFRWHVRNHTKMGAQVKRIMAAGELVGDDLVESVVRDRLHQHDWNYGFVIDGFPRNGPQAEFFMESYDLDAVIHLELPDDEVRRRVLSRRLCPNCGMDYNLIADRPEQEGRCDICGHELVTRADDTPEALEARLRDYHEKTRPVLELFQRKEVVHDVDGRPPVDEVQNAIRKTLGLPPHIPQPDR

SEQ ID NO: 12907 - protein, 474 aa, Actinoplanes utahensis
MHLTLDTVDLSVVSMRRERFTLVLMCATVLALQALVAGINLAIPRLAASSLHPGPGDLVWIVDAYVLAFAGLLIPAGALGDRLGRKGVLLAGLVLFGVANLISASAQDVAVLQAGRALGGVAAALAQPATLALLLHATRPERRPHAIALWTACMGLGGMAGNLIAGVVLQYSGWPVLFLVFVPVAALLTAGVAVCVPRAPRHDASIDPLGTALLTGGLFAWLYGIVEGPERGWADTVVLSSFAAGALTLAAFTGYALRAARPLIDPRVFRVRTVRAGAFGVGATFFALFGLFYVNAQFLQDVKGYSPLLTGLAIGPLAIGMGVVSRRAVPLTQRYGPRPMIAIGLGAIVAGLLLLSTVDAATAYPVYAGYLLLMAAGMGLCAPALTGGILAGLPAANAGLGSGLNSAAREVGAALGVALIGTVLAEHHALRSPADLVSGLTVGYRILAAILAAAAVIVVRTWPAPAHRAEPVAA

SEQ ID NO: 12908 - protein, 313 aa, Actinoplanes utahensis
MHASQGKIASYAMNLDLNLLTALDALLEEGSVGGAARRLHLSEPATSRALGRIRAAIGDPILVRSGRRMVLTPRAVELRTEVRALVERAQAVFTPPGPPDPATLQRVFTVLADDVATALGPELLARVQSLAAGVTLRFLGEDPASDGTVQLRDGRADLDIGVVDDAPPEITVEPLFTDRMTAVVRAGHPLLRGPLTPRRYAEAVHVSASRRGRLTGPIDEALAEHGLTRRVALAVPTFGAALIVVARTDLVGLMPARLGRPAIDALGLIAVDPPIPLPPKEIAMAWHQRYTADGTHAWLRARVRETIASLAAT

SEQ ID NO: 12909 - protein, 253 aa, Actinoplanes utahensis
MYAEERQQEIVRRARAEGRVDVVTLADSFAVTAETIRRDLTVLERAGVLRRVHGGAIPVERLGFEPALATRDAVLISEKERIAKAALAEVPQDGAIILDAGTTTARLAQLLPADRELTVVVNSPVLAAMLGVKPNLSVLLLGGRVRGKTLATVDDWALRPLSEMYVDVAFMGTNGCTVERGMTTPDPAEAAVKRAMIAAARRVVLLADHTKIGNDYLARFGGLADLDLLITDSGLDHELAAEVEAAGVRMVRA

SEQ ID NO: 12910 - protein, 313 aa, Actinoplanes utahensis
MILTVTLNPSVDRALEVDALLRGEVLRAVDSHIDPGGKGVNVSRALLANGVRSTAVVPTGGAEGEQLVDLLRGEGVDLVAVPIVGRTRSNITLAEPDGTVTKVNEAGPTLSAAEFGQVSDAVLTAARSAGWVVICGSLPPGPSVADFQALCERLVAAGVRLAVDSSGPGLRAGVTAGAALVKPNREELAEAAGTELATFGDVLEACERLRKAGAGAVLASLGADGAVLVEESGVLAGRSPAGVPRSTVGAGDALLAGFLAAGARGADALIEGLAWGAAAVSLPGSRMPGPRDLDRSTIHIDHDPDPARPLGRD

SEQ ID NO: 12911 - protein, 370 aa, Actinoplanes utahensis
MASTYTPEVTGGGFRAAVQKLGGHLAGMVMPNIGALIAWGLITALFIPVGWIPNANLAQLVDPMIKYLLPVLIGYTGGRLVHGQRGAVVGAIATFGVVVGADVPMFLGAMIIAPLTAYVLRLFDGAIEGRIRPGFEMLVDNFSAGIIGAGFAILGKLAIGPVVDGLTKAAGNAVDWLLAHSLMPLASILVEPAKVLFLNNAINHGVFGPLGVQQVQEHGKSILFMIESNPGPGLGLLTAYLFFGPKSLRPSAPAAMIIHFLGGIHEIYFPYVLMKPRLILAMIAGGMSGVATFMITGTGTVATPAPGSIFAYFAVTAKSGYLGMILGVTIAAAVTFAVASALLGFGRLKSDQELDEQAEPAPAEVAPQQA

SEQ ID NO: 12912 - protein, 102 aa, Actinoplanes utahensis
MATINGKDIHKLVVACDAGMGSSVMLASTLRKQLGKTGVTVEHTPVNSIPADADLVVCHSGLAARARSIAPGKPIVPFQIFLGDPAVTKVVKAIQQGTDLHV

SEQ ID NO: 12913 - protein, 147 aa, Actinoplanes utahensis
MSELLDRRAIRLAETAADRDDAVRRTGRALVEIGAADPGYVDTMLARERSISTYVGAGVAIPHGTLDGKNLVHRDALAVLRFPEPVDWDGEPVTLCVGIAAKGDGHVELLAALAEILLDEDRARDLRDATDPDTVIRLLASIKEESE

SEQ ID NO: 12914 - protein, 343 aa, Actinoplanes utahensis
MKVVRFHAPGDVRFEDVPEPQAGPGEVKIRVRNCSTCGTDVKIAKFGHHHIHPPRVMGHEIAGEVVQGTGDWVPGDRVQVIAAIPCGECPDCRRGRMTICPNQVSMGYHFEGGFAQFMVVPQEVLKVDGLNRIPDGVTFAEASVAEPLACALNAQNLARVGDGDDVVVIGSGPIGCLHVRLARAHGAARVFLVELSRQRLDMAANLVKPDAAICAAEVDPVEAILGLTGGRGADVIITAAASGTAQEQGIQMAARQGRISFFGGLPKDKPTITCDSNLVHYRELTIVGANGSSPAHNRQALELLASGAVPVADLITHRLPLDGAIDAFGIVERGEAIKVTIEP

SEQ ID NO: 12915 - protein, 91 aa, Actinoplanes utahensis
MPTRTVAVGSASGLHARPAKIFVAAAAAAPVSVTIRVGERKPVPARSMLSVLALGARRGTEVTLEADGDGAEQALDTLAALLAKDLDADDA

SEQ ID NO: 12916 - protein, 529 aa, Actinoplanes utahensis
MPEVTVLTGIGVCPGVAAGPLLRIATAPALPAPVAVADPRAETIAAYAAIAEVVADLTRRADRATEATVADVLRAEAAMADDEELRDAVRDRIEGGADAPHAIHAAFATFREMFAEAGGYLAERVADLEDLRNRAVAVLLGLPMPGVPQPGHPFVLAARDLAPADTADLDPSQVLALVTEVGGPTSHTAILARALGLPAVVACRGVLDLPGNSVVEVDGGTGRVTTGDFDVRFAPGNAEKSMLSGPGATSDGHAVTLLANVGSAKDLAAAGEAHAEGIGLFRTELLFLDRTAEPTMDEQVTAYRDVFRGMAGRRVVIRTLDAGADKPLPFLHQDGEPNPALGIRGLRVARQRPQVLTTQLAAIAAAAADTGADVWVMAPMVSTVAEATGFAAAVHAAGLPKAGVMIEVPAAALRAADLLRVVDFLSIGTNDLSQYTFAADRMCGDLAELLDPWQPALLQLIGMCGEAGRATGKPVGVCGEAAADPRLAPVLVGLGMTSLSMSPRALPAVRAALANHTYAACRALAEKAG

SEQ ID NO: 12917 - protein, 167 aa, Actinoplanes utahensis
MSKYLISAAAVVLGLAGTAGAALATEPAPTTTAAPAATRATAPQTAVTTKQAVAVVVVRTGGGHGGQSVFTLVGAANREEAEVLHLASTPEFQALRPRYAPAHPASGRYTYRIEAGYRDKTKKRVLVVEGTPGTPKVALDVIRMMVDVPAPDLSHLPVQFPPGFPFN

SEQ ID NO: 12918 - protein, 250 aa, Actinoplanes utahensis
MGHLGSAEPPIEIGKKKAEARLAEAQQRLLRLRLLLGGQIGEPKQIGPPLCVLFEGWDASGKGGAIKRLVAPLDPRHVRVSQFAAPTYDEKRHHFLQRFWTVLPGSGGMTVLDRSWYGRVLVERVEGFATGEQWQRAYDEINEFERTLTAEGMILIKFWMHVSDREQLDRFQDRAGDPLRAWKLTDEDWRNREKRDAYAEAIEEMLERTDRPKARWHVIPGDDKQYARFAVVERVCHVVEKRLAKLGRLS

SEQ ID NO: 12919 - protein, 418 aa, Actinoplanes utahensis
MTFVDDLMWRGLIQDSTDPDELRKALDGGSITFYVGFDPTAASLHVGHLMQVLTARRLQQAGHRPLLLVGGATGQIGDPRESAERTLNPPEVVESWVQRIREQLAPFVTYTGDNAATLVNNLDWTGSVSVVDFLRDVGKHFPVNKMLARDVVRNRLESGISFTEFSYQLLQSNDFYELHVRHDCRLQFGGSDQWGNITAGVDFIRRRGAGPVNAFVTPLVLKSDGTKFGKTEGGAVWLDPAMTSPYSFYQFWINSDDRDVSRYLRYFSFKSREELEELEKATAERPQARLAQRALAEELTALVHGEEEARQAIAASQALFGRGSLDELSADTLRAALAEAGLLAVRGELPPVGVLLKEAGLVASANEARRTISEGGAYLNNERITDAEATVPAAALLHGRFLVLRRGKRTFAGVELTA

SEQ ID NO: 12920 - protein, 335 aa, Actinoplanes utahensis
MRSELTALARDVADKVARHLVAAGTIIDEDSEVALQHAIAARRLASRIAVVREAVGLAAYAAGDWTTAIAELRTYHRMTGRQTHLAEIADCERALGRPERAIDLYRGADMAKLEKSGAIELLIVAAGARGDLGQHDAAVAMLQVKELTAEETADWAARLRYAYADALLAAGRRDEAREWFVRAAAVDEDQLTDAAERILELDGVVIEGDDEDDEDLDDDAAEDGEGGDVRARSGADDDEDRDDDEDEDLDDEDRADSDEDDDFDDEDDEDDDTDEADAEPVTVAETDVNTDAVKADKHEVPAAVFEAPPAGKAEDEDDEKGGDEFDSRPDDRPRA

SEQ ID NO: 12921 - protein, 332 aa, Actinoplanes utahensis
MTDHLAGGYDLAIFDLDGVVFLIDKPIPGAAEAVERLRADGTSIAYATNNASRRAADVASLLTGMGVSAAPAEVLTSAGAAAALIAEHVPAGSPVLVVGAEALRGEVRDAGLTPVESADESPVAVVQGYGPEVGWRILSEAALAVRAGATWYATNTDRTLPSPRGPLPGNGSLVAVLRTALDREPDVVVGKPEPALFTTAASLAKAERPLTIGDRLDTDIQGAVTAGMDSLLVLTGVSGPRELLEAPAERRPKFVAADLSGLFRPAGQAAVPAAEVDGWSLDRDGDRVTLTGSGDPVDALRLLCGATWDGVPAGTVSAGSAAATELLKSWGL

SEQ ID NO: 12922 - protein, 76 aa, Actinoplanes utahensis
MNHVRPDVPQIDGTCTGENVHERAERVAVPDFDYMSSPMVAMVDGIFHIDPDAPPLPRRHHRPRPAQYHTDPVQPF

SEQ ID NO: 12923 - protein, 426 aa, Actinoplanes utahensis
MTSLTLPRGARLSDASWRARHRIISRLLWCHVPVFLVVGMLGPRPRWEVLMLVAGVAGWAALIPVMPNQQAQASHTGVGLIACTFVAIELSGGSMTAHIHLYAILIFVALYQMWAPLICAVLVVVVHHGVLGLIAPERVFGMHHMGVGSAIEQVAVHAGLAAVEVAGIVVFWHFAEQAERENEQLAAEAAAAREETERAEREADHRAAEDLRLRSAEAAAQARRISEDVASISAQAHAAISAVTAVDRELAALTASVRDIASRSATAAGTAADGKEAAASAGEKVRALERSVGEIADVNAIIASLADQTNLLALNATIEAARAGEIGKGFAVVAGEVKDLARETATSVERVNTVITAIVAETDDVAQTFTRTTEAVDGIHELQLSIASSVEEQATVLAEVTKQLSTATASADQVLTGLQELAATAR

SEQ ID NO: 12924 - protein, 111 aa, Actinoplanes utahensis
MATVDECRQALHDLATRLEANAEARGRLDFDRSLACRVTDLATAFHARITGGLLTGIADGDDPQAKIALSTTSDDLLALIAGRLDITRAIATRQISIKANPFDLLKLRKLL

SEQ ID NO: 12925 - protein, 102 aa, Actinoplanes utahensis
MPDAWRAYLDLALGLTEAPRKKAQQVAGELLSRGGATAAQVQGLVEDLLSAGIANREALTNIVRFEVDRALGRVGLATADEVSELTGRVRDLEKRLREALAS

SEQ ID NO: 12926 - protein, 112 aa, Actinoplanes utahensis
MTFPQGAQGGPRPGGFRPGPPSGEFRPGPPPGGFRPGPPPGGPRPPADGGEPVAAAHYRTGDDGLVAETGHAAVDAVLSSLANAARLAPAEQIAEYEAAHQVLQDTLAGIDR

SEQ ID NO: 12927 - protein, 308 aa, Actinoplanes utahensis
MARRARLDAELVRRKLARSREQAAQLVAAGRVQVRGTVAHKVAAMVDPADPVLVTGEDPQTEYVSRGGHKLAGALAAFGPKGLTVQGRRCLDAGASTGGFTDVLLRAGAGRVVAVDVGYGQLAWPIRTDGRVDVHERTNVRTLTAEAIGGPADLVVADLSFISLRLVLPALAACTAPDGDLALMVKPQFEVGKERVGTGGVVRDWRLRAEAVLDVAAAAAESGLGVVDVTASPLPGPSGNVEFFVWFRRGAPAADRERVEAVVAAGPSGVVLPEESVASAGSSGAVLPEESASVVARENQPVAPLEDR

SEQ ID NO: 12928 - protein, 295 aa, Actinoplanes utahensis
MTRSALLVTHTGRRQSTQHARTVALDLIAAGFEVRVIADEVADLGLPDEVMAVEGPAAADDVEIVLALGGDGTFLRAAELARPVKAPLLGINLGKVGFLAEAEIEHIDQAVAEIVAGDYAVDERLTLDVRAEYDGRLIAESWALNEVTVEKGQRAQMLELMVDVDGRPLSRYGCDGVVCATPTGSTAYAFSAGGPVVWPEVEALLLVPISAHALFSKPLVTAPTSTFVLTVDPYTSFAVLCCDGRRTWDLPPGSRVTVERGQLPVRLVRLAPRPFTDTLVAKFELPVVGWRGNRR

SEQ ID NO: 12929 - protein, 585 aa, Actinoplanes utahensis
MLEELRITGLGVIDDTTLRLSAGMNVITGETGAGKTMVVTGLGLLFGGRADAGRVRADPGRATVEGRLRLQGTLGDAVRTRITDAGGETDEDGSLLLSRTVTAEGRSRAHVGGRSMPVATLSELGEQVLAVHGQSDQLRLLRPSEQRSALDRFAGPGHEKLLDGYREAFARWRKVVDDLADRRRNARQRSQEADLLKLGLDEITRVDPQPNEDEDLRAEVQRLEHAEGLRVAAALAAQALAGGVEAADDTADATTLLGTARRTLEGQSGVDAKLGDLALRIEEAATLVGDVASELSAYLGELDADPARLEAIYERRAALRGLTRKYADDIDGVIAWAENAKSRLGELDSSDELLDELDKERQRLAATVGELAGRLTAARREAATRFSEAVSVELAGLAMPHARVEVAVLTHAPSRDEPAVTVDGQELGAGPDGADEVELRLLAHPGAPSLPLQKGASGGELSRVMLAIEVVFAGAGGPPTLVFDEVDSGVGGTAAVEIGRRLARLARTHQVLVVTHLPQVAAFADRHLVVAKDTGGAITTSGVRIVEETERARELSRMLAGLPDSDLGIAHAEELLAVAGREKRG

SEQ ID NO: 12930 - protein, 392 aa, Actinoplanes utahensis
MRLPTLRRVRTSEPGPVSGVARLDRRTKRLTGRLRPGEIAVIDHVDLDRVAADSLVASGVTAVLNAKPSISGRYPNLGPEVLIQGGVVLVDNLGEEVFAGLREGQVVSVEGDQVLLDGKPVASGTRQDAETVAKSMADAREGLSVQLEAFAANTMDYLKQERDLLLDGVGVPDVQTRIAGRHVLIVVRGYDYKEDLDVLRPYIREYKPVLIGVDGGADALVENGYTPDMIIGDMDSVTDDVLRCGAEVVVHAYPDGRAPGLERVRNLDVDALTFPAAATSEDLAMLLADEKGASLIVAVGTHANLVEFLDKGRGGMASTFLTRLKVGGKLVDAKGVSRLYRQNISGSALLLLVLSALAAMAAAVAVSTVGKAYLTVVSEWWDNLVFQLGNLL

SEQ ID NO: 12931 - protein, 308 aa, Actinoplanes utahensis
MINFRYHVVSLTAVFLALAIGLVVGTAALNGPVSENLREQLTTLNKDNNVKRDQVNQYKEELNRSQDFAAQVAPWLTTKLTGRKLAVVVLPGGRDSADGVVKMLTTAGATITARITVEDKFLDPGYATQLLDLADQSSQPTIPSAGLPSNSDGVETASALLALTLDQGATVVNPDDVTAVLTALAKPGYISVAEKASGGAEGIVLVAGAPATDKDAGKKTANAVTVANQFHRYRPLVVAGDGAGDNNLVSAIRSDPTLVKQISTVDNASSVQGQVATAMATHERLVQNKVGQYGLGTGATSLVPSAAP

SEQ ID NO: 12932 - protein, 255 aa, Actinoplanes utahensis
MRRDPQAAGLRRTNFHGRTVTLAGGPALAAGATIGAASGAATGRLTAAVVAAGAVSGAVGLYDDIVGNRPEQTTAKGFAGHLGALREGRVTSGLVKIGGVGAAGLVASALIGSRRDGAFGRGVDVLLGAGVIAGTANLLNLLDLRPGRAIKAGMILGAPLAVGRHAAITAGTLGASAALLPADLNEEIMLGDSGANALGALLGVAYTARTGTFGRLAALAALASLTAASERVSFTKVIQDTPWLRSLDDLGRRPA

SEQ ID NO: 12933 - protein, 584 aa, Actinoplanes utahensis
MAAQPRRPRPPTGVTSPNNADATPAPPAASASPAAPAPPVPAAGASTVPAGSASAVAGSGTGTAAKIAGAAALITLLTILARIVGFGRTVVFYYTVGEGGHGGLPDLYFAANTVPNIVFELVAGGALASLVVPLLAGAVADGDRARVGRITSALLTWMVALTVPLALGVALAAGPIAGLLHGVPPEHQAIAARMLRIFAPQLPLYGIGIVLTGVLQAHHRFAWPVIAPLLSSVTVLTAYLAYAGVDGARTDVDGLSTAGELILSVGTTLGVVVLSLCLLIPLVRLRLPIRPGFRFPGGEGRQAVRLGWAGAVTVGAQQVVVALIVTLGAQQLARYNGAQTVFLLPWAVLAVPLATAVYPRLADAVVRRDEDAYAVSLAGTARSVVLLAGLGTAALAGLAVPASHLMNAEGAAPGIVGFAPGLFGYALFALLSRALYARGATVAAATAAGIGWLCAGVAVVVATAGFAGGAELAGLGLANALGMTVTGVLLVLAVRRHAGPAALAGLGRAAVAAVVAAGLAALAGWGVVAGLRSAFWPTAGIFGSLAEGVSGGAVVAAVFVAVAFALDRRDLGPLAGTVSPRWRR

SEQ ID NO: 12934 - protein, 378 aa, Actinoplanes utahensis
MRREERGRPLVSSDDGWHGSVVLVLGSATGGTGGHVLSLARGLVAAGCRVLVCGPAANDEHYGFGAAGVEYAPVEIPADPGPQDSGAIRALRKAIAGRDADVIHAHGLRAAFVVSLARTGVPLVVTWHNAVLAKGLRGQAGALVERIVARNAALTLGASEDLVERAVALGARNARLGPVAAPAMRAPKRTRQAVRAEFQIKGSTPLILSVGRLHPQKHYDLLVDAAARWRELDPAPVVVVAGSGPSYMPLAQRASRLHAPFQLLGHRGDVPDLLLGADLAVVTSDWEARQLFAQEALRAGVPLVTTAVGGLPGLVGDAAVLIPPNDLDALDNAVRSVLSDPQRRADLAARGPLQAATWPDETAVVTAVRAVYAEVSAR

SEQ ID NO: 12935 - protein, 745 aa, Actinoplanes utahensis
MTGRLDQIRRVRPPGTPRGRGAAAWVPYLLVLLIGAATLAGLTIRPAGDTKRGAADYVVIAAAAGLRWDDLDPQRTPALWREAAKGSTGWLSVRSADQVTCPSDGWLTLGSGNYAAWDTRPVRGRCPAITPDLTRPDTIGASVTAQSTVVRMNQDRLPYGTTPGALAESVRCTVAVGRNAAVAAARPFGRVDEYVDTLPDDPRKLLSDCVLSIVDLGTIAGSGAERQAAVAAADANLARVLAARPERSLMLIAGVADTDATSRLHVAIAEGEGWQGGRLTSAGTGRDGYLQLIDVAPTVLAVLGRPAPDKLFAGYAASVSGDRPDDPAKAMQGHNDADRRAIAQRGVASIFFTVLAAVQLILFVGVIPVLIRARRHAGPVAPPLPPRRLVAVLEAALIAAALAIPAGLVADVAPWWSADHPAWMFGAATFALMVAGTCAVRLAPRFRMTLWPMGATGALSAIVIVVDLLTGARLQLNGVAGYSATHGVRYAGLGSVGLGVFVAGLLLAAGCLAQWVGRRWRPTVVVLFGGLGVVMVGSPYLGADPVGAIAVTTGVCVAAAMSSGGWLTFARFAWAGVGAIAVTAGFAAFELHRAPLEQGTLGRFLSALGSGTAGPAMQRAAAANGQALLDSPLSLLALAGALMLVFGQFSPWGGLNRVYGLHPAVRAAIAGTVVASITAGVFGGTALGVAGAAAATAVPVAVLTALRVLLHAADRTPPPGQTDGPGGPLLRKADEDQRTVTEGAG

SEQ ID NO: 12936 - protein, 579 aa, Actinoplanes utahensis
MGRGRPGLQIWNDRRPRERALASTVRDTRHIFVTGGVASSLGKGLTASSLGNLLTARGLRVVMQKLDPYLNVDPGTMNPFQHGEVFVTEDGAETDLDVGHYERFLDRDLSGKANVTTGQVYSAVIARERRGEYLGDTVQVIPHITNEIKSRIFAMADPDENGNVPDVVITEVGGTVGDMESLPFLEAIRQVRHEVGRDHVFYLHVSLVPYLAPSGELKTKPTQHSVAALRNIGIQPDALICRSDREIPEKMKHKLALYCDVDAEAVIACPDAPSIYDIPKVLHDGGLDAYVVRRLGLSFRDVNWQTWNDLLERVHHPKRTITIALVGKYVDLPDAYLSVSEAIRAAGFGNTVKIQIRWVPSDSCETPAGAAAALKGVDGIVIPGGFGVRGIEGKVNTSRYARENGVPILGLCLGLQCMTIDAARNLAGLAGANSLEFDETATYPVISTMADQEDIVAGKGDMGGTMRLGAYPARLKDGSIVAEVYGATEISERHRHRYEVNNDYRDKLTQAGLIFSGTSPDGRLVEFIELDRATHPYFVATQAHPELKSRPTRPHPLFDGLIKAAVAYAAADELPVEAS

SEQ ID NO: 12937 - protein, 182 aa, Actinoplanes utahensis
MGFEHETVGTVERYRGAIFDVVTDEVTMSDGGTAHRDVVRNKGAVVVVALDEDGRVVLIKQYRHAIGAKIWELPAGLRDVDGEDPAVTAARELAEEADLTAGRLEHLIELHTSPGFSTEHVLVYLARDLAPVPVADRFARHDEEADLEVVRVALDEAVAMIFRGEITNAAAVAGLLAAARTR

SEQ ID NO: 12938 - protein, 447 aa, Actinoplanes utahensis
MRLTAVFTALALAAGPVAVHRPPGLDWGPCEQPDANLTCATLTLPVDWADPHGATFGTVVTKRATPHQDARVGTLVFGPGGPGDSGVDRVRINNRFSAEQRDRFDIVSFDPRTVKRTAAPTCAPEPDRPPLILRDQADFDAAVTTNRSYWQRCRASNEVFAHADSVSIARDLDALRRALGERRLTFQGSSYGTVLGQMYAERFPDRVRAIVLESVFDPYLPLTEFVRSEAAASQDVFEEFVAWCAGHTGCALHGSDVRAVWRSVLHDYPGVSTFEVAALPMGLTPNWALLATTIRNAANGTPPPVPKLDVASGIFCADFPADVRDFRAYQRLLAITAKVSPDVPYGAGMLAIRTCLGWPQPLANPPHRLDVHTRTPLLLLNAVHDPRTPYGWARHVATELGASGRLVTYEGAGHGSYQATACTTAMVDRYLIDLTIPPPGASCPAAE

SEQ ID NO: 12939 - protein, 84 aa, Actinoplanes utahensis
MTGEAAPVVPVLTAHLRCRRSALQVVACLGEIGPAAAAAVPLLRAEVEPPLPVWTHGADYDRILKDEAWRAACTATLNRISGAP

SEQ ID NO: 12940 - protein, 37 aa, Actinoplanes utahensis
MGGEDRDDRCGLAGHPPVGDRRLTGRRAVRRGEQLAS

SEQ ID NO: 12941 - protein, 378 aa, Actinoplanes utahensis
MLPCRSCSASSSPPASARIRSGTSSAGPYAWVSDAQSTVARSSSTCKKVPSCGRRRGQRGWSHRPGRFQRDAVSGRARGDRQRLPVVGDREQRGERVPGPDKIGIGRRMGRTVREPYDPGGGEGGRERLAEGADHLEVVHFGAPEGVALAGGDRVVAVGHERPQGGPVPPAADDPGGARVAPAARLGQEAGPAAQRRPAGLRGGEAGHVGHFADDHLEEHGDILSDPGSRFTTPYWMEGIVTFPKLQSVVLDTPDARALAEFYRHLLGLRYRPGDEPPAPGEDDEKGRDWLVLEGDGGMRLAFQQEPGLKPTTWPDGTVPQQMHLDTAVDSVAELNRQHERALSLGATLRFDRSDDEDEPLRVYADPAGHMLCIFVAS

SEQ ID NO: 12942 - protein, 140 aa, Actinoplanes utahensis
MPGHGRYLEDSNDFVTSVTSTDPLQACPIAPVVDIVFSRWTTPILWTLHESGRLRFVELERRLPTITPKVLTQRLRQLERDGLITRTYHAEVPPRAEYEISDLGRSLAPVFAQLATWAGGHLGEVDRARAAYDATKMQSM

SEQ ID NO: 12943 - protein, 267 aa, Actinoplanes utahensis
MIVVTGATGNVGRPLVATLTEGGARVRAVSRAAPRWPADLADPPSLRPALAGAEAFFLLVSGAGAHLDGPTILDEVKAAGVRRVVLLSSQGAAARPAHAPLRALEETVRGSGLEWTVLRPGGFASNALAWAESIRARREARAPFGDVGLPLVDPRDIAGVAAAALTDPAHAGRVYELTGPELSTPRQRAARIGQALGEAVRFVEQTVDEARAQMLGFMPAPVVDGTLAILGAPTAAEQRITPDVERVLGRPAGTFGGWADRNRHAFQ

SEQ ID NO: 12944 - protein, 267 aa, Actinoplanes utahensis
MAHSPSSARRPPLSSGSPRMSSGCWGVRRALSEGGPTGTGTHSSDHPVSHGNLSAVDMLSMIADERRRIAELIESLKPSQLITPSLCAGWTVHEVAAHLCAPWIFGARRIVPAVIRHGFRVHRANADLVRDLALDLTADEIALQLRANAEFDFNPPVVGPFGQLTDLQVHGQDICRPLGLTRDLVPERMLLALDFLISPKARGSFVARGRLDGLRFIATDLDWEGGQGLLTVRGAGEALMLAMTGRPVVLDELHGSGAAALRARLLG

SEQ ID NO: 12945 - protein, 501 aa, Actinoplanes utahensis
MGALPIRPRRLVSPMRLRTMALFAAGALATAGTLVTALPPASAASAGCSVTYKIASQWPGGFQGDVSVKNLGDPLTSWSLGFDFPDSGQRVTQGWSATWSQSGAHVTAASMGWNGSLATGATVGVGFTGTFSGANPVPAAFTLNGVACNGTVPASPSTPPPPSGAAPALKVSGNKLVTAAGETRRLLGVNRSGGEFACIQGNGIWDGPMDQASIDAMRTWKIRTVRVPLNEECWLGTADVPAAYGGAVYQTAVKDYVTLLVRNGITPIVEMHWNHGLYTGPSSGCSDVKATCQKPMPDAQYAPSFWTGVAGAFKGDDAVVFDLFNEPYPERATGDATSGWKCWRDGGTCTGIGYPVAGFQSLVNAVRATGATNVILVGGLAYANDLSQWLTYKPSDPLNNLAAFAHIYNFNTCATTACWNSQLAPVAAQVPLTLSEIGENDCAHGFIDPLMDWADAHQVGYLGWTWNTWDCSTGPSLISNHNGTATAFGQGLKDRLARVSN

SEQ ID NO: 12946 - protein, 402 aa, Actinoplanes utahensis
MSGGFPWLLVDQNIDDGDAVVAACADIDGLFADPGEPPVERYTLLGCAPAGRLRAACDGYGAPWLGNIGLETIHRPESKHPRECWECTEELLDLTVVSASPTGYGVFDVVLEGRLRIDPEHRKRRRGPDRAPEADGYVLTGITGEGEETFGTCQDVSGVFRSRPQRVPAPATLIGCRPEPRLRRAIDAFTRGAARHRRMIIASIFSVADDGTATHMLDSGLGAEVSAVRPSVLGDGLLDVDFGSSYGDAIKGGRPHGAREIWERWQAGRPTERGQWAAYPAALRHEWAGAALAHHRPGPDRPAGRTYHLDGRHVTDEDGFYCAIGEAINGPGGYFGWNAGALHDCLLGGWGAAPGFRLVWHDSAVARKHLVPGYDRRDWCPAITMDHLLAWLAEDGVEVDLR

SEQ ID NO: 12947 - protein, 371 aa, Actinoplanes utahensis
MKIGIPSEVKNNEFRVAITPAGVFEFARAGHQVFVQSAAGLGSSITDADYREAGATILPDADSVWSEADLVLKVKEPVASEYHRMRPGQVLFTYLHLAASRECTDALMEHRVTGIAYETVELADRSLPLLAPMSEVAGRLAPQVGAYHLMRQGGGRGVLMGGVPGVYAAKVVVIGAGVSGMNAAAIALGMQAEVKLLDRNIARLRAADADYRGHLQTIASNAYEIERAVLDADLVVGAVLVPGAKAPTLISNDLVERMKPGSVLVDISIDQGGCFEASRPTTHDDPTYRVHGSMFYCVANMPGAVPHTSTYALTNVTLPYALELANRGWRDALRHDRALAAGLNTHDGHVVYGPVAEAHGMPVTLLTEVLS

SEQ ID NO: 12948 - protein, 205 aa, Actinoplanes utahensis
MHPPAPPRRLPRALDTDQVERLLAVPAADNPLGLRDRALLEFLYGTGARISEAVGADIDDLQLGADSAATLRGKGGRTRLVPVGGYARTALQAYLVRARPTLAEAGRGTPAIFLNARGGRLSRQSAWTVLHRCATAAGLPVDGPHAVSPHTLRHSYATHLLDGGADVRVVQELLGHASVTTTQVYTLVTVERLREVYATSHPRAR

SEQ ID NO: 12949 - protein, 309 aa, Actinoplanes utahensis
MSGNDRAEAWTTALRDQQNSLDLGADLGPADPTAYTMRRPIPEPMPTDRHGPARIIALANQKGGVGKTTTTINLGAALAEYGRKVLLVDFDPQGACSVGLGVNPHNLDLSIYNLLMQDDVTTEDVIIKTDVAGLHLLPANIDLSAAEIQLVNEVAREMALARALRSVRKEYDFILIDCQPSLGLLAINALTIAHGVLIPLECEFFSLRGVALLLDTIDKVRERLNFDLELEGILATMYDSRTTHCRQVLQRVVEAFGDKVYQTVITKTVKFPESTVAGAPITTLDPASSGARNYRQLAREVIASKAERG

SEQ ID NO: 12950 - protein, 225 aa, Actinoplanes utahensis
MLFALGTPVAFAALVVSFIAAVMLRAVAIRFTARTVGLAERGDRLTPSLRHDLDPFGAVGAALGGMGWGKILTVDDVPRWRGRGRAAAVFAAGPVACILAGELLVAAFALISADDFRFQSLTVGMVLHGVDGPLPYGQQVLLSFGVGLLAFGLLALIPIPPLDGFGILYNAIPRPGHGMQWMRLWFEDKNIGVLLLLIFSLFPGGYPLVLMILDVLGHFFLRAWA

SEQ ID NO: 12951 - protein, 282 aa, Actinoplanes utahensis
MPPTVVITGASSGVGRASALAFARCGARLALAARSAEALETVAAECRALGARVVTVVADVTEPAMVREVAAAVDRVDVWVHTAAVMAYGRFEDVPVEVFDQVVRVDLLGAANVARVALETFRRQRRGVLIFGGSLLGTVVTPYTSSYVTSKWGLRALVRALRLETRDAADIHVCLVSPGAVDTPIYRRAANFAGRYGQPPPPVDSPEKVAAAILRCARRPRGTVNVGIANKIISLGFVVTPALYDVLVGPLMRRGGLSRERVGPHNGNVFTPVHHAAAEDRR

SEQ ID NO: 12952 - protein, 147 aa, Actinoplanes utahensis
MGRAKRIWFRLLKHTINRPAIATVHRGWGPLSVVQHVGRRTGTRYETPLLLVRRGPDFIAELTYGPDVAWLRNAEAAGGCTVLHRGAAYRIVGIDDFPAGAGVRAFGVPAGLVLRLTRRRHFRILRGVRGHAPWADPGAGPAGKRWP

SEQ ID NO: 12953 - protein, 196 aa, Actinoplanes utahensis
MVTTAPVRLSRSLQRLAGVAGLLGATVLVVNAAKRAHLVPTSAVTQLLAPLAEVFALALITALYLICEGRIGRLGRLTFAVNYVALAALVGVEFVINLVFSRLSTDQIADLRAGPLGVALTVASILFLLGSVGFAITLASTAIPPRGALALYALGSVPVALRAFVPEQVLDVSLFVLAIGVSWLSAWLVGTRRADG

SEQ ID NO: 12954 - protein, 192 aa, Actinoplanes utahensis
MLLPMPGPKNVLVDIWLLSSVATALVAEELADSPLSVDEFALYGLVSDLGPVTATQLSQWTGMSPTTLSAMLRRCQARGELARTPNAADRRSTLVELTEQGRAVYGAALPALAVAQQRLAEHLDLPDDDARATLQRVDAATRAALRLPPRPYRVSAPPVTGGLPAGTAGLTADQEAEVRAFAAWLRYRDAAG

SEQ ID NO: 12955 - protein, 251 aa, Actinoplanes utahensis
MQIAIVLYPGMTALDAIGPYEILRFLPDSEVRFVGAEPGPVVTDSGVLVLGITHGYDETPRPDLVLVPGSGPNTATAMVDRQLTDWLRRVHETTTWTTSVCSGALILAAAGILRGHPATTHWIAQDALKSFGAAARRDDRVVRSGRILTAAGVSAGLDLALWLTGEIAGRDHAETVQLFIEYDPRPPFDAGHPSKARPEIFDRADRLGRRIAMSPGAFRAVATVAWQQALRRTRRTAENRRGDLDRGRNRR

SEQ ID NO: 12956 - protein, 732 aa, Actinoplanes utahensis
MLIGPPSDQRHLDAGRCRLGGSGQREAQVGVRRPLPPGRVGVAGDPVHLSPAGDPHPRPGQKATVDEHLGLRIRGDRPAHRDAGTRYVQPERAAGRLRGGARRAAVQPGAHLPTDVVESAVDQLRHPELQRCDVVEPTVLHESGRPALAEQRVRGGDRLVGAGEGHGHPAGGAEPDPVHGHLPAALPGHGEPDERQPQPPAVVLLDRQDVLGDRPVVGAIVDLDDPGRGAELGAGVGRRADLRVAGAVRAGLQGGVAEQRVLRGVEVDGAGHQAQGGGGVPVGQGVEVARGDAPRIVGDPAGHRDRHHTHGEQQQERDERGGASPAYTRMVVIRNGRRGRGGRRRRGRDDRRGAVTAPLPLHRDVTPATEAQGRHHVIGRYRKPAFRSGASETVNCSVRPTLAAMLFLVVAYDGSELLDIACVTSALAIANRIGADPPYRTVLATPGGRPVACDSGLRLDAGAELERINEPLDTLLVTGGNGHEQAAASPIVVGHVRRLAPLARRIASVCTGSTVLAAAGLLTGRRATTHWRYAAELAARYPDVLVDAEPVWIRDGRVATSGGVTSALDLTLAFIEEDHGPTIARGVALGTVAYLQRPGGQAQISMFLARRGADDFVCRRATDHVAGHLTDDLSSGALARRFGVSERHLTRLFQAYVQLTPAQYVRRARTEAAAHLLGSTGLPMAAVARRCGFGSTESLRQAFLDRYGMPPSRYRTRRPARLRPLADLPSPG

SEQ ID NO: 12957 - protein, 314 aa, Actinoplanes utahensis
MSISTLGPGNGDVAYRMQSLRHGPAEPVLDRGVPAGTLLRLWLWAAVPALIVGAVFGFLALVLFAVSGPGLSDGTTPGDGMLSAGSMLGFIVFWTVLLAVRIDEPVGEWTTLLEERWQGADSAYAAIYATLRRRGIPVEVDAVRLRSDLLPPEVVDNRLLIADRDYRIAVSIFPYGSGLSVGWTMWRGRRGATVLGNFLRDVGAGMVGQGVRAEDLLRGERVRALREAVHAAVREGAEVAAQGLVVPIGPAFGAEVPILDLRTSVPAFPAFAAPPAPPATAPPATAPPATAPAPAAVPPAPAVVESDEPGPPVS

SEQ ID NO: 12958 - protein, 316 aa, Actinoplanes utahensis
MVYGRHVLEEPAPPAPDAAVPDSGGFTVRLHNFEGPFDLLLQLIGKHKLDVTEVALHQVTDEFIAYIRGMGDDWDLDETSEFLLVAATLLDLKAARLLPSAEVEDEEDLALLEARDLLFARLLQYKAYKEAAAHLAELEATGARRWPRLVTLEERYAQALPDLVLGIGPQRLFKLALKQFTPKPGPPQVSIAHIHQVRVSVREHAELLRDRLRRAGLASFSLLVADCESTLEVVARFLALLELYRQNLIDFEQPVSLDELTVRWIGGDREAELTVDDYEGSPEKITDKPDRSGDPGADRLDAVAPGSDLGAVEESQ

SEQ ID NO: 12959 - protein, 296 aa, Actinoplanes utahensis
MSDEQSESLAAQMGAWVPPWERRRDEPDREFQDAVDAPQDIPGQEPEPTEIEVEPEIPVPDPIEEAPEPREPATPVDDPGAYLAGFQDAAAAVAEITPVVVPAQAAAPEAVERSLDDAELTAALEAILLVVDEPTSELKLAEVTEQPVERVTRLLDDVSARYTAAGHGFDLRRAAGGWRLYTRPEYAAYVERFVLDGQSVRLTQAALETLAVVAYKQPVTRSRISAIRGVNCDGVMRTLVTRGLIEEVGTEPETGAYLYRTTSLFLEKLGLNSVDQLPPLAPFLPDDVEEVLDASG

SEQ ID NO: 12960 - protein, 254 aa, Actinoplanes utahensis
MWKKYLMPQADTAERLQKVLAAAGVGSRRACEDLIFRRRVTVNGRVAKLGDKVDPATAEIYVDGQRVITNTKLVYVALNKPRGVVSSLDDDKGRTELADFLDDNFEQRLFHVGRLDADSEGLLLLTNDGGLAHKLMHPSYGVSKTYLAEVVGPLPRTVGRALQAGVMLEDGPAKVDAFRLVDAVGKTAQVEITLHEGRKHIVRRMMDEVGHPVTRLIRTAVGPIRLGDLRPGGFRHLSNAEVAALFKAVGDDEA

SEQ ID NO: 12961 - protein, 175 aa, Actinoplanes utahensis
MTTGYRPAIVSEVTDQSPEFMPRVEPKRGPGRLLPALIALVVGAGATFGGLYLAGWRAQPQREFNVSVFLKETATQQQKDAVQAALKKLPTKGDVHLQNRAEAYAEMKDTYARAGQPLPDYVTEQNLPESYRVATTGREFDCAPVTPLKENTGVNRVLVVMTALSKDKPGAEIGC

SEQ ID NO: 12962 - protein, 264 aa, Actinoplanes utahensis
MTSSADVNGITVSYDDYGDGPAVVLVHGHPFDRSMWWPQVAALTAIGYRVVAADLRGYGGSTVVPGKTTLEMFARDTFALVDHLGLDEVVLGGLSMGGQIVMECHRLFADRIAGLVLADTFAQGETPEGHAHRNRVADRLLAEGMGGYAAENLPRMMAAYNVAAMPEVARHVYAMMLNTAPEGAAAALRGRAERRDYTELLTRVEVPTLIVVGRDDEFTPVADAESLHRLIPASALTVVDNAGHLPNLEQPEAFNAALKTFLDQ

SEQ ID NO: 12963 - protein, 609 aa, Actinoplanes utahensis
MTFTVDEFSAWNDQLLARRAVTRRSLLLTAVAAGVGSQFRLARQAFAAAGGTTGGAGVVVSGRHLSFVPGAGDIPLDAMAVTAQLVSSTGSLPAALRAYVDVGDAPGNYGTRVEAAVTHLVGQYAIPGGPVASQFYAKARITGLKPNTVYHYRVRLSDGTVTGDAHFTTAPAAAEPFTFTAFADVGTNTAPRDPARVWPAGIFDDNAYGPNDPIAGKYGTDRTPAATITRLMDTQRPAFTLLAGDICYANTSGTGLPADDTTALTGKAPAGRNLFNPNVWDVFLNQIEPQAAYTPWMFATGNHDMEPVYGNTAVLGDSPTHGYGGHVQRLDFPATGPRGCPSVYRFVYGNVGLISLDANELSWELQSNTGYSGGAQVAWLKDTLKRWRAAGSGVDFIVAFFHHCAFSTAHNHASDGGVRAAIEPLFTRYRVDLAVQGHNHLFERTDPIRHGRRTRAAPDGATVHPEKDGTTYVCVGSGGRPRYPFRPAPGAPAPAPPGVVPKGEQKLPEGQRYRGHRANGRENTSSTVANSYFWAEHNGKATKGVRVPESVDWSQVRYDGYAFIAVDVVPPRLAGGRTTLTVRTLADALPGSGQAHTEIDRITLERTAG

SEQ ID NO: 12964 - protein, 530 aa, Actinoplanes utahensis
MPATWRMPGSAATWWHWSSALDSIQLEGEAKTDTLADKTDALSQEEEARKGNRGDSSVRHAGQFCRPRARRQPDIPWHDPPMPLLTALLRDTDVPGFVTTVDRSVSRHELLAMANALAARIAGRRMVAVEATPYLSTIVTVTAALLAGVPIVPIPPDAGELERAHILSDSGADLITYDLSEKSDETPAEPGPNTPALVLYTSGTTGAPKGVVISRRAIAADLDALATAWQWTADDVLVHGLPLYHVHGLVLGVLGPLRIGARLRHTGKPTPEAYAGTPGTMYFGVPTVWSRIAAAPDRARALAKARLLVSGSAPLPVPVFEALHELTGQSPVERYGMTETLITVSARADGDRRAGQVGIPLDGVHTRLVDETGTPLPDDGVSIGHLQVCGPTLLDGYLRGAGVRPAELVDGWFPTGDVATIGPDGWHRIVGRASTDLIKSGGYRIGAGEVEDALLLHPAVHEAAVVGTPHPDLGEQVTAFVVADPVAPVELIAWVAERLAAHKRPRTVHLVPELPRNAMGKIQKKRLKTD

SEQ ID NO: 12965 - protein, 361 aa, Actinoplanes utahensis
MSVFASPSSWIESSALDQCHQVAALPGMRHVAGMPDLHPGKGAPIGAAMLSSVLYPLLVGSDIGCGIAVFPFRLKRAVPEKLAARFPDLDVPDPFHMPPVIEIPDPFGTAGPALTDSLGTVGRGNHFVELARVDTVFDADHATRLGLSRGDLVLIVHSGSRGLGERILRAHTEVHGAGPAADPEAYLSAHDAAVRWGSLNRRVMGARVADALGAPVEPPIIDECHNSVEIRDGLYLHRKGAANGDGRDVLIAGTRGTPSFLVAGHAGADAGFSVAHGAGRKMSRADALRRGKVKHTIEELRRTPLGSHVVCADRQLLFEEAPSAYKRIEQVIGDLTGHALASRIASTVPLVTYKTAHGGRK

SEQ ID NO: 12966 - protein, 266 aa, Actinoplanes utahensis
MNRRTRIGQGASVGPGSSVVASGGGRAVGSGGASGGGRALGSDGASGGGRAVASGGEAVARVQLLLSAGRGPQECSWAVAQLARRLEADARRHRLATARLASMPGEHPATYRSLLVRVCGPADAVRAFAASWTGTLCWQAPSPYRTGPGRKNWYVTAQPGDLDTPHTAFRESDVDIVPVRTGGPGGQHRNKASTAVRATHRPSGLVVVVDTERRLSLNRAAALRLLRDRLRRLDEAAARQAVTSRWRLHDDLVRGDPTRVERPLHS

SEQ ID NO: 12967 - protein, 316 aa, Actinoplanes utahensis
MGATVSDLIRIVSDDHHNGDIPLVWDAYRFADRAHRGQRRRTGDRLITHPVAVAAIVAEHGGSTPAVCAALLHDVIDDARIRPSTVRHEFGTTIADLVDDVAARVVRDLDLSPPTTPPPRRNPVPLRRAPVAPGRDLLPAGRDLLPAGRDRISANRDRISAGRDRISARRDLMLITAADRLHNLRTVQPLPPSRQRAVSLDTLTFHVPLARHLRAPAIVTELTDLACRHLITADRPGLRIRSRRLFTVARRTDPRWITETTAALGGGALLTSGILPEWAVATGGAGLLTLLTAALFSRDPKAADRLASLIRAWRRD

SEQ ID NO: 12968 - protein, 424 aa, Actinoplanes utahensis
MCRAGHAPTVCRMRTLRRTIATVLLAAVAAAGFGTPAAAGPSPVARGRLVAAHPVTTYQSRDQVAAFLAANHFDATIARYGVSLHQLIYRTVDPNGRPTTASGLLVLPLDGSSHLRTVSFGHGTSVYRGDAPSLGTDPFLTGPAISFASAGFAAVAPDYLGLGAGTGPHPWMDVPTETSASLDLLRAARTFTAGQGRELDREVYASGFSQGASAALGLARALRSGADPWFRAAAIAPISGGYALRRVEIPAALDPASGVVPRLAAAYLAYLLTSYDRWHDIYPDPAVVFTADYVSIGDLFDAGHPGAQVLAGVPESPALLLTPAGRDLLSHPRGRFAAALREADSVCEWTPGVPVRLYFSPGDEQAVTGNTTACRGSFAAHGVRVPVVDAGVDTSYDGMVHEGSELLAVPMITRWFAGLAGMSL

SEQ ID NO: 12969 - protein, 226 aa, Actinoplanes utahensis
MALEVRPARCVVAVDGPSGSGKSTVSRRLASAVDGVYLDTGAMYRAVTWAVLQAGADLTDPESITKIALETELSIGTDPQAPHFAANGTNVDAPIRGPEVTAAVSAVAAVPAVRKHLVALQQAIIAGQPRIVVEGRDIASVVAPGADLKVYLTASSAARAQRRSAEDATDVAATEADLTRRDTLDSSRATDPLRQASDAIEVDTTGMGIDEVVQHLLTLLNSKVSK

SEQ ID NO: 12970 - protein, 478 aa, Actinoplanes utahensis
MTEFPADLDINDFEGGLDFPSPAGEDTSDSFSGPVPVVAVVGRPNVGKSTLVNRIIGRRQAVVEDVPGVTRDRVPYDASWTGRRFTVVDTGGWEPDAKDRAAAIAAQAEIAVQTADVVIFVVDVTVGATDVDEAAVKMLRRSHKPVILVANKADNQNLELEAVSLWSLGLGEPHPISALHGRGSGDLLDDILDALPPTPAVIEGAPRGPRRIALVGRPNVGKSSLLNRLANEERAVVDSVAGTTVDPVDSLVQMDGEIWQLVDTAGLRKRVHQASGTEYYASLRTAGAVEAAEVAVVLLDSGEVISEQDQRVITQVIEAGRALVIAFNKWDLVDADRRFYLDKEIDRDLKRVTWAVRVNISAKTGRAVDKIAPAVRRALASWEQRIPTGALNQWLTALTQATPHPVRGGRAPRALFATQAGVAPPRFVLFTTGPFDAGYLRFIERKLREEFGFEGTPIELSVKPRKKTGPGGRGKAHG

SEQ ID NO: 12971 - protein, 124 aa, Actinoplanes utahensis
MSIFDLYGQTQHLERLDPQGVTDFVNDELIVSDIDSRQALEDLAWMTAGLFSDGNGLAQLYIDDGWDVTDGSHHGLTEQQRGELIARLGTIAHNCGQLVAELCRRASAVKRESGWDPLVTTEPI

SEQ ID NO: 12972 - protein, 293 aa, Actinoplanes utahensis
MSTIACDPLGTDRVPVGPGMSMFDPLFIGIDEFGEHVTLDIVYHNLLTAGEPGGGKSGLLNLVAATAALSDNTRLIGMDGKWVELGPWEPIMDAFIGDDIDLAIKTVRRLLTVARNRYRWLLANRRRKITREDNLSTIITIIDEIAMFSTVLGTKAQQEEFSTLLRGLVALGRACAMPVVGATQRPSWDIIPASLRDLFGYRCAFRCTTVGSSDVILGSGLAEVGFDASTISPDNPGEALLRAEKKLPYPIKAAWLSDDDIYAIADYAAWLRRPTNPATTTSYTGRTQWEMAA

SEQ ID NO: 12973 - protein, 108 aa, Actinoplanes utahensis
MSLSYVNPALTPTAPAGDSRPSKPRRRDVVENDEYAAFVRRIIRAFAKRVATGDVEALRDMVGLSAQLDDAISEAVIGLRAYGYSWAEIGDRLGISRQAAQQRWGGDK

SEQ ID NO: 12974 - protein, 138 aa, Actinoplanes utahensis
MTTSALTNDYLEALGARTGIRVEFYDPTGSRYGFPTFPYRQAPEHLATRRQLRADGLCPNGYDPVAQILWMHRGQRRVAYLYRRDLAKPKRVPTAAQLAVVAKMLLARRTCDSCGVTRDYYIPRRTGICLSCEVGGSR

SEQ ID NO: 12975 - protein, 96 aa, Actinoplanes utahensis
MSLIDLGKHLATDNCLWCIGGMSPAGIHPDLGPVLCLCPTEQWCDECGSTSLFPAEYETLDDRINELFDDGLSAVWCEACMGVVAVIPVTNDGGIR

SEQ ID NO: 12976 - protein, 169 aa, Actinoplanes utahensis
MNPLRRKAAQQPTTGPAAPASVNLTEQFAIEYAKSAVPNMLKAIDSVKRYNRATLIGALITSYLHQAHYLASTGAGYFAYLPPAIFDTAMVSMLIVVRTPGIVKDAKRWAMAVFIGAALLSATVNFAAPATSACASSSPWSSSWSSASNSSPDASAPTSPPSTNKPPNS

SEQ ID NO: 12977 - protein, 164 aa, Actinoplanes utahensis
MLMSGSDPGGGELRAVVADEGAGDVPFDDGDAAGRALPMVGFVTAAVDNGGLVAAADGDGVAAGAAVDGGDDGAAGVERVQLRVGWAGVGDVVDVDVDEGHRAPPVRVGMCPLMRAGLVSRMVVIRVSATAGVMLSRRARSSAVMGWPVVCSCWTTENRAAGSR

SEQ ID NO: 12978 - protein, 97 aa, Actinoplanes utahensis
MTFVHVDIHHITHTCPANPELHPFDTRRTIVATVDGGPCRNPISIRCGDKTAVIDCGRHEPHHRQCPACRITVIERHITSTFVGHHGPQLATTRIAA

SEQ ID NO: 12979 - protein, 598 aa, Actinoplanes utahensis
MSTSTLDLAPRENSARGAGSNADAWTPPPADYTAAGQALTRATQPGYFDWLDHVRAAAGCTRPVRLTGTLDTIEATTGRLLDSRHTDQLPDAAIYKACGNRRSTVCPACARTYQRDAFQILRAGLIGGKGVPTTVARHPAVFVTLTAPSFGAVHTRHVRKHTCTNRARCSCRPEPCHARRNPGLCQHYQPAVCWARHEPGDPQLGRPLCLDCYDHQHHVVWNLFSGELWHRTKQDAERRLAKLCKARGIPFHEVSNGKNLRRIPPVRLAHGKAAEMQRRGAVHFHALIRLDGIDPTDPTRVVAPPPGIGLNDLVDALTAASDIDFTTPDHPDRPDGWPMAWGEQIDIRPISLTGTGEVTDSMVAGYLAKYATKSTEITGHNSTRITGDTITQHADPAGDHIARLIHACWHLGNDPDAPAGKTAIRLPVYTGTAGAKIRQPFGAPRHCPDCGTRTRYRTCPVCVAERQASLDTQRPNDRQPTPYARLRRWAHMLGFGGHFLTKARRYSVTFRLLRETRIDFRRAEPDPADNATVHTVDHLDETTLIVGTLTFAGVGWHTTGDALLANTAAAQARERQAIGREELAHEASTSRPVALNAA

SEQ ID NO: 12980 - protein, 68 aa, Actinoplanes utahensis
MDGITPKALYRIPEAMRMLSLSRSVIYELIRSGRLRTVKEGRTRLVPASAITAYVTLLEQESKKGVAA

SEQ ID NO: 12981 - protein, 388 aa, Actinoplanes utahensis
MTKRRSRGDGGLHWDEQRQRWIASVTVGYTPAGKRIVRKASGKTKTEANNALRQKIREYQDGLSIPTTGYTVADAVTDWLTYGLPDVDEETVNNYTLLANGHIIPAIGARKLRDPSKQKELSATDIDRWLADKAKILSTRTLRLLHSIANRAINRAMARDKVMRNVVALCKVPTGTAGRPSKSLTYEQAKALLVAAESSSLHAYVVLSLLTGARTEELRELTWQHVDLVGRPDAEPPIPPAIHVWHSVRAHGDTKTKKSRRSLALPVRCVRVLTAQRAAHGDPRPDDYVCASKVGTQLDRHNVLRAFRAIVAAVPGMNPAEWTPRELRHSFVSLLSDNGMSIEEIADLCGHSGTSITETVYRHQLRPVLLNGAVAMDRIFGPDDTPGA

SEQ ID NO: 12982 - protein, 284 aa, Actinoplanes utahensis
MSKSTRPGRSGRGSGTVTVIEQRVHRSAAENARFAFIFTVIVSGLVALVVAKGHMHPLLAAFVAAPIAAVCGALVWALVRSWPVLRMLWWWTPEIGATVLLAWGWTALAASTSQILTAVILAVLVGGPACVPVLRRWTVAIFWCVAVRHRLRVCFSQFIITNRSGSLPLILGAWPTPVGERVWVLLRPGLSVDYLTQQVGKIAVACHAKTVRVDLAGSTNSAFVRFDIKRREVLTAKVSTPLIDEIDPIVPLDDKESATVTGLDLPDIDDIPTATEPAIPKLAS

SEQ ID NO: 12983 - protein, 69 aa, Actinoplanes utahensis
MFRYYVSYMFQGGYGSIDIHSKNPITEQGDLLETKDLINQAAGRILPGLTVMAFSRYGSVQPKPQRAQR

SEQ ID NO: 12984 - protein, 130 aa, Actinoplanes utahensis
MEGGADRLNKKVRDSSWIPGTKEIFVKLYVDTTGKQVTVSKPTEPKNDQNGNQRSEKNTGRPMWSTQVIVLDETGGEVIAITTAGEKPNVTVGQLVAIEQLEAIPWATNGRNGVAFRAVSLKPLSGASAK

SEQ ID NO: 12985 - protein, 444 aa, Actinoplanes utahensis
MTPLRLERQKLGWSRTRLAHELERRAQGRFSLATRASLLRMISAWESGARDTSDPYRTLLCEAYGRTADELGLGGGTDRAESSVGLSYASSLDAAAAILSDLARFDDMKHPAVSQGRYQPDALNAVCLDWLFGTASNDMPAGAGKRVTMKDVEEIRATTSMFDSLDRRFGGENARSMAVRFLREAVLPRFGKTSDQTVTTELYRAAAILCELIGWMSFDTSRNSLAQRYFTQALRLAEAAGDRAYASYILASMADQALFLKRPDQALRLAQVARDAGEKAGVAVATTEASMLEARAFAAQGDESGCTRALLRAEAAFNSISADDNPSWANHWGDILFASHAGTCWVDLGAPKEAASLVRTVWDSAKDQARRRVYSGVQLARVALLTNEVEQAVSYGIAALEATSGLTSNRSLQQLRDLRDQLGNHAKHPAVVEFEERARLVLAA

SEQ ID NO: 12986 - protein, 178 aa, Actinoplanes utahensis
MSTVSLVTLAEDLDREGEPEREFNPGIAQRLPRKRVAGGALIRDSADRILFVVPNYKPLLDIPGGIAEGNESPLAACRREIKEEIGLDLPIGRLLVVDWIPQHGVWPDGVMFIFDGGRLTDDESRDLKHTDDELVGLKFLALDDARHQLRPSMVRRLEAGIEALSDGEPRYLEFGRTQ

SEQ ID NO: 12987 - protein, 41 aa, Actinoplanes utahensis
MTNWVTIANDHGGQAWTLMDVDPQVSSVLTKFIQDHELLAS

SEQ ID NO: 12988 - protein, 378 aa, Actinoplanes utahensis
MTVGSYELSNGKTNWYFVIDLPMGDDGKRRQHKRRGFPTKGSAKKAETEARKAYGDASIAADGSVAAELDGWLSERELDIEETTLDSYKNIIRMYVVPHIGGRQLYSLDKRVVQDMYKTLLREGGKDKKPLSPTTVRTTHRVLQQAFKDLGINLENVRQPRPAEREDHGRKGVWSPQQSKTFLRHHRDARLYAAWALAIVAGMRRGELAGLRWAKIDLDQGIVYVHIQRTICGNKVIEKSPKGKSRRPVAIGPAMVRVLREHKVRQDAEKAEAGLLYHDRDYVFPREDGEPYYPRYFTDMWEKACLEAGVRQIVLHDARHTSATAGADAGVPEHVMQKRLGHADGRTTREVYTHVLPESERKAAELMDSALQDWDEAA

SEQ ID NO: 12989 - protein, 132 aa, Actinoplanes utahensis
MRLLAEARWRHPSNTCRFEAEYLSITEDPADNNPERYFVELSAPHPDKSHSSLWTLELQQWIPDYDDSEDDGSATSENILDCHLDTPPAVDQIVALLNLCTDHPSLLTTWAKTPIGNSLAGTPYVVDERHDD

SEQ ID NO: 12990 - protein, 106 aa, Actinoplanes utahensis
MANALTVIAEHRGEAWNELARIRDSYHRRISPWLTLMLHRAVTATPTETLRHPTSPRLLPVLPGAILSPDPGMPDPDYLTHRIARLGTGGTTQPCPPKGSTWTTHW

SEQ ID NO: 12991 - protein, 108 aa, Actinoplanes utahensis
MARRPQVWNPRASGESLTLVEVTGPDGGEEAGEIRAAYLQCVGVGVLRVADQDLVVDGGDFDAGAGRAAAAALPRRAAAHQCVVHVDPFGGHGWVVPPVPSRAMRWVR

SEQ ID NO: 12992 - protein, 31 aa, Actinoplanes utahensis
MLVAQRLLRCHAGPPLTSALSMSILSVGTAG

SEQ ID NO: 12993 - protein, 39 aa, Actinoplanes utahensis
MIRDSKNPDADALQVSRADFAGFLAAVRAGDFDEGQAFT

SEQ ID NO: 12994 - protein, 159 aa, Actinoplanes utahensis
MLLYAQPASRIVRLTSDDILRDGDQVLIRLGTPPSPVPEALAGILLQLVDGQPDPTSAANPGNRWLFPGYRAGQPLHPRTLLLLIHQPGIPAKATRVAALRQLVLQARHQSSPTPSATTTNTSPRSGPKQVAPGRPTSPATTANDHPMGRSCPHIRSCL

SEQ ID NO: 12995 - protein, 64 aa, Actinoplanes utahensis
MIHFLHHYTEIMTDPAHFAAEITMMLLVDVLFLGLIWPLLRRAIDRRVQNRHRAIEDADTHQPR

SEQ ID NO: 12996 - protein, 91 aa, Actinoplanes utahensis
MPKPYPREFRDDVVRITQGRDPGVTVERIAKNFGVHPMTLFKWLRQAELDAGAEPGVSRNDSAELREARKRIKLLEQENEVLRRAAASQAA

SEQ ID NO: 12997 - protein, 407 aa, Actinoplanes utahensis
MSKPRCPRKPPGAGPEQAKRDHYLRLMAQGMNNSAACREVGINRRTGTRWRYGRTIISADGESRVYAPIAVPKRAVSARYLSESERITIADEHRAGSSIRAIAALLDRAPSTISREISRNSDPATGDYHPFAAHQQAAARRPRPKPAKLQTNTELRDLVQELLNQRWSPEQICRALPLQHPDRPELRLTHETIYQALYRPDRGGLTRSRSPLLRTGRTYRKRRRSREQRTPRFTDSSNSIHDRPITADDRGIPGHWEGDLIMGAHNRTAIGTLVERSTRYVMLVHVPQGRNAAHFRDQLITAFSTLPTELRQSLAWDQGVEMGRHAEFTAATSTPVYFCDPASPWQRGSNENTNGLLRQYFPKSSDLSVHTAEDLTAVAAELNNRPRKTLGWDTPALRFARLLAEAA

SEQ ID NO: 12998 - protein, 187 aa, Actinoplanes utahensis
MITFTDLPRTVHSTTHRGTATMEPVPGRPPPKPYDFAGPRARYFKALIQMVIGIVAVLGIGVWLVVKLFERPFPAVHDLSDGIFGGIGFALGLAAVVELAYTLFTDGPDEALNPVMLGVAAALLIQLGRVETFKLGEALAGLLYAAALAGLFATRRWLAEPEDEQSWSPPAGWAKRWRRGSTKWHVR

SEQ ID NO: 12999 - protein, 241 aa, Actinoplanes utahensis
MAKVSAGAGTGLYASRPRQRTWTCGDHCIRPCRSTPQVGCRDALSTTSSGALLRSVRHSLIVDTDDVWQLVEQARRERDGSLQADEVAQRMVELLAEREPAEIASFAQPLWDLLAESYRVELWAAAYVVNGGASDDGFDYFRGWLITQGRTVFQQAVADPDTLADNPIVIQSAAAGECLEDGDVLNVASNAYLAATGHELPHDAFTIRYPELDFTWDFDDEAEMRQRLPRLTDLHYQSAEA

SEQ ID NO: 13000 - protein, 1263 aa, Actinoplanes utahensis
MYNRPTKSAAPAGAGTPSGVPLSHGRSSRPFPSTSSNVRWGTGWIWYPNISAASYRMVIVVSSLLHRSWRARCPAGSVPGDPRRHGPPATGQSYRATQRLVPARQPARSRSCARQPARVTAAGTGVAPRQRGQQDPHGMGFAEASGRSLWPAWTGNRLTSVATDAPAAGASAPTWTYTYDGSKLTRVCSPLSATSCTSYTYVSSSHYRSVVLDDNPAAYWPLGSTAASLENVVARSPDENKATARNVVANRPGALAGSPDGALGFTGAADSYVTLPEALLAPSVAFSIELWFKAAAGKSGVLFGSQAMQIPAVSAGGWAPNLTVGIDGKLHGYQWTAGGSASSPMVSPGVVTDGQWHHAVLTMAVDKQSLYLDSAKIGEISGKVVDHIGMTRHYLGNGYTKDWPSMGAGYFPFTGEIDEVAVYRHPLSAAQVSAHYSAQAATSRLATVVEPGQFTATSATYDHASGRITTMTDRNGAQWTLAPPTVGNRVRVVTLSSTAHDAITYTYDADHNGRLVLRTDSAGSGDWEYDAAGFVNNYTNPNNRTRYFYYDQRGNRTIDVDRYNGTWRYRYYGYDLYNDPLDPRNDQLQWSTDGRSDGMSYEHRTWYYRDEKGRPTAVVKPRLPGQSSPTARKDFTYTTGTEDAIGGGTTPPGLMSTESNFAGGITHYYYNRAGDRVRTVDPVGLTTEVSYDAIGRPTTSKISAVVNDATVDYGTTTTTYNTASLPDTVTSPAIVNPITGITHTARTKYTYDAAGHTTQVDNSDTTGGDATRTWKTGYDPAGRVTSSTTPDGAVVTTEWDQAGNQVREKRPGGQILEYKYDDLGHLTETATTGDGVDPMDPATTRMVVESRAYDPAGQLASVVDAMGRETAYTYWENGFLESIRQIKRDADGTIASTVLQQYNNYDGAGNVVRRTEAGGVVHDYLYDNANNLIQDVLDPAGLMRSISYRMRGDGQPESVVSGNGLALGVNTPGESAVLSNSGSLVDGSQARYADGTTSFTYKFTLPADTTGASVNIDIDNQFLVETSSDNSTWTKILEETRDIRDGSNRAVRTLDLTPALGAGKTVYLRVRDSQPANGWGGRVVRSDLRFQRAGAPPEAASFGYDAMGRATSTTMTDPTDSPQALITATKRDPRGLPVSVTDPAGAVTSYTYDNAGRQERIVEPARSVWRNGVATDNVTPTSVAGRNTFGELTESRDANGAVARIVRDGAGRQVEQILPAYTPPGSTAITPSTKTAYDDRGLAVTETDGLGRVTSYEHDKTAG

SEQ ID NO: 13001 - protein, 646 aa, Actinoplanes utahensis
MAQRRRHRQRHPDLGGRPQHVRRTDRVTRRQRRSRTNRAGRSGPPSRANPARLHPARQHRDHAEHQDRIRRSRARGDRDRRPGPGYQLRARQNGWLTSVTGPDPDGDGPKTKPVTRYTHDRVGEILETTDPLGARRLATYDERGNQVTDTVTERAGGTTYYYTTTMTPDDRGRTTAITTPLNHTTKTSYNTADERTTTTDADGVLTEFRYDASGRTIAQIVGTMATGWTYDALGRTIAVTGHTVTNGVLSAPLRTSRTSYDRDSRVTRKTSAEGRITDYGYDGGGNVRTITQLRTPTDPASAVTVGLDYDALGNRTRTSDGNQHVTEYRYNDWGAPVEAVEPATAAHPAAMDRTWTFIYDQGAQAIRANLPGGVSVERDYDGLGQITTERGSGAEGASTTRSFDYDALGQLRKASTTGGDNTYSWNDRGLLTDVAGPGGTATYTYDAEGRLSNRSDGAGPAAFTYTSAGRLKTVTDPLIAKTLTYTYRPTGEVQTVSQGTGSLSRTYGYDNLGRLASDTLTKANGTQSAKLAYTYDRDDLLTGKASPESPATAPTLTATTASAGKPHGHDPTIRPSRTATTTLQTAPRSAPAPTPAPTHSTSATGCSPRPAAHNPAWLTPGHRAAPSAAPPKTAPPPPTRSTPSNR

SEQ ID NO: 13002 - protein, 574 aa, Actinoplanes utahensis
MANTWSPRGTIRSTTENSATTTYTFDAFEQMTTAADPGYTVTYAYDAQGRVATRNGIAFGYGGIDNSPVLVPGAGHTPRGQIFRDPDSRPLSATLDGSPGRGLFADARHGDIRGSYDPADGSLNRSAVYDPSGEVVASTADKLPLGFQGGWSDQDTTLLNTDSRWYNPESAGFNSRDTYTLKPDPAAQANQYGYGNASPLNNIDADGHNPLVALGGVFLGSNPVGWAILGIVAVAGTGYLAYQGYQSYEYSHNVANSASSWGGMATQTSSYAYQQNAYAAHLSAAAAQGQAQATYQLAIAQAAANAHVAAMTAAYNAYVAQRIAAAQAAAARLKAETDAAVKLGQQRLAADAAQHAAAVKAAQPGPVGTTVVKPPAAIALVGGAGLVTNIDATKQLPGTVFAGAGGNDAPNIAAAAGAVAATEGLQIAGGDNGDDDGCGQKAAEDLAEGLADWVDPNDINFSQRTVSPNDYVQSMKDGTWDWNREGTALRVLERDGQLVSYDNRRLDAAREVRAEDPTYRVKIEVLDPEAANPAKSTGMNWDKSFEKRMTSKRNKDENGCRVPWQGLHERPKWE

SEQ ID NO: 13003 - protein, 76 aa, Actinoplanes utahensis
MARGIQPGEESFRSVSTFTTDYVAVRDCGTRRLVYLSHRVWVNGESLGRVERLANLEPAQSRTVNLDGAGSAIRPV

SEQ ID NO: 13004 - protein, 257 aa, Actinoplanes utahensis
MGVDRAGTAAVAGEGSGAAAGPGPAVSAGHSVCAAYRHRLGGSAAGARLRLRDDLLAPAAVLDRSRRVRPSASDTAGQVERGESDRLVESGDGRQSHRREKGGAGTGPSPVNRGKPGSKHHLICDGNGTPIYVLTSGANVPDIKRALDLLDCYPPIAGRPGRPRRRFGALLADKAYSSAAFRQACRERGTEPIIPKPKTTGIKGLGKLRYVVEQTFALLHQFRRLAVRWERRLDIHDGLVSLACVLICWRRVINWTR

SEQ ID NO: 13005 - protein, 225 aa, Actinoplanes utahensis
MRQRRPPLQRRTRTLTPKKERHRTMSRMTRSAVRGILATLMVLLGAVATLMTSPTAASASPIGATELGAVDLGGYCRSQGNVDAVLSGGTAYDWHCRTRDGQNTDLSFTKACQWTYPGELPGSAAFVFDRIDNFYAPASVQCWKASTDEVTAPALDGYCSHHPTGDRAVLTGNTVYDWKCESQSPNGPVYSPVNVLQACQQTKMRNSAVDRFTNFYDPYSWQCRV

SEQ ID NO: 13006 - protein, 157 aa, Actinoplanes utahensis
MERVSDEVSLPLPPAPPYYSPASCGPEHGRFDSDEMVDVEDPEMPAKVNAGWLHMATEYGVLDSRREFLLNVNYSDPEEVEPEYAWVRVRLSDHWDLAGGHSTALRSGFGGLFTDRFVPEFSMLSTDHKAMLNTTVWGNGTVSTIVIRPDRREHTVD

SEQ ID NO: 13007 - protein, 48 aa, Actinoplanes utahensis
MQLTEVLDVLKRLIEAAEHPDITEVSVFSRGPELPRNGIAVKDRWSGA

SEQ ID NO: 13008 - protein, 112 aa, Actinoplanes utahensis
MAGQAGTPVEWDLEQFKVEAPRWRDAVHPPAEIYIKVERWWRLLKRVDARIEAVPVRPENNPEGNLWWMWVPDVEWEDEHGRGFRLSCYFRVYEKDDPPRLVCDEFRSERTR

SEQ ID NO: 13009 - protein, 219 aa, Actinoplanes utahensis
MTFRDKSVIRQQSSDDIDTFRGVKSSAPTTGEATNADSSTSVDVPTTSPSDGLSRDLAPPYVAPMTTSASSVITAINTRRPGLKPAKQHMLMFFMQGHHLAWRDRALFDEPMHATERAVEIDASADSAEPQITDEAALNTIGYVIARYSALSPADLRTLIQASQPWQTATKPGSESRIEWALLRDWFQRPDETDDPDDERPNRAEVAAAEAYLASRARK

SEQ ID NO: 13010 - protein, 81 aa, Actinoplanes utahensis
MTARDGQRLNDWIAAVVADDQPDLRSFTAGLRRDHDAVVNGLTMTYSSGVVEGHVNRIKMIKRQMYGRANLDLLRKRILLA

SEQ ID NO: 13011 - protein, 113 aa, Actinoplanes utahensis
MADLGALPKGRAVVLASGSVPTLVRTLPWMSGPHAAAVTASIRAHDPAAEDTIAEALESLREVEQQEATAGTPWTCAPTYGRCGPPSADHRRHVGRRNPSADQLAAHPPRPTR

SEQ ID NO: 13012 - protein, 426 aa, Actinoplanes utahensis
MTPPSGLSIQDDLLDVIQKVLQGAAANLRPDLERRMRLAAAELAGGGSTMIVAEAVMDALQLLEVDLRSRRAAMADPRRRACLAFEARDDEGRLRAFQAQAGKWPRALSDALSATMSDIEFAVHNWLRALLDEGIAVIESQGLAGADLDGWLRQRLVVETEAVHRALHVAAREIGERVAASIGVSEAVPPVHLDLEPPAELVAHIRRGPRVLSERQTMATRLVGVLMPAYSGIMIALIVPRFLGLAMPYWLSTAVAASGAIALGGTALAGEKQRQRSRRNSESAAELRSLIDTFRMAVGKRARDGIRAIERQMQAGLSEAVTDQSQRLLAVAEASRRSAQAGEQPEQALAAIDIDLAFIGELRERTRQLSPPRQALPAPGEQTMALDAVALPSASGSPSHPCPARPAGSNGGSASPCSTATTTAPG

SEQ ID NO: 13013 - protein, 101 aa, Actinoplanes utahensis
MSIWQSSLEGGSGCLDLGRGLFGGGDTSIGPGQQHNGGWGGADDCGDDADGDHGWVGHGGHPGQGSFDDCDPGRGSSDDCDPGRGGNGSMGHDHHMIPFCH

SEQ ID NO: 13014 - protein, 79 aa, Actinoplanes utahensis
MLISRPCYRGGLTSTPTTEPAPGHRVHAGDKPHHRGSRPPDIKGHLPKADLVVDALPWKLCDTEAQRKRARGRVASLAH

SEQ ID NO: 13015 - protein, 174 aa, Actinoplanes utahensis
MPQPWRPAKTPCTSVGGLQGVGFAADPASRRDLLLVTSSDGHGLFDAVSGQKLARDRDLDPGVPCPDGDLCCPGLGPIAATSVRIAGLHGGGLHTGTRDGWLIDVVSPDWPNQRVLLSYRSDPFSGEEGATWWHIFHSRFSELRAAGFSPSGSTLVVATSSDITVWTRERPPVA

SEQ ID NO: 13016 - protein, 180 aa, Actinoplanes utahensis
MPMRRRPKSYVRTMLTVGSAAALSAACGQAGGPVATLAGAPHGIVVNRGGVVEVLDDTTTGTVRQVTEQDTGGTSADPLAMTKVRQLAAHTIAGLRAGRLVALDPAHADRPRTVAPASDWFPDTALTGGWAVTESLNQPPCPAIDGTAAGTTRYRLERHDLSTGKTLRTTCRPCGPDPGF

SEQ ID NO: 13017 - protein, 174 aa, Actinoplanes utahensis
MTARPLTGEPLALDLVNTEWVDHGRTVDLFDEPGGLLAWLHEQHLTGNHTTVAAPLRQARSALRQALEQPDEHAEQQLNAILARGVVRYTLHQGAVREGSDVDADWSAAWHAVRNYLDLIRQDPTRIRRCAHPACVLYFFDISRNGTRRWCSMDGCGSRAKAARHYQRHRTTPG

SEQ ID NO: 13018 - protein, 224 aa, Actinoplanes utahensis
MPHHYLQHLTTAPVAAAQQRYGSRAAIERMIAGWDTDALLGADEITFITARDGFYLATVNTDGWPYLQYRGGPPGFLHPLDPVAGHSVLAWADVRGNRQYLSVGNLGCSPRVSLFLMDYAHRRRLKILGTATVHDIRDGMPAHLAGRFGTLRTPGVVERLITVEVHSYDWNCPQHITPRWNEAELHDALAPIRDQLTQLQAENDALRDMVRRNRFQQHPSQETS

SEQ ID NO: 13019 - protein, 160 aa, Actinoplanes utahensis
MTRDPSSTPQPPRHPLPPFTVDTARAKVQAAEDAWNTRDPRRVAAAYTPDSMWRNRDTFLTGRAEIEAFLTHKWRRELDYALRKQLWAFHDNRIAVRFQYEWHDPSGQWWRSYGNEQWEFDEHGYMSRREASINDVAINPDQRRIHGPRPAHDTTDIPLR

SEQ ID NO: 13020 - protein, 220 aa, Actinoplanes utahensis
MRPGNLRARIRQLTSQACRRDSFTVRVSTSSRPARTLGAGTIALSVGLGLLTGLLDTPQSASAATRSPAVTTTQVFSQTSVPFSQSGLTLKAVASQSKAAVSRAAANRIMIEAAKHKGKLYKFGAAGPKRFDCSGYTMYVYKKAAGKKLPHKANLQQRYGKAIAKSRARPGDLIIIRDGSYGTHAGIYAGGGMMWAAPRAGKTVTKQKIWSRNYVVRRLV

SEQ ID NO: 13021 - protein, 364 aa, Actinoplanes utahensis
MTGDGRHENAALVRENGGLTLRFAGSCNPEAIQILRAGVCGTDLQILRNARPDAARILGHEGLGILPDERRYVLFNPVDPDDQDRILGHSYDGIHQRYLDAPGRPPLVSAAPNLPADLAVLVEPLAAVLYGWELAAPRSSVGIWGAGTTGVLVALVAEIRGVRAHLIHRRTDRLAFLRSTVQLLSTQTSTKLDQRRAARLDGAFICLPREGAHGALADALDAVGDNATIDLLGGFGTNDRHPDLPGVDLGQIRRSNVCGSPVLGAVTPARTRGGKQVSLTGHRGTSAAHMAEAQDLLIEHAERFGALITHVLALDVAGLEVERMARGGTRPSGRAEYIKVAIDPTMPDGSRRRPDWTTTIEDLK

SEQ ID NO: 13022 - protein, 48 aa, Actinoplanes utahensis
MDTIVAVPEDAILVIGVNRIEQDVASLVREYSEPFMTKDPGSVGPRIP

SEQ ID NO: 13023 - protein, 327 aa, Actinoplanes utahensis
MCKTFGESRSGHISPREELLPRSSACRRERMRRPARRHLPSQRPRTRSASGVGIPSSRSVGGVVTDTVGLAASLYRRGTPYVRIPTTLVGMIDAAIGAKTGINVGEHKNRLGTYYPATNTLVDPQFLRTLPARHVRNGMAEIIKMAIVKEPVLFKLLESDPEGLIAAQLVSDDGQEIMNRAITSMLEELEPNLWENELRRLVDFGHTFSPRLEMCAKPPLLHGEAVAIDMALCCALAYGRGLISATDVKRILNLLHRYSLPITHPTCDVDLLQEGLEESTRHRNGNQYCPLPVGIGAAEFVEGVTNAELARAGELLAMFAQAEEAQV

SEQ ID NO: 13024 - protein, 328 aa, Actinoplanes utahensis
MTTPVLVFDLGGTWFRVGLSHIDGSVTLLGRYPAISRATHPELPVAELQQRMVSFIVDECVRHASTDVGISIGAAVNGHTGLVLSSAPLWGPGTWELPLTQKLCEALPAVRYSVVNDVSAQALSLLDETASSDSMAAALTVSSGIAYRTIDLASGHIPLDPDHGVQGEIGHLPSAFPWRGTYLSAVCECGVQDHVSAFSSGRAIEQLLPRLAGPDWNIAAFGEACRSGDALALELLDAFTLPLSTVLLYQATLNPQVRHTVLLGGVVDELGEIYRDSVLKNLARLGLYEVTSRDSGYFDRRIKIGNGDGLEALKGAGLYARRNGRAIQ

SEQ ID NO: 13025 - protein, 328 aa, Actinoplanes utahensis
MSPGRLDSRRFFDAAYTRRFLREELTTVDGKADAYAVEARFRQTLYACAQATHADDSGLGMQIRQVGLGMFRPDAIAAGKAVPTLEYLRRFDCHPYAYFPVQITAKEYEEIWRYQLNVASGERLALLDLMFSWSQSILVQFRRTAAVIDVPVTVLMADVKGPADPVNREGWELRAHLASPSRVETYFHTADEPADVVRDGGLLLGARRFAEMLAEPCDEARDVAGAIARLASTIATDARAAEATSDATVSPGIVDPDPLVEIDLAKSRRVDTWQIIRHFGAACEMYSGPGRPTIWQAGSDGWWNRVGLLADRDKWLTATALGDGTDQR

SEQ ID NO: 13026 - protein, 544 aa, Actinoplanes utahensis
MLLDATVRPAGGAAPLWTPDRLWSQGPSVFLHDQATDGVHEAHLAHGDEPVLRFGHWHSQEAWWALQLGRTRAAHLQRHLAGLPNGARTRVSAVAAWTENLSLVALNDYDEVDPPSLVLFIGDRISHVVTLDREYAAHVGDACFASPERIVVTDDYLHLVQCLDLSGRILWRRGERGKPGADIAALFTPIACCALDGTIVIANRRSSDLITLDLDGNVIQASIPGAHVRSASAMTALDDKHALISDAYAGSLHLLTANRDRWTLENVAHPEPTPATGEFSFPRAILSVDERLLIADTNNSRLLCFPGDPPLALPVPGWPRSAIVVDDAVLVADGLGSVLRKHPRHLSADTPGIPLEVRDRQGRPVALADPHHLAHHDANSFWLTDSSLNDVLLITLDGTVSWRWTESPLADLAPLSDPHQTLPLTGTDEILVVDSLNHRVLQAAPSTGAFRAVLGDDAEEAIEYPRFLLPIPDGWLLSSESPGCLSTFDSKWRHRAQLAVHPADSPRPVHMAEPPRALFATADFLYVPDFMRGVVYVARQTGQP

SEQ ID NO: 13027 - protein, 429 aa, Actinoplanes utahensis
MMNRLAIRGGEAVRTAPWPVWPRPAEGASQALETVLHSGRWAISGPYRGTESFERQFARAFAAYNDSAHCIPTASGTASLMIALEACGVGAGDEVITPGISWVASLSTITAVNAIPVIVDVNPDTLCIDPDAVEAAITPRTKAIIAVHLYSAVADLDRLSAIADKYDITLIEDAAQAHGAAHRDRKVGTIGAVGAFSMQHSKVLTSGEGGATITSDGGLARRMEQLRADGRCLAKVPPRPGWMELEQVGEQMGSNRCLSEFQAAVLVAQLTALDAQNATRARNAMLLDKLLADDGCRPQQTSSGTTARTYYAYAVSLPEGALPGVPRELVGEAISAELGFPVKPPYLTLSRSKLYRPETRRRFALGADHLRRLDTSRFELPECDAANGRVLTFHHAALLGDEADMHDIAAAFAKVLRNGAVLSSVATGS

SEQ ID NO: 13028 - protein, 139 aa, Actinoplanes utahensis
MSVVTVAGHSPRAFTATSFTSVEIDPPLISVCVSQDGSAWPTLRDASHIAVNVLSEDQEDVARLFATPGIDRLAIHGDWRPGEQGCPLLGSVLAHLECKVAHYVEAGRHAIVLATPTSLAWREGRPLMRHGGTYTALAY

SEQ ID NO: 13029 - protein, 520 aa, Actinoplanes utahensis
MGNIQIDEHADLGCPPGRSGDNGEDALLHSALDAAVANNAEASAINNGTERWSYSELQRQSFRFANWLIQLGVQRGDRVLVRLTNTREFAAILFGCSRIGAVMVPISTEMRQFHLRAVIGDADPRLVVTTDSDVPLMSQVTERPVHALSAVVEQMRKLPMTAPAVPTPAPNDLALLIYTSGSTALPKAVVCPHAQVAFAAHAIAAELGYQTDDVVLCRLPFSFDYGLYQLLLASIAGCEVFVPPADSPDLQLLQWIRRHGVTVVPIVPSLGQMLVRLAGRTSDQTSLRMITNTGAALNEDLIRQLQKAFPNVTIRLMFGITECKRVSILEGDGVLLRPTSVGRPLGGTSVTIVDDDDQPLPPGRTGQIVVRGPHVMAGYWNAPELTMQRFRLDRETGTVALYTGDYGYLDAEGYLYFAGRRDDLFKRRGTRVSVLEIEAAAVDIPGVRAAAVLPPTADGDLVMFVDAALTGPEVLREMSVRLEPAKVPSHCHVVASLPLTPNGKTDKKSLADHLLKGATS

SEQ ID NO: 13030 - protein, 413 aa, Actinoplanes utahensis
MNRREFVERFGSPLYVYDLDRVDAALVDLRASVPEQATLFFSQKANPHPAVVERLIAAGCRAEVSSSGELATALGVGADPRECLYTGPGKTASEIANALGSGVRRFSVESEADLERVASVALAHGVTAECIVRINGLSPAGASGLRMTGMPSQFGFDLATSPPDWNRLLATPGARIVGLHFFPLTNAVDQESLFREFAASIDMAAQLRDEHQLALEFLDIGGGFGCPYAQPGERPTFPDLRAQLIEVLDERMRGWRDGRPEVAFESGRYLVGDAGTLLCTVTDVKVSKGKTYAVLDAGINHLGGLSGIGRVLPMARPEVVDGSQGGRPERAVNLVGPLCTSADLIGREVRTAVPEPGDILAIPNVGAYGLTASLMGFLSRPVATEVVVRRGHEPTASRLELRRTSIEEENNDA

SEQ ID NO: 13031 - protein, 88 aa, Actinoplanes utahensis
MTPDLDPSFVRLLQRSLGGAAEAEPLHPDADLRALGLDSMGIIGLLVDLEEEFGVSFPDHALTFATFATPRTLWSALAELRSPVDGLA

SEQ ID NO: 13032 - protein, 400 aa, Actinoplanes utahensis
MATPTMEHTLRSDVRQRAEAVLPTLAAHATRIDAEALFPVESLDCLRSSGLMGLLVPVEHGGLGGGIPDLIEVAGLLASRCLSTAMIWAMHCQQVDAVVQFAGPQLRAELLPRIAGGEVYLGSITSERTKGGHLFTSASPLEPAGDDFLLDRDAPIVTGGAYADGFLTTMLAAPDAPPTEVTLVYADRSQMAIDQRGTWNPLGMRGTHSVGLHLRGQVPGTQVVGEPGGFRHVAANSLVPLAHLGWSACWLGTAKGALRELLALRAPHRPRGLDPKSELVAARVARVRMELEVVSTYLTRVCQEVMERRANSRDLDEPATQIHLNTLKVIASESCFRAIDGIVEIAGLAQGYRRDAAVPFERYFRDLRSASLNYANDRLLVATGVLSMLDRSVRLSGEQT

SEQ ID NO: 13033 - protein, 323 aa, Actinoplanes utahensis
MRAQSEVRHGLSMLLVDVDTAIETDWHGYEGHEDLVRVEDPPVEAWEALAGAGLLPKPEWLTWVADCQSSEDEFLGRMPRKERQSIAAARRRAAADGVRLRLGDLDSTYLDAFLPLYEARTAEKRHGWSVVSDIRGDLLADAADYFVVSAWRGDEFVGGCINLAPSEGAMRIRFSAVDQSGRYASLARALYLEAIREARVRGYRSVSLGTDPNLYGHVVEPGLLRFKSRLGFEPKPSHQVTGKPASDCADLVLGFAALMDPTIMFSYRTNAVSSTASELQAEIYSYSADVAVDQHTAALSFPVRRHVVDRRPTACATGNTAPR

SEQ ID NO: 13034 - protein, 380 aa, Actinoplanes utahensis
MVLAPVHQRAQEWSFLQALSVLDGRPGAHDAARALAETELDFDYLTVQALRHHLAPAMWRFLVDNGIENRLSDPVLASFGSLAQICDYRTEELIDEASRVADAMAAAGARLAFTKGVVNQSTLYDNSGTRVMADIDLMIPPDSTAIITETLTSLGYSVAKEYDARTNSLVDLPRSRRMVYRMYPDHLPHFTKLTGNRAQPLIEIDVAFSLTWFSSAWQIPMDAVLRDLDSVLVRPGRSDRTLPTLTPAYSLLFIVLHLFREAWFITKKPVRLNQFADVVRLWRRIGANHASEIIKVVEDNGVGPAVGWVCHHVDAMFDTDMAATLGTERYAEPRWLTSGVAEDGSFVQWHGDMRARLAGGEPVIFTPAGEPPFGAAARGR

SEQ ID NO: 13035 - protein, 418 aa, Actinoplanes utahensis
MREVAVAPLTLGQLSCLRTLERMPAGSPDGLNLVRSWDVPPGQTVTSVLNALDLLEARHESLRTIFPDTPSLAVRQVILAPRGVSVEVLEVTDAADADRHAQELRRRTFSLDSEKPLRGMVFTIGGVPVRAALCWHHIAVDGWAIQRLHREFADILAGRTLTDPAVSCRELAWEEQSDPAVERTARAVEYWTRTVGDVPSGRAASLGTLRTRWATLRSSTMREAARLLAAECGASLHSVVLAAYCHAIAERDDTDSPLVALISGNRAGTRMKQVVGTVEQVSPVRVQVDPAESFSALVRRVHWDTITAYRHGRHNVDVVSREVGSLGYEGSGFGFTYFYNYMPRPARSTVAAPAHPPTRITTRDAGRDNGYPVYLVVDDDTELTCDLRDAPPTPGYEPLERLLSCIQQVVAAEADGGS

SEQ ID NO: 13036 - protein, 409 aa, Actinoplanes utahensis
MLLFVESAPTGAGMSHVRWAVDHGFDAAYVSANPEWAPERLGGEVMETLESRGRVFKVPSSEVTEVPAWLVSSIEQAAGPSGVVCGLDRSLPFAAALAEAVGAPYPSVPAMQTFRDKRAARRLYDKLGITSARWAAPADADEFVAFTEEIGGPVVLKNCRGTGSMDVRLVESSTEARERYLELSNAERYLDGDLMAEEYLTGPLYSLETIVSDGTCHHLGVTDRQIGPNPGFCEVSYTFPVQVPWQYENEMRRAVEACVQAYGIRQGMLHTEFIVTSHGAAIVELNVRHPGGLLTMMMSDCLNSSVSEILSLSALQMPLPDLSHNGKASTTVTVYPQVAGRLVQMRGLDEVGAAPFVVQALPSAAPGDWVQPPTDYRGALCQIRTVAESSNLSFNAAMAAARGISAVVE

SEQ ID NO: 13037 - protein, 419 aa, Actinoplanes utahensis
MSSNGRFGALVERPFRLLWSGRTASAVGDSLMPVTVTFTVLSVGGSASDIGLVLATTMVARMVLLIFGGVLADRLPRRLLLMGSDVFLFCVQTVVGILLLQGHKSVGMLLVAALCYGAASAISKPALIGIVPQTVSNARLQQANALMELSKSGAEILGPAVAGATVALASPGWVYLLDAATFLVSAVTVIGLQLAPMADREPESFLKNIVGGWREMAARTWYWGAVCCHGVWNVGSCAFYVLGPAIVATQTGGAASWGLVSASMAGGAVVGSAVALRVQPRRPLVAAHVALLLVVLQLSALIGPSPTGVIMAAGFVSAAGIAYANNLWTTSVQRLIPEKVLSRVNSYDWLVSFAVAPLGYGAVGPLSEKIGNAATLEIALVIVIAAATAIMLVPGIRALQQTRSGALEGWPELAARGDA

SEQ ID NO: 13038 - protein, 733 aa, Actinoplanes utahensis
MCGLAGCAALGGASLGGDAEALLQRMTAAVSHRGPDGRAFHRSESVNLGFTRLSLVDPVGGGQPLSTDDGSLVLIANGEVYNHRELIAGLPTGTKMRTGSDCEVLLHLYRRDGLNFLDAVRGMFAVVLWDRNRNRLIFARDRFGIKPLYYHRNQERIIFASEIKALFEDPSCPREIDWLGALSDQMMTGAMVLDDSQPRSWFKEIELAPAASIVTIDLLTGDTKTHQYWSFPTFDGARTGSEAELIDRYRDALASSVAECGVADVEVGLFLSGGIDSAAVAAFAPEKPRTFTALNGSTLLNGDAEYGDRIARHVGLVNHQVLFDTTVTPSADEWKRLLWLLETPLAGPEAFYKYELYRYVGAYAPEIKAMLLGGGADEFNGGYSVSFAGGGDWTDFESNVRRMELRTAQWTRPDLGTWWEQSDRSLVRESVLRDAAGGTGRDAYDMLFRWKYRDVQQYNCWHEDRTAAGNGIEARVPFLDHRLVELVAAVPKQLRPALVWDKQILRRAMAGLLPQDVVNRPKVPFFYGDGVLHTYRTFVRMLAQNGGVLLDEALSGAGARQFLDADNIRTALHGLQQDPASGHVEFLLHAVNLGLLEQMTHSLPARPAEAVTAAVPESITVHDWDEQRSSIEEAVLQRPAIDDETVVGLADGALLLHSPDDPATWYVVVDGAIEYVIDEDDNPHWPALLRALGEETPLGVVRETLGITLAVARDLVVEGLESGVLTLSAEVVG

SEQ ID NO: 13039 - protein, 262 aa, Actinoplanes utahensis
MTVTNVRAGRVRRPYATSFDRPGWTLDSRRLIAMSCVAAFSVGLWSVGGDWARVMAIVVIVEALLMCLPWRVPRTMRSGVSFWAETLCGLLAPIVAVTMTVVTRPAWLTAGADWWWFGAAVAVAAGLIALSDLRLPSLLSGELAFVFGPTPRAHGAARAFATTVCAVGEEAVFRVPALLVSPAAPVGLLGAIAFVARHHIQPGTNRRGTIRSTMVEIAAGVLLLGLTVASGSIYPALLAHILNNIPNVILELQRENDDRGWT

SEQ ID NO: 13040 - protein, 260 aa, Actinoplanes utahensis
MIIDREHILAEMKVRALVPDDCLAVFAVGSIARGWANPGSDFDFIAITARPWSVQGARSVPVPLEPNAVQALELQVGERRWEIAYWLDGQIDQMLAKASWQQFDAGISSLKVLTDPEELLLGRFPTAVPLLGADWLERRRAQLAESAYKAFMTTRSLAEADGNVEDVFGMLAAGDAHSAVLAARKAFGHIVDALLESNNDFASRSPKWRARRMRDAGLPVLPFERYWAVETMADFDEQDPAAWAARVAHLCKDLSVEIEI

SEQ ID NO: 13041 - protein, 113 aa, Actinoplanes utahensis
MGRAGRPPVQRPFRGDRDLMATAGTLTAQSVVQRASGARFRKFRGKLFVANASLAFELDEIAEFIFRQVDGESSVEAIGAKVAAEYDVDVAEAVADSLELLSQLAQNDMVHSV

SEQ ID NO: 13042 - protein, 339 aa, Actinoplanes utahensis
MCGTVGLFIGCAALSYCPKELLLQTAQQAVGNEPEYRSPFRNWHERASVRQAPRRLLTEGAIRPYFPAELVPVTRHPLIKGLAPETFDEVLIQHLYRYLNFTARLEYSVVNRTVLGIASGSVGVTLPEEMRFDAYKMYCDEAYHTLFSVDLARQVQQRSGVVARLPDEPYFIVRLKQLIAELPERDRALAELLFVIVSETLISATLADVPEWDGVSAAVRGTVRDHAADEGRHHAYFAAFLRFLWGQLSSDDRRRAAVLVPRLIDIFLRPDVPALRAEMVGYGLTAEEAECVVDETYTPDVVREHVAATSRQTVRYFESLGAFDDPLAADELHRYGMAS

SEQ ID NO: 13043 - protein, 372 aa, Actinoplanes utahensis
MNTYTDQLALPIEVHCHGFGRVDFSEFATLDLEELDRQCAEEGVLSIPTLYLHRDRLTDFEQFMHRYHALRRAGRLPHVAGVALEGPLLASHGGTPKATVWAPTRHEWERLAKLGSLGLVYTVVSPDAFTAASGLYEALDDRHPRLDWIVPLLMEHGVRPALGHFTRADELASAELVHDIVEMAWQSEWTGQGARVVTDHLFNDMPLRIRHAFRTSAARKVRDSTLAAYDLPNWTLADMGEIAGPVPAVIMREAAAGRLSACINFDGEHVDLAIATRAVELMGYSNAMMMTDRCDSARIGGQALHQTEENGLWYQDGGIVAAGSQPLAKQMRNAQVNGISDADLWQLATSTAHRAFGTGVRTDLAALSVDSQ

SEQ ID NO: 13044 - protein, 225 aa, Actinoplanes utahensis
MLDALNRLTVDWSDLPKARQQTKEILTALAEDKNALEELLARAREEEDLFDKCEHHRLLDKLVIYDALDRGFRIRVHVSTEDHRDRPHDHRFSFTSLILRGNYRHVRHELVGNLGDVPNDVQDDFDARESDLRVVPRFVTTERAGNCYTLHHSEIHTTYTTPKTVSLFLRGPAEKERSLITERETGRVWWRFGEDQEKASRRGSKRISKQYFDDLTGRLRAMEVL

SEQ ID NO: 13045 - protein, 232 aa, Actinoplanes utahensis
MTETMTSGAVISAQERAAVEFMASLPTVRWDDIEAAAEVTERIARRLGDDREMLGALVDRVRRTPELRKKCECHALDDKIVIWDDPEKGLRIRLRLANTNQYERVHNHRYSFTAYILRGAYQHTLYATDQPLDDTADVDRFWPHFIREEPAGRCITLHHDQLHTTITEPETISLMIQSPAQKRRAFMIRRSDGHVWWREGAADETAERRAEVQMSDERFEHWVTRLKAFGVL

SEQ ID NO: 13046 - protein, 246 aa, Actinoplanes utahensis
MSITQKVLRYGDSSWQRIDIYEPGDSAPRCRAVLIHGGFWRHDRTALDLEPLACALVARGCGVAVLEYRPVWDGGAFPASVQDCVAAMAALEGSDERWRDAVVTGHSAGGHLALSALAGRAGKRRVVLLAPVTDLESAAELEVGDGAIGHFLAKHHAVGGRTVEAVPVIGSADVTELVVVQAENDQAVPSALMDRQVARWRHDGLPVTHHLVAGARHMHLVNPQRGGSDVTMALLTGAELSTGNPR

SEQ ID NO: 13047 - protein, 273 aa, Actinoplanes utahensis
MTDAVTVRTVGLDQATTPLRIGVLVSATGANLRTLLDMAAADPDTYEVALVASHAPGVPAIDVARSAGVPAWPGDFDDYCGLSSQASTDADRARYRTRAREWHDRLNARIGAWEAVHGRLDLIVLAYHRWIEGDLLQRFAGRMINQHPGDLSLLGSAGERLLIGKDPVRLAMKLGHRSTRTSCFLVDGTRDGGAVLCLGPSVPVEDRRPTAAEAHEQEMRQKAASDQVALRWTVRAIAEKRLAIDTAATHRDGSPVVLIDGTPTPLGGRRFGL

SEQ ID NO: 13048 - protein, 334 aa, Actinoplanes utahensis
MSHPATETVRRSAVPATALQRLTVDAAKDAAYRHDTYFREGLWSFERHARPERHHDVTFVVLKPDAIAGRRGEQVLGILRERGWAAVAATTVRFDPLLTREIWRYQFNAASAQRIAVVDHLLGSGPSLLVLLYDTSSADLPASVRLTAAKGSAEPRAAREGDLRTRIGRVNGLFNFMHTADEPADVVRELQLFSYQAGWDWCRDALRDPAAVLASANPAASMRALLNQVTTEIPAHDLDLPAALRRLAAGQDRWSELALDHARVDEVDLWLAELRRTPLPSGTGRWDVLTVLTGWIECNEPDVAALLDTPLPARWAAITGHRPVDMPRSARCPS

SEQ ID NO: 13049 - protein, 445 aa, Actinoplanes utahensis
MPQLNATVPVPPFVGTGNLIYRSAVVPRFVGAAGCFLEAEDGRRYLDAEAANGTAAWGYDKSLLAEALLRCAELPALPSFCESSLRVRVLSRLERLFSEVIGAPGRVELDLGGAQGMETALRIAFSSRGPGTVIVFEGAFHGRSGVTSMLSSSPRYRELLAAWGLEVVRLPSPDCRSCPHNITADSCTPGCITAVSRWGSELSGVGGPGFRRKASAFIFEAVQNVGGMVQPDPVLLRAAAEHARSQGALVIADEIFTGMHRVGPRWGFQLAGIEPDIVVTSKGLTNGAAALSAVWAREPLADAAHYPPGSHSSTYVGIPHALAVVDTMLDRWEAWAEVEHDVANLELAMRGRLEELAKRHPWAIDQVDALGATARIVLTGPHAADLRRLCGTVHPQHGLLVASTGMAPDVINIHPPLVFGAAELDLMAEILDLALDALRTEGEPA

SEQ ID NO: 13050 - protein, 405 aa, Actinoplanes utahensis
MWRLRTGYRRAAVGRAGRSGTRRGAVHMTDSQPVLVGAILENGIPLVLEPTAASEALVAVVFPVAGDDLAERVVAQQLADAFHRAVRADGSSGVVLADGLLTAWCRTPPERVAEMLPRFADALLRPDWDAEACRSAGAAAAKKPHDTRDRAVNQLRSLLFPDNLAAPGNAGQCCDLETLVERHQKMLTRRPVIVASGPSVALDALPAALGLLGEPRQFGHGPGRAPGWAAVSVGGVNLGSGTGDTPTWLVLGARSVDAEGVRPDALIVLAELFGSGPASLLRRTLTDIGITGQLHSAYVAGDAPWWYVALEVPAGQVAELESIVRETFEVIIDRRLSESAFEAARRAAWAPRPDHVRELTRLIHRAAAELDQPGAAAAPTPETLTAHDVAVAARRVLAGYAVTVA

SEQ ID NO: 13051 - protein, 216 aa, Actinoplanes utahensis
MDRVLDRLQRLDWSRIEVAERVAGQVTDVVTTPGALRELIDNALGDKDLLTMSECQWWGDRIVLFDDPDSMVRIRLHRFDQGTHFPHSHRWPFHTKVLKGKYIHRLYGPESYVRQQVESGVTTLTPSTIRTETEGCSYAIDQHMVHSVTSATNTFSLVVQGPRLKEQSLRTAQDGSLIWKGGRATETTAAVKQVLMGADRLQEVRELALRSGLIDK

SEQ ID NO: 13052 - protein, 397 aa, Actinoplanes utahensis
MDLLKPVVKPYEWGSRYAVAELQGRSTPSLGPEAELWMGAHPGGPSGLDRDGAVTDLEKVVAADPEGEIGESAVKQFGPRLPFLLKVIAAEKALSIQVHPDRQQAEAGFREENERILAGATSTRTYVDDWPKPEIVYSLTPFQALAGFRSAPDAAALLDELGVPQLAPIAETLRQSPAGDARSDALVRILTWPTEERAALLDAVVAAFGRVAAGGGRYAPACAAMAQVAVDHPGDLGLVAGLLLEYVELPPGAALYMPAGGVHAYLKGVGVEVLANSDNVLRAGLTGKHIDVAELARIAQPSVPIPQVQATTVSPGVTAYDVPAPEFRLYVIEPRGGRSEPSAIGPRILLCLEGRAVVRVAAGDSVELHRGESCFVAARDGAVTVTGDARVVMASVG

SEQ ID NO: 13053 - protein, 414 aa, Actinoplanes utahensis
MTSTDEKTTPVGGRQSSLFWRYWTASTVSSAGDAVTAMALPLVAVQVLHASTFEISLITAASFIAWIVIGLPAGVIVHRFPLRGTQIAMDVARAAALLSIPLAHLAGILTLAQVVAVALVISFAGVIFDVGNSTFLPAIVTKEELTSRNSLTSGSQAVTQVAGPSLGGILVQLLGAVTSLVVDVISYLASAVLLASLPRPQAAAPVTRNASAGRMIRDGWRYVVHHEVVRPCVAAATTINFVAGGLMALTPVFLVRTLGAPVGVVGLLFAAEGVGSLIGAAVTTRLSKVLGSSPAIRWATLVGACFALLLPLATAKWGLVLFAVGNIGFAIGIVVLSILTRTHRQATTPPELLARVMATVRFISWGAVPVGAVTAGVLATSFGNREALWVIVGAAFLTPAVLWGSSLRGKRDLA

SEQ ID NO: 13054 - protein, 223 aa, Actinoplanes utahensis
MWITIHTDRRRPVHRIGLPGGGSFRGRTVRSGEGGVRVERYGGVGGVHTGGLPGEVAGLVPVVEASVVAGMVIAWAVRKARKAAGRADETVDAAIDAGAGRLHDLVLSRLGGPVQEDLAEEAASESGQVSELTRQQVELAVAAAARRDETFAETVTDLLEQLRQADRAAGTHISAAPGSAVFIGDVTATAYDDATAIGQAGTVNIGDRLGERPDPTQPGPSGH

SEQ ID NO: 13055 - protein, 1160 aa, Actinoplanes utahensis
MPGAGVLGHGQQGGVRVGTATTVNVFLSAAGPLVTARSAYLAQLRRIAPPVLEGREAELAELARFCVEPGRGSYVWWQADAWAGKSALLSTFVLNPPDELSARVQVVAFFITARLAGQDTREAFVAAVTEQMGGLTGRQPPTVPDEGLREAWLLDLLDQAAAACTARGVRLVLLVDGLDEDRSSAAGVHAHSIAGLLPGDPPAGMRVIVAGRPNPPVPDDVPDWHPLRDPGIVRRLSPSQHARDLRRLGQAELKRLIKGTAVEQDLLGLLTAARGGLSGPDLRELTGAGLAEIEDVLHTVAGRTFTRRTAEWDPDSGPEVYLLGHEELQHAATAYLGEPRLAGYRARLHAWADTYRTTTTTDGRPPWPAGTPEYLLRGYPRMLTTTGDVPRLVALATDPERHDRMRDVSGGDNAALTELAAAAALLRREAHPDLRALLRLAVHRDRLLRRNERMPDELPAVWAALGNRNRAEALARAILRSDRGADEALTLLAEEVARNGDYDEARQLVAETHLYARAGAFCRLAMLAHTGGGDEQPEGLLAAAERAAAAVTTDVEVRSFAFGHVAVVRAAVGDLAGALETIDRIEVLDRGFGEVLIRVAELAAAMDDEPAVRAIVDYWRPDGFEDPPQWLLAQSVMLAELVGDLERAEAKSALITSETSRCAALAFRVRAAEAQLAADYARSAGDIALSAPDENRVTAQLHVVRAWIAARDLEASVQTLHEMSVREDHHFPDRSALERALEAVAEQALANGEVELAAGLAVVAAERGLRRANADMILIRALVDHGELSRAERIARAGTDFAANANALAVVAYARARAGDHERAAEIAIEIEQSVRTAAGLDSPVALAELALVLLKTGSHEHVGRLVAQILGGIMSDAQDDYDRELVAVRLVGELVRCERFAEAQALTNALDPDGDSWITDVYTYARRNDGQRGQVIAEPEAAEPVEVRIGVSIQGSSDQEIRDLFEAAERRERPYYTAALAEAGRVELAESLALGLDDLNERTGALAPIVRPACERGDVELAERVSLAIPQDHERAKALATIAGQVPDDKERADRAEAEARGVRFAEERSEALAAFSAAMFAVGDVDRALSVARSIDRPPERAKALLAIADQLSPPARRRLIAEALSFAAWDVVLPWLVAHEPAALDVVVEELGVTGDA

SEQ ID NO: 13056 - protein, 828 aa, Actinoplanes utahensis
MEQRAVRAADEATLAEAAKRGDRAALSELIRRCLPVVYSVVRRRTSGPDADDVVQETFLRAVRHISSVQDPARFRSWVLAIAVRESNRRHCMHSWEFDQSVDEDIEGVADTVDQERRILARMALSEQRREIAEATGWLDSDDRDLLALWWLELAGELDREQLAAAAELAPGHLRVRLQRLRERLDLSRAIIRVLRLQGTAHGCAVLADVAAGWNGTAAPLWRKRLARHLDECEGCGRARHGLVPADRLLSGVPLLVAPPALADAVGTATAQMAASKASIGARPKPGHVGKVLAGKPAAVAAATATILTLSSVYAYSRAQAPAPRESTTSQTVVAAPTTSLGPSPVGSVSAPPVSSPADSPLTRYVSAKAPNGGNGSFGRPFNSLSQACAAVPVNGTLRLAAGAYDLGDKTCDLAKGASLIGAGQNAGGSTITGSAPILIRVQNATERTNRQQIARFALRGGVSATQRGPAETGLWLNRLYGLDVHHLTVQNFRANGIKLADIVGSKFHDLTLNNNAEDRGNGCSGNFTVGNLTDTTITNLTARDNIGYGIKASPIDDGAGNTSGDLRNSRVTMTNVVWADIDIAVSQARCAKWNTLGAEFWNVRSIGTKMTRLRINAPLSLGQLGSFDSTFEVSNSFFDLPCDSRRNMYAVEAGMNGLYFHDNYVYCGLYTLYSEEGRDISQRFRIENNVIDGASGPGVFWMPQGMENATFTGNTVISKIRIFNLGDTRKSSITLRDNIFLSRSAAQRPSLGLDGPGLQVTADHNLFTNVGPVGTRVSTGDPFPSRADVQLPRRAADLSPYRVAGSGVAARAGVGGRPVGADVPFEVG

SEQ ID NO: 13057 - protein, 979 aa, Actinoplanes utahensis
MVRVLLESGAEISSNPVTPADPHGSPPQSPVPRAGGRENCDATGWWRARACRAELGRSDGLPEARRGAQLHSRGSPPEHHPAGPVGTDTSAGAERRSSAARPQYPGGAVDDGGSLAQSLDRSRRPQLDGGPEDDGGPAGTCFRYRHSGEPAALPCRMKDHQHDRSVPGRATTARRRRDGSWSGWPAHAADGTVTIPPGRSEGSTPLTPPSVAADLILAARGGDQSALDRLIRDHLGLVFNIAARTLPRADADDVTQETMIRAVAGLPGLRDPNSFRSWLVAIAVRETRRRGNRLGADQQRITFADTDDLVAVEAGVEDHVVHRVDVARQRRMLTAATSWLDPDDRELLGLWWLTQVGTMSSAEMASALGISAAHARVRLQRLRTRLHAGRLIAEAVAALDTPHKCDDLRALVKGWDGSPAPVWRKRLTRHVDDCARCGAPFPALLPPERLLLTVPLLVPPERLFDTIVAGHEMVPSSADGPQHRGRGRRGVVAAAAVLAVALAVGLFVVDRSPAPVVVTAPPPATSAPAHSAGPSPSPPAPTSTVAIGAGAGSGGPSWSARQLPPTDGGRYLYVSGRGDDGNSGRTRDEALRTLRRAGELTEPGDTVLVDDGEYSDPGRNSVVTIERSGTPDRWITWAAFPGAHPVVHAAQWQGIWVHASYITVAGLTVTGMRAKLSPQQIAAAKNGDVSDPAVSNSCIAVTEQARADPPRRPTHVVVWGNTLTDCTLAGISVQYADHVTAAYNVTRRNGWYSPYGGSGISFSNLWNSDGRTDVKMVVRGNVSSENQNLVPCLCSGTTRKITDGNGIIIESLTNEDVHGAPLFQAPYTGRVLVENNVSYNNGGRGINVFKGAHIDIVNNTLYHDATHPAITTDLAITLADDVRVVNNIVVAGRGVPAAEVSGSSRVSFDHNLLAGSRSTPPDPNLLTSAPHFRDAADGDFRLRAGDPAIDSGTAKAAPGIDADRMPRTRPVDRGAYEVR

SEQ ID NO: 13058 - protein, 604 aa, Actinoplanes utahensis
MPQSLHVAWPAAGSRRRRTLLIAVSAAVTVAAVGVTARIGAFADDKPAIRDLTLLDAVGNRPVSGRKPLSGDETVDLAALGTRELSVQANPVGKVGSIRFQVDGRTTRVENHQPYLLSGDAENGKDVLPWTPAAGKHTVVVTPYSRADGKGTTGVPIRITLTVIDSAGTGAPARSAGRTAGAGIGGPTWAAGTLAPTQGGRHLYVSATGDDKQSGLTAATALRTLQRAADMTRPGDTVVIGNGTYSAPGRQFVLGIRHSGTPDKWITYASAPGADPRIEAAGWQGVAVNARYIIVTGLTVHGATDRLTAKQKDAARNGDEKDPMINTSCIAVSEPFGGGESTYPHHVRIHGNTVYGCPLVGISAMHSDYVQVTNNLSFGNSNWSPFGGSGISLFEAWNSDGTTGAKLVVHGNVVRDNASFVKCGCSGFKTITDGGGIIVDSFDNRDARIKTPYQGRTLVENNLSYDNGARGINVFRSAHVDVVNNTVYHNGAQPSIQDNMSVIRATDVRVTNNILVSRGAVTAATRSAVTDVTFDSNLIVGTSTVSDPHRRTGDPQFVDPANGDFRLESASPAINSAVGFPVAPVDATGAARTGKRDLGALETH

SEQ ID NO: 13059 - protein, 161 aa, Actinoplanes utahensis
MPGPGGRATVRCRSRPPAGRRVRTPSRQGMTPQMSISTIDTEDADRCRRALAEEQAASLAATANWAHVDKDRVHRDWHDLYGEIAAAITAGAQPRDEAVQELIARHHAVVSRFYTPSMDAYLGMALLYAEDEDMRTWHTSYHPRMVEFLGAAIRHYTDTRR

SEQ ID NO: 13060 - protein, 186 aa, Actinoplanes utahensis
MFADSRRASPTRRISGTALQKRRSRLITAAGVADAVMTRATGPGERRGTVLDRLSVRRTVVVYGPRAADHVWDSYVRPQRWPEWSPQIRSVDYPAETLRPHTGGVVHGPVGLRAGFRITGVDPAGPVRSWTWSVSMLGVRLVLRHTVEPVAGGTRTGLTVDGPAPLVIGYLPVARSALRRLVSRDR

SEQ ID NO: 13061 - protein, 155 aa, Actinoplanes utahensis
MAQRRYNCGCGKKRYRDEPAALAAAAADERAHQVPATTYRCPGGLAWHVTAHGFLPEALRSVGRRLAYELAEHGRVDLDDFGTRVLRLDTRPDQRQRDRVRQCAEQMAGLGLARPDDGRPAPGSHLVAVNLPGLRRVVQVGLDAYRQERTPPGQP

SEQ ID NO: 13062 - protein, 244 aa, Actinoplanes utahensis
MILDVKAVVRAHPVLSAVVVTVLWHAALYAAVQVLPRTVPEPSADLVATVANLVAAGVPLAAVALLRWWRQAGLGRPVTRRLRLTVPVLLVNLTYAAPGLTGGAARYAATASLCLAVGVSEEMLSRGVVQRMLWPLGRTRATVGVAVLFGLGHALSAVWFSRPWDDSVVQVVTTTAFGFAYAALRWHLGSIWPLVVLHAMDDFFQLRSPGAAPLWWQAAVVLVFVGYGGWLLRQPGSATPPAAS

SEQ ID NO: 13063 - protein, 397 aa, Actinoplanes utahensis
MRSHQGKRRLLLLASVVALTASLLAGTPGAAAPAGHSAQATLDSVLAAQYAKSPLVPGIGARVDAPGLHWTAAVGHDDRAAGTPLRTDVTFRIASVTKTFTAAAVLALADRHRLDLDAPVARYLPRPYPQLLRRGGYRPDLITVRHLLAHTSGLYDYGEDAGYQEAVLSDLHRHWTPAEQIRWAMDHGAPYGRPGERYHYADTGYVLLARIIESVTGMAQATAYRHLLPFSRLGLTATWFETLEPAPGHAADRREHQYYIDPTSGTALDAYSADPSFDLYGGGGLVSSLADLDRFYRGLLEGRVISRSSLATMLAVTPGAEGDRAGMGIFSRTLDGVTCWWHNGFWGAAALYCPRYRLAVSVTTGAFVADPEHATPGAITDAAALADAAIGLLRAKG

SEQ ID NO: 13064 - protein, 220 aa, Actinoplanes utahensis
MTIRVLVADDQHLMRAGLRGIVDAAAGLTVVAEAANGLQAVTLARRHCPDVVLMDIRMPELDGIEATRVITGDTPARVLVLTTFDLDEYVYAALRAGASGFLLKDTAPADLHTAIRVVAAGDALLAPGVTRRLIAEFAARPGPVAPGAGVPPGWAAVTGRERQVLALVAEGLSNAEIGARLHITAGTAKTHVGSLLTKLDARDRVQLVVLAYRGGLVPLR

SEQ ID NO: 13065 - protein, 377 aa, Actinoplanes utahensis
MVIDCGLAACYGLIIGAVATHPARSGVASLGAGSLGVVAIVLGRRLPLVALGLLATGCWLSSAFRPAAGTLAMLAAVPMLFLLFSSALRGGRVVVAGSLLLALAGAAGTAQPRPGLRGGVLVYALLFCTAWAVGLAVGRQRRYDRELVRYHALLGEVEADRARRAAARERMRIARELHDVVAHSMSVITVQAALGELVIAERPAEAGAALGVIQRTGREALADLRRLLKVLRSDETDDGAVAVSPMPGLADLDGLVARTAQAGVRVEVRVEGPIRTLAPGVDLSAYRIIQEALTNVVRHAGTDVARVVVRYGRDDVAVEVIDEGVGAAAAGNPAGGLGLAGMRERAAVYGGECSAQPLPGRGFRVVARLPLSAGGGA

SEQ ID NO: 13066 - protein, 522 aa, Actinoplanes utahensis
MQRSTTLGRQRPRPPWGLIVIAGCYLVLAGAFLATRGSAAFFATVIPVGFLSGNIIALGFGVRAARHRGLPGRSRRAWALIAVSSAALILSIVGYAATGQAGNTAVVPSLGDLAHALFPPAMLAGLLTFPTTGRSRREATKNLLDVLTVVGCGFMILWFLVIGPTVAAGGLSALQLATAMGYPLGDLALLLGAVIVLVRGTTADRKPVLFLITALSFLIVGDAYLGYIKSHPHAGGTPTWQLGCWLTAWYLMAFAAALQCHQASRQHLAERQEEPLRRVSSLPYLATGVAYLVLFWAAWLAGLYPWAGLVAGAALVTGAVAARQLVALRENHQLVVTDNLTGLANRRQLHASLARALERSRRLDTPIGVLQIDMNGFKQINDTLGHEAGDAMLVAFAKVLKDSVLGSDTVARLGGDEFAVVMNNCGGSAGAVTVAQRIIDAMAEPVMIAGQPRRPGASIGVAVMEATALPDSNAEAIRKLLYDADLAMYAAKLQKPANAWSLHVPDPEPNLTAFADQGSDLR

SEQ ID NO: 13067 - protein, 78 aa, Actinoplanes utahensis
MISEESAQGLVRSGRCDGQRSAHGDVDRVVAVRVSVQLPSGLLDRRGIGHHLDRVSRAGRRLEPVHHPGSRRTRRGSP

SEQ ID NO: 13068 - protein, 134 aa, Actinoplanes utahensis
MRIAWGLALIGATAAAAVAAAGPVFAATPSSKPARTLSSMQAAVDTKAQHIAAKMQTVQAKVASKPHFAASKTILLADITKTVSDTAAWRKQVDSATTKAGVIAANPAHQAVKEDLAKLRADLAAAKTAKPAQE

SEQ ID NO: 13069 - protein, 761 aa, Actinoplanes utahensis
MGSLRRRPWWHSAVTSGIAAAGVLWFLWWSSTGIGSMAVAYLFMPAGLLSAVLAIRAMVRAVAPAPAGRRFWLQLSAGCLLLAVGYGVLAVAAFRSRPAFPPMPAVATVGVCGGVLVAIYAVARVPLGVTSGYERGRQWLDRTIAFLGCTAVLFHFGLVPLVYSPRPRDLPLTAMMMLAFLLAAASITKVSHINGGPVDRVAIRLLAGTGLVAAVVAILVVDRGTDWPLLAQALVLPFVPVLITLAAHRQQVSTAAPPRRSNTWLPYLAVAAVQVTMTDVLLRRTGDRGQVVAVMATLVIGLVMARQYLVMRENVRLLGERKESERRLLYEATHDPLTGLANRALFRSWLDTALPSGDTTVLLADLDDFKTVNDSLGHDVGDELLAAFALTLQTTVGDDGRAVRLGGDEFAVLINGPAAVGDSVARRLMTAFDAPISAHRLLVHASIGIAGAKPGTTASGLLRDADIALHTAKQRGKGNWIRYTADLQQPVFADAQLGADLRRALDADEFRLLYQPVVDLADRRMIGVEALVRWHHPQRGLVPPLDFITTAERTGLIVPLGRWVLRETCRQAAAWLAEFGPDALQKVEPNVSVRQLHDPDFVDDVRAALADSGLPAEKLVLELTESSVLRGPRVSRVLHEVNELGVRLALDDFGTGESSLSLLRSFPVAMVKLDKSFVDGIELDEPGTARADARQAVARAVMQLADALGLEAVAEGIENEAQAVRLQRLGYTAGQGYHLGRPMEAAQITGLLVLQRQDAAA

SEQ ID NO: 13070 - protein, 175 aa, Actinoplanes utahensis
MRTLADHPLTAGPELTPPAEPAQVTVTVMLPDLDHLPAWATVLQDWLRQSSGDQADEPRDAAGTDQPQTASAPASVPELVVNPTARTAHVVGRALRLTRQEFDLLLFLTTHSGRVFTRLQLMQQAWKGPADRNERCVDVYVRRLRVHLAGRGPKITTVYGVGYRLDDSHHATVTT

SEQ ID NO: 13071 - protein, 347 aa, Actinoplanes utahensis
MDSPRSVHPDDLRELGWSPADDLRFADTPDGRRPGRVVIMHGRALELAWFPGDGPAVHDTFELGRDLNLRPVAGDWVAVQDGRVVEVGPRRTALQRPDPNGKDTQVLAANIDTIMIVQPIDRPLNLEAIERLQVMAWDSGAAPVLVLTKSDGCPDIGAALDQAGQAAPGVPVLVTSALDRQGLEELRSHLGPGTTTTMLGASGVGKTSLLNALEGRNEQVQQVGAGGAGRHTTTTRRLFRTSAGGVLLDVPGIRSLDLLTTDEGVGETFADITEAARHCRFRDCGHAGDRGCAVEEAVRDGSLPERRLESWRRIQREQAYQDRRNDPAAMAEQRKVWKQMCKEAKRR

SEQ ID NO: 13072 - protein, 246 aa, Actinoplanes utahensis
MINHWPLSDLRLRTPRLELRWPDNDDLNALADRATEGVHEPGFMPFFSQWTDGEPTVVARRLLQRQWHANASWTADDWTLYLVVVHDGTVVGTQSLGARDFAHGREALVTAWLGRRYQGQGFGTEARAAMLALAFEGLGADYVLSVVRQNNLPSLAVSKKLGFAADGVQTNVVRGEQVHSNRLRLDRDSWRSNHRLPVTIEGLAPALPMFGLADDEPAAAGVLTVTPRASVLSGIRYIDEADTYDH

SEQ ID NO: 13073 - protein, 427 aa, Actinoplanes utahensis
MLSATWTRLRALPGRAKILLWTNAVSSFGGGLVLPFLWIYLSEVRGLPVWVPAATLAVQAGTAVVGGLIWGALLDRLPYRIVVPTVLVIAGLGTAAYAVAGTPAAALATAVGYGIGISGVGTVLRSMYAAVTEGTQRTLAFSVDFAVFNAMTGVGVAVGGLVTVAHFGTAVDRFGALYLIDGLTFLLAAAVTAALLPGGRNEPGKAAGKPAGGYLSVLRDPRLLALLAVMLLTSVVCYGQFRSGLPGYLTGTGAVGAGGLSFAFTLNIVVAVVTQFVVMPALHRVRRTTLVGLSGLLFAACWVLVLAAGTHTGTTAIAFAAAGVTCLSIGEVLVVPVLGALLNDVVGDHVRGRANALFSTMLSTGSVLGPALAALLLPPHRGLPLMGLLIAVSLLTSALVWVLRGRISDDVDFERSPSTPTEEMELA

SEQ ID NO: 13074 - protein, 344 aa, Actinoplanes utahensis
MSAPVRSAAAPIRLHLSENPIGPSPLARSAAHAALDDLHIYPDPARVELTSALAEHAKVDPAQVAVANGSDELVLLSTLTIGDRDRPGLVTAATFPGYRICLDTVGRGHRELALRDGRLDVAAFAAGLAGAGVGYVCNPHNPSGTALTGAEWEVLVEAAARTGTPLIVDEAYQEFAPAGTPCVRDYLDRGAPLLSLRTFSKAYALAGVRIGYAVGTAELIGRLRSAQGTMPFSVNRVGQAAAIAALTDQKHLHDVRETIADRREWFVERLRDTGRTALPSVTNFVAVAVRRDSAELERELEQRYGILVRDAGRFGLTGYLRVSLGAETELVALLTALDTLDPAC

SEQ ID NO: 13075 - protein, 123 aa, Actinoplanes utahensis
MTTAQIRTDLPLFKAVAGHHQPAPFYLTSDMFGGLPVQLAGGELSDKVGKPVADPHTHPVPEIYLLVSPNPGGARISVLLDGDEHELSSPATLYIPAGAEHRFVTLAAEPGSYCFGVLLGEDA

SEQ ID NO: 13076 - protein, 346 aa, Actinoplanes utahensis
MTLSPARSLPTDWHGTATVPIDADQVFNGYVAANVVFALDRLGVWARLVEGPLRVTAFAGDLHVDERMFRELLRAAATFGYLTGDADTVRLTPAGVEMAAMRGYFTWAVGGYNEVFAGAAGITAGDRRFGVDIHRDEAMVATGSAQNDGSFMARILDDVLGELNFDVLADLGSGVSARVCRVLGDRAGARGLGLDISGPATQLAQQTIGQAGLTGRVEAIQCNVLDVVLRQEHRAALAEVDTVMSFFLMHDLLADPASRSQVLPRMREAFPAATTFVLADTMLRPAQDESSLPIFSTGYELAHALMGVPLHTRDEYETLFAAAGLRPRRVEAFGTPHSWLYVLDAE

SEQ ID NO: 13077 - protein, 515 aa, Actinoplanes utahensis
MSIRFLPLSARSAATLTRLRERIADHLVAHPRVALDDVAATLSRGREPFRYRCVVVAGDRDGTVAALRGERPTIRGAAPAGRAPRLVFRFGDGARDGFGRDAYDRLATVRRVIDDLDAALTERFGAPVRLLDAAAGGTPAAPGDRAAAVTVAVGYAIAEQLREWGVTADTCTGAGVGARTAAVLAGELDITTAVAQAWAGEPHSPAPGTAEPSPSGPDTQPAAPDVLSVEIGPRPGLSPAGDIVVAVLPGEDEVAALAAAAAEVWCLGADVVLSAPGDRVHLPGYPFERAADADPRPAAAQAVTNAWREVFGTSTPGTELGPLVTLRRAIAARWGYAPTLPQLAAAPDDRQVLADLTEIATAESGSTRRERPLTAREQRLVFHDAVRAGSSSAEHTVQLSIPLEREPDPDALDAALRDAQLARPLLRTVFRRRDDRWVAAEMPHPLVTLTRSAPGAEAADHAFQPVDAPLLHVALRPYDDRTDLVVALHQALADHLDIHQLAAELLDTATTRSPS

SEQ ID NO: 13078 - protein, 1461 aa, Actinoplanes utahensis
MLTGRPATAEQSHLWLAVQREPESGRFNVPIDLLINGPLDADALHGALADLLARHPQLRSAFRADDGELRQYFPDAVTVALREEHRPGPYRPEPALAWAAEAGARPFDLTEAPLLRADLLRADDAALLVLTAHHLVTDGWSCGVLAEDFVRFYQARTGGAGAVSPMPEPTVPAASEADARYWQQLLDDECGPLAPIPDLVRTGDGPGPAAHRTWTLDASGRAGLAGLAERGQVSAAVAALGVWTLLLHAWSGEPDGVLGMPFAGRLDPATHAEIGLFTRVLPVRSRFEAQRPFRAVLTDLSGQVLDSLFASEVDTEALRAAVGAPELRTVFAYQGRGQRHWTVGGTELRIVEHELESAKYDLALAVAEGSDETVLRLDYDAAVYTAASIGELGDQLCALLGAAAADPDRSCLDLLTVLAERRPHEHQHGAELSDADASVLVPHRVLEHAARRPGAIAVQHGATSLSYGDLVARAGALAHWLTGQAVRPGDIVALLLPAGVDTVVAMLACSLAGAAYLPLDPAYPDAQLELVVADAAPVLLLADPAQRDRCHGLPTTVYDLSDVLAAAAGLPAHPPQVPIDGATTLNVLYTSGSTGRPKGVVLPHAGVARLVGRPEFLPLGADDVLSHLSPLNFDGATYEIWGALAHGARLVVLDKELVLDPRALRTALREHGVTTLLVTTPLLNRIIEDAPDLLQSLRRVYFGGELISVPHIRRALRWCGPGTLLHSYGPTENSFTSTWHPIAAVAEGARSVPIGRPVPGTSAYVVFEGTLRPTPPGVPGELVLGGTGVADGYLGDPARSAEKFVADPFDPRPDARLYRTGDRVRWDATGELEFIGRTDNQVKIRSQRIELGEVEAALLAHDAVESAFVTCRVGPRGDKEIVGYAVLTDPDELAGLRQHLRARLPGFAVPRHLVPIERLPLKPNGKIDRARLPAPSDGPAPAPAPARTGRRLTGGVTAPVRAAWAEVLGTDGFRDDDNFFDVGGHSLLVVQLAAALHRHTAARPTIADLFRATTVTAQTRLLIGDAPATTAAAVAVTDPGDDIAVVGMACRFAGTPDLDAFWRNLVAGRDCLPNAADPVAHEYADGRRRVARWGMLADGLGFDAGLFGFDPEQAATMDPQHGILYECLWGAVENAALRMADIHQRTSLYAGRATGPGPRALPDRDESTRADEVVGSDATFMPSRFSYWFDLFGESLLLDTACSTSLVAVHLACESLRRGASDYALAGGVSVSHPADGSYTYVPGHLYARDGFCRPFDQLASGTVGADGAGAVLLRRLGDAIRDGDPIHAVIRGSAVNNDGRAKVGYTAPGVDGQARVIRQALTSAGLSGADIDYVEGHGTGTRLGDTIEVAALTEALGADGPPVAVGSAKASIGHTNTAAGVAGLIKTVLAVREGFLPATPHVSEPIDELRRHGDRFTVLPTGRDWPRHDRPRTAGVSSFGVGGTNAHVIVQQFVPAGETA

SEQ ID NO: 13079 - protein, 89 aa, Actinoplanes utahensis
MTTPAISDTDLAATIRREWATTLGHDDVTGDPNFFAAGGHSLLAIAMMGRLRTTLGAPLPLRLLFDNQSVTELTSAVRALVPSGSGTPC

SEQ ID NO: 13080 - protein, 586 aa, Actinoplanes utahensis
MGEPDLIHERFRRVVAGDPAAIALHDGGTALTYAQVDAHSDRAAAALLAAGVRAGDRVGVCLDRGVDLPVALLAVLKAGAAYVPLDPDHPAGRLAYVIEDAGLTHVIADEYGAARLPAVGTVLAWSALTAVDGTVGTGPAGTAYVIYTSGSTGRPKGVVVPHHNVVALIDAVREDFALHAGDTWTWFHSAAFDFSVWEIFGCLLTGGRLVVVPRWTRRTPEDFRRLLAEQAVTVLSQTPSAFAGLLELERHDAAPLPLRLVIFGGEPLDTRALRPWLDRYPPQRCRLVNMFGITETTVHVTAETIGHEQVRTGSRSVGRPIAGWAVRIVGPAGQPLPRGEIGEIAVAGAGLATGYLGRPELTAQRFVTDPDTGRRWYLSGDRGRLLSDGRLEHLGRTDAQVQLRGHRIEPDEIRAVLLEDPVVVAAAVVPRTGPGGDARLDAYLVLTAGTGPEQLAAIRRRAARMLPDYMVPATVTAVPALPLTANGKLDPGALPEPHRTGATGADDGPADGLLSACRSVLTPALRPDDNFFDAGGNSLLLARLAGALRAGDFPGVTVRALYENPTVRRLAGHLAATAPAPREIAS

SEQ ID NO: 13081 - protein, 270 aa, Actinoplanes utahensis
MARRRDRDRPAHVVPAGVRGAGGRQPLPLPPSGDRPGNGLMTPVPLLCFPPAGAGAGFYHDWRGVRPGLDVHGVELPGREKRFAEPPLTAMTALVDDLVPGILDQTADRPEVVFFGHSFGASVAYEVVRALTAAGRTGLTLIVSGAAAPGTGTRPAITGLPDDEFVAGVRRIAGYRHPALDDPELRELLLPALRADVTCQEQYRPAPLPRLAVPVVALRGAADDLVTATDAARWSEVTDGRFIGAELPGGHMYLVDAAPVVLALVERSRG

SEQ ID NO: 13082 - protein, 573 aa, Actinoplanes utahensis
MGAGLSPRRHPGRRWRVPAGSRGRPAPARLRHVPDHRARVRPGGRRHRLPRRPGHRRRRGDRLRHRAGLPRPGPGVRVAAVAGTVGVHPAGRPGVAGRHRAGPHPVAAGADPGRLHLHRRAGRRAPLPADATGDVGVTTVAYFAAAGSAGLADLLDVAEGWCELVVVNTGNRPWGPAEVAALTSLAHYVDVRDLDPDALATALRRYGVTGLVAFSDDLLPRVAAVAQALDLPYHDPVTAEALLRKDVQRHRLRAAGVETMRCATFDDPASLTAAVAHVGFPAVLKPVVGNASAHVTPVDDLASLHLACRRAGEDLNLPAIAGDAFGFGAAGTWQLEERLRDGAHPGGGWLGDYVSVESVALGAGRYRHFAVTDRLPLTWPLRETGMVSPTQLPADLLDRVLALAGAALAALGVEHGVTHTEIKLTPDGPRVIEVNGRLGGFVAGLLGRVNGEDPVRLALRAAVGDTTAGDHRDPTGYALVLVVQPPPDAVRLEQAADLAELRAVPGVSRVDTGVMPGEAVDYRTGTLGRVQTVWLAAATVTDLHTSYLRVCEVLAAGNRYRYRRPATDLEMAS

SEQ ID NO: 13083 - protein, 275 aa, Actinoplanes utahensis
MVRTSRDGRPGEAQRLLNPAQPDPLLRYEYDRGSNYEQDTRLTTALAALVPEAELHHPDHRFFQVLHLVTEYSWVAIHQVLCDLAAALDDDRPVPAARLLDRATGLGVLPVQAIRLLSDSLPQLSLLAMRAAFPPNTTGLDSPGARNLRRASRAVWTAFEGALARAGLDLDALSAAAEPRYTGDTGPLLLADVMIGLHRFDARILEWKQVHLNMVWLLLGGQPQAETDPGDADKPSSLRGRSISDLERMAASPMFPLLWQHSTTVFHRMTREDTP

SEQ ID NO: 13084 - protein, 422 aa, Actinoplanes utahensis
MTCSTWLDPSSADVVRRLRSWRTSRVTGQPAEFPYEVVTQHVQRTGKHHLAAPLIEELDRTRQFCRAGGGVRLRFLDCLLDKHDGTYRYATYLSLPVLRGLVDGPDAVLSARDLAGLLIADVMRFELEALHGRHDLLPHGRPPLRTVKKRLHHGLGHLDRHSDRVPAARHLDPAAPEQADELLASLPVSPCPLVRERLAMTVHPVHVLHDEYLFIRVLQSYETIFTGLVGSAGHALTGLRAADAGATCAHLDDAATALERAGLLFTLLATMDPDAFRHFRDFTEGASAIQSEHYKRFELTCGTPRDERLMSPAFGNVPDVLDQARRGPDTITRAYLDARRDRRFGTGEQLAVDAGLTRLERAHQRWKSTHHSLATRMLGDATGSGYTAGVPYLKDCLDNRLFWGLGVDLTVTAAEVSGAHVA

SEQ ID NO: 13085 - protein, 72 aa, Actinoplanes utahensis
MEQVTTDLLSVLAVRPARQFAAGMEIVSSVAAARQWAVPASGGGVPMWPPPGDQHHQRKVDQYVYFPTRDPK

SEQ ID NO: 13086 - protein, 325 aa, Actinoplanes utahensis
MAGAVYRTLLANPDARLHQLGTTVGITDEQARDALDRLAELALVRRSEDDDQALPLLNDPPAALSTLLARQQVRMAEQQLEFERNKAAVAELLAASSAAGADLEPNEVERVLGLDAIRRRISELASCCREEVWTFNPDGAQSAQNRSSARPINEQTLQRGVQMRSIYLDSIRNDQPTFDHVQDLIDLGAEVRTTSTLPIRMTIVDRTTAVVPIDDRSSGRGALIITGRGMVAGLAALFVSTWQAARPLAHRKTREPGQPSEQERAALRLWAQGATDASVARTLGVSPRTVRRMSENLAERLRAKSRFEAGARAMEVGWLTAADFI

SEQ ID NO: 13087 - protein, 97 aa, Actinoplanes utahensis
MYLIAAWAFPAHGELTRDRVAQVLERRLPEAGIVHLWLGERDGWRVIGMFLDGSPADDPEHTVVERVRQAIASVVGSDPTIVLAEIVPLPSAVAGSL

SEQ ID NO: 13088 - protein, 64 aa, Actinoplanes utahensis
MELIRVVVASMVSDDWGWQVLGAGVKLTGDWGWQVLGAGMKLTGDWGWQVLRAGLTVTGDWGWQ

SEQ ID NO: 13089 - protein, 498 aa, Actinoplanes utahensis
MSRVAARVGAATIVLTATVAVVTAVAALLGPGVPIGRDSSLYVLYTLSVMLASAACLCRAVVTRLERPAWILLGAALLLWACGNVYAQVWLRHLDSYPLLSWGDAAWLSWYPLVGAALIMLMRTRISAVPRNLWFDGVMVGCASGAVYAVVVFGGRSTATKGWIDLLAGFAYPTGDIVLLAMVTSVLIVHGWRLHGGWGWLVVGLAGSTVIDGGYLAEQVSDRLLYGTWPVVAFALARSAWQPMPRVEQVKLTGRRMFAAPALCALVVLAVLLHAVYAHTNPVAVSLVTVSYLTLMARVGLLFADVRRAQTLLEAAHAAADQLSRTDPLTGLANRRAVGAVFDQTRGSGHGVGVLLVDIDHFKQVNDRYGHEAGDAVIVAVTGRMTRAVRRGDVVGRWGGEEFCALLDAIPDLEVLRQVAEKVRTAVCGEPVLLPDGHRVDVTVSVGAILIDDLTPLDFAISAADERLYAAKNAGRNRVRASVAAPYDAPASQANSPA

SEQ ID NO: 13090 - protein, 131 aa, Actinoplanes utahensis
MSRLTAAGDEAVHRSGIRLHYATKWARRAGAGLHAAAGEVARIRGRSACPHDTGVCPDHGATLRGADGVSWCGHQGCGRRWSYSRQSLPCTEPVMFLVGTPDGAEQPTCVGHARAARLQLCEVKILPLRIR

SEQ ID NO: 13091 - protein, 476 aa, Actinoplanes utahensis
MGPWACRGFVAAGLVLALGFLLTGPVSQSVLYGMAGAAASAALLTGLRRQRPRPARAWWLVWASVQINLTGDAVLGLRVWVFPDSAALVLLESTVYLMSYLALAAGLTVIVHNRSAGRDRGATIDSAIVACSLALPLWLVAVTPVLDEPAQPVAILVFRLAFPIGDAVLLTLLARLLVSGSGRSMSLYLLLAAVCCWLAGDVANAVLAERGTLASYWGGVLYCLGYTAFGAAALHPSMPALATTGSAPAPRLTTGRLTVLAGLSLLPPALLLGQAFTGRQVQAVPIGVACVVLFLLVVARMVGLTREVERQARELSDLASRDALTGVGNRRSWDARLHDAVTAAHDAGGTLVIALLDLDHFKRYNDTHGHQAGDRLLKGAAAAWRDVLRRDDVLYRYGGEEFGLILPGASPGDAVKLTERLREVVPDGQSFSAGVAALHGTETVEELVARADAALYEAKAHGRSRARVAAVTPKAA

SEQ ID NO: 13092 - protein, 171 aa, Actinoplanes utahensis
MIRFAAVQDVAEIHAMVRELAAYERAAAEAKATPEQLRQALFGAHPAAYSLMAEDDDTGEVVGFALWFPRFSTWTGTRGMHLEDLYVRPHARGGGHGKALLAALADICLRHGYERFEWWVLTWNEPAIGFYRALGAELLDDWTVCRLSGDALEGLARLASAAGPGSGATDV

SEQ ID NO: 13093 - protein, 57 aa, Actinoplanes utahensis
MHVQTDLDEAIATFDRRAVESRVAAADQRAEEIRTSFPATEWPSLAAERYLRLGAHG

SEQ ID NO: 13094 - protein, 74 aa, Actinoplanes utahensis
MDALCERGIAGNNHSGGKRGFRVYPPWVITTSRQAINSQGWQLGYFLSVNDGMSLDINRARDLYHLANQAARRQ

SEQ ID NO: 13095 - protein, 195 aa, Actinoplanes utahensis
MRNYLRWMVLGTVVAISALAGHWILGAGTKARYEPEPLPTNVSAIMASYGYKKSGDNSESYTGRILGAEHYFYCPTDQDCNTAAGNAAHPPVDIYGATAVGVEVWWPPALPAKDSPLAGKRLTICTYTPEAISSARITSDEWAKNIASLSQAARGLVTEKMAASPQRLPAAPEDVQAIPVNGWQCLVPAGVRPFR

SEQ ID NO: 13096 - protein, 501 aa, Actinoplanes utahensis
MDRSRITSGLSRFKGRWQVGAVAAVAVAVAGVGLGVAFAGETVPTVNCPQVRLTVAVPAQQQADVQRNLVLLNTQIDEANQRLRTSAGQGGPNFIQNAILGPLRDKRFATINRIETAIGRNAPKPDLNAEGLSGCSLNKGGGASKKQNTAPPQAPAAKPTTAPASKPAAAKPAATKPATKAPTPDVQTPGGSPVAINGQLSVCGVHLCNRAGKPIQLRGMSSHGLQFFPNCVNADSLAALRNDWNADFIRLSMYVQEGGLESDPTDFTNKVNGLVDQATKLGLYAIVDFHILTPGDPNFNLARAKTFFADVTARHAGNTNVLYEVANEPNGVSWTAIKSYAEQVIPVIRKNAPNSVVLVGTRGFSSLGLSDGSDEKEILADPVAFKNVMYTFHFYAASHGADRRAVVARAATELPLFVSEFGSQTFTGDGRNDFASTTAWLDLLKANKISYGMWSLSDGRESNSVFKQGTCAGTTFAGTGVLTEAGRYLRSRIRTGVGDPH

SEQ ID NO: 13097 - protein, 806 aa, Actinoplanes utahensis
MRTETGRRRVSTVPPPPRRLLPRALLAVCCTLAATGVVGGFARPAEAATAITLNGASAGRTFDGVGAVSGGGGNSRLLIDYPEPQRGQVLDYLFKPGYGAALQVLKVEIGGDTNSTSGAEPSHAHSRGDLDCNRGYEWWIMEEAKRRNPSIKLMGLPWGAPGWIGNGTFLSGDLTGYLLSWLGCAKQHNLTIDYLVPAQNERQWNAATTIAVRNALNANGYGAVKLEVAEDWTYSPADQFAGNTALRDAVDAIGVHYSCGYLADQTTCNSSGTAINSGKSLWSSENGSQDYNGGAKPLARGINRVYLDARMTGYLNWDLVAATTPNNLWSTVGLVLANQPWSGYYAVGKDVWAIAHTTQFTAPGWKYLDTSSGYLGGNRTNGSYVTLRSPSTTDYSTVIETMDASGAQTLDLTVTGGLSTGPVHVWASNLNSNNPADLFVRQVDITPSGGRYSLTVQPGYQYTVTTTTGGGKGTAASPGQGSLALPYTDDFEGYPAGREARYLMDMQGAFEAAACGGGRSGTCVRQTGTQAPITWKTLSDPYAELGNTAWSNYTVQSDVMLERSGHVELLGRVGGQDLMNPGALNAYHLRVSDSGAWSILRTNTSAQTTTVRSGTTATLGTGRWHTVALGFSGSTLTATVDGTVVGTADDATFGTGLAGIGTGQGQTAQFDNLRITAGPGSGTSLALRNVNAGRCLDVPDNAQTSGTQLALWDCNGGVNQQWTRTTGRQLQVYGNKCLDAGTSGSRTVIADCSGATGQQWNLNADNTVTNVQSGLCLDASSAGTANGTAVIVWTCNSGDNQKWTRS

SEQ ID NO: 13098 - protein, 443 aa, Actinoplanes utahensis
MVRKRLAVLAAVISGALGLALAGALPSDAFATSAAAPTAGCGQAPTLAGGTHTISSGGQNRSYILRIPAGYDGNHPYRLVFGFHWNGGTAGDVDSGGTDGYNWSYYGLRRLADAAGNGTIFVAPQGIGNGWANSGGRDLTFVDDMLRQIEGGLCVDTSQIFSSGFSYGGAMSYALACARPTVFRAVAVYSGGNLSGCISGTQAVAYIGLHGLRDNVLPISSGRALRDTFVRNNGCTPQNPPEPANGSLTHIVTTYSGCRAGYPVVWAAFDGAGHDPGPRDGCTCDGWQTWTSGVVWTFFAQFGGGTPPSSPAPGGARQLVGEQSGRCADVPNSSTANGTQVQLWDCSGTAGQRWTWTSGRQLQVYGTKCLDANGQGTANGTAVIIWDCNGQANQQWNVTANGTVTGQQSGLCLDANGAGTANGTRLILWACNGGANQRWSLRG

SEQ ID NO: 13099 - protein, 264 aa, Actinoplanes utahensis
MTVIVDTAARADASASTDRASELINAMAVLPAGHPSRPGLRERAIEAWLPLARHLSQRYANRGEPRDDLYQVAVMGLIKAVDRFETDRGVDFAGFAIPTIVGELKRYFRDKTWSVRVPRRLQELRLAITAANNTLSHTLGRAPTVTDIAGYLDVSEDEVIEGLEGARAYNSTSLSTPMSESGTELGDTLGGPDTGYEEVERRVMLGPAMAHLDEREQKIVTLRFYGNLTQQQIAEQIGISQMHVSRLLTKALAKLRRNLDGATR

SEQ ID NO: 13100 - protein, 332 aa, Actinoplanes utahensis
MIAHHRDDHAGGTFLHSALIPGSDEELTTTLVRELHRSAHRLDEVLLVVSDRTRQLLTGPLRPLTDLLTWGDPAAYYQRLGSAYEDFRRHLAERAATGRRVHVIAEPDLTDHLDPGAAPVRADAYLAYEAVCNDTYAPYGCAVTCIWDSRHHPAGILDGARATHRYLLTPHGRQPSPHFRSADDYLLGRRPLPLPEVPQRVDHDLTLATAADLGSLRSALHGWASDLGLATDPAEDLVVAVVEVASNGLRHAGTAVRVRAWHRGSTLIVQCDDSAGLPVPATAGYHRPDPGSAAPGGRGLWLARQLADVVLIDATPAGTSVRLQFPHAVMHH

SEQ ID NO: 13101 - protein, 417 aa, Actinoplanes utahensis
MDPSVEVALSGMLAAAEDATPVNAVEAVTRELGTALHASSVSFLIADLSGRALVRLAHVPLGPAGGRRDGGEVATVLPFDGGPQEEALRTQAVQVNGGDPEWTVLAPVTERGEVIGLLEIVVPAEPAPQALAEIERTAHALAFVVIANRRHTDLFEWGQRTTPFNLSAEIQRRLLPAAFTCEGGSFTLSGWLEPAASVGGDTFDYSLARDTLHFSVTDAMGHGVTSALIATLGVASLRNSRRAGHSLTEQADRAGAAVAEHAPARGAFITAVLGRLDLTSGRCDLVNAGHVPPILIRGGHPEELTLPRNLALGMFPNRRVSAGAVTLEPGDRLVIVTDGMRERRAAALDLTARLRSLAALHPREAVRALADGVLDVAGPTLEDDATLLIIDWHGHHGRQRRTRAGADVSAATSADGR

SEQ ID NO: 13102 - protein, 117 aa, Actinoplanes utahensis
MDLQLSARDGRACTVVKVGGEMDMATSPQLDDFLQQVTDGGAVQVVLDLGDVSFLDSSGVGVVMVWFKELDGRGGRLCVAAVQDIVAFVLRVAVVDQVLDVYDTVEAAEAGMPPLTA

SEQ ID NO: 13103 - protein, 299 aa, Actinoplanes utahensis
MPDNQYEPQHPQDQYRTPDAQDSDRISHPGITGEMDVVPDHGEDSYHGTGRLDGKRAVITGGDSGIGRAVAIAFAREGADVLISYLPEEEDDARETAQLIEKAGRKAVTAPGDIRDEQHCATIVAKAVNDLGGLDILVNNAAYQMSQDDGLLDITTEQFDRVMKTNLYAIFWLSKAAVPHMRPGSTIINTASIQAYNPSPNLLDYATTKAGIVAFTKALGANLADKGIRVNAVAPGPIWTPLIPATMPKEKVESFGEDTPLARAGQPAELAPAYVFFASQESSYITGEVLGVTGGKPLA

SEQ ID NO: 13104 - protein, 40 aa, Actinoplanes utahensis
MARAFQAYHSIGEAYTILCERAAVHGNSLAIEAEDVVRRW

SEQ ID NO: 13105 - protein, 499 aa, Actinoplanes utahensis
MTGGNPFQNVGQPARGDRFVGREDLVARVRGIVEGDRPSNMSIIGNHRTGKTSLIYRSLIDIPAVRPDLAVVLIGIGKVGRIEDVFRLIGRATVEALDGLPARDLAGFTATLNALEAESSWYGIMSQFIKLFSTIHQRRLKVLVVLDEFDRINLAGVQTAHFQLLRDLCTEDWSSTGLVTVSRQRVKTLELGSTNGSCLDQVLAVRTYTNLFEPVEQNAMVRRARAAGVDLERHNEWITSVAGRHPYLLELLCYELVESSGDTDLAYRNVRSAYADFFARLIRIIDADLDGSGVDKLYQVIDGIGLDVSIDDALALIRYGLVVETDDQSLVPFSAEFGRYLLSIADGRDFRSLWLDCEVGLRRLIRSVLSEAAPDGDSLGLLPASFSKIVSDARSRQGRYRPVVDCSLDTIDYLNPNDLFQIIVVRWDLFEAVLGETRGAWQRRSEAVIRARNEVMHIRPIPGEIRLLAETAVTAIVTTLRGLGHLRSVSTLGVINQSG

SEQ ID NO: 13106 - protein, 1462 aa, Actinoplanes utahensis
MDLDLVQAVAKVGDFIYVYQTTGHQIAGTLATLSMSHLVVEEQGTGIKHAVALASIITVTTGQPQKATAAEPIPPNASVPPPVEPAARIPEAPPVIPRLIVPSGAATIIMQRPLAAPDFVTYANDELFNVHSHEAALDRVRQQLEYAVRVKELDPRFGRCTSMATEMDQILLGEPHSSSAFRLAGYLHYMAGHLQTASDRYLSAALIVPDVAPYWWLDTAIAALRADRVDIARQGLIRYIDGTTPQEDPDAWWALLALCERLGAAGLLHLIRPEAEATPEVRRSVLEACHSLASSAGDVELAARAAKMLQNGPEAAVLSVPTLPSLDMPARINPKSVTPRIVPAPPPQRPLPPPAKPATRQRRAERNEYDQAKYLEHRAKDLERAKMAYRDAIRKNINAESAIKDLAWLTRRVDGPEAALQVIEEEFADRLPPSASLDQILIDFYMGSQRYEDALRLLEPMLAGHLEAGQRKVVLRRICQAKLSLSQDATPYAEELLRVAPSEASARRTYAIALMRRDQPGDLDQAEEVIEELRSKEDAQALEIVDKIRQMREGGSTADLDLLVRRLSDIRFEAISDFGQYILDNFAEAADGIRQQRKFAANDIRYLRTRAQEARNKRSRERYDAYISAARIELEVSTVDGGGSESAERNAQAFFDLLLRGLTALGDTMLSTNTEVAREIYFEALALADQLRQPTMQEYWNALQRYLRSIFDSPESLTVSHDRGGNSSLSAAEVGAALADDLREVPEQSVQQLFEAVDELAARTRFASESAIRAIEHVPSLARAARRHLAEFLDLRSPDVTTERVIEAWREAGLRRQSDRDEIEQQLRLLHGLEVGEVSLDRAFTVLDNLHSERTVALAVDREACRKLQTNFRLLQYGLKEPGFEEREFRYLQVQGAMRDFAEQVKAAPTRLAVRNLLPIASRTLAQVDKTLERLYADREPDPTLSLALVEYTPDLHNRITVQVKLYNEPSCAPVESPELVVNLAAAADGIKVLDVVKSVPTVRGGDAKISSIQVELSKELVASGAFSLPIDVTYRTRTNEKGRISATLAVRLMSEADFTKISPNPFKDGAAGRTVTDPDMFFGREELVDQIEALLVEATGPGAGVAIYGQKRAGKSSIRLHLSRRLEKSDRFLVVDVANIGQLAPVSVGEANATLQILLWTILTKADAVVRQRSAALGDPIEFLPADLPRDEFLTSRVPVGDFITVFERFNAEAARHSEWRDRAFIVLMDEFQFIATWIAEGRVSSTFVQALKAVLEQRLFHLVVVGLDAMQSFIDKYANEFGVFDKRRVNYLEPRYALELMDRPIRIGGPDGESRYRERAQEQILSLTGGNPFYIQRFCYQLVEHMNSSKAPLVTEADVELVREWLLNEFGPGDFDNLETSGEPSTTAIATEAVREVLTAVAVAANDGRATIEDVERRCSVPNVVSILKDLEAREVVVQEAGAYRILVRLYHDWLRRRVA

SEQ ID NO: 13107 - protein, 203 aa, Actinoplanes utahensis
MPMKSADWALIISAAALLISLGGTAAAIWQARIARHAAEISGRAADASSAQAIAAIQQTNVLRRQLSAEDDDRALRDAPEFVIEFVGEGEWGTWRTDRRGGRRFAAISRHNNPSVHDWVKRRQLVLGHRRGPAVRTSIAVDGRQPPDAELLDPGPFDMVEGASRRIPIVTVHALEGAELTVVITSEELSGQGRRWVSRRVLAL

SEQ ID NO: 13108 - protein, 501 aa, Actinoplanes utahensis
MTINEAVLLVDWLNLSIHLKNQRLSFGSDLVGDLIKIARDECARHGSPDLVRAHFVGEQFAPSVEGAITSTFIARIHKTRTAKEQADLVLAVLAMDHIHAPGGGPGLFLLATGDQDFIPLVDRMIEARAEVVLVVASTRTLSPEYRRIAAQQNVRLLSLTDVLDIEPLPESDAEAAATRVLSLYRVCMAGGVLGGDQTRNIRMLADWGLLQPGDEEVEHTACLQQFARVDTRKVAVPAKRDTGNRPAVLRRTYLNFASATVLDIVEDADWVLRRTGNAARLPTIGDLGVGRFAADDGRRLARVIGAMKDVGWLMERSDGRFESRLEWSADGLLEPLWRVICEINRRAFASYTEGVSRDRLFQDLRSTPIAADIDRKGGKAAHEVIDHARRIGVIDAIPAGSDGYALTVIETHPVAHSVASALRTLGNLLADQVGVAVPEHEVLALMRERDEHADAQVLFGYDNRDRQRFLRVLRRSSLLDRPQGSEPMVRLKRTPWLERIS

SEQ ID NO: 13109 - protein, 293 aa, Actinoplanes utahensis
MSDVSPDTARLTFRAAEPIHGMIYFSPHGRDTYAGIGLTGRAMTYFAPRSAAMGPVPAEVTVATFFNFNPDAVRSALPAAWDIATAAQVVEARYEAVDRSLRQAWGDDTGGSAVREAADLARRAAERACDRLPGRPLFAAHASLAWPRAPHLVLWHAQTLLREFRGDSHVALLHTEGLDGPEALITHAATGAVPPEALRVSRFWSDEQWNAGIDRLRARGWLAPGPDLTLNPEGERWRRSLEARTDQLATYPYEAIGADGCGRLADLTTPLSAAVMKADLNFPSALATQRRDR

SEQ ID NO: 13110 - protein, 225 aa, Actinoplanes utahensis
MQPAVPPRRAKLGRPARITQEMIAARAQAIVDAEGVQHLSMRRLSRELETTPMALYHYVRDRDALLLMLLATKTESTPLPHFPAEPRDYLLAAAVHLHHLLDGCPWLPEILGSQELVGVVTLPAVEHLLEAAIRCGLDRQEAVELYQLLWSFVAGELFINAGTRKPEQPSRRQRLLTTLPAEEYPHLAALSEQWGELIAGDHVHRGLAGIIDGVLRDRSGPSQDG

SEQ ID NO: 13111 - protein, 510 aa, Actinoplanes utahensis
MAQLEPKRGGALAAVALAQFMVTLDMTIVNVALPSLGGDLGFEPTQLPWVVNVYALLFGGLLMLGGRAADLFGQRRILLSGTALFALASLAGGLAQAPWQLIAARAVQGMGAALMAPAALALLTLTQREGRERTRALGVYAAVSAVGGAAGVLSGGLLTQFAGWRWVMLVNVPMAACVVVLALIGVPGGQLSSGPRRTLDVPGAVLVTGGVGALVLGLLRTDHYGWASATTLVTLGIAVLLIVLFLLWEARGIKSDPLIRLGLLAKRNVAGANLFILLLCAGQFAAFYFISLYLQDVLHLDAARAGAAFLPLTLTVVVAINISTRLVPRLGPKPLLVTGGLLAAAGFAWFGALDADGGFLTDLLGPSLLTGLGMGLSFVPLTGAAVGGLPRHEAGMASAVLNSSRQIGGALGLAALVTAQASRTDARLAAGDPPLEALTSGFGIGLSLSGALLLAAALVALIVLPGKRAAGVPAGEPAAQRGASSSSPWPTNAPAGSPPLDAASSVTEPR

SEQ ID NO: 13112 - protein, 588 aa, Actinoplanes utahensis
MTPPTGLWPLLRPHRYQLLGALLLQTVSAVGGVVPYLAVVELGRELLAPHAPDRHRVWLVVAAGAAGLLVRLVAGALASAVAHAADSSLQLSLRRLLARHLTAVPMSWFSRQSAGGLNQIVQNDVNDLHTLVAHTPGELTSAVVVPGLALVYLAAVDWRMTLVALVPVLVGLVLRRALSTERRKRDEQEVDAAMGRIAVAAVEFVEGIAVVKTFGGGGRAHHRFVGAADDFARLFLRWVGSAAWLASLATLVLSPMVVLLTVLTGGAAMIGAGALAPADLLPFLLLSLALTAPVAALAHGLDNVNAARRAAGRIGAVLAEPPAPRPAAPRLPDGHLIELRDVGFAYDEEHPVLHHLDVVIPPGSKVALVGPSGAGKSTIAQLLLGFLTPTTGSVRLGGVDLRDIEPSALYRRIAFVPQDVRLLRTSVADNIALASSSAGRDEVVAAARAAGVDDHLGSLPRGYDSVVGEDAGLSGGEAQRVSVARALLLDAPVLVLDEATAFADPVTEAATRAAIDRAGQGRTRVVIAHRLATIRDADLVLVLSEGRVAERGTFDELLAADGLLAGMWRAQQEDATGVATAPQRGTVL

SEQ ID NO: 13113 - protein, 569 aa, Actinoplanes utahensis
MITLLSRILGPDYARPLHRAIALMAIASIAEGLAYALLIPLLRALLAGDTSGALPWLGAFAGATVVALLLRFRSDVAGFATGAALSRGLHHRLGDHLARLPLGWFTRRRLGEVGMLTSRGVLSTMAVPAHRLQPMISAVLTPATVALVLFLVDWRLALAAVLTAPLILLAQVWTGRTTASLDRERSISADEAASRVVEYVRAQPVLRMGGTTGRGFGLLDSALVEQQRTGRRAAIRAIPGVLALSLTVQAGLTALLVLGADLALGGRIATVDLLVALILATRCVDPLLSLSDLAGQMRNSREELERIDGVLSTPTLHEPAEPVAVRAGDLELDDVTFRRDGREVLHGVSAVVPKGARVAFVGPSGAGKSTILQLIARFHDPYSGSVRLGGNDLKTLASGQLAQNVSIVFQDVYLFDGTIADNVRMGRPEATSEELSAAARSAHLTEVIERLPQGWDTRVGEGGAALSGGERQRVSIARALLKDAPVLLLDEPTAALDPVSEVAVQSALDGLMVGRTVVMVAHRLRTVRHVDRVYFVEEGTIVESGTHDELLAQGGRYANFWNMTHMRHC

SEQ ID NO: 13114 - protein, 640 aa, Actinoplanes utahensis
MPTNSALSENSDTIDRSSYSQGAADDLRAFASTLLGRSLTPDTDGTSLIELGLQSLHLMRLVGRLRRAGRTVGFAELAADPTITAWARLLGDDPPAEPAADREPAGDEPAGDVPFTLTPVQQAYWVGRGDDQPLGGVGCHAYLEFETRDLDVARLGEAFRALLARHPMLRAVFAGDGTQTIAAESGWSGPEVHDLRSSTPAEAGAALRRLREGLSYRRFAVSRGEVVDLQVSRLPGMDRLHFDVDLLVCDVQSIRVLLADLAALYDGRRPPELSLTFAGYLRRRAAGDAPARASARDYWHARLADLPGGPRLPLAIEPGRLDTTRFTRRIRRLSPPEWAALGQRAAACGVTPATLLLTAYAEVLSRWSGDRRFLVNIPLFDRDREVHPDVPHLIADFTSLTLLDVDLDAAGDFAGRARAIQRRLHADLDHSAYSGVEVLRDMLRADPESPRTAPVVFACNVDAPLVPPAFAERFGDFTFMLSQTPQVWLDNQVYLDHDGGLTIAWDAVEDLFPVGLLDHMQDAYAGLLRSLVTAEWAGEPAIGLPESTRSRRAEVNGAVRAHSGLRLHDGFFARAARDPGRPALLGGHDGCLTYGELADRACRIGAALRARGVGRGDTVLVSAPKGADQIAAVLGVLAAS

SEQ ID NO: 13115 - protein, 340 aa, Actinoplanes utahensis
MDLPGVADCLRAAGEVVGAAVTAPGAAGLVVEYAAHGGRTADLLLAGGTRGEGTTYVTVSRFPEVPAAARARLAGTATIRGEDGTTVPDDLLHRADIGLINDTFAITSPAEALAGLRPMLRPGARVLVVAGAEDSPSALVLGPLLRGPGPRRAAPPVASWLAGFATAGFTACEIVCPGNGVALITGCLDETAPVVAAGRVLDWVATRLPGHMVPARLVVVPALPLSANGKVDRGAALRLAAATPVPAAESAAPRGHLEEAVAGLWRRSLGRDTVGRHDNFFQAGGDSVLATRMLADIRATFGTTLPMVDVLRAPTVAGMARLIIERSGAGATEETESGVL

SEQ ID NO: 13116 - protein, 269 aa, Actinoplanes utahensis
MTTTEETAARAAQGPLRRYAVRPHARARLVCLPHAGGSASQFRRWSVDAPWDVEILVAQYPGREDRYGEPPHEAMSALVAELLPAVVADRGSPARRPTVLFGHSMGASVAYELACRLTALGDPPAGLVVSGQPGPGRLRRTSLHTAGDDELIADLTRLRGTGEAVLRDRALLGALLPAIRSDYRVIETYRPPVHRPLGIPVTALRAVDDPEADADEVQAWRAVTTGSFQTYVLPGDHFTLLDPGGPALARVMSAVRAAVGATVSPTFAP

SEQ ID NO: 13117 - protein, 544 aa, Actinoplanes utahensis
MDSRVLENCVPWPDEITVAYRQAGYWTDEVLGRWPAGDPGRAGRPAVVTAGRTMTYAELDRAADRRAAGLLDRGIGRADRVVVQLPNDVDLVVCILALLRIGALPVFALPAHRTMEIVDLVEASGARAYLCADVLLGHDFRAMAAEVVRRTSTLTEVFVAGAPGDFTALADVDAEPRPITPPAPGDVAMFLLSGGTTGKPKLIPRTHADYAYQLRASAEVCGVGPDSRVLAALPVGHNFPLGCPGVLGVLRAGGVAVLAPSPAPDDCFPLIASAGVTLTALVPPMVPLWLEAVEWLPDDLSSLEVLQVGGARLDPVTAGRVVGGLGCRLQQVFGMAEGLLNFTRLDDPPELVLTTQGRPLSPADEIRIVAPDGTEVAPGEPGELLTRGPYTLRGYYRAPEVDRVRFTEDGFFRTGDVVRARRTGHLEVVGRINDVVNRGGEKVPAQELEELLTTLPAVAGAAVVAVPDPDMGELTCACIVARESQGAPELHEIRGALSERGVAAFKLPDRLVVLDRLPLTAVGKIDKKALAARAAVQTTGGGAR

SEQ ID NO: 13118 - protein, 436 aa, Actinoplanes utahensis
MTRHYRTAVIETSDEPIACALAVADLFDDYVVYEAPDGWYVAGGWAAEVVVGPRTVRCVHDGQVTETPWDDDPLVPVRRFLDGLPLAGWRAYGWCAFELGAAIAGLEPPEDVLAHFLIPTVETRLRGTQATVRGLTAEDLALVERRLTTPVRRAGRAAGRARVDLGAGTAEYQDAVATLVGDIRAGKLEKAVLSRVIGVPEKIDFPASFEVGRRRNTPARSFLLDMRGLQVFGFSPEIVLSVDADGTVVSQPLAGTRALSGDAETDERLRHQLRTDPKEIHEHAISVRVAVEELHEPCRPDTIAVSEFMAVKERGSVQHLGSQVTGRLAEGRDAWSALAAVFPAVTASGVPKQAAYEAISRLEGQRRGPYAGAVVTVGADGTMDAALVLRSAYSRDGVTWLRAGAGVVGQSRPERELEETREKLGCIAGYLVVSEG

SEQ ID NO: 13119 - protein, 621 aa, Actinoplanes utahensis
MSTGTNIHIELLGPVRAWRDGQAVHLGPPKQRAVLGLLASRAGEVVGVEQIADAVWGSDIPQTAANGVHTYVAGLRRVLEPSRSRRQTGEVLVSAVGGYSLQTDARAVDTALFTQMIGEARQLRGGGDVTGAVETFEAALKLWRGEAFGGVPGPFAALERSRLQDLRLTAAEDHAACLLDAGRHTEAVGWLTEAIGEDPLRERLRGSLMISLYRSGRQAHALRVFRETCELLRDELGIDPSPELRELHRQILVSDPALGAAAAPPSTPVAVVPPLPAAPPVQLPAVPSGFAGRDEELALLSRELLRADGDEGAVRLAVVDGPPGVGKTAFALELAKRIGGSFPDGQLFVDLRGTDPASAPAGPAECLLFLLRSLGVQDARIPDDLVGRIAHYQSLVHARRLLIVLDDARSADQVRPLLPRGSSCVLVTSRVRLSGLVARDGAHRVPIRPLDPEVSAELLAHLAGRERMRPDSPITRRLAHLCGHLPLALRLAANAFATDPGHPPAELLERYVAEPSRLDRLAVADDASTSLRAALDVSFQALPDDAARMLRSLGAARRETITATFASAVTGAPRQQVQQQLTVLADNRLIEEAGPGEYRLNNLVALYARECAGDAGRERAS

SEQ ID NO: 13120 - protein, 534 aa, Actinoplanes utahensis
MRVLLMSGLGPANLNSGYLSGSLLEGDRGPRATQVLQRAGHPDLDVNQLAFEKGGRRYALLRPRPDSVPHLTSVTLTSILAASGHDFVRVPLEEVWTSQARPPSGDIDVVLLSSTFIWNEGIVATALKWIATHVPDTPVVMGGQYTNLKFMPVMRDHPEVIAVVRGDAEESLPRVLDALQAAATLDGIPNVVWRDGPRIQINPLAYVDMELFPSPTVSGSAPIVPYESMRGCPFDCKFCSFPAASPKWRYKSAEKIVHDWTAYAAHNDAKMISAMDSTFTVPPTRLRRLLELLPGAETPPWEGFSRANTINSPELVENLARSRCRQLHIGFESMNDETLKRMSKRVSVRQNRRAGELLSRSDVGYYVFFIVGYPGETPEAFADTSDFLVDEYVGHFALSRFSITDETMPLWQDRDELRIVSDDPTDPTAAWSHVGMDSAEASRLQKETLDRVRHGSETAVLHLWQHSFQHWLMPHRDRLTNIRVEKCVERMAMAPVDYPDVAQAAKVVNDELGKLRDLGIERTDDSRTLCRDAI

SEQ ID NO: 13121 - protein, 419 aa, Actinoplanes utahensis
MSSQLFGVPDEFDVIVIGGGPAGATTAGLLAQRGHSVLVLDRERFPRYHVGESLIPAFMRPMKELGLTERMDARGFERKYGGTLIWGNEQVPWQFSFIEGGYEYAYHTRRADLDALILDRARELGACVVEDATVRETIDVDGRVTGVRYALRGGDGLVEARARLVVDASGQARVIGRRQTGVKWHDELRNVAVWTYFDNCERLPGDEYTNILIEGLDEGWFWGIPIDKGTISVGYVTRASMAGEGDQKLEQIFREQVERTTKLKKMLAPGRRSAGFRTARDWSYHSDRFYGDGWVLVGDAAAFVDPLFSTGVALATLAGSTLAKIVDQIIEHPEIEEKALDRYATAYSNFFDEIRTFVERFYDRTKYKEFYHSLAQEMVDPEQKNKPSQDFVTLISGMSGKHAMFHIDLSDLIAADDGR

SEQ ID NO: 13122 - protein, 424 aa, Actinoplanes utahensis
MSSTQVQLLFVDLALILLLAQGLGRLAVLVRQPPVIGEIVAGILLGPTLLHGRLSATLFPGGVRPLLGAMAALGVLLFMFGVGVEVEHHVLRGRGRATALCALGSMLVPFLLGAGLAGTLLSGHRTASPTGYVLFVGLAVSVTAFPVLARILSDRGLATTAVGGVALAVAALVDVIAWAALAGVQAFTGGPGQHWRVALILPFAAFLAFVVRPLARRWLLSARAGADPGEPSPLRFGVVVIGALLSGAATEVMGLHYLFGAFMFGLVMPREGARGLRDGLLRQVGRVTALLLPVYFVVAGLQVDLSHLGVTAFLELGAILVVAIAGKFAGAYLGARTQGLAARPSAALAVLMNTRGLTELIILGVGLQLGLLDGGLYSLMVVMALVTTAMTGPLLALVYRKPVEITVPAPAASPALSGAAGRAG

SEQ ID NO: 13123 - protein, 552 aa, Actinoplanes utahensis
MNQHIAGKRDTYDVAILGAGMAGGMLAAVLARHGVRVLLLDAGVHPRFAVGESTIPYTSGMTRLIAQRYDVPELKALSSFKGIRTRVSRSCGQKQNFGFVYHREGQAQDPGQINQLVVPSAIRTETHLFRQDVDAYLFHLAVAKGAVPRLGTRIENIEIDPDSGAVLRSTTGEEFRAAYVVDGSGFRSPLADAFSLRETPTRARTHSRTIFTHMVGVTPFDDAPAARHHKNPNPWHHGTLHHVFDGGWLWVIPFDNHPSSLNPLCSVGLTLDPRIHPQDGRSGQQEFDDFLARFPQIAHQFRGASAARPWVSTGRLQYSAKQVVGDRFCLTSHAAGFIDALYSRGLTNTMELVNALAWRLIAAARDGDWSTERFAYLEALQQGLFDFHDDLVYASFVGFGDYELWNAVNRTWMLGTMLGNVMLEDAYYRFLRTGDDAVFLDLENSARPGSPLPVSDGFNRMGVLARELCESVEAGTTKPGDAAAAILGHIGGADFIAPSFAFGERDTRCFNMTPAKMARNAVWCRREAPPEIGPRMINASKGLVRMRLRGGE

SEQ ID NO: 13124 - protein, 2060 aa, Actinoplanes utahensis
METHHHMDETPLAVVGMAGRFPGAADIDGLWKLLIDGADAIGPVPARRWDAGAVLDPERAIQGVGGFIDGVEEFDAGFFGVSPREAAAIDPQQRLLLETAWRTLEDAGIPAAGLAGSRTGVYVGASWHDYELVRGRSAAPATPHSLVGNALDVIAARVSYFLKLRGPSMTVETGCSSSLVALHLAGQALRSGEIGAALVAGVNLILDPHVTVGLTHFGALSPDGRCATFSDEANGFVRGEGVAALCLKTLDRALADGDRIHGVIARTVVNNDGGGESLVTPSPDGQEDLIRSAYGPPGEPTGPAPFYIEAHGTGTDRGDPIEVTTLGRLLGRPGDEPLHVGSIKTNIGHLEACAGLAGLIKLLLVLRHRVVPPSLNSARLNPAIPFTDLGVRVVREPVPVPAGPVRLGVSSFGWGGTNAHVVVQDPPVGGPEAGRDGASTGLPPVTMLSAKDWPSLTRRAADLAAAVPAAADRVPGLAGTLAWRRDHFGVRAAVVGSRPQELRRLLDALAGRAEDAQDDPGLVTGRAVETGRVAFVYPGQGAQWAGMGRELYRDSPVFRDVIDRCAVALRPHLDEDLLDVFAAGGDDRWMDRLDRLQPVLWATALGLTALWRACGVEPDVVIGHSQGEVVAATVTGALSLDDAALVVARRSRIAARTSGRGRMLMVDLDVDSAYAALEGFEDTVALAAHNGPTSCVLSGDADSVLILKELLEAEGTYCRLVNVDYASHSPQMDALRPDLLDALSAVRPRPGRPAMMSTVRRALVSGTELDAAYWVDNLRRPVMFADAIGDLLDDGVTHIVEISPHPILVTPIKRVSARRAHAPAVLATLRRGQGTVGDFATAAAAAYVAGLEPFGGLPREGVAAAPGYPLRPEPYWPVEAPGAWSGTQGFAARLRPAPDDPGSWTATFTLSCAGVPWLAEHQVHGVPVLPGAAVLTALLSCARQRWRAAPGLITGLRLTGAVALGEAPVGLAAHWRDTARGATVRLLALPEAATTWEEKATARVVRAQQPRLAPAFPDDLAARLTHDADDFYRLWHGRGLQYGPALRGIRRLAAGDGRALGEIVLAERLRAAPSHGAPHPALIDAALQVALAACEPAGDTAVVPVALGTVEILRAPEDTTVTLWSYAERRGPADADVIVFDEARHPLMVLRGLRFEPLAEHGASADDALRYHLAWTEPVEPDPVPVPGRWALCTPPAGSGDALAEAMAELGAEVVPHRSGDTVPDGLDGVVFLAPSASADCETQERGLSALAGLATAGTAAGTTPRLAVITAGAQAVTADDVVNPCAALYWGFTRVLRREHGELGARLIDVDAAGPEWAARAAAEVLGASAEDQVALRGRRRLVARLRPGPGAPPVLPPPVTPPQPFRGAVTDAGQLIWVPDRVRRCGPGEVSVAVTAAAVDEHDEARLRGAATGDGDTSLGTSCAGMVTAVGPDITGIAVGDRVVACTPGALAAEVTVRADHTRPAPPALSDAEAAALPLVLTTAWHALVRLGGVETGDTVLIHAGTDGTALAGVALARLRGARVLATAGDTTAGELAESAGAALVVDTRDPDWTRTVLSATGGRGVDMVLHPQANPDVEIEDSLTVLGVEGRVVVLGADPVRVHPPDLLRPGVGLSVCDVRQLLGRHPHRFARTLELVWDLVAAGRVPALPVRTMTYGQAARAAPDRNRRGAQRLALTDPATATEVTPVPRPDGQFRADGAYLITGGLGALGLSLAEHLADRGAGALVLLGRSGPDPTAELRVKAMRAQNVQVEVVAGDVADRDALGAALAGVRDRIPPLRGVVHAAGVLADATVASLTDRHLHTAVGVKLGGARHLDALTRNDPLDFFVLFSSVAGLLGNPGQAAYSAANAALDAFAEARRRAGRATTSIQWGPFAGIGLAAAERGRGDRLASRGMGGIEPEAAWALLTAALDEDRPVTAYVDLDLRRWFDANPETAALPSWRTLLELSRRDGGPAVADGDFLARLHAAEGADRLRVAEIKVRELTGRVLRLDPAAIEADAGFKSLGLDSLLSLELRNRLESIFGLRLSPTVLWAHSSARALAGALCERLTPHGGPT

SEQ ID NO: 13125 - protein, 511 aa, Actinoplanes utahensis
MTSETESADRGPLRRAMATIRTLQSRLAAQDENRPVAIVGAGLRLPGGITSLAGYWDALAAGRDLVAPMPAARQARFAADWATLPRRGAFLDDVLGFDAAFFGLSPREARHLDPQHRLLMEVAWEALEDAALPADRLGSRSAGLFLGIMWQDYRDWQAGEPDAFWTTGNGHNFAAGRIAYTLGLTGPTLAVDTACSSSLVALHLAVQALRRGECEVALAGGVNLILSPRSTRLVVETRSLAPDGRCKSFDAAANGFTRGEGCGVVVLKSLDAARRDGDRIHAVIHGSAVNQDGRSGGFTVPNVLSQVRLIEDALADARLTAADIGFVETHGTGTALGDPIEVEALAAALGRRNGGAPLPVGAGKTNLGHLESAAGVAGLLKAVLSLRHRQVPPVVHFRTLNPRIDLDGTGIVVPARLTEWAPGAGRYAGVSSFGMSGTNAHVVLGAAEPSGPPPDDAPAPAGFEISARTEPALRELAARYAARLATLPAADFPALASTTATGRSRLAERAC

SEQ ID NO: 13126 - protein, 408 aa, Actinoplanes utahensis
MVDLPADPRPTDVRPMLDLITADDPPELTAVRAGVVLAARLTPARPGAGLPELHPDATYLVTGGLGAVGRHLTAELVARGARHLLIIGRRPRAALPDPATGFLAELAAQGVDVHYRGDGCDTAVDLAAACAPLAGLPPVRGILHLAGTVTSAAPADLDPAAFAAAAAAKAGGAWLLHRAAVDWPLDFFVLVSSVSALWGSKGHAAYAAANGALDLLAAYRRGQGLPATSVAYGPWALDGEGMADRATRERAERTGIGAMGAAEARSALAVAVPGAAGHVIACRADLVRLGRVLPRLRAGLLAGHAEPVTGTAAGPVSGTTAGPVAPPAPVDAATVRDTVAHLLAVQLGYDGAADIRPDMGFADLGLDSINAVDLAERLTARLGRAVPVTALFDHPSVAELTAYLTGAS

SEQ ID NO: 13127 - protein, 1721 aa, Actinoplanes utahensis
MACRFPQADSAGELWELLDAGIDAVGPAPADRWGSGILRGGRVTTDQGGYLRGIDLFDAGFFDVPAREARSMDPQQRLLMETAWHALEDAGIAPSALRGTATGVFVGISYADYARLLARGGADDVDAYYGTGTALNATAGRLAYALGLHGPALAVDTACSSSLVAAHLAVRALRAGEADAALVGGVNILLDPMSSVAVSQAHMLAPDGRCRTFDADADGFVRAEGCGVLVLKRLADARRDGDDVLAVIRGSAVNSDGASSGLTVPNGSAQERLLTAALADAGLPGHAVSYLEAHGTGTRLGDPIEVAAAWRALGPGRDTGEPLLVGSVKSNIGHCESAAGLAGIVKVLLALRHGRIPANLHFRTPNPHVDWAGTNVRVVAAGTPWPRGPVPRVAGVSGFGFTGTNAHLVLADPDQPSVTPPTRPGSAHLVTVSAPDPDGLARVTAAWHDRLTGAADGDLAALAAVSGRGRTHFRYRRSAVGRTGADLARELTAAGPVYGAAQPPRVAFLFTGQGSQYFGMGRDLYETEPAFREVFDRCDDLMRPRLGTSLTELVFTGEDAAALHQTRVTQPALVALALSLVATWRSWGVEPATVLGHSVGEIAAAVCAGILDLPAACEFVVRRAELMQSTGPGRMLSVPAPEKLVEEWIRDTGLDLAAVNGPEATVVAGPADAIEALAARLSAENVRHRPLATSHAFHSRLMDPILDRLRGELAGLRTAPETIPLVANLTGQTGTTLDAEYWCEQVRRPVRFHDGLVRLGEIGADVLLEIGPDRTLTNLAGAAGLVPAGGAVSSLRRGIPARTAMLTAAAALYRAGQRLDFDRVHPTRPGRVDTPRYPFARTSYWVRPQPVAATTPDASAGPAWGTELRSPALPGRVFASHRSTTYPAHLTDHRLFGTVSVPGASQLATVLSALSGGRDTVRLQDVHFPRALVLHEGERYEQQVIESAGPDGRRVTVQSLVHEETGRWQEHLVARLPAEPPATGADDGPRADHLRHRADRELTGERFYRHLHLLGYHLGPSFRWIDHIWIAGDQALVRLTRPVETREDPGGYAVHPGLLDSCLQSAVCFAVDGEPDGEPDSEPDSGGAGLAIPFSVSRLAWHERPAADAELWAHVRVRRDADGAGLLRVGSADIRLTGPDGRTSVLIEDFRFRYAPRALVEASLSARAEVRRVDWTPVVDDGERPGSVTVLGSPPIETALREAGLRLTGLDADVLVDARFTADRPAPAQIAAEVTRILRTLPADRGYAFVGPPGPDGRPVVEAISGLLAGLRAEQPDRRVRVVEPREGWRPEHLAAALTAAIPEDGVLLAAGPDGLRARHLTGLRPPASPPVWDTAGSALITGGLGALGLSVASFLVARGVRHLTLMARSGPDEPARQVLADLATAGATVQVLTGDVTDPADCRTAVEQAGRDAPVRFVLHLAGTTDDRAFDGLTPDSFDSVFAAKVTGAVQLAAAVGTRPLTAFVLFSSASAVLGSAGQANYAAANGYLDGLATVLRGAGVPATSVGWGPWSTRYRDGLADTPAVRRAMSVRGLRALTDEQAWPVLDAVLAGGPDRLVVVAGGAEPAVPPSPAPPAAATDRGWLRDRLGDPAGLRAAIGRMVGEVLGDPGPVDPGLGFMDLGLDSIMTVDLQRRLSHALGRDLPVTVALDHPTVDRLAAHIEPAVAGEATEPADDLNRLDRDDLDPLDRDDLDPLDRDDLGEMSLDDLVRAVRADVATEG

SEQ ID NO: 13128 - protein, 551 aa, Actinoplanes utahensis
MDQQEIRQLMATQLEKSRRLQARIGELEAASRAPVAVVGMGLRLPGGVTTPEDYWDLLHRPGDASREIPADRPGLRAVYDPVPGRAGRSYVDRAGFLDDVADFDAEFFGISQREAARLDPQQRMLLETAWEALERAGVAVRRADRLDVGVYLGMMASEYNERFADRGDAGRVDPYYTTGGGLCFGAGRISYVMGFKGPVISVDTACSSSLSALHLAVRALRSGECRYALVCGSNLLLSANLMVSLSQARALSPGGRSRSFLAGADGYGRGEGVGVLVLQRLADAERERRPVLAVVRGTAMNSDGAASGLTAPNGPAQQEVVRAALRDAGIDPAELGWVEAHGTGTALGDPIEVHALAEVLGESIRRRGVPLAIGSVKARLGHLEAASGIAAVMKTALMLRHGEIPAALDPEDGPLNEHIDWAGLPFTVPRDHQPWPAVPGGRVASVNSFGMSGTNVHAVLAAAPPVPDGDPVPPEQPHLLTLSARSMPALTALARAVASRLGKAAPAEIASICHTLRCGRTAFPYRLAVVASTGPDLAVRIEEALRRPIAA

SEQ ID NO: 13129 - protein, 176 aa, Actinoplanes utahensis
MPEPGTGPARLAWGDRRYPLTTPELTLTAVAALFEDGADLRFDALRGPHDRFVDDLPTYPFQRRRCWVDEPVPDGPAVTAAPERADGAVPDAADRTAVHDYLAARLREVLDADELDEQRSFLDSGGDSFASVLFVQRVEEAYEVGVRPEDLPLDLPLAEFLGRLAAGVTRRTGTAS

SEQ ID NO: 13130 - protein, 254 aa, Actinoplanes utahensis
MTGLFVQPRRLADPELTLVVFHHAGGSAAGYHPLTRWLPASWDLLILDMPGRGKRVREPLPETPARFYDGLRRDLLSLPGTGPYALFGHSLGAVVAVEAAYALRERGMPPVWVGVCGRLPPGRSLRTPGLAADMPDDRLLAALHALGGLPDGLDSVPAFQRRFLELLRHDLRILDAHRPDPARGPLAVPLTVFGSTDDPLTPVPELAGWAAVTTAPVRQRIFQGGHFPFRRDGFRELGAAITTEIRALSLTDGR

SEQ ID NO: 13131 - protein, 173 aa, Actinoplanes utahensis
MTIDPIIGTPPAGDLRLLMASFPTGVSVVTALGESAVPRGMTCTSLCSVSLDPPVLLVCLRSDSPTREAVASSSRFAVNLLHARSRQIAHMFGSGRADRFDLIQWRHGDGAAGPHLVADAHTVADCSVMATHVVGTHTVVMGLVERVTALREQHPLLYGLRRYATWPDSPEPA

SEQ ID NO: 13132 - protein, 324 aa, Actinoplanes utahensis
MVAGPTRHALVLGAGLAGSLAAAALARHFDTVTLVDRDDLGPGAGPRRGIPQARQSHLLMGAGARAMERLVPGVLADLRGAGAHFLAAPTEVAFLTKYGWLPRTPHDEYVVCCGRDLLDRVVRDRVLARHRIDVLGAHDVVGLLGGPAAIDGAVLRDRRTGERSTVAADFVVAATGRSSRVASWLREVGLPEVPDEVVDAGTAYATRIFDAGLPPGRRPPAIVMIANVTGDAVGGVLLPIEDGLMTATMIGMRGSEPPTGDAEFLAFAKQLPHPGIADALAAAQPVGPARGFRGLVNRRSLFERLPTWPERFVAVGDAAAVLTS

SEQ ID NO: 13133 - protein, 95 aa, Actinoplanes utahensis
MQRAVRRRGRDAWDLSVSDDLRHPRVLGPRPGPAGRLQNRYADRITHVATARPPVARALVDVIALAKPVSALLTPRLLWAAARGPDRTRRQEAGK

SEQ ID NO: 13134 - protein, 319 aa, Actinoplanes utahensis
MIEHHDVALSGVRLHVAEQGTGPLVVLLHGFPEFWYSWRHQLAGLAAAGYRVVAPDQRGYGRSDRPADVEAYTLPQLAGDVVGLIRALGEKQAFVVGHDWGALVAWAVATMRPDMVRAVAGVSVPPLAPRGPQPPLLAARERFGGRFYWNYFETPGVAEAEFGKDLGTTFRRMLFGASGSRPADAGPVAPLVPPGGGFLDLAPEPPVTLPPWLTEADIAAYVEAFTGSGFTGGLNWYRNLDRNWELTAVYDGAVITVPALFVIGERDKAFTGVAAMDAAVAALAPGHRGTVVVPGAGHWVQQESPEHVTGILREFLATA

SEQ ID NO: 13135 - protein, 398 aa, Actinoplanes utahensis
MTTAPLDLAALGDDFARDPYPVYTRLREQGPVHRVWMPEGAEVWLVVGYDEARAALSDTRLSKQWHSASESFPIKSPSGSHMMNSDPPQHTRLRRLVAGEFTPRRVEALRERVQQLTDELLEAVLARPGDRFDLVDDFAFPLPMAVICELLGVPFLDRAEVRRWADAAVSSSVPAERQAAARDAARFIDALIEQKRAEPGPDLLSALIRTTDTDGDRLSADELRGTVFLLIVAGHETTTNLIGNGAYALMAHPDQMAALRADPGLLDGAVEEMLRYDGPVESATFRFALEPISIGDVKIAPGEAVMVALNSANRDAGRFADPERFDIRRATTGHVAFGHGIHHCLGNALARMEVRIAFAGLLRAFARLELDAHPAALAWRHGILVRGPHHLPVRFTRA

SEQ ID NO: 13136 - protein, 224 aa, Actinoplanes utahensis
MQSSPSRGGRMGRPPRLSREAIVEAAKRILAEEGAKNLSMRRVAKDLESTPMALYHHVKDKDELLLLLLEAHAGQFPRTDMPDDPRDHLIKAAQLLYDILADCPWIVEVLASDDLMAVSALWIVENIIDGAVRCGMTPEEAVYAYRVIWYYTAGELMLRVAREQRYARPDAGAHREKAFANLDPEQFPRLSSLSELWPALTSRDMHRPGLIAIVDGLLRQTVGR

SEQ ID NO: 13137 - protein, 362 aa, Actinoplanes utahensis
MREPALVGVLGAGGAVGTVAVTCLLTGGGVRVRAGCRRPGPARAGVRPVAVDVTDPATVRRFATGCRLVLDCTAPAYTLMDRVRAAVVDAGADYVSVMDDGRTPPPPAGRTVVLAAGVSPGLSGMLPRLLAEGLTGPLSFTGAYAGLGGLTAGAAADYLLSLDAGYGVALAGWHGREVPRALQVDEDFRVPTVDRALTGYPYLTAELRRQALMLPLARASWFNAFDGPHLLAATTRRRGAGPPGAEAIAELVRASRLDAAGRRPYQVLHGELDGYTDDGRPVHRSAVIRGTDGSALTGVVAAEAVLSVLGGQVRPGVRYASDVVDSRRLLAALQRRLPDTVVRFTGDVPCSTASAEQVEGVL

SEQ ID NO: 13138 - protein, 1825 aa, Actinoplanes utahensis
MAIVETVAALRAAGMVLYAEGDDLRYQAPKGVATPERLRWLRDHKPDVLAVLRADGDEFGGPLAADPERAGEPFPLTEVQSAYLLGRGSAFEFGGVACHGYLELAVPDWPVHEVEAAWNRLVARHAMLRATVAAEGFQQVAAEVPHYPVAHADLRDAGPEAVREAIATVREQLSHRVRPTDRWPLFDLRATSTPDGLLLHFSIDLLICDYSSFRLLLDELRREVTGEGGDAAPAVTFRDYVLALQGIGETERHRRDREYWFSRVDELPPAPELPVRADAPLAAPHFTRFATRLAGPRWQQLHRRATDLGITASTAVLGAYAETIGRWSRHPRFTLSLTVQNRLPLHPDVARVIGDFSSVSLLDVDTTPVAAFGERLATLHGRLWQDLDHRLCGGVEVLREIARRRGRAAAALPVTFTSTVSGAPTPGAGLMPGARLRYGISQTPQVWIDCQMMAEDGGLLLHWDVRDGVLPDGVAADMFAAFTELVERLADGDAVDEADPVVLPRRQRELVAAANDTAEPRVRGPLHAAFLDRARRDPGRVAVIAAGCTLTYGELLARAESLAGLLRDAGCEPGERVGVVAPKGADQVVAVLGILLAAAAYLPVDLGQPARRRDTILRDAGARFVVTDAVHAGELAGSGVVTIEADRLPATPARPAEAPGPVGGDLAYVIYTSGSTGTPKGVMISHEAARNTVDDINRRFGVGADDRVLGLAQLGFDLSVYDVFGPLSVGGALVLPQAERRGDPSHWAELMVTERVSVWNSVPAQMQLLTEYLAAAPGHDLSRLRVVMLSGDWIPVTLPDTVRRHAPSAEVISLGGATEASIWSIHHRVGAVDPDQPSIPYGRPLANQSFHVFDDVLRECPELVVGELYIGGAGVALGYLGDAARTAERFVDHPRDGRRLYRTGDLGRRLPDGEIEFLGREDGQIKIRGHRIEVAEIEAALLAHPGVQAAAVIPYDDEAGRHLAAFVEPAAADRAPLPERLPETMAAAAAARIGAVDRGRVAEMVELLDRAALQSISRLLVDCGLFAGVGSRHSDQEIIETVKAAPANHYLVRRWLGALEHEGLVRRDPDTGAYHGLTRPDEAAAKRLRDRVDVLEPAVRWGAELVRYHRTSEENLQALVRNDIDLKTLLFPHGRLDTAEAAYRDNLISRYNNAAVIAALRTIATGHSGGGPLRILEIGAGVGGTSTELIPALDDLAVEYLFTDLSHFFLNAAAERFAAYPWVRFGLFDLNADHVEQQMPDNGFDVILLANVLHNAVHAGRALELLKGLVRPGGWLVFIEATRDAYHVMTSMEFNAGLTGFEDERRETGTTFVPRDRWLSLLDEAGAEVVATLPAADDALSLIGQHVFVSRFKADRAPVEVADVQRHLAERLPEYMLPAQLHTLDRIPLTGNAKVDRGRLARWTVRGGRHAAGSAASAPADETERLLADIWCAILPVTRIGRDTDFFAAGGDSLLVAQLVGRIRDRVPAARDVEWDHLLRRVLNRPTIADIAAYLRSLESSGPAPAPSSLVSVGDRARRPAAGPGQPLHVLVHDGTGTLIPYRALVRELSPDVPMAGLVLDDEQEYLDSDPHTLTGTLARRHAATLVAAGHEEVHLIGYCMGGLLVTELATRLTAAGIRVAATTIVSSYRVPYLVEDDLLAEYIFARVMRADPIRLGYPADETETRRIVAGAVARHGGRVPEGSLLEPGENGVRPETVAGFRRLAAMDPDERLTAIGAAMPVSDAGLTSVDRLRRQFRIVKHSLVAVASHRPTPYDGPVTFVRQSGEAQVFPGMHRDMSDYWRDVCTGELRIVDVPGDHFTCMRPPNVPAVARAVRLAVPRGEHA

SEQ ID NO: 13139 - protein, 451 aa, Actinoplanes utahensis
MRRSYALVALAVTTLVALAFVIPLALLVHSAVQDRAMREAERQALGLSAVVVVATDRDLVLNSIMSTRAGQNGELAAHLPTLGTVGVSRVTPDAVIQVRQRETAGTVDVDGGRVYLRPVALPQGLIAVIEVFVPGTALRAGVGTAVLVLVLEAVVLVGLCMALADRLAARIVRSTRDLARTATSLGAGQLHARVRPSGPREIEEVGAALNLLADRFLELLAKERALAANLSHRLRVPLTALRLNTEALTAGEDRDRQLRVVDRLEYEISAVISEASRPLAARPRLQCDLGAVVADRTGFWGALAEDQGRPWQADPPPDGLTVPAAWSRVTEALDVLLGNVFHHTGEDAACRVTVVRSDGSATVIVDDAGPGFTDPDAALARGASDANSTGLGLDIAQRLAADTGGTLTVSGNEWGGARVSLTLGTLPDETPAAAPRRRRWWHGLGGAHARR

SEQ ID NO: 13140 - protein, 184 aa, Actinoplanes utahensis
MGRSWSYVAGWLAVTITAVAVSWFGVRLGVAPAITDEPPVAIDVNRRYTEIRFGLAESATPSRAAPGPSKSPPSHTPAPPAHSRTPSRQPSARPPSAPSPSPTPTVDQRPRYRINADAGTITVAYSATRVDVVGADPLPGYTVDVVRRSDTIVVARLSRPGHTSAITAYWNDGPAAQVIEDYGA

SEQ ID NO: 13141 - protein, 228 aa, Actinoplanes utahensis
MPQVLVIEDDVDVRQAVGRLLSATGHDVRLCATALDGLREAAAWAPDVVVLDLGLPDLDGAAVLRRIRATSQVPIVVATAREQESEMIRLLRAGADDYVVKPYSAEQIEARIAAVLRRGHGGPAATGLTVGGLSLDPQGRTASLDGVPLQLSRLEFDLLAYLMQRAGTVVTRRQLLSDVWPAESRSLETVDVHVTWLRRKLGERAAQPRYLHTVRGVGVRLSAPEPGR

SEQ ID NO: 13142 - protein, 222 aa, Actinoplanes utahensis
MKHKVAVASGIAAVTVAGSIALTMPQGNAATTPSHQQPAADGPAPVALATSSAADLVTNKPKTFFKSRYDKLDRRQVVSQNGLQYVVYERTYRGLPVHGGDAVVVADSRGRVLNEYVAQEQALSIPVTAKISAAAAAKTARKQLARVTTVSPATLQVVAQGAGVLAYEVVVAGAKRAPGGLAPSNLHVFVDATTGKVLPDLTRDDIVDAAGHGAYYGDVLAS

SEQ ID NO: 13143 - protein, 45 aa, Actinoplanes utahensis
MARSVGETSREAISYTGTAGSYRYRIVSYSGSGNAVLGWNVPAAS

SEQ ID NO: 13144 - protein, 167 aa, Actinoplanes utahensis
MRQSHISVVLAALLLAGVAGCANGEPAAAPPPVAASSSATPASSAMSAPTASAARAVPLTVTRRGGFAGVEESVSIAADGSATATRKGQAAAPVRVPTATTTELRRLLGTPGLAAQASPSPGAPGCDDGFEYTFVTPSATTVVQDCEGGHGATLDRLLTLGAGLFAH

SEQ ID NO: 13145 - protein, 471 aa, Actinoplanes utahensis
MKNKVVWLLLGATVLAAAAMWWRRGTPTSDIIYFAWTVPLAVAVCVTAARQPARRNRAPWCLIALALVLWLSGDGVQTLQYYAGYVPPFGLSDVLWLAGYPAMAAALLMMARYRAAGRVRGVVLDGLTLTFAAGIAAYVYFCLPIIDEGFSTLESVTPALYPLGDVMLLAGVLMLFLSPGRRGGPTYLMLVAATLYLLTDSANNVLMYVVHSDVSWDLDGAVLLGNCLLAAAGLHPRRGELTEPGRAVEVLHPARVLFLGAALATAPTVVLTHTGLGPGGRTILMAATLACIACVLIRFLQAVRGLERTQAQLAYQARHDPLTGLANRAAFTEHLDEDTAGVLLYLDLDGFKAINDRDGHEAGDAVLKAVGQRLTAAVRSSDLVARLGGDEFVIACTAADVTYGQDLAQRIVTEVSRPVEFGGRQLAVGVSIGIAAHVTTSPDARRAALLAADEAMYAAKHRGKGNWVVAA

SEQ ID NO: 13146 - protein, 80 aa, Actinoplanes utahensis
MAYGIPPERVSQPVAGPRAPMPGPQSAPSMTNGSVTVTLPARSVTTLVTTVGGTVPPGPAASPSASSSPAGGAGPGWSTR

SEQ ID NO: 13147 - protein, 1116 aa, Actinoplanes utahensis
MSTWRPSRSGSRPLTPATPPNRPVSPSTGCPAPWCDAHVVQRHIDGRRGRQAGRHPCPPAHHGGRGGVVGRGEAGDLRAVVRARGDEQRRVVAARGEAFGAPRIVLPVHEEHPFRGGADPPVDVEHRQRVVDPAQFGRQGRVRGVEARVVAQAAQVLEPQAGPAQLARRLVVVRPVVLQALVGVEAPPGHGVGPGVQLVVGRRGRRHRRAVGGRAVLPERPHRVQHGHLERAVRGAQRAGEGPALRRGIRLQVGDQPGPAPQRFALHLVERGAAGGGPDGVEEGVVRAVDRIDRVIRCHIGDHAVDVTGVEAPVVHRGHAALAAAGLNPATGVDAAQRGDDPVLVGGFLPDVEIRPVGRGRARRGEEAVLDRHLVGAQQRRRLGLRRTRTGGQAVPAGVEDGGRGGRPVQQGQPLLVATPSRMAVIGGLAIGQDEEPVAGALGVGDDGDAGDRGQLIPQRVVGGACRRDRGDGHQQAGEDGDKTFSHAVMLSINPNTSTGHPTAISGRLVAGMLLFTSRARRRAAVVGGTTAVLVLASIGTAWADPFGWRGGRQHPFAVRPDTGAASANVLANDRGATAVVRSTGLDDPAAGSLAVHPDGSYVFTPAVPGSHGTVHFGYTATDAVTVYSSAVRGGARIPPLGGLEGADGSTVPISGGGYGSSFVAAPGRPGWFYGVTDRGPNVDDDGPSGQKAFADPGFHPQIGLFQLAGGRAVLQRTIVLKAPDGTPYNGLPNPVTKRAASSEKTEDLYGDYIDPAQPYTVPGTGPAVTLDPDDGYDSEGLVALADGSFWVSDEYGPFLTHFDRDGTEIERLSPWGADAGHNVDTAHPLPAELALRTKNKGMEGLTVTPDGRTLVGIMQAALTVPDYGTDAKGKTVKPGNVSPVRIVTVDLRTRAVHQYLYLLTNPNATGGAVSEITALSATRFLVDERDGLQAGPGRAVAKYLYEIDLTGATDVTGTGPLGYLIGGTSIEAYVGDAPTAKAALLLSQAGVIPVGKSPYLDLGSVLNQLDPSGRFFGHDKIEGVATSDGGRVLYLANDSDFGIDHLLGRDEAACEASGLSDTTACAPVKSATTGKFLVHQKTLDAAGVADDGELLRVDLAKLPVVLGSTTVTIRY

SEQ ID NO: 13148 - protein, 529 aa, Actinoplanes utahensis
MRSMARKAGLAFTAAALALAGAAYGVTSASASAEAAAPLTTPQLVTDMGAGWNLGNQLEASNNGIPGETAWGNPVITQALINRVKAAGFRTIRIPVSYLGAIGAAPTYTVDATWLNRIQEVVDYAYNQGLYVVINMHGDGYKSVTGSWLICDAADQTTVRARYQKVWQQVATRFASYTEHLILESMNEEFDGQYGNPTQPCYSNINAYNQIFVDTVRRTGGTNASRWLLVPGWNTNIDYTVGNYGFALPTDQYRSTSIPGTEQRIMISVHYYDPWDFTGQEDGTVTQWGPNATNPAKTSTWGQADYLDGQLKKVHDTFVARGYPVLVGEYGSIDKTAADPTNNRYRADYARALVTAAKKYGAATAYWDNGYTGAYGFGLFNRSSATVTQQSIIDAIISAAGGTSTSPPPGGSPSATPSASPSNTPTGACRVTTAVSAWNTGLTDNITIVNTGGTAVDGWTLTFTLAAGQTITSGWNATYRPATGTVTATDVGYNGTLAAGASTTIGYQATHTGNAAAPTGFRLNGAACS

SEQ ID NO: 13149 - protein, 950 aa, Actinoplanes utahensis
MCRGPRRADGRMSTRPEDEAAERWMSLSRHPNVRARYYADAEQVDGGPLRIDAVSTIDQALDIAIQAARGLEHAHRHDVAHGAVGPDAVLVTPDGTVKITGFGVPAAAAWQADVTAVRRLVRELGGPALPDGLRMADVIDRLTGTYRQECGRPYPRPAPVPLTRTSDELTDHGIMLTVLGRVDAAQSLFDQALAVHPGHPEATYHSGLLRWRTGELTDDRLLAALDSDHLRALVHLERGDAAAALPLLLRTAKDTDAFRYAVQAERPHRLQPRTVQVRPGIRSDSLHAGPGRQVDHVRLSADGRIAATAGNETVQVWDTRTGRCLQEAHEHTATATALHLTPDGGHVLSGTGDGTVSWRTAEDGRLRRRLETGDRVVDIWTDPEARTAVITVRSGLQVWDLHAGRLLRVIDPGGPIIGAGVSADGTRAVSSGLDRVLRLWDLRTGECLAHLEGHRSLVGVIRLSADGRVAVSAGQFDPVLRVWDLDSGQCRHRLTGHVREARGLDVSADGRYAVSAGGTDHTVRLWDLRIGRCQRTFTSDYDDTAALSADGRTAAAGGLSGVVRVWDIPAPTGYAAPPQPCVPRSYAAIVVINAEADTLLDRAERAIAEEDFGTAHALLVRLRTDRRHDRTPRALRAWQRLSARIDRVAVEDVLVTRTLHGHTDRVESICAVPGSRTAISGGRDGTLRIWDLESGACLRTLTGHTGSVLSVTTDGTGRTIVSAGRDKTIRVWDAESGACVRTLTGQGSVVYSVAVSADGRRAVSSARDGDRLLVWDLTTGTRLRRLDGHTGGVPTVAITPDGRLAVSGSHDGTARVWDPDTGDCVRVLDPEEVEVVRLSADGGSVLTVDSDGRAGLWDLASGDRLRAFEPPDWSHLADVQLSHDGRYAVAAGDHLLSLHDLATGDPLFEPADRPDAITAACLSPDGRFLVAACRDTTVRVWELTWDLRLR

SEQ ID NO: 13150 - protein, 629 aa, Actinoplanes utahensis
MDDAVIAWERPARRLRPALRVDVEGAEVVAVVTGGDGRTLLAVAGGDGPPAVVSLWDTATGERVGEPLTHPAEAVLAMVALPGLLAVAYADADGPLVQVWRPASGERVGAPLPGPFDGSGLAAVSVPDGRHLLAVVEEVAGTLRLWDPATGDPVAGPWPPGIWAVTAAKTSDGRPLLLTLHGDDSQAVVRSWDPLTGDPLGQVLRTRHDEAHPHRLVALPQPDGRLILAVSRGDEDDGLVTRLWDAATGRRIGGPIEGAGPLAVPGPVPLLAAGGGLWDPGSGRRVGDAGTNGVPRPVAAVPGDPTLLAGPGPDGTLWLWDPAETPPLPDAERVGPVDLLAPVTLPGGRTVLTTGVRFWDVLTGEPARAPLTGHAGAVTAVASASLPDGRLVLVTCDQAGTIRSRDPVTGKLLAEVPAARSHVVRSMAPIVMPDGRTLLAVGNDVNVLRLRDPETGASASDMFTRLDRPPLRAVAAVPMPDGRTLLAASNATPARGGSWAARLWDPVTGLPVGDPFAERAPVWSLAATPAGHDRVLLAVGTADGTVQVHDVVSREVLGELPGRHPCLLTDAGGGQVLAVARRDEVELRDPLDWRRLSSHRMGSKVLTLAAAGSRLAIGCAEGLAVLTVA

SEQ ID NO: 13151 - protein, 52 aa, Actinoplanes utahensis
MRALLVTLGVAAVVLIVLGLLLKALKWLLIIGVVALIASIVLGVVKGRRALR

SEQ ID NO: 13152 - protein, 50 aa, Actinoplanes utahensis
MAGRPTERQSHGIGTAVIHTAEAFAARRGHRHIGLGVGDGRHPRLLSYAT

SEQ ID NO: 13153 - protein, 136 aa, Actinoplanes utahensis
MGDHQLCRLSVNDGELELAGPPAALRALSQRLRQSGATPLEVAIAGGSVVQEVTGGPLLVGLRDATTLHVSGGREYLDILWDGLDGVAHLAEAADDRGVNRHQHIEYLPGDEYRSPDSNPLVIVADWPQEPIPVPR

SEQ ID NO: 13154 - protein, 156 aa, Actinoplanes utahensis
MLDDELVEISELLQPGVTKPHVDHAARASWLAAMHEAMRSVGGAVVTAAEEPAVGRNYYRVGVEARDSIAGAILFNAAAVLVAAAEATDPQEIAVVFAAVPGSGVFSERGFQVASPEQLNEPLSEHHLHALTADERRDVVYHRPSRLGDLLFNWFD

SEQ ID NO: 13155 - protein, 127 aa, Actinoplanes utahensis
MSWGQPCRLGPRPWERLGLEWRLRPVAPNHGKPVIVSEFESAAWQGGLLIWISGEAELDAVRVSDDQAVSKHYDLTGLDDLEVLLGELDALLTSGRVPDAAVVHQHPFCQIPAIAGQHGAIVPRSGR

SEQ ID NO: 13156 - protein, 235 aa, Actinoplanes utahensis
MSENGLMSHAHVLVHPSPLGARAQDFLTAHARVVPVEAGPSDDECRAAMRSVLGHSDESALTTFRRIQQRYSGLTYFSHFRGAEIVFEPSFEVDRDTAQVLFEYAVMDVTPDGCRSGLVRPDEAVWFGFLHVDVPAFPSLDHFLECDALLHHARQQRLLSAATPLDANAYLTALRARHPGLRPVKSASGFSVGWWSDDERLVYVNGFEARLAADGRAMSPVPTVVTTWLIDEPLR

SEQ ID NO: 13157 - protein, 57 aa, Actinoplanes utahensis
MEGSGSWRTFAHLPVDRLRRLERRCLDFAGGGAECGGDEADRARILPHRSADPAPST

SEQ ID NO: 13158 - protein, 445 aa, Actinoplanes utahensis
MRGLLLAASTAVLLTCSPTVPAAGGFAMRVLAAGLRNPWEVLTGPDGWLWVTERSGHRVLRIDPGTGATRVAGTVTEAVGGTRGQDGLLGMALRLPDVYLAYSYDADPSAGMREQFKISDFRYDASTGTLRHHADLLTGLPASPDHDAGRLVLGEDDKLYYTIGDQGNDQLDRFCLRNRARDLPAGPRDRSAYQGKVLRLDRDGTVPADNPVLGGVRTHVWSYGHRNPQGLVFGHGRLYSSEQGPKTDDEINQIRPGGDYGWPRVAGRRDDKAYRYADWSASAPAPCSSLTYSDYTIPPSVPTYTETGFTSPAYTDPLRTIGTVPDGYDFRDARCTGAANMCWPTVAPSSLDFYDAPGIPAWRGSLLMPALKDGTVYRIPPGGAGDPVAELHTVDRYRDVAISPDGRTVFVATDPSGTTLGRDGRPTTNLEHPGAILAYHHTAPS

SEQ ID NO: 13159 - protein, 65 aa, Actinoplanes utahensis
MSAFVDGCDHNYGTPTQCVPLTFPGGLTDAATKCAWLTAHGFTSLVVAGRDDQRLDPDGDHVACR

SEQ ID NO: 13160 - protein, 971 aa, Actinoplanes utahensis
MDRGDGRRPAAPAGDRARPGRGGRPGRRRPGRRQPVRGRRQPRRAGRRIPAARLRRLDGRHQATVPHCAAAGQRPDERPVRNPHQLPGGGRAAAARLQDPAGAGGPQPARPDRRGAVLLPAAARRRVQVVDRRGAALPPAPRAAAVRRPALPAADLRADRPLRAAAQPGRAVGAEPPGRGALPGRGRTRQPGRGRVELRADRHAALPLPAGAPQPPEPAQPVLPARQRRPAAAHPAAGATGRRGASRRPAGEPGHAGGVVRGPVPHLGQGDLSGAHPPAGAGVTVLRSYPRPWLSGTDRKRIGQALVVALLAVLAATVPAGPARASANLVANPGLENLDPAGFPVCWEKSGWGDQSFTFGVSSPGHTGATAMRISLATSPSGDRKAMMLENPSCAPTVTPGHQYDLSAWYTTSTANTVMTVFRHDLAQGWVYWTDLATLPVASAWTRKTVRTPQVPANTDQIVWGVTIYGVGTLQTDDYAMNDVTAPATGTSCSAGDACTKGVWQVSPFDSPVRGIHSVVLRNGDVLLVAGSGNNPDDFAAKTFTTAVYHPASGTFSSVATPADLFCSGHVQLPDGRVLIMGGNKAYPAADGSHGYEGLRSSYVFDPATDSYTRVDDMTAGSWYPSATVLGNGDVISLGGLGEDSSGTVATQYFSNAQQRWLGLGEAHQTWAFWGLYPSMILLQDGRLFYTGSHVFGNGLPGTGASIYDYGANTITAVSGLRNKDERDQSTSVLLPPAQDQKVLTLGGGNINTNVDANRLTDIIDLKQANPVYAAGPALPAAKMYVSAVLLPDGKVFETGGGLHNRADPVYEASMYDPATATFTAGMATDPVPRTYHSSAFLLPDGRVMAVGDNPGDGTFDMRLSVYSPPYLFRGARPQILAMPDNRWAYGSSHTITVDGPILKAELIRPEAVTHSSDPNQRFVDLPMSVNGTTIGLNLTSNPNIAPPGWYMLFVVGTNGVPSVAQWVHVG

SEQ ID NO: 13161 - protein, 521 aa, Actinoplanes utahensis
MTTIDLARPAPVVPAAGSDVPPRHREGRADLAVALGLTAVIVALLTWNITGFPAASDDEGTYLAQAWAVQHGRGLAHYTYWYDHPPLAWVQLAGLAWLPKLLFPALTAVAAGRIAMLPVQAAGLLLVHLVSRRIGLPRWAAALALVTYGLSPLYLTMGRQIYLDAFAVVWMLGALALALSPRRHLWHFAAAGGAAAVAVLSKETIAVVLPAVVVALWQNAARSSTRPWAFGAFLSGLVLIGCFYPLYAVLRGELFPGPGHVSLIGAWEFQLGSRAGSGSVFSAGSGASSLLHSWLYYDSVLLIAGAVAAFAGLALRRVRPAALAGTILVLVALRPGGYLPAMYVVQVMPFFAIAIAGVIAWAVATLRPGRTRWRWAILGTAVALSLTVVVPRWYVGDHRALTTTDNAPYAQVAGYLHERLAGSQGGTIVVDDVLWLDCVDAGYPPDRVLWFYKVDLDSAVAERLPGGWRDVDYIVSTPAIRQDPNSLPTIRTLLTNSTVIASFGPPDGLIEIRRVAKEATS

SEQ ID NO: 13162 - protein, 411 aa, Actinoplanes utahensis
MVFVSVVLSAFAVVTLWWTMHAWRTPETLAATRFAPPDGEQHLTFSLLVPARHEQAVLEHTVQRLLRSTHEAFEIIVIVGHDDPETAAVAHRVAAGAPGRILVVTDHNEVKNKPRALNTALAYARGDVVGVFDAEDQVHPDLLEHVDHAFRATGADVVQGGVQLINFHSSWYSLHNCLEYFFWFRSRLHLHAKKGFIPLGGNTVFVRTDVLRGANGWDGTCLAEDCDLGVRLSSRGAKVVVAYDSTIVTREETPHSLPGLLKQRTRWHQGFLQVLRKGEWRRLPTLRQRILARYTLTSPFVQAFAGVVIPIGVAIALWAQLPVLVALVTFLPVLPMVATLMFQVIGLRDFGKEYDLRIRWHHYARLIIGAFPYAIVLAVAALRAVWREYTGRRNWELTSHVGAHLTEAAAA

SEQ ID NO: 13163 - protein, 198 aa, Actinoplanes utahensis
MSSPHPAAPVGRPRSSGARRLGGSAREEIVDAAAALFAERGYAATSTRMIAERVGVRQASLYYHFRTKEQILAEMLEATVRPSVDYAAALSAQGLGPADTLRALVRYDVGVLLGARWNIGILYALPEIATEPFAHFRAGREQLRVTYRELAGGVIPGDLILGLVESVIGMRRDLAVLPPHDQLQDAIAAAALRLIEND

SEQ ID NO: 13164 - protein, 516 aa, Actinoplanes utahensis
MTTTTSTDAADLRGFGYEPELRRSIGSYASFAAGFSFVSILTTVFQLFAFGFSFGGPAFFWTWPLVFLGQFTVALNFAELAARYPLSGCIYQWSRRLAGATVGWFAGWVMIIAQIVTVASAAIALQVVLPQIWSGFQLVGGDPSLTSTTGATNAVILGAILIALTTLVNVIGVRLMSIINSTGVTLEIIGVAAVVVLLLVHAERGPGVVLHTGGLGSGLSYVGPFLVSALMAAYVVVGFDSAGELSEETHDPRHTAPRTILRALAAAGIGGGLLLLVALMAAPSLTDGRLATEGLPYVLTSRLGETGGRILLIDVAIAVAVCTLAIQTAGSRMIFSMARDEVLPFSAALSRVNPRTGTPALPAIVVGVGAAALLLVNIGQAALFTALTSVCIVLLYLAYALVTIPLLVRRIKGWPVTGPDVTTTERGGRLFSLGRTGIVVNGVAVVYGLGMILNLGWPRAEVYDPAGAHWYLHYFSLLFVAATLIGGALAYARYRTRAMSLHLPSFPAVVAEGDPA

SEQ ID NO: 13165 - protein, 268 aa, Actinoplanes utahensis
MSTATTAGARQHARAQAGTVTEHMPIVPASRAGAGLVWAETVPGGGYASKRLARGTTLRLTAPHGDACVSVLLFNADEPWERLNVADTVKVLWQAYVGEGHLLLSDQGRVLASVTAGAADLSDTFCGTTTITSNIRRYGDGSAHSGTPAGRELFTLAAAKHGLTRRDLPPSISFFQGVRVGDDGRFAPPAAAGPGATVELRAEMPLTVLLVNVPHPLDERTTYTCNAVEVRAATGAATAPTDRLWSRSPEGERAFLNTADYLTARGIA

SEQ ID NO: 13166 - protein, 201 aa, Actinoplanes utahensis
MTTVLDQIVPARAPWSAIVRHDQTLTIVDLHGNQAVDCLIYNAADTAERYSAPDTVAAQGGIFLTTGSVLRSSEGNPLMTVIADEVGRHDTVGGACSRESNTLRYGHHTQHQHACVENFLIEGSRWGLGKRDLVSNINWYMNVPVDPDGSLGIVDGLSAPGLTVTLRAELDVLVLVSNCPQINNPCNGFDPTPVRMIISEG

SEQ ID NO: 13167 - protein, 1159 aa, Actinoplanes utahensis
MFDTLLVANRGEIACRIIRTAARLGLKTVAVFSEPDRAAPHVRMADQAVLLGPAPARESYLVVDRVLAAALSTGAGAVHPGYGFLSEDAAFATAVEAAGLAFVGPTPAQLTAFGAKHTARQLASAAGVPMIQGTGLLSGLDEALTAAAAIGYPVMLKATGGGGGIGMQACFGPDQLARAYDRVERLAVANFGSGGVFLERFVPRARHVEVQVFGDGAGRVVALGDRDCSLQRRHQKVVEEAPAPGLPAAVRDRLHESAAALCASVGYRSAGTVEFVYDAAREEASFLEVNTRLQVEHPVTEEIFGIDLVAWMLRLARGDAGMLDEPRRAAGVAVEARVYAEDPTQDHRPGAGLITDAVFPGDVRVDGWVAAGTEVGTAYDPMLAKVIVTGATRGEAFANLRTALAGTRIDGIETNLGLLRAAAAHEDVLAARHSTATLAGVHDTEPRVVVQRPGTLTTVQDWPGRIGLWEVGVPPSGPMDDLSFRLGNRALGNPEGAPGLECTVDGPALRFTAETTVCVTGAPVPVSVDGRPVPQWEPVVVPAGAVLDVGTATEGGLRAYVLFAGGLDVPRYLGSAATFTLGQFGGHGGRALRVGDVLRSAVGAIGAGRPVAAPPHIGHDWRIRVTEGPHAAPEFFTREDIDAFYAAEWQVHFNSARTGVRLVGPKPRWARTDGGEAGLHPSNIHDTPYSVGAVDFTGDVPILLGPDGPSLGGFVCPATVITSERWKLGQLSPRDTVRFVPVDDLDFTPLIRTRDDGVLARTDDATYRRSGDDNLLVEYGPMTLDLGLRMRGHALMDRLRAEGLPGVVDLTPGIRSLQIHIDPAVLPVRKLLDVVRSIELPAVRDLEVPSRTVHLPLSWDDPATREAIARYMNGVRDDAPWCPWNIEFIRRVNGLDAVEDVYRTVYDASYLVLGLGDVYLGAPVATPLDPRHRLVTTKYNPARTWTPENAVGIGGAYLCIYGMEGPGGYQFVGRTVQVWSRWQREAGDPWLLRHFDRIRWYPVGAEELLDLRADMAAGRHRLRIDDGTFRLADHEDFLAANADSIAAFRATQAAAFGAERDAWAAAGEFDPRPEPEAAPAAGQVTVPDGGALVEAPFVSSVWRVDVRPGDRVAAGQPLLALEAMKLETVVTAPRAATVTDILVTPGAQVAPGSPLVVLA

SEQ ID NO: 13168 - protein, 548 aa, Actinoplanes utahensis
MRPTTRVRAAYDRLARNERPEAWITLRPVTDLLADAVVVEARLAAGEELPLAGKLVAVKDNIDVAGLPTTAGCPAYAYRPAVSATAVQRLVDAGALILGKTNLDQFATGLVGTRSPYGAVRDVRDPTRVSGGSSSGSAVVVALGIADLALGTDTAGSGRVPAAFQGIVGMKPTPGLVPTDGVVPACRSFDCVTVFARTLGEGRQALGIISDPMPPSGAAPPHPIVAVPDRCELTALSPDRLDAFEQVTKDLEAAGARLRPIRLAPFLAAAKLLYQGGFVAERYAAVGAFIDEHPAEVDPTVRAIIGAARDIPAHVLVADTERLDRLRAEAMAEWGDADALLLPTAPTHPTSAEVAADPIGVNATLGTYTNFCNLFGLSAVAVPAAFGVQIIARGFADTVAADVAALVLGETPCGGTTGTGLPLLVVGAHLTGQPLNHQLTEPGGRFLRAVRTAAHYRLHALPTDPPKPGLVRVAAGGAAIEGEVWALPPDALGRLLAGLPSPMALGPVRLADGTTVTGFLCEGVAAEGAPDITGHGGWRAYLSSRAGS

SEQ ID NO: 13169 - protein, 238 aa, Actinoplanes utahensis
MIPGYLDGYEPPIVDSPLVDGSALMAHDLFWPAFLSTVGGSATAPYAFGADPADLDEMVDAFLDEHEWPVFSLLLAGTGQLHVVMRNLPDDGGVDYVLDPGTGSRSIPLAALDGHFRGPALAWPELIDTARPPGAPHTSAERLLLLLPACADRDRPSDVTEMVAAALTAVGAVSGTHAVAEELLDSPRFWTRDCGWTIVDQALVCLGSHAYRSADAELTSSDLRLVTEAFRSTSADPA

SEQ ID NO: 13170 - protein, 292 aa, Actinoplanes utahensis
MSITMQLATPDSLGEIVEAVAVWQHTGGPVQLHPGDLGWHWRFGGRELAEAVRVWTRNGQILAVGLVDDGVIRMGIAPGVDEDAAFAARLLADLSDPGHGVLPDGAGAVEARFGAALRHLLRRSGWVPDEPWTPLSRELIEPVEDCGLRVEVIEAHNVRDRFVDDRVAVHRAAFANSTFTVERWRAMAAAPPYRRARCLVGYDGDGDAVAAATVWSAGGGRPGLLEPMGVHRDHRGHGYGRAITVAAAAALQEMGSSSAMVCTPSSNVGGVATYVSAGFQKVPDVTDFRRTS

SEQ ID NO: 13171 - protein, 98 aa, Actinoplanes utahensis
MATSTHAHENVAVKGNRFRGEETKPSFKTTELIVYVLAVIGVLIASYTVGDGAANNGTDHFAADKAWWYITLLTIGYMISRGLAKAGSRSSDVDPRTH

SEQ ID NO: 13172 - protein, 101 aa, Actinoplanes utahensis
MGPDENTYVRDQNARVDPMLTIGTITAAGLRDILADLPDDAVVVVARDGAGDDTCSPLADVEECWYLAASGESVPLGRDGDGNVHEPGPGDLYAVLLRPTC

SEQ ID NO: 13173 - protein, 146 aa, Actinoplanes utahensis
MRHPPEPDSPSTTQLIERFVLASSTYYQEFAAVADRHDLNSTQVKLLILVHRPQSMRALAKQLSCDASNVTGLVDRLERRGLVRRDVAPTDRRIKIIGRTPAGEEVVGMVRAEMAATHRALAAFSDDERALLGTLLTRMHAALDES

SEQ ID NO: 13174 - protein, 497 aa, Actinoplanes utahensis
MSSPAARRETVLVLVLGVATMVVSMMQTLVVPILGLIGHDLHASTSEVSWVTTATLLSAAVFTPLLGRLGDQYGKKPTLLAVLVVMVAGSVLAALTHSLGWLIVARVLQGAATAIFPLALSVVREHLRPERLPGAMALISGTLAFGGGLALVTTGLLTQGADADFHRVFWLSAGLAVLALLAVAAIVPSGGHRSGGRVDVWGALSLAGVLVALLLPISQGHGWGWASARTLGCFAAAAVLAVVWVLIERSVAEPLVDLRMFTHRPVFFTNLAGILVGFGMFTQSIGISYLVQMPTALAGYGFGASVLRASVEYLLPAAVASLLAAQLGGVLLRRIGARATLVAGAALGAGGFAWLAVTHTRPASVIAAGAVIGAGVALGYAAMPALIMASVPHHQSGIANGINSISRSTGSAIGSATVTSLLAAASVPGLPPGVPPLPAESQFTLSFVLAGAAFAVLIVITLTGLRRHPQTPATPAAPAIPATDPIHPDPAPVAAAR

SEQ ID NO: 13175 - protein, 358 aa, Actinoplanes utahensis
MAGTGCATAPRGLEAAVVELVRRGPEHRIHVVLTADRWADLSAGLPESVGTRLELRLRDAERSMVSRRAALAVPRRDPGYGLTPDGRHFRSAAPWPDAAVPIRAAWSGQTAPQMRMLPELLSPADLPDRPGEGFPIGLDESTLEPVRFDPGADQHLVVVGDPGSGRTGVLRLIAQSIVARCMPAEARLMLVDPRRGLTGAADGRHLLIHAGSRAAVADAVATVRQAMTERLPGPEVTAERLRKGRWWRGPDLFVLVDDYDLVAGTDGDPLAELVPLLPYARDIGLHLIVARRTAGAARAMYEPLPRMLTLLNSAFLLLSGSPAEGPIVGDVRPAKQPPGRGTLVTRAGVRVVQTAYPQ

SEQ ID NO: 13176 - protein, 494 aa, Actinoplanes utahensis
MAGCRRRAVTPGLPARGRGTRASLRKGRPMTVHRTTGGPAWTPALPAGRVMCADSTGRALLALSVPPGDRRDDTLSRVPVLGRHGELPDRARRAALTAEAAGEALPVALAGHVDAEAVARWVTGHHRSPRYPAVVLGSPHGAAVHLAAACGAAWLPTSFTVTLPWPGGDPGDWAAARDWGARLAGPILDRNPGVTVRQVHDPVSRGVLCGATVSLQVRWRTLPAAYRSFLTTRGPDGVHLFVRDLRTWPVDGGPPGYSFQIGSPVAGGDPADYRGGDDAFGRLLHRIGAGDWTDPPAGTPRHYAETSGEPGLEAEIRTVAAAGGSAGHRLLYSDPHALSAAVADLHRAWLSPPPGARHALVGTGRMTDPWQAFDAGVVPYWCESSSHAAATAAEWWLAGSRPYDRITVLPDPPGTPHGRLAAPAHWRSIAAFAGRGAVGNLLARRYPTLPAAAGHATDYLRHATTAPGRRPPIPAGEAVRHLSRHRTVPGLMIL

SEQ ID NO: 13177 - protein, 31 aa, Actinoplanes utahensis
MKSPRRDGTQPRNHRAAMTPSHKIAVATTPG

SEQ ID NO: 13178 - protein, 79 aa, Actinoplanes utahensis
MYTGAQQASAAAHGYPPAMPMRPPAVWPVAVVTLFFGIFGLIPAVIATGKARQQGIAVSRYWLAFGLPLIFWLGVVAAR

SEQ ID NO: 13179 - protein, 206 aa, Actinoplanes utahensis
MPGTEPVLLPPSADPTFAGPAYGPPPASGAAAPAYGPAVEMPAPAPASAMPAPASAMPAPGYAMPPQGYAMPPQGYAMPAQGYAMPAPAYGMAPGYGAAPGYGAAPGYGAAPGQAAMVGGGVAMAGGAAAMVGGGAAMAGGTAVAATGAAVAGTSVISGLFMMFFGALLSLTIIGAIVGIPMIMAGMATAGFGAAAGTTAMVALAS

SEQ ID NO: 13180 - protein, 426 aa, Actinoplanes utahensis
MTPRRTLAVVAALTLSTLGLAACGGGDDSSGGNVTMELWENATTGPGRAFWEKAAADYQAAHPTVTIKIQAVQNEDLDGKLQTALNSGAAPDIFLQRGGGKMAAMVDAGQVKDITADISAETKQAVPEAALKTGQIDGKAYAVPVAILPGGLWYSKDVFQKAGITAPPATMDEFNAAVTKLKANGTPVALGAKDAWPAAHWFYFFALRSCSKATLDATAESKTFDDPCWTRAGQDLQAFAATQPFNNGFLTTSAQQGAGSSAGLIANHKAGMELMGAWDPGTIASLTKDAKPLPDLGFFPFPSVPGGQGDPAAVMGGTDGYSCSAKAPRECSDFLNYLLTKDVQEAYYRGFNALPVNRAAQGAVTEDYLKAVLDTYNKAPYVSVWLDTLYGQNVGNALNVSIVNLLAGKGDVAGIIKAVNDAAKKG

SEQ ID NO: 13181 - protein, 305 aa, Actinoplanes utahensis
MPARRGAGWAQRLEIAALSGPAILVFLAFVIFPVLMAGYYGFYRWKGFGVPTDFVGLDNYRTILQDSAFHDVLLHNGLIVVLSLVLQGPIAVGLAMLLNRRMRGRSILRVLIFVPYVIAEVIVGTAWGLLLQSEGAVNGVLRSIGLGGLAADWLSDPKLAIWTLMLVLTWKYVGFAVILFLAGMQNIPEELSEAAAVDGASFWQTQRRITLPLLGPTVRIWAFLSILGALQLFDLVYIIWGQYVASTAGTSTMVTYMVTEGRNAANYGYGNAVAVVLFAISMIIALVYQRFVLRRDTEGALTGGR

SEQ ID NO: 13182 - protein, 274 aa, Actinoplanes utahensis
MKSRTAGNPAVYLIALLLVGLMLGPVVYIVIGGFRTNSQIITDPAGLPRPWVFTNYADVLASSTFWRQVGNSAITAVATTIGVVTLGVMASYVLARYRFRGRGAMYALFAAGLMFPATVAITPLYILVKNLGLVNTLPGVILPQIAFGLPTTIIILVPFLQAIPKEIEEAAAIDRCSRLGFFWRMVLPLSVPGLITTGILAFITSWNSYLLPLFILNDQDSFTLPLGVQAFASQYSVDTAKVLAFTSLSMIPALVFFSLFERRIVGGLTGAVKG

SEQ ID NO: 13183 - protein, 232 aa, Actinoplanes utahensis
MTSLHVATTGADDTDGSARRPLRTINRAAAPARPGDTVVVHAGEYREWVTPRRGGLSDNRRITYRAAESEHVVIKGSERITGWQPDGGTVWTVAVPNTLFGDFNPFVEEVAGRDVKQAGYARRNVYAAGARPFAGERDPVILEWGTATVVVDGEEVHLATDFPAGIDEAAAVPVGGRDLERVRFADAEFEERDGRPAMLTTDLTGVIKDPERRYAAGPIVALTAGPRRVRVW

SEQ ID NO: 13184 - protein, 553 aa, Actinoplanes utahensis
MRHRRGNDRTDPMTLLDHVRRPAVLAGLLAGVLGLVWTLWFAHDAGDLAAQYAWTSFVREHPWSAYNMSWYGGMHPASYSVISPYLMAWLGVRTTGVLACTAGAALGGLALTRFGVRRPLLPSVWLAIAVWANLAAGRVTYLLGMVFALMAALLAPPRSGPRPDRPVLAAALGALATLCSPVAGLFIEVLAAALFLVGRRRRAYLLAAGPPVVIAATSLLFPFSGVQPFPWYAALATVAAAVAVGVLTPPAWRTVRAGAWVYAVGVALCWALPTPIGSNVERLALLVGALILFCAAPARRTRRATVTYLAAAALAVWTMVQPVSDVIHTSRVTDRTAADARPLITELLRLDAQRSRVEVVPLRTHWEASVVAPYIALARGWNRQADVERNPLFYDDTLTPDSYRAWLTNWSVAYVVLPAMEPDSSGIAEAQIITAGQPWLPLVWQDADWRVYRVEGADPLVSAPATVVSAGPAALTVHMPQAGSALVRVAWSPWLAIDGAADDSVPRACLARSGEWTELSAPTAGTYTIEARYALSRGTPCGITRHDPDTPPR

SEQ ID NO: 13185 - protein, 513 aa, Actinoplanes utahensis
MRVALVTLYVAAGLVAAAYSALSWRRRHRSSLAISLGVILASAALWSLAQAVAAVATSRAVGLAATYAMFPGVAALVAAFFWHTTVFTGGPPEALRGRLRLLLVHPVLLTAVVVTDPWHHAFFRSISDYPGGGVVPHPGPLYWAHTAYCYTILATGAARAIGAMRRAVRGHRRVFVIFLGGALAPAAGNLVSVVAGLGEQQVDLTPVLFLITASMWWWAERAGVTSRRTPVAYKQVIAALQDAVMVLDPDGRFLDVNPAAAELLAGLNPAAAGAVVGRRWQEITGPRLAATFDGEGQQTVTAASGRVYDVRVVRMGEPGGDSPGTVVVVRDVTELERLRAELTDQAVRDGLTGVFNRRHLTAVLDGRIREAVAGGHPLSVVMIDVDHFKAVNDNYGHAAGDEVLTRLAGELSAAVGTAGTVARYGGEEFAVVLPGTGVREAAELAEGWRERCTRLTVPTACGPLRMTFSAGVAQLTPSTRAEELLRRADRALYGAKEAGRNRVVWDSLTAATP

SEQ ID NO: 13186 - protein, 179 aa, Actinoplanes utahensis
MAAAGGTPVAAVAVAGVIAADGPAWEQSPADLDRDLAVNLHGVANLARAAIPGMLGAADPSRCRFVAVVSSAAERGLPLLASYVAAKHAALGYIRALAADLGPSGITANAVLPGSTGTELLTRTARAYGLAGAQDFARHQRLGRLLTPAEVAAAVAWLCSAAASATTGAALAVDGGFTG

SEQ ID NO: 13187 - protein, 83 aa, Actinoplanes utahensis
MEAVEMRVDSLEPVRPVAVITGAGRGIGAAVARALAADYDLVLGDAPGPAAETGLGYRLATLTELTAVAADCRAAGARVAAPS

SEQ ID NO: 13188 - protein, 408 aa, Actinoplanes utahensis
MGRDWFESVAVAQRRAQRRLPRSVYGAIVAGSERGVTLDDNLAAFAELGLAPHVAGQAAQRSLATTVMGQPVALPVIISPTGVQAVHPDGEVAVARAAAARGTAMSLSSFASKPLGEVVAANPQTFFQMYWMGSRDEMLRRMDDARRAGAKGLIVTLDWSFSHSRDWGSPTIPDRMNLSAMLRHAPETLRRPRWLLAYLRQRRIPDLTVPNLADDGVAPTFFGAYGRWMQTPPPSWDDVRWLRAQWGGPFLLKGVIRVDDARRAADCGVTAISVSNHGGNNLDSTPAPIRALPAVVEAVGDRVEVLLDGGIRRGSDVVKAVALGARAVLIGRAYLWGLAANGQAGVENVLDVLRNGIDSALLGLGRADIRDLRPEDVVVPAGFTRRLGAGVPAASAAPAASAAFEVIG

SEQ ID NO: 13189 - protein, 90 aa, Actinoplanes utahensis
MRTTPAPGVTSRILENGHLELFVGDTGRRLQWGRVSAAVWIALRQHRGQCTAAADMLADLWDIDRINMRTEVEIRVDEWCDAGLMCRERD

SEQ ID NO: 13190 - protein, 345 aa, Actinoplanes utahensis
MPARRSPAGGRAGAGPVPAGAGREPGRGRGRRAAGAAVRRSGRGAGPGGGRRRAGRGGRRPGPDRAPHRPRARRHPGGADLLTSTDREVLPVTQQAPDPGLWFRRFHPAPAGDVRLVCFPHAGGSASFYFPVSKALSPRMEVLAVQYPGRQDRRSEAQLTDLHVLADRIAEALAPLTDRRLAFFGHSMGAMLAYEVGLRLEDAGRHDLTHVFASGRRAPSCYRGESVHQRDDEGILAELQRMDGTDPRLLTDPELQRMFLPVIRGDYRAVETYRHRPDAALRSALTVLTGDSDAMTTVAEARDWAAHTTGHFDLRVFPGGHFYLVPQAAAVLDLLSTTLAPLPTY

SEQ ID NO: 13191 - protein, 487 aa, Actinoplanes utahensis
MRHRCRGGRGKGPGRGPPRGSQHRRDSYVHRRGRLTAPPTPEDLGMTILAPTLVGTERFRALGPRHIDEIADRYGLPADLRESVRLVSAVLPFRVNEHVLNTLIDWDRIPDDPIFQLVFPQAGMLSADDGRQVAAALSDGDRTRLQTVVRDIRGRLNPHPSGQMEHNVPRGADGEPLAGVQHKYRSTVLYFPGQGQTCHSYCTYCFRWAQFVGDADLRFAAQSPHQLVEYLHRHPSVTDVLVTGGDPMVMSTERLRSHLEPLLAVPTVRTIRIGTKSLAYWPHRFGSDGDAEEVLRLFEQIVATGRNIAVMAHFSHPRELEPEPARWAMERIRATGALIYCQAPLIARVNDSAAVWREMWHRELAAGAVPYYMFVERDTGPHEYFKVPLERAASIFREAYQDLSGLARTVRGPVMSATPGKVIVDGVTPAGDGEALQLRFLQARDPALVGRPFLAHRSPTAAWLDELVLHPSTPADIAAAVGSAVSR

SEQ ID NO: 13192 - protein, 417 aa, Actinoplanes utahensis
MTRHIAPNMALDQRIAERQAAGERIVHLGFGEARLPVFAPLAERLAAGAARNRYGAVVGDLPVRTALAGYFTRRGLPTEPGQVMTAPGSKALLIGVQLALPGDIVLPAPCWNTYLPQAVLAGKTPITVPIPAGCGGVPDPELLPGALRAARAAGHHPRIMLLTLPDNPTGTVADPETIRRLCAIADREDLWILSDEIYRDILHGPEVAFRSPAELLPERTVVTTGLSKNLALGGWRIGGARFPASPQGERLRADVAAVASETWSALAQPMQEVAAYAFSEPPEIRRHLAAGARLHAVVARAVYEIMVGAGATCRPPAGGFYVYPDFEPLRGHLAGHGITDAASLEHELLETAGVAVLGGHHQGDDPAALRFRAATSLLYGDTDAERAAALAAADPVALPHIRDILARLEEGLAKLCR

SEQ ID NO: 13193 - protein, 319 aa, Actinoplanes utahensis
MPIGDSRVTYDGAAIVFPGMGPLRYAEAARFLMFNPAARRLVAVADETLGYRLLDRWRDTEGDYSAYAQAAFLVTCLALAEWVAETHDVTPSVIAGASFGGKAAAAYAGAISAPDAIRMTAGIARCEEEYFRREHRDVVTVSFARTPRERLDEILADLTADGGWHDFSCYVDDDLHMVSMSAQRLDWFHARVRQAGGLPLYVTDPPMHSAAFGPLREIVEREVFAGVRFADPDLPVLADQDGSLRRTAAGVRDMLLDGLVMPVRWPRVVTALRDAGVGRVYVAGPDSLFGRVRRTTDNFAVVTANPRLAMTPRRRPLPV

SEQ ID NO: 13194 - protein, 105 aa, Actinoplanes utahensis
MPAARRCSFVDLKRAFFNEGDDIMWDVKFEEMVRHCLPFLPSGEQLEADADLRDLGLDSLGTVELLSALEKGYQVRFTDEMLSMDTFATPRTLWGALSGIVPTAV

SEQ ID NO: 13195 - protein, 508 aa, Actinoplanes utahensis
MDDVALSLPSRFLRGLALGPGRTALRIGSQRVSYAELHELACDWAGALRAAPDGPPAAVGVLAGKTFEGYAGVLAALYAGATVVPLHPDFPIARTRYMLQTAGVSAVIADPAGWAALDRLHAEGLRLPAVGDGPAGDRLTIGVRAADALAGPVAADPDGAAYMLFTSGSTGRPKGVPIGRGAVAHYFGLLDARYDFGPDDVFSQTFDLNFDCAMFDLFGAWGAGATVCPVPAQAYRDLPGFVADRRMTVWFSTPSAIGLIRRMGGLGAGALSGLRWSLFAGEALRAADAVDWQAAADRSTLENIYGPTELTITVTGHRWSPATSPQRCVNGLAPIGTVHPGHDHVLLGADGAEVPAEGELCITGPQMTTGYLDPADDAGRFLDRDGRRWYRTGDRVRRLADGELVYLGRLDSQVQVQGWRVELAELEHALRSCPGVEDAVAVTRPAEEGLELVVYYTGQVTPPALLARRLRDILPAGMLPRVYRHLGELPLNSNRKVDRGRLARDLAS

SEQ ID NO: 13196 - protein, 547 aa, Actinoplanes utahensis
MATYGSAPFHPPLDPPIPGPPRPRFSLDSAFMTIVEIHAPEMLHEFLLQHAATRPGAPAVIEQSRTTSYGELRERAEAYAAALAGLGLGIGHRVVVDADTSAPAIAMLIACSMRGLTYIPVSPETPTPRVLSVAAAAGAVLHLQTTEGERTGLPPELGAGRFGPDSLEVTHLPAIAPTGRTACTPVDPAYIVFTSGTTGRPKGVVMSHRAVLSFFRGMLAHRIVGPDDRVATTSPLQFDFSLLDIGLALGSGAAVLPVPRPFLRWPRRFLSFLAATGATQVNGVPSIWRPVLRHEPDQLGTLTALRGVLYSGEPFPLPELRQLRKLRPGLRIVNCYGSTESIACSFTDVPDPVPDSGDGVPIGPAHPGAELLLLGEDGRPVSGAGVLGELYLRSPALFSGYWDDPATTGRVLVPDPVEPRSGQLVYRTGDLATRGGDGLFYYSCRADSQVKIRGNRVELGEVERRLLDLPGVGAATVLAPPRPDGEPVLCAFLAVAAEAGLTEARVSAFCKETLPDYMIPSEVRLLGELPVTVNGKVDKAALLAGRE

SEQ ID NO: 13197 - protein, 578 aa, Actinoplanes utahensis
MERAAMRDSRGTGSVGDHLAQRRAGLAGSLRDLPVPEQVRRLRSLVTGQLLPILRTIRPAEEIVVAGATPFREQGLDSLGLVDLHARLNAATGLALPVTVGFDHPTPDALAAYLRAELLGLAESGAEVVAAARASDEPIAIVGIGCHFPGGADSPEQLWRLVADEEHVHMPFPADRGWDLDNLFDDDPERAGTTYVRHGAFLTGAAGFDAAFFGIGPREAAAMDPQQRLVLETTWEALERAGIDPGTLRGGRTGVFIGAEPQEYAVRLHEAPDGLDAYLLTGNTTSVLSGRVAYLLGLEGPALTVDTACSGALVALHLAAESLRRGESALAVAGGVAVIGAPGVFTAFSRQRGLAPDGIAKPFAAAADGTSFAEGAGLFVLERLDDARRNGHPVLAVLAGTAINNDGASNGLTAPSGAAQRQVIRQALANAGLTADQVDAVDAHGTGTTLGDPIEARALIAAYGPGRDADHPLWLGSVKSNIGHTQAAGGAAALIKMIMAMRHDLLPRTLHVDAPTPNVDWSAGTVRLLTEATPWPRRDRPRRAGVSGFGISGTNAHVIIEEPAAVPEPERPAAPVPP

SEQ ID NO: 13198 - protein, 419 aa, Actinoplanes utahensis
MVTGVARDARLAYLFTGQGAQRFGAGRELYAAYPVFAAALQDAVAHLDLHLAVPLGEVLFGASADLLDRTEYAQPALFAIGTALFRLLESWGLRPDFLAGHSIGELTAAHLAGVLSLADAAALVAARGRLMQQLPAGGAMVAVQATEDEAGPLRDADLDLAAINGPEQIVLSGTRDAAEAAAARFAALGRRTRFLDVSHAFHSPLMEPMLEEFGRLAAVLDYRPPAIPVISGVTGRPATTEELTDPGYWVRHVRAAVRFHDSLTWLLDENVGTFLELGPDPVLSALGRAAVTDRANAPVFAGTLRRDRDEAREVATAAATAHVRGARLDGTGLFGAPATAVPLPTYPFQHQHFWLHGAQTGRVDAPGLGQIAARHPFLGAVVPMAGAGATVLTGRLALAEHPWLADHVVAGANLLPLAS

SEQ ID NO: 13199 - protein, 1439 aa, Actinoplanes utahensis
MLGHDDAGQVDEDRAFSEIGFDSLAAVELRNRLADLTGLRLPATLTFDYPTSVALAGHLATALGEAAGAPVPAPSAGPAPTDEPIAIIGMACRYPGDVNSPEQLWDLVLRGGDAISTFPEDRGWDPDTYDPAPGVPGRSYSNEGGFLRDAAEFDAGFFGISPREAQAMDPQQRLLLEVAWETFERSGVDPASVRGTGTGVYAGVMYHDWGLRLGTLPEELAAYHGNGSLASIATGRIAYTFGLEGPAVTVDTACSSSLVAIHLAAQALRRGEIGLALAGGVTVMSTPDTFVDMSRQGGLSSDGRCRSFGAGADGVGWGEGAGLLLLERLSDARRNGHRVLALVRGSAINQDGASNGMTAPNGPSQQRVIRQALGAAGLTTADVDVIEGHGTGTRLGDPIEAEALLATYGRDRPDDRPVRLGSVKSNIGHAQAAAGVAGVIKMVLAMRHELLPRTLHVDEASPQVAWDSGAVELLTSEQAWPRSARPRRAGVSSFGISGTNAHLILEEPPAAGPVPPVGDLPLPLLLSGRSAAAVREQAALLDTYLRERPDSDLTAAALALATTRAALPFRASAADPRDLAAPVVTEAGPGRTAFVFSGQGAQRLGMGRGLYAAFPVFAAAFDAALTDPGLRGVMWGDDVEALNATGVAQPALFAFEVALFRLVESWGVRADFVAGHSVGELAAAHVAGVLSLDDARRLVAARAGLMQALPPGGVMVAVQAAESVVRPLLVEGADVAAVNAAGSVVLSGEPAAVDVVLAGLPGVKTSRLRVSHAFHSSLMDPMLAEFAEVAAGIDHGVARIPVVSTLTGAVADFDADHWVRQVRQAVRFADAVQHLEAAGVTRFVEIGPDAALTPLIDATGIATQRRDRDEVTELLAATGRAWTHGVRVDWTAVRPAPVAALPHDLPTYAFQRRRYWLDVTPAGDVGAAGLDPVEHPMLAAAVVSAADGGLVLTGRLSAAGPGWLADHDVLGRVLLPGTGFVELALRAADQVGGAGVEELTIEAPLTLPARGGVAVQVVVGPASGAGIRTVAVHSRAEAGAPWQRHATGTLTAVAAEPDFDLMAWPPAGAAPIEVTGAYERLRDRGYAYGPAFRGLRAAWRHGDEVYAEVALPESAHADGRRFGLHPALLDAAMHADLLGDDPDAPTLMPFAWTGVTLHATGATALRVRIRRVRGDEVSAMWIADDTGRPVATVGTLVSRPVSAAQLRGSTAAGDAMFRIGWQARPVTPDGRVLPEAGAAAPGPLVALTLRASGADVPATVRAVTGDLLDRLRAWLDDDATAGSRLVVVTDRAAAVRDGDDADPRTAPVWGLVRAAQAEHPGRLQLIDTDGTPESDAVLAAAAATGEPELAVRAGQVLIPRFEPAPGGDREIPWPTGGTVLVTGGTGGLGALLARHLVTEHGVRHLLLTSRRGPDAPGAAALADELRAAGAEVTVVALAS

SEQ ID NO: 13200 - protein, 2087 aa, Actinoplanes utahensis
MAAMIAAVPADRPLRAVLHAAGAVAGGTLAALTGEHLDTVLAPKVDGAWHLHDLTRDRQLDAFVLISSAGGSVLAAGQGDYAAANVFLDALAAHRRAAGLPATSLAYGMWAVDTGLGGALGRADLERMRRLGLPALEPAAALELFDAAVRQDSPAVLLTRVDRTALGARTDELPALLRRLAPPARRRAPAATEPTAFTDRLAGLAEADLLRTLIDLVRGQVATVLGHEGAAAVAPDRAFRELGFDSLAAVELRNALSATTGLRLAATLVFDHPTPRAVATELATMIGGRPAAEPAAPERPATVRPADDPIAIVGISCRFPGGVRSAEDLWRLVAAGEDAIGPFPADRGWAGDSIYDPEPGVPGKTYTRAGGFLYDAAYFDPEFFGIMPREALAMDPQQRLLLEGAWEAFERAGIDPAGMRGSRTGVYAGVMYHDYASRLPEIPAELTGYVGNGSAASIASGRVAYTLGLEGPAVTVDTACSSSLVAIHLAAQALRNGEVAMALAGGVTVMSAPEIFVEFSEQRGLAADGRCKAFAAAADGTAWAEGLGMLLLERLSDARRNDHPVLAVIRGSAINQDGASNGLTAPNGPSQQRVIRAALDAAGLAPAEVDAVEGHGTGTRLGDPIEAQALLATYGRDRTDEDPLWLGSVKSNIGHAQAAAGVSGLIKMVMALRHEQLPRTLHVDQPSPQVDWTAGAVRLLTEPVAWQRGGRPRRAGISSFGLSGTNAHLILEEAPAEPVTTPVRVPGPVLLPISARTAAALPDQAGALRAHLAEQPDADLGDVAYSLATGRAALGHRAVVLAADRDAALAGLAEVEPVTAGDGLTAFVFSGQGAQRLGMGRGLYAAFPVFAAAFDAALTDPGLRGVMWGDDVEALNATGVAQPALFAFEVALFRLVESWGVRADFVAGHSVGELAAAHVAGVLSLDDARRLVAARAGLMQALPPGGAMVALPVPLDRVEPLLTAGVDIAAVNGPASVVISGAEDEVLTIAAAFPSARRLRVSHAFHSSLMDPMLADFAEVAAGIDHGAARIPVVSTLTGAVADFDADHWVRQVRQAVRFADAVQHLEAAGVTRFVEIGPDAALTPLIDATGIATQRRDRDEVTELLAATGRAWTHGVPVDWAALTPAGRTVDLPTYAFQRRRYWLEAPPSRPGDPAGLGQHDAAHPMLGAVVVAAESGTVTLTGRLSVPTHPWIGDHSVLGTVLLAGTSYVELALRAAAEVGCDVVEELTIEAMMTLPDQGGAAVQVAVGAPDAAGRRGFTIHSRAEDAPAEVGWTRHVSGFLAPGAPVATTASFGLTAWPPPGAEPVDISDVYDYLTGQGYHYGPMFRGLRAVWRQGREVFAEVALPDEARSEAGRFGLHPSLLDAALSATDFLDGRRPQDVGGTQLPFAWTGVALHAGGANRLRVRINWVGSDAGAGSEAVRLQLADPAGRPVATVESLVVRPVTPDRVAAAATAASGARRLDTVFRVNWTHLPLGGANTAVAGRWAVLGEDVFGLGPTVPVFADLTALRAAGRPAPEVVLTGTAPAGGDVPGATRDRFDEMLRLCQEWSADQRFAQSRLMVVTTGAVAVDDEAAELTQAPVWGLVRAAEQENRDRFVLVDVDDPGRAAPLLAPIAAAGEPEAAVRGSQVRVPRLTRATAPATGHPAPWDPAGTVLITGGTSGLGAVLARHLVTAHGVRYLLLLSRRGADTPEAKALSADLTLLGAEVTVAACDVADREALAGVLAAVPADRPLRAVVHAAGVMDNAMLGSLTADRAGRVLRPKVDGSWNLHELTGDLDTFLLFSSTSGLLIGAGQASYAAANRFADALATHRRAAGLPATALAFGLWTTPTGLGGGGFDAAAEEQRMARLGMPAFDTADGLAMIDEALALGEASLVTMRVDTGALAAAPAAAVPPLLRELAGTPVTRTPQSSVTAVAPAPEASLEQRLSALTGAERADLLLDLVVAHVAQVRHDEPDAVDRTRGFTELGLDSLAAIELRNRLSTAIGMRLPATLMFDYPNPTALAGFLLEELEPTLAPPPAAPDPDAERLQAALAALTPARLREAGLFDRLLALAAGDTGPSIEEMDVADLVAAAMATTDNGGE

SEQ ID NO: 13201 - protein, 304 aa, Actinoplanes utahensis
MPTAKGTVAFGPHRTWYRVTGQLGAGRPALVVLHGGPGITHDYLKNIADLAADGWPVVHYDQLGNGGSTHLPERGADFWTPALFLAELDNLLTGLGIADDYVLLGHSWGGMLGAAHAATRPAGLRGLIVANSPASYPLWLQEMKVLRDRLPDGVNDTLLRHEAAGTVDDPEYLAASRAFYERHVCRRVPWPSDYMASFYELYNDPTVYRTMNGPTEFHVIGTLRDWSVIDLLPSVAVPTLVISGRHDEATPATLQPYLDLVPDVRWELFEESSHTPNLEEPDRFREVLGAFLSELTRSPRWQQD

SEQ ID NO: 13202 - protein, 164 aa, Actinoplanes utahensis
MAAGLTERTSIAGFREAMASFPSGVTIVTTTDQDGHWCGFTATSFCSLSMDPPLVLVCLARTARCHPGFRTARSWVIHTLTPGQAGLAMRFADRTADKFGGGEFVANAQGHPVLPGACAIVECDAYSQHEAGDHTILIGRVTAARVQAAEPAVYFRRGFRELSS

SEQ ID NO: 13203 - protein, 173 aa, Actinoplanes utahensis
MTEREQALAMGSIAEYGRYVRFACPAYSGEWLFFAPIGTLTTAGGIVGIVKGGGGLADWIFLPLSLIVGLAMVGLCFRPAFERRRGGPTPRLYCFEDGVVVATRGELRAFRWTELTVHSVDWTSGSGENYSSGTRRTWTGPDGAEVVTFRGDEPERAGDRDMRKLHEAALRSR

SEQ ID NO: 13204 - protein, 203 aa, Actinoplanes utahensis
MATHQDASAAKSRSGRPQITSRDHLEKVAFRLFAESGFDATTIDGISDAAGIGRRTFFRYFASKNDLVWGDFDGELAVFRAWFAAVPADRPMLDAIRHGVIAFNTYPAAQVALHRERMALILRVPSLRADSTLRFVQWRQVIADFVAARRGGRPDELYPVTIGHCALGAALAAYEVWLEDETADLPALLAESLRVLTGPHHHA

SEQ ID NO: 13205 - protein, 98 aa, Actinoplanes utahensis
MSVNGKWQIVVNSPVGRQEAICEFEAEGAVLTGKCYSNDVVVEIQDGVVAGNQVKFVCKIKQPMPMKLSYTLVINGDKISGEVKPGLFPKQAVTGVRL

SEQ ID NO: 13206 - protein, 274 aa, Actinoplanes utahensis
MSTLVTTVARPAGVRQVRYGVLGRFRVGTGPDEIDPGPHKMRLLLALLLIRAGQVATPEQLIDDIWGADPPRRAVAALQVYISRLRKVLRPADGDLSIATQKNGYLVTLDMGEVDHHVFQSLLAQGRTLAREGRHAAAVTVLEEALALWRGTPLDGLHDSARVRAFATWLQELRLECHELLIGSGLALGRHRDLVGRLYGLTAEQPLREAFRHQLMIALYRSDRRADALLVFQDARAVLREQVGVEPGRALADLHFAILNGDEQLYRGLRGERR

SEQ ID NO: 13207 - protein, 89 aa, Actinoplanes utahensis
MIGVGLSRSSGLLPINAVRHSPVGQSNGWYVWQGGPAPQDDDFFSPIHVEHANIHFPELVAYLALPPGIGVILAPGYEYIWHDEAFLEP

SEQ ID NO: 13208 - protein, 196 aa, Actinoplanes utahensis
MISARHQLVADAALDVLARHGSRGLTHRAVDAAADLPPGSTSYYYRSRAALLSACVQRLVEHDNTELDAMASTITASDPTTLAQSLAEVLHRWLTTGRQRHLARYELTLESVRRPEVAAELRHSGSGLRQRITVILAGLHASDPPRQARWLVACIDGILFDNIAGANSNNAIDVIELNAATRDLINAVLPARDVDP

SEQ ID NO: 13209 - protein, 398 aa, Actinoplanes utahensis
MDVEERRSAAIVGGGIGGLAAAVALHRAGWTVAVYERSPTRSGIGAGLTLWPNAVRALHALGLAEALRSRAMAVRATAVRRPDGRCLTQTHAGQLLSRYGSPQMAIVRADLVEMLASALPPGCLRPGMNVTDIDAGGLDRQAGIRCGDQLIRADLVVAADGVNSGLRQALWPAQPPAEYRGYVAWRAIVRAPSAQVGGASETWGRAARFGIVPIGDDLVYLYATATTTAREPGADELVDLRHRFRHWHDPIPALLDAIEPGALLRHDITALHPPLRRLHHGRVAFLGDAAHAMEPNLGQGAGLAIEDAVVLAHAVADGSSIVTGLALYDQARAGRVTRLAQQSRLLGRLTQSPSAAVAALRNITIRLIPDRLALRGFDAAASWHPPTLRPATTTQEHL

SEQ ID NO: 13210 - protein, 149 aa, Actinoplanes utahensis
MNPQISPRRSACAIGAWSLIATGAVHAAAIALGTAAATPPAERVARQAMAATHVDIAGIDRTLWQLFTGFSAAMALFIFGLGALNLLALRRAPQLFFDTRAALALNLSILLPAFVLSVLLFPPPPIVFLGASCAAFGYALTRSSTRTRG

SEQ ID NO: 13211 - protein, 66 aa, Actinoplanes utahensis
MNARIRRAVRARGHFPNEQAALKCVYLAVMSLDPTGTGRRRWAIRWKPALNAFDLAFEGRLTAGRN

SEQ ID NO: 13212 - protein, 49 aa, Actinoplanes utahensis
MLDAGVNLRDVQIAARHADPRTTIRYDRARKNLDRHPNYILAAFMASGT

SEQ ID NO: 13213 - protein, 94 aa, Actinoplanes utahensis
MIIIAGRLHVAPADRDRYLAEVANVARLAREAPGCSDFVQAADALDDTRINVYERWESDDDLHRFRAAGGPALDLPPLQDANVRKYRISSDEEP

SEQ ID NO: 13214 - protein, 157 aa, Actinoplanes utahensis
MSTDEASGVPRRYEIDPDPAWDGSDDQDGVLTVVLSWVPDPLVGRPPELAASPELVAALLADGLTGFITGPARATYDEDAFDGAGVMTPPELVRLIVGGDPAADFFYGWGEGLVVSERALALLQTRCRNLTVRPTDEPRPDMLSLLGWQLPPVISRE

SEQ ID NO: 13215 - protein, 354 aa, Actinoplanes utahensis
MGNAVEVSLPSEAGVIVDLAPISTGGSAWLFLDDAGQIGKWDRSTATVRHLATTTVPDESGREPWNGRVVRRRLHASADGAFAAVVNDYGRFGEVLDLGAGGVTLTLDGGGYEEGTVPFSLVFAEHDGATVVVHRTNWNRLDVSHAGTGALVTARSSTSTDSHMESEHGLDYFHGALYLSPDGRRILDDGWVWHPVGFPVVWRMDQWLSVNPWESEDGQSRMGLCGREYYWDHPMVWIDETRVAVEGIGDDADDIRPGARLFDTTRSSQGGLWREETAVETACIPGPSGRFFSDGVHLFSSGDDELAAWDLATAALVGVVRRFAPTHYNRHTGEFLQLSDENSVLVWAHPKTAS

SEQ ID NO: 13216 - protein, 115 aa, Actinoplanes utahensis
MTTARPDGFNELLHFPVRLSLVSLLAPAAHADFSYLREATGLSDSALSKQLTTLQDAGYVEVRRTGRRATARLTDSGRHALTDHARALRTLLGAALDPTTAGPTTAGPAIPGPAT

SEQ ID NO: 13217 - protein, 147 aa, Actinoplanes utahensis
MDATEAAKALAEIDQRGRQTLRQGSPRRVPAWFAYGSAAALALACAGNDMTGWVRTAMLLTGAATLIILAAAMDRVTGVRLRMRAVRRAPWALFAAAVLATVIGVGTVLRLLDVPADGTLSGLAGALVWITAIGPTQAAAGAPRNPA

SEQ ID NO: 13218 - protein, 203 aa, Actinoplanes utahensis
MNICMLTSVGHREDLLEGAKACLYAKGYLRTTTRDIVAASGTNLGSIGYHFGSKEVLLNLALIEALGEWGTELAAALAAQPDPEAGPVERFQLTWTRVVSLFGRHGGLLAANFEVFAHAQNNADVREMLLSGLNEGREGLGRMFYRGDDDDTRRAIGTFCHALMTGVMAQWLIDPASSATGADLAVAMRALVAELTGATAGGA

SEQ ID NO: 13219 - protein, 527 aa, Actinoplanes utahensis
MTQIKRQAGRREWIALAVLSIPPLLVSMDITVLYFAIPQITNDLRPTTTQQLWMIDIYGFLLAGMLIALGDLADRLGRRTLLLLGLAVFGLASLGASFANSPETLIVARAVQGIGAAALMPAGLALLRNLFEDDGQRRTAITIWSIGVASGAGIGPVISGVLLHNFWWGSVFLVNVPIIAVALILTAVLVPNFKVAPGSMGRFDFFGALLSLVAVLAIIWGVKEGAINGFHAKPLTALIGGLVAAALFLYRQTHLTHPMIDPKLFRTKGFTPVLVLSLTGFFCVIGFGVFSTQWLMEVKGLGPLQAGLWMMASPLLAGGIVPVATGMVNKVRPAYLITGGFVLATIGYVIMSQVKADSPILLVVSGTVCIGIGTASIFALLTDMVIAVAPVDQTAAVSALSKTMQELGGALGIAIFGTVGASVYRHYFDAHLPSGLPADVVAGARQTMGAASGIAASLPDQVAKPLLEVARIGFSNSLATTAVVGIAVAAGSALLTVTRLRHVRYTTEEVAAKATAEPAEAEIAPVA

SEQ ID NO: 13220 - protein, 935 aa, Actinoplanes utahensis
MEFIEIGNALERLLAILAVVAHGLGRLVLVSGGLGSGKSTLLHRFWREAGQGDAVFLSASGSVAESGLQFGVVEQLFVSGDLPGDLADRVLLRVGEAAGQSEEAPDPEALTEIARESCAALLALSRERTVVVLVDDLQFVDQASREVLLFLARRLRSAPVLFVFSEWLWPQPTLPGYRAELSRLPHRQMCLSALTERTVTRMVERELPAAAAAAVAPAIYRQSAGNPLLVAALLDEYRARPGSLADGLASGRAFGQAVVASLRRWGPWLLDVVQALVVLGDRATAADVSRLCGVRVGKVQQVLEIMTSAGLVEDGRLRHVAASDAVLDSMPPDRLARLNGQAAEVLLQAGDTGMRLAEHLVAAGAAETSWAVTALLDGAERALAADRVEFAMQCLELALRGSREPERKAVIGASIVRAAWRIQPSLGAPYREHLRTAALTGGLSDTDVFVALRQALWQGDLENATATYQALTGPGRHSDPQVAARARLAYQWVHGPGQTLVAEADQPDPRTGDDLWSQAAHTLGKVWGERVRKSITISAEHVLRSSPLGDTTIEAIGTALLALTLSNRAEEAAVWCDRLIDEARRRGARTWQAVLSSLRARIALHRGELGTAVRLAEDSLRLMQPSDWGICVGLPLGTLAMAQTALGRHEEAEATLHRPVPDAMFGTRHGLWYLRARGHHHLACDRLLAALTDFQDCGRLARNWGMDVPALLPWRSDLAEAYLRLGEPGTARPLVEAQLERAGTADVATRGMSLRILAACGEADWRESLLREAVEALEKTGDRRELSRALVDLSQVYYDSGDLGQARNLARRAEQEAKACEIPLRAAHRDVACHAGAVRGAEPVVPTAAAGDEQVPVSGAVLSGAEIRVARLAGLGHTNREISKKLFLTVSTVEQHLTRVYRKLGITSRAELPAGLAARGQELGVAEPSELYTAG

SEQ ID NO: 13221 - protein, 143 aa, Actinoplanes utahensis
MVAFSESAVIDGDAAAMWRVLTDLPALPQWDPHMEGIGFDGPFQVGAEGWTKPKGAPKGRFTVTAIEPERSYSTRSPMPMGSMSVTNTLEPVAGGGVKITRQIEVRGGFSPMFKWFFMKPMRRDLLATFQALGAEAGRRSTAG

SEQ ID NO: 13222 - protein, 475 aa, Actinoplanes utahensis
MTKAVVLGGGMAGMLAASVLAERVDRVTIVESDTFPGGPQARRGLPQGHHFHMFMGGGVDALDELLPGMSDALYLAGAHRRRFGDEFLGVSGNGWGRPYDGRAYVLACSRPLLDHMVRTRVLADDRIEVLPATKAIGLLGDRTRVTGVRVESSDRSRAGAGGLGIAADLVIDATGRTSHAPEWLTELGAPRVHMDTQDAGFAYAGRTYEAPTGAGVDFPAILVQADAGTGRPGRGGGILPNEDGRWIVAMIGTRGGHPPTDEAGYLEYARGLADPLIGELLAAARPVTEIRAYRGLVNQRRYYDRLPVPEGFLVVGDAAMTLNPNYATGMSMAAFGALELRDELGRHGLTGDLTRRVQTAIGKAGSVSWLAATTNDSWFPGSEANFKLRGAKAQKGFVQRWNRVAAENADVARATYEVATFLAPRKAMMTLPLMLTVMRGPRLPQLTLDEAIRSYPNFADPLAKLDLGVGVPGAR

SEQ ID NO: 13223 - protein, 1586 aa, Actinoplanes utahensis
MGDEEKLLTYLRKATAELRDARQRITELESAGTADDPVAIVAMACRYPGGVTSPEDLADLVLDGRDAVAGFPDDRGWNVEGVYHPEPGEPGRTYTRQGAFLHDAAWFDAGFFGIGPNEALLMDPQQRLLLEISWEAFERAGIDPRSVRGSATGVFTGMMYHDYPEAHSTGSVASGRVSYVFGLEGPCVTVDTACSSSLVAVHQAVQSLRTGECRLALAGGVAVMATMDTFIEFSKQRALSADGRCKPFAAAADGTGWGEGAGVLLLERLSDARRNGHPVLAVIRGVATNQDGASSGLTAPNGPSQQRLIAAALADAGLTAADVDAVEGHGTGTVLGDPIEAQALLATYGADRPADRPLWLGSLKSNIGHTQSAAAVGGIIKMVMAMRRGVLPRTLHVDAPSPKVDWSAGRVELLTEARPWPAGERRRRAGVSSFGVSGTNAHVILEDVADEPAPDDTAPAPGIVAWPLSAASADGLRGQAARLAERLPDATPAAIGHALATGRAALSHRAVVVGADLPELLSGLAEVAAGEHEAGVSHDRPAVVFTFPGQGAQWDGMAVELIETAPAFAAALERCADALAEFVDWNLLDVLRGVPGAPTFDRVDVVQPVLWAVMVSLAELWREHGVEPAAVLGHSQGEIAAACVAGALSLADGARVVALRSRVIATGLAGKGGMLSVPLSRAVAEQRIERFAGRLGLAAVNGPGSVVVCGEPTALDDLVAELTEAGLQPKRIKVDYASHSHYVAEIEAEVRAALAPVRPRPASVPFYSAVTGGLLADTTVLDAGYWYRNLRQTVQFEDATRALLDDGHALFVECSAHPVLQVGLQDTIADAGAPAGTVESLRRQDGGLRRFAGSLAAAWARGATVDWARFSPAARPADLPTYAFQRERYWMAPVAGADPVSLGQQPLRHPLLGAAVPLPGTDGLVATGRVSLTSHAWLADHDALGAVLLPGTAFVELAINAGAQVGCGVLAELTVQAPLVLPDRGPVALQVLVGGPDEDGARPVAVHARAEGGDAPWVCHAAGLLTPDDGGPAPGHPDDSWPPAGAVAVDVTGAYDGLLGRGYAYGPVFQGLRALWRRGDEVYAEVALPEPAHADAALFGLHPAALDAALHAALLTSDPDGTVLPFAWTGVRLHATGATELRVRLAPAGTGSSIHLTDPAGRPVLSADGLVSRPVSAEQLAAPGAPRDVPYRLDWMPMPAAGTAPPVRWREVGGLDELTGDDDLPDVVLLRAPAADPADLPAALRETGAATLATLRRWLSEPALDGRRLALLVEPDTLLGDTVRGMLRAAQAEHPDTFLVLDHDGRPESLAALPDALAAGEPEVSIRSGRPHLPRLVAAGPPDAAARPDPAGTVLVTGGTGGLGALVARQLTTDCGVRHLLLTSRRGPAAPGAEELVAELTERGVQVTVAACDAGDRAALAAVLAAVPAEHPLTGVVHAAGVLDDGLIAAQTPERLDAVLRAKADGAWHLHELTADADLAMFVLFSSVAATLGGPGQTTYAAANGFLDALAAHRRAAGLPATAMAWGLWTGAGMGDRLREADVRRMAADGLPPLPVADGLTLFAAALRTDAGHQALLRLDPVVLPS

SEQ ID NO: 13224 - protein, 540 aa, Actinoplanes utahensis
MRRRAAAVLGFTDPAGVDPGRAFRELGFDSLASLQLRNALNALTGLRLPATLVFDHPSCAAVAGHLDELLMGAATADDRAGDRVATADGEPIAIVGIGCRFPGGARGPAGLWRIVDEGADVIAGLPADRGWDLDNGYHPEPGTPGRHYARGGGYLHDAAEFDAEFFGISPAEALTMDPQQRLLLEVSWEALEHAGIDPATLAGTDTGVFAGLMYHDYPLNTATGSIASGRLAYTYGFEGPAVTVDTACSSSLVAVHLAVQALRRGECGLALAGGATVMSTTETLVDFSMQAGLSPDGRCRSFAAGADGTGFAEGAGLLVLERLADARRHGHPVLALISGTAINQDGASNGLTAPNGLAQQRVIRAALADARLTAADVDVVEAHGTGTVLGDPIEANALLATYGRDRPADRPVRLGSIKSNIGHAQAAAGVAGVIKMVEALRHDTLPRTLHAVQPSPHVDWDAGAMRLLTEPAAWPGGDRPRRAAVSSFGISGTNAHLILTEPPAAAPAEAPVAAGAPVVPWLLSARSPQALREHAAGLAS

SEQ ID NO: 13225 - protein, 331 aa, Actinoplanes utahensis
MDPMLDDLRDVAAGLEAAAPRIPLLSTLTGRWATAEDITTAGYWARQVREPVRFHDAVVALAATGARVALELGPDAVLAGLGPHCVPDSDLDFLPTLRRDRDEERALVTAVTAAHARGVPMDRAALLAGTGGVPVDLPTYPFQRRTYWLTAGDSSGIAALAGAVDSGDDAFDAGLPAMIAGQSPAQRHLTLVDMVRVHAAAVLGHPDVAAVPIDRPLQELGFDSMAAVSLRRRLTAATGLTLPSTLAFDHPTCEAAARFLATRLAEEREPDEALATVVRLETLLADTTPTAEVTARLEALLRTWNDRAATGGDGLSDEELFARLDREYGGV

SEQ ID NO: 13226 - protein, 463 aa, Actinoplanes utahensis
MGQDETMSDDRLRGYLRRAVADLDDAKRRLREAEQSRHEPIAIVSAACRFPGGADTSERLWDLLAAGTDAISDFPMDRGWDLAALYDPEPGTPGRTYVRTGGFLHDAADFDADFFRMSPREARETDPQQRLLLETAWEAVERAGIAPTALRGTPTGVFAGVVYHDYSTDGGPGGLASVASGRIAYLMDLTGPVVTVDTACSSSLVALHWAVRALRSGECSLALVGGATVMAGPASFVGFSQDRGLSPDGRCRSFAAAADGTAWGEGAGMLLLERLGDARRNGHPVLAVVRGSAVNSDGASNGLTAPNGPAQQRLIRAALADARLRADQVDAVEAHGTGTTLGDPIEAEALLATYGRQRRDGRPLWLGSVKSNIGHTQAAAGVGGIIKLLEALRHETLPPTLHVDEPSGHVDWTTGDVRLLTEAVAWPAGDTPRRAAVSAFGLSGTNAHVILEEAPAEPAALAS

SEQ ID NO: 13227 - protein, 792 aa, Actinoplanes utahensis
MDPILDEFSTTIASLEYAVPAIPIVSTLTGRPATGDDLRSADYWTRQLRQPVRYADAVRALHDTGVTIAVEIGPDGVLSAMGPGCLDPEAAVTFVPLLKAGRPEPDELVGGLATAHDHGAAVDWPAFFAGTGAARTDLPTYRFQRSPYWRDTPAVTADPLAPLHYRVEWAPVDIGPGALTGRWLVLHGWADRRVTTVLDALAAHGAEVVAIPVSGLDRPAIAALLAAAPAALPAPVGVLSLLALDTTAHRDHPEISRGLADTVTLAQVLGDAGVTAPLWCLTQHAVAAGDRHDVDAGQSAVWGLGAGLALERPDTWGGLIDLPPVLGPATAGRLAAVLSGATGEDQVALRPDGAYARRLTRPSPGTTGDSWQPRGTVLVTGGTGALGGHVARWLATAGADRIVLVSRRGEAADGATELAAEITALGAEPVIVAGDVADRDALAAVLDRFPVDAVVHAAGTAQPMAPLEELTLAGFAATAGAKTTGAVHLDALLADTPLDAFILFSSGSAVWGSAAQAAYGSANAHLDGIAAARRARGGAAVSIGWGSWDAGMVDAPIAAAMRRIGAPAMNPALAVRALGRVGAGADPQPVIADIQWDRFSPAYTLARPRPLLHDLPEAAVAPSAPTAAVDTLAALSAADRADAIDRLVRTAVAGLLGYADPDAVDTDRPFTDLGFDSVSAVGLRTRLNERTGRNLPSTLVFDHVTPGALTDHLIGLYAADGAPPSAMDHLARLEQAVDAAAPDDPDRRPLAARLRALLGRLDGAADADDVNQRLDGATADDVLAFIDAEFGS

SEQ ID NO: 13228 - protein, 685 aa, Actinoplanes utahensis
MATDDKVLEYLKRVTADLHQTRRQLQEREEADAEPIAIIGMACRYPGGADTPEQLWGLVAGGTDAIAAFPGDRGWDLGPDSAGFARVGGFLDGAGDFDPAFFGMSPREALVTDPQQRLVLETAWEAFERAGIAPATVRGQAVGVYIGSGMQDYGALLDLSPELTEAFLGTAATSAVISGRLSFVLGLEGPSLTVDTACSSSLVALHLAGQALRAGECTLALAGGVMVMATPGPFQAMSRQGGLSSDGRCKSFAAGADGTAWGEGAGVLLVERLSDAQRLGHPILAVVRGSAVNSDGASNGLTAPNGPSQRRVIRKALASARLSSADVDVVEAHGTGTVLGDPIEAQALLETYGQDRERPLLLGSIKSNIGHTQAAAGVAGVIKMVMAMRHGVAPRSLHLDEPTPHVDWSTGNIRLLSEPQEWVADGRPRRAGVSSFGISGTNAHVIIEQAETVAPPGDDQGPVVLPLSARTPDALADLAERLRGVAGDLRPVDVGYSVATGRQVFEQRAAVVAGSRTELTDRLSTVTASTARAGDLGVVFTGQGSQRLGMGRELHARFAVFAAAFDEVLAGFTADVRKVVWGDDAEALNRTGSAQPALFAFEVALFRLFESWGIRPTVLGGHSIGELAAAYVAGVWSLEDACRLVEARGRLMQALPAGGAMVALPVSADQLVLTPGVGIAALLAS

SEQ ID NO: 13229 - protein, 870 aa, Actinoplanes utahensis
MELPTYPFQRDRYWLDAEFRAADVASAGIDSTDHPLLGAVVTLADPDTVVLTGRLSLPTHRWVADHVIAGAVLFPGTGFVELAVQAGDQVGHDVVQDLSLIAPLVLTETDRFQIRVVVGAPEAGRRPLSIYSRPEGASTEPWLLHATGQLAAASATTSPGASLSGTWPPAGAEPIEVGEVYRELAEGGYTYGPAFRNLRAAWTSGSDVYAEIAPENLGTDRFLLHPALLDAALHAVSHTGVLGDSAVVPFSFTGVTLRASGAAALRVRLSHTGPRTLSITIADSAGSPVATVDSLVMRPISEAVGSAAEPVHQLVWQPIDNAGAAAPTAGTGHAAGGAAQAISAAANVTGQALSAAATATGQALSAAVTATAQALSVAAQAISAAAHGTGRAAGPAAPAATASAHATSGAVYATGPDGAQVEVVEAGAFDPGPGAAVPLRVRAVLAGVLRKLQEGTAVVVVTRYAVAVADGDVVDVVQAPVWGLVRSAQAENLGRIVLVDTDGGDIAGALASGEPEAAVRGARVFAPRLVRAAPGEGVSFSGRVLVTGGTGGLGAIIARHLTENHEISDLLLVSRRGLEAPGARELRADLERLGATVHVVACDVSDREAVAALLAAFPVDGVVHTAGVLDDGVLDAMTPERLDRVLAPKADAAWHLHELAGDLTAFVLYSSASGVLGNPGQANYAAANNFLDGLAQFRRARGLPAVSLAWGLWGSTGGMGGELSAADATRLNANGIRPITPERGVALFDAALAAGTPVAVPVSLDLGVIRRRLDFVPALLRTLVPSTRRRRPATAQSSLRRTLAALPEQEWPAAVLQVVRGQVASALGYATPAGVEIGRAFSDLGFDSLSAVEFRNALAAVVGIKLSLAS

SEQ ID NO: 13230 - protein, 245 aa, Actinoplanes utahensis
MLLGSIKSNIGHTQAAAGVAGVIKMVMAMRHGVAPRTLHLDEPSPHVDWTAGNIQLLSEAQEWVVDGRPRRAGISSFGISGTNAHVIIEQAEESPVTPGADDDGPVVVPLSARTPEALADLADRLGEVAASLRPVDLGFSVATSRAVFEQRAAVVATSRASLGEALRTATASTARPGDLGVVFTGQGSQRLGMGRELHARFPVFAAAFDEVLAGFTADVRKVVWGDDAEALNRTGFAQPALFLAS

SEQ ID NO: 13231 - protein, 779 aa, Actinoplanes utahensis
MDSLDYWREAWSGAAAGLGSGDVSSAGLTAPDHPLLGAVVTLPSTGGVVLTGRLAVSAQPWLADHVVGGTILFPGTGFVELAVRAGDEVDCPFVEELTLIAPLALAGPDAAAQLRVTVMPTGEAGRHRVEVHSRAEHGAAEWRLHAEAVLADRAPAAGFDLFQWPPAGAEPLDVTGLYPALAEAGLPYGAAFRGLRAAWRQGADVLAEVAVEGAESGRYGLHPAVLDACLHAIALTEGSGETASLPFAWSGVTLHAAGAAAVRVRVTPTAPGEGVRLQVADATGSPVATVDSLTLRPVDAAAMRTTGVDGLLRLAWQPVVSGTAVPDDVVVLEAARFDPGPGVAVPVRVRAVLAGVLAKVREGDPLAVVTRHAVAVADGDVVDVVQAPVWGLVRSAQAENPGRFVLVDTDGGDVAGALAGGAAEVAVRGGEVFAPRLVRSGVGGDGSVFSGRVLVTGGTGGLGAVVARHLVDHHGITDLVLVSRRGVDAPGAAELRADLELLGATVNVVACDVSDRDAVAALLDEFPVDGIVHTAGVLDDGVLGSMTPERLDRVLAPKADAAWYLHELAGELSAFVVFSSAAGVFGNPGQANYAAANNFLDGLAQLRRAQGLPALSLAWGLWGSADSGMGGDLSAADLGRMRRSGVVPLTEAKGLALFDAAVSTPAPVLVPLGLDLSGADPLAVPELMQGLLRRRPSRTAVSAGASVWRSRLADLDEPGRLALMSDLVCAQAASVLGFASADAVDAGRAFSDLGFDSLSAVEFRNTLAAAVGIKLSLAS

SEQ ID NO: 13232 - protein, 1407 aa, Actinoplanes utahensis
METYGQDRPDDRPLLLGSIKSNIGHTQAAAGVAGVIKMVMAMRHGVAPRTLHLDEPSPHVDWTAGNIQLLTEAQEWAVDGRPRRAGVSSFGISGTNAHVIIEQAEEPPVTPGTDDESPIVVPLSARTPDALAALAGRFADLLEADPAIRPLDLAFSVGTKRAAFEQRTALSGADRAGLVARARRAAGGAPTPTPIRKGPVGVVFTGQGSQRLGMGRELYTAFPVFAAALDEVLAGFTAEVREVMWGDDPAPLHETGFAQPALFAFEVALFRLFESWGVRPGVVGGHSIGELAAAYVAGVWSLEDACRLVEARGRLMQALPAGGAMVALPVSADRVALTAGVGIAALNGPASTVISGVEAEVLAIAEQFPNARRLKVSHAFHSPLMEPMLAEFAAVAAGLTYAKPAYPVLAAGDVTDPAFWVAHVRDAVRFTDTVAGLVERGVGTVLEIGPDATLTTLIGYNTDELATIAAQQRDTGELLATATAAGRLFETGAAIDWTAFYAGRDARAVELPTYPFQRQRFWLDALDYWKEAWSGAAAGLGSGDVSSAGLTAPDHPLLGAVVVLPDDEGVVLTGRLAVSAQPWLADHVVGGTILFPGTGFVELAVRAGDEVGCPTVEELTLVAPLALTGPDAGAQLRVVVSPADASGRRRVRVHSRPEHSAGEWQLHAEATLTEETAPAGFDLLQWPPTGAEPVDLTGGYPALAEAGYGYGPAFQGLRAAWRRGDEIFAEVATDEADADRYTLHPALLDAALHAVLLTHADGDGDGRIVLPFAWSGVQAFADGGPATIRVRISPAGTGDDLTIRVADRAGRPMLTVAALTSRPVDPAAMRAADVDGLLRLSWQAVAPGTAVAEDIVVLEAARFDPGPGVAVPVRVRAVLDAVLARLQEGEPSVVVTRHAVAVADGDVVDVVQAPVWGLVRSAQAENPGRFVLVDTDGGDVAAALAGGEAEVAIRGSELFAPRLVRSTVTAGGPAFAGRVLVTGGTGGLGAVVARHLVDQHGIVDLLLVSRRGPDAPGAAELRTDLERLGATVNVVACDVSDRDAVAGLLEEFPVDGVVHTAGVLDDGVLASMTPERLDRVLAPKADAAWHLHELAGELSAFVVFSSAAGVFGNPGQANYAAANNFLDGLAQLRRAQGLPAVSMAWGLWGSTGGGMGGELSPADVARMRRGGVVPLTGAKGLALFDAAVSTPAPVLVPLGLDLDGADPQLVPPLLQGLLRRRPARSAGAAGTPDGAEWRARLAGLDRPDRLALLLTLVRGQAATVLGFASADAVDAGRAFSDLGFDSLSAVEFRNALTAAAGIRLSPTLIFDYPTPAALAEHLLSHFADGPETDGGEAEVRQVLRDIPLSRLRDAGLLDALLELGGVRVAAAESPEPAETLSIDEMDTESLISRALEDFDFGDTTQGA

SEQ ID NO: 13233 - protein, 683 aa, Actinoplanes utahensis
MPSSEEKLVEALRASLKEADRLRGQNRKLTAASQEPIAIVGMACRYPGGVVSPEGLWDLVADGVDGVSEFPTGRGWGTDIFDPVPGAAGKSYVREGGFLHDADLFDPGFFGISPNEALVMDPQQRLLLEVSWEVFERAGIDPVSLRGSDTGVFVGMMYHDYAANSSTGAVASGRLSYVLGLEGPSMTVDTACSSSLVSLHLAAQALRAGECSLAVVGGVAVMATPEVFVEFSRQRGLSPDGRCKSFAAGADGTAWGEGAGVLLVERLSDAKRLGHRILAVVRGSAVNQDGASNGLTAPNGPSQRRVIRKALASARLSSADVDVVEAHGTGTVLGDPIEAQALLETYGQDRERPLLLGSIKSNIGHTQAAAGVASVIKMVMAMRHGVAPRTLHLDEPSPHVDWTAGNIQLLTEAEEWVVDGRPRRAGISSFGISGTNAHVIIEQAEEPPAASGTDDESPIVVPLSARTPEALADLADRLSRAAADLRPVDVGFTVATGRSVFEQRAAVVAGTGAELTAALSTVTASTARAGDLGVVFTGQGSQRLGMGRELHARFPVFAAAFDEVLAGFTADVRKIVWGDDAEALNRTGSAQPALFAFEVALFRLFESWGIRPTVLGGHSIGELAAAYVAGVWSLEDACRLVEARGRLMQALPAGGAMVAVPVSADQLVLTPGVGIAALNGPAS

SEQ ID NO: 13234 - protein, 926 aa, Actinoplanes utahensis
MRSTGLVASGHPMVGAVVTAPDGPRVVLSGRLSLAAQPWLADHAVGGTVLVPGTGLLELALTAGRQVDLPVVDELTLMAPLLIPPADGVVVQVVVDDPDAAGRRAVAVYSRVEDAADDQPWTLHAQGTVSDELGGDRWDALQWPPAGAEPVDLTGGYPALAEAGYGYGPAFQGLRAAWRRGDDIFAEVATDEADADRYTLHPALLDAALHAVLLTRDGDGDGRIVLPFAWSEVSVHAGTGPSSIRVRISPAGTGDDLTIRVADQAGRAILTVAALTSRPVDPAAMRATDMDGLLHLAWDRIEAGTAAPGDHEVVMAAAFDPGTGTPVPERVRAVLAGVLAKLQEGTSLAVVTRNAVAVADGDPVDVVQAPVWGLVRSAQAENPGRFVLVDTDGGDVAGALAGGAAEVAIRGNELFAPRLVRASVADSPVFTGRVLVTGGTGGLGAVVARHLITGYAVRDLVLVSRRGVDAPGAAELRADLELLGAAVNVVACDVSDRDAVAALLGEFPVDGIVHTAGVLDDGVLGSMTPERLDRVLAPKADAAWYLHELAGELSAFVVFSSAAGVFGNPGQANYAAANNFLDGLAQLRRALGLPAVSMAWGLWGSTGGGMGGELSPADVARMRRGGVVPLTGDKGLALFDAAAAAPVVIPMGLDLTGADPLLVPPLLQGLLRRRPSRTAVSAGASVWRSRLADLDEPGRLALMSDLVRAQAASVLGFASADAVDAGRAFSDLGFDSLSAVEFRNALAAVVGIKLSPTLIFDYPTPAVLAEFLLAELTGAGEDVITSTVVADDDPIVIVGMACRYPGGVVSPEGLWNLVADGVDGVTEFPTGRGWGSDVFDPNPGTPGKSYVREGGFLHDADLFDPGFFGISPNEALIMDPQQRLLLEVSWEVFERAGIDPVSLRGSDTGVFVGMMYHDYAANSSTG

SEQ ID NO: 13235 - protein, 424 aa, Actinoplanes utahensis
MSYVLGLEGPSMTVDTACSSSLVSLHLAAQALRAGECSLAVVGGVAVMATPEVFVEFSRQGGLSRDGRCKSFAAGADGTAWGEGAGVLLVERLSDAKRLGHQILAVVRGSAVNQDGASNGLTAPNGPSQRRVIRRALASAGLSTADVDVVEAHGTGTVLGDPIEAQALLETYGQDRERPLLLGSIKSNIGHTQAAAGVAGVIKMVMAMRHGVAPRTLHLDEPSPHVDWTAGNIQLLTEAQEWVVDGRPRRAGISSFGISGTNAHVIIEHVDEPSVTPGADDDGPVVVPLSARTPEALADLADRLGEVAASLRPVDLGFSVATSRTVFEQRAAVVATSREGLRAGLQAVTASVPRSGSLGVVFTGQGSQRLGMGRELHARFPVFAAAFDEVLAGFTVDIRQVVWGGDAATLSQTGFAQPALFLAS

SEQ ID NO: 13236 - protein, 2349 aa, Actinoplanes utahensis
MTDYLAESWLAEEIGGLRSTGMTASGHPMIGAVLSAADSTRVVLTGRLSLNSLPWLADHAVGGTVLVPGTGLLELALTAGRHVDCPVVDELTLMAPLLIPPADGVVVQVVVDDPDAAGRRAVSIYSQDGDRPWVRHAQGTLSADAGAERWDVLQWPPAGAEPVDLTGGYPALADLGYGYGPVFQGLRAAWRQGDEIFAEVAFDEVDADRYTLHPALLDASLHAVLLTHDGSAGDGRIVLPFAWSTVSAFGDPGTGPKAIRVRISPVGDSGDITVRVADQTGRAVLTVSALTSRPVDPAAMRAADSAHLLEVAWQPVEAGTAAAEDVVVLEAAAFDPGPGIPVPVRVRAVLDAVLARLQEGAALAVVTRHAVAVADGDVVDVVQSPVWGLVRAAQAENPGRIVLIDSDGGDVSGALGAGEPEVAVRGGVLSVPRLVRSSGGGGGVSFTGRVLVTGGTGGLGAVIARHLVENLDVRELLLVSRRGRDAPGAGDLKADLEGLGATVNVVACDVSDRDEVAALLAAFPVDGVVHAAGVADNGVIGSMTPERFDRVLAPKADAAWHLHELAGDLTAFVMFSSAGGMVLAAGQAPYAAANNFLDGLAHLRHARGLPAVSMAFGLWAVDAGLSAFLQEADFERLRRQGLPPLTEQEGLAAFDAALTAGAALVVPLKVDPAVPARGDDTPALLRSLMKPASSRARRAGGSQVLLRQLAGLGAADRAAALLDLVRNQVAAVLGHSSPAVVEPDRAFQELGFDSLSAVELRNVLNEVTGLRLPATLVFDYPSATAVAGYLDTQLTGAGADAAPPVTTTRRADDEPIAIVAMACRYPGDVTTPEELWRLVHDGIDTVSDFPDNRGWDTARIYDPEPGKFGRTYSKEGAFLHDAAMFDPAFFGISPNEAIAMDPQQRLLLELAWEAAERAGIDPVTLRGSSTGVFAGLMYHDYGQGSDRASSSGGSLVSGRIAYTLGLEGPAVTVDTACSSSLVALHWAVQALRSGECSLALAGGVTVMSTPAMFVDFSRQRGLSPAGRCKSFAAGADGTGWGEGAGLLLVERLSDARRLGHPVLAVVKATALNQDGASNGFSAPNGPSQQRLIRQALSVAGLGTADVDVVEGHGTGTVLGDPIEAQALLETYGRDRPDDRPLLLGSIKSNIGHTQAAAGVAGVIKMVMAMRHGVVPRTLHVDQPSPHVDWTTGNIRLATETRDWPAVDRPRRAAVSSFGISGTNAHVIVEHAEDPAPRREPVTVQGSALVWPLSARTPEALTALAGRLVRLLEADPGLRAVDVGYSLGGRPVFEHRAAITGGYRSELLSRARKVTPVAARPGAVGVVFTGQGSQRPGMGRELYAAFPVFAAAFDEVLAGFTVDIRQVVWGGDAATLSQTGFAQPALFAFEVALFRLFESWGIRPTVLGGHSVGELAAAYVAGVWSLDDACRLVEARGRLMQALPAGGAMVAVPVSADQLVLTPGVGIAALNGPTSTVISGVEAEVLAIAEQFPNARRLKVSHAFHSPLMEPMLAEFAEIAGGVTYNNPRFPILTSGDVTDPAFWVAHVRDAVRFTDTVAGLVERGVGTVLEIGPDSTLSTLIGLNTAALTTVPGQQRDADEADAAVAAVARLFETGTRVDWTAFYAGRGALRTELPTYPFQRDEYWPGEQLLLTPDATSIGVDTMEHPLLGAAVPLADSDSFLLTGRIARQSQRWLTDHQVFDSVLLPGTGFVEIAVQAGEQAGCDLVEELTLIAPLVMPDSGAVLQARVSAPDETGRRTVTVHSRAQDAAPDSRWTLHAEGVLGHGDGALPDDVAVWPPAGATPIDLDGGYDLLADRGYGYGPAFQGLRAAWQLGDDLYAEVELPEPVRAEAAFYGLHPALLDATMHVLNFAGGEGAPEGQAMIPFSWSGVTLHATGSTAVRVALIRQDPASLTMRISDPAGAPVATVAGLNLRPVAVEQLRPGGRADALYRLDWVGRKAAGGTLPAYADIRLEPTVGDVPAAVRRNTALVLDRVQAFLADESRAGTVLAVVTRHAFAVADGDPVDIAHTPVWGLVRSAQAENPGRIVLVDSDGGDVSAALASGEPEIAVRGGELSVPRLVRSSGGGGGVSFTGRVLVTGGTGGLGAVIARHLVEKHEISDLVLVSRRGLDAPEALPLRADLQRLGATVNVVACDVSERDEVAALLAAFPVDGVVHAAGVADNGVIGSMTPERFDRVLAPKADAAWHLHELAGDLTAFVMFSSAGGMVLAAGQAPYAAANNFLDGLAHLRHARGLPAVSMAFGLWAVDTGLSAYLQDSDLERLRRQGLPPLTEQEALAAFDAGLTEGHPLVAPLRVDQAALRSRVGDLPPLLRGLVPVTRRRAATGAAS

SEQ ID NO: 13237 - protein, 358 aa, Actinoplanes utahensis
MLGFAATLLGHADPAALDPERDFLEAGFDSLTAMDLRNHLNAATGLDLPPMVIFDNKSPARLAAWLRAELAVDTTAAETGGDTLSALFRSGLEAGAVGEAYDLLRSVVRLRPRFRTVDEVGDLAPAVTLRESDSELPRLICLSTPMATGGMHQHSRVVAHLGSPRHVVAIPTPGFVAGERLPASVDVAVQALAEQVLRAADGHPFLLLGYSSGGSLAYAVAGYLEERGIEPAGVVMLDSFRVEDEAAGATMPIRELTLRLYDQESLFGRFDSARLSAMACWFDLVPQLPVRPVRAQTLFVRCTQSFLELEEGQRDWEAEPLGPGQTLVPLAANHFSIIAERSDATAEVIDRWLTAHAL

SEQ ID NO: 13238 - protein, 495 aa, Actinoplanes utahensis
MAHRARPLTAPLPSQKGRPVATSVDQIVDALRKQMRENETLRQQNGSLNAALAAAAEPIAIVSMACRYPGAVTSPDELWKLVADGTDAVSAFPSDRGWPTDVYDPQEGRPGRSVAREGGFLPRATDFDADFFGISPREALTMDPQQRILLECAWEAIENAGVDPRSLRGTPTGVWAGVMYHDYGFGTSDGSIVSGRVAYCLGLEGPAVTVDTACSSSLVALHSAVQALRAGDCTLALAGGVTVMANPDMFVYFSTQRGLARDGRCKSFSARADGTGCSEGAGLLLLERLSDARRNGHPVLAVVRGSAVNSDGASSGLTTPNGRSQQRVIRRAVADAGLTLADIDAVEAHGTGTRLGDPIEAQALLATYGRERAPGGAPLLLGSLKSNLGHTQAAAGVGGIIKMVQALRHEELPISRYADDPTPHVDWTAGAVELLTANRPWPRGERVRRAGVSSFGLSGTNAHVILEEAPDAPAPAPAPASGHWPLALSGTTPAS

SEQ ID NO: 13239 - protein, 807 aa, Actinoplanes utahensis
MVLATDRAQAVTALDAVAAGEPHPDVLTGTVPAGAPPRAGFLFTGQGSQRHGMGRELYDAFPGFATAYDAVLAELDPHLGRPLRDIGPDLLDTTEYAQPALFAFEVALARLVESCGVRPAVLGGHSIGEISAAHLAGVLPLADACRLVAARGRLIQQLPSGGAMVAVAASEDEVTPLLTADTGIAAVNGPAAVVVSGDAGTVLGIAARFPRTTRLRTSHAFHSPLMDPALPAFQQIATTMSYAVPDTRIVSMTTGRRAEAGVIDTPGHWVRHVREPVRFLDGVRAMAAEGAALLLELGPDAVLSPLAETALPDLVACPASRRDQPEVRTLLAALATAYVTGITVDWAALHAGSDVVRVPLPTYAFQRRRFWSEAQVWPAPEPAALGLAAAAHPLLSALLRLPDGGAVLTGRLTAAAHPWIADHAVHATVLLPGTALVELAVSAGTRLGSPALDELVLAAPLTLSGAEARDLTVTVGPPGPDERRPIRIHSRPAGAEHAPWQLHADGSLGAAHPRIPAADLATWPPVGAEPIDVADAYPRMARRGYDYGPAFQGLRAAWRRGADTFAEVRLPATDDGYGLHPALLDAAMHADILADDGPALLPFSWNRVAVHATGAGTLRVRIRHDDGDAATIALEAADETGQPVLTVGSLVSRPVTALPAGDGHHESLYDIAWRAVTPPAGVTESAEVHVCVTPAGLDVPAAVRAVAGETLHAVQRWLGDAGRRRLVVVTRGAVAVPGDDGVDVCQAPVWGLIRAAQAEHPGRIVLVDADPATSVPDAVGTALAAGEPELALRGPAGYVPRLAPAPS

SEQ ID NO: 13240 - protein, 384 aa, Actinoplanes utahensis
MLVTGGTGGLGALVARHLVARHGVGRLLLVSRRGPAAPGADRLHAELTALGAEVTVAACDVADRAALQRLLAEVPDLTGVVHCAGTAENALLEAVTETQLRDGLRAKADAAWHLHELTADRPLTAFVLFSSAGGLVLASGQAAYAAANVFLDALAVHRRAAGLPGTSVAYGLWDVDTGLSAGLAETHRARMRHLGLPPLAAEDGLALLDAALTADRPLSVPIRVDATALRNRTDEVPALLWTLAGRTRRRVVAAEPAAGPAALVARLAALPAAAQERAVLELVRKDAAAVLGHDRPSGIAAERGFLDLGFDSLTALELRNRLNDATGHRLPPTLIFDFPSPGALAAHLHRKLVAPAAAPIPARADLSTANAEDLFAMLDAELGG

SEQ ID NO: 13241 - protein, 419 aa, Actinoplanes utahensis
MRFGLLYHHQLPRPWADDSEERMLLESLEQIELADKLGFDYVWETEHHFMEEYSHSSAPEVFLAAAAARTSRIRLAHGIVSLPPGVNHPVRVAERLATLDLISGGRVDFGTGQGSTQLELEAFGVSRATKQEQWQEALEVVTRLLTESPFTGHSGAFLDLPPRNVVPKPKQKPHPPLWAACSRPEAVEQAARNGLGALSFAFISPEEAKARVDAYYRVIASEQCVPAGFAVNPQFALVLPFSCHEDEEVALDRGLEGAHFFAYSFMHYYVNGKHRPGQSNVTEDFQRLRGQLGLVRDPGAAFLAAVDDKTREERAALRRCIGTPKQLTETIRAYEEAGVDQIIFQAQIGANRHCDILESLELFAAEVLPEFAERRPAREAAKQERLAAAVQAAVARKPRQSADVSDYVARAERPEMMRR

SEQ ID NO: 13242 - protein, 282 aa, Actinoplanes utahensis
MGRVENKVALITGAARGQGRSHAVRLAEEGADIIALDICEDIDVIDYPMGTAEELEETARLVEKAGRRVFHRRVDVRDRAAVHAAIDDGVAELGRLDVVIPSAGVNQLGADRPLRTFTEIVDVNLSGVLNTVHGAIPHLGAGASIIIIGSAVGLMPGHGESGPMGLGGAAYSMAKQTLVLYTSLFSVQLAPLNIRINAVHPANVNTHMIQNRATYEIFRPDLDEPTAEDAREGFYAFQGMPIPYMEPQDVSHAIVYLASDESRYVTGLQFKIDAGALGKMGR

SEQ ID NO: 13243 - protein, 922 aa, Actinoplanes utahensis
MDFENAYDRMELQSRAPTTAGFPPALPYPGTLTLLQDLLTESSASRGRLAVVSGGQASGKTRLLNEFAETAEEGGALLLRASASRGESALRFGIVEQLFCTTRLPIGVADRIAGLLTAGGEDTTAFRAIFAVMLDLARGGPLVVTVDDVQFADPQSQQLLLYLHRRLGPARILLVVTEWNTPRPGTSAFSAELTRRPHERVLLARPGVAEVAGLITPRLGAGGAALAPLVHRLSGGNALLALALAMDLHNAGVPGGREPGVAFRHAVLECLYRCDAPLRDVAYSLAVLGDYAQADNVSRLLGITTDEVAQAVAVLTEAGLLSDGAFRHPSVPELLLETMPAEQRGAQNLAAASLLDRCGAPPTEIARQLVMGGQPPEPWAVPVLREAADQALAADRVQFAIKCLRLALSAGLTDGQRIRITAMLVRALDRLNPAAAAPHLPELLSALRRGELTGRDTAVVIRNALWNGRLTEVADLMRTANTHALLTEPGIAAELRLNQYILFGQLPESFPAREDAAGNIFARAIDALCTMWRSGPDASVIASAEQVLTNYSLGDTTVSTIAAALSIFTHGNRHDEAATWCERLIADATRRGAASWTAVFSYLRAEVALRRGDLAVARDYAEEALRRLAPEHWGVLVGYPLSVLANALTWLGEHDRAGEVMRTTVTPAPMLSTLCGIRYLQARGRHYLATERVFAAAKDFRQVGTLARERNLDVPSLVPWRTDLAEASAQLNRPAEARDLLHQQFQQRGLDGRARGAALRLLAGLGDPARRVGLLKQSVSALEAACDRYELGRALHDLSQAQRQAGDVERSRQTASRAAQEMKACHASDTGLAPVAAPEPGSPPAGRPRAAAADDRAADMTLSKAEQRVATLAAQGHSNRQIARTLYITMSTVEQHLTRVYRKLNARCREDLALLLAGPRVF

SEQ ID NO: 13244 - protein, 68 aa, Actinoplanes utahensis
MMNDVSRTIDATLIGGPADFPPEFRNQQVAAGAGKVKVAFYGGYEHFENRDSETPEILVWVGRTRVAE

SEQ ID NO: 13245 - protein, 50 aa, Actinoplanes utahensis
MVEASMAQDDSTVTEPALASGVPVPASGVPELLEELLVESVSIDGMCGVY

SEQ ID NO: 13246 - protein, 102 aa, Actinoplanes utahensis
MVCVVSTDPHRRPFDLDLAWELHPRVAVRPEGFGALLYHFGTRELSFLKSPDLLTVVRGLGERDTARAACVAAGLRPDQLPGYAVALASLAGSGMIRRREDT

SEQ ID NO: 13247 - protein, 469 aa, Actinoplanes utahensis
MTTPMPLTGHFERGLAAPICLTWELTYACNLSCVHCLSSSGRRDPGELTTQECRRLIDEFERMQVFYVNIGGGEPTIRPDFWDLVDYATAHRVGVKFSTNGVRINRERAARLAGSDYVDVQISLDGATAEVNDAVRGAGTYATALRAMDNLAEAGFAGFKISVVVTRENVGQLDDFAALAARYDAQLRLTRLRPAGRGADVWPRLHPTADQQRVLYDWLVDHDGEVLTGDSFFHLAAYGKPLSGLNLCGAGRVVCLVDPVGDVYACPFAIHDTFRAGNVRDHGGFAAVWRSSELFAGLRGEQSGGACTSCSAYDACRGGCMAAKFFTGLPLDGPDPECVRGHGATALATAGATPRPSPDHSRPARAARAVPISIGRPGSVPVGIGHSGAAAVPAGIGHSGAAAVPAGIGHSGAAAVPAGIGHSGAAAVPAGIGHSGAAAVPAGIGHSGAAAVPARPCDENPLAGLPAWN

SEQ ID NO: 13248 - protein, 466 aa, Actinoplanes utahensis
MQLPHGYTVALDVRTRVVDGGRALLGGAPGTHLLRLTPKARRLLAGRTLRVTDPASAALAERLLDLAVAHPVVADLPAPADAGVTYVIPVRDRPAPLARLLASIPAGSDVIVVDDASRNPAAIAAVAARYRARLLALPVNRGPAGARNAGLRSVRTPFVAFVDSDIVLDPGTVPTLLRHFADPRTAVAVPRITGLRTARSETWIGRYEESRSSLDLGSRPASVRPGSYVSWVSTACLVARVSATGDGFDEDMRVGEDVDFGWRAVRAGWRVRFEPSVAAAHEHRVRFGDWFVRKAEYGTGAHPLALRHPESVAPAVLPPWGVALGAALLAQRRWSLPVAAAVYAVTAARIARKLDVDGAAGLGMRLTGGGAVTVLQQASALVTRHWWPATAVGCLFSARVRRVAAVAAVTDVVLEYATQGSRGRIRLDPVRYGVARRLDDIAYGAGVWWSAAKGRSATALRPRLRG

SEQ ID NO: 13249 - protein, 280 aa, Actinoplanes utahensis
MLTAVTGSLLAVSDLHVSYQQNREVVERIRPGTGDDWLIVAGDVGERPADIGWALGLLRDRFARVIWAPGNHELWTHPQDPVRLRGDERYQSLVELCRDLDVVTPEDEYPMWTGAGGPVVVAPLFVLYDYSWLAPGATTREESLKLAYDAGVVCTDEMMLFPDPYPDRAAWCAARVAYTEQRLSAIDPALPTVLVSHWPLRREPTDVLWHPEFRQWCGTDRTADWHLRFRAAVAVYGHLHIPRTTRYDGVRFEEVSLGYPREWGRRGDQPQPVRRILGTP

SEQ ID NO: 13250 - protein, 155 aa, Actinoplanes utahensis
MDEIPQRVVLDDPAARTTAENVAADLAAQLQRGGDTLDADVYDAWFAADILWGSPYGATLTGFEGLNAIHHRLMDRSAPVTAPPAPASRFEVVSVLAPAPGVVVAQIRRQALAAGGFSEMALYVLVERAGRWWLAAAQNTPIRPADGALSASPGN

SEQ ID NO: 13251 - protein, 398 aa, Actinoplanes utahensis
MGVTLGTPAHHRRRLPGTPPGGATSRMRIMATIYDVAQRARVSPATVSRVLNGNDSVDPGLADRVRDAVRELNYRPNMVARNLRRSRTTLWAVIISDVENPFFTALVRGVEDVAQRAGYSVVLCNSDEDPAKEARYVTAALEDRMAGVIISSAGSTANVTRLIEAGTPVVAIDRQIGGTRVDSVLVDNEHGAEAATAHLIGNGYRRIACITGPAAVSTAVQRLRGYRRALQTHKIKIDDALVRHADFREDGGYTAMASLLDAGEPPDAVFTANNLMTVGAVECLVDRGVAIPAGLGVIGFDEAPGARLLRPALSTVAQPTYELGRTAATLLAERIADPDRPPSTVTLLTELRIRESSRGQATVQAAPLRVTSTGRGSAPVDVPLKPKLSDAPGAGTPW

SEQ ID NO: 13252 - protein, 141 aa, Actinoplanes utahensis
MPRLPRVLAALVAGTTAFAPVPAPPPLHQGRVFTKADDTRCLTGGAVGALLSVRACDDQTPGQRWYQASTGALYNGLNCIRAEGALVRVAACNGGDPAQDWWFIEEIRSGRYGPCLTDEGDGTVRLQPCTWTLNQKWISSS

SEQ ID NO: 13253 - protein, 525 aa, Actinoplanes utahensis
MRRLLIRSAVLLLGAGLISSVAASPAQALPNNLALTPPMGWNDWNAYGCNVSEALVKQTADKIVSAGLATAGYQYVNIDDCWMQKSRDAAGNLQPDLGKFPDGIAGTAAYVHGKGLKLGIYEDAGTATCAGYPGSLGHEAQDARSFAAWGVDYLKYDNCNNSGSTTTAQYIARYSAMRDALAATGRPIVYSICEWGVNAPWTWAGDVGNLWRTTGDIQANYASMLSIFHQNVGLAAYAGPGRWNDPDMLEVGNGMTATEDRAHFSLWAEMAAPLLAGNNLVTASATTLSILGNRSVIAVDQDSAGRQGHLVSSTGGLDVLAKPLANGDVSVVLFNENAATATISTTVAAIGKSGASSYGLADLWAGTSGSTTGTISAGVPGHGVVMYRVSGGTTGGGTDTVVTIRGAGSGRCLDDPNSSTTNGTQVVIWDCNGGGNQRWTRVGNQLQVLGKCLDAYNNQTTNGTKVEIWDCNGQTNQQWTVNADGTITGVQSGLCLDVTGAATANNTLVELWTCNGGSNQKWTLS

SEQ ID NO: 13254 - protein, 133 aa, Actinoplanes utahensis
MRTPTATPPQTPTATPSRSPATSPTSAPAPSGACQSGFASHATGQIGEGATVVGASFTARRGRQTACLAGPSGTDFDLYLDRNVGGRWTTVAKSTGETSREAITFSAAAGTYRYRVVSYAGSGKAVLGWNAPA

SEQ ID NO: 13255 - protein, 305 aa, Actinoplanes utahensis
MTFCYRQVTPCGRRSPYGDRSFKGFLFPLPPAYSLRMLASNRRECGGREPAPPSALSRTPRADRATPGTIRCADGAGPLKEQRLKHKVALATTLTAVTVAGSIALTMPQGNAATTAGHQPPAADGPAPVALATSSAADLVAKKPKAFFKSRFDRLDRRQVVSQNGLQYVVYERTYRGLPVHGGDAVVVTDSRGRVLNEYVAQEQALSVPVTAKVSAAAAARTAQKQLVKVSAVSPAALQVVAQGAGVLAYEVVVAGAKRAAGGVVPSNLHVFVDATTGKVLPELTRDDIVDAAGHGAYYGDVLAS

SEQ ID NO: 13256 - protein, 184 aa, Actinoplanes utahensis
MRNAFAARVLPALLIAGLAGCSTGTTAAGSPATSPVASSPVSTPGSTPASPAGSPAVTSAAVPAAPSTAVADAAAFPVVITRTGGIAGVDDRVSIDADGAATVTRRGQKARHVTVPPAMMTGLRRALAAPMPRGAAVPPAGACSDGFVYQITRPAGSVTVADCGKPADPGVTAILDVAKALLAG

SEQ ID NO: 13257 - protein, 219 aa, Actinoplanes utahensis
MRVTVDRRRFGGHRSVQGRGRLTATRGDQRHRAGFLRLCGMTVLHSVHTADLSPSDRSRIRDLLDDAFGGRFDDHDWEHALGGLHILISVDGTLIAHGSVVRRQFLHQGRSVRCGYVEAVAVHPAHRRRGFGSAVMTEAERLIDHGYALGGLSASASAVDLYRGRGWRRWPGGTAVLGPAGVTPTPGDDDSTLLRLVPGGTPLSVTDPVVCDWRDGDVW

SEQ ID NO: 13258 - protein, 296 aa, Actinoplanes utahensis
MSTPVAPARVRPSITVLTAVVVTVTAWASAFVAIRAVHAHFGAGPLALGRLATGTVALTAALLITRGWVRPTAREWSLVAGVGVIWFGLYNVALNAAEQRLDAGTSAMLVNVGPILIAVLAGVFLGEGFPRRLLIGAGVAFCGVLLIGFAGRGGSAADPLGVALCLLAAAAWAVGVTLQKPALRRLPALQVTQMACTVGMLTTLPFTGGLLHDLRTAPPASIAGVVYLGLIPTALAFGTWAYALTRMTAGRLGVTTYLVPPLTILLAWPLLAETPHLLALAGGAVALTGVALSRRR

SEQ ID NO: 13259 - protein, 181 aa, Actinoplanes utahensis
MVTIYSDERLDRNLGGWEMPVSWVQSINPVFIIILSGAFAALWTRLGDRQPSTPIKFAAGTTLMGLAFLLFLPLAGGGPHSAPLLALAGILFVFTVAELLLSPVGLSLATKLAPHAFQTQMVALFFLSVALGTAASGSLAQLYSPEHEVAYFGILGAVAIILGVALGAAARPISRLMGDVR

SEQ ID NO: 13260 - protein, 676 aa, Actinoplanes utahensis
MPAAHFGERSKFPNQQPHAHGPWWIYPSYEPALTRGLTTLAGCTSSLMLPRPKPPARPPRSVKPGRLAKLPRPGAFRSAAAAAGAPCHPRENSRPRVAAANLPAMPGPPDPERSRETEVSLLVVRVPGQDPPPPCKVCGEGKHWTKGYCRNCHPSASQRGCLDCLSWGPVRIGGLPAFQGSWCYACSQNRRRYPVGPCRFCHREAALLHGVCRLCRHEAGRRAGSGHQIRPLDRLKQHPSQQLFFAEMLRHLQLGGLRRVEPRPPPPAPASWGPPVGVQGVLFDLNRDLSLFVRKEAAVCDDPRLFHAHAVSARLADRGGWSHHTVLGVNRALTAVLGCRPDDGQQIRMSELRQLGRRKMSAERTAEVLNEMGLLHDDTPDALAAWVDRQLDGLAPRIEHEVRHWIDFLRGRLPRSKSRPVEGVYRELAYLLPPLRAWSDRYDSLREVVRDDIKAVAFARGQDLDYRTHQLTALRSLFRRLKRDQLIFRNPTTPLSLPGRDRLVAARPLPDEELRRAVSWAAGRPERTVLVGLAIGQALRPVQMRRLLVVDVNLGERMLVVEGQPWPLHDLTFNALTSYLDHRRTRWPNTRNPHLLITQQTAAEIGPVSKSWSKIVMKPLGITLVQLRQDRLLDELIAHGPDPLHFMTVFGCSDTTALRFLRVAEQLLGHDPRFRR

SEQ ID NO: 13261 - protein, 211 aa, Actinoplanes utahensis
MILTFSSTSSERGSGARPAIPERSESRTGGEVDDRRPRQPSPGRDKDPIRGSDPAFDAFFMNTFGQVVRRLLYSGASRADAEDAVQQAMAAVYERWSEIGEPDRFVHVVARHALIKMQSRAHREAQRWALQGGPFVVSEESGLDSAALEADAVRGLFALLTPMQRQVISLYYDGYPTNEIADSLNISQSTVRVHLQRARQILRKALSSVDG

SEQ ID NO: 13262 - protein, 401 aa, Actinoplanes utahensis
MDNAYGVFLGLDVGKTDHHAVALNPEGKRLHDAALPNTEAGLRKLFDKLARHGQILAVVDQPASIGALPVAVARACGHQIAYLPGLVMRRLADLHPGTAKTDARDAYVIADAARTLPHTLRRVDAGDDTLAELEMLVGYDDDLAGEVTRISNRIRGLLTQIHPPLERVLGPKVQHAAVLDLLSRCGGPTGLRKAGRSKLVEIAKPRAPRMGVRLVEQIFTALDAQTVVVPGTTAAETILPKLAENLRDLLKQRDQVAVQVEEMLDAHPLSSVLISMPGVGVRTAARILLEVGDVAAFPTSGHLAAYAGLAPVTRRSGTSIRGEHPPKGGNKQLKRAFFLSAFAALSDPLSRAYYDRKRAEGKKHNAALICLARRRVDVLHAMLRTSTPYQHKPVENLALAA

SEQ ID NO: 13263 - protein, 30 aa, Actinoplanes utahensis
MLLSEQNRFFVTGGWGEPISPLIENEGFIG

SEQ ID NO: 13264 - protein, 195 aa, Actinoplanes utahensis
MTNYLAIVSSIVALVGVWIGGRLTFRTQAKGWKQAESQRWRDLRQATYGDFLAAVRRYRTYVGRHETPFELAPYADGIRLSPRLDEQGMVHKQALDAALAQVQFIAQQQETASAARTLVSMARRTAVAKTIYGSKTVPTRIDDMFWHSELAFVNAIRAELGLIPLVQDTYDDPMKTLDRELFDAYRSQQAGTGSN

SEQ ID NO: 13265 - protein, 31 aa, Actinoplanes utahensis
MATIGAGVSRTCRRIAAAWAAMDGAEGLHRG

SEQ ID NO: 13266 - protein, 142 aa, Actinoplanes utahensis
MNGHVTRRPDPMARRQSQPRADLVHRSAPFLPSDSEIRQVFIYQTAANFLIFVLIYLTGLAIFWAKYRCVAVTQDAIYVLESSKVSGGGKPQRLIGTLPRRTQLGPMSGRWSQMKLLGEQCWVHKRFHDQVAAADREAGFTA

SEQ ID NO: 13267 - protein, 289 aa, Actinoplanes utahensis
MCTSSAVIVRWSSMGMERLPYRTDLSDARWALIEPVLTQWREARRGLGIRPPVHDLREIVNAILYVARTGMAWEYLPHDFPPAKTVYDYYAKWEADGTTARIHDLLRSWVREALGRDAEPSAAVLDAQSVKTSCNVRESEQGIDAAKKIKGRKRHIATDTLGLLLAVVVTAASVSDSAAGKGLLSTLAAEHPTVSKVWVDGGYQNTVLRHGAGLGIDVERVPRRAEKGFQVLARRWVVERTFGWLMQHRRLARDYEALPQRSATMVYWAMTNTIMLRLTGESTQTWQRL

SEQ ID NO: 13268 - protein, 544 aa, Actinoplanes utahensis
MRDRADPQGVPPARRPGRGTGLGVAQEPADGAGVAGGRPVGGPHARGAHQFTTHQAAAGGHHRDRARRWLPAGPARRRKRRLAVRNRLMSCYSVLLAAVLTGLIVPLAISTVTRDTQAMFIDRLNDTDRLASLADPALRTGHITALSMELRQYHQIYGVDVLLVDRDGVTVLEQGDGQVASRAMLRRYVDEALTGERHDVSGAIWPWRDQPLVVATPIGRGGEIIGGILTISPVRGLQLEVWRYLAVLAACGVLAMIAGIAVGQPLVRWILRPVYDLDAMVTSLPEQLHRSRAAESGPPELQRLAASVNQMADRITELIDRQGSFVSYAGHQLRTPLASLRIALDNLAPAPGKRDRSHEIAVQEADRSAAIIDSLLAYASANARAAAATEIDAVPAIEAWVAARQPMAEAARVQLVCRAAGPRWVRVAPSVLDQAVEVLVDNAVKYGETRTRIFIEVAAPEPGWVEVSVEDDGVGIPDDELLHAVEPFWRHPSRQVHDGSGLGLSIIGALVTASGGELQLAGVRPHGLRATVRLPAARTECDAR

SEQ ID NO: 13269 - protein, 302 aa, Actinoplanes utahensis
MLAAGCSGSSAEADELVIATGSVGGVYDRLGTALASVGQRFALQMSAVRTAASIENMTLLGNRAADIGFTTVDCASLALGGEAPFPAPVPIAALAALYDDYLQLVVRADASIGTLADLAGRRVSTGEVGSGTDIAAERVLAAAGLAGRVRIARQSLSTAVAGVRAGALDAFFFSAGLPTPAINDLVRAEPGIIRLLPLSQLVGRLQSEFGEVYAERTVPRVTYRMTADVGTIGITNVLVVRRDMSDNVARRLTALLFEAGFQLRDAHIDAEQIDPRSALGTYPVPLHPGAQQYYRAAKLFVD

SEQ ID NO: 13270 - protein, 478 aa, Actinoplanes utahensis
MIDVIVVGSGPNGLAGAVALARQGLTVTVLEAAETIGGGTRSGELTVPGVLHDHCSAVHPMAVASPFLASLPLDQHGLTWTWAPVELAHPLDGGRGAALYRSIERTAAALGDDGATWRRLFGPLAADFDTLATDLLGPVLRVPRHPVRLGRFGLRAAAPASALARLWRTAESRALFAGTAAHAMRPLHTPGSTAIGAMLIAAGHRHGWPVARGGSRAITDALARHLFELGGTIQTGALVRSLADLPPARVVLLDVAPSAAARICGDRLPPRVARAYRRWRHGPAAFKVDLAVEGGVPWRLEAARQAGTVHVGGELNEIAYAERQVTDGRLPTRPFVLVAQQYLADPARSQGDIHPVYAYAHVPSGWDGDATDAVLDQIERFAPGLRERIVARSVHTVSQFSGGNPNYVRGDILTGANTPAQLVARPRWAIDPYATGVPGVFLCSAATPPGAGVHGMCGYQAARSALRHIQSTKSLAAR

SEQ ID NO: 13271 - protein, 389 aa, Actinoplanes utahensis
MSPHDAQVRALDAFLRADPQTWPRLAPALVARAGEQRLREVVDEAHGRLGGITGVIDTPDGLAIEGPQGQVLAWAETDEGGALSGLWIAGARRGRVRSGRRAELIGYAVPYVPMLWGAIGCWTARSVLGWAGLLLTTVAMYTFIRGLGALPVRPWWANHPLTLLFTLALASTARLPRLTAEGGADSLIVGVVLVVAVVALLVPARRHRWPESTERPLAVFPVDGDWYVLQGGGRLINHHATVPEQRGAVDLVRIGPQRGDASRLESYLAYGEPVVAPCAGRVVTAVDGIEDQAPGTIRFAPPYGNRVTIDNGSELVTVAHLKPGTVTVRLGDTVEAGQLIGAVGNSGNSSMPHLHLQADRAGVGLQLRFACINGSLYRGRRVRAPKRRP

SEQ ID NO: 13272 - protein, 333 aa, Actinoplanes utahensis
MNRLDTFLARISVREHRLIGIALMRIVIGFATILYCLADYDRREFLWGPTSYYSAGVARTALPHHGFSLFLLSDSRVWFEIVFHLVIVVSLAFMIFGGRSLTIAQAVLLWSLHWRNQDVLEGGDNLAQIVIIFMIFTVSNAYFAPGARNRRERMLAREAPVLRTAVHNLAAYLMVFQICVLYFMAGYWKVTGEQWQDGVAMYYISHVTGFALSSTYAALMSNAFIGTAVTYFTVFTELAFPFAVLSVRGWVRKTVILAIEGMHLGIMVFMGLVCFGLLMLGADSVCLRDDDYKTMYRYALRLRDATLARYRRRFTAPVPSAVVAMEEDTRVAA

SEQ ID NO: 13273 - protein, 220 aa, Actinoplanes utahensis
MSPREALPVRIRVAVPLLLLVVALFTAATLIYNAPASPARNRLDFVPKLLQPYFWQDWQLFGPNPPVTNNLIYLEVRLRDATGQVTESAPAEIEQAIDRQPRSFRTNPTKTPGIMLAFNASANNFARAASAIAKMPADQQADARKKLFDEYANFFVEMQRFFSASADGLYPGRDIVAVRARFRTRSIVPFSQRYQDPPPAQPEKELLDTSWLTYIPGIAR

SEQ ID NO: 13274 - protein, 592 aa, Actinoplanes utahensis
MRAIALLAAAAAIVMSVGNTFPAAAETAGSAVARLYIDVRDQNDLDSLARAVTDPRSPSYRHFLSPADYRRRFALTDAQHRDLLTRLAADGIRVTGETSHYLRITGPAAAVARVAGASAAAHSLSTPVSAAADAAARLAGPQARVREKADADEPAKCSSWLGESPAADMPPAYGSISSYATCPYRPDQLRKAYHVTTTGRGRTVAIVGAYGSPTMRADADRFATAVGDKPFRPGQYREDVDPNAWNLTPDCAPPADWAGEQALDVETVHGYAPDAAVRYVGANSCLDEDLMDAESSIIDNRSADLITNSWAEIIHADPGHLTPDLVAAWNRLFEQAAVEGIGVYFASGDCGDASPGAAHAGLNCDPATTAAQAEWPAASPWVTAVGGTALGTDAHGRYAWETSMGDDLSIRSADGTAWTPLPGVFVFGGGGGPGDAPQPWYQRGVVPAALAAAGGQARRVTPDVALEGDFAVPVLVGYTLGGTFQLIGYAGTSAASPGFAAIQAGAEQVSGRTIGFANPLLYRLSRAGVLHDVTEPTAPVTAVRDLGADQGDLRYVLFTLGQDYGLSATTGYDAATGLGSPGPAYLSWFRRH

SEQ ID NO: 13275 - protein, 111 aa, Actinoplanes utahensis
MSIKRFVALGVAVPTFLTASLVGLDQAAMASPAPEAVKPASVAPIVAFNGSADPQFWGAVAQAAANAAAGAVAAAVVAAALAPKSSSSSSGGPATGTAADRSGDAQFDVAS

SEQ ID NO: 13276 - protein, 297 aa, Actinoplanes utahensis
MATLAVTRRHDLTDRQWAVLAPLLPAASTTGRPPKWDKRQLIDGIRWRIRMGTPWRDVPAVYPPWQTVYGLFRRWQRDGTWDRILAALQAAADTNGRIIWTVSVDSMTSRAHQHAAGARTNGHLQKEPPGGVHDEPADHALGRSHGGLTTKTHLACEQGQKVLSMVVTAGHRGDSPQFIPVLRRIRVTRLGVGRPRTCPDLVLADKAYTSRANRAYLRKRGIKACIPSKKDQDAHRKAKGSRGGRPPKFDKALYRMRHAVENSIARLKRYRGIATRYEKLAVRFQAALTIVIIGEWL

SEQ ID NO: 13277 - protein, 73 aa, Actinoplanes utahensis
MTVTVTDMHIPAQRDPGHDQMVTPESARVAELQEMIRSGQYAGYLDELTDALAKAKAARDEIRQLTATSALGA

SEQ ID NO: 13278 - protein, 134 aa, Actinoplanes utahensis
MSFHPPADGRWAMQPRLFRIGNTTLLDDDPNPWTVKAVTANFAVLTRLDDPEWENGDDDPEDGPTSNDCDVLYTVLDCRNGYRGPCNLSGWGYGDGTYSEADCAAMLADFEAGDLEISHRNWTRIRFADEAAVR

SEQ ID NO: 13279 - protein, 85 aa, Actinoplanes utahensis
MTTLRDDLAVLIREADKDNELSPYQLASSISEFLLDRGLVTPVQAHAVSDFAEEQNRGAGYRHPKPVGPEALAAVIVDRFNLEEN

SEQ ID NO: 13280 - protein, 75 aa, Actinoplanes utahensis
MSLIGGRIRDLIYVEKEHVNLDEAAAIARVLRCTGKYGAGRPEVRTDEMVTDVLAVMQVLAGPDGDNARYLSRSA

SEQ ID NO: 13281 - protein, 159 aa, Actinoplanes utahensis
MTTMEDLYPDGHGYHDAHGPYIDAVAKALDEAGFKTDISWSDPNDPRDGWIGFDMEQQPHRNGEPVWSYDEVGIGWSENRGWHLLCIDDRNGRDSRYVFELAIARLASPETVANAVAEQAGIDAHVASDDYPDVDFPEHTFEDDDIPFDQALAQYREPA

SEQ ID NO: 13282 - protein, 52 aa, Actinoplanes utahensis
MPDTDLTARLHRLLHLYRALPDDRIVLAAIVGDDADTLTLGDLRELARLVGA

SEQ ID NO: 13283 - protein, 52 aa, Actinoplanes utahensis
MERAGFTMNTFFRAVLRWVRNDPRRLAQFKALMVEVDAETPRGRPKKNAPQE

SEQ ID NO: 13284 - protein, 169 aa, Actinoplanes utahensis
MTFRNTYVAPMTTSASSVITAINTRRPGLKPAKQHMLMFFMQGHHLAWRDRALFDEPMHATERAVEIDASADSAEPQITDEAALNTIGYVIARYSALSPADLRTLIQASQPWQTATKPGSESRIEWAHLRDWFQRPDETDDPDDERPNRAEVAAAEAYLTSRARKLAAV

SEQ ID NO: 13285 - protein, 60 aa, Actinoplanes utahensis
MADLPADLLVIVHHDDSVTRYEQVTYCPWPGGVTVYRNGEQIAEHNDVIGQHAERAAVPA

SEQ ID NO: 13286 - protein, 70 aa, Actinoplanes utahensis
MCQNPLCQYTSEAVHELRVAGTKMVRLVCADRSCTFWASGELCKDVPNAVIERDELHPVDAGGVHIYDDF

SEQ ID NO: 13287 - protein, 146 aa, Actinoplanes utahensis
MPGGGRAWPGDRLRSGQVHRRRALQPHRVERDDRCPPRLVRSADRRPTQPPVRQSGDHGRRGGALAFRAGDGMSAYANDPRVNDVTGRGTLFLVADKPDGEPVARVRPFIDGATWVAWPVDENLMTELPEFGTADEAIRSVIGDPQ

SEQ ID NO: 13288 - protein, 62 aa, Actinoplanes utahensis
MSIDYTGEVVGRDPVGKTIVEALVSSHPDWSDQQVTDRINREYDEPVITVAEVARWRPGMAR

SEQ ID NO: 13289 - protein, 87 aa, Actinoplanes utahensis
MTARILTLKPSQMQRLRQQQHVWWDDSTGREVLVRTDPGGRVDTYPGALVLTLTPADLDLIETPDGLVCADETRTTGWTVCMAEVQA

SEQ ID NO: 13290 - protein, 91 aa, Actinoplanes utahensis
MTAAFTPCRCGPDRPRKDTMIRIRLVDGRTVETNTYTLDQAYKLMADGHPLQIGGPEDCELQPVFADDPQGENPRQAINAAAIVSIEEDGA

SEQ ID NO: 13291 - protein, 85 aa, Actinoplanes utahensis
MQHIHTNAAELMSARNGTTTFMTVADGTYSNKVAFDVKGGEMAPTDGLPRVVLTPDQFQKITAKDSRDYQVTADDGSVYAVSVWA

SEQ ID NO: 13292 - protein, 61 aa, Actinoplanes utahensis
MTDLNALLTLYTTWSKALEAAEKDGPEQSAIRAEIADYEAAKAARQIADLLAAEILEPASV

SEQ ID NO: 13293 - protein, 74 aa, Actinoplanes utahensis
MSTVYVAEIEGQDLRLIKDGNPNVPYDLEVYPIYGHDDADRWLAKHGYTDHDNWGWRKANSSKPAIWLKNVVAP

SEQ ID NO: 13294 - protein, 57 aa, Actinoplanes utahensis
MTGHDLELSAPSTWPQDEHAFCGCGRLMRRDDAGRLVCDDCETAADDAAVIVAEVMS

SEQ ID NO: 13295 - protein, 83 aa, Actinoplanes utahensis
MNVFSYRLVYRGKVEAEGVNSDFQHDNAEDFGRAYAATIDANRPPRPYPLHLLVWEGEDTSRDPDFKHRCRRHVDHVLTGVAS

SEQ ID NO: 13296 - protein, 64 aa, Actinoplanes utahensis
MSTTTYAPPAGADNPDDFDRWEKELVGDTRHHFRPSKAALRREDQHAIDEALGYHRHRTNERRD

SEQ ID NO: 13297 - protein, 71 aa, Actinoplanes utahensis
MTVRTTHPLTADRAALAAAGPQAFALTPDDEREIGNFLIEVDSLPDEDAALRLRIPIDMVPQFRQLMATGR

SEQ ID NO: 13298 - protein, 91 aa, Actinoplanes utahensis
MHTAPATYPYSTAQDMLLGAGLTEKQTVSVISRLSEDGVRVLAASASEPARQVVHALAHETIAGLAETLHMQADPDVAVVRELLRHAVGAW

SEQ ID NO: 13299 - protein, 75 aa, Actinoplanes utahensis
MQDFNIEFLWKDVASGGNGCHAILKTDGGYYVQGRVVTGDERAAVLSHSEANRSGLLDDEDVIFVHGNVLDRLNS

SEQ ID NO: 13300 - protein, 289 aa, Actinoplanes utahensis
MQDRELKKWLLQPGGVVERLRQLQSTGTTKTSNNDLAARAGWIPSKVSKLRLGQQTPTADDIRSWVAATGGSEQDEHELLVMLADAERHTTSFQKALKKGQAAHQQTYNELVEQADVVRMIERSFVPSVMQTREYATAVLTGSMKLHKTADDVAEAVAARMQRRKFLLDEKYRFEFIIDETVLTRRVAPPEVMYSQVDRILEYMDLPNVRLGILPVYGTFHDVVRNSFELYGKIGVVETYYDDDELDADGWTAHANAMRDVWQDAVEGDEARKLLRAAMKYHASDMNKS

SEQ ID NO: 13301 - protein, 184 aa, Actinoplanes utahensis
MRKVLTDGGPGTEFWRAFETFKRSAWRWEQQPAYHLGYEQAQFDQFLAGHPESPLENEELGSWMKQVAAHVNHGRTIGRVRIVETPPTDYQRWMRWMDKFNRGAGETIQYLTRHGAQKAGIIPGIGAEDWWLFDDRRLLLMRHDDKGRRVRVEAVEDEPEVEKAIWWRAQAIAAANREAASLEV

SEQ ID NO: 13302 - protein, 52 aa, Actinoplanes utahensis
MITVNELRRLFHALVIEPGRRVVDVIAWSIYRRRHQSAARTSHYARQALTEP

SEQ ID NO: 13303 - protein, 215 aa, Actinoplanes utahensis
MLDHLGQLRAFTYTRPGIGSADPRSAPNPPLPHSRFADELAALLDSAGLSEPAVIVGHSFGGNIARMYAARYPHRVVGLVFVDASIPRQRINPADSRLVDGDGPDATEIDFLTGEVEILNATLPDVPAVVLQGDARLWPDLVSPVHADLWDTYQRILARQLGCPLILADSVGHQVPTDAPALTAIVIAAVAKAAANGSAVHLDATKFGQAGGVML

SEQ ID NO: 13304 - protein, 140 aa, Actinoplanes utahensis
MDLDELSAAVMPYVSAAVAAYGGAMAQRATDAAVDSGSTATVAWGRQLLARLVASRRGRQVTEAVEELARDPADDASRVLLQAQVLKAVSIDAHLAAELEHIVQEARADGDHYTVSVHHSSGFQIGSNNQQNVFMRPSTE

SEQ ID NO: 13305 - protein, 1343 aa, Actinoplanes utahensis
MNGNISSSSHFQQGDDNTQNFYYFISYGADGEAVRPEAMLGHVRELTPATLEDRDEELAELAEFCFGDEPYMRWEGEPWAGKTALLGFFVLHPPERVDVLHFFIRGGQASWNDSFAFEQVLRAQLQAYLATTDPGTVNPSLLHLDRTDLLDRAVKHAAATGRRLALVVDGIDEDQSRSRATRLPSILSLLPADPSPVLRVILASRHQLDQPTDVVDHPALSCRVRRLSGSARAARLQRAARLELDTLLGMGSLATDVLGFAVASEGGLSIAEVAELSGAEAEKVRETLVNGAGRTLVLTAFPDGGTGFAFSHDSLRLGASEVLGASKMRQYRARIDDWARAYRSLRWPAETPFFLLARYGKRLADAGEVGPLTELARDTSRHARMRDELGGDGPALTEVVSAQALWQLQRDPDLRSAAQLARIRWELTSPNLHMPPELPAVWALLGQPGRGLNLIDALERSPQRTELQQSMIDALLHAGRPDIAAYVASDLPDPEREVALHSVATALLAAGQTDEADGVIGFAAEKCANGIEVVIRYARLRGATYARQFRHPGVREAAFYQVIEGLCEDGRISEAQEVAAEIRDAQVRGLADLTIADAAGHPISPTLHRRVLELAAENPHLSETILATLARCLARAGSYQEAETALLRTADPADAGRPVLAICVEAGSFADAEALAARLARAAHRLSPVNDLCDLLVDADRPDRALALARTLPTAAEQVGRVAAVGARLMSRGDPRGPGVLEEAERLASETGPKGYAHLAILAARMADDALMTRSLRRVPDDALVSVASAIAEGGWESAAMQAVDLLDDPVQEAYVALQLAEAAIEQNRPQVARRAALFAVERRLTGTDFDVDEPDFDATEVDPLDLDEAGVILARAARILATVGDVRAALRVATAADTASRQTTDPERADEDLALVACAEAELGDLEGAEKRIRRIGDKETRREALSQLARLATGKPRADTEASDEDGTGELAARLAEELQGDILQEVTAALVASQRLRLASRLAGRAAEPGERAHALAVVAQGYLEVRDADHADLLAIHALRILPTGESVEHSETAACIATVFLAAGHADRIPAVEQQLRLAWQRAVFHAELAVQTIAGGTLTPDAAVRYIRRAEQIAEALVDPWERCCAFSRLITAWSAVGDAPSVTRMIAAATEAAVGCDGSWMLPEPVVLGIDALLRLDRPEEAARLLQDDAEHTPAMEVYLAEALAEHGHLDAALHFARSLAPERAFTQRWNVFTSGPGGDDVRDQALARIVAVMARDGGRPDDALRIVEEITSPWAKAGAMTDLAVGLARGRRPIRAKQVMAAALALGEWTIPLRGLVVVEPDAIRAAVSQRVIDL

SEQ ID NO: 13306 - protein, 1096 aa, Actinoplanes utahensis
MVVFTVVLTTVVSVRATLNTASTLWGVISALVAFGSTVAGMKLLKPDVTPSDGAELEAALVADVRRQLQEEERRQRLNDPWPIPVQLRPADAAITDHWQVIRAGDGDGTPLPLTGNLSQIDTLFSAIPSGRMVLIGPAGCGKTVAARRLAVLRADAWQSGQPVPVLLSLAAWNVTRQPLPQWLVQQIADDHPAVPQARTVARTLLVAGRLLVILDGFDELLPQARRQALHEINQSLSAPQLLVITSRADEYTAEVTASDVLTAAAVLRLQPVPLATAFTFLQEAGPPTTAARWRDVQARVTERDPLALVLRTPLFVTMARALYDTAAANPAELLDRARLPDRAALERTLLGQYVDQAARSIAADSGGVISPRRVATVHRHLRTLAAIVRTGRTGDLSWWQTPHVVPAVAAAAPISMTLGLLGAVSFAVVLGGKWQVACTSLFATLAGVFVAVTVGAITLPPRPTAGGRYVEKPHWMRAIPVPALVAGAGAVSLLAAAVGGVAAVYGARTLVVDLTGLLFVVFATVWLLSPSWADLRYTDWDRRRERWLGTALAFTCGGAVFVAGAVEGQVSPGRVYQFAVLAGFAVAAAVSGIIAGRRPRVRSRHRRHRASRRRVMLSWLVAVTVAALLTAVDPFLWWGAVQAAVVALALRLLGETLVSIGPGYRTPRRVAPRLGDAAPVIVPRVGLGAIAGAIAVTVMTLLFPALSWPVWWAAGISTGDLPVPALPALADMAPFVFVGALTGLLVGVLHWVLAPIDHGRMAGPRQALHTDATVLGLLLAVPAAVAGTLAAVLVGQHPHRPALVFVCAVLLIMLPVLVAVVRTSAWLQYRTAHLWLAGTGRLPWRFLRLLEQARDAGVLRQTGSTHRFRHVRLLHQLHVPATNVTGSRRRAWPPEEWPAAWRWSAGAAVCLLIAGGAVRQADIVAAAEQTQPTLATPTWQDLQRHGACLPGCRVTGHVAVNHKSWGPVTLLSTLDESGDEPIAGVVVTDRTGKVRWQQELDTWTELTIAGRDRTGNVFLIFSMGGDKGVVVLHPVRRGFAELGPSPEDPYFFSSNLIDAGDGSYAIDQSINDCSPPCADGAVTHTRYYWTGKSYRP

SEQ ID NO: 13307 - protein, 132 aa, Actinoplanes utahensis
MTHSPRVLDASALIAMFGGHPDLMEMLDDAERGNVFLLLPTVAVAEAEAALNVGLALWTPFLMSRGVTTLDLTMHTAVEAARLADPQLPGAVAGPLMAGQVAFEAQALNAVVVTQMPSMYAGYEVAIMPVEA

SEQ ID NO: 13308 - protein, 41 aa, Actinoplanes utahensis
MHCQDIGCITHPQDALFEQWPAAPHHHPGASFTTQAGEATN

SEQ ID NO: 13309 - protein, 195 aa, Actinoplanes utahensis
MTFRDKSVIRHQSGSRIDTLRSAGSSANPVRKVPDSTTSTRADVRNPSPGEGLPPTPMTAYVAAMSTATDIAAALREQAQAQIPYGLSSNLTDVQYDAARFAVASFGALSAMDLEALVRGQGPWTATPTGKAIDITVIRDTVRAQQEIPEGNVSGYPQSLRQAMLRPADQRPPRAATPDSPEEIEAFIADVKARM

SEQ ID NO: 13310 - protein, 113 aa, Actinoplanes utahensis
MEFAEAWGGRYPAIVRLWENAWAEFVPFLAFDAEIRKVVCSTNAIESVNARIRRAVRARGHFPNEQAALKCVYLAVMSLDPTGTGRRRWAIRWKPALNAFDLAFEGRLTAGRN

SEQ ID NO: 13311 - protein, 491 aa, Actinoplanes utahensis
MTVFLAKPDNGPALPTGHPAAARSWIDAVSAQVTAVTHSTWLIYGVCGVLAGLLTMSLYGRNRRTKNTDKAELTGTDRAVTRITGILATAVVALGAWKVFGDVLHLHWFFRMVLFFFAEAQIVAAWRRVRRHIHRHATLGPGIRTIYGIALGSALVAAMDADRMVEVVLRFFAALVAAYMISEELAEELDIHLQAHPALAGTAKKVRGRIKWALTPERILVWLRLAEPSERTVEEVERQRRIARFARTAYRLHLLRENNAKKWRINLAQWSLRRQTEAANEHLRLATDQALLSDMRAQLALLYQVEDTTTRAAVADLNPLRPTHPDTQPGSQTVRTRTRSSETRSETERTQPPTQTANQAAKPSENPAEGTVEKPAEKATANSGANPKTVAAKPSHPLADHPVDSVRKLARAFARNRALTNADLGRKAGVSTGTANRYMPDVRAAFNAAENQTTRPERTQQVRIPVPIPQPSQPVLAGVNGYHQTPEENLR

SEQ ID NO: 13312 - protein, 62 aa, Actinoplanes utahensis
MTDTMTTTAEATVTLTVNGVTKTFTATVNSDGDPSNAALSALSAARGDAADWTGRPLREALR

SEQ ID NO: 13313 - protein, 99 aa, Actinoplanes utahensis
MTTDLTPYRALDLGTVGEPAALVDKPIGPVTLPPQPPKPSKRQAVDTAGSLTLIAGALTGLAFHAGSSPELVIYPVGASIAAMVIAAVVHLRSMPKVAR

SEQ ID NO: 13314 - protein, 79 aa, Actinoplanes utahensis
MLKAVRGTTAEQRAKARRLVRGQRRLAFFKEKIKDAIEGKSRVEQACYYVQAVAADLDERGRNELALAVAEIADRRNPR

SEQ ID NO: 13315 - protein, 141 aa, Actinoplanes utahensis
MTIADAFDGVFPEAPSNAATTTATRPARPTVVPLRPADTTRAKARQRPHAVIRLARIVYLDAADSWITEERSPSAKTVWRTDYTAGLDTVWTPYRYWTYAWRPIAVLAALFLDALKFLFIHPFRGPVSTAIIAALILLATH

SEQ ID NO: 13316 - protein, 131 aa, Actinoplanes utahensis
MLNMFSSLLATVGGLIVFAGAWYIHQKVRLTRTACVMAAVGGFVTYSGVVGSWANQYARQLGIVCAVAVFVGVCIIVADIKGKKKGADRPALIAFFLVPIFLASGIGVLPTITKGLRDGVQKNTTQMQKMG

SEQ ID NO: 13317 - protein, 506 aa, Actinoplanes utahensis
MGLEFLVCLLLAALFTGGRFVQDTIATAKGTTPPHVERARIRAEGRARAREAAKPEKERSPYAAGKPGLKDVAAVYWGDALQDVIDAHEQRRAEKKAQRQENQAAKAENRPARHFRPSLAERVERLAKLLWEGPQRPAEDELVPSVDEVLIAEPAAGADTSPPPGGPGGSRVLMRWDCERCGTGCGGYDSDDAAAQDAQLHLNKVHGGCGKVVAGRIEFLPGDPDGESPARHCDTCGTTVGMTRNVTRCIPCIAINATREQPHGTRPTRHTQGHWGNGTFVRASARDSQTGDAYNWACQHCGQTTRREFPSPAAADADYYSTHMPCPIAGDLKPGSGGLCFFTCGQCGFDSGQIYPDQDAAHAALKAHRCSNPNNQEDAMTTPATSGSATGDAHDLESASNECDLLDGDLTAVDTALDLIDERITSAGAAAERLKGFLDSKSMPDSITAGMATALEMLSPEHIKALIDAIAAAKTGVRASKEAIDTMNEQATEALQGADGSAVNGR

SEQ ID NO: 13318 - protein, 791 aa, Actinoplanes utahensis
MSVDQRPAPTRDMPPGGSPPTRPRTASRGPDGQLTVPSGAAFLSWHYRAADGKTVKARKQPVPVSDGGELTHYEMECPACPDSGQWVSVKSKVHRPLCAVCCTELRRPGQRQWRLSRIPVRQLLQERRAHVNATATTAAVGAAGLVLDAADFPWWGEIAQAAAVPACVAGSWWFTRAWLTRYSNTADFPDPTVEPTNAVIAQRARTAAYLAAAAGVWCELADAINLNITTGDGGLAVAALLGLGVIGSRPYLRWAQARRVPAPQPAIDEDDEPVDDTPQPTEAELLRAYVLERWEKVSVKGRVLHGTRLEDIMPSVGGWSGRIIAHEDSDLDPEKFDTAEPLRKIARAYSVGTSMVSIVADPFDANQATILVQRTSPLTKGNDWSGNGIDLKTGFAETMTLEDGTRGRHPFWRPGWGAVMELIAGATGAGKSEYLNLLAALERQSGVVVSWIGDPQMGQSLGDLRDGVDWFAPSVEEILVMLRVAAMVMIARNLVTTRMRREETRPDGRVVQRRVKYREVSPDFPLLAITIDEAHIPMNDPDHGKEITKLLALLSKSGRKANIKVRLLSQSVLLSEIKDSVLRGQLASGFVAVFRTADKLTGTAAWPGGRMPGDPANLPAAWEDGFSTAGLGYASSTKRMRMRTDYAGDLYDLITTGDTLGLEASVLGVAGPLYADRWKRLEAFDSMDPAELLGAGIPANLLDSAPGDTAPPTGGREAVLRFFAERWLDGDRDPVPFGELAGAVRTVIKTRACTNAVNKLVDEQILATDKGAYWLTESGAEQMGVLEEVPA

SEQ ID NO: 13319 - protein, 66 aa, Actinoplanes utahensis
MTDADTMRALTRYLDDASRRERAADERNKAIVGAIEKGFASLVKELHDGITLIQHTLIDELRDMRR

SEQ ID NO: 13320 - protein, 143 aa, Actinoplanes utahensis
MMGKSHALSGAVGWLAGCAVLAAAGSEPSPLTVAIGAAVATGMALAPDVDHPQSTIAHSLGWLTCLIAGGVERAAAVLRTSSCRHCSTGPDRGGHRGITHTALCAVLAGAITTTACLAAGRVAALIVVGVAVWLPRTPPCRRG

SEQ ID NO: 13321 - protein, 242 aa, Actinoplanes utahensis
MEDSFRRTVARCARPVRLLEVDLHPFPQVGTQRHVHQDAHRRPRRSRRQRRHRLVGLGRLHDRAGPPARRRRKKGRSETDKPDHAFGRSRGGLTTKIHLACDGAGRVLAFVLSGGNVNDCTRFEQVMAAIRVERIGPGRPRTRPDHVIADKGYSSRAIRRYLSRRGIAHTIPERSDQQKGRRNRGPRGGRPPTFNKLIYRHRNVVERCSNRLKQCRSVATRYDKTGSSFQATVTIAALLQWL

SEQ ID NO: 13322 - protein, 142 aa, Actinoplanes utahensis
MAAPDPGLPVDTGRHASVDAVPDRLRDRNGCRVDARRNRRCFPTGARTRAMTEANEHPPWCTREETLQSLTRHRSNEVRVGTWRRPANGGQVSARLTSAYDGPPAIAVNVWIGVGVTASISLEQAEAFRDGLTQLLNLAGRG

SEQ ID NO: 13323 - protein, 77 aa, Actinoplanes utahensis
MPTQYERAVISAGTRYEAGVITDAQAVHEIRQAAYTAGSDATVATATHTPTNWRELAGLNQSAVDGPSNGETVRMLA

SEQ ID NO: 13324 - protein, 125 aa, Actinoplanes utahensis
MTTRKTVPVPEDVLMHLTHALVTDTARLTLDAWSPGDVVRMGDPFGKVLSWLWVTDPDRAVELYNTTLDHVRRLAPGATKQITLDLALQGLPQDLPPSDGSNARLIERLRQDIPQLAFGDPNSES

SEQ ID NO: 13325 - protein, 41 aa, Actinoplanes utahensis
MSSYPAVRGGCRVSLGRMSVMLFTAAAADLHGGDRPQVFTS

SEQ ID NO: 13326 - protein, 600 aa, Actinoplanes utahensis
MTAEQPYQPINALPPPPTFGVVPPDPLHPASPPRHSHRRWWIIGIAAAAVLLIAVGATIWFLRDRPKADRGPFDRAVANLAAAPMLRYTTTIAGVTADLTVTGNGDSFGAISIAGQHVDLLTINKRNYVKFTTGLLGTKFQNRWVTGPASTAAPLSGTWPAPADLADTLFTALDQAGPFPKDGGPTSNINGVAARKVATPNVTIYITDTAPFRVLRLDPASSGKTLPTMPSLPAVPTLPSLPALPDLPSLPGLPALPTGVLRQQLLHHQQPERAPPPAAGKPIPGQMDLFSLDSAATDKAFGTLAGNTAQLTDAVDTSVQFSAQGTGTISCGVSGCRITTQVSNKLATTSPGKIADSSVSAVLNADIRIDGQPAGSCEAGPIPMKPNGATSISCTSPEAGATFAAIKAEKEAAAKAAGGGTVTVSSTASAQVYATAQTEVEVTKKTKELAAEQQQAQAYQCPVTGKACTGDPFNDLAAFRKRQGMPEAGTDADKDTAARLDVGGQIFYGRNGKGKVTDIPVNAYTRDHAEGDVFQQAKNAKITADRAVMYVDRPLCDGCGAYGGVGSLLRGTGIKEVVVVAPNGRFLITAARPSTPQPLD

SEQ ID NO: 13327 - protein, 87 aa, Actinoplanes utahensis
MGADEVTWRRAWQSKRGLIRLGEHADGRWLVWRSTGKHREFWDERAACEYLQKAMSRSRWEEVTTAGTSHRPDGAVVFSSDRVAQPD

SEQ ID NO: 13328 - protein, 429 aa, Actinoplanes utahensis
MPASPVSPARPAQVTPPPPAAEDQPAQPSVTQPMAPVNAAAPALAAGSHQQRPTAPVTPDEMLKMTTPETSAEVPTDRTSAWAAIPTTSVHHAATIVGSPWWRLAVERLAWIIHREITPDDLPRMTYSRLAEQITSTTLRVPELGRGVVEAFVNDYIRAMNGEPGKATYPWRDLLPQPVTTPVGSELWKQQIGDLRVALINELDGSDETDPRELAMTLAPTVPRLDDATLYAFVNDYVCALGGHPVSGDPAWQHLLPHQKQSQRASPRIPLPHRGAEGAGAGAQRQAVIAPEGHGQRRAARRQDVVREKASIAAATPRPAAVTHRVPQPRPAGDPQEQKLASSPRELREQLADMMASGQMETCTEKWKRETARQLYRDITAAGERITGTDLAALFGRDPRWGQRRKEDVDRGRRTQDVARARNRSATKE

SEQ ID NO: 13329 - protein, 209 aa, Actinoplanes utahensis
MPARMSATQPLTIDLRGHTRRRRPCAPFGARDHDEPSPLQPRHLAALHHDYARTRPGVVLADRPRHAGRLADDRLHRNPAGRTRIFPARRGGAAARDHRRRSTDARAVRWRRPTPREARRHRTRKTSIARTWADHLRPKLERYLRSYPAAPDRAAIARIIDDINYALEHQFFTDLDATAMTTIAGDLDHLVLLTDRDPADQRPTRKDKR

SEQ ID NO: 13330 - protein, 142 aa, Actinoplanes utahensis
MGGVDDDTTGKVRGRDRRHLYPGRPGRLAPRFTAAELADLTEAAAAAGMTPTGFLAEAGLAFARQARPARLDPLREQLRQLQVDLLQARTAVAGIGENLERAVTAADRTGVVPPWLVDAVAVCRRRLDALDAVVERVDGRLP

SEQ ID NO: 13331 - protein, 475 aa, Actinoplanes utahensis
MITKIAAQGQRVGGLLRYLYGPGRCEEHVNPHLVAVWDPSRSPGDLEPVAGVGGRPDVSMLARLLEQPVRAGRNPPRQPVWHCSIRNHGSDRVLSDAEWGQIAREMVAGVGLAAADGRPGVRWLAVRHAADHIHVVATLVRQDGETVWPGNERWRCQATARRLERRYGLYQVAPADWTAHRRPHTPEVHKAIRAGRSSTARDELRRRVRAVAATATSESEFVALLRESGLLVRLRASTVDPAQITGYAVALPGRGGGSPPVYFGGGKLAADLTLPRLRVRWGMPTPDAGPPRPPVDRAARVAALHQAAAAAQQATQVVRDGLGAGQAATQATVAAAADLLTVLAQASEGDRPGPLHRAAEHFDRAARLRCGRTVPADGRSQDLRALSRLIALMGQISGNPDRSAALALTLKLALLADAVEQLRGAQHRLHQARDARTAARALRALAPAGAGRVAAPATVRLTPMRTVNDGWRTPG

SEQ ID NO: 13332 - protein, 347 aa, Actinoplanes utahensis
MTDLTQQVHEDPFAEGRQSMLQAMSALVTVFEAAARYAAVGVQDRAAEAERQAQREDQAARMQQQANRLRAAEQRETDRYARQIAEANRPLRERGTLFEAAEAWRWGTVHGDTPVGRQTAADALHRLRHLAPDLVDGYERRCRAGVAPHEAMADAAVDWWEQQHAAEPQPGRPSRRQLTHVPDAVDEFDQAVRAQVAVLARDVDPAAVAAFQADLRRQNMVAADGLDLLLQFTVEQAKTMPADTELLVGRAIERAYRADGRTAAGALDRPATAADEHTEGQVAAKVLDADADQVAASIGRHHNASGSPRAVSAQAFPPLRLAAPGAQLRPTPAGGPGRAPHRTGPRR

SEQ ID NO: 13333 - protein, 175 aa, Actinoplanes utahensis
MTTTNRAHPATLFDPVTPEEPIRLPSEPAGPARDMEPAPAASAAAAAVPAGEEGAEPLYSTVEEWVNTYLLPTFPRPVGAVGMTRWYWCRQWWRHEEAVTRLTALWYAWESARLEVTGMVGWLPLLDHNLPLLCGEDGPFRGCTVGKTADTARHELPAIAATETAPDGWWNWWDN

SEQ ID NO: 13334 - protein, 355 aa, Actinoplanes utahensis
MRWWQRKPKDRATWSFDPLEGVGPLRFGMTSQQVKAVLGAESLESYRGYEGKESWQRYSDGGVTAIYDQGGLVAVAIDALAGPMVRLRELDLVGGKPSAVAAGIQQLAGRDDAVVTVNWSGDPEVAAWGLSLGATPQWGLSPSGALERTGMMVTDALFVGAELAEDPYSSEPIIRWRDVRGWECDPGAWLVIPEESRARWDWTPLKAVGPLEFGMTPLQVSAALGGEAPAARRGYYPSPLLEKAGQWFPSEERFDVTGVTAHYQGWDIPSLAAVTVHGRTGPQVAYDGIDLIGKSIPALEATLYQHAGNEGVTLAFGCNGDVGPLDLSMLVRAARAGDVVISEARFGVEDWEDHG

SEQ ID NO: 13335 - protein, 408 aa, Actinoplanes utahensis
MTTAGPASAADPVRLRVAVRAAVDFYRRQLTGPAGGPARTYLRQRGLQPVVDRAGPWQIGYAPPGWQNLARHLQASGYTAEELVAAGLCRRQHADPGRLLDVFRDRLMFPVRDQHGPVGFTGRAAPGAGPDTPKYLNTAQTPLYDKSQLLFGLAEQQDRLQAGWQPALVEGPTDVLAVWLSYSRDGDRGIAAVAACGTALTPAQAEQVSAVLGAQQHGVVTAYDNDPAGRAATDRAWSLLHARLPSRLLHHAVLPAGADPATLLTRPDGRVDLRDTLQAHTQPLLETVVNHRLDTLLDRNPRLLDDVGGRVETARHLVTLMFDADDKAEAIRIGALITQRTGISVQALVEIAVDYVEASWSEAAGTLNSAGPAPPASQSAFPPLRPRGMVASQPSPATARATHPTRRR

SEQ ID NO: 13336 - protein, 638 aa, Actinoplanes utahensis
MRPVEPRGNAGGATTPWVVLGLCAAGWVVVWLGWLAGRLVAVFTGRPAGPGFGADFTQGVVHAGWARLWPGVSPTVVAVVYAVLLLALVVLVSVGVAVWQRFRPDAEDPLPALASRAEVAPMSLAQTAAKARRLRPSLQQTPVKEVAEEAAGVLLGEHRRRHGRGDRVYGSWEDVVLAVMAPRSGKTTALAVTAVLSAPGPALATSNKADLWATTATARAGRGRVWTFDPQHITHVEQTWWWNPLAAVETVEDAQRLADHFIQEIRAENGSDDFWAKGALDLLTSLILAAAVSGAGLDAVQEWLSDSITRVPGQLLEQAGFAASARALAGRQAGAPETREGIYETARTAAACLANPEIMQWVTAPGDRRLRSLDVDAFAGSPDTLYLLSKDGAAAAAPLVAGLTDQVLRAAVTLAEATGGRLDPPLLAVLDEAANICKIRDLPDLYSHFGSRGICPITILQSYRQGARVWGERGMDALWSAATVKLVGAGIDDARFAEDLSRLVGEHEVTVASRTRDGSGTTSHQVSTRRQRILEAAQIRALPKGTALLLATGVRVAMLTLLPWYEGPQAQQLSTAVAANTADMTRRAGQARAARRARYADRAGHTGHRTGRSPDDDGAGGAAEHDHDRARRAGRTRG

SEQ ID NO: 13337 - protein, 977 aa, Actinoplanes utahensis
MPSNPVRIAPSWGHRGPHAGRASHVAPGMEYQGTTHQMCGLFPFTAGSGAPTLGVPIGRHMLWGEVVCLDPLEWLRAGLVTNPGVFVLGQPGVGKALDVDTPVPTPHGVARLGDLKPGDAVFDEHGRPTTVVAVSEVWTGRTCSRLRFSDATTVVADDEHLWVTQTQAQRQARVVARLRPPARRPLGTAAEQARVAELLAAATPGQDTTLPDLAAQVGWDQPSVRDRLYRWATGWPVTGRAGNARLFDRYSTLQQTALMLAAPVNDQREDTGTVTTRQIRQTLTHAGKTNHAVPVAPPVSGHDRPLPVPARLLGLWLGDGATDRAMFTTADPALAAEFSAAGYRVLAGRRYRYSISSQRLPAPPAGIVCRRCRKPFDATYTGQQYCSRPCAARAPQTGHRQARTCQHCRQPLRRSSTGQRHRACAHAQTLVGQLRALGVLGDKHIPAEYLRASVEQRRQLLSGLLDTDGTVSPGGQVQYTSCDQRLAEDVFDLIASLGYRPAMNRRATGSTVTAHRYAYQIGFTTTDEVFGLARKRDAHRQRRRAATLRTAVRYIVAVEPVPSRPVRCIQVANPSGQFLVTRAFIATHNSTIVKRLVTGMSGCGTHTLILGDTKPDYTPLVRHLEGQVIRVGRGLDRINPLDSGPLGAVLSRMGAEESRQLRLEVRGRRMSLLLALCALVRGGPLSNTEEVILGRAIDVLAERLPHDPTVPDVLHLVESGADELRAAARARTEGEYRRRVDQLVPTLALLCEGSLRGVFDGPTSTALDLDAPAVSVDISQVAAAGDQLVAAAMLCTWSYGYAMVDAAAALADHGLAPRRQYLGVMDELWRALRGASGLVEHADALTRLNRQKGMASVMVTHSLADLDALPTEADRAKAQGFIERAAIKILAGLPPRELARVNDVVRLSGREQDLVASWAAPEAWFTGAAHPGRGKYLIKTGERPGLPVAMTLVDEEIPLYDTDAAIRDVRPAVAGRI

SEQ ID NO: 13338 - protein, 400 aa, Actinoplanes utahensis
MDAHRPPGRRPLDGVPAPLPGRRRGPPAIRAGRRRRARPGPGRRPAVADLREHPGPAPRPDPHRHPESGGHGVPAAGPDTAPGTASTGRRQPAPAREDPMIGSYTITDDGPHHGWRFETDSHSFQFETTSRTVAFGNPPRQAEVLNAHFTLAVTVPRGDPQWELFTAADNSRNRQLRATLPALVLPRLHAALLDPAVTWKTGDRQVTDNPGGHATLPDRSWVEITAWMPPPYRYTDRDQADARRLLHPSLSLPQRRDAAFAWIREHVPRIPGLPGPDYDPGAADTLLRQIEASKVGRIEVDFANAISERGRETYTVATVEEARKLAAEHRPYNNTRVSASRIVGWRNGTTYTETVDLTSRPTSSAAAAFPARAVPFPAPASMPAGLPPATGPGQQRHRAR

SEQ ID NO: 13339 - protein, 308 aa, Actinoplanes utahensis
MSELRFRIDDGPLRGWSGTHYSAAIGLRLLSQTITVHPPNLPDSAPGSPRVSLSLHLEPGDPQWEVMRIFGRTQQNTPTARQIREIALGLLLPRVQAQLAVRDGWLMSRASSITAGISGQLADLTGPASTVQVAAADSFRRHRSGISLGDRMNRDGLTATFAWLLQQSWRQALPAGQDRTAWTAATDTFLRTPLPGQPHVGQIVLTFRNGTGDGLRHRVADTLHEATIMAGSYRPFNNTAVTAEQVVAIDHGLPIIRPITLDPADSPKRAQPTATAFPRPAVIVPGTPGTRPAVAPPSRPAPTPGPRR

SEQ ID NO: 13340 - protein, 193 aa, Actinoplanes utahensis
MSRAPSGYRAGGRNGMVHVLNQRTTTTLQQLAGAGTDLNRALALAELAHIHRRLAVAQPKRAAARTLQADLLQTLAELYYARNEPPLVPDGWPVGYAPDVLMAGLRDMVQTDNLGFHRTSLLLIRDSLSRRDPRSAVLATVADALAPSGPADPVPGQAYHSGQAFPRLRPAPGTAPAVIPSPAAGCIPQRRAR

SEQ ID NO: 13341 - protein, 202 aa, Actinoplanes utahensis
MGVLSSFTQRLRARFAPATPTHTDRGAALLPGAGRAEPHDTTLADLLARSARTTERLTDLDPDNAGRSDRQIAMLRSLSHVYYTRAGYFLPGPGPATAFTPPVRRLLQAMTIAADRREQAALLAQTASTLAAADPHDPALTAVAQLRAHLPAPNAAPLAGTVRPQLRPAGQGFPPLHPRASFAAAGVALGRAATRPAMGRSR

SEQ ID NO: 13342 - protein, 485 aa, Actinoplanes utahensis
MRTYAGWRRSRGMGLFGLGSVQTVVVLGAVVTMVISGSLSLGLLAVTAPPALIVVIVMVARWDGVSLAAGIAQRVRWQAGSRRGYTRYHSGPAVTGDHGWQLPGVLAATRLLAVDDPGGDFGVVHHQRLGTMAVTLRCAATSTWLADASTTDTWVASWGGWLANLGYLPMIDHVAVTVDTCPDQGSRLAEHVGRRIMPHSPASAQRVLRRLVEVSPAAAADVETRVTITFRPAASPARPRTIDEALQEIARTLPGLQDALGSCGLTVLGRATTAQLAATVRGAFDPAARADLARLSPLDLDRWVDWSSCGPVFAEEHIDRYVHDSGVSVSWAWHEAPRQSVHADVLARLMAPGAYPRRVTLLYRPLPAGEAARAVESEVNAAVFRAAYNRAKRRDETARDLADRERAQQTAREEAVGAGVGLLSLWVTTTVLDPDDLGRAVADVESRADIAKIRLRRQRAAQSTGFAATLPCGICPPQLARQWPR

SEQ ID NO: 13343 - protein, 346 aa, Actinoplanes utahensis
MDFVLDYLMGEAAKGLAYLAGSLAAWILTTSANICPTNGADPASWDPNWAQNCNSTASAAQSIQHLMLPLTGLTLTIGLIWQAIMMVVTRKGEPLLQAGRGLISTVLWGGLSLAVAHLLLKASDGFCVWVIDESIPGDGAPNEKLQHLLTSMVADSPEVTGMAGFFISVIMILFLIALVVMMTFRTAGVILLAGTTQFAAAGKTTGITSGWLNRNLSWSAALIAYKPAVVLIFAADAKLLQSDSGRDRFTGLAMLIVSIVAMPALMKFFTHFTGQMSSGGGGLATAASGGASALHAAASMRSLGGGSAAEHARYLDSNGPGKPAPSGAAPAPSPMPMSAGPAAGAS

SEQ ID NO: 13344 - protein, 101 aa, Actinoplanes utahensis
MQELKVNAQLVLDHVLAAGNVPDTPVKPVPGLETLGPQIVGYMKWILILCGVGGLVACGIMMTVGRRNRSAMASDGAAGIPWVIGGLMLGGMSAVIVGAFL

SEQ ID NO: 13345 - protein, 373 aa, Actinoplanes utahensis
MPHRVGIAVDCCRLFRPVGIPDSRPARKVGRPAMSSRSSMWVAAAGAALLLAPCMLLGIGIAGVAATGASCMVSLPTGASSSTTATASTAWDNEQVGNASTIVAVGSRLRIPRYGWVIAVATAMQESSLRNLGDLGAHNDHDSLGLFQQRPSQGWGTPAQIMQPEYAATQFYQHLLRVDGWQTMTLTRAAQAVQRSAYPDAYAKWQPDAERLVTTVTGSSGAGFGCAAAGGTADAVFRNPDGSYPPEPCSIRPDPTTGRGCLTPRTLHLVQQTRAAGFPAPSCWDQRSEGEHPLGRACDFMMTSGGEATGAEKARGDAMAAWAVANADRLGLKYVIWFRRIWTRRTGSWQPYQTIAGNDPSGWHTNHVHISVE

SEQ ID NO: 13346 - protein, 89 aa, Actinoplanes utahensis
MNQYGRQIEQHWQKYLPIQYAQLSAPETFFAEQGESAAAQIQNLTDSLAGQDPPGESFMAKLGRINMARTNAEDAVMRDMLPPQETTTT

SEQ ID NO: 13347 - protein, 241 aa, Actinoplanes utahensis
MTSTLAEVRMSDAVRRLLGPDLTARVAATPLAGGRCQDCHLPLPQHSVVNVVVFQDQDSCVVGCLHPDCGTSQIRLLPAGALARTGPASVPMRLVAGVMPHGGRPLPVLTLQPIMQVVDVARPVAVDAFLDVLVQAGMTTELDFLRAPEPLLGWPVAISQASAGQAAIQIRMPGGALLVDGVTAVSPAWRDAASRYGWCVLYAGRNLGDIPAGQPHNGSLPQAGLVAGARLRLFGASRNLG

SEQ ID NO: 13348 - protein, 172 aa, Actinoplanes utahensis
MSPHHHPATPPELAVPARNDIRVAALLTSQAGRQVPTVAIEHQPPTTTAPTSRSQHGSTLLSTLVAYGMTTEVNLHQTARPLLNWPVSIGPSGPMRARIRIVLPGNLAPIDGVTAYTPLWRTAATRTGWLLLYAGYQLWDPTEAAPTSASIAAAWRAGTLAAARLQIRRPRC

SEQ ID NO: 13349 - protein, 202 aa, Actinoplanes utahensis
MHEKAGQERFLDADEAFLIPRLADLAGRYAPADRDNVLMLAGRIAADLDEANWPRYAEAFATMHRLADDWLVTPIDPGSFVYRLQAVLALEGDEVWGAELDRIGNDEVEVECPQCTTSLFVAFGKDGCFATHEDYATKPDVEQTPLLPAEPAELTGVGQRLHLMSLAAGQQSVAAALTYLFGRATCTQCGTTFRVSEQVFRR

SEQ ID NO: 13350 - protein, 158 aa, Actinoplanes utahensis
MTDVPPLRIRVYQPADLLVVHELNRAGLAAAGVPADADVYAGDLDDPAATYLRGRAILLVGEADGRVVAMGALQEVDRDSCEITRMRVAAPVQGRGYGRSMLHALEDHAVRLGYRRAVLLTGPDQHPAIDLYRSAGYTVTSWEQHGLIPGIRMTKSLP

SEQ ID NO: 13351 - protein, 557 aa, Actinoplanes utahensis
MHRGFAPGSGRGRLAGPGPRRLGGLCEMVPADVRPHGERTRDRRDLPGRIPHLAAGGNRCPRTVRACCRPCGRGGGGTCGYRNFSRHRAGDSRSAASVTAWLGGVVNTLTGQMSMPHSPRCRCTAALRAQATTDGWPLTALVDTIIQRCGHSRLRAQRLARGWTSSDLVGRLRQVLGAGSRLAATTVSRWETGKERPSPASLQALFTIYDTDLAGIDCDIRPIAATSLTPAGPTADNADVLAAADELRRNVDATLSATTVSDATIDHLLQVADQHGRLYKTDNHRPVFLADLFADLEEAWRLADRKLPTGQRRDLCVVIAKLAGLVSMVAVNQGRYRQARQWLHTARLAADETAQPVLRAWVATRAAVTALHLGDPVTATTVAAEAEMLTRRHPSRLSAMAWAIMARTAAVTGDADTARHALQQAQHTFPACPDGPEMGNTANTFTLGQLHFYASDAYTNLGDTRAAMQAQDQALAAFGPGEMLDPALVQLDRARCMVVAGDIGGGVTHAQTVLLDLPADYRPAIILRRAATVVASVPAQRRTVTAARDLHAVIAGR

SEQ ID NO: 13352 - protein, 231 aa, Actinoplanes utahensis
MHPSLPPPADRAVTPAAASRTLPPARFAQAILLNPGPAIRALNRSTLPAGQRLALLAEALLRLGRTEPAITAAIQAVTVVGAQRPMPATDLLAASTVCTDIAVWVGDLGAARACTTLEQLALDWDDHPRRFLAVALRAVALYQHTSCRTGLALLDRLTGFYQARNSSDPIGQTLTSTVRLMTDICASSHRPPAPLRADPVPGGLLHPDITHPNAGYLQSRLLRHPGRHTCQ

SEQ ID NO: 13353 - protein, 319 aa, Actinoplanes utahensis
MKWDGFRTIIWRNADGVRVQSRHGTDLTAYFPDLVGPLTAALPPRAVLDGELLVWDPDRGRCSFGLLQRRLVAGRRIAEVSRKHPAHLVAFDLLRDGRGTELLDQPLSVRRAKLERMLRTAPPQLVLCPQTAVPAVARGWMQDLGTAGIEGVVIKKIDERYRPGTRSWTKVRTRDTAEYVVGGVTGTVDHPVTLLLGRYDRTGTLRYTGQTHPVRPEHRADLAAVLHALVFRGPQAGHPWPIPLPTAWTARFNDRRPLTYTPVEPTAVVEVEVDTAIDGPFGRARHGARLIRVRMDLRPADITLEQTASGDRVGSAAGR

SEQ ID NO: 13354 - protein, 203 aa, Actinoplanes utahensis
MAPSAQIVTLPAMTLRIEQPHHYDPVGAVHRSAFGGQHGSTVAELVDALRRDDPAALSLVSEQAGEVVGHIMFSRALLDAPRQLVAVQSLSPLTVAPQWQRRGIGSELIRGGLQRLDEGGIPLVFLEGDPGYYSRLGFSPAVEQGFRKPSLRIPDEAFQVVKLSAYEPWMVGTFVYSNIFWEHDCVGLREATHSDMGVLSGTE

SEQ ID NO: 13355 - protein, 39 aa, Actinoplanes utahensis
MPHSSGPVEGNVNRIKMIKRQMYGRAGFDLLRKRVLLSA

SEQ ID NO: 13356 - protein, 157 aa, Actinoplanes utahensis
MIVGQKPRPSSLDPFKAHLLRRISEGCSKATVLHREITAQGFNGGYGIVRAFVEQHRARPDLSVMVKLPSVREVTGWICRHPDHLVERDSDRLRALLDRCPELATAADLVRSFAGMLTNLRGNQLSVWITAAQQAALPGLTGFATGLTNDLDAVTAA

SEQ ID NO: 13357 - protein, 140 aa, Actinoplanes utahensis
MTCCLAVTPPRSPSGSPNTQSRRSSAGHRASAYVEGARTGAPDAVQVADRFHLWQNLAKVVERCVARHKDCLREPVTTPGGDRAAAAEVPEPRGAMAQRRREHHQLVHGLLAEGAGIRQIARHLGWGRHTVQRYARAATW

SEQ ID NO: 13358 - protein, 82 aa, Actinoplanes utahensis
MAVGLTGALLIAVNRSVLLAGVMMALSLVPAAALGGYALVVGDPATAGGAALRWVHDALIVFACAYLVVGIHRKRQRRTTQA

SEQ ID NO: 13359 - protein, 51 aa, Actinoplanes utahensis
MVTGLVLRLIGVDAIAGGERFLPAGFCCTIGAASPGRKLSPRWLSASPVPC

SEQ ID NO: 13360 - protein, 205 aa, Actinoplanes utahensis
MALQELQAMQTAFELLSPLDASAQQRVLVWLSAALADTNGGPVSADNPGAGMPSNIASEDVVAGTPTQYPGTLPGHQTLAPVAAAGERGAEAEPQVAAEPGSGPVDEPVSAARPARTRAAKSTGRRAGKTGKASAAATSAPVVRTASGRRSERPSGEQFLTDLNTLGSFKALAEEYGKSIGTIGNWANQLREQGFAIPVGRQKKA

SEQ ID NO: 13361 - protein, 94 aa, Actinoplanes utahensis
MESAGALWLQDGPAIAPELLKALPKYLADDLYAPQALRVLALMGPHARPILPYLDRFLASRQRVDLTLGDLDADMRADDMLLAAMSATREQITR

SEQ ID NO: 13362 - protein, 223 aa, Actinoplanes utahensis
MAVTAHDVAGSLPDIATLRERCRALAVLEAILSPEEESRYYSFTSAWSEGEELASMDNGSGDAWSIVFSPAGAFLWGFDHESSMSPAVNNEELWPGLVDTVPDVFSAAVNEPAFSYEGTLEATVCLWRQTDDDRWHAGDIDFPDRPDPDGAERLFSVLLDPTGLAYHRFAEDYYGKAVDLDAVREILALSPLTTSLVRRLNADRSTAALIADLSYIGYPSQLA

SEQ ID NO: 13363 - protein, 58 aa, Actinoplanes utahensis
MLVHQYAYFALSSNQVSAAETTARLLIDPDEVVIRGSRHVEPVRPASTAGRLFAASQD

SEQ ID NO: 13364 - protein, 97 aa, Actinoplanes utahensis
MFIVLLRFTENKAAAGEHMPGHQQWIKQGLEDQVFLLVGGIQPQLGGAVLAHNTSLPQLQQRVDADPFVIHRVVDAEILEITPGATDPRLDFLMPVG

SEQ ID NO: 13365 - protein, 357 aa, Actinoplanes utahensis
MSTGLFEPFPLGDLTLANRMVMAPLTRNRADHDGVVTPMMVTHYRQRATTGLIISESTPVSAEGVGYPNTPGIHTEAQAAGWLRLTEAVHAESGRVFVQLQHCGRISHPSLLPDGSTPVAPSALRPSGQTFTPSGLQEFVMPRELEAHEVPEIVAQFEHAAKRALDAGFDGVEVHAGNGYLVDQFLRDATNIRTDAYGGSPRNRMRLLNEILDAVCAVWPAHRVGVRFTPENSFNSMADTNPQAHFRYFLEQLRTRDLAYVHMLEGDMTTKTSALDYRALRDAFTGTYIANNGYDLPRAQTAIRDGAADLIAFGVPFLANPDLVRRYRDGLPLNTADPSTYYTGGPLGYIDYPTYDA

SEQ ID NO: 13366 - protein, 188 aa, Actinoplanes utahensis
MGGVKATREQIIEAADRLFYQQGYEHTSFAAIAEAVQISRGNFYYHFKTKDDILAAVIDARLAERRRMLERWETEEPTPAGRIRRYIEIPLTNRADVQMYGCPVGTLTTELAKLNHASFAEANSVFTLFRTWLREQFALLGHESEADALAMHVIAFSQGVATLANAFHDEGFIWREVKQMSDWLTAYE

SEQ ID NO: 13367 - protein, 538 aa, Actinoplanes utahensis
MARTDGVVRRTGNPAGRWFADLPVAVKIFTAVGVVAAAAVAAGLLAIASLAAVYRSGEAIQQKSLVPAVQLAQLRQQALTARIAVRDVALLADKKAAQAKLDAADKAVAAAAAAYRADANDPAGVDEFTQLWQQYVNVRDTQQLPAALAGDYPTFEKVATTTANPIMTKVMAALDTAGAAEQAQGVARVTEAADTYHHARTNLIILLSVGVLVGAIVAAYTVRCIVRPLREVGTVLTGMAGGDLTGIAEVGSRDEIGRMAAVLTQATTGVRETVRAVAETADGVASSATQLAATSTAIAGTAEDTSGRSQSVAAAASQVSASVQSVVAGAEEMSAAIREIAESASDAARVAASAVDAAASASGTVTRLDASSAEIGNVLQLITAIAEQTNLLALNATIEAARAGDAGKGFAVVASEVKDLAQETARATEDIAARVSAIQSDARAAAGSIGEISRVIEQINQYQTTIAAAVEEQTATTAEIGRNIAQAAIGAGDIAGTIGGVADGAASTSAGMTEARTATAELSRAATGLQDLVQRFHY

SEQ ID NO: 13368 - protein, 87 aa, Actinoplanes utahensis
MTIPGYDYAQPTEKSLLTALTASVGADAARALTDLAVKKAGRRTSASTDDLVKMTEYLMELGDLVRVTARSEKIRAVTYRALHDTVK

SEQ ID NO: 13369 - protein, 170 aa, Actinoplanes utahensis
MSAAPAAHTLTDPARMRVLAAIDFDNPALRAGLNHVAEDTAQATGMPISLVTLVLDTSQLFAGSTSLDGCWIAAAGGTPIEWSFCVNTVTTGQPYVIPDMAASTHAANPLVTVDNVASYAGVPIVLAGQTVGAHCIIGVTAQQFTADQLQQLHTGAQQAGALLQQFSNLT

SEQ ID NO: 13370 - protein, 341 aa, Actinoplanes utahensis
MRRALIIMASASGTPVPAIASLIAGHEDTVRDVIHSFNEIGLRALDPQWAGGRPRRISDDDEAFIVATATARPSTLGRPFTCWSLRKLADFLATDATREVIIGRERLRQILRRNQVSWQRTRTWKESKDPDFDAKLDRIEEVTTRFPARSFAFNQFGPLSIRPHHGRGWAPRSHPDRLPAAYHRTHGIRYFHGCYSLGDDQLWGVNRRRKGADHTLSALKSIRKARPDGAPIYVIMDNLSANKTPTIRAWAVRNKVELCLTPTSASWANPIEAQFGPLRMFTMANSNHPNHTVLARKLQKYLRWRNANARHPDVLAAQRRERARVRSERQQRWGRPRTKAA

SEQ ID NO: 13371 - protein, 217 aa, Actinoplanes utahensis
MGAIAESSGAVEVCLQQIFVALMGTRRASVVASGQNAGWLVDNCLAVLREPSFSHTEDTRELIKVLVRAPDVLRSRNDLLHAFWVRHEGGDARVNTRYRKAPTLKSVETTEPASAAERLQILEKLLADLGYRIFGDKMSWHSVAVGCPESVTYTVDDLDPDAAFRRPVPGSSRPAREPTVLELKRRAAQIREIVEASKIPYRLDLPDRHEEKCFWIL

SEQ ID NO: 13372 - protein, 159 aa, Actinoplanes utahensis
MGNVRPEREIPLARATYVAAAGRYLNAVRNVAARGVPIDPGDPVREWTAADAAAREIREELGLDLSPGRLLVVDWVPAQPDGRPPLANYIFDGGQLTADQLHNLRLPADELTAWQLTTAAEWPRLLAEHLVRRLHACAHALATNTTAYLNHGWHPTDPT

SEQ ID NO: 13373 - protein, 168 aa, Actinoplanes utahensis
MARTVMSRLVRTVKIIVALLLLVAGSAGCSLFGDDAPTRDEQIQKILDENAEFTVFLRDDATDAQRNDVEAALRALPGVTEVSYVNRDEAYQQMTKLFSADPASVADVSRDALPESFKVKMSDIAAVRQIRDEGTVGKLPGVERAVFTCLDVQECKKMSTPGPTGSPS

SEQ ID NO: 13374 - protein, 177 aa, Actinoplanes utahensis
MGPAAWWLEAGTLVAAGLVLFGARSDLERTAYLWFAVLGVVLACVDIAVRRLPNLLTAFWGAGLLAGLLIPALAQHRFTSWLQALALGIVLTVLFGLVALVRPGQLGWGDVRAIGVAGIALGWLGWAAAYAGIFLSFTFALIFVILRGRAHRKQAVRFGPFLVAGAVVVCALMPTVQ

SEQ ID NO: 13375 - protein, 184 aa, Actinoplanes utahensis
MRALYALRVAAAATVLAGLAGCTHKSAAAPIPPPAPTSASPSTDPAVAAASAEILDRFRSFRQAYDTAGLTADYKSEDLTRYLEDPLQKDVVAFMLNTKIHGAVYRGEAQSTPTISKIDLKAKTATITECYDTTKFKLYFTKNNSPVPVPSGPRRGIIETLAKDYGGKKGWMFYKSQALTDPTC

SEQ ID NO: 13376 - protein, 291 aa, Actinoplanes utahensis
MLARLVQVTVLVAALVAGTLAAPALADDGGGACSGWDCGSWGDQPGASGGTGSSTGGGGGGDGGCNWLGMPVPCDGGSLGWYDGKSCYLKPVAEGPAGDSHGGTGFWYWATCFTGVVLGGGLGAPVLRWYPTAQGPSPEELARRALATITLKPPTMGVDTAGLVFTPVWLWTAKTPNTWGPISASASAAGLTVTITARASQIVWQMGNGDSVTCTNPGTAQKAGEADRRSPTCGYDGYPQPSRTRPGGKYTITATTSWRVDWAGGGQTGVIDQTRVATTTVAVKEAQVVNQ

SEQ ID NO: 13377 - protein, 230 aa, Actinoplanes utahensis
MSLTDTRTSPAPAGPLPLTGAPAARMPRRRRPGLLAAGIVVMVVATLGAYTYARTAGDTVPVLAVATTVTAGHQIAAGDLKTVQVNRGSGLAPIPADQQSTVIGKYAAVELVDGTLLTAGQLTDKAVPGAGKQLIGLELTPAQLPARPLHPGDTVQLVVTSDPHNVTVDPKAAAQDALPRPVTVPATVAGVGDKATDGNTVVDVVVAEAFGPGLVDRAQQGRVAITVVAG

SEQ ID NO: 13378 - protein, 268 aa, Actinoplanes utahensis
MSLIAVVAGKGSPGATVTSLALTLTWPRDVLLAECDASGGSVLTGYLGGQVPADRGIAQLSVADYHNRLYDAFSQQLRSLTETAPYRLLLPGTTEPGQAAGLSRLWDQLGQYLRDLERSDPPVDVIADCGRVPAPHAPLPLLRHADATLMIVGRTLTAVAAARTRLPQLQAEVGKGGGVLRLLVTGAGDYDAPEIAKHLGVELLAELPEDGRTAGMFTNGTGVPRPSATLLRAANSAAAGLRTLIEQRRAAAAPTPVTPSASREDSYA

SEQ ID NO: 13379 - protein, 507 aa, Actinoplanes utahensis
MPDRPPLNLYRPVEPRRPSPRPGAGAPAAPARTLPSLPSIVTQLPPPPPLPAQGRRRPPVELDYEVVLALHSLVSDRVSDNLRGRQVGPDSQRQLTIETTREVVREHIDNRIQAGDQIPLGYEDALTDAVAAQLLGLGRLQPLLDDPQVKNIHVSGHDRVRVEYADGRVDEQTFTAAGSDAELLELLQRRAARDGLSERSLSTSQPILHLRLADGSRMVAAIAVTPRPVVVIRRHRITKVTLDDMVKLGSITPLLADFLKAIVAGKVNTIVAGLAGSGKTTLLRALASEIDREEWFAVMETERELALDPQRHPWAVEFEERQGHGERDAQGRPEGELRLVDLFPAMLRMNMQRVVVGEVRAAEIVSMLDAGATTQGTLSTIHARSADAALTRLAELLLRYGATPTPTGAYMQITGAIDLLIFQRVDKRPGQPDRHYVSDVIELNGLADNGLSVARSHLFRAQEPGGLAMPTGVRPNDHILQALSYGGFDVQRLFPETAAAAGTPWGR

SEQ ID NO: 13380 - protein, 293 aa, Actinoplanes utahensis
MPPLMFALLAAAGVAGIMLIVAGAVGTRPAPARPDGRLQRARRYWRGANLSRRDRLTRQIILVAAAAITVLVWLLVKIPLLALLAGLIVLGVRWLFGAGAGEQRAIAQLEALESWTRRLSDVVRTGLGLGEAILVSTRDAPQALAEDLQLLAAHLRGGVTIVTALDRLADRLSDATSDEVIVALRLHATDRGQRLSDILDELTASVAREITVRREVWASRADPRLTTKIMTCLGIGTYVLLVTNPTYIRPYATLMGQAVIAVCTGVFLALLIWIRKLSTTRKAPRLLSTQESR

SEQ ID NO: 13381 - protein, 288 aa, Actinoplanes utahensis
MSVTIAAVFGVLFGAGVYLLLRGAVPAAPRLDLALQRLYATPMPAAGEKDSPIARWLTTRIGPRLRIPTRELRLLGKSTERYVLEKVGLPVVGLLFVPVVTVAVDTMGLHLPVVVPVAGSLLLAALFFLLVDIAIKQQAEEAREQFVRAVAVYLSLVALERSAAHGPVESLERAAQVGTSWVFVRIRETLAAARIAGIPPWDGLSQVADEIGVPALGDVGDIMRLSGNEGAQVSQTLISRAQSLRIALQTKDHDRANTGTTLLYGTGSLMVMVLFVLVGYPFLIRLLA

SEQ ID NO: 13382 - protein, 210 aa, Actinoplanes utahensis
MNSPRPTRQGVVHVRTRCLRPDLGEGPRRGVAPRRRGAVGRTGRPDRLRAGGGPAGRRRDHRGGPGPDRQHHLSCEAAANRRRSWWSAAARDDGAASLEMVVIIPTALLLLFLSLQVAMWSYARSIALTAAQEGLTAARGYNSSAAAGTARAQDFITRAGGDSLTGARVSVTRTATQASVTVTGSSLSLVPGLRFRVSQTATGPVERFVR

SEQ ID NO: 13383 - protein, 139 aa, Actinoplanes utahensis
MTGWWHQIRRDDGTIGLFVAVAAFGILAAIGLAVDGGGRMRTLQHADDIAAEAARAAGQAVDLNRAAATGETVVDPQQAITAGEQYLSAAGVSGTVTISADRQQITVVVTDHYDTIFLGILGYGRLPVDGHGSAQLLTG

SEQ ID NO: 13384 - protein, 1103 aa, Actinoplanes utahensis
MASRALRRTRQIITGVGALLLLLAIIAGAPAALVWLGGNPLPDHLPALGQFSDALLRPDDGTLFLQALTVAGWAAWAWFTIPLLVESVARLRGVRTPRLPAFTGAQKVAAGLLSAIGLLVASPAVAASGPAYAAPLTTTSTAATTTAVADQPGSSPLTTSTPTAHHAATARPQTAPLVYRVAHGDQLSAIAARFLGNADRYPEIARANPRLEHRDHRFPDHIEGNWRITLPAGAHDRGAREHAHGSVVQPGHPEHTPTPATPPSSAPAPSRPAVPQSGTASQPATAPSDTSGAGTTRTATPTTSTSATGRPSTAPATPPAASTTAGHHTSPTLSASTPSAEQAPTRPDQAPAAGTDESVDSSQIVTGASLAGAGILTALLLTGLYRRRRTQRQHRRTGRRLPHPADGTTERAMRAAEQPADVDRLDAALRSLATGLTGRPEHELPDIAGAWITTGPGAGHPLTKPVVSLILTRPCPNPPAPWIADGTAWTLPADADPGEPDDLLAPLPTLVTIGSQPGQHLLLDLERLGQLTIVGASDNTAALLRYLITELACNQWSDDAEIIIAGFEPDEAELLAALNPDRIQASTAVPTATSRLRRRCAAVTTALHAAGVADTLTGRLTDIGEAWAPHVLVAADPSEHDRTELDELGQQLTTLGRCSVASVVATTTLGAATDNGHVLTLLDNGVLQITLADGGAPFLAATIRAAALPRTELAPLADIMTQARSTSDEPVPAAPEPEPWAQGTDAAGSLLPHHLFAAEPSPTPPTPAVDPAPPQPEPEQPADSLTEPGTAVDDPITSIVLVDTRQPARHEPPTIPRQQRPPVDGDLDADLRAWHNQDPTRPLISILGPVAVTAPGTEPDRRRFYAEIVVLLAGRGTRGITGDQMSDALWPDQQISPSSRRVAIARVRRWLGDTPTGELWLPDMGPDRLYRLTPGYLLDWHLFRRARARGESQGAAGIKYLRAALELVRGVPFDGADRAYAVGARNPYAWLPESDLYPGHIVSAVVDTAHRLAQLYLDIGDYTNARWTVQQAWAADPDRGDDGPWQDLMRIEHAENNMAELRTLVGELMRAREAEYPEDLAPSTYTWLRTLVPELLSSGTFAG

SEQ ID NO: 13385 - protein, 132 aa, Actinoplanes utahensis
MRYLTRQFAIGALRRGNGIEQFLGGVQIEDEPAIRWVEISPMNRQYRVSLHTVQDLDDDRVGDLPNLISLDPAEEEYVGEGRELGVTDDGAEAMSLAERLTDARPDRWVNHAVAGEEYMDYVRSRRGPTQAP

SEQ ID NO: 13386 - protein, 180 aa, Actinoplanes utahensis
MATWVNVYDSDDPWDEDPPILGSFDYDRVLRFDRLPTPVGSSRAGIGTTGDNAYEIINTEYLLRTACGRWVCEHFFQQPPGEPKINRWFYNDEMAATWLRSRNLQNVVEHYFGTPPPMPPGSQPSPDGDPIFFQPDAETSSRIDAYATASGFDRRYGMYWLLLQGLNAAEAAAGPENPHT

SEQ ID NO: 13387 - protein, 208 aa, Actinoplanes utahensis
MGSGGEHPYDGRHDAARHPCHPRRGHGRARPAGPSGWAGQGPPHPRSGSAAPRAGCPQGRARATAVRFARHVTESETPVVSLVLDTSAIAAWVRGSAAVGELLAEIDAEGGKVVIPLTCLLAAASQITTDREWLYLLLDHPTTVLISDDPEDWEMLSSTISLLGTADLASAAWIALDWNTEVLTQHSDRYAKLAGGNLALQIHDYFDG

SEQ ID NO: 13388 - protein, 114 aa, Actinoplanes utahensis
MTVSIVVVSSDVAFWKIAEGDPGDIFDGLADGITERLEPHSDVAWFRGELLSRWPDLVNVLEPTEDDLLDVPEDSAKYVLLTLPVRMLDRLDSIFDLAQKYGLSGYSGVAGQAF

SEQ ID NO: 13389 - protein, 188 aa, Actinoplanes utahensis
MRLTAGLHRDALAEHAGEVVSLYRAPDGRLTAEIGTTTSDTRRHLAIEWPTGLPDGWTDDTRIAADDPGTGPALVVALTPDPDAGGLRTDLLPNPGHEPRYTWGYDGGNPRMLYAALVRCATGRWDHPLASGTMVARISRHPETSPLYQTISTHRGPLRLRWHDIRSQIHQQLQALRNPAPADDEDPR

SEQ ID NO: 13390 - protein, 125 aa, Actinoplanes utahensis
MTIYGIIVVILLLAYTGIVWWAVDAVTAEAILVQTLIAGAGLCALIGVVQILLHAGDGPVPNFGAVWITAAVLIGGALVIFGIALRIQRHKDRAIELPRYDHDVTWENATASDIEGMRDTSYPPR

SEQ ID NO: 13391 - protein, 151 aa, Actinoplanes utahensis
MGKRDRLRHRGHARHFISTALTDSPQKATMNLFTVTSGILLGAPTAYTGALALSRAVATLAEITATRHEVSGLPTEPFAARVHADRRRGVAVAGTSLALVAGIALGVVLAVTVADLFWVGISGAALCAIAYWAAVRPRQTALRQPMSGADG

SEQ ID NO: 13392 - protein, 158 aa, Actinoplanes utahensis
MAPEPGRWSGHDYAGPVEPDCIGHFDLAPWNIVFDGEQVTGIIDWDFAAPTSRAWDLAYAAHQFVPFHPTEALAAWGWDSEPDRAGRLRLFTQAYGAPVTAAELVDLAAMRLLSIGAHIEDRIRADDPAFAVHQAEDHGSGYRAAAAWILTHRAQLLG

SEQ ID NO: 13393 - protein, 119 aa, Actinoplanes utahensis
MTDAVQRGRFAAPVRRGEAVDRAAGPGAVDIHALLTHLHDHGFDLSPQVLEVSDDGARETLSFLPGDTGYPPLAAALRLEQALTGVAGAVPAAARRDAGLRGSGAGPVERPRLRRPGRA

SEQ ID NO: 13394 - protein, 130 aa, Actinoplanes utahensis
MRSSPRASAAVTALSGPSSNSTGLSGRTYERRPGHCHLARSPAGSAGTPTPSPSTTSAGCRPSSIAVRNYAPLQTSSASFGEIMTHRHGHRLADWINTAEQAELPGITRFVNGVKSDLAAVTAGLKATCS

SEQ ID NO: 13395 - protein, 230 aa, Actinoplanes utahensis
MYVRCNRRRLHLGGTKFPDDRLSCGAMGSTYQTLLVAADFDATVDALCDAGVVGVVVPLAEHRVAVLPKESEWDQAPVRSIGEGLSVSLSCPALAMSVFDSDLLCCYVIRDGGIVHTYINDVEMTVEWVPEEDGQFHPMIDGVVHSVDFKIPKGPAGDDPAAFASFAVGVPDLNAIAAALRNEGTSAHVMAEVQHEELLAALGLPSRALTTAYRHCEPAVFPDAIVLELE

SEQ ID NO: 13396 - protein, 195 aa, Actinoplanes utahensis
MDVADFWRFVERSADAESDPNRRALWLEDRLSRIALTHVVDFQIHLDAARRPIDTYDMWAAANQIMDGLCSGDSFWYFQTWLIGQGRRWWQHAARHPDNLVELPAMQALAGSQPGEWEDAAWPHWEQLACVASNAYDRVTGEEEGIDDALLDRGHIRPFDPRPDGVPWDSDSLAAISQRLPRLSRVFPRRRYTKP

SEQ ID NO: 13397 - protein, 131 aa, Actinoplanes utahensis
MVWDDHDPAATITLTAYVDVDSLWKPDRDPEALWYPEDDPADALYAAKMMAPLNRSGSRLGSEMLDWAAGRAWDAGLTWLRFDAWTTNPRLHAYYVGLGFRHVRTIASRVSGACFRRPSQPYHGYLKTDGE

SEQ ID NO: 13398 - protein, 129 aa, Actinoplanes utahensis
MRCYSAGDQLLPCGAREGRSPTTRKPSNRGPPRTRVGPTVGDRRLAKIRVAQLYARDLEAAIGLLLTAPEAQPLLPPERAPHADDLIAHQQLTARLTTYLAHRRGIRVTLWTTLVVVPTIALALILLLR

SEQ ID NO: 13399 - protein, 137 aa, Actinoplanes utahensis
MSEVDPSALMSLAQELRRSLGDAAETQRRVLSVTGSATSPDGLVTVVVGPRGQLVDLRIDPRVYRRPNAGALAATILATARAAVEQAVEQTRELVDARLPKIGGLLASGAQRPLGVRDLMRAHDGDLSRVLDAGEWS

SEQ ID NO: 13400 - protein, 356 aa, Actinoplanes utahensis
MPVNGRERPVMPGAWQAMTVIHPGSAGLRVRYRQGVLIDAAGFPDWVLYARTVVELPAPIAELTGDEHRVFDVLAANRVMLGADPLWPDLRVGLPHATATPPGWCWARLPVSGERARRVALVPVELHGAFRHGGGSRTLPVGRPGSGVRTGVAPVERGNGEVVSEPIIAEVEALLGYGLPPAYRRFLAAGNGVGPAEPAVSAVAGMVVDQPLFGLGRDDMLQDLGYAPRWLGDRFTGEFLPVGFVQGGILAIRVAGPDAGSVWFFDDDDPRDDDSLGPAEICGRLLRRCAGDFDEFWAGLRRPAAVLLEVVEDLVAGGLVREVRPELAGAALPERMRAEWQAVPQQRSISVDDLML

SEQ ID NO: 13401 - protein, 391 aa, Actinoplanes utahensis
MGGAAWAAANSAERRLARAWADDDADRFADVLLHADLFLPGFADDGASGQRLLTRERGGRTFLLVYTSVEALQEAIPAVGVGWRRTTFAELAGSWPNPAWGLAVSPNTPIGAYLDAEQVRLLGEEVAAEPPFAPGGERERAMRAAQRAGDAEVYLDLLVTADVLLPLAGPAGADDLGKPGFPWLVQRAAGVATVPLFTSRQRLRDVWPDSADRPAVVEVPLLSVVRAWPGAAYRMVVNPGSPMIAEFTGAQVPDLWRWAQELVLRRTSASQSGSENEPLAEQPVVAGPRMRRVQALVDPSVALGWLAAGGGRISASVGPAGAVGILDGYLVRWHEDETLGAATRPVVELELPYGAQLVRLVAGQEIVVATYDAELSWWRPSIMSVLRGEAR

SEQ ID NO: 13402 - protein, 81 aa, Actinoplanes utahensis
MSSYLELPEGTEAVAQIGARLRAQAQDFKEQARQILGDIQGLDQGQPWGNDQAGKAFAEQYHKPVEGAGSLALAMQDRLPS

SEQ ID NO: 13403 - protein, 1165 aa, Actinoplanes utahensis
MRGGIRDAGADLRLRLGENNALGELGTPGAEAGVGSAGDIGSQAGTRAAGEPGFEAGPRPAADHGTGGSEQTSTSGGSEHSTGSSGADQQARGESGDRASTEPGQRSESTGGVQQAEPGGGPQRAEPGTGEQRSGFGDTARDESPQASGKPEQTSAGQSGTADRGDQRVVEPDGGGRQETGHPDRFPEAANDSDTGRGDMSAGSDRAVPERAADGSDGVADPGREAQRLAGADNSHAREVHGDSREGTAGAGRGAPALHGARFEGADGGRPAEAGVPAYGRHAEIGGPRIPEPAAVRSAVPETAFSGGEPARPVAPEPIAARTAEIGRSDLSTPRPADLAPGETTSPRTEGPTPRIAGPDRPPGEPASSAPGRDPRGDTAGTKPDGSGPERPARDNGNSRTATGDESRDQGDRPSQRDDGHDDPRRRASDPDGRRWRDYARRIQRWSENRAADQAAMDRALFRRFKPEQDGTARLRPETVQRVLDTPADRLDGTGQRFKQMVEQHFTDPAFKDGQPVRRSASPDDIAARLGELRTSRPPSLTGRLLHIDKLRDALPDWPRRLPELDPIHSEHVIGGEYHGFGRPADTVSVGREIREAVPEVLDRLFKNVDFHRPEDGGPDVLRTGDGRDIKVDFGAESMDRKHVGTSERDRRGGMWRVRANSGTKPEHISTVTSHELAEILQKERLRAAGERFPPKKNMLSPKDTGARELSPDDHGRIAEMLDWHERSLTGEAGARDRLGELLDHLGLRGDESRAVASRQAVTDLLGDPSAHHFSDGAAARFNDLLNGPARDLPPAPSVRTFTEADLKLPPTDVPRPPWMDESKTILVEAHQQTGQSLRYHVVGDAADTFRTTDGTLQKYGHGRPEFLDDPFRKAKGWDVTAEKDKLPELRHDPAAEHTGQIAGDSKQYHDLADPLDRAARDRAAKMDDLNAVLDRIEAQTGQPAGSLRHVTADDLGRRSFAKTRSSLAPLAIEHPELRSRIEALQDAVDDYADLHRDRGMASNRVGMIAGREYAKSLGVPEGDIHGEVHDDPKSGELDVWGVARDEHGNATRLVVVEAKGGSAGLDGRERLQQGSGPYLERVMQLDKKFQLFLRAHSDIAAGLRSGAIRVEYYLVSQPHMPSRGTVVPPAKVSQFRFHYRDVDQDFGDDLNVFDPRNIGPELPE

SEQ ID NO: 13404 - protein, 154 aa, Actinoplanes utahensis
MAAWQALDEEQVLRAAQELLSASRLLATPAQEAAAALGWTVTDFTRRSGLLDSGYGLGPYSAYFAIDRQGRLEEVILNICERIPGSSPEIDAFKQDTFAAAASVMTGVYGKPTDLQPGKEPELWWDQGEVTLRLITTQDTVALQITPTELLQEI

SEQ ID NO: 13405 - protein, 152 aa, Actinoplanes utahensis
MAGEDWEAFRNGLARSLAVLPDGGALIVRDQQRTVCFVQFLFNYDHIRAEVASGWDLTHQPNLTPEEFAAIERIGWLSPVHDHTLNHGLNIAWPAPSAEYRRVADISVVTLRDVFLVPSPASLCYQSFISPGNRPLLMHSLGIPLQEGKSGR

SEQ ID NO: 13406 - protein, 161 aa, Actinoplanes utahensis
MADWQALDEAGILQTAQRLLSAEPWLMTTSLTDMAARFGWTVSNFNPDYPTLGAFIDDGRGLGPESGFVRLDEQSRVQHILLSLTESVAEEGPDVDAFLQDVFADATAALTGEFGRPTPTVYGEEPQLWWQRPATMFGLLTEIDAVSLQLSPNELMGGEWE

SEQ ID NO: 13407 - protein, 150 aa, Actinoplanes utahensis
MDWPAFRDALARSIATLPNGAALIVSDAERTVCYVQFLLDRNTVTAEVASGLDRWDRPFLTEEETATVEQIGWLPPDNPVVNHGVKLTWPTRSAECRRVADMSVAALRDVFEIPSPANLRYKAFKVAGGAGVPMPKLGIPARKDQPPATR

SEQ ID NO: 13408 - protein, 43 aa, Actinoplanes utahensis
MIRPGKISYLVVQASETGGIEVTGYLTDETVLDRATIQMAGSQ

SEQ ID NO: 13409 - protein, 157 aa, Actinoplanes utahensis
MTYRVIDGQALKDMLVVIRETDWDWSATATPGLLAQLGWDVIEELPGKGLEAETHLGVEPSTVVLGFVDGKVDTLMVSLTDLLPAQETALRQDAFAGCVSQATGILGAPTDRRPGVSPSASWRGPIATVEIRKVDSGVYLTWTHNAFADLVRSVEED

SEQ ID NO: 13410 - protein, 130 aa, Actinoplanes utahensis
METTDWGTLTDELVQHMFEMAEGDVLILSYGAHYVQMKQGPRWLSIEAVANEFLPDEVRLDEAGQRRLTELGWAAPDPPASYNWHQDTAFPIRSDEARRLATMMAVTLDEVFRVTHPAELSRDEFNVRTV

SEQ ID NO: 13411 - protein, 105 aa, Actinoplanes utahensis
MVKAKGGIVGTGGRGRLQQGSALYLELTMRLDAKFQAFLRDNPVIAENIRIGVIKVEYYLVSQGYAEASGVPDAKVYRFMFDGVDPGNVFEPGNPDVPRARSMRR

SEQ ID NO: 13412 - protein, 166 aa, Actinoplanes utahensis
MTEVGMVQWREVDEATVLRVAQTLLSLEPLLLSASVQEVAAKAGWTVTRFDPERPNRSAFLDTGYGFGSRSAFFKTDASGKVTSILVSVTEEVAGGGMAADEYKLDAFAVAASALTSAFGKPDRPRPGEEPQLWWQRDTTWFGLITEHDGVSLQLTPAERMVGEWS

SEQ ID NO: 13413 - protein, 153 aa, Actinoplanes utahensis
MTGLDWQTFRDGLVRSIASLPNSGALIVGDEERTECFVQFMLDYDHVVAEVASGMDPWDRPNLTEHEAAALEKLGWLPPPELQEHCNHGVKIAWPAPSAEYRRVADMSVAALRDVFGIPSPDSLVYKAFVVSATGDPLQMPRLGIPYRPDWRS

SEQ ID NO: 13414 - protein, 161 aa, Actinoplanes utahensis
MSNQQPPAINRDLVTTLTAAALAAAAPEELTILNEIAEEYFADPDAVLNPRRRDEAVGFGVDLALLAPYALAIATPVVHFLIETASSEMQNAARPLVAQTVRRLLRRSAGEMDAPSATPLNSQQARRVREIAYDRARQLDLPEAQCVVLADAIAGAILVSA

SEQ ID NO: 13415 - protein, 765 aa, Actinoplanes utahensis
MSDPDAPSSTGDSPTRPNGPRPNVLACPSPTTARFILLVVATLATGLFVGVFVHNMVLGDRWQREVVACASGLPYAEAEGADVLTTWQAWAECTADAEHRRAIFAFAGLAVAAVAAFVIFKRSPRRLERRRRLRPADERFAAARQRFTELSHAAGLTRPPTLMIGPATQRDAFSYGLPGSQRVVMPVAALIRPQCPEFTALAAHELAHVARRDVTVAWAAKSIGYAVAPLLLVPALLAVLTGELSLLTDYVWRAVLLGAVVTLTRAAILRSREHDADLLAARMGSSVPELSAVLAQMPDMRSRHLRHLIANHPYAHRRIAVLDNPASIARASFVDAAAAAFLAGLMPYLIDLVVVPLLTGTAGVGVTDLVAAAVMGPLVGATIGLASWRACLVSRVSGAAVHRGPVAAGVLVGFLLGEAASLAQYGPGGYHPHPSPLLLSVTALSAVGATVATVGLGELWADAAGRLPSARSFWLTAVLVPGLLFTATLWAAMKVQKSLEWGGWGMASLTLTDYFARPTMVVGTLVLALAAAWPIWLARRDTVTPAWLLESGTGRSWPATDRPAARFTVIAGLLAGTCGAAVIAVFRALAGAAADDAQAAQRLYSYVFLAGAVAAAATITVECFWPGRGAGAALISAPVAAVTAMAGLVVINTLLGGTLTWTFAYDIGRQPIGLALLSQTFALSIVAFLPRGRRTSRRIGLAAIVVVATLAILAASAVITARDVLVPIAAKSIASGEPRPLDEDVACGSCRVIGPVTGHANRQYW

SEQ ID NO: 13416 - protein, 400 aa, Actinoplanes utahensis
MPKRSSKLTRSGSFPALAPTQAAKPTTVVQVVGHQHAAAIPQWISPDRFEPYLRHAGHDRDKACELYEWAAELNSAAFQAIHYVEVILRNAIDLQLQKRRNEDAAKIPWFLTPLGSDNKSQQEIDYAVAQVRERLRKVDKRKDTRAQIVAGLTFGFWANLLQTRHEDLWRSTIRHAFPRSSGNRSDVAPIVFKLRTFRNRLAHHDSLLAVDVPFQINQMITLLDWIDEDAAHWLRSTEKATAVHAQRPFARNDTVVVAGADAWPLYQKVHAYVCQPGRAFQPVEHLAFYTARAIQPEIPVIRERIDNVDWTTAESRRRRATGDPKDQRLADIIDQSIADGWTGGRYQVFLLSAPGDTGHHTRRSTIPHTAPPGRGQAYTQGQRYAVRQKLISARTTSDLT

SEQ ID NO: 13417 - protein, 245 aa, Actinoplanes utahensis
MPRRSPRLWLLTITTAAVSLLASLPAAVSVQAAAATAYGQDVSDYQGNVNWAAQWNAGSRFAYIKASEGNYYAASYFASQYNGAYNQGMIRGAYHFAIPNASSGISQADYFIAHGGGWSKDGRTLPGALDIEYNPYGATCYGLSQASMRTWITKFLNRYHDRTGRWAVIYTTTDWWSTCTGNYNGFWANSPLWLAHYASTPGTLPAGASTWSFWQYSDSGPFAGDSNQWNGSLDRLRALACNGSC

SEQ ID NO: 13418 - protein, 267 aa, Actinoplanes utahensis
MGTFGAGPFSSDGAMDFLGELAGHPPAERQAVLRRTFLLVKENPDLLGREFFPDEIVAVAAVVAAALPGGQQFDEELARLEELDLIPNIRLISPLQDLVGHTREALLSVADPWLQGWTTELANAEARDTFATLSQVLAHGCDSPDDLDLIWEEANDYGIEGGVPDGTPPGIEHLTHLMRVYNSAMGGGLYFALEANEPSRVRRAIIALRYFGMAEAATLLDEALNSESHDSVPADVDFYALVDGGPDLLGKAFRAKAVETPDDFNRG

SEQ ID NO: 13419 - protein, 343 aa, Actinoplanes utahensis
MGEVTRRAVLAWPVAAAAKFRTTGAPRHQPGIVSLPPNATVLAALDLRGAGLDVVTRLFAMLDRGIRALGGQVETTVSVGASLFDARFGLATARPPELVPMPAFRNDLLDPAQCHGDLLLQVGADLPGTAQRALRSLLTPDIRLRWRITGFRAGNGTDAHGRPTSRNLFGFSEGAGNPEGDDRLWVRPVGAGDAWAAGGTYLVVRTIRLALARWNYDPVSRQELIIGRRKSDGAPLGRTPLDAHVRRADPGTAGPPGGGILRRGYSFRRGLDPTGQPDEGHLFICYQNSIERGFAAVQRRLAGEPLERYVLPVGGGYFFVLPAADRLGQPLLDAGRSGADARP

SEQ ID NO: 13420 - protein, 1351 aa, Actinoplanes utahensis
MPTAGTYTIVVDPRDQHTGTLQVALTAASGGARPAERPRLAAPTTSLTGRVARLNGAGLAKVTLRVGNRAAVADPAGNFTITGLPSGRHKLHIDGHAANRAGRRYGVFEATVDLVADTANVLPFTVWMPELDTAHEVRVASPTTREVVLTNPKVPGLEVHIPAGTVIRDENGAVVRRLGITAIPPHRPPFPLPHLGVHAPVYFTVQPGGAYLWPRGARIIYPNHSRLPARQKVEFWSYEPGGRGWHVYGHGQVSPDRRQVEPAPGVGVYEFTGAMFNAGNLPPDVGPPPGGCSQAGDPVDCATGLFLHSETDLRLDDVLPIGLERTYRPGDPRSRAFGIGTTLTYDMFLWSAEQYRQVDLVLPDGGRVHYVRTSAGTGWSDAVFEHTGSPGEFYRSRISWGAAGGWLLTLRDGTVLEFPQYRPLAAVRDRFGNRITITRDGDGRITQVTSPSGRWISFADDTNGRITQARDNLGRTVRYAYDTAGRLTQVTDPTGGITAYTYDSAHRMLSVTTPAGIVKVRNTYDSHGRVATQTLADGGTWRFAYETGAGGRITRTVATDPRGVQRSTTFNAAGYATVETRAAGTPVGRSVTLSRDAANRVIGVVDPLNRRTGYTYDDRGNLTSVTRLAGTSGQVTWRFSYEPRFGQITSVVDPLGRATALAYDDRGALSSVTDAAGDRTTFRSDAAGRPTEVTDPVNATTRLTYRAGLLATVTDPLGRTGGQWVDPGGRPVFVTDAVGAVQTRTYDPLDRIVQVTDAHGGVSRMAYDPGGNLVSLTGPRGGVTRWSYDAKGRVASRTDPLAKTERYTYDRGDNLTGYTDRRGVTSTVTFDALDRPTAVAHGGSGVDTYAYDAGDRLLQVSTAPATAAGVISRAYDPLDRLVTEQTPQGRVDYSYDSADRRTGMTVQGQPAVGYAYDAADRLTSVTRGGAAVRLGWDTAGRRTSVSLPDGVTTSYAYDTTGQATAVDYRRGTATLGGITYRYDTAGRRQGVDGSLTQVDLPPAVTGATYDAADRLTRWGNAALAYDSNGNLTSDGTRNYRWNDRDQLTAVGNAAFRYDQFGRRTSVTVGAVTSNYLYDGKNAVQEQTTARPTATLLGGLDLDDHFGRIEGNTATYHLTDALGSTVALTDANGIATRYSYEPYGATTTTGTPSTNRYQYTGRENDGTGLYYYRARYYSPAIGRFISEDPAGTGGSLYAYAAGEPISRADPTGMVWKEVALVSGAGFRVIREVARAEAMRLYQAGLHVATNSAKGARKLAKDVSTAAGGGGRACHREAHGTGANHYHGLDERGRHLPGGHVFYDTSLKGIFMSIVDVDGNGYLDERDWTELLNPFPFLIMPPAADSFNSPMEV

SEQ ID NO: 13421 - protein, 301 aa, Actinoplanes utahensis
MVIWGFRGKHGFGSAFIYLIIVALLAPSAVIVDALPATARAVGSGADFVYDELGRLVTVVRGAGGADGVARYEYDTAGNITAVRRENPTTAGVIDFDPRLGRAGTDVTILGRGFAATAAQNSVQFGSAPAAVLSASTTRLVVRVPSDGTSGPIRVATPTGAYTSAQPFRFPPPGPAVTGISPVTVAAGSTVRIEGGNFSPRLAENAVDFNGQLGEVVAATASTLTVRAPAGVTSGPIGVSTPFGQTRSSGYAYVPPSSFGVADVDFTTSLATGAATTVRVSKPEKIAMVVLAGYAGQRLAS

SEQ ID NO: 13422 - protein, 37 aa, Actinoplanes utahensis
MLADCGGAAAGGRDAKFGDQWRRGARLERLAGAAAGK

SEQ ID NO: 13423 - protein, 918 aa, Actinoplanes utahensis
MVREHGDVQPGAQAAGDGGVTVSHAQGLQVGDRNVQHNHFPAAAVSPVSVRPAAVPAPDGLVNVAVAPGVFVGRGTQLRQLDEVLAEPGAAVVQAVHGLGGVGKSTLAAQWAWQHRDRYRPVWWIDADTTAGIDAGLATLATALQTDLPDGLSLEVLRERALQWLASHDGWLLVLDNVNDPGDVARLSARVGTGRVLVTSRRATGWAGIATAIALDVLDLDDAVEAMRQVLAGSGRDRDADGLVQVARELGCLPLAVDQAAAYLAETGLSSSAYLQLLKQYPANMFAHGGEGAGERTIARVWRVTLDRLADTPLAGKILRVVAWYAPDAIYRALLAGLADPPTIARALGRLAAYSMITLDEHTLTVHRLVQAVARTPDPEDPHRQPDDIDTARTQAIAELRAAMPDDWRLPKHWPRWRALVSQVEALAEHSSNRIDNDTAASSLYNQAAVFLHDQGVVARTIPLFKQALSDRRRLLSDDHPDTLTSVNNLASAYKAAGDLGRAIPLFKQALSDRRRLLGDDHPGTLTLMLNLAGAYEQAGDVGRAVPLLERTLSAYKRILGDDHADTLNAMNGLASACASTGDLGRAVPLFEQSLTDCRRVLGEDHPQTLIVASNLASAYTSAGDVGPAVPSCEQSLTDCRRVFGDDHPQTLSAVRSLAHAYEVAGDVARAIPLLEQSLTDYRRTLGDDHPDTLSAVNSLAFAWASAGDVGRAVPLFEQSLTDCRRVLGDDHPHTLTLMNNLASAYEHAGDVGRAIPLFEQSLTGRRRVLGDRHPDTLASMNNLANAYEQAGDMGRAVPLFEQAFTGRRRVLGDHHPDTVLSLNNLATAYWTVGDVDKAVPLLEQSITYCRRVFGDDAPGTVLSLNNLAFAYRARGDVSRAVPLFEQALAGCRRVFGDDDPRTKLVEESLTLLCGSNE

SEQ ID NO: 13424 - protein, 102 aa, Actinoplanes utahensis
MNIIVSTDAGTVYLNVAGELDMDTADDLHKPLHQAVTRPGTTTIVIDFAQVSFCDSSGIAVLDRAYGEARDAGITLRLVNPQPTVRRVLSLLRMLQTLTGAD

SEQ ID NO: 13425 - protein, 101 aa, Actinoplanes utahensis
MAVMRRRDHLTGYELTVLGSLTDPVEALSAKITCELAAGHDEQHTAFLIATQHGDHWWIRWDAGQRALTLADFCDHHNQQSDDDCLLPKAHPGRYSFEFES

SEQ ID NO: 13426 - protein, 465 aa, Actinoplanes utahensis
MPGGLDVSRCSRHIMTCSAMGSGSSSPPCWAGCTPSRAQPCRRRVTGQSMPAPERRWQHSIATALLVRVGVAMFLPISIATVWLLIDPQGRQLLQIDLSRRMLYVMALLLTLLFAEAVIDMRRRFARVRTLLAAMESLAAGDVDVRVDDRGRDEITLAAACVNRGAKGLAMLLGQVADHARELHAASDGLSEHAGAVTRHTAETAQQAMLLSQSIGEVNTTLHQLRDGAGEVRSSIDAIAARAATAGQAATDGVTAAATTRDSVTRLETSSTQISGVVAFINSVAAQTNLLALNATIEAARAGDAGKGFAVVAGEVKGLAQQTEQATGSIDAQVDAIREDAAATVTALQGIAGAIAQINTEQEYIGAAVDAQRASTTAMTQRVNDTADTALALTATITDLAHTASRSTEGTREVADEIATLACIAAGLDQLTARYSTSTPRTQPVPAAPRTARPAPVEQAAIELF

SEQ ID NO: 13427 - protein, 87 aa, Actinoplanes utahensis
MPTVPGYDLDQPTQASLTAALSAQLGPETARALVDLTAKKLRLTRSGTTDDLVRLTEELMTIGDVLRVTARSEKIRAVTYRALHQNV

SEQ ID NO: 13428 - protein, 170 aa, Actinoplanes utahensis
MINNQQSTTLAAPERMRVLASIDFDNLDLRTALNRITARTAERTGLPISLATLVFNTSQMTVGATGLDDTWIAAADGTPVEWSFCANMITTGRPYVIPDAHHSEQATNPLVTIDGIGSYAGVPLTVGGQIVGAHCILGTQAHQFTPEQLAELACAAQEITALLQEFSDLD

SEQ ID NO: 13429 - protein, 188 aa, Actinoplanes utahensis
MQLVHAGGWRLLQIPDITDPGLCYRLCRDRIWAGDCHTTELHDRLALLGLSLDDFTTAGIDCCIMVDPSSHIACLRPAEPVDGQAHLPLCSLCRHNLTQMRGFPRHRDIHQPAAAIPHLSTLWQHLDTDHDRRELSHHLRHPIAKILGWAEVLHDDTTMRPAQAHQINVIYQSACDLQQLLDNAASPL

SEQ ID NO: 13430 - protein, 150 aa, Actinoplanes utahensis
MPSLTPAAPAPPHHRRCCTCSHCRSVRERPAESFPLHEAAYPILNQASITAHLRSSCRRRPIARRKTFTDGAWFVGATFTGFAWFDEATFTGDAELGKAILEPGSSLSLAGARVMRRANRKDTWPSGWRIQDDPSSNCDLLVPEGPAAAA

SEQ ID NO: 13431 - protein, 351 aa, Actinoplanes utahensis
MPTAANAGYYARIVQRRAVSRRLVEAGIRIAQLGYGSANGDGLELGAVVDLAQQAVYDITIDRGAGETAQVGDVFQPVMDDIESAGSRDGSMLGVPTGFKDLDRLLNGLQPGQVIIVAGRPGLGKSTVGLDIARHAAIRAGMPSGFFTLEMSKVEMVTRLLSAEARVPLHVLRSGQLSDDDWARMARCMGQIADAPIFVDDTPSMGMSEIRSKARSLKKKHNLRLLVIDYLQLMSSPKKTESRQQEVSELSRGLKLLSKEIGCPIIVISQLNRGPEQRQDKRPQLSDLRESGSIEQDADVVILLHRDDYYDKESARAGEADFIVAKHRNGPTDTITVAAQLHLSRFVDMAL

SEQ ID NO: 13432 - protein, 71 aa, Actinoplanes utahensis
MSDRVPPHDVEAEQAVLGGMLLSAAAVDEVTEIITGTDFYRPVHRTVFETILTLHGKGEPADALTVAAAPS

SEQ ID NO: 13433 - protein, 211 aa, Actinoplanes utahensis
MNDGTTRWTWGTPSRGTQLPTTFKAAEAPNLLVAPPFRAPPQISGLPTTKTCIRGTASLRRLSMDKAEVVLLLTLAATFDYRRIGEADVEAWYLALDDIDLDDAKAAVVRHYRDQTDRLMPAHVRAGVKAIRAERRRLEPSEALQLPSKFEDDMNRQVRMQAGGAHVREVLAAVGHHLEAQSPPSVSAMDQLRALTAGPNWDADASEVSGE

SEQ ID NO: 13434 - protein, 261 aa, Actinoplanes utahensis
MARISVGRAELENRPHILYRFYDRTGVLLYVGITVDFADRMATHAKEKDWWVRVDRSATQVDYYDSRRAALDAEREAIKAEKPLENDQHNVFMEASAATLGSQSPCGDRCTTACRSHHEDKWWQGRDDLAVMVIDEVRGVLGEDQRLLDAAKFAAAHLELPVPERTYPDDNAVVLTALSLVERVADDTARLRLIARYVFDAVPAGMLAAATEAAERDWSCAGEPEAPWEDKMVDVLRHLSYLLAKSFNQPRPGRSRKQVQV

SEQ ID NO: 13435 - protein, 124 aa, Actinoplanes utahensis
MSGINIDNLPPTQQLILDVLAARYRLGEQVWPLHTTVQKPLRELADRGLVTLLNGIVEKSIRARLTDAGQALTLHEQYQPPNGGIGRYRQALEDIRAFAVARSERPGMDGIAELAGQALKVGPR

SEQ ID NO: 13436 - protein, 78 aa, Actinoplanes utahensis
MTIPGYLDKHEGRWRLIWRDDDGTLRQFTAHNIDVVTAYATKHGIRVTTPRPILTLQPHADEPDRIMPDGPLNMRFSG

SEQ ID NO: 13437 - protein, 71 aa, Actinoplanes utahensis
MTAPAAARPLTPRQQETLRYIAAGHTNTDTAKLMGVGITTIKANIKAILARLGARNAANAVYLAFKTGELT

SEQ ID NO: 13438 - protein, 100 aa, Actinoplanes utahensis
MTIFPDWRAIGAVMHWARTVGADVKVTKYRQYSPAYICHQWTLPTGARITVGSYAGSTNPDMTVVNGAARYDGEPTSAADALNTLGVLGVIPAALMELAQ

SEQ ID NO: 13439 - protein, 32 aa, Actinoplanes utahensis
MITWIDTLTDRLWANKPDAEFRDLFTPVTVTA

SEQ ID NO: 13440 - protein, 102 aa, Actinoplanes utahensis
MTDQAQPIEHIEDIPPELRGLFLEHLKAARHVQEEEIKALHAKLREATRRGYDLALTTLKDESLYMQWWNSSHCSPDGPAREHYLRYLTDTAPGGVFWEVAR

SEQ ID NO: 13441 - protein, 76 aa, Actinoplanes utahensis
MLTAQTLHETLVRATLDQAAAGGCNKCVPNVCSDHFTPGIEEAGWSAVAERMDRWAASGYSGDWQDAEYDDPEAAS

SEQ ID NO: 13442 - protein, 80 aa, Actinoplanes utahensis
MSYDSRAYDNEHGDPVVVLVAEGTHDVSRLINLLTVGNCEQISLGRKVLQQVRRHNGGRAALQLLAAHGGPDFLHDDEVA

SEQ ID NO: 13443 - protein, 138 aa, Actinoplanes utahensis
MTPIDRLNRANELAATPGEHGTREEWIRHYAAQAMAAFAGFYDVTHEPRTGNDRPEIGYLALIGQTSVAAVLGLDASPRDLPSLLWHYDPDGDALNGERIEEYIVSVLDRAGINPADLNERYETSHFRSPSRAAEVAR

SEQ ID NO: 13444 - protein, 161 aa, Actinoplanes utahensis
MTTKIPSFPACTVVTSNGPVTVPCEPISDDLAITPVFGMTEDFRAVLGGDFLITHRATGLHVSDGPGCIECCRSAGKALVATGVDWSAITAGGGAEFMRALPDETRRAVAEARTVSWSCDIEYCNPWPEGATAERAQSKTNHLRQIVEQNARIVAAQEAGR

SEQ ID NO: 13445 - protein, 69 aa, Actinoplanes utahensis
MTDLDLDAVRDRVDKAHRWADWQSLAVPAAVRLHFTDDVPALISYIQHLTTELAATRQMLDVLTREETR

SEQ ID NO: 13446 - protein, 81 aa, Actinoplanes utahensis
MSISVRYHVDPHEPLAIYRGNEWIGSMFSPIDAAAAVIHLNRGLRECLCEMDGPASRNEDCDGQCCGVGMCSCSATAEVDR

SEQ ID NO: 13447 - protein, 108 aa, Actinoplanes utahensis
MTLTRFHTTEPFDGGEGGFFHWWVSNGPHMLALTVIESSTKARFNEIYMHQPSNDGGCRFHDGCEPSALSNPVIRDTLDRIVAAGTTDDAVYAELERLHGEIFAEVAR

SEQ ID NO: 13448 - protein, 116 aa, Actinoplanes utahensis
MGRRRVRRGQDPLGAGSGHGCRPQRGRYGVTAQTDHDDLVAQIVTASFSLTRDTATRLIDSLTEQLADSQAEVDAIRHRVQALLDSDYTPNADAILRALWPDASTRDAFRRDKEAQ

SEQ ID NO: 13449 - protein, 119 aa, Actinoplanes utahensis
MNAPPSAVLDATSVWPTVGGMTSQLSVPPGVGHLRVCQYLSVTDKQLADVLAAYRRAEKALDTRRDELFKAIGEAVTTGRVRQSDVVKQMGYTREHVRRICRAYEDWRDGKTTELKLAR

SEQ ID NO: 13450 - protein, 118 aa, Actinoplanes utahensis
MVRLADGFEWATTGEHRDEWCVRRTGLPQMLCGRSFNGTGRRGGWAPAQQPAATPEGAHPLCVVLAEAQHGLCPVCGWDIATEDGLIVGHGRWQVTRDGVESSDEPCAGAGQVPEVGG

SEQ ID NO: 13451 - protein, 80 aa, Actinoplanes utahensis
MSAKVVPLLSGTQQRILTFIQSYAAEKQFPPTMKEIGAGVHLSPSAVAHQLIRLQGAGWISRVPNTPRAIRVLDPETGGD

SEQ ID NO: 13452 - protein, 64 aa, Actinoplanes utahensis
MTRASELVQALAEAMHEVQCLPGTKGYHKYSANHREPEQRRAALNLNPLAAAGHILSPVPVEAS

SEQ ID NO: 13453 - protein, 164 aa, Actinoplanes utahensis
MAGETVITVVGNIVADPELRYTQSGAAVCSFRIASTPRVFDKQTQDYRDGEPLYLSCSVWREPAEHVAESLQRGARVIVQGRLKQRSYEKDGEKRTVVELDVDEIGPSLRYATVKVQKAQRSGGDGGLRPQQAPRGGGDPWATQGARSAASSGGQRSFDDEPPF

SEQ ID NO: 13454 - protein, 206 aa, Actinoplanes utahensis
MTKTETRTWTLRIPAPAKMLSANDRPHHQAASRIRKAWREATFTLARQAKLPTGLERVRIDVCLHHTVARNRDDANWHPYVLKPIADGLGPTKTSRQRNGEIRVDVGYGLIPDDNPAHLDGPFPVLGEKVSRKEYPLGLAVVTIVDLTGQPTGGFETERRLMSATTAWTFRCPARHQIVVTVRRLEDSGPYRNLFMEQHAGCEAQP

SEQ ID NO: 13455 - protein, 67 aa, Actinoplanes utahensis
MLRPSQAGGYPIGRLAHISQPRVHAALDRLQAAGVVASEWEPGPVSEFRPRRRLYRIAGSRLVEVGR

SEQ ID NO: 13456 - protein, 55 aa, Actinoplanes utahensis
MMDLIADDYLQHFDRDPWADARVLIAGQGDVLRAPSDTDRPAWDRSDDDDYWDAS

SEQ ID NO: 13457 - protein, 126 aa, Actinoplanes utahensis
MNSWNHAVSAARKWGGEPDHYIAVEEFLDSSKEIFGDVRHRSMYHHTAGVWLCQRIFGRTITVPKINGHGSVDIPVRLIAERHVIEDLGWLPSPADYIAGMPIKPWMSGSQRKELPLSHLLQGEPA

SEQ ID NO: 13458 - protein, 154 aa, Actinoplanes utahensis
MSTLRAITLRAPWSEAVAVGAKLVENRAVNIKWRGEIAIHAGMQADPAADSDSRIIGLLGENASHAATRGAIVAVARLVGCHQARQPDDPSLTCCGRWGMRLYRGKPAWHLVLADVRRLPKPVPCRGYLHIGWWAKDAVEAEVRAQLDSSLSAA

SEQ ID NO: 13459 - protein, 126 aa, Actinoplanes utahensis
MTDLESGSATEEIYNPVTVEQAIQNCADRIAKGVRIVASRYKTYQAAKRTLDRARAQAFLHYPGTQAEKKHAAELATIEERDARDSAYEEYKYARELAAALEDELRALQSINKSVTSAYNAVGVNR

SEQ ID NO: 13460 - protein, 390 aa, Actinoplanes utahensis
MAIKTLQQRLTQVGVIRLGQKVPTSNGNTRPGKLETLRFTSPSRPLIDAVAKLYGGEVKAWQANTGPQWEVITGVKEIPVLVPPQRIDPNMEHWGNGYRDRMCDGETETIRQRPCLCAQMQQGGRRIDSRELCKPTTRMSVMLADVPSLGTWKIESHGWNAAAELPTLAASIESAPQPIPARLEVQVREKKDFDPSKPQGKQIESKVFMVPVLHFDWLTPAQAFGGELGAAARAALGAAAVQRHAIESAQAERARPKLTAEDVQTLADEAETVKQVQDLWRDAAKDGVLTEKLQAVLKARAAELTPAPAAEKDSHTSPGSQVEVDEVVDAEFADDADAVFVQIQSVAGELRWSAAELEQRVQQFLNKSSDDADAFDLTRLLEAIKAGEVR

SEQ ID NO: 13461 - protein, 355 aa, Actinoplanes utahensis
MPITEGAEQTLTVREFPFHSVEESDDGRWYIIDGQRLMSVTTAFNAIAKRGLIPWAAGLAAEQAFADLPTLVSASRRRLCDNTWSRCRHEPAESCEKCPCRVCRLCVQKWIADRHVRETARRADEGTRVHDVAEWWSFHGTIRDHDPDIAPYVKTFQEFVTDYGVVPDDVLLAEALLVHRDIGAAGTTDGIIRFRAERSEAAAKLISRMLTYAGTPVKWRQAQKQKLTLDLLIDYKTREGDDPHIYPEYALQEAGYRHFPVVRIKNSDHEEPLQPTDGGVIIQLRPDGYTVRPVVCDRNTYEQGFLPALNLYRWLTESGHAAVSSRTFVLPETVAARARKAAQEQAISPATASEA

SEQ ID NO: 13462 - protein, 125 aa, Actinoplanes utahensis
MSGPIPVRVTRYKDPHCGHTHSSRQRAVEHMARCWWNPDARGCKTCRHFVGPWQSMGEERCEVGVNLGGRPACRGCGGHGWRDNSAGGEVKRTSETTVGHIDDGCEIKPGPVVGCEMWEAADADH

SEQ ID NO: 13463 - protein, 176 aa, Actinoplanes utahensis
MTAAASFDRAYYEVPRTAACPFCRSPRGSDCRSIGGYTVGFHAARIKAVAHLNRQQRDDAVQKLRAEEKARRDKTEAILAKPLTADQLATRAAIDAGFQQIKEAARAREKQMYARCRDPWLHNEACECRLGRPYAHPEPKPRVIRDVTDLAEVRARLSEAGEQALADALAELAGAR

SEQ ID NO: 13464 - protein, 153 aa, Actinoplanes utahensis
MRQRLWRQVTSVSGSQDPLSHDTSVATVVATAQGVSPSEPSPKEPPVRTKTRTTVNLKPGMVIKTVASDSTETLLPATYRVVASNTKTTPYAERCIKFTDGTHIMTALTWEYSVARGKAARNAAKQRAALIPSFALADALNLLSAYTAGAVTA

SEQ ID NO: 13465 - protein, 579 aa, Actinoplanes utahensis
MLRLYDEFAGVGGTSHGASYVPGIEVYAAANHDRHAVDSHNLNFPGARHFQADITKLPVEKMPYAELFSASPACPAWTDANGVKRDFDRANAEAQTLFDLAEAEPDPALKKRLEEYKRSRLLMKEIPRYLRAMNGRGTPVLAGMMENVIQCRKWHEWDAFLREIRNIGRGYHLWFFALNAMHMEPVRSLKTPQSRNRLIIAYVHKSIGRLPDWDKWLRPHAHCPSCDMRVQAIQVFKKPGADMGAYGSQWVYQCPRVSCRGREVFPATLAALAAIDPSVPGIRIRDRAAHGLPDLKDATLGRLRAGVRRYWAPLMVPGEGRDGKTAAPASAPLRTQTCRNETGYAYAPFLSPAGDTWRNAPSSALDPMPTRTTRECDGVASLPLPPFITPLRGGGDKENARRISEPLSTVTASGNHHGLALPPLITRQNSGHEESGTTPATEAIRMVTASGKQSVAFARPLLVPYYGASTSALPSSQPIGTLTTKDKYALVTSDADRIANSFDLDDVLFRMLEPHEIARAQSFAPTYRTSTTTKRINVRLFGNAVPASIAEVVFSALTECISGEELDRFIEPRDLAVAA

SEQ ID NO: 13466 - protein, 68 aa, Actinoplanes utahensis
MTTTADARVAGWMQLTRVPGSIHKLHTAGYVVEVGDGIPTYCHTEDEARAFLRALRLPDDVPVQSPPS

SEQ ID NO: 13467 - protein, 186 aa, Actinoplanes utahensis
MSSGFLYAIKFSNGVIKVGSTRTPQARLRTHAGEAAGFGHQVLDQWLSDEHDGYQSTEQTLIAQMTFLACQRHRREYFQHVNWDQVLRVAKTVVANHVAGRWTTVPLEHGRFTMADVAAMHPQFERSYLHQGCIYDQFARSIDRREFVMSPAQIKTLLDMHADLPGPFTGTPSASLRHRMERRAAA

SEQ ID NO: 13468 - protein, 110 aa, Actinoplanes utahensis
MLRHFRVGPCATAGARPTLDAMSDAAKPTRRAAIDTSRVAVNKDLFLNAFADKGCATGQERADLIGTSRRLTERYLAGEVVPTLPTARRIAKRLGRNIDDLWPDNLEAAA

SEQ ID NO: 13469 - protein, 142 aa, Actinoplanes utahensis
MRTVLTDTRYGCAMSGATPGPTFGKLLTQGRTAKTWSQDRLAAETGISRTTISRYEREITSTPEAEHVRALCAALDIDPRRAAVSLGYLTADEIQPAVPVPAKLKEILDVLEDPNIPAADKQSWIDYLLYLKAKAQDSASAS

SEQ ID NO: 13470 - protein, 214 aa, Actinoplanes utahensis
MTEIDWSDVRPRIAVLAGLAGAAEVFGAISHGWRLAPALTADELAELEGQLGVELPVDYGSFLTDVSRGGAGPAYGLFPVRRVEGRWAWEGDGASLNDRETLTRPFGHIRAFNPADDLDNPPQIGRNDDALWELHDEVLSDPAHVTGLLYLCHLGCALREALVVTGPSRGQMWADDTADGEGFRPLHNPDSSRMTFAAWYRTWLRQSERTSSER

SEQ ID NO: 13471 - protein, 263 aa, Actinoplanes utahensis
MFSVAQFEAVIAEINQGKQTYDAKIAQVIPAADHLASQWWVADVIAEAIHYLAKETVDLATEIGNFILDLLKGCGAPIFMFRDSWTWTDIKSGFSAVSTQLTTQNLVVDDSKWAGDAKDAYLTVAEAQSAAAGRLSSIAGNTSNSLLECAIAGSAFYLTVAAVLAKLIVAAAASVAAFSSAIFSEIGAMIFLEEGGVNITALATAAGLLSGFLGDQARVMISLHSDSSDPANFPGGMWPRTNASAFSDATVKDGDADWSLKKD

SEQ ID NO: 13472 - protein, 104 aa, Actinoplanes utahensis
MSQPTPDEVRVATDALRTESGTWNNQSDTTKALSAKTATLEFGRLEAGLFQMMVGPYNDVIHAVTARANEGVTAMKEIADTLHQAADTYEQEDRAGAHRIKNVY

SEQ ID NO: 13473 - protein, 240 aa, Actinoplanes utahensis
MEPDMARRLQQLQQRAQQLGKVASDLAAAAPQHVEGSDATGCVVATLGPDNLPADFRIQDRWHQRLEAEKLAPAVLAAYADAVKTKQRQWVGRLDQSGWWAQRRDAEAGWLVTEPAPAPKGGRPQPDDPEFAEQIMKTLRNAREQASQQPPASAQGTDAQRNVTVRLGQGGFVGCDIDTRWARSSSGTAISGALRTALQQAKRELKPSSTTFGEVDALVADALATLSALTRTQQHRGDHR

SEQ ID NO: 13474 - protein, 137 aa, Actinoplanes utahensis
MARASARTARTSGFALFLMAMITAAELLGTAYAVLIGLEELVQASPYGHTGTVIVTLAAAVIAVAAAVIAWRGIGGTTRIVAATLTFLAAGLVLMLTISLLTSSKGHAMGFSIVLAPGTVFLFWIGRAVLQAPAGGR

SEQ ID NO: 13475 - protein, 34 aa, Actinoplanes utahensis
MAAWLQPLADLYQACGANLEVAKRQRVWRATQPW

SEQ ID NO: 13476 - protein, 70 aa, Actinoplanes utahensis
MSRPPRPTWYTWTALLASSLATGTAAVAISLHAQAESNRKLCGIVSTQDDAWSETTPTTVTGSRVAKAMR

SEQ ID NO: 13477 - protein, 418 aa, Actinoplanes utahensis
MIDAIRDGDVEEARRFLTVISSGDRWEADIRAFGAAVLRHGGPGMAEMLFQDEVLPSGLWDDVDPVVWAADHGTCGFLDNLLHRHSVDETQLRRALEAARLWLEATPELELRRRAGIGVGEPVVIERDRVVIDDLSPRTPRLRLSALDGRRAEVLLAHRGVVTTLETTLSLPVSPDELLARALRSADPEAPDWSNVRRALQQRFSMADNVRWSIDRLGDPRVAVRRFTAELMHHLTLDGDGPDEPYAPQALNALHDRITVEPEPLVLDSLMGAYAGFRHIGDILVELLPFAGHPHPGVRTRVAMELLNGTGGPADDPPPHVLGVMFGLTRDPSAQVRGAATAELVYSRIDTPELRDHLAALLAGSDRRIRIQAATGLAMRGDPDALVQLRDLSAEDGYESHAWYDLDMVERMLGLSGL

SEQ ID NO: 13478 - protein, 480 aa, Actinoplanes utahensis
MIVADRGWGADVLAAFRDEFYRCLTARSDALFELSDAVLCADGPVKTLVDLTLTAEHRRGHGALYDALNHGRIDLGRLRRALTAQPLPRFADGRIVLAVDVSPWLRSDAACSPERLFCHVYGRAKSAAQFIPGWPYSFVAALEPGRTSWTAMLDVVRLGPADDATAVTATQLRGVVDRLIACGQQQAGDPHILIVCDAGYDVTRLAWVLRDLPVEVAGRIRADRVLRLPAPPYEHSPSGGRPPKHGGEFDLKDSATWPEPAATTINETISYGKAEARAWDRLHPRLTHRAAWLDHQGTLPIVEGTLIRLQVEYLPGDRAAQPMWLWWSGTGADPGDVDRIWQAYLRRFDLEHTFRLFKQTLGWTRPKIRDPRAADRWTLIMIAAHTQLRLARPIAIDLRRPWEQPVPPEALTPARVRRGFRNLRTRSALPAAAPKPTRPGPGRPRGSKNHSRAARYDVGKTVKRETSLGGPPRRKPKARG

SEQ ID NO: 13479 - protein, 126 aa, Actinoplanes utahensis
MTRRFGDRARFAVEVGEVWPPPPAPATGELRTVDLWAAGTRMTTDDNTVFLPTFIGFLRSTAAKVRRRQVSPCPFPEHSPEEVFQLLYTDDETDFREQFWLMHWGETVDNVTSYAYLDDDDLVIVF

SEQ ID NO: 13480 - protein, 500 aa, Actinoplanes utahensis
MLRPAEPCPLLSMLVVAVVTDRAKAIDVLAEFREELYQCMTRRADALFELTEALLCTEGPVKTLVGLSLAPEHRRGHGALYDALNHGRIDVEVLRRQLAGLPLPRAADGRLVLAVDVSPWLRPDGNCSPQRSFCHTYGRGKDEHRMIPGWRYSIIAALETGRTSWTALLDAVRLLPGADVTTVTCAQIRQFVDRLTDAGQWQAGDPDILIVLDAGYEAPRIAWLLRDLPVEILGRMRSDRVLRRATPARVYKPLGGRPTRHGGEFVFGNPATWDIEHAVTHTDTRLYGQVRAQAWDRLHPRLTHRAAWTDHDGPLPIIEGTVIRLTVEHLPSRGEPKPLWLWWSKLDATAADVDRCWQAFLRRFDIEHTFRLLKQTLGWTAPQLREPAAADRWTWLVLAAHTQLRLARPLAQDLRRPWERPMAPERLTPARVRRGFRNLRATTPSPAHAPKPSRPGPGQPPGSRNRQPAARHDVGLILVTGQAHQRPAHHKKGTKPRRTG

SEQ ID NO: 13481 - protein, 521 aa, Actinoplanes utahensis
MPATSRIPHQHTPPHHQVDSPPVSDLYARKSTKDAGRSVARQERAWRADCATEGLTPGRVFVDPELSASRYAKKARPDFAALLDHIRQDGCQVISLWEPSRGSRQMGEWVNFIDLCRLKGILIRIFGDDDPQTYDPRRQRDRDHLFKEGMAAEGESERLSTRSRAGIADAAVNGRPHGKIPDGYKRIYTTPDEDADGSLLNARKLHVEQVIDEDRAAIYRAAAEGILNGVPVNYIARVLTAWQVPTPRGATRWSGGALYNSLLRPSLEGHRELNGIIITRDAWPPILDADTVARLRQLREAPRTSRSHNDTRLKYMLSGLVQCGLCRRPLSGLYDRKTAGTRYECMITRGGCCRVSTEMEPVDSLVSAMVTDRLREPDALAVFEPSADANLQAQQAQAELDALMDRKKELYSSAARPGGPSMALVAAAEQELLPRIEEASRRLKAVKTPPALRGYDPIDLADNWLSYSPGERRTVVSLLAEVVVAPVGRGGRWSPWRLADSRWRGQHRTWGDLWREQGLVR

SEQ ID NO: 13482 - protein, 320 aa, Actinoplanes utahensis
MHDDDDPRVRRGMATFFGQPRPLANLFGVELWERFSFYGMQGILLIYLYYEAADGGLGIDKSTATSIVGAYGGAVYLSTVLGAWVADRLLGSERVLFLSAILVMCGHIALALLPGLVGVGVGLVLIAVGSGGVKANATSLVGTLYDAHDERRDAGFSLFYLGINLGALAGPLLTGLLQKNLGFHYGFGLAAVGMAIGLTQYALGRRNLPDAGRAVPNPLPPGRWPVVAAVVLAGVAVIVVSALTWLTADRLSTVVVVLSILAAAAYFTVILSSRRLDGRERRKVWAFLPMFLASAAFWSLYQQQFTVDNFHNTGMPSTVR

SEQ ID NO: 13483 - protein, 48 aa, Actinoplanes utahensis
MSIQGVFYLIAVILLVVAALPITTRGFNLALLGAAFALLGYSWNTITG

SEQ ID NO: 13484 - protein, 719 aa, Actinoplanes utahensis
MSSRIRRSALFGAAVLLATPAAAHAAPATATTTGVLQQTVADTFGAGPDRVRTTVRTDGGATVDVPGGLAEGITPGVGVTLTRRADGTVSGLARRTGIAAGTSPVSGTHHLVFVPVHGSAGTDPATLPTAADFTTVTASVDRYYDTVTGGAVRFTVDRVLAPQKLTATGCDTAALENAARDAAGAVTQDRFHHLVVYYPYDATCGFAGLAYVGGQFVWLNGYKTTQVLGHELGHNLGLWHSDGYHCYAEPARQTPVPLSANCTVEGYADPWDIMGSRATGELTAAHLDQLGLLGDGGTQPAAAGRRVVLAPLSGGTGLRQLTVTAGTRTYYLEYRDGGRLDQPYARSGTGLAVRFTDTTLDSGYAHDHQLVSYHPEDGTITLKPGEGWNDPGGALSIRTGVATADGLPVTVGGVADTTAPTAFTLTGPAAGASLTSTTSTVTWTPVTDDSTVAAITVLVDGRVAATASGTATATPVAVPDGRHTLQAVATDPYGNASRTPAITVTVDGTAPAGTPAPAAIPRVGAEVTTGGIPVRVAWGLTDANGVARQRIAQDGATYSTLGTSVRQIDATAKPGVKTRWQLAVADRIGHTGTVSGAWTTASLNTRGGTFSGAWRTVSGRSLLGGSEQTSTAKGAAVSYTFTGRAVGLIGTRDSGSGAVDVYVDGAKFGSITLYNGVVSSRRLVYTLVWSGAGKHTVTFVNQATAKHPKMSVDGIVSLS

SEQ ID NO: 13485 - protein, 436 aa, Actinoplanes utahensis
MNDSRCAEETTGCGCSVTVRTSRCLRRMGARRHRGVGRPTGARLVLCRAAHVPRHDDRHRAARRGGAGGRGAWDQPDHRGGSRAGRLHRCDDAPPERSPDGVRDRGAGAAGGDRRGRPEHRPVAPGGAAGHESAVRDSADLPGTPQVTSTCAIMVTVIHQAAVNIPDLDDGFRLKARTMLTVAIPMMYEQFTAHLDVASMRADGFGSVITYAGFRRFPVPLPVSATLSVDVLTRQVELSGRGLGQRSSRLGFECEYTFRCRPGTGDPSRYRESISDTEVVCGQVRLLLTTIRRDGAPGSRVVGAPLPQTRHMDVHVLPDPHPSVADLAPVDGEMIAEGERSGVFGRQHTDTGQIVFTGEYLALLEDHLSGLAADAGLPISAGDAGRIAVVFREAFRAGDRFTLRGQLWRDGDRHTALIGIHAAGAERPHIFGRLHT

SEQ ID NO: 13486 - protein, 757 aa, Actinoplanes utahensis
MQHDCSTNATNLNANQACRTASLQRLTIVTRPPAERQVGVSPLVKTIKSDHDTGQDDRQHRIQQDIRLPEGKLQAPAATVHVAARPGTFIQLRERSISDVFPGCRRGDRKGGQTMTAGGAWAPLEVYRTADDLVRRRNKLIKEVEDCYKRAHPNGSGPSRSEVQSWRESLYEVATTLVDSGLGQVWMFIEYRVAPDMNPIDVVLAGSHPVDGLSYAALELKQWGSVERPTLSHPAGLCASCKAAGNTALCERCAVECVYAPFYSKHKKHPAIQVRDNLIALKKYHSMFDDRYVNLVGAAYLHNLKDEQHQWISNVAPCGDIPTFTARQPDSLREFLTRNFGSGAGTRAAQSLLERRRTNLPITSELGAVVDGHTRFSLIENQLHAVTSVMDSLRATTSSGAKKVFVVSGRAGTGKSLIALTLLGKAIENQYKVRYVSGGIASRETFKRASIGHRPAFTTLNNVADNIGVNEQDLILCDEAHRLTRQPMRGSYSVRPGETSVAVVVTRAKVPVFFIDGDQRLFADEVWSPEALKREIQRLGAEVVPIALDRPLRAVGSATYDTWIQRLLTGDPVPWNADADSDPEPFELYYATSAARMESFLHSKEASGASARISAGMCWNWTDDTGTFPDVAPDAGWARPWNAGDNHKTPGVPKRRFWATEPGGFGQIGCVHTAQGLEYEWGGVIMGPDLTTDGRRWRVHREHVLSKANRIGDDEELLRAICNAYGVLMTRSIRGTVLYSVDPATRQLFADLGLSRI

SEQ ID NO: 13487 - protein, 569 aa, Actinoplanes utahensis
MDEDLANSTDGGFAGLGLRPELLRALTDLGYEEPTPIQREAITPLVAGHDLVGQAATGTGKTAAFALPLLQSLTPGSADTPTALVLVPTRELAEQVSQAVHRYGRDLNVRVLPVYGGQPISRQLQVLRRGVDVVVGTPGRVLDHIERETLRLDAIRTVVLDEADEMLDMGFAEDIEAILAETPAERQTVLFSATMPPRIDAIARRHLRDPLRIRMGRDTAAADALPSVRQSTYMVARPHKAAALGRILDVEMPGAAIVFCRTREEVEEVTESLNGRGYRAEALHGGLSQDQRDRVMSRLRAGTTELLVATDVAARGLDVDLLTHVINFTVPSAPEAYVHRIGRVGRAGRTGAAITLAEPREQRLLKAIERLTGQRIVVEKLPSVTDLRARRLELVRSTVQEAMDADDLDRFRSVLASLTADADLETVALAGLRLLHEANGGDVDEPEIPSLSPGRDPDRRPRDTDRSRDSDRHPRDDRYTDRRSARNRGSFTQIFVGLGRRAGLRPQDLVGAIAGEAGLPARDVGSIQITDRFALVEVPETDADRVIRALSHSTIRGRRPTVRRDRPHR

SEQ ID NO: 13488 - protein, 152 aa, Actinoplanes utahensis
MATEYIVQSDADVRSDELTGFFESTLGELATDRTIVLPGLFVTPDRPPEDERDETTRRLGFDHRVTATFRFHNLADPQTRDHNVAVMVGAVLAFYDRFGGSGALFYNDDVLTVQWTPREIVVNRDWTEFFEIDAVVAVIGDRPVRHLGQPLL

SEQ ID NO: 13489 - protein, 227 aa, Actinoplanes utahensis
MGGADRGVHDGVDDQPDQPVASDRRLSGMPHPKDHDGPGPGHRPHHQGTGSARSIGGGHADATRIAGLGRTHGPVPPFTAGPPLTRPSRTPDPGLRPTGNRTGAHPFRPEDLGRRREDEAAATLARNGYQVEQNPPTRANGRNPDYRVEGEYVDCYAPKSDNPEKVRNSLSKKLRDGQAKRFVLKMEDTSCSLEEIAAVLRRKPIRGLEEIIVVRDDKIMPFYPFGE

SEQ ID NO: 13490 - protein, 233 aa, Actinoplanes utahensis
MTSPSLVAVADSGGDAALDATMVGDLDGLIATIRGGDWIDTLLAGATTGVDVASTAIDPCGALLANGLGWAMEYFQPLRHMLDMLTGAPGRVAAHAATWQHIAADLDGTAADLKRSLHGDLPDWQGAAAGAYAAMMSHNVAALSTLSGTAAAMSAATEAAGNLVAFTRDLVRGLIADLVSRLAVWAAEALAVVTIPVVATQIVAAVATWAARIVGYTTALTTSLTNLSHLIDG

SEQ ID NO: 13491 - protein, 107 aa, Actinoplanes utahensis
MTAGPDGLLVDAGQLRRHAANLRALHDRFAAVRAASGFITHDPHAYGLLCSWLPALLAARHRRQDELVAYVAENLDILAGHLHAAATDYEASDDRSAATIRTAGRLI

SEQ ID NO: 13492 - protein, 129 aa, Actinoplanes utahensis
MASNTEPLLDPDAALDQVRAWQGEIDRMLARTRTMSLRMRELRVTASDPRHLVEVTINSSGALLDIRFGPRLPQYDPVHVARIVMATVQTARRQALRLTREIIDETVGPDSTAAREMIISTAESLGEPA

SEQ ID NO: 13493 - protein, 745 aa, Actinoplanes utahensis
MGSAHDEDERGQYPGPWDTPPRRNAGAPPPSTSPSRSPSPEPDPPPVPDPPRRSSPWASPAPPRKPPTVTPPPPDPQIFVPPPATTPVPTRSVPAAPPPAFAPPTFIPPARVEPPRIGPEPRHPTPLQAPPRAPEPVAPAPFVPHQRTAAPAHLPAPPPPVAPAVAAPSRPPSRLHSLLIFLALLIAATAAGGLLFLRKEPDRAPDPKLAATQAATALREQDAAALKVSFFDQSGLDVTGDLTIARGGATAGTLTDSGGGRADYLASGSEAAVRGDQDWWARRDPARIGVLKDAWVRPEHYAFPLDGAGLDPGALAGLVDWVRAAGASAPDADSVAGKPAVGLRRDGWTVLFSRSRPYRLLWFGGPLQNGTPLAPTINGSPSAPTPPYVSVLVDPKAPAVPQVTVPDAREEQKTPARLPAFDVTVNAATCRTVTCSWTVTATNVGKVACDASVIASVTPGMPETRVAALGTVPPGASRTTARMTFPNPAPTNRNVSADYRAQAYCPEIYGPNLKLMRRLQERGLVPGRSPTLSRLDPSQMPAMLFTLDAMAGAGRFDADRATEEMEKAITAGALPEIGELVQSRRLANPEVLYGKLANLIFEYDTAAPGTPVREKTGYRRELQIAAGILRQDRDATVTLDGGGIDIVVRTAGSPTYAIQAKSVSSESIAENLRRAAEDLRAHAPAGASKVALLYVEAPAGYAHAAGRDRFEREFTAVNADTCAAGLDRIEIVNQGGDQRFPGCTR

SEQ ID NO: 13494 - protein, 189 aa, Actinoplanes utahensis
MGVRTWIEGWPVYRQLTGTDPLGRGAAVQSPRSKSLTARTETADSMARSVCPYCAVGCGQRIYVKDGAVTQIEGDPDSPISQGRLCPKGSASKSLVTSDRRQQKVLYRRPFGTDWEELDLDTAMDMIADRLLKAREDTWEDTDDEGRPLHRTLGFSSLGGATLDNEENYLIKKLFTAMGALQIENQARI

SEQ ID NO: 13495 - protein, 840 aa, Actinoplanes utahensis
MAEAHPVGFQYVVEAKNRGAKVIHIDPRFTRTSALAHTYVPVRAGADIAFLGGVINYILSNEKDFREYVVAYTNASMIVSEDFRDTEDLDGLFSGFDPETKAYHQGSWAYEGQQDDDSVQDHGESHTDRETASGLEQESHGPPIPADVPRDPTLQHPRCVYQILKRHYARYTPEVVERVCGVSPEQFREVCEAWTANSGRERTTALVYSVGWTQHSVGVQYIRTGAIIQLLLGNMGRPGGGVMALRGHASIQGSTDIPTLFNLLPGYLPMPHHQQHETFRQWVDAIRHPEQKGFWADAEAYAVSLLKAYWGDAATAENDWGYDWLPRLTGDHGTYQQVLDMIDGKIKGYFLLGQNPAVGSAHGRAQRLGMANLDWLVVRDLFMIESATFWKDGPEVATGEIVPGECKTEVFFLPAASHAEKEGTFTQTQRLLQWREKALDPPGDCRSELWFFYHLGRLVRERLAGSTLPRDQGILNLAWDYDPDDGEGVLKEINGFDVATGEPLPGFSALKADGSTACGCWIYSGVFKDGVNQAARRKSRKEQDWVAAEWGWAWPMDRRTLYNRASADPDGKPWSERKKYVWWDAEAGEWTGYDVPDFEKTKAPDYRPPEGATGVAAIAGDDAFIMQGDGKGWLYAPSGLIDGPMPTHYEPAESTVHNPLYAQQANPTRKTYDRPDNQLNPVSETFPYVFSTSRLTEHHTAGGMSRQLAYLSELQPEMFVEVSPQLAAERGLDHLGWAHIVTARAAIEARVLVTDRIRPLRVDGRVLHQIWMPYHWGGSGLVTGDSANDLIGIVLDPNVLIQESKVGTCDIQPGRRPVGRELLDYVADYRKRAGLRTEGH

SEQ ID NO: 13496 - protein, 305 aa, Actinoplanes utahensis
MAGNSLYGPLDPAPDAGYPDAPPRMGFFTDTSVCIGCKACEVACKEWNGVPDDGFNLLGHSYDNTGGLSANSWRHVAFVEQPVDHRNVDVFAEAAGPQFLGMPSRDLPGRTMDAPRTDFRWLMMSNVCKHCTHAGCLDVCPTGSLFRTEFGTVVVQEDICNGCGYCVPACPYGVIDQRHDDGRAWKCTMCYDRIGDGLTPACAKACPTESIQYGELEELRGRARQRVATLHEQGVAEARLYGHDPDDGVGGDGAFFLLLDEPEVYGLPPDPIVPTRDLPKMWKRAGLAGLAMAAAVVVSFLGGRP

SEQ ID NO: 13497 - protein, 64 aa, Actinoplanes utahensis
MVPKAEFRSYYGRPIVRPAVWRHDIAAYLFTGGLAAGSAMLAAGGDATGRPALRRAGRATALAS

SEQ ID NO: 13498 - protein, 530 aa, Actinoplanes utahensis
MARPATGRLAAPRPPQPGWPQQPVPLQGWPQQPVPPQGWPQQPVPPQAGWPQQPVPQPGGWQPPAVLLGPPAPPREPAKTDRLAAALGNASFLSLGYFLMRRTVLGVLTLLASLILLLGIVPAVHTGWIEIVAVLWWIAMIVHGWFLARGPVEPATRTRQRIVGIAAAAVVLLLLGGLRVQAATIGSAVDDAKAAGDCGGAVSKLDKLWFGLRVADGPMAAEGDDTVEACRQLNEADETLTGMLTAPSATGLTAGFDQINTVLTRFPGHEKMADAVLDGFLGKLPLSDACGTATITSWLAKRPKTNNTLDRSAEVVAKHEPAALAGCGDTYLNGQQWESAKVVYQQLIDTYPTDVNKPKAEEGIAKADLAIEFDAFKDATDSVSGNYCDTPVKYSAAKAYGKGVNRAMVFGNDTEAKRLPGGWKTTDPTVANLVLCVSGDSQGAAVRSCDYGSAGQHRVTFHKVKVTVRGYEVRSGKQIFSKTLQFSGTSCPHRIEYMTTLGVDLGPPRHMDVKVDANDVQAQFKPLIVK

SEQ ID NO: 13499 - protein, 330 aa, Actinoplanes utahensis
MTVRLTQYAHGGGCACKIPPGELEQIVAGLTGPDQQAGGDLLVGLDDGDDAAVVRIAAGTAVVATADFFTPVVDDAYDWGRIAAANALSDVYAMGGRPVVAVNLLGWPRDVLPLELVTEVLRGGLDVARQAGCHVAGGHSVDDPEPKYGMAVTGVADPDRLMRNDAGRPGIPLTLTKPLGVGVLNSRHKQTGEVFPQAVAAMTTLNRAASEAALAAGVVCATDVTGFGLLGHLHKLARASGVTARIDPAAVPYLDGAREALAGGFVSGGTRRNLDWVRPHADTAGVSEDELLLLADAQTSGGLLVAGELPGWPIIGELLPPEDGVTVVVR

SEQ ID NO: 13500 - protein, 862 aa, Actinoplanes utahensis
MLDFGLHVVDFASQPLVFEGAHGPAWMGQVLLNPVKPLPKVLAGQPQPIERHACPASLNPVRTVVTGVATPSSPRRMVAAAVLPMIAVPAFRSQVAFAAGSTPPVYSLAATVAPAPMTLADCNDPTCIVAPAPSGNDDYPTLNNLLLLAASRTVPAVLDADNNVVTPATTATVFLGEGTYRVGKVLKLPANVNLRGRGITATTVSMITANNVNFTYASIISWDFNHQIAGATSNLVSDLTVNGNCREGAGQPVPSDMPGRPGEFCDFRGADGKAASTNSGGGVSVGDNWTVRQVRFTNLEYFKVWVGNGVTNVRIVDNRFDNWGGAESGDEDNVGGGSRNDGVIVEYNQFDKTIRGNSFDFTNAIRTTVRNNVVRSDGTIATARKDTSLYGNMYFEGIQQATVTDNVLWGAQIALKSNSLYAHSGENRDITDPRDSIVSGNRISYSGETGISVTYDDYKDGPNASNLGQPGSWTDKSAPTDAFHVVRPGGNNVVRDNVIEYTGRSGIMVNGSYASAKNAADTITGNVIHNAGWGGSTVYDSGAGYFDTAGIGLSIGVGDQVYGNTIEDYPAKKTTWYGIDLGARRASTSPTGTVLTGPAGEVNTVTNVIGTAYHDQTRISEAVTNLSAGGKVLNWDEAYPLDGRPIRGYRIYRDGNVVGDLPIGSVSIPNNIMTADESNFENASAGTAGWVAGTRTTLARVAGNSSRGTASMTLTSSGTGEVSFSGRKINVTPGQVYTSVLSARAMSTAAAGKQVRAGVKITFANGTTQKWATNNKTAIDSYANWITSYYTFSVPADAVSVEPWYLIEGTVAGDAHMVDRLGLVAGTRTEQFTEANGPANAVYHVVSYTADDNSMPQSVVVP

SEQ ID NO: 13501 - protein, 402 aa, Actinoplanes utahensis
MTQAVTAPDPVRAPARPGPNRALNALRAVAAVLVVVYHLRQLLFVDAADAGDGLSTRLLYAVTNMGPAAVVVFFVLSGYWVGGSVFSGFRRDRFRWASYATARLSRLWIVLIPAVALTTILDRVGLALLSGTSIYLGDPAYHHTVPADGLAERLTAGTALGNVFFLQTMAVPTYGTNASLWSLAYEAVFYAVLPLALYAWRGRGGIGKRALSLVLLLGLCALAGPAVLKYLPVWLMGAVVALYREPVRNWLQARSAHWLAWSRAGASAGLTAGLWLAQASYRSVNVLLLATATTVLLALLVEDVGWTGVPGRVLGGLSDYADSSYSLYAIHLPVAAMTAALLTPHVAARWAPTATHWLALAGICAVLTAIGWAFAHATERHTDRVRRIADTLIASVAARTRT

SEQ ID NO: 13502 - protein, 257 aa, Actinoplanes utahensis
MDGVPLIVEPDRDEPGCAAVLVDGTIAGRPYRFILDTGAGRTSIVADAELARLPRRGSQQSSGLVGTSTADLLILPELTVGPLSWTGLEVSSTDTGHPDLRNLLGMDAIGAYPGRFDFDRGSWQPAPTGTLPTRRPLDRGARGHILVDVEWPGVTARACWDSGAGITVVGKTFVARHPELFRSAGTSSGIDATGATVEGAAYWMAAARIGGRMFAPHRAVAYDMPAGLDRVDLVLGYPALRQAVWVFDFPARRWSVE

SEQ ID NO: 13503 - protein, 428 aa, Actinoplanes utahensis
MDPRRQIPRTDAVLEDPRLVAAAVRLGREPVKAAVRAAQQRVRDGELDAADVAGAAVAALPETAGGLRTVLNATGVVLHTNLGRAPLSAAAVEAVVAASGHTDVELDLATGRRARRGRGALASLAAAVPRAGAVHVVNNGAAALVLAATALAACREIVVSRGEMVEIGDGFRLPDLLESTGARLREVGTTNRTSAADYAAVVGPQTGFILKVHPSNFVVRGFTSAVAVGALTGFGVPVVADIGSGLLAPDPLLPDEPDADGTLRAGADLVIASGDKLLGGPQAGLLLGDADLVERLRRHPLARALRVDKLTLAALRATVAGPVTPTWAALRYDPDELRDRTGRLAAALDGIPVRVVPSVAVVGGGGAPELQVPSWSLSLPISYAVSLRVATPAIVGRVEHGRLLLDLRCVPPAADPQVAAAIRAVSCE

SEQ ID NO: 13504 - protein, 109 aa, Actinoplanes utahensis
MSRGRDYPHATTPLTTTTRTHPPTRPPAPQHRPRPRPRPPEPAPTTPPAPHHRPRPRSPRPPEPAPTTPPAPHRPTAAVTTITGEAVTATAVTRSARPVCAPDPGRLLA

SEQ ID NO: 13505 - protein, 86 aa, Actinoplanes utahensis
MTAVAVTASPVIVVTAAVGRCGAGGVVGAGSGGRGDRGRGRWCGAGGVVGAGSGGRGRGRGRCCGAGGLVGGWVRVVVVSGVVACG

SEQ ID NO: 13506 - protein, 308 aa, Actinoplanes utahensis
MRVVATAGHVDHGKSTLVRALTGMEPDRWAEERRRGMTIDLGFAWTMLGSGTVVAFVDVPGHERFVPNMLAGVGPVPAAMIVVAADEGWRQQSAEHLAALDALGVRHGLLVVTRSDLADPGAATAVARAEIAATSLGAVEAVPVSAVTGAGLPELRAALDRLVGGLPEPDADAAVRLWIDRSFTIRGAGTVVTGTLGAGTLRAGDELALTGMDRPVRVRGLQSLGEPRAAVAAVARVAVNLRGVEKDAVARGAALLTPGRFRLTDLIDVRLHGAAFPTRAMPQPVPGEPPASVTPPVDAQAGRTGLSA

SEQ ID NO: 13507 - protein, 283 aa, Actinoplanes utahensis
MRVRPLGVDTVRLRLGRALPLRIGDRALLRDPGRHLVIAGVTVLDVAPPAVRRRAARVAELATMDGRPDLAGELRRRLLVRGSVLLGMGVPPRSPVAGDWYADPAHWAALRARLRDEVGDYVAGNPLEPGIPIDDLRHRLGLPDRVLVEALVEPPLTIRGGRVGAGPRELPAALLAALEKAFDRERPFTAPEAHRLSDLGLGARQLAAAVRLGLLVQLAPAVVLPAGAPERAADVLTAIPQPFTLSEARRALDTSRRVAVPLLELLDRTGVTRRLADDRRTVN

SEQ ID NO: 13508 - protein, 150 aa, Actinoplanes utahensis
MNDGFHADRTQEMFLAVAPPVPPQTGGADVIEVAAYRGDTVFEREVIEKLAAAAARSVPGVAELGGDVARFFNAVLDRVGLDKVGDATRGVHARVDGIDVDITVVLCLRAGEVVSEVTSEVRARVIEAVEKYGVQVNNCTVKVDDILMPE

SEQ ID NO: 13509 - protein, 33 aa, Actinoplanes utahensis
MPFVRDDLCEAAAMAAFGPRAGRRSSGPVSDPG

SEQ ID NO: 13510 - protein, 124 aa, Actinoplanes utahensis
MTRYLISFNDGAMDHIARAELGDVAEATHAVAQEAMDAGVWVFGAGLERQRASVVATDGVVTDGPYPETKEVIGGFAVVEVATREEALAWAARIAAACRCAQEVREVLPDAVQDEMFRRAGRNR

SEQ ID NO: 13511 - protein, 140 aa, Actinoplanes utahensis
MSRTLAIAAALAAACLAAGCSGGSGDDTDKTVAPAAQNSQPAVHSQPDLRASMEAQLGFPPKPDTKAAEAYVADLKSIDPKLVAAHDPEVLVNRGRDQCRDLKTRPQKDWATVASQRFTTPQANAARIIKVVRERLCPTY

SEQ ID NO: 13512 - protein, 383 aa, Actinoplanes utahensis
MYADPFETPERGTLREAMATFVRREVVPFLDAWERAGEIPRELHAGAAKAGLYGVGFPEEAGGDGGDTVDMVVATEAFLEAGGSSGAHAALFTHGIALPHMIAAGDPSLIDRFVRPALAGQKIGSLGVTEPDAGSDVGALRTTAVRDGDDYVVNGAKMFITSGTRADFVTTAVRTGGPGAAGISLLVVERGTPGFTVSRKLDKMGWHCSDTAELSFADCRVPAANLIGAEHGGFPLIAQVFVPERIITAVHAYSVAQRCLDLTLVQVRARETFGRPLISRQVVRHKLVEMRQRIELARTFTRRVAARHAAGDWVPGEACLAKNAAVDAGKYVVDEAVQLHGGMGYLRESEVERHYRDIRILGIGAGATEVMADLAAKIFEYDR

SEQ ID NO: 13513 - protein, 198 aa, Actinoplanes utahensis
MRRTQAQRSAATRTRILEATCQSLVERGYAETTTAEVQARAGVPRGTLLHHFPTKVDLLVASVQHVARRRLDALTAELAEVTGDGLDAYIDAVWHSFSAPMFWAALELWAAARTDEELRAALLPVEKEIFGVLHERAVAVLGDDPRVPGVTQMTFEVMTGLLMTGIVSGDPVAGELPIRRWKRAAATLLGRASSTRGQ

SEQ ID NO: 13514 - protein, 879 aa, Actinoplanes utahensis
MRFRRRSVPETLPVVVPPRRLSRPWALSVTVPATPERVHAYLTHAATMADWMVMHTGWPADPPGVVHGGSRFRQRVRLMGTPVEVRWTVRDAERPRTLWLDGTGPMGIEVGVYLSLAAGEGGTVVRLDGGVQGGPTDGPLGAMVARSLTDALRTSLRRLTAVDLTATGPVIGGPDDAASGRVRPPEKSGKIRHERTGIDLDPWTPVIVGAGQVSDRSSTDDPVTLAVRALREAATDAGRPGLLPMADTIGWVASVSWQYLSAGALIAEAVGATPTHTVQTSLFGGDGPLRLLNDIAAAITRGETSIALLAGAESAATAAAADRAGHPLNWPRQPDGTAPTRILGSDREPNNTPETDAGLVSPLHLYALIENALRARHGRTPQQHQAVITELWSRFADVAATNPYAWLPGPRTPADLATPGPVNRPVCHPYTKLLTANLQVNQASGLIVCSVRAATEAGIPQDRWVFPHAGAHASDAWFVTERDDLTASPAIGAIGRAILAHTGTTINDIRHIDLYACFPSAVQIAAAELGLPLDDPARPLTVTGGLTFAGGPGNNYAGHSVATLVSRLRADPDGFGLATALGWYLTKHAATILSAHPPRAGFRDIDAGLRLPRALRPAASSGSGGTLEAYTVTYHRDGTPATGIVTELGPDGTRIVRTADPASLLDGDPLRPFPRPAALTPVEVAWHGPVTVIRLNRPEARNVVDPLTARALQRAIGDFEADPDARVAVLTGTGPTFCAGTDPETAALGPIGKPLIAAVEGVAVAGGFALALAADLIVAADDALFGLPEVTEGLVAAGLTRLARRLPRAVALELALTGEPMPARRLHDLGLVNRITAPGKAYGQAIDLAVSIAAHPAAAVLLSQRAVAECGGDDLRRKG

SEQ ID NO: 13515 - protein, 528 aa, Actinoplanes utahensis
MSVLENVHAVLRMHQIGIVNLLRPDRLAGAAVRNARLGPQAALIMKAAAEHPHAPALTDERGTLNYRQLDEQSNALARALTELRLPPRSVIGVVARDHRGLVLTISAAARAGLRLALMNTGLAPQQFAEVVARENVRAVLYDSEFAALADAVPDTVPRYLTWADEGAADRTIDMLIAGQPTTPLPLPDRPAGFIILTSGTTGLPKGAPRTRVSPLASALIADRIPFPRQGAIVVASPLFHSTGFGAWTVGLALADHAVLLRRFDAERILRAIADHRASMLVAVPTMLTRILALGPETIARYDTTSLRTVFVAGSPLAPELTNRFQDTFGEVVYNVYGSTEVAVASVAQPAESRRAPGTVGRPPVTVRVALYDDEGTRVTRPHVTARVFVRTGIPFEGYTDGRHKQVIDGHMATGDRGHLDENGLLYIDGRDDDMIISGGENVYPVEVENLLTERDDVIEAAVIGVDDPEFGTRLRAYIVPAEHSARDPQEIRDYVKALLARYKVPRDVVFIDELPRNATGKVLRRLLQ

SEQ ID NO: 13516 - protein, 550 aa, Actinoplanes utahensis
MGPVTAYRGKQVLILGVLGHAGRMSDDGSSADKASAADSAHAPERTDAAATGKTDATGAAATGKTDAADATDAGAVTEKADAAAAEKAGPAAPEKAGPVDKGAQTLVILGASGDLTGRLLLPGLGALVAAGEAPPLTLIGAGMDDWDAQKWRERVTGAFPESPAGKTVIDGTRYVRADVTRSEDLRGLLEGADRPVIFFALPPAVTAKACEALLDVDLPDGTRLVLEKPFGTGANSAAALNRLLTRLVPEERIHRVDHFLGKSTVLNILGLRFANRIFEPLLGSEHVESVDIIFDENLGLENRAGYYDRAGALADMIQSHLLQILALLSMEPPTSLDPQDFRDRTAEALRATRLWGGDPKTASLRARYTAGDLDGRQLPAYADEAGVDPSRETETLAELVLAVDTWRWAGVPFRLRSGKAVGSSRKEAIITFKEPPRLPTGLHGPERPNRLRIGFGPDRFALDFTVNGPGDPFELDPVTLETDFGPGDLPPYGEVLHGVFDDDPLLSVRGDTAEQCWRIVEPVTAAWRDGQVPLVEYPAGSAGPAETLLQ

SEQ ID NO: 13517 - protein, 143 aa, Actinoplanes utahensis
MPSDFALKSMNAVHRALLRVSGGRFGYRVIGMPVLELVTVGRRSGVPRAVMLTSPIRDGEAHVVVASRGGDDRHPAWFLNLRDRPQVEVAFQGGPRRPMIAAVATPEERARLWPEIIAGFPNYAGYQRRTEREIPLVLLHPVR

SEQ ID NO: 13518 - protein, 261 aa, Actinoplanes utahensis
MPPDTYARDDDSVDMAENLDGRVALVIGGSRGIGAGVAARLAEDGADVVLTFQHRDDQAAVVVKQIEGFGRRGMALQVNSADPEAVTSAVDRAAEQFGRLDVLVNNAAVFFVGPVEDFGREEFDRMIAVNVRAPFLAAKAAARHMGDGGRIITIGSNMVERTVFPGFSLYSMSKTALVGLTKGLSRDLGPRGITVNLLNPGPIDTDMNPADGPASATIIGFTALGRYGTPAEIATAVAYLAGDGARYVTGAVINVDGGFSV

SEQ ID NO: 13519 - protein, 159 aa, Actinoplanes utahensis
MSGELQVDYATFRRMEFTDPRFGLRMLAAWIFALILLGSGVWHVLTEPISVQHAYLFLFALGLAAIPDALIGLSWLTQRKRYAVPARYQITAQGAAEHTAAGTRQVAWSEVARVNRGRHAWTIKKAFGAEAFVIPRAAFTPAASKTINDFFLAHPEFAG

SEQ ID NO: 13520 - protein, 580 aa, Actinoplanes utahensis
MSRRSRRGRRAGGTAVEEARQPNRRPPPWSPWSAAPPARVRFGQTRRGHHLAPAATACIKATGNAASPCNTGRRRRRTQARMAGTAGVFVAVIAVAAGVAVFASPSARQPDLAQSSGPAPLPTGALPTVALSLSKPYHDLWPDALVALPLRLPDGRRYSVKAELGADRYLLEPRDDQRRYLPVVFNARTGVTRELGTVPTSGFTVYDPAGTYLTDHYIAWVVSAQETRGAKYYEVWSAPRDGGTAVRRATFGPDEMTVSVAEVGGVFYAGTEPAEGAGAIYRILGGAVRYARRRARRILPVYWAALATSALIAAIVPSLPLSAPPTLRSTIVYALLLQDALAAPAPNGAFWSIAVEAGLYLAFPLVLVARRRCGATVTLAAVTVPVITAGLLLPELSLRPRAIGYTLELAPLFTMGVLAAGIVSASDRVRRLPWLALAGMTGAPVLMVIVLRGSAWAVVHYYWLDLAVGPAIGLFLAALATRRPLRLTRLLNGAPLRKVGGFSYSLYLIHMPIVALISTLLVGPRTGPHLTTFIVTTVLVVPICLATVRLFAAVFEIPFQRCHRRRESGPVHISNASACS

SEQ ID NO: 13521 - protein, 197 aa, Actinoplanes utahensis
MITVAAGSTLTLRCPDMETIPLVCLAQVRAPFIADLPPLPVLSLDEPGVRRYGILELVSSAGVAWVEAELRGGLITVLGDSPTGVVQRRDSPRIAGTYPAFGTAQVDTGPGQRLIALSGHVRDVSTSGLLLRATAGDDSPHLPTAILRTLLHVTMPWGEMTASVTTVDQRADQLRGTFDWIDPGDAKALAAFVGARR

SEQ ID NO: 13522 - protein, 260 aa, Actinoplanes utahensis
MSIGANESAARLAVLVDADNAQPAIVEGLLAEVAKYGTAHVKRAYGDWTGTNLRGWKEHLLAYSIQPIQQFAYTTGKNATDAAMVIDAMDLLYSGRLDGFCIVSSDSDFTRLAARIRESGLIVYGFGERKTPKPFVAACDKFIYTENLTAPHSPAEPADAPAAPQPPIPAARLKSDSALVNKLRNAVEAASDDDGWATLASVGHILTKQSPDFDARNWGYTKLSDLLAATALFESERRTTEKGKTAVIYVRDRRRRKETA

SEQ ID NO: 13523 - protein, 363 aa, Actinoplanes utahensis
MSRLILDETAEIGVDSRGLVRGEDTVAEWRDPDGPLPWAVEDWQPEPEIVACAQLGEWAAVLARVGRHAQLGVRRDGRRPDWHGLSKSPEDMNRGMVGATLLGPLRLAEVTAVTRREDLIGVQVQGARRVQQIVVPRHVENPPGDALDPALARHAVTAIAAQAPGAPLDLPDELTRDLQRLLHRKPFRTTWIAVGLRVAETWELPGGFQVPVVYDVEPGQVQGFVVDEATGAPHSTLQACRNHHLSGRPAWCSYCLSPTCGACAEAVRPCRLCQGAVCGDCVATADGRCPACARLTRVGMLARGRYGVSGGGSVWHGEVPNVQVTIREQRNYWTLERWDRYDRVTFPLDPPTIHALREWVKTS

SEQ ID NO: 13524 - protein, 243 aa, Actinoplanes utahensis
MRKAPIGGPPPSDYRQSRSDLSSFSTVSARRQGATAIATSAEFAATRHRVAVVGQDRAGLALARAAVTAGHTVVGFDHDAGLVAELRAGRSPLGDDLVRMHETGRYHVTDDPAWLSGCTVHLIAVPAPPHRGRPDLSLVLAAADTVAGHLRDQDLVVLESRVAPGTTRGVFQDALAARSSARYLLAFAPDRNGHAKLAGGVDRRSTLAAAAFYRTMYDVVVACATAEEAEAANLTDSAGRRSA

SEQ ID NO: 13525 - protein, 111 aa, Actinoplanes utahensis
MDLHPQDYDDLVHGQSMVEQWRRSDHAVAVAAELMKLHGGTVPMSELLWAGAEAFLPRQWNAGRAAEPADAAAEVYDRWRRLTDRRLQRQRQAEAARAEQARQEQADGNKS

SEQ ID NO: 13526 - protein, 257 aa, Actinoplanes utahensis
MADFDMRTADLTALNSLTKYPSIPTYHELDPRNGGLTETVTVLPGPVYASEKIDGTNSRLIMLPDGNHLIGSREELLYARGDLIGNPSQGIVASLRTVAENLPDQHLPADTLRVYYLELYGGRIGAQAKNYSTRGAIGWRLFDVAEVSGLAELLTWPAPRIAAWREDGGQTWATEDELRAVTAFDLAPQLFTMDGADLPADVAGMHAFLGERLPRTLVALDDSGQGRPEGIVLRTADRSVIAKARFQDYERTLKRRR

SEQ ID NO: 13527 - protein, 219 aa, Actinoplanes utahensis
MHKSRIIAAALTGVTATLLLTAAPALADDTAVLTTDALAGPAVAVGDTISAGIVSGSLARFATAPGGSNGMKCSTSSFSATVNDNPAAPGAAALGATLAVAGCTVSGVPGVTGVNSVTINKQPYATTVASDGTVTVSGTDAAPISATLDLKSLLGSVTCNFVAANNTISAVADNTDNSITFTDQHFTKSSGPAACVADGYFTARYTPVVTSAAAPVFVN

SEQ ID NO: 13528 - protein, 337 aa, Actinoplanes utahensis
MVPVAGPPSITRHWKPRNAAETAGTHPPSIAIPSKEWRMTASRLTFILAMIAASVATVALTPGAARAATYSGMENCPLSAPAMKDPSNLQVGCVYSVTHGGSVTIGSTTVALNNPITLQFGVYWPASAPTRTFPDGSEANVYSTVPAAGGRTLVAKPLQVAIPGIANIIPGVTSVFAQVELAGPITGFVPLATGEDTPVFVMPIKLHLYNALFGARCYIGSDTDPIRFSPTTGTTSPPAPNKPATGDAGTISIDPDPNGFQTLGVGFTGATLVDNAYAVPKASGCGLIPGSLDPLIDLAFGPLPSAAGRNAVVFSGNDTSFAVSPSLDDLTRALAAS

SEQ ID NO: 13529 - protein, 243 aa, Actinoplanes utahensis
MTNTAIGPLPGARAGRDPARAIKRGPRSMTPEAVAATQRERLFDALVHTVAEKGYANARVSDICTAAGVTRPAFYALFAGKEDAFLDTYRHGTGVVLRLMDDAYANAGDWHDGARAALKVLLDVLASVPAFAAMAIVEIDAAGPLARRERTELLGRFARFFAEAPGVPDGLVGAIVGGVYAAIYGHVSTGRVAELPDLLPMLSYFMMAPFLGRDGAAAELACQPAGERVVAPCATSDTDEVFH

SEQ ID NO: 13530 - protein, 201 aa, Actinoplanes utahensis
MSSTRYGHTRWRRFTAMLLGGLAITVGLVLLTGRGVLAASFSISGMPFTVTSPKLHGYGFEQYAELDQMAPGSPNEGDTGGQVVVIVSAIKDAQLDGLCQSIALGGINLKISAGSATNKVTADTLVVDSDLITGNADFKAIDIGRDASTLDRVKGKTGAIGVFGQQAEEVTITNLKQNNYATTAATFHLPSLHMSFTSDGC

SEQ ID NO: 13531 - protein, 150 aa, Actinoplanes utahensis
MSGSAGADHRVSPGARVWRAFRHWQLARPFWGGLLVLLGGLEILMTVWAPLGVVLHVGMQNFIGYLLPLVIVLLGLLILFNPAQRIFYSLIAMVCALASWITSNMGGFLIGLLLALVGAALTFAWALPAPVPVVAEAPEPRSPDNPEPSA

SEQ ID NO: 13532 - protein, 112 aa, Actinoplanes utahensis
MTMSSKWSAVTATLLFLGGIGIVQGVAVSPATAAPVPAGVVAGGAHGGAAVGDRDFRQGYRDGYSDGWRQAKQDCREPLTAFRGLRNRDDDYARGFDRGFGRGFAAGFREYC

SEQ ID NO: 13533 - protein, 338 aa, Actinoplanes utahensis
MVDCRIRWESPFLEVAMRRRTLLKIPALGAGAAVTVPHRPDLIIEPGDSVQAAIDAVATGVIGLRPGVYRGRVIVPADRIGLELRGLGRRPDDVVIADDRANGTLKPDGTPWGTSGSASVTVDGAGFRAVNLTFANLFDEAAHPEITNRQAVAVLTRADRLTFDRVRFLANQDTLYVNSTAAGVAARAYFRDCYVEGDVDFIFGRATAVFDRCHLHSLDRGTSPDGYVTAPSTDAANPHGLLFAHCRFTSNAPPGTVFLGRPWHPGNDPGATGQTIIRESWIGAHIGATGWSDFGSWPWRAARFAEYRNFGPGARCGPDRPQLSRAEATSYDIEDFLW

SEQ ID NO: 13534 - protein, 938 aa, Actinoplanes utahensis
MVKFLLALLLALGGAAVPAAATAATEHTVTFDRYSLMLDGRRTFVWSGEFHPYRLPSPDLWRDVLQKMKANGYTATSVYFDWGYHSPAPGVYDFRGVRDMDRLLDIAAEVGLYVIARPGPYINAEVDAGGFPGWLTTQAGKARTDAPDYLAASDEWLGRIDAIIRRHQYTDGHGPVILYQIENELAAVGDSQKRYMRHLYDRVRADGITVPIFHNDKGRNGYWTPPAADLYAFDGYPGGTCRTDGTVGAPAVAPDWGMYGPGGPKGGATASPDTPGFVAEFGGGWFDYWGSAGTYPCTAQREGPGYERVFYGTNIANRLSIQNFYMTFGGTSWGWLPAPVVYTSYDYGAAIAEDRSLRPKVNTMRELGYFLQSTPPITKLERGPDLVPSSGAIKVYHPVNPDDGTQFLIAVHNPSNARTDDTATVPLTVDGRAYTVPLRINGQDAKILTAAYDVSGQRLVYSTSELMTHTADTLLLYGRDGETGETVLNYPAAPVVSGAVDSSYDPATGDLRLSYPHVGLTSVRISGGGRPAVTLLIADQSTADTFWKSGDVLVQGPALLRDARFAGDELRLTGDTAAATPLRVWSPRPYRTLTWNGRRVAAPGRPTVSRSGPLTALLPGPEPVTLPALDRWRWSAEPEESDDTWTPATLTGTNSTTEPPAGQPVLTADDYGFHHGDVWYRGHYTGSLPDTVTFDYGAGGAGMLQAWLDGTYLGQHTLPTALASPPTRGTATFTVPEARRATGDHVLSIMVRNNGHNEDGGVNDAHKEGRGLISTSVPATWRIQGETPDPVRGVTNNGGLYGERHGWSLPGYPDRTWSAPPATTPTGTSWYRTTVDLHVPRVDDASIALTIGEPGVKGGHYRALIFVNGWNMGQYIADVGPQHTFTLPAGILDPHGHNTLALAVTGDGGTLEPLHLTTTTVVRGGVPVRRVASPPYRH

SEQ ID NO: 13535 - protein, 158 aa, Actinoplanes utahensis
MRGRSPQEEVEQYGQCDRQQDRHHDHAEAAGRATEEPDLHVSDTHGHPPTRTGHGYTDGGGGRAWSCILNALLAVPIFAPGTPAWAASKLGGRYLHHCCAAIGVGHAKRWGATDHDWFWVDGDRKVAINTTSACWQTYGTGVVDRLSSYPTGGWECWG

SEQ ID NO: 13536 - protein, 51 aa, Actinoplanes utahensis
MLIFGLILLLLGIFLHVSILYTVGLVLLVVGAALWILGAVGRPVGGRKVWF

SEQ ID NO: 13537 - protein, 141 aa, Actinoplanes utahensis
MGAGRGSRNRAVGTRLLGAALLCSLLTACGDAEVAAPAADPGAAAGVTDCGTFTLGQGESLPASAARCLIEAVHAGRPARLAVTRPTVEGDPIPVTYTAGADGRVEVVTDARRDRFGGRTVTRDFCTGPSATPELEFARCS

SEQ ID NO: 13538 - protein, 401 aa, Actinoplanes utahensis
MDGMTVLLLATLVNAIGNGAYVTISVLYLTTVAGLSPAMIAIGLSAGAAAGVLAMTPLGYLADRHGPKRLSILALIVLAGAYTALLAVRSPLAFGLLSCVIAVATALVKGANGALAAGSVAASGRLRMRARMRTMTNAGIGLGTLGGSIPLLLQTDRAYVVILLVNAATFVVAAALLTRAPAVPPQVTPPGGPRLVALRDRPFLVFAAVDGLLSAVYNDLLGIGLPLWLAAGAHAPLWLISVTLVINTAGCVLLQVRTARDVHDLPGARRAAVRGCLILALSCAVLAATAGHPPWLAGTLITLAAIIHVVGELWLSTGSWGIVFAITPPWAQGQYQGTYFAGRGVGDMLAPPLVTACVLGLHSAGWLVLAALFAAGGAIYPPVTRWAAARITSIERTPAPA

SEQ ID NO: 13539 - protein, 39 aa, Actinoplanes utahensis
MPSGAMGAGRRPAPSVMIRRAAAMAVGCLMRLPSPGTPR

SEQ ID NO: 13540 - protein, 198 aa, Actinoplanes utahensis
MLKIRTAVFMATGALAALGVAGTALAADGADDTSASPSASMAASYDRGGAAVGVAEAKAIAIRVAGGGYVRSVERETEHGRPVWDVDLIVGGVEHDVDVDRASGEVLRHRIEGANGPAASGGATAAASASADDHGRQAEPGDDRGGASTRSRRVEPGDDNGGAGTRHAEPGDDKGGHGRGGDDRGGDDRGGRGRGSDD

SEQ ID NO: 13541 - protein, 64 aa, Actinoplanes utahensis
MIIDDSSPFSDLDAYTALPRLGGLRLSPDGRRLVVGVATPDRKKNRYVSALWEIDPDGGRPAPS

SEQ ID NO: 13542 - protein, 549 aa, Actinoplanes utahensis
MAGPDGTVVTGASVLTSAADLDADRKLREGRRDAGVSAILYEEYPIRHWDHFIGADRTRLIALDLGADAAGQPVPRDLTGHAGRALGEEPAWDLSPDGRTLVALWVVAEPAGSQRTTLVAIDVATGTRRTLADDEDYEYDGPRISPDGTRVAVVAYRRSTATDPGDRKLMLVPLAGGPQRSLTEAWDRWPETIRWAPDGAAVFVTADDQGRCPLWRVGADSGEVTRLTDDDGAYTEFEVAPDGSAIYALRSAVDAPPAVVRVALDGGGVAELPGPAGRPVIPGRLTEVTATAEDGTPLRAWLALPSTATAADPAPLLLWIHGGPLASWNSWQWRWNPWLAVARGYAVLLPDPALSTGYGVAFIRRGWGSWGAAPYTDLMALTDAAEQRPDVDETRTAAMGGSFGGYMTNWIAGHTDRFTALVTHASLWALDQMWGTTDASFYWIREMTGEAVPANSPHLSADRITTPMLVIHGDRDYRVPIGEGLRLWWDLLSRSTAADGSSPHKFLFFPDENHWILKPAHTRVWYETVLAFLAHHVHKEPWSRPELLG

SEQ ID NO: 13543 - protein, 260 aa, Actinoplanes utahensis
MLAPGIVLNGRYQLTHRIAAGGMGEVWRGGDRLLHREVAVKVLLPALMNDRDFITRFRSEARMMAQLRHPGIVQVYDYGENAVVDGERFDYLVMEYIDGTSLSKKVQQAGRLSPAETMAITAGVADALHAAHQAGIIHRDVKPSNLLVRPGGAIVLVDFGVARSVGITGITGTNVVMGSAHYMAPEQAEGQPVTAATDVYALGAVAFTCLTGRPPYVGDNPLAVLAQLVHGQPPVLPPDVPRPVAAVVLRALAKDPAQRF

SEQ ID NO: 13544 - protein, 179 aa, Actinoplanes utahensis
MILGRCSHFDMSEMVRLSGTDRRHLWMVMKRGAWTVVTLGLAAATVFGAVPARADESKSADKSATYCRLRVHGGILSHYRTLGSDKGRLGCPMGIEQSAAGGGRMQQFDGGSIYWSAQTGAHAVAGRILQLWQGNRGEAGCVGYPVDEESDTPDHRGRYQHFQRGTIWHWNDGRVSAVC

SEQ ID NO: 13545 - protein, 118 aa, Actinoplanes utahensis
MGSRVLAVRGRTSGEVRTTIVNMFTHDGERYLLAPRGHTQWVRNLRVAGEGELRLGRRSERFVATEVADADKSELIRLYLRKWAWETGAFFDGLTADSPEADISAAAPGFPVFRITAG

SEQ ID NO: 13546 - protein, 40 aa, Actinoplanes utahensis
MTGVHCLQERALLSTEETPEDVMRYLAPKSATNVFNDFAK

SEQ ID NO: 13547 - protein, 198 aa, Actinoplanes utahensis
MRVNETAATRARRAQIVTAAIDTIAELGYANASFARIASRAGISSTRLISYHFDDKADLVRAVVGAVLGEAAAFMGERMRSARDRTGLLTAYIQANLIFIAEHPAAIRAVIEIAAAARTGEGAPLVDPADADDPGARLATMFREGQEAGEFRTFDPHVMAVTLRAAIDAAAVQPDLDPHAYAAELVALFTRAIRKDEL

SEQ ID NO: 13548 - protein, 213 aa, Actinoplanes utahensis
MVKTPSRPSRFAPALPILIDFGLPLVVYYGLRAAGVDQWWALLLSGVIPAVLVIVRFARTRTVDYPALFVLTIVALSLGVSAMTGDARTMLIRDAWGGLFGGLIGVWLLASVWVGRPALMYLVRAFVLAKVGEPGLRGWENRWHTDPGFRHGLRTITFVWGCASLLNMLVTVLAAVLLPLDLAPAVLNAGWPAIAVPTFLFHLYYTRKKDLRA

SEQ ID NO: 13549 - protein, 414 aa, Actinoplanes utahensis
MTYDVIVAGAGPTGLMLAGELALGGARVAVLERLAARTGQSKALNLQPRSAEVLASRGLLDDILVQAPALLPHGHFAGIPLDYSTLDTPYPFQVGIPQARVEERLAAWATSLGAELRYGTAVTTFAQDDGGVTVDGERAAYLVGCDGARSVVRKQAGVDFVGRDARVCALVADVTLAGDGPAGWELPAPKGDGMLTVLPLGDGVFRMLAAGPVQAAAGRDDPIPDSELADALARDGLTLDAVRWASRFTDATRQAARYRRGRILLAGDAAHIHSPAGGQGLNLGLQDAFNLGWKLAEVIRGESGDALLDTYHAERHPVAARVLQASRAQGVLYIADDDVLALRAMVTEFVDTQALARRVAGLDHGDRIPGLDLTRLHDGRRHVIDGVPVRPDGFRWSAPASAAVSAQAAANWVR

SEQ ID NO: 13550 - protein, 610 aa, Actinoplanes utahensis
MYHAMNQQDEKRPFSLATLRRIARFARPHRRALTGFLTLSVVAAVLAVAGPVLAGRVVDAIVGGADTGLVVRLAAAIALVALGESGLGLAQRWFSARIGEGLILDLRTTVFDHVQRMPVAFFTRTRTGALVSRLNNDVLGAQRAFSDTLSGVAGNLVTLILTLIVMIGISWQITVLALLLLPIFVWPARRMGGRLARLERAAAEHNAAMNTQMTERFSAPGATLVKLYGRPEAESAEFAARARRERDIGVRTAMAQWTFMTALVSVSGLAIALVYGLGGYYALRGSLPAGDVVALAILLTRLYAPLTSLAGARVEMMSALVSFERVFEVLDLEPLIREKPDAREVPDGPVSVEFDGVRFAYPSADKVSLASLEEVATLDTRGGSEVLHDVSFTAEPGQMVALVGSSGAGKSTMAGLLPRLYDAGAGAVRLAGVDVRDLSAASLRATLGMVTQDGHLFHDSVRANLRLARPEATEAEMWAVLRRAHVADLVAALPDGLDTVIGERGYRLSGGERQRLTIARLLLARPRVVVLDEATAHLDATSEQAVQAALGEALAGRTAVVIAHRLSTVRAADQILVIEQGRVVERGTHESLLSSGGRYEELYRTQFAAA

SEQ ID NO: 13551 - protein, 592 aa, Actinoplanes utahensis
MPRSTCPAAIRMSPLPLSGRSMSQCARPSWSKARSQFQEKFAREFEVVPWISRIGVRPFAGSPVQCRSAGCRCAGAGTSSRAVDSKIARLTWTATIRPRLRLPDPLHEPEIAHQGGATVARCPSRAGIRPGGDDPTGIRGPARCRSARDRRNFSAVDKGFAVVRGLYRCLRLAALTAVLPLVGVTVAGGGALFAGTWTHGRHLSWPLRTLIGAGQVLIVVVWVAAALWITHLLTSRPLAGSARRLAARWLDRDLAVTYHPPAPVTRMATGFWWDGREYHKTEREARRRSAMHARFHDPQVTGDGIWALAAGVTVFPVTVLPPLAGTAGLLAALVRPASWGAVAIPLGVVLILAGGAAAPFAWRIFRPVADRFLGPGARIRLGRRVAELETLQADLTETQAAELDRIERGLHDGAQARLVAMGMSMQAAERMVDTDPAAAKALLAETRAASRAALAELRLLVRGINPPVLVERGLVDALRALALDLPVATEVTAAVPARPERPLESALYFAVAELLTNVAKHAHARRVTVDLAHAGRTLTATVTDDGTGGAAPAPGSGLHGIQRRLAAFGGTLEIDSPIGGPTRATVSVPCVL

SEQ ID NO: 13552 - protein, 220 aa, Actinoplanes utahensis
MRVVIAEDLFLLRDGLVRLVQAYGHEVTAAVDSGPAALEALLTERPDVAILDVRLPPTFSDEGLQAALAARREIPGLPVLILSQHVEQLYARELLADARGGVGYQLKDRVLDADDFIDALTRVAAGGTALDPAVVAKLLGHPRRADPLATLTERERSVLALMAEGISNTAIATRLFLSEGAISKYTTTIFAKLHLRPDDNDTNRRVRAVLTYLAADRPDD

SEQ ID NO: 13553 - protein, 341 aa, Actinoplanes utahensis
MTDLERRYARLIHWCYPAAYRRARGTEILGTYLDSVSPDRRRPTLADTVDLVTGGLRERVRACGLADLAPGFRLAGTFAMITATALAAGWSVVELVRRFAWDDPRPGTFTSIGILVWASWLLASVVHVAAPARWARPAVIAALLITVGIAPLADLLARLRPPLFVLLPQAALGLLALAGAGRGRLAVRLLPAAAAAAITATALAAGVLAGPYLDPFMIYYRAADHELPAAGTILLTAALATAFTLSARGDHRGAQALLALPAPIALLAIHPLTAAITGTAANVPNPTWSSMAAVAVLVIVAALTVLLIAATALRHRTTAAPPARPRCPTCGANRPAGAGRR

SEQ ID NO: 13554 - protein, 137 aa, Actinoplanes utahensis
METPLREPTFLILTALAGEPLHGYGLVAEVSRLSEGRITLRPGTLYGALDRLTDAGLITVDREETVDGRLRRYYRLTDRGTTLLTEETDRMRRNVEAATTRLRLAPSPARRGRRTPGTTFGRSLASPGTALRLGGWA

SEQ ID NO: 13555 - protein, 459 aa, Actinoplanes utahensis
MAGAVRRGGQDRRRTPVVVAPQARRDRDRTALPAHRPRGRGQAERAGVRARLTLLVAATTVLVLLAFLVPIALLLRQVAQDRALSQANTVVRTIVPFAVGDVPALRTAVTGQAVPVTVFHWDGTVVGAPATVTPAVRLAAAKGQSFTVSTPAGREVVVPVVGARGTSVIRTVVADADLTRGVSRSWLTLAGLGAALLLLGLLVADRLARTIIAPITQLSAVSHRLAGAELTARAAPAGPPELREVAGALNHLATRIQDLLAAERERIADLSHRLRTPLTALRLEAESLQDPTESARVAAAADGVARAVTAAIQQARREVTHQPAGCDATAVVSDRVAFWQVLAEDTGRPVTRSLPDTPLPVAVAADDLAAALDALLGNVFAHTPDETPFAVTLTARPGGGATLTVADEGPGFPASATTRGASGGDSTGLGLDIARQIATGFHTEGGPGGAVVRLELPAP

SEQ ID NO: 13556 - protein, 175 aa, Actinoplanes utahensis
MPGPSLAAVARPATDMDADRIAEICTAAYRAAYRELLPPGYIERTAGICFGAARVARQVPADPPRWFGYQVAEEGDRLVGAAGGGLTRPGIGELHLIYLDPAERGRGLGTLLLDRVIAQIREAGGTEVWLSVFLGDGPGIGFYRSRGFQPMATVQADLSREDDHIRSLRMRRALR

SEQ ID NO: 13557 - protein, 329 aa, Actinoplanes utahensis
MRRGPGRYLWWLAGQVRGRLALGMTFGSLWFFSLAAMPWLIQQAIDQGVTPRRPGPLVAWSFGVLAVGLANAILGILRHRNMTRLRVDAALRTADLVLTHAVRLGAALPRRITAGEVVTIGISDVWQIGRGMNVGGVGVGSVLACITIGVLLGHTAPILSLVVLAGVPLLALLVIPLLAGTQRAGSRYRERQGALNARLVDVIGGLRVLGGLGGSATHLERYVRESARLRDQGYRVGRPSSWVNALGDGLPMIFLAGVVWVAARMAVTGEITVGELTAVYGYTALLVIPASVLIFCGFDLAYGVVGARRVTAFLRLPLDDPAGDPPLAS

SEQ ID NO: 13558 - protein, 123 aa, Actinoplanes utahensis
MAHDVADDLGRHVEGDGRNLSGGQRQRLRLARAVHADPEMLLLAEPTSAVDAHTESAIAERLAAARRGRGTVVATTSPVLLDRADTVHYLVAGRVAASGTHRELLDTDPGYRALVTRVFGDDR

SEQ ID NO: 13559 - protein, 573 aa, Actinoplanes utahensis
MSAALPIADQRQVARAALALIAADKRSVAAMTLLNSLAALAGLGSPWLLGRVIDTVATGGGVHAVDRLALAVLGCAIAQVLLSRFALALAFRFGERTSARIRETFLRRALSLPASVVERVPAGDLAARGTTDVDAVATTLRDVLPRILIGLAEMVFIVVAVVLLDPLLGIVGVLGLSGIWFATRWYLRRARDAYLREGESNSWLADELAATTSGARTVEAFGLADRRLAAGHAAIDETRRTRLFTLRLRSVFFPVTETFYAVPVMLVLLLGGYLYLHHRVSLGTVGAAVLYLRQLINPLDTLLIRIEQLQSAAASFARVEGLVRIEAPPVIRDRTPDGDRIEVRDVRFAYDSGRDVLHDIHLTVRPGERLAVVGLSGAGKSTLGRLLAGVDRPTAGTVTVGGVPIAGLPPELLRRQVVLVTQDHHVFRESLRDNLMVAAPDDELRRALATVGATWADDLDRDLGAQPLDGAQAQQLALARVLLAGPHTVILDEATALLDPTAARDAERALAAVLHGRTVIAIAHRLQTAHDADRVAVLDDGRIIELGTHDELIAAGGSYAALWRSWHRADQMR

SEQ ID NO: 13560 - protein, 277 aa, Actinoplanes utahensis
MACRVARSGSPGRSPASSSRSTAALRRGMISQPAGARSISWAGKRRWRASASTSPQAGQSNCLRTVHPMGPACTSCPGGASRVARRTDRVSASVAADLPATTRSGGRRDAERRGGGRRRRGDGGRRRDGERRRVAGMTTPNTGIELVRLSDSDQMVGDPAEDVRGRQVRDRDGHELGRVDDLLIDPAEHRVRMLCVAHGGILGFGATSSFVPIEAIRAIDDDVVHVSEPKQIVAEAPRYDPALIDASEYYNELYRHYGYAPFWSGGYLYPGYPYYRI

SEQ ID NO: 13561 - protein, 116 aa, Actinoplanes utahensis
MEAAGVAKAGHLNAAPVAVIRGISDFANGTKAASDGASWQPRAAEHAAAFAAALAAEIRPRRTAAPSAARQAEPVTVENHNTVTGNARVGMQGGTIAGDVHFGAGFWDDATGSGRR

SEQ ID NO: 13562 - protein, 416 aa, Actinoplanes utahensis
MKSSDNRPPTTTTNNHAGDNARVGFQGVVHGDLKLVVPPDASPAEKFQAAKAHLDSRSITTARKLMEEVVHAGHTSAEIWFYWLLAYLSRRTLRELSPTERDRLEKARETAAGVPGADRWTRGIRVIGQVLDAAESGAGQSTSITECLIGLDDKPQDEIHRHLGLLLRDAVRNDVWRQDIASAIRRQRAANREKRVWKFFEPDPRAARVYPLADRPSDAQMAEWLDCDVQVLLDQTMSRYQLRRDEIQTYASLEAPGPNCRNARIPNGPWRYSTYRIVVFLLTREGVRQIEVDLRFAQGTFHSWNRMNYRFEAVAAVRVEEGDDGARDFDLSLISGENVEVRATDSTQADPAVEDPRIVADASMDAAGLRSTLFMLEGVAAEGRAWWHARHPRSSDPDDDPVRRMGGKRETAEPRR

SEQ ID NO: 13563 - protein, 72 aa, Actinoplanes utahensis
MPEKKSWSDLSRGQQRAIMALAAAELVVTTVALADLIRRPGVQVRGRKLAWLPAPAVQPFGPLAYLRWGRRR

SEQ ID NO: 13564 - protein, 666 aa, Actinoplanes utahensis
MSSVDRRSFLQMLGMPAVAAAMPAGLEKALAIPANNRTGSIEDVEHVIFLMQENRSFDHYFGTLRGVRGFADPHPATLPSGKSVWHQRNGDGELLPFRPDVPDLGGSFLPDPPHGWDDTHGAWNGGRYDGWVPNKGVETMTHHTRADLPYHFALADAFTVCDNYHCSLLGPTDPNRYHMWTGWVGNDGTGGGPVITNAEAGYDWTTYPERLEKAGVSWKVYQDVGLGLTAAGSWGWTSDPFIGNYGDNALLYFHRYQNAQPGDPLADRAKTGTEVNRLGRAPERLLTDFRTDVENGTLPRVTWIVAPEAYTEHPNWEPHNGAWYISQVIDILASNPAIWSKMALFVTYDEEGGFFDHLIPPTPDPARSTVSTVNEIFTGAGHPAGPYGLGIRVPMIVVSPWTRGGWVNSQTFDHTSLIRFLERRFGVTEPNITPWRRAVAGDLTGAFDFRTPNRRPVDLPDTAALKPSDLTRQPDLVPVPPTEARLPRQERGVRPARALPYALHADLTGDTLVLRNVGRATAVFHVRPSGADPVSFTVEPGKHLTGDFTAAEVEVHGPNGFYRRFRRGTSPIETRARYVEHHDTVLLEIRNTGRDRAEVTVSDRYTGHASTLTLRGGTTRTSQINTTRTRGWYDVTITVGDTVQQYAGHLENGRDSITDPGMGGLL

SEQ ID NO: 13565 - protein, 76 aa, Actinoplanes utahensis
MAGAPTTPDDLFAVAVAVAVAVAVAAGQAVSAVAGQAIPSLAAGLLVATATIARYAYLARCPEQRETTDVPRAGRF

SEQ ID NO: 13566 - protein, 1227 aa, Actinoplanes utahensis
MSERGERAGRLRVELFGGLRVCRDEADLAVPGARLRGLVVRLALAAGRPVGAGTLVDSLWPRERPADPANALQSLVSRLRRVLGDAEAVAQDEGGYRLRVGDDDVDVVRFERLAGQGRQRLRAGDAVGAAELLGAAVALVRGGIAAEVGVVAAAVGLRLERSVGAAFADVAESDLLLGRFDAAEGRLVRLLAEHPLDERVTALLMDTLAAQGRQADALALYERVREEVAERLGADPGAALRERHLRLLRGEYGDGTRTTGPVGAGRAGVGRGGSAEAEAAGQAGRGGGVSAGPRGAGEAGAGSADPVAGGGARGVGRAGGGAGRDAAVDGAAGRAGGLGVPGDGGPEEEREQGGSNLPEPLTSFIGREADLARLDDLLAAGRLVTVLGPGGAGKTRLATQAARRRRGEFRDGVWLIDLASVTASGELPAAVLTATGLRAAAIFEGGLRLEGRGDVDVLVDQFAGRECLFVVDNCEHLIDAVAHLTTALLVRCPGLRILATSREPLAVDGEALVPLGPLGLPEQTPPGHAAAGQSPSGHAAAGQSPSGHAAAGQSPSGHAAAGRSVPQPPAAVEGMDGAVERARRAPAVRLFAERAAAVLPGFAVDRSTVADVVQIVRRLDGLPLALELAAARLRTLGLRELADGLDDRFRLLTTGSRTALPRHRTLRAVIAWSWELLAEDERILAERVSVLPGGVTAGSAAAVCPQVRAALIPDLLAALVDKSLLQRAPDGRYRMLETLREYGIDRLAQQHALVATRGLAARHLAGVVAEHDPRLRTAEQLDALRVLRAEYDNALAALRHLCDERDADGATRLALSLVWYWQMFGRHADAAFWLHEALSLPGERDPLVTDTAEAVLALNRVSADRVMVTETAQQRQDRLRSLAVRLNRHAELPGMVGALSTVVLFMAQEEAAAQERMAQLVSGPDQWVAALARLFRAQVAENNGDVAQVRVDVTDALAGFRAAGDRWGQATTLPLRALLRQYEGDLDGALADLTLAKALAGEFGSLDLGDEIFIDLRRADLHMRRGEPQEALIAVQAARLRAARAMTPEMMLLIDALEAGTMVGMGDFARAEELVARAEGGLSGGPGGFFDGDHGTAIVQTVRASLALHHGDPVRAEKALIAAYAAAQQTRDMPILSMVAVGAAGLADLLGRHREAAQLLGAAARLRGSHDPTELQVAELTRRCRAALGEDGFSEAYAVGWTMDPHTALARADPGQLRALEGQARLL

SEQ ID NO: 13567 - protein, 273 aa, Actinoplanes utahensis
MTAAVLDEVTYTDHARGGPFLALIRHSAALAQRSLIKTIRTPEALIDVTIQPVIFLLMFTYLFGGAIAGVGGRHTYLQFLLPGMLAQSLAMGGIALGQNLNADIEKGVFDRFRSLPVSRSAPLVGAVMADIIRYVTVCVVTLGIGTVMGFRIETDAEATLAAVALAIGFGLCFGWISVFVGMLVRTSGAVQGVMFLLVFPLSFGSNVFVKTETLPGWLQAFVKVNPITHLVGAERGLLTGGPVAHHLIATLAWMACLLVVFVPLALRAYNKRA

SEQ ID NO: 13568 - protein, 324 aa, Actinoplanes utahensis
MDDLVVRAEGLRKRFGKTQALDGVDLAMRRGTVLGVLGPNGAGKTTAVRVLATLLRPDEGTAYVAGIDVLREPQKVRRRIGLTGQYASVDEDLTGTQNLVLIGRLLDLTTRDAKKRATELLAWFDLTQAAGRPAKTYSGGMRRRLDLAASLVGHPEVIFLDEPTTGLDPAKREDMWGVVRTQVAQGSSVLLTTQYLEEADALADEIVVVDHGRVIAQDTPDGLKRRVGGQTLRIRPADPGRLPDVLRILDAVASPGTTAAPDATAGSRPGAASVPVTTDTALDDVLPALRRAGIEVNELGLHLPSLDEVFHTLTGGEKKDEVLV

SEQ ID NO: 13569 - protein, 756 aa, Actinoplanes utahensis
MRRPPGWAAWLLGGSAAVVGYTLLPYGWPQFVLSWLVAVSACVTLVVGAWRHHREQLAAWHVFAGGALLWLGGDLYYALRADGGYPTWADAFYLGAYPLLLTALFQLTRRRGPLWSGNLIDSAIVAISVGIVYWTFVIEPVLVNPAVPLLTRAVTAGYPAMGVLLCALLVPMLLRRGPRTAAMWLLTAGGVVTMAANVVYTLLPEVFAAHATLVYAGYLFADVCWAAAAAHPGKAAGVVEEDDSLGWGRLLVLTASMLLVPAILLVQGELGVGRMSWLTVGIGSMALFVLVVTRMSGYIARVRSQARRLHDLAMRDDLTGLPNRRAFEEEAARVVAGGPCRLIMVDLAGFKHVNDRLGRAAGDQALAAVGRLLRMSLREGDAVARMGADEFAVLACDTQPGDGESVVARLLDALRRPIVSGEQELLLNPRFGVADSEDCGAVPVPELVRRADTARYAAKSSGAQLMVYTPELDERADAAASLGAELRHSLDDGDFRVVYQPIVDLRSGRFEAVEALVRWQHPVRGFVSPADFVPVAEDNGLIVELGEFVMRTACHKFAGWRRDLGADGPSYVSVNVSARQLSEPGFPEVVAAILDECGLAPAELLAEVTETALFGGGTAVQAVETLHAAGVRIALDDFGTGHSSLGLLRTVPVDVLKVDKSFVDEIIAGAGRAVIVDALIHVSKGLRLRAVAEGVETAEQARYLRRLGYEYAQGYFFGRPVPDPEFRPELRDPLPDYEFGGELGTGDRPAFAVDQV

SEQ ID NO: 13570 - protein, 275 aa, Actinoplanes utahensis
MIPAVVYAIPAFLLLIVMEVLSYRFLPDDQERGYETRDTATSLSMGAGSQVIGIPWKLVTAFAFAGLYVLSPVKLDPHDWWVWVLLFFADDLAYYWFHRLHHEVRVLWASHVVHHSSQFYNLSTALRQSWTPMTSTPFWLGLALLGIPPWMIFLQQSISLAYQFFLHTERVDRMWRPIEWFFNTPSHHRVHHGSNDPYLDRNYGGILIVWDRLFRSFEPEGERVTYGLTTNITTFNPLRVATHEYAAIWRDLRSATSWRARLGYVFGRPGWQPAA

SEQ ID NO: 13571 - protein, 206 aa, Actinoplanes utahensis
MRLTLFAAVATTEIIAVAADLTPLQWATKPLLAPLLIGYVGRANRLSAGLAFAFLGDVALLIPGQPAFLAGMACFLGAQLCFLTWFLRLARPKPAACIGYAVVWAAANALLGTRLGALRLPVLIYSLALAAMAAAATGVSRRTAIGGALFLLSDLTIGAGAAGVHLPAAGVLVMTTYAAALALMVTGSVPAGSHRRERYGMARSGR

SEQ ID NO: 13572 - protein, 186 aa, Actinoplanes utahensis
MPDVPVANRRPTRADARRNYDALLAAAREIFAESSADASLEEIARRAGVGIGTLYRNFPTRRDLFEAVYVEEIEQLSAAAAAAAELPPWAALRAWLDRFVGYVVTKRAVVDALNRESDLFAACRVAMYAAGEPLMARARAAGEVRADASFDDVLRMISGLVSGAFVDDEQRNRVLTFALDGIRAGR

SEQ ID NO: 13573 - protein, 477 aa, Actinoplanes utahensis
MPRLYQATPRVTFTVLAAAAAAFALMQSLVTPVLPTIQRDLHTTTGTVTWVLTAWLLAASVATPLMGRIADMIGKDRTLLVALAAIAAGCLIAALAPNVTVLIAARVVQGLGAAVFPVSFGIIRDIYPPQRVTSAIGILAAVIASGSGVGIVLAGPIVGVLDWRWLFWIPMIAVTLVGLVAWRVVPPSPAGGRGRINWLSAVLLAGWLVALLLPLSKGTAWGWASGRTLGLLTAAAVLLAGWMLSELRSAEPLIDMRMMRLPAVWTTNLVSLLFGAAMFGVFAFLPQLMQVPASSGYGFGASVTGAGLLMLPMMVTMAVSGSLSGPLTRWVGNKAQLLIGAALGAVAALTLALAHSSPSVVAVTGGVFGIGLGLLYSSMINLIVQSVPRTQTGVASGMNTNIRTIGASIGTALVSTVVTSHPGPRGLPAEAGYTEAFLLLAVASAAAFLVALLVPAGRKPAVRPTPVTVPELTPVEV

SEQ ID NO: 13574 - protein, 56 aa, Actinoplanes utahensis
MSDLDPEGFAEFVTTDGPGSADVEQQAEDAELIGEPQPVNDLIQRSAEEPDEGSYR

SEQ ID NO: 13575 - protein, 336 aa, Actinoplanes utahensis
MSSIRELARRCGVSVATVSRVFNSPEVVSRQTRQHVLGMAAEIGYLPNESARTLATKKSHMVGLVWDTDHRRPGWRHPFLQDILVALKGALSAQGLHLLMLAPDQSAGPVGRQRFLRAVQRHSVDGVVIIDNGSRDPAVLALVDAEVPCVALDLRFTGPTCTYITSDNAGGGRLAAAHLLERGHQRIATITGPERNWPAGERLAGFRAALAAAGRPLPDDLVVAGDFYLDSGDAAMTALLSRDPRPTAVFAAGDEMAVGALRAAHRAGLRVPQDVAIVGFDDIELAALIPPGLTTVAQDKTGIGTSAAEAIVAMLSGAPTPAPTTLPTTLITRGST

SEQ ID NO: 13576 - protein, 422 aa, Actinoplanes utahensis
MRLSRFLQMAAAASAVAMLATACGSDGGSGGGAGDNVTLNVSLFGNFGYQELYQQYEQAHPNIRIQERTADYNAHHRDLATHLATGSGAADIEAVDTGFIAQMRAVGNQFTDLGTDRAGEYLPWKWQASLTKDGKQIGYGTDVGGLAICYRRDLFQQAGLPADREQVSAAWAGGWDRFIEVGKKFAEKAPEGSAFFDGGGALYNAIIGQAPVGFYDSNDAIVVNSNPEVKKAWDLSVQAIQANLSAKLVESSPEWDNGFAKSRFAAIACPAWMMAKIKDQSKAFAGKWDVASVPGGGGNWGGSYLTVPRQGKHVDEAKKLAAWLTAPEQQSKVFTTKGLLPSIPSLYDRPEIGALQDPFFNNAPIGKIFTTAAKQLQPQHQGPRAGDIQTAIRDGLTRVEQGNQTPDQSWAQTLKDVDRLAK

SEQ ID NO: 13577 - protein, 304 aa, Actinoplanes utahensis
MAINARLTRLDPQGSPYLYVLPFFLLFGVFGLFPLIYTGYVSFNDWNLLDGGAHQWVGLANYREMLQDSYFWNSLGNTLSIWVLSTVPQLLAALGIAHLLNHKLRARTSLRMGVLLPNITSIVAVTIVFSQIFGRDFGMVNWVLGLLHVGPVDWQAHSWTSHLAISSIVIWRWTGYNALIYLASMQAIPHDLYEAAELDGASSGQQFRRITVPMLRPTIIFTTVISTIGGLQIMAEPLLFGGDYSPTGGSDRQFQTIALFMYEQGFREFRFGYASAIAWTLCLLIAIFAVANFLLTRRIATDEE

SEQ ID NO: 13578 - protein, 298 aa, Actinoplanes utahensis
MTALADPPATRATPPAVAKRRSRRGFGFPRRGSAWTYAALLAVVAGSLFPLYWSFVVASQTREAVSRTPPALIPGGHLFDNIARVFDSTDFGTALLNSFIVSGSITVSVVFFSTLAGFAFAKLKFRGRQVLLVLAIATSMVPQQLGIIPLYMLMAKLGWTDQLAAVIVPGLVTAFGVFFMTQYLGRAVPDELLEAGRIDGCTTFGLYWHVVLPAARPAAAVLGLFTFMQAWNDFFWPLVVLQNNATVQVALSSLASGYTTDYTLTLTGTLLATMPILVVFLVLGRQIVGGIMQGAIKG

SEQ ID NO: 13579 - protein, 455 aa, Actinoplanes utahensis
MTDPLALPDFPDGFLWGAATAAYQIEGAVAEDGRGDSIWDTFTRRPEAIASGEVACDSYHRWRDDVALLDDLGVDAYRFSIAWPRVLPAGTGRVNRPGLDYYDRLVDALCERGIRPFVTLYHWDLPQALEDAGGWRVRDTADRFADYATVVAERLGDRVQDWMTLNEPYCSSIVGYAEGRHAPGAVEGHGALAAAHHLLVGHGTAVAALRAASPRARVGITLNLSPSVPATGSAADRAAADRMDLLINRQFTDPVLGRRYPEGFAAMYAGVSDLSFRRDGDLELIGAPLDFLGVNYYYRIHAADAPHTQADPALRSACDIGVRSVARDGVPVTDLGWPIEPQGLYDTLAGLAGRYAGLPPVYVTENGVAQLREGLGEDPERIAFVAGHLEAAAKAAAEADVDLRGYFYWSLIDNFEWARGYGPRFGLVHVDYPTGERTPRASYHWLRERLAGRSG

SEQ ID NO: 13580 - protein, 153 aa, Actinoplanes utahensis
MARFPVRRGRTLDAMELHWWSIEVLDGPRLSAARWQDSYGNALVEAAVTHGAFEWQWHRHTWGVLFEIAFRTEERFADYRDLPAVRAALDAVPDPVNGLLIYPGRGGSSGRVQPRRPLPRAGAGAAPIPVEPPRTDVRLGPTEPPVTTAGVTG

SEQ ID NO: 13581 - protein, 221 aa, Actinoplanes utahensis
MSDAAQERPIRVVIADDQRMVRDGVQLMLELIDGVEVVALATDGNEAIAAVAAHDPDVVLMDLRMPHCDGTTATRRIRAEHPRTQVIVLTTFADDSDVLAALRAGARGYLTKDAAAEEVHRAVHRVAAGHADLDPSVQRRLLTWLPAGSPGPAGAGAQGLTERELDVLRLIGSGLTNGEIAAYLKVSESTVKTHVNHVFAKIRVRDRAQAVTFAFRNGIAS

SEQ ID NO: 13582 - protein, 334 aa, Actinoplanes utahensis
MRRLSPVFALFFLSPLVGEFFLGDFAITLLPLIFVFAPMYGGAAVLIREVTRRTGRGWPTIVTLALAYGVLEEGLITQSLFNKDYLDQHLLDPGYIPAIGTALPWVVFVLTLHTVWSISVPISLVEESSTRRTRPWLGRIGLTVITVLMLGGGFAVFNATRTDPSLSHGFLESSPQALSIVGIAVVLIVVAFLLPRPAATEPAARPVPGTAPGPWVVLATGILAGLLFMSVTWSIVPTVPGVVLMLVATLGTAVVVSRWARRAGWGPWHRFAITAAALLTYTWHTFFAHSAGFVLDLISHLVYAAAALAILWYVARRIRAKAPLGETDRLHAVG

SEQ ID NO: 13583 - protein, 638 aa, Actinoplanes utahensis
MRVRNLGILAHVDAGKTTLTERILFTTGATHKRGEVHDGTTVTDFDPQERDRGITIFAAAVSCDWAGHRLNLIDTPGHADFSDEVERALRVLDGAIAVFDGVAGVEPQSEAVWRTADRYRVPRIAFVNKLDRAGASLTAVAESMRVRLGVVPLLVQFPLGAEGAFRGVVDLVGRRTLTWADGVLSVHDGMPPEALPARRELEEQVAGLHPAALQEWGDMSDATLRDALRDLTRSGEAVVVLCGSAYRNRGIEPLLDAVTDYLPAPAVPAGADPVALVFKVHTARAGRLTYLRVYQGTIVKGDTVWDAGAGRTERIARILRVQADRHTEIDRAAAGDIVAVTGVKHAPVGATLSSRAHPVRLEAPRITEPLVSVAVEARTRADAERLPPALAALAEEDPSLSVRVHPETAQTILSGLGELHLEVALEKLRQRTGLRVTVGRPQVAYRETVRRGVRDLLYRHVKQDGGAGQFAHVVLTVAPAGDTGFAFESAVTGGRVPAEYIRAVEAGCREALGDGPLGGHPVTGLRVTLTDGRTHPKDSSELAFRTAGKLALREALRACVMELLEPVAEVTVTAPADTLGAVLSDLAARRAQVTDSGERTVTATVPLAGLSGYATRLLSCTHGRGTFTSRPAGYRPAA

SEQ ID NO: 13584 - protein, 203 aa, Actinoplanes utahensis
MTVVAVVGIIGLVRLWTRFGPGWAQPVTGPLAAALLITVSGRTARQAGLTVSGWRYAAAAVVLIGVGYAVAVRLPAARRLFRTTYDRPWLTALIEVPLATVVFEEVAFRGVLWSLLDRDHGAVAATAVTAVLFGLWHLAPERPWTDAVVTGVAGVLLGVLRAVGGGLLAPALVHWAVDGIGVLAAAHVTRTGVQWGRPQAGAG

SEQ ID NO: 13585 - protein, 522 aa, Actinoplanes utahensis
MTSRTEAAPAKLDAAVLKIAGVVVLGAIMSILDVTVVSVALPTFQREFNATYAQVAWTMTGYTLALATVIPLTGWAADRFGTKRLYMTALLLFTLGSVLCSTADGIGQLVAYRVLQGLGGGMLMPLGMTILTRAAGPERIGRLMAVLGIPMLLGPIGGPILGGWLIEAANWHWIFLINLPIGAIALVYSWFALAKDSPEPSESFDFLGMLMLSPGLAAFLYGVSSLPGEGSFTATRVWAPMLVGGLLVIAFVIYSFKPKHPLLDLRLLRNRNLSVATITLAVFTIAFMGAGLLFPSYFLQVRGESTLHAGLLMAPQGIGAMVTMPIAGMLADKIPVGRTVPFALLLIAAGFFTFTQVGTDTSYVLLCGSLFVMGLGMGGTMMPIMTSALKTLTSHEVARGSTLLNILQQIAGSVGTAMMSVILTNQLNDSAVVPGMTAPDGSPVTEAGVAIASWSDPKIAQAVPADLLHRGLAFVADSFATTFWVGFALTLSTLIPAFFLPRKRQESQLAADGAPAAPVIVH

SEQ ID NO: 13586 - protein, 201 aa, Actinoplanes utahensis
MIRVVVVRDEGYFGVPVRTFLEPEPDMHYVTTLPINGELAARAAQLWPAVIVIDTEYMVSQVLPIADALHTAIPSCAMLLLCDPSKRGMLPPRRWNGGMNFLTKSAAGAALADSVRRLAAGERVVSPMLQAASLNTDRGLSTRELEVLGLAAEGESVKEIAGRLYLSGGTVRNYLSAVISKTGARNRLDAIRIARKEGWLR

SEQ ID NO: 13587 - protein, 187 aa, Actinoplanes utahensis
MLVDRLEIPALPVLLPLGAVLMVLSWWWLRRQGRLTTRRLVVAWALCWYAVAVLGATMLPAHLSWGPGAGPPATYRILLVPTLSMRRRDFVLNMMMTLPLAALLHLNFGIVDRLWVVRTGFLLSLSIETTQLVMILTVHGTRWADVNDLLSNTIGTIVGFVVWHRLMRVERLRAAVTGVAPQTVRPG

SEQ ID NO: 13588 - protein, 373 aa, Actinoplanes utahensis
MRVLHVISTASEGSAAHQLRLLLPRLPHDSEVVSLGPGGLISGVPVHQLGTARDRDPAAIVRLRALIRRGHYDLVHTHLYRACVQGRIAARLAGVPHIVATEHHLGRPGATRLGPFYLLSERLGEMTIAATASIAGRLRGWGVPDRRITVVPRAIDPGEYRFDPALRAAARRRLGVPGGTAVIGVTGRLHPAKRHDLLIRALTEVPGAVLLLAGDGPARPALHQLAIIEGVADRVIFAGAVRHPREMLCAMDIYASTDPHTWGLSVLEAIAAGLPAVYAACPPLEERRAARAPVRGTYRLSPHDRESLPRALRAEVLCLAERRGTRMPARTAGLRYDADHLAATVGQIYDRLTRAAPSAGPLRSLRHGDAPPA

SEQ ID NO: 13589 - protein, 580 aa, Actinoplanes utahensis
MELSLVAAVVHTVAGLWTGLYTGRWSYGCFEEILALAKTAAITTPAVFVLDTLLGRLVPRSAIIGAGLTGLVLAAGVRYAVRLLHDQRLRPHQAGTRVVVMGAGEGATQVIRAMLRSPSSPYVPVALLDDDPAKRTRQIMGVPVAGNRHAMAEVVRNLRADTVVIAIPSAGAELIRSLTDLAAPLDVDVKVVPRVVELFGRTVRVEDIRPVSHADLLGRREISIDLAAVAGYLQGRRVLVTGAGGSIGSELCRQVAQFNPATLVMLDRDESGLHAVQLSLDGKGMLDDRNLVVADIRDQQRLDEVFAEHKPHVVFHAAALKHLPLLEMHPSEALKTNILGTYQILQTAIRHNVDRLVNISTDKAADPCSVLGYSKRITERLTAAADAAAPGTYTSVRFGNVLGSRGSVLTAFAAQVEAGGPITVTDPEVNRYFMTVQEAVKLVVQAGAVASRGEVLVLDMGEPVRIADVAKRIAESAGGHIRIVYTGLRPGEKLAEVLLGPDEPDHRPNHPLISQAPVPPLDGAVLSLLDPRSPREDLIAVLRWLAESPALPGRVEKPPAPRSGGSRRHAEFTMRLGRHP

SEQ ID NO: 13590 - protein, 418 aa, Actinoplanes utahensis
MRVVIAGQGYVGLPLAVRAAEAGHHVVGYDVDEDRIKRLAAGESYVDDITSGQLQQVLSGGNFHPSADPRTCAGFDVAVIAVPTPLRDGTPDLRHIEESARTLARYLRPGATVALESTTYPGTTTELVGPLLEEGSGLIAGEDFHLGYSPERIDPGNRQWHLATTPKVVSGINPESLARVQAFYASVVETTVPVSDPKVAELAKLLENTFRHVNIALVNELAVYAHDLGIDVWEAIDAASSKPFGYMRFVPGPGVGGHCLPIDPSYLSWRVQRTLGQSFRFVELANDINNHMPDYVVRRLVVAMNRRRRAVNGSTVLLLGLAYKKNSGDARESPARRVAALLLEMGAEVLAADPHVVEDAHVDQRVTRVRATREVIAAADAVVLLADHDAFDLDEVVEHATYVLDTRHRITGTNVESI

SEQ ID NO: 13591 - protein, 219 aa, Actinoplanes utahensis
MDLVRPIWNVLNQLVALVALLLLSPLILAVALWVRIADGKGVLFVQARAGKDGRPFRMLKFRSMVHNSVAMSAQLGMADPFGLLQDDPRITRCGRILRRTSLDELPQLINVLTGRMNLVGPRPDVLPQVANYSAEDARRLEVRPGITGWAQVNGRDDIDWPARFVLDRWYIDHWTPLLDLKILARTVTGLRRAEPPVHVDTLNIARSAVDATQELGRAA

SEQ ID NO: 13592 - protein, 366 aa, Actinoplanes utahensis
MPPDREIGSEFHWDPLALVGEDRGGLPGWVPARRELFATGCGAIRAVLRVLAPAGRLHVPSYFCTGVAEALTECLPVTFYRHLPDGHGPHWETLRVRGGDVVLAQNLFGWDDKAPWDAWIRAHPGIAVVEDHSHDPFSGWARNSIAAYVVASLRKTLPLPDGGLVWSPAGRPLPAPAGAESPGAAQKLAAMLLKAGWLDGQPVPKEAFRALQRQGEGALLGSDGPASTVTRAVLPLLDVLGIRAASSRNAHALRTALHGRSADEILGFARGAADVAPFRVQLALRSEKDRDTLLALLAAERIYAPVHWRQDRARWWSGDPEAAGLADRMLTLPVDHRCSSDDVSRMAEVVTSQASRESRSGHIIRA

SEQ ID NO: 13593 - protein, 407 aa, Actinoplanes utahensis
MTAGGWIALGIAVFGSLCYAAGSILQAVGARRSTSAVTTLGHPLYLVGIGLDMTAWLGSMVALRQLAVYLVESVLAGSLALTAFAAWAFLGSPLRKRDVAAIGVTIGALAGLAMSAGQQHVVAASFTLRLSFIGALIVVLGLGFAATRIGSPGLIATIGGLSVGAAALGGRALHLPDEQMRTVGSAAMAILGEPLTYVLLLFAANGMVMYANALQSGEVGRVTAIHWTAEVIAPSVIALTLLGDTFRPGWWPVALAAAVITVGCAVVLASAPATATLDETAALPAGAEPHALPAPPLPVLPGAPGHPVTALVPLQAWRLAIPIEARWPALQPPLVRGYGTVVWWGPSWAPLPIWVPPDRTLVPRDRPKLADRPQRIWPARVGPQLPESRRPARHREIIIPGRDRDAA

SEQ ID NO: 13594 - protein, 236 aa, Actinoplanes utahensis
MAHRCQAPGHVEGELDERIVGFYERLRARFPDHPPYPDPDDCPWMSMPLDVGIDHVFMCLSFSERSHPATTLIAELATEYELTLWDPQDGSAHRPVTAPSRQDVEAWWRDLLDGRCSREETFDRVRPWVEDPPDAVEDPITMMGLQQLHGFALTVDGRAGHLHDDQEVRAGFEQWLTHGTRFDADPAGWRRDRYRQALLAVLRDQGRQHARTLAKRMVAADWLSTEDAEQILRSQH

SEQ ID NO: 13595 - protein, 212 aa, Actinoplanes utahensis
MTDWDRFRHEISWFLDDGQTATVGDPQPWDREPVDGLPVLSALLATATRTPVTVDDDHFELLAWGPPAERRGWLCRPPRAEADLTVPRVHRDFWAVCGGLVERFGEPSSWWENQNEVLTAQAAAEPVEGPFDAYAWIWEGATPLEPRDHYPVAVEANGNLTLARRTDGRLLLFAPDHAFDGVTAIADGLLTIDGVPDLATWIEVCATAWLPE

SEQ ID NO: 13596 - protein, 140 aa, Actinoplanes utahensis
MAEILTKVGKADPSLNRVLSDELDRFNAAATPEVAPAEELTVRVEQEGELVAGVSGWTWGQAAGIGMTWVREDHRGTGVGTGAMTAFESEARSRGCTHVFVTSFTFQAPAFYQRLGYREIFRWESVPTTGRDDVHLRKEL

SEQ ID NO: 13597 - protein, 328 aa, Actinoplanes utahensis
MGGPAPDALMPWPEMSPGSCRGASENALCPFDGIIRVMITDARLLTTLTLDGTDMLVSADTGTVRVTDPRTGRPVSEAAIGGITAIVACPTGWRDPVIAVGADSGLYWVEARTGTVRHEEGGIAAMSAWAGTLLAAAGHAPGTLLRWDAGTGARLEPLGSHQEPITAVTVLHGPVVCTGDRTGTIQRWNPRTGARTAPALTVGDEAVLALAPAPLPDGRLLIAAATADLHRWDAVTGEPVGVPVVVDSTAVTTLTATVVNGRTELITAGHDEVVRRWDAETGLPVGEAVPGRSATVLRRHGVLTLAVGTLDGRLDLRSLGQPHPDRRI

SEQ ID NO: 13598 - protein, 1018 aa, Actinoplanes utahensis
MPALRKLALGAAARAGRLPLPITGLAAADRRHVYRVLRRDPVPALADRLIGTVRDHFGDDEAGALLVACGPETVRALLPQLAHAVRLESLNRRHPGALAEHLTATLAAVPPEHRRHEWARSSGAVLALAPAQALDLLERCAPETELPGRLTGYGVLAAHDPGRVARLLAAPARAGWLRHRRLSPKLLRRLATLPDDDVIPLFRHVRESAPGFAALLRAFAPARRGALYDAALAEVDTTTLIPADEVMEALPATVRIREATRVLGLDRIREQESLVLHWSAYLAWPQAATAQEAALRSGDATERARGYTRLIAAASRARDPEAVAAVVARLTRMRNEQDPVRATALTELAQVAGLLTAGSAADLTTITTDAVEARDASAATTTALSRLATGTLQHHVDVPALRDWSLLAIDLVSTAATVPVLRRFDRVLRRGQETMVFDRLRPWVEAAIARGRYAPLFALTDALGRRAHHLPELQRMLRDTIPGTTARIAETAIARWLDDPRHRAARVAEVLAADPSAVLLGPVWRIVAGTRTDLLDRVLARRPTGRFANSRGHWAPGGPARPDRWLPRQHAAFVDLQAAIVADPGGPVWSRIAALHIAAPAGDPGRDLVLRHVDAPEVPLAEAALGALVWSARPDLALPVLLRHAADDRARVALYAAARAAKHLPPAVLAPPLEALLSTSAVAKVTSRKEAVRILARYGPPDSVGRLLAVFQDPATHRDIRAAIIGAARQRLDTEPSWTVLDLAVAAGRPREERRAVLAADPYLIAARHRPRYAALVVAACRADDPEIRREAFARLPGWSRWAPAATDLIVERLTDLVVATGDAVTPGLLRAAGPEALARALSTLVTREDAETGPGAPGGDHPARRRIGALLRTVGALARALPADADRTGLREPVRALAEHPGHLAAAVATLVTLGRLDNLAEIADRCADRPVLAARIAERVGARLRELPEWPAVPVLQDLIATLAARGDLPGGLFAVALVRAGDSFSWAGRWRDLLLSLRAHPEPEVRDDAWSIDMT

SEQ ID NO: 13599 - protein, 102 aa, Actinoplanes utahensis
MNIGTPEDLPGLDEGTDQNRSAVRRRPATMSVMPFTARAVRSLLATLDPLPHHARMRHLAQWARTSPRAPEVCAALRAGTDHERRLALIADLARGDTAGLAS

SEQ ID NO: 13600 - protein, 273 aa, Actinoplanes utahensis
MGEVVWLGRYPVKSMCGEDLTEAHLDASGFEGDRRHAVLDEETGLVASAKNPRRWRALLSMAARHEPAGRVVITCPDGEQIHTDAPTADRALSRVLGRPVRLTATLPQDASMERLTPPTEPGAGTMTHSSLAAGTPGNTFVDYAAVHVITTATLDALARRHPGGRMDPRRFRPNLVVHLDDAAPFAENTWQDRTITVAGHAEIRIVTPTPRCAVPTLAQGADLPDDPDVLRTAARLNRVPVFDLGELTCVGAYGAVQRHGPLRIGDRITITRR

SEQ ID NO: 13601 - protein, 691 aa, Actinoplanes utahensis
MHPGDVGRPRLRPDGPGGRQHPPGRDLRRASRRAAARRRRPRLAELPAGHHPALGPRQRGADGRRRAHHPLRHRLRHETGDAGRDGARRRPGHRAAGSAGRAGAVRASAQDRAGPAAAGRARQQRMVRADAGLRRAAGETVLLRPVQPARRVPGLAIPVAHGDPGRTPAHHAALDAVRPAVEPGPAPPAAAHLTLRSATAGPMVADMVRKRRTAGLAAILFVALYVLLVRVLPIPPVVAGRISQSTLAGIGALVSVLWARAAARSRGRIRAGLITWSVAGAGWAIGELFWLADGWRTGTAAIGVAANLGFSATIVAAPAAAVLLVGRPSASIRTLFDALMIGMSLFFVVWALTLGPQHRSGAAGVGTVAYATADVVIISLVLLLLAESSATLRVPLEIAALGMIVQFTADSVYTYQTIAGTYRFGSLPDLLWLLAWVAFAVGAPHRDELHGVTRIGDGGRPRAYLPYVPFLLAFGTGVTILATGGHLDRVLATLSMALTALVVLRQMLIISDNRRLTRQLSALVDDLRYRAEHDALTGLANRVRFEECTEQALLPGAPGRVAILLIDLDGFKPINDTYGHPRGDRVLAEVAERLLTAAGPHDVVARLGGDEFAVLTTTDPQPLAARLLAAVATPFDVGPETTTIGASIGVASCRPGTQGFGQLVRDADAAMYEAKRNGRNRVVMQQPSAVG

SEQ ID NO: 13602 - protein, 340 aa, Actinoplanes utahensis
MTASLLDPAAREWKETLQQVRHDMYHVPDYVVLDARLYGGTPAAFHFERGARRLLIPLILRDIPDADRRDALSPYGYPGPVSDAAPHETEFWRAACAALSETLREAGIVSLFVRMHPLLDPPSPVLGEAGALVRHGETVSMDLTVSVEEMWRQTRSDHRNHINRAKRAGTRIVFDDWSRLADWVEVYHDNMRRVGAADYYFFTYEHLAALHDAVGDRMHLAVALEGDEVVGGNTFFEYDGIATGYVSSTRRARGRYADELLYDSVRRWCSERGARIFHLGGGKGGGEDSLFSYKAGFSPSRHPFHTWRVVTDPTAYHRLVLRKRPGADPADLTGTFPSYR

SEQ ID NO: 13603 - protein, 378 aa, Actinoplanes utahensis
MNRIPRRTLLLAGAGIAVAATVAESSARPCNAMPITAQPPAAAPAARRALKPVSHWAAVFQQSWDYESATAQPLSLSRDSQDHYDLAYTLDGNVAMFRATGATRYLDRALAYVENVVASAAPSTSLTRSTFRDRYRGWASSKSGQDGDEVPLYESYFWRYGTQLLTAMRQSAAVWGDPGYRARHARLLSFAEVDVFEKWYNRGAADTIYRDRTHMAAHWALIALNLGRLTGDTARATRYRQVYTTIGGRIRNQMIRNPVEPTAYFWNDVWGSTRRPGQDVGHGNGVMAYVVEARDQGTTWNAADMTAFGNLLTKVIWPGGTTYHGYVDGTGMDNGWIADGFVKLGRYDADVQHRLESYGVVNDQFAANMALNAKILRA

SEQ ID NO: 13604 - protein, 403 aa, Actinoplanes utahensis
MRRIFLAPGLLLVLIGIGGRFTLDRAGFPDLAWVDLRVIGVAVALVVLLIDLARRRPQPRVGREGWLVAASIFLLFQIASALWSPPAARIGPQTVDLILLAVLILAFYYWTLGDPERAILFTFQLFWLAAIVFALAAIFINGPGEQGRYSAFGGGPNVFVRIEILGVISAIAMFLSTRRLLPLLVTPLFLLAAVLSGSRAGLMAGGAVGLVALAKIRGRLRAGPVLACGAFLLTAGLVIWFAAPPEFTSLFQERFVQQTVQEQYLSDRTDIWAAAIRMFTDHPLAGAGLDGFYGLIGVNQMVEYPHNYVLAVAAEGGLIGLGLLTGALILWTRTVRGGGALPRATGLAVAAAVFVALSSLFSGDYYDARLAWTFAAMAAAAAVSRARTVPSAEPARVKEAVGT

SEQ ID NO: 13605 - protein, 416 aa, Actinoplanes utahensis
MSELAADVTRQKAIVREPAVQLLASQVLTGAVALAANILMVRSMTPTHRGEVALMLQVVYLATQVVLLGTERSFVAGYHNVAPGPAVRAYAKLLLLPSAIGLAVAVLFTATAAHHRSPGPMIVTLLAVYTVVEASALASRSVAIAVGRVRDFMICRVLESVLLLAMLIGLYVHHTSHPEIWFLAYVFAGAAPTLAYLIIWLRLPPDPDAAPARRDLNRQVRREGLALFPAAISNMAMLRVDRLVIPALASTAALGLYTSVATMTELLAWPIRAYADSRLGHWRAAHRDGSLRPRPIVLAVAVYSLVVVPFVAGALYLLIVPVFGHQYAAARDVVLPLVVAAGLYAVSRVSLGLLIAKGHSKLVSVAEIVGFVVSFAVYLLLIPRRGILGAAYGSLAGYGACLLFALLSTYAVRDRR

SEQ ID NO: 13606 - protein, 484 aa, Actinoplanes utahensis
MELRAYARACRRRWLWLLIPVLLSAGIAAGLALSAPAAYRSSMILFASAGGGDPDAEARRLNSYIALLTGPRVAQGVVARLGSGQITADEVRQSLSAQVSEGTDLLEIAAVDPSAARSREIVTTAATVLVTLAKQITPANPDGTPAAAISILQDAETTRQPGNLARNTGFAAVLGLLLGAIAVAIREAAGRTVAEEDDLRRLGLGTVGVISLDGRHGRGDHPDQTLAEAFRRLRSVLPGITDGARGNPRGRALLLAGPGRKEGTTAVSCGLAIALAETGARVVLVDANLRTPGIGRYLSLDPAPGLAEVLAGSARVPDVLHESLNGRLTVLPAGEQVPDPGGLLASPRLPATVRSLTEQFDVVLLDAPPLNGPADAAVLGRVTDSALLVVRAGRTRTADVEKSVELLTRIGAKLAGAVLNALPRKLPTGEHWATAARVAPADELIPLEEPEPAIAKGVVRGRARVVKAALAGETSEPEEPTDGE

SEQ ID NO: 13607 - protein, 415 aa, Actinoplanes utahensis
MRVVYIHQYYCNPRMAGGIRSYEQARRLVARGHTVDVITTDITPGERGLGWKVTHDDGVTVHWFRVPYNNHMSYARRLRAFAEFMVLATARATRLSADLVFATSTPLTVAVPGVLAARLRRVPFVFEVRDLWPEVPIEMGALRNPVARGLAGALANFAYRNASEVIALSPGMAMGVNRRRPSAPVTVVPNAADMDLFAVDPAAVRRFREDHRWLGDRPLIVYTGALGAVNGVDYLVRATARMCERDPDIQVLIVGHGREWESTGRLAADLGLLDRNVRMWEKVPKSELPVILGAATMSTSMVRPIRGLWDNSANKFFDALAAGRPIAINYGGWQADLLRDTGAGLVLDPGNPAAAGDLMASRVRDEDWLDRARSAAHRLAVERFSRDLLFDRFEAVLERSTRRAAAGRAVLSGQS

SEQ ID NO: 13608 - protein, 377 aa, Actinoplanes utahensis
MTEPRIYLSPPDVTDVERKLLLDAFDSNWVAPVGPDLDAFEQKCAELVGVRHAVALSSGTAALHLALIAAGVRRGDTVLIPSFTFAATANAVMYLGARPVFLDSTRESWNVDPQILADELRGRSVRGQLPRAVIAVDMYGQCADYRPILEACDRYGVPLIEDAAEALGATYRGRPAGSFGLAGVLSFNGNKIVTTGGGGVLVTDDGSVARQARHLSTQAREPVAHYEHRVVGYNYRLSNLLAAVGRGQLQRLPAMIEARRVTFEHYRAALGDLPGVSFQPVAGYGVPNWWLSCLLVATTGLRDRIVAALAAQHIEARPTWKPMHLQPVYRDCVMRGGEVSADLFHRGLCLPSGSALSGHDRERVVAAVRSVAAEQKG

SEQ ID NO: 13609 - protein, 256 aa, Actinoplanes utahensis
MEPPTAIKRRLNELGIRSRLRARPRAQGRVLAPAGLFRRLPSAPGLYFPFYHDVLPEYADDLRHHLRTLRRLGPMVGWEEALAVLAGDRPLTGPMFCLSFDDGHLSWRDVVVPVLRELSVPAMFFLTTGLVGQPGNLSWADCREIRQAGFGFGSHTLTHHRLADQDEREARREIADSKREMEDELGVPVLDFAAPYGNPAVDYTERDVRVAREAGYRSFASTRRPAMHTGDSPMWIHRQGLHPAWPIMAVRTRVHD

SEQ ID NO: 13610 - protein, 336 aa, Actinoplanes utahensis
MLRLQRVEPAPAVHADRATYPDRLLFHTPEWLAFVAECQGAEPVLATVSDGGVTVGHFTGLLVRRYGLRILGSPMAGWTTSYLGFNLKPGVSRRDALGALTRFAFDDLGCAHLEVRDRGATEADLAGTSLRWDAAPTAVIDLRPGEDALFGAMASACRRNIRKAAKSGVTVEEADADPAFADEFYDQLRDVFAKQNLVPTYSVERVKSLIRHLAPAGRISLLRARDPAGRCVATAVLPWAHRTMYFWGGASYREHQHLRPNEALIWYALRWAKARGVTEFDFVGGNPYKAKYGTTEVAVPWARQSRSPLVATLRDTAKQAYAWKQRTAARLTHLPR

SEQ ID NO: 13611 - protein, 159 aa, Actinoplanes utahensis
MLLGAGGPVMRKRVDFAVIALVAVAGLAAGCGDTGSSGSKSPVTRSPTVTVTVGDWASPTVESVTSSTPPVRMSSATAVGTPADGPPSATVSSTLPNLPPYRPPTTGKPLRPTGPITPPPPIIAEDPADGGRSQRHRTPEAHHQRPVTDEPATDRPGSS

SEQ ID NO: 13612 - protein, 221 aa, Actinoplanes utahensis
MTTIGLIGSGNIGGTVARLAVAAGYDVVLSNSRGPETLQGLVSELGPKARAATAAEAAAAGDIVVVTVPLKAYPQVPVEPLAGKVVIDTNNYYPERDGQIAALDSDESTTGELLQRHLPESKVVKGFNNIWFGHLAQLGRPSGAADRTALPIAGDDSAAKLVVIEFLDQIGYDAVDVGPLAENWRTQRDTPVYVTPYGPFGGAPTPAGTDVVRKAVAEAKR

SEQ ID NO: 13613 - protein, 518 aa, Actinoplanes utahensis
MDAPLPGGVVFAATSPGSAAPSGRATRPGLRALLDAYFAAPDAIARLQQFHDALAAQQPPAGELRPTLRRLLLTGDDGMRERIRLTGRCLIGAATELFPAQAGLAMLAEAGEPIDAAPIRLLGRLDPLSHAAIAALEALGASTDLIWLADRSSRVHRHFIARALCRLADPPAVAWLRARAAADERGVTPLARDAIDVIDLAAELTTTPPLRAVPPPPTPAPPAADPTLAGPAPPPAAPTAPASLSPAALSAASLSAETWERAARLVLRLGRPHDYSRGFDEFHQLVRLARAVARHAPHLPGTPARWSLIAQLATELSTGRIACADWSTGDPAAEGIADTGSPAVHGAGSDSTPGPDRFAGDRQSLVAALTGRLPVGHGPGPSTFDVRREPVPPTGFHIRVVAADPDEGLPAETRIVVDGRPVIPAAFHRGPPNPPKFLLAQGQLRADPEPQEVQLAEAWCTEGCCGALYVTIVRDPESDQVTWHDWRGHTTPEPPPSLHFPGEEYDAELARATHRLFP

SEQ ID NO: 13614 - protein, 233 aa, Actinoplanes utahensis
MREVAEFGRRLAAAGWASDLLVAGSLATGDYLTGVSDLDLVAIVPTEPDPDQIAAVHAGCDPALKLGCVYVPADRLADPTADHPTWTHGRLVRRILSGVTRAELVRHGYAVFGRAPGELLAAMSDDDVRAAAHAELTGYWAWAGHRPWIFLDPAMADLALTSMARGRHSLIHGTLLTKSAAVAAAAGPPWLIAQLRARRQGQRVASPRLRTAWLAWRDTRRTVRGVLPPRRGR

SEQ ID NO: 13615 - protein, 498 aa, Actinoplanes utahensis
MTERYVVAIDQGTTSTRCIVFDRRGQLVSLAQQEHKQHFPRPGWVEHDAMEIWRNVERLAPRALRRAGITLDQVAAVGIANQRETTVIWDRLTGIPVGRAIIWQDTRTDALVHSLSSSPLSPHVSDISGLPLATYFSAPRLRWMLDHTPGLQDRAERGEVLCGTMETWLIWNLTRGAHVTDVTNASRTMLMDVHTLDWSDKALDFFGIPRAMLPEVRASIGAFGTACEAFPGVRIGAALGDQQAALFGQTCFTPGEAKCTYGTGSFLLLNTGTELVRPGHGLLSTVAYQVAGSPACYALEGSIAITGSLVQWFRDQLELISSAPEIETLARTVADNGGCYIVPAFSGLYAPHWRSEARGVIVGLTSYITKGHLARAVLEATAWQTREVVDAMNATSGLALTTLKVDGGMTADNLLMQMIADVLDVPVVRPLAAETVSLGAAYAAGLAVGYWPDLDGLRRNWHIAGQWMPAMDPAVRNAEYVNWQRAVQRTFDWIQPTP

SEQ ID NO: 13616 - protein, 296 aa, Actinoplanes utahensis
MRPCSLLRPMPLDARKTGGREQRTAVGIVEHQLRRVVAQPHRVRTMPGPVQSIERAAAILRMLAGGPGRLGLTEIARSLDLAKGTTHGILRTLQGVGFVEQDRTSGQYQLGAALLHLGTSYLDINELRSRSINWADPLAARSGEAVRIGTVCEGQVLVVHHVFRPDDTFQTLDVGSLLPLHATALGKVLIAYRAGVLDSAPSPYTRKTIVTPRELAAALEQVRECGWAADVEEFTLGLAAVAAPIRGYGGLVIGAIGVSGPVERICDSHYTPRPHLVTSVRDAARAISREMGAARR

SEQ ID NO: 13617 - protein, 278 aa, Actinoplanes utahensis
MAARLKVPGLLGELLAEFAGTLILILFGCGVVAQVVAAGIGDHDSIAWAWGLGVTLGVYVAARISGAHLNPAVTIALAVFKGFSWRKVAPYALAQFLGAFVAALLVRWNYTEVLNAKDPGLTIKTQGVFSTLPGNGSLPVGHWGAFRDQIIGTAILLFVILALTDMANTAPGANLGPFVVGLLVVAIGMAWGTDAGYAINPARDFGPRLASFFTGYSTAFRDQTGYLYFWIPIVAPIIGGVLGAGLYQYLIGRFLPTDEPQEVGEIPTARESLEANRG

SEQ ID NO: 13618 - protein, 505 aa, Actinoplanes utahensis
MADFVGAVDQGTTSTRFMIFDHGGNEVARHQLEHEQILPQAGWVEHNPIEIWERTVAVVRTAMQKANLSASDLAAVGITNQRETAVMWDRRTGRPYYNAIVWQDTRTDRIASALDRDGRGDVIRRKAGLPPATYFSGGKIQWILENVDGVREAAERGDAIFGNTDSWLLWNMTGGADGGNHVTDVTNASRTMLMNLETLQWDDELLSFFNIPRQMLPEIRPSSDPTGYGVARVAGPLGGEVPITGDLGDQQAATVGQVCFAPGEAKNTYGTGNFMLLNTGTNLVRSEHGLLTTVCYKLGDAAPVYALEGSIAVTGSAVQWLRDQLHLITSADQSEALAAQVPDSGGVYFVPAFSGLFAPYWRSDARGAIVGLSRFNTDAHIARATLESICYQTRDVVDAMAQDSGVTLDVLKVDGGITANNLCMQIQADVLGVPVSRPVVAETTALGAAYAAGLAVGFWKSTDELRENWNESQRWQPTWSAERRDQGHGRWKKAVQRTLDWVDVD

SEQ ID NO: 13619 - protein, 563 aa, Actinoplanes utahensis
MTVLSPERRDAALAALAAAEVDVLVIGGGVVGAGCALDAVTRGLSVGLVEARDFASGTSSRSSKLIHGGLRYLEMLDFGLVHEALRERGLILSRLAPHLARPVRFLYPLQHRGWERLYTGAGVALYDTMAWSGSLPNHRHLTRRGALRACPALRKESLVGALQYYDAQVDDARHTMFLARTAAAYGAHVANRVEVVGFLREGERVTGVTVRDLEYDRTFEIRAQQVINATGVWTDETQSLVGERGQFHVRASKGIHLVVPRDRIQSTTGLILRTASSVLFVIPWGRHWIVGTTDTDWALDKAHPAASAKDIDYLLTEVNKVLARPLERADVQGVYAGLRPLLSGESESTSKLSREHMVGSPVPGLVVVAGGKYTTYRVMAKDAVDACAFNLNRSVARCCTDRIPLLGAEGYPALWNRRGLIAAGSGLHIARVEHLLGRYGSLIHDLLALIEDDPTLGRPLTGADDYLRAEVVYAAAAEGARHLVDVLTRRTRISIETFDRGTSSAAEAAELMARVLGWTPAQRDREVENYRLRVEAERASQEQQTDETADATRLGAPDVIPLS

SEQ ID NO: 13620 - protein, 213 aa, Actinoplanes utahensis
MDASTEELRDAHDVLSEFYATHLAGVLDTMPVERAMLNLFAELTLTVGTEVADVGCGTGRLLPYLADRGLTPRGVDLSPKMIEVAEREHPGFPYAVADLRDLPFDDATLAGVVCWFSLIFLAPPARTPAFTELARVLKPGGYLVTAFKHGDGTRRRTGRSNSLGVDFDRYWLSPEEMTARFTQAGLSPVFQGHVPPEENDPPYGYMLVRRITG

SEQ ID NO: 13621 - protein, 194 aa, Actinoplanes utahensis
MTSSSTPPRRRDAARTRQLLLDAARRRFATIGYAETTVRHIADEAGVNVALISRYFVSKEGLFEAALTASFTELRAAAGDVDPARIPETIAEQIIGQSSNTGPSHALLLILRSSGEERADRIRLRFLHMFAEKLSEAASLQGGDPDTLRAQILLSTAIGATLLRATNLEPLASASAADLTGPLRDVLQALIKVT

SEQ ID NO: 13622 - protein, 258 aa, Actinoplanes utahensis
MKFLSIVTALLALTAAPASATARTQSYVALGDSYAAGIGAGDYTGSACVQSRTGAYPYLWAKAHPTAKLTFRACSGATTATVLATQLGSLSKSTRWVTVTAGGNDAGFATTLQTCLLGSDADCSAAVQQSTKIIRSALPTAADTLYTAIRKKAPNARVYVVGYPHLLSTGGGTGCVFDPTRRQLLNSTSDTLATVLRQHTAHRKNFTFVDGRTILAGHEVCTAHPWIHGLATGDLTESFHPTAAGHQAYAKALTKVMS

SEQ ID NO: 13623 - protein, 707 aa, Actinoplanes utahensis
MTKRLVLAAVTSLALAGAGVAGISLAGTASAAVSLNNSDVTANLWEWNFDSVAAACTSQLGPAGYGAVQVAPPQESVTLASTSDGAHPWWEVYQPVSYDVSGRLGTQAQFTSMVTTCHNAGVRVYVDAVINHMAGSNNTGGSGYGGSTFNATGYSYPAVPYSYNDFHHPNDGYCNDDDGQIDDYSNAAEVQNCELVSLSDLKSQDTGVRTKIAGYLNKLVDWGVDGFRVDAAKHMAAADLSAIKALLHNTTEGRSPYFAQEVIPGGSGAIAPSAYTGIGDVLGFSYAYGLKTQFANGTLSNLSGIPSWSLDATSDQTAAMVTNHDLERNGSTLRYQDGSTYLLANYFLLAYPYGQPFVYDGFAFSTSATGASPPADANGYVTSTSCTNGAWQCTTQSAGVKGMVAWHNATRSATTVSNWTNTASNVIGFSRGSLGWFGVNRSGSASTATYTTGLADGAYRDRIAGTTITVSGGRASVTIPANGAVAIDVNARSGSSASPSTSPSVSTSPTSSTGTVQATFNVYAATTAGTSVYVVGSTAALGNWDTAKAVALSAGGYPIWSSTVAVPSGSSFEYKYLKKDAAGNVTWESNANRAVTTGSSAVTFTNSFGVANAGATAVTFTESATGTGLYVVGSIASLGSWNTADAIPLTSTGASGWSRLVALPQRTTFQYKYLRKDSSGTVTWESGSNRSYTTGTASSYTISDTWK

SEQ ID NO: 13624 - protein, 112 aa, Actinoplanes utahensis
MIELVSADRCVTCDVCIAVCPTNVFDRGADGVPVIARHGDCQTCFMCEAHCPADALFVAPLRTPAEPGSPLRDEAHLTARGLLGSYRKEIGWGRGRKPGARLAVGPELGPPS

SEQ ID NO: 13625 - protein, 526 aa, Actinoplanes utahensis
MPTEPTPLDLTADVVVAGGGPAGAWAALTAAQAGADVLLLDKGYCGTSGPTASGGTGVWYVQPDPDQREKAMASREALGGHLADRRWAARVLDQTFENMNRLAVEARYPFPEVGGEPYRRGVQGPEYMRRMRSWIRRAGVRILDHSPVLELLTDPGGTVAGVRGHRRQHDTAYRVRAGAVVLATGGCAFLSGALGCDVDTGDGALYAAEAGAELSGMEFSNAYGIAPAFSSVTKTAYYNFATFYRADGSHLAGASSQGGRSVIAAELLRGGTVLCSIDRADAGQQAQMRIGQPNFFLPFDRLGIDPFTERFPVTLLLEGTVRGTGGIRIAGDDCATTVPGLYAAGDAATRELICGGFTGGGSHNSAWAMSSGTWAGRGAARFAAGLGAGSHRRRLVSAGADGPPQADASGALEVVRAQVHPYDKNYLRHGDRLRPALDELNGVWSALRGSAGARGAQAVRTRQAAAMVAHARWMYTSALARTESRGMARREDFPALDPAQHHRLTVGGLDDLWVRPEQAAVRAVAS

SEQ ID NO: 13626 - protein, 63 aa, Actinoplanes utahensis
MEGRLGAHRAAAPSSPSPRTVQPLALRSHTESLHGTGRNPARSRCPARSRCPARLALPGPLAS

SEQ ID NO: 13627 - protein, 185 aa, Actinoplanes utahensis
MTKRLMVVLAAIVAVLVPAAPALAHNPLVGAVPAKNATVTAAPAEVKLTFLEKLDPATTKLTVTGPDGAAVAEPVVTGKSVTVSFGTPLGNGKYTVAYQLTADDGDVIKSSYTFTVAVAQASPSAAASDAPIAAVSVVPAVTVAAPAAPSQDKGNGPWLGLAAGIGVLVLLGAGIFVFLRRRRTT

SEQ ID NO: 13628 - protein, 210 aa, Actinoplanes utahensis
MSDEKPTTPIPVTPAHAEPVAEPVAEPVAEPVAATPAAQPPYVSTVAGGQPATPPPPPPPGWAYVPAGAQLPPPPPGYAYVPAGPQQSPRTPWRGRRVPLLTTVAALLLGCLLGVGVTAVAGFAFGHHRDGGGHGQFNGRGGDGRGGSGRGGDGRGNGPYGNRGGFEGNRGGDFGPGQRGNGRTPDNQTVPVNPPSGAPQSATPTPSASR

SEQ ID NO: 13629 - protein, 353 aa, Actinoplanes utahensis
MKRSTLRKTVLTLAALAAGLGIATAAPASAQAAPTTAKTTTKECVTGAKLVPTCGVLWGAAAGGFTGKPREVEHRAWERASGRTATIFHTYHKGDEKFPTDAEIAMARDKAHPRVLLMNWRVEYGTTWAGVAAGKEDKRIDAFAQRIKTKFPEKFYLVLNHEPEDDVIPTAGSGMTAKDFAASFRHVIQRLRADGVSNAVSVVAYMGNEKWMAQSWWKDLYPGNDVVDWIGLDSYVSAEKNYYHAGVFADLLDRKAKGGVGFYDWAVRNHPGKPMMVAEWGAYHRVGKVVNKSAVFNSVLPELAKRPAIKAIVYFDTKKDLYGDRDISIDSSPASLASFRKLAASPLFNVTVR

SEQ ID NO: 13630 - protein, 210 aa, Actinoplanes utahensis
MLHTITAGVLLATSLAGAPATAWHGAPPPTDKMIIGVVAANGSGCSGKSANVQVSPDNTAFTVTYSDFTAQTGPDAKPTDYRKNCQLALDVHVPSGYTYAVAGADYRGFGHLEEGATGSETAFYYFQGESHSTRIPHNFKGWMDNDWQQTDKVEVGSFSFLPCGEQRYLNVNVELRVNPGWSSRKATSFLSMDSSDGNLDTVYHVAWQKC

SEQ ID NO: 13631 - protein, 114 aa, Actinoplanes utahensis
MTIKDIFLDAFGRFAAGDVDVLRQVIRDDFVNHDPDTPRDKDGFIDATINGPIGSSTLDLKRVIADDIFVVAHYRLVPAGGGLGEAVADVWRFEGDLIVEHWDVAQPVTAPDQV

SEQ ID NO: 13632 - protein, 565 aa, Actinoplanes utahensis
MRKMVPVSALSVAVLLAGCNGGGGGDPTTSTAAFDPKTCQGGTLTVLNQGGINHLDPARLYTSGGGNLPSLLFRTLTTRNRQPGEAGTKPAPDLATDLGTPSDGAKTWTYHLRDGVQFEDGTPITAADVKYGIERSFAPELPGGAPYLRDWLQGAADYQGPYKQPDGIKAIETPDDKTIVFRLSKPEGDFPFLATATQFAPVPKAKDTGAEYEKHPVSSGPYQVESYEPKKSLVLVRNPHWSSQVDALRYACPDRIEVTSGLDSAVINQRISTGAGADANAVTTDAVVGPEQLAQLGTGSGLDKRVTRGEFPSTTYLAFNTKKAPFDNPKVREALSYAVNRTSVVNALGGSAVVGPSTTFLPPQKALGYQPYDWFPAGDTGNPDKARQVLAEAGLSNLTIELAHENDDSEGVGPKVASAVQEAFKQAGITVKLTAIDTATYRDVTGKPATQPGLSLQTWGADWPSGGPFLIPIFDGRQIITAGGNFNLAQYNDPAVNAEIDAINALTDPAAAAQRWGALDAKLGKQALVLPLTHEKDVYLVGKNVKNAYADGWRGQLDIARISVK

SEQ ID NO: 13633 - protein, 307 aa, Actinoplanes utahensis
MARAAGHRPDLGQVIRALLRDRGFVAGAVIAAGMVLVALTAPLLAALAGQDYTTYHDALLDSARGGVPLGSFGGVSGEHWLGVEPGTGRDLFARLVYGAQVSVGVAVGATILEVLLGVGVGIAAGLGGRWADGVLSRVIDLVLSVPALVMAISLLAIVPQDWPRPVLLATVIAVLGWGGTARISRGETLTLRTRDFVAAAQVAGAPWWRVARREILPGLTAPVLTYAALLLPTNMVAEAGLSFLGVGVRPPTPSWGQMLSSATTWFRADPAYVLLPGLLLFLTLLSFVLVANGLRRVFDPRQREVLR

SEQ ID NO: 13634 - protein, 329 aa, Actinoplanes utahensis
MIGHLARRIVGGVLVLLALSALVYTLFYLAPSDPATLACGKGCTPERLADVRAAMGLADPVLTQYRHFLQGILVGRDYSLGPSVRHCPAPCLGYSFETSQPVTGLLLDRLPVSFSLAIGAEILSLIIGIGAGLLSGARRFRWLDRIVNGLILAGYSIPVFLVGLLLLLLFCVHLQWLPFPGYVPITTDPLLWAQNLLLPWVSLAVIQTAAYARLTRSGLQESLAEDHIRTARAYGIPERRILWRRALRGALLPLVTLTAVDVAAIMTSAVLTETMFGLPGVGQLLVGAVNQIDLPVVVGVTLLTGVIIVVANTAADLLYAAVDPRVQLR

SEQ ID NO: 13635 - protein, 514 aa, Actinoplanes utahensis
MTLLTVTDLKVSFGDRKAVDGLSFAIPAGGSLGIVGESGSGKSTAALALLGLTGGAVSGRIDFGGTDLVVADPRPFRGARIAMVFQEPLTALNPFQTVGSQIAEVYRLHTGASRREARARAVEVLGQVHIPDPARRAGAYPHEFSGGMRQRALIAMAIACRPELIVADEPTTALDVTVQAQILDLLDEVRATTGAALLLISHDLGVVAGSTEQVVVMRHGTAVETGATETVLRTPRHAYTRALLDAAPRPGGRVYVPGAPLLELRDVHKHFKKPRRPAIRAVDGVTVTVHAGETLGVVGESGTGKTTLARMMVGLVPPTSGTVTFDGVDIARRRGRSVQMVFQDPLSSLNPRRTVGESIADPLRLRGDRDPRRRVCELLERVGLSASEYDRYPHQLSGGMRQRVGIARAVAPAPRLIVCDEPVSSLDVTTQAQVLTLLEELRAELGLALVFVSHDLAVLRRIADRIAVLKDGRVVEIGPTTRVYEQPEHPYTEELLAAAHRLHAGVAVGEHRAE

SEQ ID NO: 13636 - protein, 187 aa, Actinoplanes utahensis
MARAEVYVSTDVETDGPIPGPHSMLSFGSAAYLRDGSLVGTFSANLATLPGAAGHPATMKWWASQPAAWAACRQDPEDPAVALERYRGWLEALPGRPVFVGYPAGFDFMFVYWYLIRFTGTSPFSHSALDIKSYAMAVLGSDFRATVKRAMPRRWFGDFPHSHVALDDAIEQGALFCAMLADRHSRV

SEQ ID NO: 13637 - protein, 605 aa, Actinoplanes utahensis
MDAHRRRQDAREQLAEHGEERPPQLGEDAGRQHGRGEDRPARLHRHDRHQQDDDADHRHAQGPGGQEHEGAVHRRGRRRRLPQPDEPRHGCGHPRRRQDRRGVFRDRHSGQRRRPGPGRDGRNARHGPQGHGRLIPHLAASMRFTELTWADVDPDRHPFDPDTVLDVVRAVAPAGGVPAPYRHERGVFDAAADRARWDWQRAMGAALVDHYGPWALGWNAEIAGRAADGALVLRWSGARDSITTPEETLAAVAGSLLDWRTFLEEVAEFLPRHLPLPAEPRAAAAAWEAAITSLVAMVAARSGADEHWYPVCAQTLRWFLAVAGVPAAEHDALIDVAIGGRYFSFVFPLGAEVADVAESVAAAVTGTTPAPDDLWPETWPQDWPNWRGRHLPAASHVPRVPAPVVVDALAVWRRVRQQARWERADRVTGPARAARDGIAEHFAKRGSGAAHLLAALELVRADAAGGGPLTFARLETWQREVLGVAAARFRAVSAWARAGAEHYPYRDDLPDSFAACLAEATDPAVPLPARAARVYLDIVHFHPFADGNARSAALAVYFVLAREGVVLSRAAPLLMTRWPASVPGNAEGLAAVIALLIRQTGRLQR

SEQ ID NO: 13638 - protein, 148 aa, Actinoplanes utahensis
MTGTAQEYLDTRLPDPAIRAAIVLDIDNTALETTYHPGLISPATAPVLALARQAEAAGAAVFFVTARPQLLAWQTRQNLRTAGYPVTDIYLRPWFDFDPDATLKTNARIAIENRGYRIVANVGNNVSDLQGGHADRTFKLPDYNGQLS

SEQ ID NO: 13639 - protein, 166 aa, Actinoplanes utahensis
MPANAGNNFGSAEHLLGVGRAKERSMNPEPNSARPKHPHSRHRRRMFAVVAGIAVAVGVGGGVAMASGVPFAKSDTSGGMCARTLSAQADLSEPTGGFDPKHPSRACAQGWHQMWGDGTPVPARFVACYHPGANAGGSVIYPADRFADAAAACASIGSTAIPGVKA

SEQ ID NO: 13640 - protein, 192 aa, Actinoplanes utahensis
MPVLQDRPGHDRQSAERRLEELFRLHADAVLTFLRHRTDHETAQDVLTETFTIAWRKLGEIPEDPRGWLYGVARRVLANHVRSQGRTAAVVERMRHESRLSGPDESGIEDALHRHDVLAALAVLPEADREVLLLAGWYDLTGAQAARALDCTRAAYALRLHRARRRLRGVLSGSATARGTTSAARPAREANV

SEQ ID NO: 13641 - protein, 172 aa, Actinoplanes utahensis
MNDELREVRRTRPAPVEGWADSAEGRELFDTVLTHTRAEPVPRTSRRHRRRALTIGAALLLAVGAGGGVAVATGVPFSPGDTSGGMCARTLSAQADLSPPKGAFDPGDPAKACADSWHQMWGDGTPKPARFVACRHPGKDAGGSVVYPAGRFADATSACASIGAEPIPAANR

SEQ ID NO: 13642 - protein, 396 aa, Actinoplanes utahensis
MPERSETAHQVADLLRTAREALGMSVAFLSRMEGPVQHLEVVESDLPLHDGMTQVRATSLCQAIEDGTLPPVIPDLAAIPAAAGTPALKVGIRSYISVPVELSDGTVYGTFCGAGLTPDPLLDDRDRVLMRVLAHAAAMIIEPDVRKRQRNAAIERRLRPVLARGGPVVLLQPIVDLATGRRSGAEALSRFPREWQQPPDEVFADAALIGERENLELAALRRAADHLPDVAGYVAMNISPATLFTDDGVAFLSRLPLDRIVLELSEHDPVDDYARLRAVLAPLRARGMRLAIDDVGAGFSSLRHIVATAPDVIKLDRSIVSGVAGDHVLSVVVRALADLAGAVGATVVAEGIETAADAAALAGLGADLGQGWLFDKAVPAEDLRDAYDLAPAACPS

SEQ ID NO: 13643 - protein, 396 aa, Actinoplanes utahensis
MAKSHFVRNKPHVNIGTMGHVDHGKTTLTAAITKVLADRDPVANRYVAFEGIDRAPEEAARGITITIAHVEYETPTRHYAHVDMPGHADYVKNMITGAAQVDGAILVVSAQDGSMPQTREHVLLAQRVGVPHLVVALNKSDMADDPELLDLVELEVRELLSAYGFPGDEVPVVRVSALKALEGDPRWVASISELLDAVDAYVPVPARETGEPFLMPIENVLSISGRGTVVTGKVERGELRVGEPVEVVGLGPTLSSVATGLETFGKVLESAQAGDNAAVLLRGVKRDQVQRGRVVAAPGTVQPHRVFQARMYVVTAAEGGRHTPFAADYRPQFYFHTTDVSGGLDLGGRDLVRPGDTLDAVTVTLGKPVALEPGLGFAVREGNRTVAAGTVTAVLD

SEQ ID NO: 13644 - protein, 757 aa, Actinoplanes utahensis
MLIELEIGGMTCASCASRIEKKLNRVDGVSATVNYATEKAVATVSGAVSADDLVAVVEKAGYTARLPMVTAPETPDVSDPLRDRLLLSVVLSVPVVVLAMVPAWQFDHWQWLSLTLAAPVVTYGGWPFHRVAAINLRHGAATMDTLVSFGTLAAFGWSLWALFVGTAGETGMRHPFAFAIARGDGAGNIYLEAAAGVTTFLLAGRYFEARAKRRAGAALRALLELGAKDVSVLRDAHEVRIPIAQLAPGDRFVARPGEKIATDGVVEDGSSAVDASMITGEGVPVEIGPGGTVVGGTVNAGGRLIIRATRVGADTQLARMARLVEQAQAGKANVQRLADRISGVFVPVVIALAVATLGWWFGAGAGWTAAFTAAVAVLIIACPCALGLATPTALLVGTGRGAQLGILIKGPEALESTRRVDTIVLDKTGTVTTGQMSLAATRPAPGQDPDELLRLAAAVESAAEHPIARAIAAACPSAAASSSAVSPSAAASPSAASPAAAGSLAVRDFTSFAGFGVRGEVAGHQVTVGRLALLERDGLTIPAEVVTAAAEEEAAGRTAVVAGWDGAARGVLAVADTVKPTSREAITGLRRLGLTPILLTGDNQRVARAVATAVGIDEVIAEVLPADKVAVIESLQKSGRVVAMAGDGVNDAAALARSDLGLAMGTGTDVAIEASDLTLVRGDLTVAVDAIRLSRRTVRTIRGNLFWAFAYNLAALPLAAAGLLNPMIAGAAMALSSVFVVANSLRLRTFRAARRHL

SEQ ID NO: 13645 - protein, 283 aa, Actinoplanes utahensis
MRSSVRFTAYVLGLILIFGAAAGAGKLLGTAPRPAPAHTAGAHSGHETTLPAGLQVTQQGYTLSPLTSSFAAGEAQPFAFRILGPDGRAVTRFAGDLHLIVVRRDLADYQHLHPVRAADGTWSTTLTVPEPGQYRVFTDFTPLAVARNLVLGTDIPAAGDYRPRPLPASGWAVETDGYTVTRAGDPQAGAPAWVTMSVSRDGQPVTLEPYLGTFGHVVALRQGDLAYLHMHPQDGSTAGSDVTVDATVPSGGVYRLFLEFRHGGTVHLAEFTADATTGGHRHD

SEQ ID NO: 13646 - protein, 199 aa, Actinoplanes utahensis
MLDWGMPEPTLWNRTRQAVYDEIARTAMDLFLSRGFEATTIDDIAAAAGISRRSFFRYFGTKEDILLGDLAAQGELAARALAERPEDEEPWTALRNTFHAIKEETYDAATMLKISRMMYETPSLRARHIEKHLRWQESLVPELRRRLGADPDDPLDVRAEALVACVITCLDVAGEAWTRANGAVPLEVLFDSAATALRP

SEQ ID NO: 13647 - protein, 281 aa, Actinoplanes utahensis
MSVRHTMHGMSVVDYRKQTVLITGASAGLGAEFARRLAARGAGLVLVARRADRLAALVAELSAPGITVTPIAMDLAVPGAGERLSAAVEAAGVTVTSLINNAGFGTNQAFHEEDPARVTDEITLNVTSLVGITRAFIDRLRAGDGFLINVASIAAYQPNPRMAVYGATKAFVLSFTEALWFESRHTRLRVLAVSPGATETEFFEVAGQGADGGTRRMRADQVVDSALRALDRRTSRPSVVTGALNRVLTGATRLVSRRLLATVVGTLLERSADARISTRSA

SEQ ID NO: 13648 - protein, 267 aa, Actinoplanes utahensis
MRESALVVHDLRMATFRSDDGVEIYYEVREGGDGERPPVLLHHGFIADGRTNWELPGIVAALTGAGRRVVTIDARGHGRSGKPHDPGRYGESRMAEDVRALLDLLGATEVDLAGYSMGAIVALLTATRDTRVRRLVIGGVGAAVVELGGLDTRVVGGESLIRALRTDDPSTIGDPAAAGFRAFVEAVGGDRLALAAHAAAVHAAPIPLATITAPTLVLAGGSDPLAVRPEVLTAAIPGAVLRTVPGDHLSALRDPAFTPALLEFLNA

SEQ ID NO: 13649 - protein, 130 aa, Actinoplanes utahensis
MGRNSPAAVRAAQPRRDETVAIDGLPSPTIRAIRELERTRLWPGAVATALRGWRRTVHGPRARLFDLDDDCPCCDRSQDRMVLERAMTALGGRPGRDLRAAVDLLDEVLRRRTHHDATTPAGAVWWHRRV

SEQ ID NO: 13650 - protein, 42 aa, Actinoplanes utahensis
MRGARRPGAVARADGSVAATGLEVLLPAPDGRITHDYRFIGA

SEQ ID NO: 13651 - protein, 347 aa, Actinoplanes utahensis
MRRRTGFEIELMAPAGVSRRTLATDLAGRCGGSVRPVWHSDSEPSLVPGLGRFLHLTPGFEVRRPDGDLLCTLVDDITLVAGLNPAAPPQAGWFRVLTDDSRLLRLLARHSDPAGTIDQALAPAAELWGRKVQQLGDYYRLDDAADATIALAAPLGGERERPCEIVTPPLTGGFETALEELLGPARELGFTVPYEAAVHLHVDGAPFRMPHALSNLVRLFTYWREPLRAVLRTNPACRRLAPLPEPLVRAVEGVPTTAQLRAAAAEGELTKFFDVNLTQLLTDTPLRNTVEIRILPGAISARPILDQAAVLELLLDRCLDPEPIPRGDSVDGLLELAAEALAGRPGD

SEQ ID NO: 13652 - protein, 266 aa, Actinoplanes utahensis
MTDHGDRLREAFARTESQTPDAGDVYARVVELSRKHKYRRRGATAVGGVALGAGLIAAVVNLPAILPGDPQSGTGTSATAPFVAGAPASPAPSASSADQQDKDLQAYWDAGYTGDDVEALAKLWKMSPDDYLGVKTEAGRRLLAGETLPIRPQPVQETPASVAKFFDAGYSVDDAATLAKLWHLKTPYDAKVAGGEKLLRGETLPIKPHPSAEQIEEKRVSAFFDAHYTIADATRLAKLWHLKTAYDAKVLGGKKLLAGQTLPIKP

SEQ ID NO: 13653 - protein, 183 aa, Actinoplanes utahensis
MHNGGSGHVDSGVTFEQFAMARLPSLLRYAVVLTGDRHLAQDVVQEVLARAHVKWRRIQNADSPEAYVRRMVLNEYLSWRRSWAVRNLHLAGERLVEIDDARGGVHDHADRIAESDALWNRLATLGRKQRAVLVLRYYEQMDDDTIADLLNCSPATVRSQASKALRTLRLESERELSFAEEKS

SEQ ID NO: 13654 - protein, 447 aa, Actinoplanes utahensis
MTTTAPTPAHLAGNFAPVTGETTTLDLPVTGAVPAELTGWYLRNGPNPHHGTSAHWFLGDGMVHGVRLDHGRATWYRNRWVRTRVLTDDARAYGPDGTRDLTAGPANTNVVRHGGRLLALVESALPYEITTDLETVGPYDFGGRLHTPMTAHPKVCPTTGEMHFFGYGGLEPPYLTYHRAGADGRLSLSRPIDVPAHTMMHDFSLTAAHVIFMDLPVLFSLDGARTGGMPYRWDDTYQARLGVLRRDAPQGEVRWYTIDPGYVFHTLNAHDDGDRIVMHVVRHEHAYRPGQPAAAPDLWRWTIDQRTGRVAEERLDDEAVEFPRIDDRRTGQPARYGFAVTDNVPRRLADVSAVIRYDLHTGSTTRHRLPTGQVPGEAVFVPAGGAPAGSADGWLLTFAYDPGRDASDLIIIDATDLAAPPLARIHLPHRVPFGFHGNWLPDHDRAE

SEQ ID NO: 13655 - protein, 183 aa, Actinoplanes utahensis
MEFLSGFAPWIVFGAVTAATDWTIGALAGLLATVLLIIRARRAGARADRLVLEYSNAAFFACAAVVALLQPHSPIASWTGPLSLAWIALTAWGSLVARRPFTLGIAKASAPREVWDNPVFHRTNLVITAVWAATFTVAAVLLATLQAVHAGTAATIAVFLLYVIPIAFTRRYPAIVRARYARS

SEQ ID NO: 13656 - protein, 177 aa, Actinoplanes utahensis
MSLRFALLGLLADRPSSGYDLLTEFRTSLAHVWPATQSQVYRELNTLTEAGMLTVGEEGPRGRREYRITAAGRDALDAWLTTPDSAPSYRSALLLRVFFLSLAGPERAAGFFRDQADLAGQRLSGYHDLVESRTWDAGTLERYGRIALEYGIRLAAMQRDWAIWAAGQLPDDGSPGN

SEQ ID NO: 13657 - protein, 352 aa, Actinoplanes utahensis
MRTIEAQRLRGGSDVPGGRRKQRVSMADVAKLAGVSSQTVSRVANGQVGVVEATREQVLAAMRELGYRPNSAARSLRYGRFNTLGVILFGLSSTGNSRTVEAIATQAAAAGYAITLIPVGVPTQDNVLGAFTRMGELAVDGVIVIIEVHLLDAATVALPPGVHVVVVDSDAGERYPVVDTDQADGARQAVRHLLDLGHHTVWHIAGPAGSYSAERRATAWRTVLEEAGRPVPPIGRGDWSAESGHRAGLDLPADCTAVFVANDQMALGVLRALHERGRRVPRDVSVVGFDDIADASSYLPPLTTVHQDFAEVGRRCVQALLDQIAAGPAAPGTDLVPTHLVVRGSTAAPHRP

SEQ ID NO: 13658 - protein, 288 aa, Actinoplanes utahensis
MTRRSWIGWQFVAPFLAVFALVFLAPIAYSAYLSLYRTRLIGGTTFVGAENYTKALHDPQFWSAVGRVSLFLVVQVPIMLILALLIALAIDSGRLYGAAFFRITIFLPYAVPAVVATLMWGFMYGSQFGLIRNLNDLLGVTLPDPLAPDYVLASIGNIVTWEFVGYNMIILYSALRVVDPSLYEAAAIDGAGQFRIVRAIKLPALRGPLLISTMFSIIGTFQLFTEPVVLRTIAPNAILTYFTPNYYAWQLSFGGQQYNYSATVAVVMGLLTMVVAYLVQARAVRKAG

SEQ ID NO: 13659 - protein, 302 aa, Actinoplanes utahensis
MVAAPTIRPAARRRPQPAAAPPRRSGSRTLTVLTTLMLLYTMLPLAWLVVSATKTQQGLLGSFGLWFDHDFALFDNIGRVFTYQDGIYLRWLGNTVFYVVAGAGGATLLSALAGYGLAKFAFPGRRAVFALILGAVAVPPTALAVPTFLLFAKMGITDTVWAVIIPSLMIPFSLYLMWVFATEAVPDEVLESARVDGAGEFRIFFSLAVPLLSPGLVTALLFNVVVTWNNLFLPLIMLKDRNLYPITLGIYSWNQQSLTVGGDVVFNLVITGSLLAIVPLIAAFLLLQRYWQSGLAAGSVKQ

SEQ ID NO: 13660 - protein, 448 aa, Actinoplanes utahensis
MRITRRHALFGAAMSITLLAAGCGSAGKSDDGTTKAAATTVSDADVEAALQAGGNLTVWAWDPTVQKVAEQFQVKYPKVKVTLRNAGTGNDQYTALQNAIKAGTGVPDLAQIEYYALPQFSLSQGVTDLNQFGAGSLDGTFAPGTWNSVHAGEKIYGLPLDSGPMALFYNKEVFDRYGIEVPKTWDEYAAAAAKLHAANPKSYITSDTGDAGFTTSMIWQAGGRPYRVDGTTVGITFADAGTQKWTSLWQGLIDRKLLAPIPGWSDAWYKGLGDGTIATLVTGAWMPGNLETGVKAANGKWRVAPMPQWAAGDKVTAENGGSSLAITEASQAKTLAYGFLKFAAVQDGAQIRTDAGAFPATTAQLNADAFKNKQFPYFGGQKANEILSESAAEVATGWSYLPFQVYANTVYNDSVGKAYTGGAKLQDGLKAWQDASTRYGREQGFTIP

SEQ ID NO: 13661 - protein, 667 aa, Actinoplanes utahensis
MSDSPSDSPKMRNTTPRRWLRRAGAPRLEYGADYNPEQWPREVWAEDVRAMRAAGVTVVSLAIFSWARIQPRPEVYDFAWLDEVVDLLYAGGIAVDLATATASPPPWLTARHPEILPVDKHGNTVWPGGRQHWRPTSPVFRAHALRLVRALATRYGKHPAVVAWHVNNELGCHNVYDYSQDAALAFRSWLRERYRTLDGLNAAWGTDFWSQRYSDWDQIIPPRQAATHPNPTQNLDFKRFSSDALKDHLIAERDLLRELSPDVPVTTNFMVMGETSAMNYADWASEVDFVSNDHYVVPHPQARDELSFSANLTGNIAGGRPWFLMEHSTSAVNWQPVNLAKKPGELARDSLTHVAHGADAVCFFQWRQSRAGAEKYHSAMLPHAGQDSELFRSVAALGERLAALESVAGTNRVPADVAILIDWDSWWVAEHDSHPTDRLRYRQEALDWYTALLDLGVRADVVPASSDFSGFTVVIAPVLHVVPAALAARLNSFVTQGGHLVCTYFSGIVDENDQVWLGGYPGALRDLLGIRIEEFGPLLDGETAELDNGTVGTLWTDRVDVTDPHVAVLARYKTGDQAERAAITRRAVGAGSAAYVSTRLGPDGLAAVLPGLLQAAGVTSELAPELRGRVELARRARHRFLINRTAEPIDLGADGMLAGRDVKIIQD

SEQ ID NO: 13662 - protein, 285 aa, Actinoplanes utahensis
MPEDDSRSGLRVGGWVPPYSPDARSRKPLIRPTAPTDFPPPPIPYFAGWNRRSMPWRRRAALAAAGAATVGVVAAVSLGDPASHPAFVAAPDPAGTVVPFSLPPRPPSPVETVPVASNTSSRPTATGSAPKGGPTRRAPAAVTLSVGGTEALTVADRTGFRVRHRNFLGRLDPIGPGSSVLDRADSSFTVRKGLNDSRCVSLESVNYPGYFLRHQNFVLKLQRRDGSGLFAADATFCPVTIRSGAALALRSSNYPKRFVVASGDRLTLDESAPEAALALVPRAAD

SEQ ID NO: 13663 - protein, 131 aa, Actinoplanes utahensis
MESPVTPEPSGLPPTLPRISDYWPDAPHRLGPPADVYELPGVEATRTGTPAGGLAGDPAPPDGTRWIGAPPEPRTGRDWKPVVFLVAVVILVSGGVLAALAAVRSSGEDAGSLPAPPLPVPTVGGTPPATP

SEQ ID NO: 13664 - protein, 200 aa, Actinoplanes utahensis
MPPAPAGPALPDTATFELADGVAQLRVSIGDVPRGLVKVSVGKNSRIAARTTVSGGTVRVDVRPNGRRTGTARLEVLLNSSVTWSLRMRGGVSEAGIDLSRGRIRSVDLIGGAATVDLSVPDQRAAIPITERGGIRTWRIVTESRVAARVFLRRGAGVVTLYGDTDAGVDRGVTLRSGQGDGGIRVDSEGGIGALTVQAR

SEQ ID NO: 13665 - protein, 202 aa, Actinoplanes utahensis
MTRTQGDALPPEASYSLDHFIGLYEAKGDPWDNATKWSDQRKYAVAMASLPQPRYRRCYEPGCAVGVLSVMLAARCDEVVAVDCVDEAVVQARALTAGLPNVRVERALLPAELPGGTFDLIVVGDLLYYLSAADLQTMLDGMVERLEEGGDLVSAHFRDRLNPGNYDGFNVHEAIAARPGLARVIHHEDEWFVLDVFRKVAG

SEQ ID NO: 13666 - protein, 506 aa, Actinoplanes utahensis
MTERTVTLFLSGLLEEHPVGGKPQPAPVTADLTHMLLRCYVAVTTLLVATYLAWPFDDRQWPYLAVTLGAALPAVGYALRRAPAGARLPWWLMLAALTSYNIGNLIWIVLVEVGGRATGDGSLAELFYTGGGLCLLTSAIAVVRLRGAGDIGGVIDSVITAVALGGVLWDAVLLPAMSAQHQSTPRQLSMFLGLTMISGTLGAMLRVSMAGRRSASVWLITASVALVLVADVVSALAVGPDGVRADWTNMVYLAAYAVLGWAALHPSITTWVTPGHRPADEISRGRLTFLGVMLALTPMVGGGRAILGLPTDGILIALSSAALTPLVMIRIARLAAQRRAAEKALHHLATRDALTGLPNRAACLDHLSTATMSAEPLAVLFGDLDGFKPVNDRLGHAAGDELLTLVADRLRACVREGDLVSRFGGDEFVLICRGETAVPGVSERIAAMTALPFVVAGEEVYLGMSVGAAAGRTGDRAEALIRRADEAMYEAKKSKRVGALSLVLAG

SEQ ID NO: 13667 - protein, 331 aa, Actinoplanes utahensis
MRVRSTVLTGLTCLSLAACTAGAGPGPAPAPVVSTEPAEQFYVDPSGAAEAQVRSWNAQGRAADATAVRRIADQPAAVWFADADPGFAGRARDLVTAAAAAGRTPVLVAYYVPQRDCGGHSGGGAPDAAAYRDWIGQLAGAVHDSPALVVLEPDAVTHILQGCLSPEAAGERFALLGEAIHAFRADPGVRVYLDAGNPGWVKDVDRVVDALRSAGIADADGFSLNVANFETTQANLDYGTSISDRLGGTHFVIDTSRNGNGPATTATSGDGHWCNPPGRALGPAPTTRTGHDRVDAYLWVKRPGESDGACGDGAPPAGQWWPEYALSLATN

SEQ ID NO: 13668 - protein, 1022 aa, Actinoplanes utahensis
MQIGVLGPLLVRTRDGAPIDVPGARLRALLAILALEAGRTVPKATLVDGIWGDTSPADATNALHRLVSRLRKLLPGGLIEAHQDGYRLATDPDSVDAVRFERLLAAGRPGEALALWRGPAMQDVGLTGSPAFDAAVTRLQEQRLAALETRDAGPESIPELTTLVAAHPVRERLVAALMRALVAGGRTGEALQVFQRTRETLADTLGVDPSPELSALHVALLRGEAAGPRAADRGNLRAELTSYVGKDVEVATVRGLIGRHRLTTLVGPGGTGKTRMATETARSMLDTLPDGAWVVELAGIGADGDVAQATLAALRLRDALLGEAPDASPVDRVVAALRERDVLLILDNCEHVIESAATFAHRVLGECRRLRILATSREPLGIIGEALWPVAPLALPDEDAAPEHIAASPAVRLLRDRAAAVRSDLVADPRAPATMARVCRALDGMPLAIELAAARLRTMSLEQLANRLDDRFRLLTGGSRTALPRHRTLRAVIDWSWELLAEPERVVLRRLSVFAGGATLEAAERVCGAGDETLDLITALTEKSLVVAVGEGAPRYRMLGTVREYAEQRLAEAGETDAVRRAHLAWFTEFAERAEPHLRRAEQLEWLALLEADHDNLSAAMRGALAAGEAGPAVRLAGAAGWYWWFGGHKAEGYELLMAAVALPGEVADDVRALAYAFVIMFAGSGHGDQFATAEWIRRAHAAGRDAGGGHPALRLVTAMERLLRGTAAAAFEPLLADDDPWVRALARLQIGKMWIALGHEATDADAYLTAALREFRAIGDRWGISFALTELAGRIAMRGDLAAAGECLEQAIAVVTEAGAIEDVVPLRSRQAKLHWLAGDPAAAAAALAEAQRVAGRVAWPHALVELALTRAELAAWSGDAERAGGLLDEAMAMLGAEAGQPILRALGHHMRGRLAADPDAAREHHRAALRAVTEAGHAPLTAQILTGIAGWALDTGRDAEAARLLGAAVAVLGMPDRSHPDPARFELRARDRLGDRAFAEAVREGGGPDWAELAEVTLAS

SEQ ID NO: 13669 - protein, 246 aa, Actinoplanes utahensis
MSDSMIMLRRNFRHTLRNPTTLFNAVLFPVVIMLMFVYLLGDAFSVGVDYVDYATPGMILLAVCYGLSATATATNADMTKGIINRFKVMDVSRGAVLTGQVVASLLNNVVAVAAIIGTAFALGFRSSASLLDWLGVAGMVVLLGVSVGWLTVALGLTARTVETAGLATVPLIMLPFFSSAIVPADKMGPGARQFAEYQPFTPIIETLRGLLTGMPSGHDAILAVGWCLVIGVGGYLWAVSAFTKRA

SEQ ID NO: 13670 - protein, 308 aa, Actinoplanes utahensis
MTTAIEVSGLRKAFGDRVVLDGIDLTVPAGTVYCLLGPNGAGKTTTVNVLTTLIGADAGLVRIAGHDLATEARAARATIGVTGQFAAVDELLTGRENLRLMADLRRVRGDVATGLLERFDLTAAGDRLAATYSGGMRRKLDLAMTLVGDPRIIFLDEPTTGLDPRSRRTMWEIIRGLVAGGVTIFLTTQYLEEADRLADRIAVLDQGRLVAEGTAAELKRRIPGSHVRLRFATTADLDAAARVLPDATRDDDTLTLRVAGDGGTRSLRSLLDRLGGYALDAEEFSVHTPDLDDVFLALTGNTPKESNR

SEQ ID NO: 13671 - protein, 649 aa, Actinoplanes utahensis
MIPRPQPSLARRLLRTLAIVPAVAAVLAANQPIVVFAADRIHRFRIDRESYKQAYGHWSMLAVPDKFKINAIHAALLSTGKVLIIAGSGNNRQNFEAGTFKTILWDPATDGFSLVPTPSDMFCSGHTFLPDGKLLVAGGTKSYEVLPGNIRFAAGVMKIKNESPDHGPRTIAKGTRFVAPDGRQYATRTAVTVPAAMKMVHAGQTMVHAGEVEVWVDAVIAGDTQSINQPAQYEIAGLTGRDAKNLYGVADKINREKQEYGGDNTTYEFDPRTERYVRTGNLTDHRWYPTLAPLPGGNVLAVSGLDQFGRMLPGRNEIYLTREHRWVAAPQLTRNFPTYPALFVTRDQRLFYSGSNAGYGSATVGRTPGLWDLTNNDFQPVPGLRDGTMTETSASVLLPPAQRQKVMILGGGAVGDSPVSTARTAIADLSRPHPVYTAGPDLPNPTRYLNTVVLPDDTVFTSGGSSGYRGGPYHGQNRSDLLTAQFYDPYRNAFRTAAAPSVGRDYHSEGLLLPDGRVVTMGGDPIYDRSGKNPGVFEQRVEIYSPPYLFRGARPRISGGPAEVARGATASYPSPDADRIRTARLIRPAAVTHATDVDQRSVALPLRRGPGGITVQIPRDRGLVPPGWYMLFVVDTDAVPSSAVWVHVP

SEQ ID NO: 13672 - protein, 564 aa, Actinoplanes utahensis
MAYDYDSFSRLAGPPDPVPDGDYRVRLRRLAHHRPVRSLLIAIFAFTCEATFFGWLLTSADLTGGVSPVTAVMIGAIALIELFRLVNVVTLCLATLRARDPVPVPPEAGLRVAFLTTIVPGKEPVAMVEQTLRAAVRIRGEHDVWLLDEGNDDDVRKMCADVGARHFSRKGVTRWNAAKGAFKARTKHGNYNSWVDAHGDDYDVFVSVDPDHVPLPSFGERLLGYFRDPDVAFVVGPQIYGNYDNLVTRWAESQQYLFHSLLQRAGNRLGAPMLVGTNNAVRISALRSIGGLQDSITEDMATSLAVHATRNPATGRRWRSVYTPDVLAVGEGPSSWTDYFSQQHRWSRGTDEVCTGAFWRALPRLGAGRGLHYALLMAYYPTTALAWLLGTVTAVAHIAFGVHGVQVPQQVWSMLYVDAALFQVGLYLWNRRHNVSPHEEAGSSGLTGMLLSTLCAPVYVTAFRQTVLRQQAGFVVTPKGDSASPDRVATFRSHLCWAAVFAALLVTAVVTGRTGGLMWLWPSLNLALCLAPPVLWATAAKPPAPVAAAPIPAQRTKEPVRTYA

SEQ ID NO: 13673 - protein, 162 aa, Actinoplanes utahensis
MIAGQSPGGSPRTRRNPAGDRRSDDSAAPLRCVIRVRRFARQTFEPNGPVIRLLCRGGANVTRRRFDKAVAMLILFLLILVLAAACVLAVRGVRAEARKAEEPLLVPESFFAPQSLEGVLCTQLLDGDITRRQYLRSMAGIAARDEARHPLVVPWHLGAGEE

SEQ ID NO: 13674 - protein, 251 aa, Actinoplanes utahensis
MAGTVRRLPGAAAARLFRHGRRVEHGDATNRRSLYHRISGGSVERLAALSDGIFAVTMTLLVLDLHVPVAAEVSRQRPLWSAGAVAPERALWGALVHVGPSALAFALSFLTLGMFWLGQQTQLNYCARGDRQLSWLHLTFLLGVSFMPFSTALLAEYMTVRLALAVYWLNLLVLGLLLLACLRYAEGAGLLREDRDPGFRAGLRRRIVVAQAVYLVGVLLALVNTYAGITLIVLMQLISAVGPKIRPFDRF

SEQ ID NO: 13675 - protein, 657 aa, Actinoplanes utahensis
MIGDSLDEVHLQEVLDGRWAHIRRAVRDELGKAGFAAVYGETGDEARERVSRLIRQIPSDIGVASAFPRAYGGSDDPGGSVVAAEMLAYADLSLMVKAGVQWGLFGGAVVALGTERHHAAFLPGIIDTEIMGCFAMTETGHGSDVQKLRTTCEYDPATETFDLHTPHEAARKDYIGNAARDGRMAVVFAQLITGGRGRGVHAWLVPIRDADGNPMPGVTLGDAGHKAGLLGVDNGRISFDHVRVPRDMLLDRYGQVAPDGTYSSPIENDTRRFFTMLGTLVRGRVTVGGAASAATRAALTIAVRYGDTRRQFGVPGADREVVLNDYLAHQRRLLPALATSYAYLFAQEELVGTLADVQAGPEPVDEHRQRELESRAAGLKAMQTWHATHTIQMCREACGGAGYLSENRLPALKADTDVFTTFEGDNTVLLQLVAKGLLTGYRDAFGSLDGWGRTTFVAEQVREMVLERTAARGLIQRLVSAVPGRHEEVAVTDRGWHLTMFEDREKHVLEGAIRRLRSGAASKKDHPFDIFNDVQDHVLKTATAHIDRITLEAFVAGIDRATDPGVQALLGKVCDLYALTTIEADRGWFLEHGRLTPARSKAVTAVINDLLKELRPHLRTLVDAFAIPDGWLNAAILREEPARQESTAEEDARITAG

SEQ ID NO: 13676 - protein, 164 aa, Actinoplanes utahensis
MTEQPPHPGPTPAEPTSGYPAPGYPAAYPPGYPAAYPPAPPGYPAAYPPASPGYSAAYPPPYPASGYPAAYPPGYPPFPGGYPPPPPTGKIHPFAVTALVTGLIGLAPVAVIFGILAIRRINRTGERGRPQAAGGLIAAAIWLIVILYVVEFVLTFHDLRMTTV

SEQ ID NO: 13677 - protein, 219 aa, Actinoplanes utahensis
MGSAGVGPGWGGCSVTASPANLARLLEASRYRGAPENREFPSVGRSTIPGMLKLSFVEGDATAPAGSGPRIIAHVCNDIGAWGAGIVRTISRRWPGPERMFRAWHASPGAEPFRLGAVQLVPVEPELWVANMIVQHGIATRRGLRTGSGHERDAGPPVRYEAIRECLATLAVHARTHRASVHMPRIGCGLAGGVWSEIEPLIEETLGAADIPTVIYDLR

SEQ ID NO: 13678 - protein, 465 aa, Actinoplanes utahensis
MFDVIIAGCGPTGALLAAELRLHDVRVLLLEKETEPPAAVRIVGLHMRSLELLAMRGLLDRLREHGRQRPAAGFFAGIDKPVPTGLDSTHAYLLGIRQPILVEQLTEHARALGAEVRQGVAVTAFDQDDDGVTVDLCAGEPVRARFLVGCDGSHSTVRKLLGVPFPGEPSRSETLMGELEATASGEEIAARAADIRRADRRFLLTPAGPATYRVVIPARTLSTRAEPPTLEDFKRELRATAGTDFGLHSPRWLSRFGDATRLVDRYRIGRVLLAGDAAHIHPPIGGQGLNLGLQDAFNLGWKLAAEIGGWAPDGLLDTYHSERHPVAAEVLDNTRAQRELLAPTPGARALRRLLTTLMDINDVNRHLIEKIAATDIRYDFGDDLLGRRQPDLELTQGRLYDLMHRGRALLLDRSGTLSVTGWSDRVDHVTDPADAPSVLLRPDGHIAWLGAAQGDLNRQLTRWFG

SEQ ID NO: 13679 - protein, 307 aa, Actinoplanes utahensis
MTATALRALLHSGRVTHVPGVHDPATAALAVAAGHRAVHLSGAAVSATMLGRPDLGFVPATQLADRASILVPVLNGVPVLADADTGFDDPEHAVWTGLAYHRAGISGLHLPDRAGISGLPLPDRAGISGLRLPDRAGATGRHEVIAPGPAAAKVRALADRVPELVVIARTDAYAADGLGETIRRCVAYAEAGADAILPGGVHDLGELDRISRAVNGVPLVVDRSEAAGSPPASTDSDLAAAGVRLVLHPVAALLAAMRAASLAYRAIAETGTAEQVDRLPWAAFTALAGPDETADSDARSVPAGLQT

SEQ ID NO: 13680 - protein, 355 aa, Actinoplanes utahensis
MFDEAVVVGVTAFCESAAPVSGDEVKGKLLSGGVEPWLAERLTYFLPLAFGRRVIDGASVDETFLDGETRRRLDRDPVYQAAARRALIADEAEIARIAGYSSEVAAVSQAVQGGAELTKLRLGPIALEDALLPVGSGSGGVPSPASVFAHWMTAYGVPIGDDLRLGEAEFRATLAAHPRPAPELVVAQVNFAVNHPALARPWMVESCVGVAPTWKEAIFQTLAMFERAVAYPMIAALLDRGAAGDNVHVERFSHPAGEFDLLLGAQVDLFATDPVPSAEAVLDELLAALRDVPLSRAVHALRFFTAYQDGRMLTNEVFLDGEPWEAGSKVTAAAPAPLPTGPVGVRVFAFLVPVG

SEQ ID NO: 13681 - protein, 250 aa, Actinoplanes utahensis
MRQMTVVSLNLCVGLRNSLPPLRERAAAIGEQLEDSGAQAVLLQEVWTRRALRDIRARLPSYRNWVCKSGLAIGGREPLSEPRFRRFAGVPAGHRSQLVRAAAGRWFRGLLTARTADGALLGNTQLTSNRDGDWSTGNRHDALQRGQLRSLHAAMRAAGDAPLRILGGDFNVAADSPLYSAVTDGDTWTDPFAGDPRATFRIECLPAGSTAHRIDYLLVSGDGWHVAARELLFTGDLLSDHCAPLVRVTC

SEQ ID NO: 13682 - protein, 303 aa, Actinoplanes utahensis
MNDDLLADFVRVDRERRLGTYGIHVYREGHEPLTHRFRSDDRVNLYSVSKTFTSVAAGLAEADGRFRLDDLFLDHFPELRGIAADGFERVTVRHLITMTSGSTHKWFASERIDAADLLHEFLAAPLDAEPGERFSYTGSGPYAVGRLIARTTGADVRAYLLPRLFRPLDLHNPAWHTCPLGFPFAESDLFLKTGELARFARLLLQEGVWEGRQIIPAEYVRRMPAETVDTTAMAQRAAQFGHGYGLGVWLSGDGTYRMDGAYGQYALIDPERRVTVTATAHSEGEHEEDLFEALAELLKRVAG

SEQ ID NO: 13683 - protein, 634 aa, Actinoplanes utahensis
MSMFGGGFGGPGHAIPGRHGSGTPFAGIPPELAAGVARLEAAEPPLPAPDEPFHQQPDTRRLTLWSLLANRPGLLVTAALAVLAEALLLQAGPLLVQIGIDHGIVARDVPVLVVSALAFVAAVALTAVASGVRIRQSGRLAAYVTRDLRVRVFAHLQRLSLDFYTREKAGVTMTRMTSDVEALQQLLQEGFAQFLIQGLTMIVVTVVLVHYDAELALITLLLVVPPLAALSIWFRRAADLGYRRQRDAIAALFSHLSESLYGVRVITAHNRQQRSVVEHREVVGAYRDANDHTGRINAVYGPGSSVIGLLGLAALLAIGGRRVLRGELTIGELTAFVLYINAFFQPVQQLVQLYTNYQQARAALGKLRGLLGTVTGVPESIDARQLPPATGGIEFRGVSFGYVPDRPVLRDVTLRIAPGETIACVGPTGAGKSTLAKLVARLYDPDRGAILIDGHDLREVTLDSLHRQVGVVPQEPFLFAGSLRDNIAFARPDAADAEVDAAVDAVGLRDLVDRSPDGLHTVLHERGQSVSSGERQLIALARVFVAAPRIIVLDEATSSLDLRSELRVEAAVQRLLQGRTAILVAHRLSTARRADRVIVVDDGGILESGSHDELIAAGGRYASMFATWESHAAA

SEQ ID NO: 13684 - protein, 589 aa, Actinoplanes utahensis
MSPAPRRAPRAGIDPDPSKSWLRRAWPLLRSHRALLVTSLVLSFVGLVVQVQIPNLVRIGIDRALVAHTAGLSRYVALITALSLIQGVINYLARLYLLRTAYELEYDLRSTVFSHFMRMSYGFYDRVQSGELISRATADIRAVQMYLTFGPSILVQCMIAVIAFGLMISVNPLLAVVSMLTMPAIAVLGVRMRKAIFPVSWLIQARLAGVATVVDENIQGVRIVKAFAAEQQQVDTLASAADRVRWAYATDARLRSRWTPVMDNLPRLGLALVLLIGGLMVLNGHATVGTVVAFNSYILMLQPPFRMLGMIIMMGQRAAASARRIYDILDTEAEITERTEAAAPPPRGAVSFDDVRFAYPDGTPGLKGLTLHLEPGETVALVGATGSGKSTIARLAARFYDVTEGTVEIDGVDVRDYPLATLRDRVGIVPDEPFLFSISLHDNIAFGHPHATREQVIAAATAAGAAEFIQELPQGYDTVVGERGYTLSGGQRQRVAIARALLVNPPILILDDATSAVDVRVEHEIHESLRALMAGRTTIMVAHRLATIGLADRVILIDDGRVLADGTHAELLASEPRYSAVLAQKEPVA

SEQ ID NO: 13685 - protein, 434 aa, Actinoplanes utahensis
MLLTDVVLSLANDLGRTEVWPRQPGCSRPSLGPQPARSDRDGMLRRLATLAAGVLLGLGLPVPARAATVACGPAADSPRCTVWMGRVAWVPDGDTLIVTVNGTKTARSIRLIGVQAMEQHTYSPRPANRTGECHALEATARVEHLVRAGGGVVRLTAQDARSTSRGRPLRSIAVRINGRWVDIGQDLIKRGYALWLPFAGEWAWDAAYARAQATASTRSTGMWNDHYCGTGPAASMTVWANTQGHEGEFVRIGNTGRRAVDLTGWWVRDSGLRRYTFRRGTVVPAGGHVYVHVGKGRDTVTDRYWGLNGQIFTNPDPARHALGDGAYLFDPQGDLRESFLYPCPLRCASPLTGKVTLRPENGAIALVNTGSAAVNLQGHMLVAERWQHRFDEKTLLQPGEALSFARRPTMRLQTADMWTVASYSDAGPGSPLRQ

SEQ ID NO: 13686 - protein, 217 aa, Actinoplanes utahensis
MPVTAATVLATRQPALAPVFGTLTLFTGRMGSGKSTLALQNAFNRRQAGRPGVLLTSQDRAGEGIMSSRLGVTADAVEVHPGMDLTALVAEQVPSGGFVIADEAQFLSPEQVEQLAWAADEMGVDIDCYAIITDFLSRLFPGAQRLVELADVIVPLQVEVTCWCGRPGRQNARLVDGQVARAGEQVAVGDTSETSAVSYRVLCRRHWRNGEPGPASL

SEQ ID NO: 13687 - protein, 463 aa, Actinoplanes utahensis
MTQAGRRHRVVVVGAGFGGLFAIKALRRAPVDITLINGTAYHLFQPLLYQVATGILSEGEIAPPIREVLKRQDNVDVRLGWVTAVDTENKVVSVNGPGVDYTVEYDTLIVAAGASQSYFGNDEFADHAPGMKSIDDALELRARIFGAFEVADLHTDPEEIQRWLTFVVVGAGPTGTELAGQIAELAHRTLPGQYKHIDPRQARIILVDAIGAVLNTFGDHLSAGAQRQLAKLGVEVKLNTKVVGVDSTGIDVEDPQGRHRIPSITKVWAAGVAAPPLARQLAESTGAKTDRAGRMFVAPDTSVPGHPEIFVLGDMMNLAGADGKPLPGVAQVAIQSGRHAADQIKRRLAGKETGQPFKYFDKGSLATISRFSAVASIGKVRLSGFPAWVVWVAVHLFYLVGFKNRVTAVLHWAVSFIGRGRSERVATQQQAFARRAIRAYGDPFERERAETVTAHKKSLTADR

SEQ ID NO: 13688 - protein, 32 aa, Actinoplanes utahensis
MEETVAESPRVLGISWGRMEVEGLAEGKDFKL

SEQ ID NO: 13689 - protein, 168 aa, Actinoplanes utahensis
MVEKQAARRRIPGRARVRRGTPPDGDDAPGWRAFASAGSGLHHKICHVLGGTFGLPHAQTHAVLLPHVLALNTAYAGDRVSAIAAALGAPRTGSTANAALAGLATAVGAPRSLNGIGLREADIPEAVDLIMPVVPPSNPAPVTPAILDALLRAAWRGGPPESPSDRTM

SEQ ID NO: 13690 - protein, 354 aa, Actinoplanes utahensis
MTTSVERPAAAEAAPVSSAFTARERWVLLVASAWLVIGLQLDAYAHATTPQLETFWTPWHGVLYSGIAASGFTLLWIMKARLPSIPTYQSLLALPNALRLPLAGMASLLVGGGVDTLWHNIFGIEKNLEIFVSPSHELIILGMVLVAMGPALMTATEPGRRLGTGGAFLVAISALFAVLPLHIYSLHASALGFHHLGTGVRVPNVFSVDGQLVHGYLFSTVLLLVPILMIGRRWPLPIGLPAALVAIPALLMHLMFDSEAPWWPQLTVAIAAPVVELALRVANRLVTLPVTGRWVALGLIAPPAVWGAVLLVGKIQTGTVGWNVHMVTGLLTLVALTGAGTVLVTRSIQFLQRS

SEQ ID NO: 13691 - protein, 293 aa, Actinoplanes utahensis
MTPMRPLRWLTVVLTAATAVLLTTAGPAAAHAGGLVATDARSRVVTVTPAVPGLTVTAIEDGARLRLTNRTPGPVTVTGRPGVVAPGDTLTWADPSFTPEGKKIASGRTQDWTLTLDAGGTAVTVSGILIGERPPDPWPWWALAIVAAVAIPVIARRLHRGDLLLCAAGTVAMAASIGHVAGSTLAVESAPPLGTFLSAAGINLLAWPLILGGAVTTLRGRPAGLLAVCAGAALTAVFVFPDVTAFHRAVLPFAGPAVAERALVVLALGLGAGVAVAGASVLRTLAQRAEAVA

SEQ ID NO: 13692 - protein, 107 aa, Actinoplanes utahensis
MRVVTAGLLLVAAALLTVPAMLAMQVLASAGSLVSVGALSAAFVLVVASGSIALFVQLALLALTRPVAGSPAGPVGGAPAVGSPPIASASVAPRSVASAPADAGSSS

SEQ ID NO: 13693 - protein, 465 aa, Actinoplanes utahensis
MHRVRGLAGRALRRRGPPGHAAAPARSAVNPPASGPAPLAHGVGSSSDLPLPLDLVLQAGAATVVLSFLIAAVLWTRPRLGGGTVRAVRTAGWLPVLRLVVLLLAVYLVGDALAGPGEDENPAARALFVWLWVGIIPVSVIFGPVWRAVNPLRTLFRLLRLPRAGLRPRPASGAWPAAGWLLAFVWFELVAPHRTEPAVIGGCLLGYGIVQLGMAAVRGEEWFGRGDCFEVYSELAGRLSPVRWRRPLTGLAAPLPVTRGLAAFVAVWWGSTIFDSASGSPVWAGFVQRAGHGAVLATGALLLVCSGVLLAVRRIAGKWDVTASLIPIAVGYTLAHYLSLLIVEGPRGFLQLIHQWGMGGGPAGNVAPIPGVIAGAQVALILAGHVLGVIVAHDAAQVAGSVAPVAVGSGAPAGAPGGGSVVSGGPVAAGAVAGRAALGTLADEFPLVLFMIGCTWAGLFLLFVR

SEQ ID NO: 13694 - protein, 212 aa, Actinoplanes utahensis
MSVDVGDDDGSQVPPALKQLTPKQQRILTVIRDSVRDRGFPPTVREIGAAVGLVSPSSVAHHLKVLERHGLLRRQPNGSRAVDVRTADPAVTIPVLGDIAAGVPILAEQHVLDHLTVSAGMVGHGTLFALNVKGDSMIDAAICDGDVVIVRQQPVAENGEIVAAMLDGEATVKTFQRRNGHIELIPQNPNYAVIPGDDATILGKVVSVIRRL

SEQ ID NO: 13695 - protein, 147 aa, Actinoplanes utahensis
MRGTEQGAKCGHALFRFATEPEPDHAAATRPGETPGSDSRPVGGSGREVGPVVVEAVERQIRSDPGRERGGDSVQRVHSRQGTSSPPSRRAGPPGEAARIAVATLTGTPTAVERIRLVAFDAETRDHLAAALRGAAEDGGSRAAGSR

SEQ ID NO: 13696 - protein, 410 aa, Actinoplanes utahensis
MVRFRFRRETKERMSALRTLLRAPHVRRLLTASQVGRLPMASAPLALLLFARESHSLALAGLVVGAYTAGMAVSAPILARIVDRWRQPPVLWGSALLSGAGFLLVAAGGHATGATMAGALLGGLGTPPLEACLRALWPDLVEADVVAAAYTLDIAVQEVIYVTGPLVTLLAVAVAGPPAGLVAAALLQLAGVALFASTPVVRTWRGVAAVRHWAGPLRVGRFVLILLGVVGAGAAIGSLPVAVTGYAEAAGNRSLSGWLLAAEAAGALTGGLLYMRARPGGRSRLPLVTAGLAAGFLPLLLMPGPAAMAVLLAVAGLSLPPVLTAVFLTADRLTPAGTAVEAFAWVITAFTVGSAAGAAITGPLVGDSVRYGFTFAPIAGLLAVAAMSAVAYGPGGRRSADHPSPSGRGG

SEQ ID NO: 13697 - protein, 92 aa, Actinoplanes utahensis
MLVGILVLALHVGLGLLAAHRLWTGSDDPHQWMYFYGTGGCCIAPVTGAVGAFLTNNPRFKAIGIGMMTGVALALIAATVGWAINFIPSWAS

SEQ ID NO: 13698 - protein, 385 aa, Actinoplanes utahensis
MGGGGMLTDEHTVLLSPPDVGDLELEYVTAALRSGWIAPAGPDLDRFEAEIADRVGVPHAVALTSGTAALHLALLGLGAGPGDVVVVPTLTFVATANAVAYTGATPVFADCDPDTGNLDPDLLDALLTELRAEGARVRAVMTVDLFGSCADYDRIGPLCDRLGIPVVEDAAEALGATRAGRAAGSFGRVAALSFNGNKVLTTSGGGMLLTADGGLAERARHLAGQARLPVTHYEHAEIGYSYRLSNILAALGRAQLRRLDEMVERRRALHDAYAKIFSDVDGVTLPADADPGSNRWLTSIVVDPERAGWQAAELAAHLAARRVETRPVFKPMHLQPLFAGARAALTGAAERLFRNGLLLPSGSALRDDQVRRVLDEIADYMGDRR

SEQ ID NO: 13699 - protein, 209 aa, Actinoplanes utahensis
MKPRPPGRGTDTVQRAIDVVAAGAGLVLLSPVITVVAGAVAAGLGRPVLFRQQRPGLHGRPFTLVKFRTMRDLDERRGLVTDADRLTGLGRALRATSLDELPTLWNVLRGEMSLVGPRPLLMQYLDRYTPEQARRHEVRPGITGLAQVSGRNAVSWEERFAIDVWYVDHRSLGLNLRILARTVRLLLRRTGITAPGEATMPLFLGSDRA

SEQ ID NO: 13700 - protein, 211 aa, Actinoplanes utahensis
MPEPLVIVGCGGHGREIFGVVAAVNDAGGGPWKVLGFLDDAPSEANLRALDRLGSGWLGPAALLAGVDAHFVIGIGDPRVRDGVAAALEPSGRPAARLVHPAATVGPDTGLAEGVVLFAGARVTTNVTLGRHVHLNQNATVGHDSVLDACVQVNPLAAVSGDCRLGRAVLIGTGAVVLQGRSVGDRATVGAGACVVRDVESGRIVKGVPAG

SEQ ID NO: 13701 - protein, 450 aa, Actinoplanes utahensis
MTGRPSGPAPVWSGTSNRAGSSRVYRQDEGVRITYVHQYFKTPGMAGGTRSYEFARRLVEHGHQVHMVTADASGGPARVTTEAGIVVHWLPVPYDNAMSYRRRILAFLSFVGRATLVAARLDHELVFATSTPLTVAIPGVVAAMRRRVPMVFEVRDLWPRAPIAVGALRSPAARWAAGRLEAWAYRRSAHVIALSDDMADSIQRRFPRVPVTVVPNGSDRALFSGPAARRAGAALRRSLPWLGDRPMVLYAGALGVVNGVDYLVRAAARLAVLDPEVRVVILGDGRMRESIRRLAAELGVLERTLFLLPPVAKTEVVAWFAACDLATGLTLNRPELGSDSSNKLLDALAAGRPVAVNHGGWITGLLTRTGAGLALPPDDPEGAATVLAGFLRDPAAGAAARRAASALARDRFDRNVLFRDFERVLIEARYGLGAGRTAASTSRIHISRAS

SEQ ID NO: 13702 - protein, 451 aa, Actinoplanes utahensis
MGLREYLRVARRNWWLLLTSVVLALGVALIVNLNTTPVYAARVTFFFSTPIAGASDLYPASMFNASRLSTYAKLLTSDEVATPLAGSPGIDLSLKDVRDAISAKTVADTVMMEVSVEDRDRNRAMLLLTRLTRRFDTAVEDLERPKAGEPSTVKVTVVSGPALDDGPVSPDWANNFALAAVAGMVTGAIGAVGREAADHTVRTADALQVLASAPVLARVPLDRGHPFVSPSASARTEALREVRTQVQCAAAAGSVKTLAVTSAVPGEGRSATACGLALLFAEAGQRVLVVDAELRHPRLAALLGREDSAGLSTVLDGTAALEQVLQPWGAGLWLLASGRTPPNPSELLSSPRMTELVDAVRKKFDVVIFDCPPLLPVTDAAVVAARADGTLLVVRARRTTSAQVTAAVRALHAVNATLLGCVLNMVARKGPDAVPRYDSYLGGPGPRAAAA

SEQ ID NO: 13703 - protein, 601 aa, Actinoplanes utahensis
MMGARFWAYRRVFPLLVDATAWAVGLLAAVLARHDFLPTRRHLAGGLAAVGLAVLLQAVIGHTRHLYRGRYRFAEFDEIRSVVFTTAAVTVVLTVIVVFVWHPVSPGLPALGGAAALTLMLGIRDLRRLRWSRQRRPDAQTAAPVLLFGAGTAGAMLVASMLHDRHGRYLPTGLIDDDRDKRRLRILGVPVLGTRDDIPRALADTGAGLLIFAVANADAALVRDIRDRTLAAGAAFQVVPSVSEMMDQPVEVGDIREVQVADLLGRHQIDTDLSGIGGYLTGKRVLVTGAGGSIGSELCRQIHRFRPAELMMLDRDETSLLAVQLSIDPVALLDDPSVILADLRDADRVREVFRTRRPQVVFHAAALKHLALLQRYPAEAIKTNVLGTLNVLDAATSVERFVNISTDKAADPTSVLGYSKRITERLTAWTARRRTGTFLSVRFGNVLGSRGSVFTKFNAQIAGGGPLTVTHPEVTRYFMTIQEAVHLVIQAAAIGQDGEALVLEMGEPVRIAEVAAQMAQFAPAPVAIEYIGLRPGEKISETLFGAGEVDSRPDHPLISHVQVPPLDPVRLAALAEPSDSGVLIARLAEICAAPAPATVVR

SEQ ID NO: 13704 - protein, 435 aa, Actinoplanes utahensis
MDSSSQSGPRPARAGVHAALRAWRESLIDLGDHNRLINFAAGNADLLEITSPDPHQVVTTLSRGTGAVLTGSGGAAPGDGTFRTELTERSLGPLLRRLQRRARQEYLDRGVFVLHLALGMLHWRLAADDEDPDSETTSYTSPLLLLPADLVTGDLAEQPELRLRDEEPVVNPALALRLRRAGIAVPDLEPAAELNVSRFWDEFTGTVARRHGWHIERTVILTCLTFHKDAIYRDLRDNEERILAHPVVRALATTDPRRQTEAFKFTPIRPEEVDRLAPPEGMPLVLDADSSQRACVAAALAGHSFVMDGPPGTGKSQTVANMIGALLHAGKRVLFVSEKVAALDVVRNRLAAAGLDRYILELHGQQAGRREVATLLAAAVDETPEPPADAPVLDRAALRERREALTAYAAAMNETRRPLGASLYEIIGRCAGLAS

SEQ ID NO: 13705 - protein, 1005 aa, Actinoplanes utahensis
MPWTALPSAADLPMPPSLEAFPGPVGLDTLTAADADELARDFARAADQVDRHRRAVNRVTAKLGLPQAGTIRDIARVAAVAELGARPHKPERFWFTPGALAGVQTGAGALRRALEVLVATEIQARPYFSEAILAQPVEELAERFATVHRGFGRLRAAYRRDRRQVAGFVLPTAHLGDAVDRIGTAVAWKRARQELAAAEHAYATALGRYWQGRGTDFVALDEAIAVAAAALAAAPPAGIGSVLTYICAPAPDPEPIQVVTEARDALLRWQATLRPAPYPAARPELVSGPIDDAIAWLTGHVTALHAVAETVRAYDAATGHTLDYAETVRLGSLRDAAARAAAALGGPADGLAEVDPGALAATVAWAAQARDFAGGPLSEAQLVALRDLRPIVGLAERAAEWEQASRAVLAGFGPSRQADLRDRFADYQRAAAFLRDIRNDSSGQEEWFACLDARDVLTFHGLDAAVEFCADRRLDGTDVPAVLDRALLHGWADAVVRADHRLRPWRSDDRDRLVAEFRQADERLAVVAAREIVAAVEDRRPPPESAAAGLLRREAMKADRQLPVRDLLGRAREAVLALRPCVLASPLTVSQSLPPDIGFDAVIFDEASQITPADAINCIYRGTSLITAGDDRQLPPTSFFDRAATEVPDTEVLDYQSVLELAKACGAFPGMGLTWHYRSRHQALVAFANDAFYQGRLSTFPAPGSGGPDTGVALFPVAGVYRRSTGRDNPVEAERVAERIVHHFATRPELSVGVVTFSVAQAEAIERALEKLAAGQPALERMVTDDRLHGFFIKSLESVQGDERDVMIFSIGYGYDEAGRISANFGALNRPNGWRRLNVAITRARHRVEIVTSILSRDVPESENEGVRQLAAYLDYVERGAGDTSLDHNDPTGDFVESILETVRGWGYPARAALGTAGGRVDIAIRHPDDPSGHYLLGVRCDGPGYRDCPAARDRDRLTDQVLLSLGWRLHRAWALSWYRDRDGEQARLRAALDAARAAWAGRTS

SEQ ID NO: 13706 - protein, 917 aa, Actinoplanes utahensis
MPSTSARERLRAVLGWVRRRPRWLRRTVAALVAVNVVLVLAAAGYVWSVDLPADPAPPQASVLYYRDGQTVLARIGLADRTDVPLDRVPVGVRQAFLAAEDRGFYDHHGVSVRGLLRALWSNVAKDSGQGASTITQQFARNAYLTQERTVSRKAKEAALALKLEHRFTKDQILERYLNTIYFGRGAYGVEAAAQAFFGSSVDRLTAYQGAVLAAMVKDPTRGDPAVDPHWTLNRWKWIVRAMSDAGWLPPGAADRTPYPAVAPESVTASAVGGPVGLIADRVEDELVAAGVSRQQIRTGGLRVITTIDPQAQRAATASIGAALAGQPAELRTALVAIDPHDGGVRAYYGGDRGRGYYDDALAARPPASTFKPLVLAAAEERDISYRSYYNGTSPRLFSDRGGAPLYNLDNLQCPVCPLDTAMVYSLNTPFYALAEQIGPGRVRDLALRLGVPASYGDQTTLVDLNGELTPGRTRADIAIGRYPVAPADLAGVYATLAGGGIRADRHFVTRVVTAQGTVLHRADTTGRRVLGAEVAADVGAVLTRVVQHDGAVPGVAAAAKTGSQQYGNTSDSSDAWTAGWASGLAAVVWVGRDKPGPIRTRKGAAINGDGMPYTIFKTFLAGALRGGQRMSLPPAAEVGHVEKADLQTIETKVSMIPGRVFAGPRRGDQVDRSLAVGDWSERTARLTAALDRYAATAPDFAVSLVDRRTGRHFDYHGDRAYETASVVKVELLAALLLSAQDAHRQLRAAERRRAEKMIKASDNDTAKQVYDAIGGPTGLSAALTRLGLNSTTPNPSFGLSRTTALDQTRMITALSDSGGPLDSTSKQQILTLMANVNADQNWGISAASFDGEQVALKNGWLSRTTESHRWIINSTGRITGAKTDVALSILSHGHSNQPDGISVVEHIAALTRSYLGW

SEQ ID NO: 13707 - protein, 59 aa, Actinoplanes utahensis
MAASGFDRRSAAQLPIAAERTIWASGVPRLARPLFRLDAVIDAADLAPVLESVRTHIVA

SEQ ID NO: 13708 - protein, 229 aa, Actinoplanes utahensis
MDEILRRSDASAAVGELGWRFVLGTLQAAVAVDSISEGAQVLARAVAACGADADAHLRADLCPSRVVLSLQSAERAAVTTRDADLAGRITRAVGEGGWRTGPDLGADGPRSVQLIEIGIDALDIAAIRPFWRAVLGYTDEPGHGDPEDPVVDPLRIGPAIWFQQMDQPRPQRNRIHFDVSVPHDEAPGRIEAALAAGGRLVSSEHAPAFWVLADAEGNEACVTTWQGRD

SEQ ID NO: 13709 - protein, 55 aa, Actinoplanes utahensis
MRSRRSSLVFGCLCAALAASAMAVHLPYYAIFATAAFVAVLTVWVVVLSRSGRRR

SEQ ID NO: 13710 - protein, 176 aa, Actinoplanes utahensis
MLALLADGQSAASVSIEQVAAKAGVGKATIYRRWPNKEALLIDAVRSMKGPLPTLVGVSARDDLVALVTANRSTRAREFGMVTACLLPELQRDPELNRMHHAVMEPRREFMRDILRRGIATGELRPDLNIDLTVLMLSGPSMMQSMFGSATGLPEENFPAALVDALLRGAATHPGP

SEQ ID NO: 13711 - protein, 525 aa, Actinoplanes utahensis
MNDVAQPQAGHPRRWAILGVLVISLLVVVLDNTVLNVALRIIADPQRGLGATQSELEWAINSYTLVFAGLLFTAGILADRLGRRITLTIGLVLFGIASLISAYADSPDQLIAARAVMGLGAAAVMPSTLSIIANVFEPRERGRAIGVWAGAVGLAVALGPILGGFLLEHFWWGSVFLINVPIVVIGVVLVTVLVPESRDPRPNRVDVLGVLLSIVGLTLLTYGVIKGGEDGFGDTLSWAPLASGVLVLAGFVLYQSRIEFPSLDVRLFRNRQFSASTGMIGLVFFAAMGAMFFGAFYLQLVRGYGPLESGALFVPFAVGQMVFAPISSTMVKRFGPKLVSTVGLLLVALGLAIWLPITATTPIALVALAFFVQGVGMANVMPPATESIMSALPREKAGVGSAVSNTIRQLGGALGVAVLGAVLSSVYRDNLGSATDGLPGPAADAARESITGAYAVAAQAGPAGPALIHTANESFVTAMHWATAGGLIFALLGALVAALFLPGKRPAGPHSPVLAEEQGVALVEA

SEQ ID NO: 13712 - protein, 773 aa, Actinoplanes utahensis
MHSRGIRHLWWIYLLTTGALTAVYLLTPFNADTRWIYVVVNSTAPLATWLGLRGNLPQRRAGWRVIGLGLAFSAAGDVLFAVHTAVSGEPAFPSIADWLYLLGHLTIAAGTAMLAARAGRTAFIDAAVLLSPLASLAWILVVEPTVTVGGSLTARFFAASAPVNTLIVVYCALALALGVELRTPGVRWLLTGLVAWFVSDALYTHQSLAGTYREGGLIDLGWMAMPILLGTAALHPSMVNTTPRRAAMTTLTLNRALILFGAALLLPCLHLFWEPGSDAPLVLGAALSMALVAVRLAGPIHELAWRAGHDPLTGLVNRSLLMDRLALALDTLPADPAARVGLLFCDLDHFKDVNDSLGHDAGDQLLIEISTRLRAAVRETDVVCRLGGDEFVILMPDTTEEQADVIAGGVADNLGRPMRLADGTEFFASLSIGLRTTADTDADPDTLMQDADTAMYQAKAAGRGRMVRFDADVRSEAAQRLRLDADLRRALTHPGELYCVYQPVFRVDDGRLHSVEALVRWAHPADGTLPPVVFIPIAEAAGTVGQVFTVVLEQALTEQRGWYNRTGGWIPIAVNLSPRQLDAAIAGQVLAALERTGTPPGQLTLELTETGMAEPETVEAALGPLRRAGVKIAVDDFGTGYSSMARVADHGWDVVKIDRTFVAGIHRDQARASLADAMVRMAHALGMVTVAEGVDNAADLQVLARLGCEYAQGYLLARPVDADGILEMASASPRVSVELGSGGGELSPSGSGGVRPGDLVGVELDVEGRQQVG

SEQ ID NO: 13713 - protein, 151 aa, Actinoplanes utahensis
MTTIVNGLDELKALVGRDLGASEWLEITQERVNTFADATGDHQWIHVDVERAKGGPFGGPIAHGYLTLSLVIPLFGSLLKVEGITMGVNYGLERVRFPHPVRVGSKIRLAATVVSVEDVPGGTQSTFDFTVQIDGVDKPACVARAVYRQYA

SEQ ID NO: 13714 - protein, 284 aa, Actinoplanes utahensis
MRPGRAAARLHSARNPGRFRPARRAVAEEQTEMALGEAAKLLARAGHVVVFTGAGISAESGVPTFRDALTGLWSRFDAQALATPQAFAEDPDLVWGWYEWRRRLVQRVRPNHGHLAVSRMAAHLPRLTVITQNVDDLHERAGSPAPLHLHGSLFTPRCASCSRPAPLPPPIPDDADAEGRRIPPPRCRHCTGPIRPGVVWFGEPLPEYALESAVRAASACDVLLTIGTSGLVYPAAEIPRLAARAGAAVLQINPQPTPLDPIATVNLPGPAAEILPTLVDTTWP

SEQ ID NO: 13715 - protein, 484 aa, Actinoplanes utahensis
MGRRPAGLDRLAAAGCGRSDRRSGFDAFAAVAHGDRKCPTATVGEAEAAEEAEEDHAGHRSDRPHRSDRGGSARRRRTDRELRRLGVPVTPARAAADWRRRLDALGARTMTVVGDWIAPSPRPGPSDGHVKALVTVVALVGGVVPILVMALTWAMRPKVEDHHRLCTTPAGERLGYVVADRPADDRYRPAAQCNSTGAENAVRRTGIGRYEVTLAGLGTGGGAAEVTPVTTDDRICTLLDWSADSADERLRVGCFDRAGRAADSGFTAGFWTARGRAPAAYLRLGDPGRTSQTAQDEYSFNSADGLNSADRGDVGSYVVSFGGLDGVAGGAVKVTAVGDAATVCAVEGWSGDQENRYLAVRVHCRDAAGQPIDSRFAVTFAVGRPTTGGYVRADRPGQAGYAATGDYQFNSSGGANGVRRSGPGDYRVSLGGVVSSGGSAQVTAYGSTVDCVTTPAGGNPDVRVVCRDPSGTPIDTAFVLIYTA

SEQ ID NO: 13716 - protein, 277 aa, Actinoplanes utahensis
MIHDRRGSGAPLLLIHGLGSHWQVWLPLLPLLSPHRDVISVDLPGFGASPPWPPAAVPGPVPRPAPASPDGPGSVRHLADQVEAFLDSLGLDTVEVGGSSMGGGIALELGRRGRARTVTAFSPIGFWPTGGGRWCRFIVTAARAGATALDPLLPRLMATPAGRAALCSIFYAHPGRLDRDESLAAARALAAAPGFAAARSAFRRLTPWAATDPGALPTIPVTIAWGTRDAVLPYRNQALRARTALPAARHVPLPGCGHLPFPDAPAHCADLLLHPAT

SEQ ID NO: 13717 - protein, 558 aa, Actinoplanes utahensis
MSFDYDVLIIGSGFGGSVSALRLTEKGYRVGVLEAGRRFADEQFAKTSWRLRDYVYAPALGCYGILRLTLLKNVLIMSGAGVGGGSLGYANTLYEPPDAFFADPQWAAITDWKRELGPYYDQARRMLGVITNPVETDADRALRAVAEDLGVGHTYRRTPVGVFFGRDGSEPGAEAPDPFFGGAGPARRGCTLCGSCMTGCRGNAKNTLVKNYLYLAERAGARVHELTTVRNVRPLPGGGYAVATRRTGGLRRSTLTARQVIFAAGALGTQRLLHRLRDRGSLPAVSPRLGELSRTNSESILGARTRRRDRDYSHGVAITSSIHPDPVTHVEPVRYGPGSNLLALLSTVLVDDTGRGPRWWAGLRQLATAGRDLRLYLSPRDWSRQTVVLLAMQPLDNSITVFRRRGRLTSRPGVGEPNPAWVPAAHEVARRTAEKVDGVPLGSYTAWVGKPVTGHFIGGCAIGADPESGVVDPYHRLFGHPGLHVIDGSVVAANLGVNPSLTITALAERAVALWPNNGEEDTRPPIGHGYLGIGPTAPVRPAVPPSAPGALRFPGVAR

SEQ ID NO: 13718 - protein, 585 aa, Actinoplanes utahensis
MGGQAGDRSFHRRLRDRRRPGVRRGRSVSSAVRASRPARDRRIGGGRQSGCQPVADDHRAGRTRGRAVAQQRRRGHPPADRSRLSRHRSDGAGTPRRATVRTRCPPLPGGGPMTRILVIGAGFGGVAAANALLKAGFTDITLIEKADRPGGVWRDNRYPGCACDIPAPLYSYSYAPNAAWTRRFPPQPEILDYLERCVSAFGLTGRVRFGTEVSAADWTGSAWQVTLADGEILEADVLIPAVGQLSRPVIPRLPGTFGGPAMHTARWDASVPIEGRRVAVIGTGASVIQLVPAIAGRAAHVTVFQRSAPWTLPKPDRRYGRTRRRLYEMAPVLMAPSRAGTWLMTVVTGLAVTGNRAAGALLHGLSRAQRRWQVRDPELRRKVTPDEPMGCKRVLFTNAWYPALARPDVDLVTEKIVEVTENGIRTADGADHPCDVIVYGTGFAATDFLVPIRVTGRAGTSLDEAWRDGAHAYLGMAVPGFPNMFLVYGPNTNTGNTSVVFFHEAQARWIAQAVRRIARSRQPLEVRPEVAAAYDEEMQGRLAGSVWAACQSWYRTASGRIVTNWPGMAAEYRRRTARLNPADFR

SEQ ID NO: 13719 - protein, 343 aa, Actinoplanes utahensis
MASDLTGFIAGLPKVELHVHHVGSATPRTVARLAERHAGSTSVPADPALLAEYFTFTDFAHFIEVYLSVVDLIRDAEDVATLTYDIGAGLAGQSVRYAELTLTPYSSVVRGIPAEAYCEAVEDARRRVARDHGVELRWCFDIPGEPTMTGADVTLDVALRQRPDGLVSFGLGGPEAGISRESYAGHFAAARAAGLRSVPHAGESTGPQTVWDALHHLGAERIGHGIAAARDPELMAYLREHDIALEVCPTSNVCTRSVPSLAEHPLPALVAAGVPVTVNSDDPPMFSTTLNHEYQVAADLLGLDEHGVADLARQAVRYSFLDATGRSALLTEIDTYVTATTAR

SEQ ID NO: 13720 - protein, 120 aa, Actinoplanes utahensis
MHPLRRITTELGAGFRFLSGSPPLRRVTLASVLAAFAVGGGGDATGYAVISQGLHRAPQFTGPQTAGLALGAVLIAVLDYRLVLVGAGLCLLVAAAALRRTKVPEEPSETAAAAEITTSR

SEQ ID NO: 13721 - protein, 566 aa, Actinoplanes utahensis
MTATPRLPRKLGEIGIPTAPMPAATPISEVEAMLHAEQLTPGVIVATDTGYRLVSRIALNRTTTGRLGFGRALTVRGTLADLAGADSLALPADTDIDVAAEAALARKGGDREEPVLVVWPDGRCGIAPMMELLSAMAGRYAKLSRTDQLTGLPNRSLIAAEGQRRLDAGTLVAVLHLGLDRFQDANDVLGHHGADILLHRVAVALSAAHGPGDLAARLDGDQFLVLLGDLPAGHTPQSMGRHIAAGLRGPHTVDGLPIGVEVSIGVSPADHHDIQVVQRRAAAAMRRAKQDRTGVVSWTPGLDSTQRVDLRQLTELRTGLKSGHLRLHYQPLHDAVTREINGVEALVRWQHPQRGLLPPGVFLPDAERSDVILELTDWVLAEALHQAALWKRAGHHVPVSVNLPAAYLAQARAVPTILAMLDLEQLPAELLTVEITETAVLARPDEVAAQLADLRLRGVRVAIDDFGTGYTSLGLLPRLPIDELKIDRSFVVQMHDSPAHATIIDSVIAIAKALGMKVVAEGVEDEPTAADLARAGVDLLQGYHLNRPTPPDAVPLLPARPLLTVL

SEQ ID NO: 13722 - protein, 448 aa, Actinoplanes utahensis
MLTPQITEQPVADGRNRAVGACSLAYLHIDRAGRIQDWNEAAERLFGWPRDEVIGRPLADTIIPPALRSAHNAGFARRLALGDGPDLGHRFEAPAVHRDGSELTVSMTLDSLGPDGFCAFISDQTEWHQARQELQRSNQLINAILQHTTAVISAKDLDGRYLFVNGEYERVFQVSAADMVGREEADVLPAAIAAGSRAHDVEVAGSGAARTVLEQLPFGDDIREYVVTRVPLADPDGSVYGVCTIAIDDTARRRTEAALAAGEERFRSTVNNAPGMLYQFRIEPDGTGAFTFVSAACRDLYGLAPEQIVGGTEADLITYIAEEHRESYRASVRESAATLEPWEWRGAIVRHDGQRRWLYGVARPHREPGGATVWDGMLLDQTREHATEVRLAGTRHELEDLTHRLAPLSFTAAADAGAPVADLVALIDPADHDELARCWAAARDGRPA

SEQ ID NO: 13723 - protein, 460 aa, Actinoplanes utahensis
MNRRTLLLGGAAGALTTVLPAGAEGAPHADPVLNDAEIYGVPTAQPLISQRADPFISRRYDGKYYFTGSVPAYDRVVLRGSPTLAGLTTATETTIWTQPNNGFIWAPELHRIDDKWYVYFTKSTADDIWHIRPWVLESSLADPLDPSGWVLKGEIALEWDSFALDATTFAHRGRQYLVWAQSEPEIAVNTSIYIAELANPWTLRTKPVRLTTPTKTWEIQGFKVNEGPAVLVRNGRVFLTFSASATDANYCMGLLTADAHANLLDRASWVKSPDPIFTSDDDTQRWGPGHNSFTVAEDGRTDVLVYHARDYPQINGDPLYDPNRHTRVQKLYWHPDGTPLFGVPVGDGGPIVRLSAGRDFLHHGTTSLEMAPAPEDLGATQFRFVAAADGTETIRSVDKPSLSVRIDGTSVRLDPAGTPVRRIPARGGVTIRTAADPALFLRVDKGAIGTAKTGTVFRLS

SEQ ID NO: 13724 - protein, 819 aa, Actinoplanes utahensis
MPRIRSRLVGVAAVLVSLPLAVAPPVSASPVQPDYTIKVSPQADGAALSRQQYGVFFEDINYAADGGLYAELVRNRSFEFTSADAAGFTGLTGWTATGSATVVDDDQRLNERNRNYLALDGSVTNAGYNSGIAVQKNDLYDFSVWARGTALLTIELGGVTGTIAVSGDTWKKYTATLKAGATTDRGRLTVSSSAPVKVDEVSLFPRDTFKGRRNGLRDDLAEKIAALHPGFVRFPGGCLVNTGSMYSYDAANNYPRARAYQWKDTVGPVETRATNKNFWGYNQSYGLGYYEYFQFAEDLGAMPLPVLPALVTGCGQNRATVDDALLQRHVQDALDLIEFANGPKDSTWGRVRAQMGHPKPFGLTTIAIGNEENLPEQYFANFLRFQAAIKAKYPSITLVGNSGPDDQGGTFENLWAKNRANHTDMVDEHYYNSPSWFLQNNGRYDSYDRNGPKVFLGEYASLDARFANSLAEAAYMTGLERNADVVKMASYAPLLANIDNVQWKPDMIWFDNDESWGSTSYQMQKLFMNNVGDRVVPSTVTGGGVVRPKPITGAIGLSTWRTAATYDDVKVTRPDGTTIFSDDFGDGDADGWTAVQPRGTWTVTDGGYAQTTTDTEDTMVKAATITDTDYDYTLKATKQTGSEGFLVAFGIQQTGNFYWWNLGGWNNTQGAVEKGVTSAKEQLLTRPNTIKTGQTYDLRVSVRGTRVTLYLDGAEWGSFDDNAVTEPFAQVVTTDAKTGELIVKVVNAQDKPALTRIDLGNRKVAGTARMTVLAGDPGEQNTRTAEPIQPVTSTIHGVASSFTREFPADSVTFLRIRTR

SEQ ID NO: 13725 - protein, 253 aa, Actinoplanes utahensis
MELNVSVADGVALLEMRRPPANHFDEELIGRIVEAAFALDEDPACRVIVLASEGKHFCAGADFGGGDFGRDHVDAAARLYRRAMQLFDVRTPMVAAVQGTAVGGGLGLACAADFRVAEPGTRFVANFAKLGFHAGFGLSVTLPELIGRQKATDMMLTARRVGGDEAYRIGLADRLAEPGRVRDAARALATEIAGAAPLAVRSMRATLRGDLADRVRRALDHELAEQKIHWATKDSAEGITASLARRAPVFTGE

SEQ ID NO: 13726 - protein, 423 aa, Actinoplanes utahensis
MAGLLALVGVAVEPDRTARLAAVAVCDLVVAVPAALMPWGRLPRHAPALLGLPAFAVLGFATWSFGGVASGTGPFLVLIFAWAALHFPRWILLAFLAPATIAYLLPLILTGQPPFVTGSAAVLMPIALVVGLLIEAQARHLRDDRERLSRIERWRAAMVNTLAHDVRTPLSAVQIVLEELRAEATGTDAGMLDVALRQTARLTRLADGLLDVQRIDRTGHLTLDLRPHAAEELVRDALTYVRADEEIEVEISASATVCVDKQRFEQILLNLVANALRYGGPPVVIRFGRDGDTDRLEVRDHGPGIPDALRDTPVRTVRGQRAGRRRPRPVDRPPAGPGTRRPDHRRGPRPGRGDAGPLPHRPLTAPPGATLISLFRPSNRSSRRRRGGRRHSPVKTGARRARLAVMPSALSFVAQWIFCSASS

SEQ ID NO: 13727 - protein, 312 aa, Actinoplanes utahensis
MKVLLPDSVELDVTLPDGVIGVTYTPTAPIPGEHADADVLVVWGNTAAQLADAARRLTRLRWVQTLSAGPDAVLQAGFAPGVPITAGLGLHDQTVAEHTLALLLAAARRLNLLVRAQIGHRWAGELGGLQPVREEHSFRTLRDAHVVVWGFGGIAATLAPLLTALGARVTGVARTAGDRHGYPVVTAADLPQVLPTADVLVSILPAAADTAGVLDAGVLALFPPHAWVVNVGRGSTLDEAALLDALRAGRIAGAALDVFVTEPLPPASGLWDEPNVIITPHAAGGRPLGAARLIEENLAAFRDGRPLRNRVA

SEQ ID NO: 13728 - protein, 255 aa, Actinoplanes utahensis
MGRCAAHRRRRPAPTGSSGPASRPRSGRPRRRRSRSRRTSAPSSSFLRAPPSPSPCAASRRPASIFAVMAKDLAAVGPRLRALRQKRNITLTRLAETTGISVSTLSRLESGARRPTLELLLPLAEAYQVTLDDLVDAPETGDPRVRQRPIERHGHTYVPLTRRPGGVQAFKQIIPATPDRCDPEQQTHEGYEWIYVLSGRIRLLLGPRDILLTPGEAAEFDTRVPHALLNPGPGPAEVLNLFGPQGERVHLRAHS

SEQ ID NO: 13729 - protein, 521 aa, Actinoplanes utahensis
MERTYDVIVIGGGAAGLSGAVTLARSNRSVLVVDGGEPRNAPSGHVHNLLGREGVAPTELYAAGRAEVEGYGGEVRTGTAERAERVDGGFVVTLAGGDRVVGRRLLVTTGLTDELPDIPGLAEHWGGDVAHCPYCHGWELRGKRIGVLVTGPLSLHGAQLWRQLTDDVVYLLNGSPAPAPEQAEQLAARRIPVVAEAVEAVQSDSGRISGVRLADGRVIGLEAIAVGPRLVARSAFLASLGLEAVPMELNGHVMGMRIAAEERTGATAVPGVWVAGNVTDLGATVAVAAAAGQTAGAMINLDLIAAETRDAVAEYRRRQQTMVEADAWEERYRGKAAIWSGQPNVQLVAEAAGLPAGRALDVGCGEGADAVWLAERGWQVTAVDISSVALIRAAGHAAAAGLADRITFRHADLRQEPPAEGSYDLVTAHYMHLPRPDRRELYGRLAAAVARGGTLLVVGHHPDDLAERPRPMHFPEMLFTARELAAELDPGRWEVLTTAKRPRAGQDGVIHDAVLVARRKH

SEQ ID NO: 13730 - protein, 1732 aa, Actinoplanes utahensis
MRPDEGNGQPGLGDDARAALAAWRDQLADTGAADRLIDLPRAGADLVEITGPGPEAVTGRLRAGRDWSFGPGGGDVLATDLPADTLHTLLRHLRRHAHQETLDHGEDTLHLATGLLHWTDRAGAGHASPILLTAVELVALGPGDVPRLRAATGDPVLNPALAARLREHRVELTADLGALRERITGRNGWRIVDTVVLARFDLAAEAVRQDLAEHEDLILAHPVVRALAAEDGDFAFPPATGEHLEGDEPPLLLDADADQRACVAAALAGHSFVIDGPPGTGKSQTVANMIGALTHAGKRVLFVAETASALDVVQHRLAAAGLGNYLLDLHGQRAGRKQVAAALAAALEAVPLPPPGMDETDRRTLAARREQLTSYAQAVNEPREPLGLSLHQVAGRHALLSGVPESPAPGLQPLALTETALDRVLAAAEQLSGAWRPATERSGFRWREVIEKEPLDGALHEAQVALEALTEATEAFGPLAAAFHVRLPVDAEELARLVAHAATRPAEVPDHWLTAVALRPIREAADTLARLTATAREAAEQARERTGLSAAQLAEQEVAELPEQPTLNPPAVGLASLTAATAKSLAGRFAADADELEHQQRTLDRVTGRLGLPDVVTFSDVELVTLVAELGARPDKPEPAWFSPGAQAGVHAAAGALRRHVEAVAEARNRARQYFTDAVLGEPVEELAERFATVHRGVRKLLAAHRWDRETVTALAEPGVSADDAVANLPLAVAWRRANEGLLAAERQNAALLGRYWQRLDTDFLAIGRALETVSEVLRVTPPEALDAVIAFVCHRGGDGELLRVVTEARDVFRHWRATPEVAQRPELGQRSVGAAVAWLRAQVGPLGVAAGVLEQLSKVTGRELDLGSAEEIVAARTSVVSASRAVTEALPGLRALLGDVDLGSVDRGLAWAAAARTLRSGADAALTAEQAAALRLDGENPDLSVFIEVWQEARQRIIDAFGPARQVRLGTALDRYETARDLLRDLREDDTGQREWFQYLAAREVLAEHGLDSAIDHCADHGVEVGKLRPVLERTVYRAWADAVIAEDERLQPLTSVERNELVEEFRRLDADLMPDAAGTIIEALNARRPAITPDGAPALIRAQEGRLPVRELLDRTWEAAVALKPCFVMPPAAVSRYLPADQRFDVVIIDEASRMTPGAAVACAYRGRSLIVIGDDCQLPPANGQPSVLVAANDCGAFTRLALTRHYRSRHETLISFANEAFYQGRLVTYPSAHPVGDDLGLALLPAVDAPVEAALVAERVAHHFTTRPTLSLGVVTLTPGHADAVADAVETVLGERPDLERFLGEDPLTGFFVKPADAVQGDERDVIILATGPDLAAAGGPVGARKLNVAITRARQRVEVVTSVSERRREEPADEGERRLADYLAPTAAPAAATTAISDIAEYVASLIEGWGFAVTRRAGAGHCRIDIGVRHSTLDAYALGVQCDGPEYAGTPARDRDRLREQVLHALGWHLHRVWSVAWYHDRAEEEARLRAAIENALAVPDVFAEPDLELVTRPAQPPEWALPYQHAQLEPLPPAARVNDQVVRTLLERTVETIAEVEGPVHIAVLTRRIREGWGINRITQPIRQAIEAAIASSTVGFDGTFITAAVAPIPAVRVPGDGVARKPEQVAESELQLALEYLVLDAGLVESDDLLAAAARLFGWPANKTGSARLAAMLDDLVAGGRLIAHRNGLIAAPENDLLDLPDPATLPHRPDAATVDLETEAAGRS

SEQ ID NO: 13731 - protein, 189 aa, Actinoplanes utahensis
MPAPQPPFRWKTWHKVTIGVVGATTLLGCGTAIVTLIPGRPERTVAAGATTLPVVTAATTAATASPSAPVPPGPASKAGPSPTALRTSPPVSYADCDAVIAAGAAPIRTGQPGFRKAFDTDGDGVGCEPADGVPATPSREPGPTDDGGLDPRFPNCAKARAAGYGPYHRGTDPEYDWYKDHDKDGVACD

SEQ ID NO: 13732 - protein, 143 aa, Actinoplanes utahensis
MSLTAEDRLEIHEVLALHGHLCDAGDYDRFDLVFTADLQVDVSALGYEPVRTGPASRPSLATYIEVARRRGPGSTLAMHVTNIIVRADGDGARAWSKGMTVGEDGRVASFTYADHLVRTGHGWRIRHRTVSPHREPGRGVPVR

SEQ ID NO: 13733 - protein, 246 aa, Actinoplanes utahensis
MGRRLPLASVALLGLAACGSPAAHTAVTPPSSSVVPVPPVIAAPTPPPAKPKISKAGLAYFFTVALSARYGTDAHAVVKWTHPTVTIGVHGGDAASRTCLNRVITDFNALSGTSDLALASGPADIEMHFAPVSRFRSLEPSYVAGNDGFFYMHWSGQNVITRATVLIRSTGISRTVRCHLIREELTGAMGLANSSGKYPDSVFYNRYSATPQKYSALDTEVIRLLYSDAVHPGDDQPTVTRAVTVG

SEQ ID NO: 13734 - protein, 403 aa, Actinoplanes utahensis
MEFWLDLNEEQTDLRDWVHGFAEQVIRPAAAEWDEREQTPWPVLQEAAKIGLYGFEFLINTWADNTGLSLPIANEELFWGDGGIGMAISGTSLAVAAIYGSGTPEQLVEWVPQCFGDADEPKVAAFCSTEPEAGSDVASMRTRAVYHEATDEWVITGQKAYATNGGIANVHVVTASVDPALGSKGQAAFVVPPGTAGLVGTKKLKKLGLRASHTADVFLDDVRIPGSCLLGGKEALDERLAKARSGVKRSGQAAMRTFELSRPAVGAQAIGIARGAYEYALEYAKNRVAFGRPIIENQAIAFALADMKMEIDAARLLVWRAAWMGRNDKPFTAGEGSMSKLKAGEVAVAVTEKAVQILGGAGYLREHPVERMFRDAKIYTIFEGTSEIQRLVISRAISGMQIR

SEQ ID NO: 13735 - protein, 512 aa, Actinoplanes utahensis
MDALFVGATMLRRGLLNPGNPIRIVQQFAALGRWGFGLAGELRQAAARSPRRIAVIDDQRTLTYAQLLNRAEKLARGLPVAPGERVGILCRNSARMIEALIGVTSVGADPVLMNTGLSAHQMVTVAKDQGLRALHFDDEFAPTVALVEGVEKISEERFEELIAGAPAGSGTVPPERPGRTIVLTSGTTGVPKGARRPTPGGFRPLCSVIDRIPLRAEDRVMIAAPLFHTWGYAGLQIALALRATVVLRRRFEPAAIVHDLVRHACTGMIAVPVMVQQLMELAEPPAKPGLRVVAISGSALPGGLATRFMDRYGDVLYNLYGSTEASWASIATPEDLRFAPDTAGRPPYGTKVAVLDEHGDPVPRGAVGRLFVGNEMLFEGYTNGAAKLMRDGLLATGDLGHVDATGRVYVDGREDDMIVSGGENVYPAEVEGLLADLPQVREVAVIGVPDDEYGQRLAAYLVLRDGETLDPEAVREHVRHHRARFSVPRDVTFLDALPRNATGKVVTRDLPR

SEQ ID NO: 13736 - protein, 152 aa, Actinoplanes utahensis
MLFAAGLIVWVLAAGPVTLSGHPWVFLVLGVLAGAISLVITHGHVVRRRRPVGVAAGSPGELAVQPRDELAVVPVDGRTGAAVAFGAAGLFLFSVFFGVLAFALGLTALRRGTPGRWGRTAATAAVLLGIADFIILITMVATQPHHGVLRWS

SEQ ID NO: 13737 - protein, 433 aa, Actinoplanes utahensis
MDSPIESMGDKYYGRGMLSSKTFGRRAVLAAAAGAGAAVVLAPSAEAAGAADGRNDTLLDWYDLTATTIGVVTGPQQVTNSRTWAIAWIAAWRAVSMVRGGADAELALAAAVHETLITTNPAATAALDAALAATLARLSVRHPDRVVAAGADAARAVLAERAGDGLDPASVNRPYPPPAAAPGVWQPTPPAFASPVQSGQGDGRPFLVRIVEPLQPGPPPDLDSDIFLRDLAESRAVGAVDSTVRTAEQTAVARFWSQSSLNGFTGALRTTLAPGGSHAGRRRPLRERVGLIALFHAATIDAQITTYQAKYRFLRWRPVTAIRTGSVDPDPDWTPLLATPAHPEYPSGHTTYAGAAQAVLDTLAGPPRAAFTLTSAVATDVTRTYRRWSELTRDNIDARVWEGVHFRNTDETGAAVGRRAALAGLARWHGRPI

SEQ ID NO: 13738 - protein, 127 aa, Actinoplanes utahensis
MRLSIVEDERELAESLRRGLTAEGYPVDVAHDGSTGLEFAMTHAYQVDPGPARRRGRAAAPVRRRRRAPTPQPARRPAHTVEVAPADGDTADRAHHFHPIAVSDPLRSAPDGYLLIARSVGVTVDHR

SEQ ID NO: 13739 - protein, 197 aa, Actinoplanes utahensis
MANRGRPRTFDPDTALRQALDVFWEHGYEGTSLSDLAQAMGIASASIHACFGTKENLFRQVMTRYGKIHGEPPRRALREHPDARTAIHEMLRATADQVTGPDTPHYCMLVLAAPTGAVENHAIREFLAAGRRGQRELIRARLADNVPAAVLDGMARYYATVVQGLSIQARDGATRDDLESVITCAMAAWDTLTGDPP

SEQ ID NO: 13740 - protein, 324 aa, Actinoplanes utahensis
MRALQQTSLTGPEGLRLIADAPIPSPGPGELLIKVSAAGINFVDCSYARGTFAGGPAVPYVAGIEAAGAVVALGPGVTGPPPGTLVVGVHTGGGAFAEFMLLPAAAAVPVPPGWAAEQALGLLVNWPTALAALKPLGGLTAGQTVLIHAAAGGTGQAAVRMAKHYGATVLATASPGKHDVVRELGADHVLDSRGTDLAAEVLRLTGGVDLVLESAGGATLEASLAAAKRVTGRVVVYGLAGGTATISNWDLVYRHQVHLIGLNIGILIQAAPQLFGEVMGELFTLIGAGVLAPGRPVLHDLADGPTVLAELEARSTVGKQALRL

SEQ ID NO: 13741 - protein, 87 aa, Actinoplanes utahensis
MTVSDHYVVIKGRRWRATDPAIPEEVAAELRKALMAARRDVGTALRAGEDPAPARARVHAAKVALGERGTPWWEQTLDERRQRWEQL

SEQ ID NO: 13742 - protein, 118 aa, Actinoplanes utahensis
MTVTDEVRRLLDGQQTVEITTIGRRSGTPRRIETWRYRAAGRYWLTGSPGSRDWYANLLAQPAFTLHLAGLDVPARGRPVTDARERARVFGDIVPGLGGGGSLESWIAGSPLVEIEFG

SEQ ID NO: 13743 - protein, 310 aa, Actinoplanes utahensis
MVAVVELTEGPGTSAAYAKAALGMLRRGGSALPDVELVHRGVSVDRAHLARYDRVCGLRLGDTLPATYPHVLAFPLAMRLMSDGDFPLPMIGLVHVSNRITVRAPIDAGARLDLRVRAVDLRDHPRGRQFDMVATASVDDEVVWEDVSTYLRITSAGGGARDTGTGTGTGRNAGGGSARGSGNAPLGGAATRFPKPDVSGSSGGAVWRLPTRVGTDYAAVSGDRNPIHTSRLGARLFGFSRQIAHGMWTKARCLAALEGRLPDAYTVEVSFRQPILLPSTVRFTATLTGDDWDFAVVSKRTHLTGTITGG

SEQ ID NO: 13744 - protein, 733 aa, Actinoplanes utahensis
MHQDVDAAVRAGREVSGEPRRRVLGGQVELQRPAARPVRHVGQRVAGAGHVQRDHLGAVAGQGRRDRCADASGRAGDQGEFAGQWLVPVGGGRGCGRADPDDLAGHVGGFPAEQEAQGGLDRLLAPGCHVDQLAGAAPAEFLADAAGQTLQAPLRGRLFRVRGGFRWRAQHDDPAARGQAAGVRVEVVEERPEPRRGGDAGRVEDQGGVFRPVRALGDHLHPGVLQQFADRVGESSAGRGAEQHRSGRHRVARAVPSQAGRVGQAETLDHGPAETGVGEVRVPVSHASTLPVSSFAVVDVVDRSVEDSVPTVRRVAVLGGNRIPFARSNSRYAAASNQDMLTAALDGLVARFGLAGERLGEVVAGAVLKHSRDFNLTREVVLGSRLDPHTPAYDIQQACGTGLEAAILVANKIALGQIDVGVAGGVDTTSDAPLQVNEDMRQALLELNRARTLGARLKAVAKLRPQHALQPEIPRNSEPRTGLSMGEHAAITAARWNVSREDQDALALTSHQRLAAAYDSRFFDDLMTPYLGLTRDQNLRADSSLEKLAKLKPVYGKENATMTAGNSTPLTDGASTVLLASQEWAAAHSLPVLAYFADCETAAVDYVHGDEGLLMAPAYAVPRMLARNGLTLQDFDYYEIHEAFASQVLSTLAAWESPEFCKAKLGLDAPLGSIDRAKLNVNGSSLAAGHPFAATGGRIVATLAKLLSRRGAGRGLISICAAGGQGVVAILER

SEQ ID NO: 13745 - protein, 150 aa, Actinoplanes utahensis
MSYQPPSVPQKPTAAFVGASWVALGLGIASFAVGLWNSHMTKSEVGFYAATLLLGLFGALSLQKSVRDRAEGVPVTNLYLGVAGIIVGLSIVMMTIGLWNSGLALSERGFYGLAFAMSLFAVVAVQKNVRDSAPPAATRPAVVSPYPDGR

SEQ ID NO: 13746 - protein, 189 aa, Actinoplanes utahensis
MTRRPLSLVALLLLAGCTTGRAHPAAAPAPAVCTGGQTVFAKAVTGKLLTGVTPVEKGLARDVVFTDPYDQINTRTAAVRTAATAPAEQIYRELAGRYGEDHPLAPYGEVYHPATGESFSMDRTGRFVAYEWLRTLDVPFHYTCGGTTTDGTVITWSAVLTDGILNCDEPAPAATTADDPEREARRLRC

SEQ ID NO: 13747 - protein, 115 aa, Actinoplanes utahensis
MRGHALAWHQQQPGGVSSLSGSALRSAMVNHITTVATHYLGRIYAWDVVNTAVYTMVKGFLARGVPIDCVGFPSHINSASPPEPAPASASRAPGRPLRARPPARRPDTGRSRGPS

SEQ ID NO: 13748 - protein, 222 aa, Actinoplanes utahensis
MQTGVQAAVPVLYVRSIESARRFYALFGYGESRAGGDGAARWSYLQCGEHTLLLAGVQPPLIQVELPLLIYLYVTDLAAVRDRLDEAGHEYEMAGYPEHAPGGELRTRDPDGNVVLVGQRTAIAADARVETTGPQARFSLIRQAAEAVSRRGGAPASCQIGAADGSACPKPAEVKLADTWGATVWGCLSHVDEALINARGTFIATEDGQGLGPWLSHRSRRP

SEQ ID NO: 13749 - protein, 86 aa, Actinoplanes utahensis
MSPSSELEVVLPAALHARPAGEVVRAAARFPAAVEIRHGARSASARSALKLMSLGVTAGATVTVHAEGEDAAAAAAAVAEALRLAT

SEQ ID NO: 13750 - protein, 127 aa, Actinoplanes utahensis
MGLVGIVLVSHSEQLASGLRDLLRQVAGDEVRIEPAAGTDDGDLGTSPDRLSAAIAAADTGAGVVILADLGSAVLTARAVLADTPGPLLVDAPFVEGAMAAAVTASTGAGPAAVAEAAREARDVAKF

SEQ ID NO: 13751 - protein, 330 aa, Actinoplanes utahensis
MKKFINDPADVVAEALRGLAAAHPELRVDTGEQYIARADAPRAGKVGLVSGGGSGHEPLHGGFVGPGMLDAACPGEVFTSPVPDQILAATKAVDGGAGVVHVVKNYTGDVMNFQLAAELATEEGISVETVLVDDDVAVEDSTWTAGRRGTGATLLVEKIAGARAEEGGKLGEVAAIGREVNAASGSFAYALTAGTTPAAGRPGFDLPADEIEAGVGIHGEPGRRREKLRPAKDLVHAALDAILDAKQFPGPVIVLVNGLGGTPLIELYLIYGEVAAVLEQRGVPIARKLVGNYVTSLDMAGMSLTLCQATDEMLRLWDAPVRTPGLRWGA

SEQ ID NO: 13752 - protein, 206 aa, Actinoplanes utahensis
MDATLARDWMRAAAAAVAAETDRLTRLDSAIGDGDHGVNLNRGFAAVVAALDAGAEDTPAAVLTRAGTTLMARVGGASGPLYGSALRAAGKALPDTAAVEATDLVAALHAGLEAVRRLGGAAPGDKTMIDAYAPALAVFERSVAGGADLAGASAEAAEAAAAGAAATVPLRARKGRASYLGERSIGHQDPGATSTSLIFQALAAVS

SEQ ID NO: 13753 - protein, 525 aa, Actinoplanes utahensis
MGVGGAFDNRSLRTKIVAAALTAAVGGLIVGGMSIMTVRGLNQKAADAQHKSIAIETAVSGFSRNLEAFVGSNSAMQLYPSQAAQIGAVAAQYKQAATDALTSLGAELPGDATVTRTQQDWDSFLQFLGSTAASDHPLSKAEIVAGLAQYGKLHDALGADGNALQARAAAVAETQIADARSAANSATWTIAGVLAAGVVLSMLIGFRVAARVRDAVRGVSRLAEGLAEGDLTRTSGVTTRDEVGQMAAALDSGIARLREDVVQLAGSATTLQHAATQLTSVSSAVDAAATEASSQAGTVSAAADNVSNNLQFVSSGAQEMGSAIRDISVSTSEATQVVVQAVQAAAATNAIVARLGESSAEIATVVKVITSIAEQTNLLALNATIEAARAGELGKGFAVVAGEVKDLAQETAKATEDISRRVQSIQTDTSGAVSAIEEISEIIERINGLQLTIASAVEEQTATTQEMNRTLAEAAGGAGNIAATITGVSEATRRTTDTVGETRRAADELTATAGQLQTVVSRFRY

SEQ ID NO: 13754 - protein, 219 aa, Actinoplanes utahensis
MYPPEPWHLRGQMYLSVFLIPLRDVPPLPGVLGAAARPLSFGGRAAIGAAWVDYQPGGVLHYRELLSAVLTHERGRPRVSITDIWVDSVASRDGGRNLWGIPKDLAGFTLDADDDLIDATATAPDGAPIAAALIRLKSRLPGRFPLGFTVAQALGGHVKRTPVRGRSGLRTSQAAWRPDPAGPLAYLAGHRPLLSLAITDFWLTFGRTAADRAATARPR

SEQ ID NO: 13755 - protein, 211 aa, Actinoplanes utahensis
MFRNLTAGAAVLASLVVGTPAQAAPQPTPGEMMIIDVVNANGSGCPDKSAKITVSPDNTAFTVTYSDYTAQVGPQASPLDFRKNCQLALDIKVPSGFTFAIASADYRGYASLARGAWAQEAANYYFQGHSQTTRIEHTFRGPVDDDWQRTDQVGIASLSYLPCGERRYLNINTDLRVNRGTSDAHRYTSFISMDSTDAAINTVYRVAWKKC

SEQ ID NO: 13756 - protein, 759 aa, Actinoplanes utahensis
MRHDRHARAEVRGNKGSVLAEPGVPCTMVAMPAAQQTSRPAPHVLEAVLERLTYVNEETGYTVARVATAKSGSDLLTVVGALLGAQPGESLRLSGWWSSHPQYGRQFEVVSYTTVLPATIQGIRRYLGSGLVKGIGPVFAERIVEHFGLDTLEIIETSPDRLIEVTGLGPKRTAKITAAWAEQKAIKEVMVFLQGVGVSTSIAVRIYKKYGDSSISVVRNSPYRLASDVWGIGFKTADTIAQAVGIPHDSPERVKAGLQYTLSQATDNGHCFLPVDQLTDEASRILEVPAGLIPRCLDELVEEEGVVREDDHVYLVPFHRAEISLAATLVRLLHDRSDRMPHFGDVDWAKALDWLHRRTGNTLAPEQEAAVKLALTHKVAVLTGGPGCGKSFTVRSIVELAAAKRARIQLVAPTGRAAKRLAELTGHPAATVHRLLKLQPGGDASFDRDNPLDADLLVVDESSMLDLILANKLVKAIPPGAHLLLVGDVDQLPSVGAGEVLRDLLAAEVIPRVRLTQIFRQAAESGVVTNAHRVNRGRPPLLDGMSDFFLFPCDDTEETAGLTVDVACQRIPRRFGLDPRRDVQILTPMHRGPAGAGALNTLLQQQLTPAREDLPERRAGGRVFRVGDKVTQIRNNYDKGVAGVFNGTVGVITGLSPEEQTLTVRTDEDELIEYDFDELDELAHAYAITIHRSQGSEYPAVVIPLTTSAWMMLQRNLLYTAITRAKRLVVLVGSRKALAAAVRTVGAGRRHTALAERLG

SEQ ID NO: 13757 - protein, 81 aa, Actinoplanes utahensis
MDVPPVPGFAKSPGRSPAPRLEESTRPAPAPPPPHHPTTPADTADPQPSPPASSCPGAAGLPLLGGRYGTAGAGRPGRLAS

SEQ ID NO: 13758 - protein, 215 aa, Actinoplanes utahensis
MQPTPRRALRLTAVLASACALTGCAAFASTTATVSPTVSPGPTSTFLQTPTVPTSSAPGLSNTGTNLPVVVASLVKYGQWLIANPDPSLVDRIAVPGCAAANDLIHETQSLVDQGAYVTTALPVVTGMQYPSPAASAGAASLGDQTMLDMQVSRPAEALTQRTTAKKTQIISYLPELRSTTVRVSLIRGADKKWRFCEVTTPLDGSRADSITVLL

SEQ ID NO: 13759 - protein, 89 aa, Actinoplanes utahensis
MLLGLVSLLLLIVQVLLIARAVLDWSVVLAGPAMPGSLRSRAYGAVFAATEPILAPIRRLIPPLRAGGMSIDLSFLIVFFVISLLRNFL

SEQ ID NO: 13760 - protein, 272 aa, Actinoplanes utahensis
MTRLHPPAGPGRLVHRVDAGRPPGRRARRRASQTRPPGAGRQLGDDRAGRRGRRPGGRGGVLRVVLPPGPDLHDDRAAPGARAALRRLRGPARRQGRGAAGRRPGPAAGGARPDHRHRAARQDPRPGDRLGGRRARVAAGGTYERLFYAATVLADVTPDTPAFTEEIFGPVAPVLRFRDAEEAVRLATATEYGLSLGIVTRDVMRGLALADRIPTGIVHINDQTVSDEANSPFGGVAASGTGSRFGGAAANIEAFTETRRVTVRDEPPAYPF

SEQ ID NO: 13761 - protein, 326 aa, Actinoplanes utahensis
MTHEIQITAPVDLCLPDGRLNPAAVGWSRKPLHRANLRGWGRNKRWEHWGVVTPAHILGVVASSLDYAGVHSLYLLDRVSGREIAVDATVPLARGAVLPDRSGSGRVTASGGGLSIEIAQDFDGTSVRARARDLEVDLTMPAVEDRDALGVVVAWSRTRFQYTVKDVGRPVHGRLVVKGVEHIVPAQGSHATLDHGRGRWPYSVTWNWAAGADADRAVSLGGKWTDGTGTTENAVFEEGRLHKIGADLRWEYDRTDWLKPWRITGDGVDATFEPFHERVAKTNLGVLAGETHQCFGRFSGWARASDGRKIDLDGLTGWAEEARNRW

SEQ ID NO: 13762 - protein, 198 aa, Actinoplanes utahensis
MNDFAEIPPTTLADVLGRGQVMDIGVRPLWTPVPRVAGPAFTVRCEPGDNLMLHAAIYRAEPGSVIVVESGDLDYALAGGNVCAVAHRRGVAAFVLDGLIRDLGEVREIGFPVFARGVIPIPGTKEKVGTHGETVRCGGVSVRAGDIVVADEEGIVVVPADRQAAVLTDSRARLAKEAAETLDDWERAHRAKIEKALG

SEQ ID NO: 13763 - protein, 196 aa, Actinoplanes utahensis
MLLPLPPGDFQAYLFDCDGTITDSMPVHFQAWQDALAEYECEFPQDLFYAWGGRPCADIVADLNARQGLSMPVAAVAERQESLFRAGLPSMRAVPGVLAHIEESYGRLPFGVVSGSTRPAVIDSLLALGLLDRFPVLVCAGDYTHPKPHPEPYLLGARRLGVDPARCLAFEDTELGVRAAQAAGMAVVRVPPPWER

SEQ ID NO: 13764 - protein, 151 aa, Actinoplanes utahensis
MQIASETGGWLRMRPVRYEFESEPDGPREDWLTVEVAAAGRDGHTWQTEVPCLLVAEAIELAGWLHDEAGTGELEFIEPNVAFRRRHGGPGVELLEVTFAQETLPPWLPGSGRGRVHRIRMEVTSDHLVQAAGDWAAEIAAFPPRADLADW

SEQ ID NO: 13765 - protein, 207 aa, Actinoplanes utahensis
MDFRRTFRSAAIAYAGLVADLPAGRLDEPGLGDWTLRELLGHTVSSALRQVPKVLAAPAPQVEVATAEGYFAYARSAPEELVAAAHAASAEDAKASGELLGDDPAGHVSTLIGRATEALSQVRDDDVITSAAGGMRVRDWIPTRTFELVVHGLDAAAATGVEFDLPVEVLAESLILATRTGLGIGAGVPLLRALTGREQLPPGFTIV

SEQ ID NO: 13766 - protein, 1114 aa, Actinoplanes utahensis
MSEIAEETIALVRRWLGEAATVPVGGSAAQLAGLLRDPKGLAFAVGFVDGVVRPEDRRVSARALNALAGDVPAFLPAHLKAAVKLGGALAPIMPGVVVPLARRALRQMVGHLIVDATDRRLGRAIRKIRKRGVRLNVNLLGEAVLGRGEASRRLSETERLLARPDVDYVSIKVSSTVAPHNPWAFDEAVDDITEKLLPLFTLAARTGKFVNLDMEEYKDLDLTVAVFTRLLDRPDLLGLSAGIVLQAYLPDALSAMMRLQVWSAARRERGGADIKVRLVKGANLPMERVEAAVHGWPVATCDSKQATDTNYKRVLRYALHPDRIRNVRVGVAGHNLFDVAYAWTLAGQRGVRDGIEFEMLLGMAEGQAEAVRRDVGGLLLYTPVVRPEQFDVAIAYLIRRLEEGASSDNFMSAVFELHHDSALFEREKQRFLASLADLDDTVPAAHRVADRYAAVPHSAPGHFENTPDTDPAVASNRTRMRSLLARVPSSRLGLDLRRIDSAAELDTTLEKAAAANWGGADRRAVLHRVGDALEAHRDLLLEVMAAEAGKTIDQADPEVSEAVDFAHYYAELSARQIDGATPVPARLTLVTPPWNFPVAIPAGSMLAALAAGSAVVLKPAGPAERCGAVLAGIVRDALAAAGADPDLVTLLQVDEAGLGRELVAHPLVDRVILTGAYETAELFRSFRADLPLLAETSGKNAIIVTPSADLDLAVKDVVSSAFGHAGQKCSAASLVVLVGSVARSARFRTQLLDAVSSLEVGPPTEPRTQVGPLVEPAAGKLLDGLTTLGAGESWLLAPRKLDESGQLWSPGIRDGVRRGSAYHRTEYFGPILGIMTADTLDEAIDLVNEVDYGLTSGLHSLDAGEVRTWLDRVQAGNLYVNRGITGAIVRRQPFGGWKKSAVGAGTKAGGPHYLTGLSGWAPAPATASTDIDNAAVRTLLTAAAAHLTADEVASVTRAARSDAAAWAASFGRAEDVSALGVERNVLRYLPTPVTVRLAAGAPLAGLVRVVAAAKLAGAPIQVSTAEATRLFPEATVEPDAAFAAGLAGVSRVRLIGGSAGDLATATGGRPDLAVWAGPVVEAGEVELLPFLREQAVSITAHRFGNPLPMAAEVL

SEQ ID NO: 13767 - protein, 318 aa, Actinoplanes utahensis
MRMLEIRRLILLRELAIRGTLAAVAEALNFTPSAVSQQLSQLERETGTVLLRKAGRRVRLTPQAEVLVASVDEVLDTLERAEARLQAAATRVTGAVRVAVFQSAALAFMPAALRLAAARFPDVRVEMVQREPEEALRETWARDFDMVIAEQYPAHAAPHHPGLDRRDLTTDAIRLALPAEAESLHPVDSLDTARHMPWVMEPRGAASRHFAEQLCRRAGFEPDVRYETADLQAHIRLVETGNAVALIPDLVWAGRTPSCRLLAPAGSPRRTIFTAQRLSGAESPAARAFRGLLEEVVLTSATGPAPGPGRSAPGTPQR

SEQ ID NO: 13768 - protein, 487 aa, Actinoplanes utahensis
MTMRQKCLAVAAAALALVTALSAPASAAPATCAAPTPSTTHPGYLVFDPACDVSGAPFTPLTDASGKAISKIYTGIRDGAAYRVEVPLRWNGKLVVYAHGYRGTGTVVYVDNPALRAHYLQTGYAWAASSYATNGYDVGQGVRDSYAMIDTFRAATGHRARSVIMSGASMGGQVTAVAIERFPHAFAAAMPYCGVLGDTRLYDYFLDANVTAAALARVKIDFPLTPAADYPAQWHAQVGRITAALGVKVGSAPALTPAGKIWSDVVERRTGGERPGFDSAFAYWNAAPSLAPLSDLPFLFGLYPGLTGGTGGIAPGNVTDNQFTFYRADDYPWPSFAELRLNADVLRVRHTATGDPGLSGIPRVEGRPTIPVLSLHDVGDLFVPFAMEQDYALRAARNGRAGLFVSRAIRGVGHCDFTEAELAQGFDDLTRWVRTGQRPAGDAILDRRQVAADSFGCRFTNGAHPTFIAAVCPAQSVPAPAPDPSRR

SEQ ID NO: 13769 - protein, 607 aa, Actinoplanes utahensis
MPMISRRTIFKASAAGLLATQLRALPAEAATGTGFVDGYRTNVIANLTTDTNAAVRILSGFQKVWATGAAWNTGTVLDEAFLRASMRYVTRVTAERTDAEAAKAFLVDRQHQSYSVIAGLGPLADLYRAGALAVTSITSAPATTPAGTISDSVPAGSPAGAATGAGSTSSALGKVATLVNTLRGNYSSGNPSKYAYQYPRPWRLTEQSRVADTGAVDEFGYPVYDSPVKVAPALLRQRSTSPADDAGYVSGHTNALFLAALAYAYAVPERFQELVTTAYDLADTRIVAGMHSPVDVIGGRILATALAAAILRDPANATIKAEARAQALAYFQEKTGTRDLFGYAHDPADRKANAAIVRHKHTYDLPAHGKRVPVTVPDGAEVLLETRLPYLDAAQRREVLRTTGLTSGHPILDGPEQWGRLNLFAAADGYGAFDQTVAVTLDAALGGFHAADAWRNDIAGRGGLVKLGSGTLTLSGDNDYRGGTTVAQGTLVAAAPTALGRGDVTVSGGVLVAGQVTVHGSYRQSGGVLAVVADPEGKPALTVSGDATVGGTLRIAVPPALRHDAPIPVLTAGCLRGRFASVVVDTPAFRADLVTHGDTIAVRLRAA

SEQ ID NO: 13770 - protein, 425 aa, Actinoplanes utahensis
MYKTALLAALLAVPAVIPAPAAAAGATGGTLKILSYNIAGLPDILSSADTDRATSTTAIGSRIAGYDLVNVQEDFNFHAYLYAADTHAYRTPTSGGAGIGSGLNTLSKYAYDTDDFERDRWTSCQYDSGDCLTPKGFTFQRVRLAEGVYVDVYNLHANAGTNAGDLASRAANLSQLTTFIGSHSPGNAVLVFGDTNTRYTRDGDTIADFVANNGLTDAWVTLERGGVAPAKGADPILCSDDSCEVVDKVLYRGSRFITLNATAYHNEHAAFLDAGGLMLSDHDPVSVNLNWSTNPAYQFSEQFGGPHGDYFDDVDTAGPLSSISLRAGSRVDRIGPHGGTGGTLKTLTLGDGEYVTSAQLCRGVYNSHTRIFSAKFTTNRGNTLAGGTTTADCVTRTAPTGWQIAGFHGRAGDEVDKLGLIYTRH

SEQ ID NO: 13771 - protein, 302 aa, Actinoplanes utahensis
MYQAAAPPRRRTWLRVFLTGLLLWLLTVVVTLVTGNPNLIPTLVLLGSFLVPVTFVLWAFSRRHSGEVTAELLFSTFITGGVLGVLAASLLETYLLHPSPGFFLGVGLIEEAAKLGALAFLTRRLRHKYAADGVVLGASVGFGFAAFESAGYAFTALFTERGLSLMQLVQTELLRGLLAPLGHGLWTAILGGVLFSASGRRHFAMTRRLLSSFFGVAVLHALWDSMHSIALLVTLVLTGTPYQYSLLQRGYEPQPTAAQTHLFTLLSWGGLILISLIALLWLRAVARRADQDGRSLWRIPVG

SEQ ID NO: 13772 - protein, 142 aa, Actinoplanes utahensis
MDDPGIAYGYGRHRGLLVDRSGVEEIVFGRVLLYLEKADTDLINALAARLSGVIIEEPVTPYAPEARALWALPVPVLTGVRVDDSWLGHEVVVDFDAATTAPPAPATAGLRLHAEVSSPAEARDAGHLADGWAPLRADDLAS

SEQ ID NO: 13773 - protein, 186 aa, Actinoplanes utahensis
MRYFDEPAGSPPAASFGRRGVRSPLPEDLDFLGTVIAASPLDDPLVVLPMVAVRAEISAFAALADPAWRLGLDVATPAAALAVADLVDDCHLLRISSGDLAQHTLVWDRSTRNDTLLPPDRLPTVITQLVEWSASVAATRSIPCQVSIDLRPTPQLHDQLRAAGVTEISCPPPLIRHWRHLLDRSV

SEQ ID NO: 13774 - protein, 234 aa, Actinoplanes utahensis
MTQEPMDPTVAFRELSRIKLGDTDLEGVLATVADLAKRSIPGAYEVSVTLIRDRGPHTAASTGPAADHIDKWQYEMGSGPCLDACRQSLTLLVGDVRTERRWPGWEERAADAGVNCALSVGLPIRERVAGALNIYAETPEAFDDDAVVLAETFAGYAAVALANAHLYDTTVTLAGHLQAAMAGRAVIEQAKGIIMGQRHCTADEAFTILSRASQESNRKLRDVAAELVDRAQRR

SEQ ID NO: 13775 - protein, 120 aa, Actinoplanes utahensis
MPVPSPADGEGCRVPVEPPLTVFFRHLTADSALLLVQGEVDAGTAGVLTTALNHAVGAYPLVTCDLSGVTFFGAEGAHAIALARARGHAQGHVLELAGAPAIARDVLLIAGLGTMLRISG

SEQ ID NO: 13776 - protein, 236 aa, Actinoplanes utahensis
MMAHDRPESAAAFTELGRIKLGETDLNGVLDRVADLARRTLPGAGQVSITLVRNRAAYTAAQTGESALRLDERQYAQDRGPSLEAAAGKTTVHVPDTATEPRWDGWGEHAAAAGIGSVLAVGLPIVENVSGALTIYGAAAGAFDEAAITLAQTFVRYAAVALANAHLYDTTATLAQHMQAAMAGRAVIEQAKGIIMGERRCTADEAFAILTRVSQDSNRKLRDVAAALVERTQQRG

SEQ ID NO: 13777 - protein, 174 aa, Actinoplanes utahensis
MVVPFCAAVARPAIRGVRSHRTRPQVPWRAADLEEDECPGGSGPMSVSRLNRALQTPSVTPVRPSARERHQNARDDAASLTDRDRELIYQATGQRIGDGPKNAGWINSLAAAIAADRAAGRLAPGQEVTAAYLKDLSRRYDQGGTGRNPVAGYLEPALRHLSRRDDGNRLDVTA

SEQ ID NO: 13778 - protein, 134 aa, Actinoplanes utahensis
MTTWTTTERIDLGPVRLEADLTLTEHATGVVLFAHGSGSSRHSPRNRAVARELHRRGFATLLADLLTTREDTRPQRFDIGLLADRLVGLVDWLRAQPATAPLPLGLFGASTGAAAALVAAAARPEAVRSIVLAS

SEQ ID NO: 13779 - protein, 166 aa, Actinoplanes utahensis
MDIVVVRKLGAPGRPEFGLGAVAEDGPPVFDPDNLRYAGLTEEAMDGTLAVEREELARRVRRYRGERPAPRVTGRVVVLVDDGLATGVTARAALRWVRGRAPVRLLLAVPVCAPEARDLVARQADGVVCLSAPPEFFAVGRWYHDFGQLTDEDVDAVLDRFHHTLK

SEQ ID NO: 13780 - protein, 240 aa, Actinoplanes utahensis
MDTAIEVHDLVVRRGPRTVLDRFSCAVARGSVTGLLGPSGSGKTTLMRTIVGVQVVAGGTVTVLGSPAGAPALRRRIGYLTQAPSVYADLTVRENARYFAALHRLGRDAADRALETVGLTAAAGQLVADLSGGQRSRASLACAIVSRPELLVLDEPTVGQDPVLRDELWAHLRRMAADGATVLVSSHVMDEANRCDRLLLIRDGTLIADDTPAAVKRSAGTDDLDQAFLTLIRAHERVSA

SEQ ID NO: 13781 - protein, 242 aa, Actinoplanes utahensis
MILLSTIRRILTQLRHDPRTLALIVVVPTLLITLIYFMYDGQPRAFDRIALTMLGIFPFIVMFLITSIAMLRERTSGTLERLFTTPVGKLDLLFGYGIAFGAAAAVQAAVAAGFAYWILGMDAAGGLGPVVLIAVANAVLGVALGLLCSAFARTEFQAVQFMPLVVAPQLLLCGLFVPRERMVGWLQGISDVLPMSYSVQALGEVGVHPEPTGTMWRDLIIVLGAIIVALGLGAATLRRRTR

SEQ ID NO: 13782 - protein, 210 aa, Actinoplanes utahensis
MARRTGRRPGNPDTRESILNAAREAFADKGYDGASIRVIAAGAGVDPALVHHYFGTKDKLFLAAMQAPMDPVALIEAATEGGPDEVGDRFVRLFLRIWDGPGGAAGVALLRSTVGSEWTTKLFREFVVTQILRRAVPRLGLDETEGRLRVTLAASQMVGIAMARYVIKVEPLASAPAEAIVAAVGPAVQRYLTGELPGVFASGEAVGPSA

SEQ ID NO: 13783 - protein, 405 aa, Actinoplanes utahensis
MPVWLMISLVVALAVLGAGAAWALRGRGPGGGDGTVWGRFGAGGGSGPETLAGARERIAELSAALAARDSELEQLQEDRAAQAQAAGLQQKQQQQTLRRRAKEAIDSTAAVIGGKLEDVVVQVGAARQAAAATHERVSHTNDAAEALVRRARSADEAATALNASLRQVAGIASVISGIASQTRLLALNATIEAVRAGAAGSGFAVVADEVKSLADTTADSTEQITSTIAALEADVAQMGETLSAIIHDVGDIEDAMRQLGGIADRQHDIVMRLHASVDATMAQIGDLSDVAERLERRRHDRLAIEGTVRLRLPSRPQPVTANMVDLSSEGLGCTLAADIPVQIGDVIRAELSFDGLGGAVDAKVMRRTPRDGQMEIGLQFQDLPTSVRNDIDTYLTKLGAAPGEE

SEQ ID NO: 13784 - protein, 70 aa, Actinoplanes utahensis
MTISIGTSTQSSAWETHAAWLRLRGDCQQLFDHVVAGANRRELEDDKVAVLESRDVIARLEPGSGVNILV

SEQ ID NO: 13785 - protein, 164 aa, Actinoplanes utahensis
MVAPVPVDLAEIVADITGARADAAVVAGKPEPRFTIGDLPPVQAEPVLVRQLVDNLVGNAIKYTAPGVVPVLQISADASDGMVTVRITDNGIGIPEGRHDAIFGNFHRAHAGDGYLGTGPGLAICKRIVERHGGEITATDDPGGGSTFRFTLPAATASALLSPV

SEQ ID NO: 13786 - protein, 67 aa, Actinoplanes utahensis
MTTGYRLSLARTALFALVYAAAVYAGRRTAMVADGVSLVWPAAGWRWSGSAPTAPRRPGDSTPCSWP

SEQ ID NO: 13787 - protein, 208 aa, Actinoplanes utahensis
MEIVELLASPVHRFEGRPADGPAPAPEGESVGEIRIRAGLGIVGDRYFNHPAHRDASITVIARESLPAGAGLAQARRNILVAGLRLAGAPARSPAPDTGGSPAPEAADSPGPTAAGSPAVQAGGSPGGLTLDDLVGATLTLDSGDGPVHLSVRRRANPCAWMDVTIGPGAWKALRGRGGVRCVPLNDGILRVGPLSATIRFPDERNQH

SEQ ID NO: 13788 - protein, 250 aa, Actinoplanes utahensis
MRIGVIGAGQLGGTLATWCAESGHDVAVTSRHPDRLTDLVEHGDGHIRAMTIPEAAVFGEMLFFAPNWDSAREAIDIAHDAMAGKVVIDATNPSFMSAPTEGMMPGAPGPGGLGAFAPGFPSALEIPAFVRVPDNPGTSRELGFSTKSGFETLIDWAPEAHWAKAFNTISTEVLDRRRGHDPLLAEFVCTNQRDAREAACRIIQELGFAPFFAGGPEAARLTETGGPLQMREVDVYDAKDVLAEALAAIQ

SEQ ID NO: 13789 - protein, 489 aa, Actinoplanes utahensis
MCLAQARPPPGDRRAAGGGGERPGDEPALVTPEDGEGGEGAAQGRRVRAGAVEPGFGVAAELAGQSVQQRDDNGQLGVEVEVETGSGDPRPGGQLVDGDLGERLAGEQVAGGVQDRLLAQVTLARAAAAGGHVNHDNALSSIFDVVSIPSFPTSQERSMQEIRLASRPTGWPTADNFELVELPTPEPGPGQILVRNQFMSVDPYMRGRMNDVKSYVPPFQIGAALDGGAIGEVVASNAAEVPVGATVVHGLGWRDYAVLDAGHARVVDPNAAPTLSAYLGLLGMTGLTAYVGLLDIAQFREGDVVFVSGAAGAVGSVVGQIAKLRGAKRVIGSAGSADKVRHLVDDLGFDAAFNYKDAPVRDQLRAAAPDGIDVYFDNVGGDHLEAAIGSLNKFGRVALCGAIAQYNDTAPPAAPRNLALAIGKELTLRGFIVGNHGNRMKDFVAEVGGWLRSGQISAQETVVDGLANAPEAFLGLMRGENTGKMVIKI

SEQ ID NO: 13790 - protein, 767 aa, Actinoplanes utahensis
MANRFQLWGQAGWASAEVVGETHYAKSIRALFGPDFNPQGTDITVPVQLIPDRSNRHDRNAVGVWSDNALLGHLPRPEAARYVGVLTALTKRKLVPEVTAQIHGREWGEYEGRPPAFVATIRLDLGEPHMLVPANDPPVHEHRLLPTGSALQVNGQEQHVEALAAFQRPEGECWAYVTLHEMADHLVEVRLGDARVGDLSPKTSFELVPVLRYQAERGLVVAARAVVKSNAVKTEVMLYVARVQDLPETWVGPSARAGAVSGRVTPVSPAATPVVPATPGPDPVGPGGASTPGWVTGSDAVPSRATGSGDGAPAWATGSGASAPAWSSASGGSAPSWSSGAGGSTPAWTSGSGDAAPAWTSGTHEAAPAWTSGTGDAAPAWTSGTGDAAPAWTSGTGDAGQTWTPESGEVAATRASGSGDAVPTWASTPSDAQPTWMDRSELVPAWVQPSGTVPSWAASMSGPVPTIAGRPQAKDPVVPGVAAPPIPGVPTTPVPGVSVSGGPAYSTSPGAGSSADSVFGSSSRPVSGTSAGSASGLPGRPVSGVSAGSASGLSHRPVSGVSAGSASGLSHRPVSGASAGSASGLPSRSVSGVSGQGAGLSAGQVSSLTGGFPNSPAGRPNSSPDRDGSQPDFLNAPTGLTRSPGAGGPGTPPSGGTGPVSPAGPSAGARPTGMFGGAGEIAETTVIPALSAVVLSKHQAAGTAPVSSAPDLNRHAPIPPAPTGIKFAVPPGWPVPPDGWYPPEGWHPDASWPPAPAGWQWWVPTWE

SEQ ID NO: 13791 - protein, 62 aa, Actinoplanes utahensis
MLGRAGDLRVGQIVVGPTGLIVVAANRSPIRLQVRPARRAGASGAGGADVIASWPDPCGTSD
